United States Patent 7,745,391 (HUMAN THROMBOSPONDIN POLYPEPTIDE) - sequence listing, part 140

SEQ ID NO: 371179 - DNA, 3738 bp, Homo sapiens
ccgcctcgccccgtttccggcgcggcccagcgagctcggcaacctcggcgcagcgagcgcgggcggccagccagggccagggggcggtggcggccaaggtccgaccgggtgccagctgttcccagcccccgcctcgggcccgccgccggcgccgccatgggcaagaagcacaagaagcacaaggccgagtggcgctcgtcctacgaggattatgccgacaagcccctggagaagcctctaaagctagtcctgaaggtcggaggaagtgaagtgactgaactctcaggatccggccacgactccagttactatgatgacaggtcagaccatgagcgagagaggcacaaagaaaagaaaaagaagaagaagaagaagtccgagaaggagaagcatctggacgatgaggaaagaaggaagcgaaaggaagagaagaagcggaagcgagagagggagcactgtgacacggagggagaggctgacgactttgatcctgggaagaaggtggaggtggagccgcccccagatcggccagtccgagcgtgccggacacagccagccgaaaatgagagcacacctattcagcaactcctggaacacttcctccgccagcttcagagaaaagatccccatggattttttgcttttcctgtcacggatgcaattgctcctggatattcaatgataataaaacatcccatggattttggcaccatgaaagacaaaattgtagctaatgaatacaagtcagttacggaatttaaggcagatttcaagctgatgtgtgataatgcaatgacatacaataggccagataccgtgtactacaagttggcgaagaagatccttcacgcaggctttaagatgatgagcaaagagcggctgttagctttgaagcgcagcatgtcgtttatgcaggacatggatttttctcagcaggcagctcttttgggcaatgaagatacagctgttgaggaacctgtccctgaagttgtaccagtacaagtagaaactgccaagaaatccaaaaagccgagtagagaagttatcagctgcatgtttgagcctgaagggaatgcctgcagcttgacggacagtaccgcagaggagcacgtgctggcgctggtggagcacgcagctgacgaagctcgggacaggatcaaccggttcctcccaggcggcaaggtagtgctctgtggccaccgagagagggtgccacgtggccccagactctctgtgtgcctctccttctgggttggtgctgtgtgatctagcacagccaccgggatccagaggtcagcgtggggccctgacgggaggtccggatcagacacacataaggctggtctcttcagtcggggtccaggtgcctctggcagggctgccgctggtgtttcatgcatcgtggaggccacgtggtcactgacctcatttccttgatggaggccctgctgcaggctaatcctttctcttggagtgaatgctgacttctgtgtctctgtcactgggtgttgacgtgaggcaccgcccttgttattccagtgggggtgctggtgttggatccgacagatggtccataataggccaccgactgtgttcacgtggctcctgccacagatggtctttgtggtggtggggcccactcagctgaccacgctctcctttctggcaggagacgttctagacccagtgtcttcagtggaaacagagcacaggctgtctgcagtctcaggcttcctagcagccctgataagagaagtagagcaatgcaggtgacattaatccttgcaggtttcatttcacctctatatccaacattttatctcaacatgtagtctgtagaaaacgttaatttgagctttatgggtttttttcatattaagtcttcaaaatgcacatgggatgggatgtaaagaacgctgaagtgggggcatttcagaggtgtctgctgctttttgcctgtgcctgctgggaagttgcagtgctctgtgtggcttgcgtgttgcgaggttgcggtctgcgtggctcacgtgttgggaggtcgtggtctgcgtggctcacgtgttgggaagttgcagtggtctgtatggcttgcgtgttgggaggttgcagtctgtgtggcccgtgtgttgggaggttgtggtctgcgtggcttgtgtgttgggaggttgtggtttttgtggcttgcgtgttggggggttgtggtctgtgtggctcacgtgttgggaggttgtggtctgcgtggctcacgtgttgggcagttgtctgcttggctcacgtgttgggaagttgtggtctgcgtggctcatgtgttgggaagttgtttatgtggcttgtgtgctggaggttgtggcctgcgtggctcacgtgttgggcggttgtctgcttggctcatgtgttgggaagttgtggtctgcgtggcttgtgtgttgggaagttgtttatgtggcttgtgtgctggaggttgtggtctacgtggcttgcactgtagttcttttggacagccttgctctgcagtctgtgtttcagccctggaattgccacattctccaagaagccctggtttcttgactagagagccttgtgtagaagccaggacctgggttctgggtgaagccctctgcagatagagctgggagatgcctgttgtgtgtgtctgcaccacatacatggacactgtgcagagggattctgttggcacctgtgtttacatgggttgaaaactgtttttacacggaaacttccagttccctcgtgccccgtgggttccgcccacttcttccctttcagttttgtatctgcgccgtgaggacttgtctcctaatcttcgtatcaactccgtgtcccattgagctgaccttccgcctctcccccagggccctggccatcctgtgggctctgagactttgcatggatccgcggtggggagctgcccccacacaaacgtccggctcttctcaggccaggtggctgccctgacatggcatgatgtccagcgcatggacgtcacccttgcactggagcccagccaaccgctgcatgacagccctcttcccccttgaaccccaagtctgcacacaccagtgcctcctcttcctggatcctcctgatggcctgtacacagaactggggtgtgggtggtgggtttttaaatgaaaaccagtccacacatgcttgagggctggagccgcctgccgtcagggcagtgccatgctgacctgctgaccgttccattttgtcaaggctcatgagcaattttaaatgtttactcgtgggtgaaggtttttgtttcagctgtaccccctatagcagggccatggggagcctaagaggttctccttggcacctgtgcgcgctctgctgttgccggtgagtctgaaattccagggaatgccgtgaggggccctctggcgtttgttcttggacaaatgtgctttcacccccattaagccctgcttgttggtcttcatttcatttgtgctgcgctgcccctcctgagggacagacgctcaggcagtgcttccttccagatgggctatctgaagaggaacggggacgggagcctgctctacagcgtggtcaacacggccgagccggacgctgatgaggaggagacccacccggtggacttgagctcgcttcccctgttttctgtttaattgatgagcctgggaaaggagtgtgttctgcctgcccgttacagtggagcgttccgtgtccataaaacgttttctaactggg

SEQ ID NO: 371180 - DNA, 2435 bp, Homo sapiens
caagaacctctcagaaacttctctcattaactaaagtcagctctcccgctgggcccactgaagataatgacttgtctaggaaggcagttgcccaagcacctggtagaagatacacaggaaaaagaaaatcagcctgcaccccagcatcagatcattgtgaaccacttttgccaacttctagcctgtcgattgttaacaggtccaaggaagaagtcacctcacacaaatatcagcacgaaaaattatttattcaagtgaaagggaagaaaagtcgtcatcaaaaagaggattccctttcttggagtaatagtgcttatttatccttggatgatgatgctttcacggctccatttcatagggatggaatgctgagtttaaagcaactactgtcttttctcagtatcacagactttcagttacctgatgaagactttggacctcttaagcttgaaaaagtgaagtcctgctcagaaaaaccagtggagccctttgagtcaaaaatgtttggagagagacatcttaaagagggaagctgtatttttccagaggaactgagtcctaaacgcatggatacagaaatggaggacttagaagaggaccttattgttctaccaggaaaatcacatcccaaaaggccaaactcgcaaagccagcatacaaagacgggcctttcttcatccatattactttatactcctttaaatacggttgcgcctgatgataatgacaggcctaccacagacatgtgttcacctgctttccccatcttaggtactactccagcctttggccctcaaggctcctatgaaaaagcatctacagaagttgctggacgaacttgctgcacaccccaacttgctcatttgaaagactcagtctgtcttgccagtgatactaaacaattcgacagttcaggcagcccagcaaaaccacataccaccctgcaagtgtcaggcaggcaaggacaacctacctgtgactgtgactctgtcccgccaggaacacctccacccattgagtcattcacttttaaagaaaatcagctctgtagaaacacatgccaggagctgcataaacattccgtcgaacagactgaaacagcagagcttcctgcttctgatagcataaacccaggcaacctacaattggtttcagagttaaagaatccttcaggttcctgttccgtagatgtgagtgccatgttttgggaaagagccggttgtaaagagccatgtatcataactgcttgcgaagatgtagtttctctttggaaagctctggatgcttggcagtgggaaaaactttatacctggcacttcgcagaggttccagtattacagatagttccagtgcctgatgtgtataatctcgtgtgtgtagctttgggaaatttggaaatcagagagatcagggcattgttttgttcctctgatgatgaaagtgaaaagcaagtactactgaagtctggaaatataaaagctgtgcttggcctgacaaagaggaggctagttagtagcagtgggaccctttctgatcaacaagtagaagtcatgacgtttgcagaagatggaggaggcaaagaaaaccaatttttgatgccccctgaggagactatactaacttttgctgaggtccaagggatgcaagaagctctgcttggtactactattatgaacaacattgttatttggaatttaaaaactggtcaactcctgaaaaagatgcacattgatgattcttaccaagcttcagtctgtcacaaagcctattctgaaatggggcttctctttattgtcctgagtcatccctgtgccaaagagagtgagtcgttgcgaagccctgtgtttcagctcattgtgattaaccctaagacgactctcagcgtgggtgtgatgctgtactgtcttcctccagggcaggctggcaggttcctggaaggtgacgtgaaagatcactgtgcagcagcaatcttgacttctggaacaattgccatttgggacttacttctcggtcagtgtactgccctcctcccacctgtctctgaccaacattggtcttttgtgaaatggtcgggtacagactctcatttgctggctggacaaaaagatggaaatatatttgtataccactattcataagttagggtaaagtgaaaacacaattttctggatatattgggcctcttagtattttttggagttttaaatataaaggagaatatctgaatgacacttaaaatgattgcttgtttatgtccagacagacttattttttattctaatgatggtagcaccactgatcttggatgtacatttatgtatactttgagaaaaagggttttaggttgatttttgtaatttcccacatttgtacatgtgcttttaaaggtgtacataaagcttcaaatggcaataaatatttatttttatacattc

SEQ ID NO: 371181 - DNA, 1252 bp, Homo sapiens
ggtcagctgatcgcgcactgagggtgcgatcccgggctccccattccttcctggggcgcctccccggcccagggccaactgggtcccggtgtcggcaggcctggggtcggcgacggctgctcttttcgttctgtcgcctgcccgatggacgagcctcccgggaagcccctcagctgtgaggagaaggaaaaggtactagagatacctggaccattaacggataaatagaagattcatttgttgagtgactgaggatggcagttcctgctaccttcaaggatctggatgatggggagaaacagagaacatagtgtgagaatactgtgttaaaggagaaattagcattcttgaaaagggaatacagcaagacactagcccgccttcagcgtgcccaaagagctgaaaagattaagcattctattaagaaaacagtagaagaacaagattgtttgtctcagcaggatctctcaccgcagctaaaacactcagaacctaaaaataaaatatgtgtttatgacaagttacacatcaaaacccatcttgatgaagaaactggagaaaagacatctatcacacttgatgttgggcctgagtcctttaaccctggagatggcccaggaggattacctatacaaagaacagatgacacccaagaacattttccccacagggtcagtgaccctagtggtgagcaaaagcagaagctgccaagcagaagaaagaagcagcagaagaggacatttatttcacaggagagagactgtgtctttggcactgattcactcagattgtctgggaaaagactaaaggaacaggaagaaatcagtagcaaaaatcctgctagatcaccagtaactgaaataagaactcaccttttaagtcttaaatctgaacttccagattctccagaaccagttacagaaattaatgaagacagtgtattaattccaccaactgcccaaccagaaaaaggtgttgatacattcctaagaagacctaatttcaccagggcgactacagttcctttacagactctatcagatagcggtagtagtcagcaccttgaacacattcctcctaaaggtagcagtgaacttactactcacgacctaaaaaacattagatttacttcacctgtaagtttggaggcacaaggcaaaaaaatgactgtctctacagataacctccttgtaaataaagctataagtaaaagtggccaactgcccacaagttctaatttagaggcaaatat

SEQ ID NO: 371182 - DNA, 1699 bp, Homo sapiens
ggtcagctgatcgcgcactgagggtgcgatcccgggctccccattccttcctggggcgcctccccggcccagggccaactgggtcccggtgtcggcaggcctggggtcggcgacggctgctcttttcgttctgtcgcctgcccgatggacgagcctcccgggaagcccctcagctgtgaggagaaggaaaagttaaaggagaaattagcattcttgaaaagggaatacagcaagacactagcccgccttcagcgtgcccaaagagctgaaaagattaagcattctattaagaaaacagtagaagaacaagattgtttgtctcagcaggatctctcaccgcagctaaaacactcagactgaaacagcagagcttcctgcttctgatagcataaacccaggcaacctacaattggtttcagagttaaagaatccttcaggttcctgttccgtagatgtgagtgccatgttttgggaaagagccggttgtaaagagccatgtatcataactgcttgcgaagatgtagtttctctttggaaagctctggatgcttggcagtgggaaaaactttatacctggcacttcgcagaggttccagtattacagatagttccagtgcctgatgtgtataatctcgtgtgtgtagctttgggaaatttggaaatcagagagatcagggcattgttttgttcctctgatgatgaaagtgaaaagcaagtactactgaagtctggaaatataaaagctgtgcttggcctgacaaagaggaggctagttagtagcagtgggaccctttctgatcaacaagtagaagtcatgacgtttgcagaagatggaggaggcaaagaaaaccaatttttgatgccccctgaggagactatactaacttttgctgaggtccaagggatgcaagaagctctgcttggtactactattatgaacaacattgttatttggaatttaaaaactggtcaactcctgaaaaagatgcacattgatgattcttaccaagcttcagtctgtcacaaagcctattctgaaatggggcttctctttattgtcctgagtcatccctgtgccaaagagagtgagtcgttgcgaagccctgtgtttcagctcattgtgattaaccctaagacgactctcagcgtgggtgtgatgctgtactgtcttcctccagggcaggctggcaggttcctggaaggtgacgtgaaagatcactgtgcagcagcaatcttgacttctggaacaattgccatttgggacttacttctcggtcagtgtactgccctcctcccacctgtctctgaccaacattggtcttttgtgaaatggtcgggtacagactctcatttgctggctggacaaaaagatggaaatatatttgtataccactattcataagttagggtaaagtgaaaacacaattttctggatatattgggcctcttagtattttttggagttttaaatataaaggagaatatctgaatgacacttaaaatgattgcttgtttatgtccagacagacttattttttattctaatgatggtagcaccactgatcttggatgtacatttatgtatactttgagaaaaagggttttaggttgatttttgtaatttcccacatttgtacatgtgcttttaaaggtgtacataaagcttcaaatggcaataaatatttatttttatacattc

SEQ ID NO: 371183 - DNA, 1356 bp, Homo sapiens
ccataggtgatggtatctttttttggtcacccttattcatagagagtagtagggtcagggttttaaataggctattgtgggctggtctgagaaaccagccaccatgtacaagattgtttttatgggaaaacatgttctgaatgttcaaaaaccaatttacaaatgaatatttctaatttgagcactccctgcacatgtgtgtcctcattctctctttgccaatatttccccaaatgaatggcatgaaatgtagtactatctaaggggaaggaaatggatgaatcagattcatgcctggcaagactggctaaaacaaacactgggaaccggaagcaggagaagctaaagctagaagttggctgaacgcggtggctgacgtctgtaatcccaacactttgggaggctgaggtgggaggatcccttgaggccaggtgttcaacaacagcctgggtaacacaggaaggccttgtctctaaaaaaaaaaagaagaagaacaagaagccagaagtccagtccagtaataatctcaacagttcctagacggcagggaaaaaaatcaagccagtggttaaatcctggatacttcagagcctatcggtcattgctttaattgtttggtttttgtctctgccagatctttatttttcctgacatactcttgacagtctatttgggatatttatttttctccgaaattaggggcttctctttattgtcctgagtcatccctgtgccaaagagagtgagtcgttgcgaagccctgtgtttcagctcattgtgattaaccctaagacgactctcagcgtgggtgtgatgctgtactgtcttcctccagggcaggctggcaggttcctggaaggtgacgtgaaagatcactgtgcagcagcaatcttgacttctggaacaattgccatttgggacttacttctcggtcagtgtactgccctcctcccacctgtctctgaccaacattggtcttttgtgaaatggtcgggtacagactctcatttgctggctggacaaaaagatggaaatatatttgtataccactattcataagttagggtaaagtgaaaacacaattttctggatatattgggcctcttagtattttttggagttttaaatataaaggagaatatctgaatgacacttaaaatgattgcttgtttatgtccagacagacttattttttattctaatgatggtagcaccactgatcttggatgtacatttatgtatactttgagaaaaagggttttaggttgatttttgtaatttcccacatttgtacatgtgcttttaaaggtgtacataaagcttcaaatggcaataaatatttatttttatacattc

SEQ ID NO: 371184 - DNA, 2854 bp, Homo sapiens
caagaacctctcagaaacttctctcattaactaaagtcagctctcccgctgggcccactgaagataatgacttgtctaggaaggcagttgcccaagcacctggtagaagatacacaggaaaaagaaaatcagcctgcaccccagcatcagatcattgtgaaccacttttgccaacttctagcctgtcgattgttaacaggtccaaggaagaagtcacctcacacaaatatcagcacgaaaaattatttattcaagtgaaagggaagaaaagtcgtcatcaaaaagaggattccctttcttggagtaatagtgcttatttatccttggatgatgatgctttcacggctccatttcatagggatggaatgctgagtttaaagcaactactgtcttttctcagtatcacagactttcagttacctgatgaagactttggacctcttaagcttgaaaaagtgaagtcctgctcagaaaaaccagtggagccctttgagtcaaaaatgtttggagagagacatcttaaagagggaagctgtatttttccagaggaactgagtcctaaacgcatggatacagaaatggaggacttagaagaggaccttattgttctaccaggaaaatcacatcccaaaaggccaaactcgcaaagccagcatacaaagacgggcctttcttcatccatattactttatactcctttaaatacggttgcgcctgatgataatgacaggcctaccacagacatgtgttcacctgctttccccatcttaggtactactccagcctttggccctcaaggctcctatgaaaaagcatctacagaagttgctggacgaacttgctgcacaccccaacttgctcatttgaaagactcagtctgtcttgccagtgatactaaacaattcgacagttcaggcagcccagcaaaaccacataccaccctgcaagtgtcaggcaggcaaggacaacctacctgtgactgtgactctgtcccgccaggaacacctccacccattgagtcattcacttttaaagaaaatcagctctgtagaaacacatgccaggagctgcataaacattccgtcgaacagactgaaacagcagagcttcctgcttctgatagcataaacccaggcaacctacaattggtttcagagttaaagaatccttcaggttcctgttccgtagatgtgagtgccatgttttgggaaagagccggttgtaaagagccatgtatcataactgcttgcgaagatgtagtttctctttggaaagctctggatgcttggcagtgggaaaaactttatacctggcacttcgcagaggttccagtattacagatagttccagtgcctgatgtgtataatctcgtgtgtgtagctttgggaaatttggaaatcagagagatcagggcattgttttgttcctctgatgatgaaagtgaaaagcaagtactactgaagtctggaaatataaaagctgtgcttggcctgacaaagaggaggctagttagtagcagtgggaccctttctgatcaacaagtagaagtcatgacgtttgcagaagatggaggaggcaaagaaaaccaatttttgatgccccctgaggagactatactaacttttgctgaggtccaagggatgcaagaagctctgcttggtactactattatgaacaacattgttatttggaatttaaaaactggtcaactcctgaaaaagatgcacattgatgattcttaccaagcttcagtctgtcacaaagcctattctgaaatggggcttctctttattgtcctgagtcatccctgtgccaaagagagtgagtcgttgcgaagccctgtgtttcagctcattgtgattaaccctaagacgactctcagcgtgggtgtgatgctgtactgtcttcctccagggcaggctggcaggttcctggaaggtgacgtgaaagatcactgtgcagcagcaatcttgacttctggaacaattgccatttgggacttacttctcggtcagtgtactgccctcctcccacctgtctctgaccaacattggtcttttgtgaaatggtcgggtacagactctcatttgctggctggacaaaaagatggaaatatatttgtataccactattcataagttagggtaaagtgaaaacacaattttctggatatattgggcctcttagtattttttggagttttaaatataaaggagaatatctgaatgacacttaaaatgattgcttgtttatgtccagacagacttattttttattctaatgatggtagcaccactgatcttggatgtacatttatgtatactttgagaaaaagggttttaggttgatttttgtaatttcccacatttgtacatgtgcttttaaaggtgtacataaagcttcaaatggcaataaatatttatttttatacattcaaaaaaaaatatggctctatctggtctcagggaggggagctatggggaccgctatctattaggagggggtaattaattatccctccgtcactgaccaccgtgtcttccggacgtaccgcctgtagtgagccgtgtcccagataacctcataaggcggcaatcacgagttatctgcagatatcggtggattagcgacagacaagatcacgggagcgatgagggctctagatatcgctacgtatcaccttaaagcgcacgatccgatcacagcatctacatacgacctcatcgcactgaccagcatttctacactgagccttctactcctagtgtgaaagctcgacaggccttcattcattcatgtcgcgtccactcgataccactaatgcgcgcatctccagtaaactccatatccaatg

SEQ ID NO: 371185 - DNA, 704 bp, Homo sapiens
tgagaagataaaattactgggacttggtgattgactagattgagaggaaggagagaatatcaacatggtagggttggtcacttgagtggtgaccaagctcgaaatgtgggtattatccttgtctccttccccccagtctaggtggtcacttgagtggtgaccaaccctgaaacttggacattagatggtgatgcaattcattgagataggaatgcagaaagaaacaaaaggtttatagaaaaagttaacaagtttaattttgaatataatgaattcgaggtgcttgcagcatatctaggtagatattatgaaagtaatatatgttcattgtagaaagtttagtatacacgttttctgggttagatttttttttcctgatattaggttagtttatattatgcagttcaacaatgcggagaagggctacctagagactgctttagtgcaaagtactgacttttcatactgttttaattacagaggcaaagaaaaccaatttttgatgccccctgaggagactatactaacttttgctgaggtccaagggatgcaagaagctctgcttggtactactattatgaacaacattgttatttggtaagctttccctctaggtcctcagttccctcatctgtagtatgaggatatacctctaattttacagggttgttgtgaagattaaataagagagtatgtgtaaacat

SEQ ID NO: 371186 - DNA, 1118 bp, Homo sapiens
ggtcagctgatcgcgcactgagggtgcgatcccgggctccccattccttcctggggcgcctccccggcccagggccaactgggtcccggtgtcggcaggcctggggtcggcgacggctgctcttttcgttctgtcgcctgcccgatggacgagcctcccgggaagcccctcagctgtgaggagaaggaaaagttaaaggagaaattagcattcttgaaaagggaatacagcaagacactagcccgccttcagcgtgcccaaagagctgaaaagattaagcattctattaagaaaacagtagaagaacaagattgtttgtctcagcaggatctctcaccgcagctaaaacactcagaacctaaaaataaaatatgtgtttatgacaagttacacatcaaaacccatcttgatgaagaaactggagaaaagacatctatcacacttgatgttgggcctgagtcctttaaccctggagatggcccaggaggattacctatacaaagaacagatgacacccaagaacattttccccacagggtcagtgaccctagtggtgagcaaaagcagaagctgccaagcagaagaaagaagcagcagaagaggacatttatttcacaggagagagactgtgtctttggcactgattcactcagattgtctgggaaaagactaaaggaacaggaagaaatcagtagcaaaaatcctgctagatcaccagtaactgaaataagaactcaccttttaagtcttaaatctgaacttccagattctccagaaccagttacagaaattaatgaagacagtgtattaattccaccaactgcccaaccagaaaaaggtgttgatacattcctaagaagacctaatttcaccagggcgactacagttcctttacagactctatcagatagcggtagtagtcagcaccttgaacacattcctcctaaaggtagcagtgaacttactactcacgacctaaaaaacattagatttacttcacctgtaagtttggaggcacaaggcaaaaaaatgactgtctctacagataacctccttgtaaataaagctataagtaaaagtggccaactgcccacaagttctaatttagaggcaaatat

SEQ ID NO: 371187 - DNA, 2286 bp, Homo sapiens
caagaacctctcagaaacttctctcattaactaaagtcagctctcccgctgggcccactgaagataatgacttgtctaggaaggcagttgcccaagcacctggtagaagatacacaggaaaaagaaaatcagcctgcaccccagcatcagatcattgtgaaccacttttgccaacttctagcctgtcgattgttaacaggtccaaggaagaagtcacctcacacaaatatcagcacgaaaaattatttattcaagtgaaagggaagaaaagtcgtcatcaaaaagaggattccctttcttggagtaatagtgcttatttatccttggatgatgatgctttcacggctccatttcatagggatggaatgctgagtttaaagcaactactgtcttttctcagtatcacagactttcagttacctgatgaagactttggacctcttaagcttgaaaaagtgaagtcctgctcagaaaaaccagtggagccctttgagtcaaaaatgtttggagagagacatcttaaagagggaagctgtatttttccagaggaactgagtcctaaacgcatggatacagaaatggaggacttagaagaggaccttattgttctaccaggaaaatcacatcccaaaaggccaaactcgcaaagccagcatacaaagacgggcctttcttcatccatattactttatactcctttaaatacggttgcgcctgatgataatgacaggcctaccacagacatgtgttcacctgctttccccatcttaggtactactccagcctttggccctcaaggctcctatgaaaaagcatctacagaagttgctggacgaacttgctgcacaccccaacttgctcatttgaaagactcagtctgtcttgccagtgatactaaacaattcgacagttcaggcagcccagcaaaaccacataccaccctgcaagtgtcaggcaggcaaggacaacctacctgtgactgtgactctgtcccgccaggaacacctccacccattgagtcattcacttttaaagaaaatcagctctgtagaaacacatgccaggagctgcataaacattccgtcgaacagactgaaacagcagagcttcctgcttctgatagcataaacccaggcaacctacaattggtttcagagttaaagaatccttcaggttcctgttccgtagatgtgagtgccatgttttgggaaagagccggttgtaaagagccatgtatcataactgcttgcgaagatgtagtttctctttggaaagctctggatgcttggcagtgggaaaaactttatacctggcacttcgcagaggttccagtattacagatagttccagtgcctgatgtgtataatctcgtgtgtgtagctttgggaaatttggaaatcagagagatcagggcattgttttgttcctctgatgatgaaagtgaaaagcaagtactactgaagtctggaaatataaaagctgtgcttggcctgacaaagaggaggctagttagtagcagtgggaccctttctgatcaacaagtagaagtcatgacgtttgcagaagatggaggaggcaaagaaaaccaatttttgatgccccctgaggagactatactaacttttgctgaggtccaagggatgcaagaagctctgcttggtactactattatgaacaacattgttatttggaatttaaaaactggtcaactcctgaaaaagatgcacattgatgattcttaccaagcttcagtctgtcacaaagcctattctgaaatggttcctggaaggtgacgtgaaagatcactgtgcagcagcaatcttgacttctggaacaattgccatttgggacttacttctcggtcagtgtactgccctcctcccacctgtctctgaccaacattggtcttttgtgaaatggtcgggtacagactctcatttgctggctggacaaaaagatggaaatatatttgtataccactattcataagttagggtaaagtgaaaacacaattttctggatatattgggcctcttagtattttttggagttttaaatataaaggagaatatctgaatgacacttaaaatgattgcttgtttatgtccagacagacttattttttattctaatgatggtagcaccactgatcttggatgtacatttatgtatactttgagaaaaagggttttaggttgatttttgtaatttcccacatttgtacatgtgcttttaaaggtgtacataaagcttcaaatggcaataaatatttatttttatacattc

SEQ ID NO: 371188 - DNA, 657 bp, Homo sapiens
tgagttgaaaaaatgtgtaactctagttcattggttttgattgctataaggtattccatcagaggcatacacaacattttacttacaaattcctctagaaatgaaaacctaggttgcctgcaactcattgtcactgcaaataatacttcagtgatttttttaatacatggacttgtgtatggaatccagtttccaaggtatccccaagtgacccttgtcttctagtattcatgcccatgtataatccctttccacattgtgtcggggttaatctttgtgaccaacctaatatggcatagtgatagctttgtgaattcccagactaagtcataaaataacactgctgcttccgccttgttctcttggattacttgttctcggcaaaaccagccactatgttatgaggatgctttagcagcccagccctatggagcagccaatagctaccaccagcttaccagccctgtgcctgaggcatcttagaagtggatcctttagcccaagttaaacattcagatgaccggagccccagccaacatctcgactgaaacttcataagcaaccctgagccagaactatccagctaagccactcctgatttcttgacccacaaaaactatgagataataaatgtttattgttggtttaaaaaaatcc

SEQ ID NO: 371189 - DNA, 7571 bp, Homo sapiens
  misc_feature (4724)..(4724): n is a, c, g, or t
ggtctcgatctcctgaccttgtgatccacctcctcggcctcccaaagtgctgggattacaggcatgagccacggcacccagcctcatttgctgttaaactcatttattgagtcacctttttcttcctcacactttttagtcttagaatttttgtgtgtttttatttaccctaacctgtcaatttcatagtttccactttcttgttgaagtttccaaacttgacctcatgcctttgaatatactaattctattgctttgacacatttttttcccgaaaaaggtgtaaatgggtcaataaatggaagtaatacatcatctgtaattggtatcaacacatctgtactatccactactgcttcaagttccatgggacaaactaaaagtacaagctcaggtggaggaaatcgaaaatgtaatcaggaacaaagcaaaaaccagcctttggatgctagagttgacaaaatcaaagataagaaaccaaggaagaaagcaatggaaagttctagcaacagtgatagtgattcaggcacatcatcagacacctcaagtgaaggcattagtagcagtgattcagatgatctagaagaagatgaagaagaagaagatcaaagtattgaagaaagtgaagatgatgattctgattcagagagtgaagcacaacataaaagtaacaaccaggtgctattacatggtatttcagacccaaaagcagatggacagaaagcaactgaaaaagcccaggaaaaaagaatacaccagccattacctcttgcgtctgaatcccagactcactcattccaatcccagcagaagcagcctcaggttttgtcacagcagcttccatttattttccaaagctctcaggcaaaggaggaatctgtgaacaaacacaccagtgtaatacagtctacgggattggtgtccaatgtgaaacctttatctttggtaaatcaagccaaaaaggaaacttacatgaaactcatagttccttctcctgatgttcttaaagcagggaataaaaatacctctgaagaatctagtttattgaccagtgaattgagatccaaacgggaacaatataaacaggcattcccatcacagttaaagaaacaagagtcatcgaagagcctgaagaaggttattgcagctttgtcaaatccaaaagcaacctctagttcaccagcacatccaaaacaaacattagaaaacaaccacccaaatccattcttgacaaatgcacttttaggtaatcaccaaccaaatggagttattcaaagtgtcattcaagaagctcctctagcacttactaccaaaactaaaatgcagagcaagattaatgaaaacattgctgctgcaagtagcacccctttttcctcacctgtaaatctgagtacaagtgggagaagaacccctggcaatcagacacctgtaatgccctctgcctctcccatcctgcatagtcaagggaaggaaaaagcagttagcaataatgtaaacccagtaaaaacacagcatcactcccatcctgcaaaatctttagtggaacaattcagaggaacagattcagacattcccagtagtaaagattctgaagattcaaatgaggatgaagaggaagatgatgaagaagaagatgaggaagatgatgaagatgatgaatctgatgacagccaatcagaatcagatagtaattcagaatcagatacagaaggatcagaagaagaagatgatgatgataaagaccaagatgaatcagatagtgatactgaaggagagaaaacttcaatgaaactgaataaaacaacttcctctgtcaaaagcccttccatgagtctcacaggtcactcaacacctcgtaacctccacatagcaaaagccccaggctctgctcctgctgccttatgttctgaatcccagtcacctgcttttcttggtacatcttcttccacacttacttcaagcccacactctggcacttccaaaagaagaagagtaacagatgaacgtgaactgcgtattccattggaatatggctggcagagagagacaagaataagaaactttggagggcgccttcaaggagaagtagcatattatgctccatgtggaaagaaacttaggcagtaccctgaagtaataaagtatctcagcagaaatggaataatggatatctcaagggacaatttcagcttcagtgcaaaaataagagtgggtgacttctatgaagccagagatggaccgcagggaatgcagtggtgtcttttgaaagaagaggatgtcattcctcgtatcagggcaatggaaggtcgtagaggaagaccaccaaatccagatagacaacgagcaagagaggaatccaggatgagacgtcggaaaggtcgacctccaaatgttggcaatgctgaattcctagataacgcagatgcaaagttgctaagaaaactgcaagctcaagaaatagccaggcaagcagcacaaataaagcttttgagaaaacttcaaaagcaggaacaggctcgggttgctaaagaagccaaaaaacaacaagcaataatggctgctgaggagaagcggaagcaaaaagaacagataaagattatgaaacagcaggaaaaaattaagagaatacagcaaatcagaatggaaaaagaacttcgagctcagcaaattctagaggctaaaaagaaaaagaaggaagaagcggcaaatgccaaattattggaggccgagaaacgaataaaggaaaaagaaatgagaagacaacaagctgttcttctgaaacatcaggaacgagagcgaaggcgacaacacatgatgcttatgaaagctatggaagctcgtaaaaaagcagaagaaaaagagcggttgaaacaagaaaaacgtgatgagaaaagattaaataaagagcgtaaactagagcagcgaagattagaattagaaatggcaaaggaactaaagaagcctaatgaagacatgtgcttagcagaccaaaagcctttgccagagttgcctcgtattccaggacttgttctctctggaagtacattttcagactgtctcatggtggtgcagttcttacgaaactttggtaaagttttgggctttgatgtgaatattgatgttccaaacctgagtgttcttcaagagggattgctaaatataggggacagcatgggtgaagtacaagacttgcttgtgaggctcctctcagctgctgtatgtgatccaggtctaataacaggatacaaggctaaaacagctcttggagaacatttgctgaatgttggtgtgaatcgagacaatgtttccgagattttacagatatttatggaagcccactgtggacaaactgagcttactgaaagtctgaagaccaaagcttttcaggctcacactccagcacagaaagcttcagtcctggctttcctgatcaatgaactggcatgcagcaagagtgtggtcagtgaaatcgacaagaacattgattatatgtcaaacttgaggagagataaatgggtggtagaaggtaaactccgcaagctcagaatcattcatgctaagaaaacaggcaaaagagacacttcaggtggcattgatctgggagaagagcagcatcccttgggcacacccactccaggacgcaagcgaagaaggaagggaggagacagtgattatgacgatgatgatgacgatgacagtgatgaccaaggggatgaagatgatgaggatgaagaagataaagaagacaaaaaaggaaaaaagactgatatctgtgaagatgaggatgaaggtgaccaagcagcaagtgttgaagagctggaaaaacagattgaaaaactgagtaaacaacagagtcagtacagaaggaagctctttgatgcgtctcactcattgcgttcagtgatgtttggccaagatcgttacagacgccggtactggattcttccccaatgtggggggatttttgtagaaggcatggagagtggtgaaggactagaagaaattgcaaaagaaagagaaaaactgaaaaaggcagaaagtgtccagatcaaagaagaaatgtttgagacttctggggacagtttaaattgttcaaatacagatcactgtgaacaaaaggaagatcttaaagaaaaagataacacaaatctattccttcagaaacctggctctttttccaaattaagcaagcttttggaagtagctaagatgcctcctgagtcagaggttatgacccccaaaccaaatgctggtgcaaatgggtgcacgttgtcttatcagaacagtggaaaacattcactgggcagcgttcagtcaacagcaacgcaaagcaatgtggaaaaggcagactctaataatctgtttaatactggttcaagtggtccagggaagttctacagtcctctccccaatgaccagttactaaaaacgctgactgaaaagaatagacaatggtttagtcttttgccacgaacaccctgtgatgacacttcacttactcatgccgatatgtcaactgcttctttggtgactcctcagtctcagccaccatctaagtcaccttcacctaccccagctcctcttggatcttctgctcagaatcctgttggcttaaatccatttgctttatcacctcttcaggtgaaaggtggagtatctatgatgggacttcagttttgtggatggcccactggtgtggttacttctaatattccatttacatnatctgtacctagtctaggatcggggttagggttatcagaaggaaatggtaattcattcttgacttccaatgttgcttcaagtaaaagtgaatctccagtaccacagaatgaaaaggccacttcagctcaacctgcagctgttgaagtagcaaaaccagtagattttcctagtccaaaacctattccagaagaaatgcagtttggttggtggagaattattgacccagaggacctaaaagctttgctcaaagtgctgcatctcagaggaataagagaaaaggcattacaaaaacaaattcagaaacatttggattatattactcaagcctgcctcaagaataaggatgttgctattattgaactgaatgaaaatgaagaaaaccaagtaactcgagatattgtggagaactggtcagtagaagaacaagcaatggaaatggatttgagtgtccttcaacaggtagaagatctagaaaggagagttgcatcagcaagtttgcaagtgaagggttggatgtgtccagagcctgcatcagaaagggaggacttggtatattttgaacataaatcatttactaaattgtgcaaggagcatgatggagaatttactggcgaagacgaaagcagtgcacatgcactagaacggaagagtgacaaccccctagatatagctgtaaccaggctggctgatttggagcggaacattgaaagaagaattgaagaggatattgctccagggctcagggtatggagaagggcattatcagaagctcgcagtgctgcacaggtagctctgtgcattcagcaattacagaaatcaatagcatgggaaaaatcaattatgaaagtttactgccaaatctgtcgaaagggagataatgaagaactgcttcttctttgtgatggctgtgacaaaggctgtcatacctactgccatagacccaagattacaacaatcccagatggagactggttttgtccagcttgcattgctaaggcaagtggtcaaactctaaaaatcaaaaaacttcatgtcaaaggaaaaaagactaatgagtcaaagaaaggcaagaaggtaactttaacaggagatactgaagatgaagactctgcatctacaagtagttcactaaaaagaggaaacaaagacctcaagaaaagaaaaatggaggaaaacacttctattaacttgtcaaaacaagaaagttttacttcagttaagaaacctaaaagagatgactccaaggacctagctctttgcagtatgattctgactgaaatggaaactcatgaggatgcatggccttttctacttcctgtaaacttgaaacttgttcctggttataagaaagttattaagaagcctatggatttttccacaattagagagaaactaagtagtggacagtatccaaaccttgaaacctttgctctagatgtcaggcttgtttttgacaactgtgaaacatttaatgaagatgattctgatataggcagagctggccacaatatgaggaagtattttgaaaaaaagtggacagatactttcaaagtgagctgaagttataataatctctttatttttttccttctaaacaaggacaaatgagaccagcaatgtgaactgtatttacataaacgtgcaaggcacatacataatgactttctttttccttaagtataaaaaaaaagtatcagaagaatgataccatttttaaaggcttcattcctacaacaaccaaggccctcggttattggtttgtgtgatttatcagctaatttaggtagaacagggaagcacacccaaagaattttcaaaggaaagggtgttatagtgcaatagcaattaaaatatatcaaatcgcactgaatactcaacaccagagctctaatgtgggaaatggttctcctttccctctcaataaatatctatttttcatttttttactttgtagtttattttttagtgaatgtatttaattttatgaattatttatgattaaaccacatccagaatcttcgttttctgtgaaaaggaagaactagaaaattgctttaaatcttgaaaatacaaggaatgttttaaaatataaaacaaagccaagttaaactgtttacactgatgtgctataaaagcaccaaaaagaaactttactgtagagttacaagtacatttatatatatatgttgctgcatcacttgtgtagttaaattgtatttcaaaacagtgaaaaaattgacatgtatatactgttcattcttgtttatattaagtcttgttttaaatatgtattatgtgtatatattgtttgcagacattattgttcatgccttagaggattgtagcattttattttcgtctgaaggtaatgatagctatacagtctgtacagtaattatcctctaccaacactgtggcgtctccttaatcttggtagtgcctgcctttgaaacagggtgtaggggatattagttttccatttttctattttgttatataattttaagccaccagggcctaaattaaagtataatcatttgtatccatgtggaataaaattgtgacaatttcctacgcacacagtattttttcatagaaacatttccctcccatttgccttgcctcagaaataaatttaaaagacgtttgtaaccactgtgttttatctactgtgtgttgtggtggcctgttggaggcaaatagatcagattttttttgtacctacgtaagagtacttgaagttttatttaaaataaaatgttgtggaaaaggtagcattctttttttaggagtgttatttttcactatgtgtggcacggatacaataaaagacttttacaaactaa

SEQ ID NO: 371190 - DNA, 2345 bp, Homo sapiens
ttgtactaatttacactcatgagatatttttaatggttacattattttagtatacagattgtcataggttagaattaacttaaaatttgcatttctaaaagctatcttttaaaatgtattgaactggcttgagttggtttgaaatgaccattcccttcttactaataagcttatgcagattcattcacctttcttttctcttttctgtttttctacagagaaagagaattgggcttatcccgccagaaaagcacagaagccacagtgcttcttgttgaaagacagaccctcataatgttacctctagtagaaagatagcatatgcttgttttgcttgtttgggttcatcatactctattgcttgggcagaagagcacatatgaagagaagagaaatgggaaatggggaagacaacgcagagcaccatatcttggggtgtatatagaagctacaggacaagtgtaatttttatcattgcatggggagcattgacataatttctactgcagctgagcattttttaatatggataataggattctgcaagtgatacatttggtcagagaacttaataaactagtcaagtgggataggtcctgtgacagaattgtgtgatacaggtcaaacaggagttgggttatggggaaaatgccagttgaaatatgttttgatctttggagaaacctattttttcatttaacctgttctttaaatccagtatgttccagaacatacaaaaatgtttaaatgttccatttgtaagaggatatcatgtattttatatcaatttaaatgcagttatcctaatcatttttctttcatttttaccctttattaactcttcatttgtttacaaaacaaatccactctatgaacgcaatctctaattatgtgttttctttcaggtatccaaaccttgaaacctttgctctagatgtcaggcttgtttttgacaactgtgaaacatttaatgaagatgattctgatataggcagagctggccacaatatgaggaagtattttgaaaaaaagtggacagatactttcaaagtgagctgaagttataataatctctttatttttttccttctaaacaaggacaaatgagaccagcaatgtgaactgtatttacataaacgtgcaaggcacatacataatgactttctttttccttaagtataaaaaaaaagtatcagaagaatgataccatttttaaaggcttcattcctacaacaaccaaggccctcggttattggtttgtgtgatttatcagctaatttaggtagaacagggaagcacacccaaagaattttcaaaggaaagggtgttatagtgcaatagcaattaaaatatatcaaatcgcactgaatactcaacaccagagctctaatgtgggaaatggttctcctttccctctcaataaatatctatttttcatttttttactttgtagtttattttttagtgaatgtatttaattttatgaattatttatgattaaaccacatccagaatcttcgttttctgtgaaaaggaagaactagaaaattgctttaaatcttgaaaatacaaggaatgttttaaaatataaaacaaagccaagttaaactgtttacactgatgtgctataaaagcaccaaaaagaaactttactgtagagttacaagtacatttatatatatatgttgctgcatcacttgtgtagttaaattgtatttcaaaacagtgaaaaaattgacatgtatatactgttcattcttgtttatattaagtcttgttttaaatatgtattatgtgtatatattgtttgcagacattattgttcatgccttagaggattgtagcattttattttcgtctgaaggtaatgatagctatacagtctgtacagtaattatcctctaccaacactgtggcgtctccttaatcttggtagtgcctgcctttgaaacagggtgtaggggatattagttttccatttttctattttgttatataattttaagccaccagggcctaaattaaagtataatcatttgtatccatgtggaataaaattgtgacaatttcctacgcacacagtattttttcatagaaacatttccctcccatttgccttgcctcagaaataaatttaaaagacgtttgtaaccactgtgttttatctactgtgtgttgtggtggcctgttggaggcaaatagatcagattttttttgtacctacgtaagagtacttgaagttttatttaaaataaaatgttgtggaaaaggtagcattctttttttaggagtgttatttttcactatgtgtggcacggatacaataaaagacttttacaaactaa

SEQ ID NO: 371191 - DNA, 2272 bp, Homo sapiens
ttgtactaatttacactcatgagatatttttaatggttacattattttagtatacagattgtcataggttagaattaacttaaaatttgcatttctaaaagctatcttttaaaatgtattgaactggcttgagttggtttgaaatgaccattcccttcttactaataagcttatgcagattcattcacctttcttttctcttttctgtttttctacagagaaagagaattgggcttatcccgccagaaaagcacagaagccacagtgcttcttgttgaaagacagaccctcataatgttacctctagtagaaagatagcatatgcttgttttgcttgtttgggttcatcatactctattgcttgggcagaagagcacatatgaagagaagagaaatgggaaatggggaagacaacgcagagcaccatatcttggggtgtatatagaagctacaggacaagtgtaatttttatcattgcatggggagcattgacataatttctactgcagctgagcattttttaatatggataataggattctgcaagtgatacatttggtcagagaacttaataaactagtcaagtgggataggtcctgtgacagaattgtgtgatacaggtcaaacaggagttgggttatggggaaaatgccagttgaaatatgttttgatctttggagaaacctattttttcatttaacctgttctttaaatccagtatgttccagaacatacaaaaatgtttaaatgttccatttgtaagaggatatcatgtattttatatcaatttaaatgcagttatcctaatcatttttctttcatttttaccctttattaactcttcatttgtttacaaaacaaatccactctatgaacgcaatctctaattatgtgttttctttcaggtatccaaaccttgaaacctttgctctagatgtcaggcttgtttttgacaactgtgaaacatttaatgaagatgattctgatataggcagagctggccacaatatgaggaagtattttgaaaaaaagtggacagatactttcaaagtgagctgaagttataataatctctttatttttttccttctaaacaaggacaaatgagaccagcaatgtgaactgtatttacataaacgtgcaaggcacatacataatgactttctttttccttaagtataaaaaaaaagtatcagaagaatgataccatttttaaaggcttcattcctacaacaaccaaggccctcggttattggtttgtgtgatttatcagctaatttaggtagaacagggaagcacacccaaagaattttcaaaggaaagggtgttatagtgcaatagcaattaaaatatatcaaatcgcactgaatactcaacaccagagctctaatgtgggaaatggttctcctttccctctcaataaatatctatttttcatttttttactttgtagtttattttttagtgaatgtatttaattttatgaattatttatgattaaaccacatccagaatcttcgttttctgtgaaaaggaagaactagaaaattgctttaaatcttgaaaatacaaggaatgttttaaaatataaaacaaagccaagttaaactgtttacactgatgtgctataaaagcaccaaaaagaaactttactgtagagttacaagtacatttatatatatatgttgctgcatcacttgtgtagttaaattgtatttcaaaacagtgaaaaaattgacatgtatatactgttcattcttgtttatattaagtcttgttttaaatatgtattatgtgtatatattgtttgcagacattattgttcatgccttagaggattgtagcattttattttcgtctgaaggtaatgatagctatacagtctgtacagtaattatcctctaccaacactgtggcgtctccttaatcttggtagtgcctgcctttgaaacagggtgtaggggatattagttttccatttttctattttgttatataattttaagccaccagggcctaaattaaagtataatcatttgtatccatgtggaataaaattgtgacaatttcctacgcacacagtattttttcatagaaacatttccctcccatttgccttgcctcagaaataaatttaaaagacgtttgtaaccactgtgttttatctactgtgtgttgtggtggcctgttggaggcaaatagatcagattttttttgtacctacgtaagagtacttgaagttttatttaaaataaaatgttgtggaaaaggt

SEQ ID NO: 371192 - DNA, 652 bp, Homo sapiens
tttcaaaacagtatatacatgtcaattttttcacgttttgaaatacaatttaactacacaagtgatgcagcaacatatatatataaatgtacttgtaactctacagtgaaaaaattgacatgtatatactgttcattcttgtttatattaagtcttgttttaaatatgtattatgtgtatatattgtttgcagacattattgttcatgccttagaggattgtagcattttattttcgtctgaaggtaatgatagctatacagtctgtacagtaattatcctctaccaacactgtggcgtctccttaatcttggtagtgcctgcctttgaaacagggtgtaggggatattagttttccatttttctattttgttatataattttaagccaccagggcctaaattaaagtataatcatttgtatccatgtggaataaaattgtgacaatttcctacgcacacagtattttttcatagaaacatttccctcccatttgccttgcctcagaaataaatttaaaagacgtttgtaaccactgtgttttatctactgtgtgttgtggtggcctgttggaggcaaatagatcagattttttttgtacctacgtaagagtacttgaagttttatttaaaataaaatgttgtggaaaaggt

SEQ ID NO: 371193 - DNA, 896 bp, Homo sapiens
agaagaatcatctcctgcttcaatctgctgctggataggaactaatcagagagagagaagcggaagacggagaaggagggagtcgaaggctttcccgatcacaaatctcacctccactacaactctctttatacttttcttgcagaaataataatagaaataaggaggtggtggggtttccaaaaatcttaaccttcaaccatctggggaaaaggcaaaaatcccatctaccgcaactctcagttcgagagtaaaggtgagtttaaaatcctcgggcgtgaggggtgcgggtgaggatgtaaattcccagtgttacaaagccggtggaaacagcagcggagaaactgcgctcgggcaagcgggggactccggagttgctgcgtggaggcgctcgccccgccgccctctcgccctccgccgctgtttatcctcgccggtcggtgcggctctttgttgtggtggccggaaggctggggtggttctcggggtcccgagtggagtttgggggaggaggacacggagatgtgccgtcctgggtgggaggtggggggtgcggcctcaggagaacgtaaactttattcctagaagccggtgcgggacttcgctggagtagggccgtgggttgtgctcccggccgggcaggcgctgccgccgcgagtccgccgcctttgtgccggccgccctggcttcgcgtctccttcctcttccccttcggcttccagcgctcaggtcgccgccaacagttttgcttctgggaaggtctatgtcagcacgcagaaggtttgaggagcattgcttctcatacagtaaggtctgtgccttggtctcatgttttagcagttcttccccgggaacgaccgccagctcccaactcctctgcttccctcttttaatct

SEQ ID NO: 371194 - DNA, 7596 bp, Homo sapiens
  misc_feature (4822)..(4822): n is a, c, g, or t
tgagtttactgaagatgagcgggggtgggggtggggcaggtgggattgggaaaagatctggatacctgggaaggtctatgtcagcacgcagaaggtttgaggagcattgcttctcatacagtaaggtttcccaacagtgatgtcacaagattgaccacattgatcacaatatggagtctggagaacggttaccatcctcagcagcctcctctactacaccaacttcatcttcgacaccttctgtggcttcagtagtttcaaaaggtggcctttccactggagttgcttcacttagctctacaatcaacccatgtgcagaatggtggcgaacaactgatgctcatactcgtacaggagcaaccttctttccaccattactgggaattccaccactatttgctcccccagcccagaatcatgattcttcttcattccattcaaggacttcgggaaaaagtaatcgaaatggtcccgaaaaaggtgtaaatgggtcaataaatggaagtaatacatcatctgtaattggtatcaacacatctgtactatccactactgcttcaagttccatgggacaaactaaaagtacaagctcaggtggaggaaatcgaaaatgtaatcaggaacaaagcaaaaaccagcctttggatgctagagttgacaaaatcaaagataagaaaccaaggaagaaagcaatggaaagttctagcaacagtgatagtgattcaggcacatcatcagacacctcaagtgaaggcattagtagcagtgattcagatgatctagaagaagatgaagaagaagaagatcaaagtattgaagaaagtgaagatgatgattctgattcagagagtgaagcacaacataaaagtaacaaccaggtgctattacatggtatttcagacccaaaagcagatggacagaaagcaactgaaaaagcccaggaaaaaagaatacaccagccattacctcttgcgtctgaatcccagactcactcattccaatcccagcagaagcagcctcaggttttgtcacagcagcttccatttattttccaaagctctcaggcaaaggaggaatctgtgaacaaacacaccagtgtaatacagtctacgggattggtgtccaatgtgaaacctttatctttggtaaatcaagccaaaaaggaaacttacatgaaactcatagttccttctcctgatgttcttaaagcagggaataaaaatacctctgaagaatctagtttattgaccagtgaattgagatccaaacgggaacaatataaacaggcattcccatcacagttaaagaaacaagagtcatcgaagagcctgaagaaggttattgcagctttgtcaaatccaaaagcaacctctagttcaccagcacatccaaaacaaacattagaaaacaaccacccaaatccattcttgacaaatgcacttttaggtaatcaccaaccaaatggagttattcaaagtgtcattcaagaagctcctctagcacttactaccaaaactaaaatgcagagcaagattaatgaaaacattgctgctgcaagtagcacccctttttcctcacctgtaaatctgagtacaagtgggagaagaacccctggcaatcagacacctgtaatgccctctgcctctcccatcctgcatagtcaagggaaggaaaaagcagttagcaataatgtaaacccagtaaaaacacagcatcactcccatcctgcaaaatctttagtggaacaattcagaggaacagattcagacattcccagtagtaaagattctgaagattcaaatgaggatgaagaggaagatgatgaagaagaagatgaggaagatgatgaagatgatgaatctgatgacagccaatcagaatcagatagtaattcagaatcagatacagaaggatcagaagaagaagatgatgatgataaagaccaagatgaatcagatagtgatactgaaggagagaaaacttcaatgaaactgaataaaacaacttcctctgtcaaaagcccttccatgagtctcacaggtcactcaacacctcgtaacctccacatagcaaaagccccaggctctgctcctgctgccttatgttctgaatcccagtcacctgcttttcttggtacatcttcttccacacttacttcaagcccacactctggcacttccaaaagaagaagagtaacagatgaacgtgaactgcgtattccattggaatatggctggcagagagagacaagaataagaaactttggagggcgccttcaaggagaagtagcatattatgctccatgtggaaagaaacttaggcagtaccctgaagtaataaagggaatgcagtggtgtcttttgaaagaagaggatgtcattcctcgtatcagggcaatggaaggtcgtagaggaagaccaccaaatccagatagacaacgagcaagagaggaatccaggatgagacgtcggaaaggtcgacctccaaatgttggcaatgctgaattcctagataacgcagatgcaaagttgctaagaaaactgcaagctcaagaaatagccaggcaagcagcacaaataaagcttttgagaaaacttcaaaagcaggaacaggctcgggttgctaaagaagccaaaaaacaacaagcaataatggctgctgaggagaagcggaagcaaaaagaacagataaagattatgaaacagcaggaaaaaattaagagaatacagcaaatcagaatggaaaaagaacttcgagctcagcaaattctagaggctaaaaagaaaaagaaggaagaagcggcaaatgccaaattattggaggccgagaaacgaataaaggaaaaagaaatgagaagacaacaagctgttcttctgaaacatcaggaacgagagcgaaggcgacaacacatgatgcttatgaaagctatggaagctcgtaaaaaagcagaagaaaaagagcggttgaaacaagaaaaacgtgatgagaaaagattaaataaagagcgtaaactagagcagcgaagattagaattagaaatggcaaaggaactaaagaagcctaatgaagacatgtgcttagcagaccaaaagcctttgccagagttgcctcgtattccaggacttgttctctctggaagtacattttcagactgtctcatggtggtgcagttcttacgaaactttggtaaagttttgggctttgatgtgaatattgatgttccaaacctgagtgttcttcaagagggattgctaaatataggggacagcatgggtgaagtacaagacttgcttgtgaggctcctctcagctgctgtatgtgatccaggtctaataacaggatacaaggctaaaacagctcttggagaacatttgctgaatgttggtgtgaatcgagacaatgtttccgagattttacagatatttatggaagcccactgtggacaaactgagcttactgaaagtctgaagaccaaagcttttcaggctcacactccagcacagaaagcttcagtcctggctttcctgatcaatgaactggcatgcagcaagagtgtggtcagtgaaatcgacaagaacattgattatatgtcaaacttgaggagagataaatgggtggtagaaggtaaactccgcaagctcagaatcattcatgctaagaaaacaggcaaaagagacacttcaggtggcattgatctgggagaagagcagcatcccttgggcacacccactccaggacgcaagcgaagaaggaagggaggagacagtgattatgacgatgatgatgacgatgacagtgatgaccaaggggatgaagatgatgaggatgaagaagataaagaagacaaaaaaggaaaaaagactgatatctgtgaagatgaggatgaaggtgaccaagcagcaagtgttgaagagctggaaaaacagattgaaaaactgagtaaacaacagagtcagtacagaaggaagctctttgatgcgtctcactcattgcgttcagtgatgtttggccaagatcgttacagacgccggtactggattcttccccaatgtggggggatttttgtagaaggcatggagagtggtgaaggactagaagaaattgcaaaagaaagagaaaaactgaaaaaggcagaaagtgtccagatcaaagaagaaatgtttgagacttctggggacagtttaaattgttcaaatacagatcactgtgaacaaaaggaagatcttaaagaaaaagataacacaaatctattccttcagaaacctggctctttttccaaattaagcaagcttttggaagtagctaagatgcctcctgagtcagaggttatgacccccaaaccaaatgctggtgcaaatgggtgcacgttgtcttatcagaacagtggaaaacattcactgggcagcgttcagtcaacagcaacgcaaagcaatgtggaaaaggcagactctaataatctgtttaatactggttcaagtggtccagggaagttctacagtcctctccccaatgaccagttactaaaaacgctgactgaaaagaatagacaatggtttagtcttttgccacgaacaccctgtgatgacacttcacttactcatgccgatatgtcaactgcttctttggtgactcctcagtctcagccaccatctaagtcaccttcacctaccccagctcctcttggatcttctgctcagaatcctgttggcttaaatccatttgctttatcacctcttcaggtgaaaggtggagtatctatgatgggacttcagttttgtggatggcccactggtgtggttacttctaatattccatttacatnatctgtacctagtctaggatcggggttagggttatcagaaggaaatggtaattcattcttgacttccaatgttgcttcaagtaaaagtgaatctccagtaccacagaatgaaaaggccacttcagctcaacctgcagctgttgaagtagcaaaaccagtagattttcctagtccaaaacctattccagaagaaatgcagtttggttggtggagaattattgacccagaggacctaaaagctttgctcaaagtgctgcatctcagaggaataagagaaaaggcattacaaaaacaaattcagaaacatttggattatattactcaagcctgcctcaagaataaggatgttgctattattgaactgaatgaaaatgaagaaaaccaagtaactcgagatattgtggagaactggtcagtagaagaacaagcaatggaaatggatttgagtgtccttcaacaggtagaagatctagaaaggagagttgcatcagcaagtttgcaagtgaagggttggatgtgtccagagcctgcatcagaaagggaggacttggtatattttgaacataaatcatttactaaattgtgcaaggagcatgatggagaatttactggcgaagacgaaagcagtgcacatgcactagaacggaagagtgacaaccccctagatatagctgtaaccaggctggctgatttggagcggaacattgaaagaagaattgaagaggatattgctccagggctcagggtatggagaagggcattatcagaagctcgcagtgctgcacaggtagctctgtgcattcagcaattacagaaatcaatagcatgggaaaaatcaattatgaaagtttactgccaaatctgtcgaaagggagataatgaagaactgcttcttctttgtgatggctgtgacaaaggctgtcatacctactgccatagacccaagattacaacaatcccagatggagactggttttgtccagcttgcattgctaaggcaagtggtcaaactctaaaaatcaaaaaacttcatgtcaaaggaaaaaagactaatgagtcaaagaaaggcaagaaggtaactttaacaggagatactgaagatgaagactctgcatctacaagtagttcactaaaaagaggaaacaaagacctcaagaaaagaaaaatggaggaaaacacttctattaacttgtcaaaacaagaaagttttacttcagttaagaaacctaaaagagatgactccaaggacctagctctttgcagtatgattctgactgaaatggaaactcatgaggatgcatggccttttctacttcctgtaaacttgaaacttgttcctggttataagaaagttattaagaagcctatggatttttccacaattagagagaaactaagtagtggacagtatccaaaccttgaaacctttgctctagatgtcaggcttgtttttgacaactgtgaaacatttaatgaagatgattctgatataggcagagctggccacaatatgaggaagtattttgaaaaaaagtggacagatactttcaaagtgagctgaagttataataatctctttatttttttccttctaaacaaggacaaatgagaccagcaatgtgaactgtatttacataaacgtgcaaggcacatacataatgactttctttttccttaagtataaaaaaaaagtatcagaagaatgataccatttttaaaggcttcattcctacaacaaccaaggccctcggttattggtttgtgtgatttatcagctaatttaggtagaacagggaagcacacccaaagaattttcaaaggaaagggtgttatagtgcaatagcaattaaaatatatcaaatcgcactgaatactcaacaccagagctctaatgtgggaaatggttctcctttccctctcaataaatatctatttttcatttttttactttgtagtttattttttagtgaatgtatttaattttatgaattatttatgattaaaccacatccagaatcttcgttttctgtgaaaaggaagaactagaaaattgctttaaatcttgaaaatacaaggaatgttttaaaatataaaacaaagccaagttaaactgtttacactgatgtgctataaaagcaccaaaaagaaactttactgtagagttacaagtacatttatatatatatgttgctgcatcacttgtgtagttaaattgtatttcaaaacagtgaaaaaattgacatgtatatactgttcattcttgtttatattaagtcttgttttaaatatgtattatgtgtatatattgtttgcagacattattgttcatgccttagaggattgtagcattttattttcgtctgaaggtaatgatagctatacagtctgtacagtaattatcctctaccaacactgtggcgtctccttaatcttggtagtgcctgcctttgaaacagggtgtaggggatattagttttccatttttctattttgttatataattttaagccaccagggcctaaattaaagtataatcatttgtatccatgtggaataaaattgtgacaatttcctacgcacacagtattttttcatagaaacatttccctcccatttgccttgcctcagaaataaatttaaaagacgtttgtaaccactgtgttttatctactgtgtgttgtggtggcctgttggaggcaaatagatcagattttttttgtacctacgtaagagtacttgaagttttatttaaaataaaatgttgtggaaaaggt

SEQ ID NO: 371195 - DNA, 7727 bp, Homo sapiens
  misc_feature (4953)..(4953): n is a, c, g, or t
agaagaatcatctcctgcttcaatctgctgctggataggaactaatcagagagagagaagcggaagacggagaaggagggagtcgaaggctttcccgatcacaaatctcacctccactacaactctctttatacttttcttgcagaaataataatagaaataaggaggtggtggggtttccaaaaatcttaaccttcaaccatctggggaaaaggcaaaaatcccatctaccgcaactctcagttcgagagtaaaggtttcccaacagtgatgtcacaagattgaccacattgatcacaatatggagtctggagaacggttaccatcctcagcagcctcctctactacaccaacttcatcttcgacaccttctgtggcttcagtagtttcaaaaggtggcctttccactggagttgcttcacttagctctacaatcaacccatgtgcagaatggtggcgaacaactgatgctcatactcgtacaggagcaaccttctttccaccattactgggaattccaccactatttgctcccccagcccagaatcatgattcttcttcattccattcaaggacttcgggaaaaagtaatcgaaatggtcccgaaaaaggtgtaaatgggtcaataaatggaagtaatacatcatctgtaattggtatcaacacatctgtactatccactactgcttcaagttccatgggacaaactaaaagtacaagctcaggtggaggaaatcgaaaatgtaatcaggaacaaagcaaaaaccagcctttggatgctagagttgacaaaatcaaagataagaaaccaaggaagaaagcaatggaaagttctagcaacagtgatagtgattcaggcacatcatcagacacctcaagtgaaggcattagtagcagtgattcagatgatctagaagaagatgaagaagaagaagatcaaagtattgaagaaagtgaagatgatgattctgattcagagagtgaagcacaacataaaagtaacaaccaggtgctattacatggtatttcagacccaaaagcagatggacagaaagcaactgaaaaagcccaggaaaaaagaatacaccagccattacctcttgcgtctgaatcccagactcactcattccaatcccagcagaagcagcctcaggttttgtcacagcagcttccatttattttccaaagctctcaggcaaaggaggaatctgtgaacaaacacaccagtgtaatacagtctacgggattggtgtccaatgtgaaacctttatctttggtaaatcaagccaaaaaggaaacttacatgaaactcatagttccttctcctgatgttcttaaagcagggaataaaaatacctctgaagaatctagtttattgaccagtgaattgagatccaaacgggaacaatataaacaggcattcccatcacagttaaagaaacaagagtcatcgaagagcctgaagaaggttattgcagctttgtcaaatccaaaagcaacctctagttcaccagcacatccaaaacaaacattagaaaacaaccacccaaatccattcttgacaaatgcacttttaggtaatcaccaaccaaatggagttattcaaagtgtcattcaagaagctcctctagcacttactaccaaaactaaaatgcagagcaagattaatgaaaacattgctgctgcaagtagcacccctttttcctcacctgtaaatctgagtacaagtgggagaagaacccctggcaatcagacacctgtaatgccctctgcctctcccatcctgcatagtcaagggaaggaaaaagcagttagcaataatgtaaacccagtaaaaacacagcatcactcccatcctgcaaaatctttagtggaacaattcagaggaacagattcagacattcccagtagtaaagattctgaagattcaaatgaggatgaagaggaagatgatgaagaagaagatgaggaagatgatgaagatgatgaatctgatgacagccaatcagaatcagatagtaattcagaatcagatacagaaggatcagaagaagaagatgatgatgataaagaccaagatgaatcagatagtgatactgaaggagagaaaacttcaatgaaactgaataaaacaacttcctctgtcaaaagcccttccatgagtctcacaggtcactcaacacctcgtaacctccacatagcaaaagccccaggctctgctcctgctgccttatgttctgaatcccagtcacctgcttttcttggtacatcttcttccacacttacttcaagcccacactctggcacttccaaaagaagaagagtaacagatgaacgtgaactgcgtattccattggaatatggctggcagagagagacaagaataagaaactttggagggcgccttcaaggagaagtagcatattatgctccatgtggaaagaaacttaggcagtaccctgaagtaataaagggaatgcagtggtgtcttttgaaagaagaggatgtcattcctcgtatcagggcaatggaaggtcgtagaggaagaccaccaaatccagatagacaacgagcaagagaggaatccaggatgagacgtcggaaaggtcgacctccaaatgttggcaatgctgaattcctagataacgcagatgcaaagttgctaagaaaactgcaagctcaagaaatagccaggcaagcagcacaaataaagcttttgagaaaacttcaaaagcaggaacaggctcgggttgctaaagaagccaaaaaacaacaagcaataatggctgctgaggagaagcggaagcaaaaagaacagataaagattatgaaacagcaggaaaaaattaagagaatacagcaaatcagaatggaaaaagaacttcgagctcagcaaattctagaggctaaaaagaaaaagaaggaagaagcggcaaatgccaaattattggaggccgagaaacgaataaaggaaaaagaaatgagaagacaacaagctgttcttctgaaacatcaggaacgagagcgaaggcgacaacacatgatgcttatgaaagctatggaagctcgtaaaaaagcagaagaaaaagagcggttgaaacaagaaaaacgtgatgagaaaagattaaataaagagcgtaaactagagcagcgaagattagaattagaaatggcaaaggaactaaagaagcctaatgaagacatgtgcttagcagaccaaaagcctttgccagagttgcctcgtattccaggacttgttctctctggaagtacattttcagactgtctcatggtggtgcagttcttacgaaactttggtaaagttttgggctttgatgtgaatattgatgttccaaacctgagtgttcttcaagagggattgctaaatataggggacagcatgggtgaagtacaagacttgcttgtgaggctcctctcagctgctgtatgtgatccaggtctaataacaggatacaaggctaaaacagctcttggagaacatttgctgaatgttggtgtgaatcgagacaatgtttccgagattttacagatatttatggaagcccactgtggacaaactgagcttactgaaagtctgaagaccaaagcttttcaggctcacactccagcacagaaagcttcagtcctggctttcctgatcaatgaactggcatgcagcaagagtgtggtcagtgaaatcgacaagaacattgattatatgtcaaacttgaggagagataaatgggtggtagaaggtaaactccgcaagctcagaatcattcatgctaagaaaacaggcaaaagagacacttcaggtggcattgatctgggagaagagcagcatcccttgggcacacccactccaggacgcaagcgaagaaggaagggaggagacagtgattatgacgatgatgatgacgatgacagtgatgaccaaggggatgaagatgatgaggatgaagaagataaagaagacaaaaaaggaaaaaagactgatatctgtgaagatgaggatgaaggtgaccaagcagcaagtgttgaagagctggaaaaacagattgaaaaactgagtaaacaacagagtcagtacagaaggaagctctttgatgcgtctcactcattgcgttcagtgatgtttggccaagatcgttacagacgccggtactggattcttccccaatgtggggggatttttgtagaaggcatggagagtggtgaaggactagaagaaattgcaaaagaaagagaaaaactgaaaaaggcagaaagtgtccagatcaaagaagaaatgtttgagacttctggggacagtttaaattgttcaaatacagatcactgtgaacaaaaggaagatcttaaagaaaaagataacacaaatctattccttcagaaacctggctctttttccaaattaagcaagcttttggaagtagctaagatgcctcctgagtcagaggttatgacccccaaaccaaatgctggtgcaaatgggtgcacgttgtcttatcagaacagtggaaaacattcactgggcagcgttcagtcaacagcaacgcaaagcaatgtggaaaaggcagactctaataatctgtttaatactggttcaagtggtccagggaagttctacagtcctctccccaatgaccagttactaaaaacgctgactgaaaagaatagacaatggtttagtcttttgccacgaacaccctgtgatgacacttcacttactcatgccgatatgtcaactgcttctttggtgactcctcagtctcagccaccatctaagtcaccttcacctaccccagctcctcttggatcttctgctcagaatcctgttggcttaaatccatttgctttatcacctcttcaggtgaaaggtggagtatctatgatgggacttcagttttgtggatggcccactggtgtggttacttctaatattccatttacatnatctgtacctagtctaggatcggggttagggttatcagaaggaaatggtaattcattcttgacttccaatgttgcttcaagtaaaagtgaatctccagtaccacagaatgaaaaggccacttcagctcaacctgcagctgttgaagtagcaaaaccagtagattttcctagtccaaaacctattccagaagaaatgcagtttggttggtggagaattattgacccagaggacctaaaagctttgctcaaagtgctgcatctcagaggaataagagaaaaggcattacaaaaacaaattcagaaacatttggattatattactcaagcctgcctcaagaataaggatgttgctattattgaactgaatgaaaatgaagaaaaccaagtaactcgagatattgtggagaactggtcagtagaagaacaagcaatggaaatggatttgagtgtccttcaacaggtagaagatctagaaaggagagttgcatcagcaagtttgcaagtgaagggttggatgtgtccagagcctgcatcagaaagggaggacttggtatattttgaacataaatcatttactaaattgtgcaaggagcatgatggagaatttactggcgaagacgaaagcagtgcacatgcactagaacggaagagtgacaaccccctagatatagctgtaaccaggctggctgatttggagcggaacattgaaagaagaattgaagaggatattgctccagggctcagggtatggagaagggcattatcagaagctcgcagtgctgcacaggtagctctgtgcattcagcaattacagaaatcaatagcatgggaaaaatcaattatgaaagtttactgccaaatctgtcgaaagggagataatgaagaactgcttcttctttgtgatggctgtgacaaaggctgtcatacctactgccatagacccaagattacaacaatcccagatggagactggttttgtccagcttgcattgctaaggcaagtggtcaaactctaaaaatcaaaaaacttcatgtcaaaggaaaaaagactaatgagtcaaagaaaggcaagaaggtaactttaacaggagatactgaagatgaagactctgcatctacaagtagttcactaaaaagaggaaacaaagacctcaagaaaagaaaaatggaggaaaacacttctattaacttgtcaaaacaagaaagttttacttcagttaagaaacctaaaagagatgactccaaggacctagctctttgcagtatgattctgactgaaatggaaactcatgaggatgcatggccttttctacttcctgtaaacttgaaacttgttcctggttataagaaagttattaagaagcctatggatttttccacaattagagagaaactaagtagtggacagtatccaaaccttgaaacctttgctctagatgtcaggcttgtttttgacaactgtgaaacatttaatgaagatgattctgatataggcagagctggccacaatatgaggaagtattttgaaaaaaagtggacagatactttcaaagtgagctgaagttataataatctctttatttttttccttctaaacaaggacaaatgagaccagcaatgtgaactgtatttacataaacgtgcaaggcacatacataatgactttctttttccttaagtataaaaaaaaagtatcagaagaatgataccatttttaaaggcttcattcctacaacaaccaaggccctcggttattggtttgtgtgatttatcagctaatttaggtagaacagggaagcacacccaaagaattttcaaaggaaagggtgttatagtgcaatagcaattaaaatatatcaaatcgcactgaatactcaacaccagagctctaatgtgggaaatggttctcctttccctctcaataaatatctatttttcatttttttactttgtagtttattttttagtgaatgtatttaattttatgaattatttatgattaaaccacatccagaatcttcgttttctgtgaaaaggaagaactagaaaattgctttaaatcttgaaaatacaaggaatgttttaaaatataaaacaaagccaagttaaactgtttacactgatgtgctataaaagcaccaaaaagaaactttactgtagagttacaagtacatttatatatatatgttgctgcatcacttgtgtagttaaattgtatttcaaaacagtgaaaaaattgacatgtatatactgttcattcttgtttatattaagtcttgttttaaatatgtattatgtgtatatattgtttgcagacattattgttcatgccttagaggattgtagcattttattttcgtctgaaggtaatgatagctatacagtctgtacagtaattatcctctaccaacactgtggcgtctccttaatcttggtagtgcctgcctttgaaacagggtgtaggggatattagttttccatttttctattttgttatataattttaagccaccagggcctaaattaaagtataatcatttgtatccatgtggaataaaattgtgacaatttcctacgcacacagtattttttcatagaaacatttccctcccatttgccttgcctcagaaataaatttaaaagacgtttgtaaccactgtgttttatctactgtgtgttgtggtggcctgttggaggcaaatagatcagattttttttgtacctacgtaagagtacttgaagttttatttaaaataaaatgttgtggaaaaggt

SEQ ID NO: 371196 - DNA, 5706 bp, Homo sapiens
  misc_feature (2932)..(2932): n is a, c, g, or t
gcttcttttacttcccagaatcagatagtaattcagaatcagatacagaaggatcagaagaagaagatgatgatgataaagaccaagatgaatcagatagtgatactgaaggagagaaaacttcaatgaaactgaataaaacaacttcctctgtcaaaagcccttccatgagtctcacaggcacttccaaaagaagaagagtaacagatgaacgtgaactgcgtattccattggaatatggctggcagagagagacaagaataagaaactttggagggcgccttcaaggagaagtagcatattatgctccatgtggaaagaaacttaggcagtaccctgaagtaataaagtatctcagcagaaatggaataatggatatctcaagggacaatttcagcttcagtgcaaaaataagagtgggtgacttctatgaagccagagatggaccgcagggaatgcagtggtgtcttttgaaagaagaggatgtcattcctcgtatcagggcaatggaaggtcgtagaggaagaccaccaaatccagatagacaacgagcaagagaggaatccaggatgagacgtcggaaaggtcgacctccaaatgttggcaatgctgaattcctagataacgcagatgcaaagttgctaagaaaactgcaagctcaagaaatagccaggcaagcagcacaaataaagcttttgagaaaacttcaaaagcaggaacaggctcgggttgctaaagaagccaaaaaacaacaagcaataatggctgctgaggagaagcggaagcaaaaagaacagataaagattatgaaacagcaggaaaaaattaagagaatacagcaaatcagaatggaaaaagaacttcgagctcagcaaattctagaggctaaaaagaaaaagaaggaagaagcggcaaatgccaaattattggaggccgagaaacgaataaaggaaaaagaaatgagaagacaacaagctgttcttctgaaacatcaggaacgagagcgaaggcgacaacacatgatgcttatgaaagctatggaagctcgtaaaaaagcagaagaaaaagagcggttgaaacaagaaaaacgtgatgagaaaagattaaataaagagcgtaaactagagcagcgaagattagaattagaaatggcaaaggaactaaagaagcctaatgaagacatgtgcttagcagaccaaaagcctttgccagagttgcctcgtattccaggacttgttctctctggaagtacattttcagactgtctcatggtggtgcagttcttacgaaactttggtaaagttttgggctttgatgtgaatattgatgttccaaacctgagtgttcttcaagagggattgctaaatataggggacagcatgggtgaagtacaagacttgcttgtgaggctcctctcagctgctgtatgtgatccaggtctaataacaggatacaaggctaaaacagctcttggagaacatttgctgaatgttggtgtgaatcgagacaatgtttccgagattttacagatatttatggaagcccactgtggacaaactgagcttactgaaagtctgaagaccaaagcttttcaggctcacactccagcacagaaagcttcagtcctggctttcctgatcaatgaactggcatgcagcaagagtgtggtcagtgaaatcgacaagaacattgattatatgtcaaacttgaggagagataaatgggtggtagaaggtaaactccgcaagctcagaatcattcatgctaagaaaacaggcaaaagagacacttcaggtggcattgatctgggagaagagcagcatcccttgggcacacccactccaggacgcaagcgaagaaggaagggaggagacagtgattatgacgatgatgatgacgatgacagtgatgaccaaggggatgaagatgatgaggatgaagaagataaagaagacaaaaaaggaaaaaagactgatatctgtgaagatgaggatgaaggtgaccaagcagcaagtgttgaagagctggaaaaacagattgaaaaactgagtaaacaacagagtcagtacagaaggaagctctttgatgcgtctcactcattgcgttcagtgatgtttggccaagatcgttacagacgccggtactggattcttccccaatgtggggggatttttgtagaaggcatggagagtggtgaaggactagaagaaattgcaaaagaaagagaaaaactgaaaaaggcagaaagtgtccagatcaaagaagaaatgtttgagacttctggggacagtttaaattgttcaaatacagatcactgtgaacaaaaggaagatcttaaagaaaaagataacacaaatctattccttcagaaacctggctctttttccaaattaagcaagcttttggaagtagctaagatgcctcctgagtcagaggttatgacccccaaaccaaatgctggtgcaaatgggtgcacgttgtcttatcagaacagtggaaaacattcactgggcagcgttcagtcaacagcaacgcaaagcaatgtggaaaaggcagactctaataatctgtttaatactggttcaagtggtccagggaagttctacagtcctctccccaatgaccagttactaaaaacgctgactgaaaagaatagacaatggtttagtcttttgccacgaacaccctgtgatgacacttcacttactcatgccgatatgtcaactgcttctttggtgactcctcagtctcagccaccatctaagtcaccttcacctaccccagctcctcttggatcttctgctcagaatcctgttggcttaaatccatttgctttatcacctcttcaggtgaaaggtggagtatctatgatgggacttcagttttgtggatggcccactggtgtggttacttctaatattccatttacatnatctgtacctagtctaggatcggggttagggttatcagaaggaaatggtaattcattcttgacttccaatgttgcttcaagtaaaagtgaatctccagtaccacagaatgaaaaggccacttcagctcaacctgcagctgttgaagtagcaaaaccagtagattttcctagtccaaaacctattccagaagaaatgcagtttggttggtggagaattattgacccagaggacctaaaagctttgctcaaagtgctgcatctcagaggaataagagaaaaggcattacaaaaacaaattcagaaacatttggattatattactcaagcctgcctcaagaataaggatgttgctattattgaactgaatgaaaatgaagaaaaccaagtaactcgagatattgtggagaactggtcagtagaagaacaagcaatggaaatggatttgagtgtccttcaacaggtagaagatctagaaaggagagttgcatcagcaagtttgcaagtgaagggttggatgtgtccagagcctgcatcagaaagggaggacttggtatattttgaacataaatcatttactaaattgtgcaaggagcatgatggagaatttactggcgaagacgaaagcagtgcacatgcactagaacggaagagtgacaaccccctagatatagctgtaaccaggctggctgatttggagcggaacattgaaagaagaattgaagaggatattgctccagggctcagggtatggagaagggcattatcagaagctcgcagtgctgcacaggtagctctgtgcattcagcaattacagaaatcaatagcatgggaaaaatcaattatgaaagtttactgccaaatctgtcgaaagggagataatgaagaactgcttcttctttgtgatggctgtgacaaaggctgtcatacctactgccatagacccaagattacaacaatcccagatggagactggttttgtccagcttgcattgctaaggcaagtggtcaaactctaaaaatcaaaaaacttcatgtcaaaggaaaaaagactaatgagtcaaagaaaggcaagaaggtaactttaacaggagatactgaagatgaagactctgcatctacaagtagttcactaaaaagaggaaacaaagacctcaagaaaagaaaaatggaggaaaacacttctattaacttgtcaaaacaagaaagttttacttcagttaagaaacctaaaagagatgactccaaggacctagctctttgcagtatgattctgactgaaatggaaactcatgaggatgcatggccttttctacttcctgtaaacttgaaacttgttcctggttataagaaagttattaagaagcctatggatttttccacaattagagagaaactaagtagtggacagtatccaaaccttgaaacctttgctctagatgtcaggcttgtttttgacaactgtgaaacatttaatgaagatgattctgatataggcagagctggccacaatatgaggaagtattttgaaaaaaagtggacagatactttcaaagtgagctgaagttataataatctctttatttttttccttctaaacaaggacaaatgagaccagcaatgtgaactgtatttacataaacgtgcaaggcacatacataatgactttctttttccttaagtataaaaaaaaagtatcagaagaatgataccatttttaaaggcttcattcctacaacaaccaaggccctcggttattggtttgtgtgatttatcagctaatttaggtagaacagggaagcacacccaaagaattttcaaaggaaagggtgttatagtgcaatagcaattaaaatatatcaaatcgcactgaatactcaacaccagagctctaatgtgggaaatggttctcctttccctctcaataaatatctatttttcatttttttactttgtagtttattttttagtgaatgtatttaattttatgaattatttatgattaaaccacatccagaatcttcgttttctgtgaaaaggaagaactagaaaattgctttaaatcttgaaaatacaaggaatgttttaaaatataaaacaaagccaagttaaactgtttacactgatgtgctataaaagcaccaaaaagaaactttactgtagagttacaagtacatttatatatatatgttgctgcatcacttgtgtagttaaattgtatttcaaaacagtgaaaaaattgacatgtatatactgttcattcttgtttatattaagtcttgttttaaatatgtattatgtgtatatattgtttgcagacattattgttcatgccttagaggattgtagcattttattttcgtctgaaggtaatgatagctatacagtctgtacagtaattatcctctaccaacactgtggcgtctccttaatcttggtagtgcctgcctttgaaacagggtgtaggggatattagttttccatttttctattttgttatataattttaagccaccagggcctaaattaaagtataatcatttgtatccatgtggaataaaattgtgacaatttcctacgcacacagtattttttcatagaaacatttccctcccatttgccttgcctcagaaataaatttaaaagacgtttgtaaccactgtgttttatctactgtgtgttgtggtggcctgttggaggcaaatagatcagattttttttgtacctacgtaagagtacttgaagttttatttaaaataaaatgttgtggaaaaggt

SEQ ID NO: 371197 - DNA, 7824 bp, Homo sapiens
  misc_feature (4977)..(4977): n is a, c, g, or t
agaagaatcatctcctgcttcaatctgctgctggataggaactaatcagagagagagaagcggaagacggagaaggagggagtcgaaggctttcccgatcacaaatctcacctccactacaactctctttatacttttcttgcagaaataataatagaaataaggaggtggtggggtttccaaaaatcttaaccttcaaccatctggggaaaaggcaaaaatcccatctaccgcaactctcagttcgagagtaaaggtttcccaacagtgatgtcacaagattgaccacattgatcacaatatggagtctggagaacggttaccatcctcagcagcctcctctactacaccaacttcatcttcgacaccttctgtggcttcagtagtttcaaaaggtggcctttccactggagttgcttcacttagctctacaatcaacccatgtggacatttattcagaacagctggggatcaaccgtttaacctgtccacagtgtcgagtgccttcccaatggtcagccacccagtctttggtctacattcagccagctcagggcattcagaatttggtggtttggggacacttggtacacccacagccttagccgcacatccccaactagcatcttttccagcagaatggtggcgaacaactgatgctcatactcgtacaggagcaaccttctttccaccattactgggaattccaccactatttgctcccccagcccagaatcatgattcttcttcattccattcaaggacttcgggaaaaagtaatcgaaatggtcccgaaaaaggtgtaaatgggtcaataaatggaagtaatacatcatctgtaattggtatcaacacatctgtactatccactactgcttcaagttccatgggacaaactaaaagtacaagctcaggtggaggaaatcgaaaatgtaatcaggaacaaagcaaaaaccagcctttggatgctagagttgacaaaatcaaagataagaaaccaaggaagaaagcaatggaaagttctagcaacagtgatagtgattcaggcacatcatcagacacctcaagtgaaggcattagtagcagtgattcagatgatctagaagaagatgaagaagaagaagatcaaagtattgaagaaagtgaagatgatgattctgattcagagagtgaagcacaacataaaagtaacaaccaggtgctattacatggtatttcagacccaaaagcagatggacagaaagcaactgaaaaagcccaggaaaaaagaatacaccagccattacctcttgcgtctgaatcccagactcactcattccaatcccagcagaagcagcctcaggttttgtcacagcagcttccatttattttccaaagctctcaggcaaaggaggaatctgtgaacaaacacaccagtgtaatacagtctacgggattggtgtccaatgtgaaacctttatctttggtaaatcaagccaaaaaggaaacttacatgaaactcatagttccttctcctgatgttcttaaagcagggaataaaaatacctctgaagaatctagtttattgaccagtgaattgagatccaaacgggaacaatataaacaggcattcccatcacagttaaagaaacaagagtcatcgaagagcctgaagaaggttattgcagctttgtcaaatccaaaagcaacctctagttcaccagcacatccaaaacaaacattagaaaacaaccacccaaatccattcttgacaaatgcacttttaggtaatcaccaaccaaatggagttattcaaagtgtcattcaagaagctcctctagcacttactaccaaaactaaaatgcagagcaagattaatgaaaacattgctgctgcaagtagcacccctttttcctcacctgtaaatctgagtacaagtgggagaagaacccctggcaatcagacacctgtaatgccctctgcctctcccatcctgcatagtcaagggaaggaaaaagcagttagcaataatgtaaacccagtaaaaacacagcatcactcccatcctgcaaaatctttagtggaacaattcagaggaacagattcagacattcccagtagtaaagattctgaagattcaaatgaggatgaagaggaagatgatgaagaagaagatgaggaagatgatgaagatgatgaatctgatgacagccaatcaggcacttccaaaagaagaagagtaacagatgaacgtgaactgcgtattccattggaatatggctggcagagagagacaagaataagaaactttggagggcgccttcaaggagaagtagcatattatgctccatgtggaaagaaacttaggcagtaccctgaagtaataaagtatctcagcagaaatggaataatggatatctcaagggacaatttcagcttcagtgcaaaaataagagtgggtgacttctatgaagccagagatggaccgcagggaatgcagtggtgtcttttgaaagaagaggatgtcattcctcgtatcagggcaatggaaggtcgtagaggaagaccaccaaatccagatagacaacgagcaagagaggaatccaggatgagacgtcggaaaggtcgacctccaaatgttggcaatgctgaattcctagataacgcagatgcaaagttgctaagaaaactgcaagctcaagaaatagccaggcaagcagcacaaataaagcttttgagaaaacttcaaaagcaggaacaggctcgggttgctaaagaagccaaaaaacaacaagcaataatggctgctgaggagaagcggaagcaaaaagaacagataaagattatgaaacagcaggaaaaaattaagagaatacagcaaatcagaatggaaaaagaacttcgagctcagcaaattctagaggctaaaaagaaaaagaaggaagaagcggcaaatgccaaattattggaggccgagaaacgaataaaggaaaaagaaatgagaagacaacaagctgttcttctgaaacatcaggagttggagaggcatagactagatatggaacgagagcgaaggcgacaacacatgatgcttatgaaagctatggaagctcgtaaaaaagcagaagaaaaagagcggttgaaacaagaaaaacgtgatgagaaaagattaaataaagagcgtaaactagagcagcgaagattagaattagaaatggcaaaggaactaaagaagcctaatgaagacatgtgcttagcagaccaaaagcctttgccagagttgcctcgtattccaggacttgttctctctggaagtacattttcagactgtctcatggtggtgcagttcttacgaaactttggtaaagttttgggctttgatgtgaatattgatgttccaaacctgagtgttcttcaagagggattgctaaatataggggacagcatgggtgaagtacaagacttgcttgtgaggctcctctcagctgctgtatgtgatccaggtctaataacaggatacaaggctaaaacagctcttggagaacatttgctgaatgttggtgtgaatcgagacaatgtttccgagattttacagatatttatggaagcccactgtggacaaactgagcttactgaaagtctgaagaccaaagcttttcaggctcacactccagcacagaaagcttcagtcctggctttcctgatcaatgaactggcatgcagcaagagtgtggtcagtgaaatcgacaagaacattgattatatgtcaaacttgaggagagataaatgggtggtagaaggtaaactccgcaagctcagaatcattcatgctaagaaaacaggcaaaagagacacttcaggtggcattgatctgggagaagagcagcatcccttgggcacacccactccaggacgcaagcgaagaaggaagggaggagacagtgattatgacgatgatgatgacgatgacagtgatgaccaaggggatgaagatgatgaggatgaagaagataaagaagacaaaaaaggaaaaaagactgatatctgtgaagatgaggatgaaggtgaccaagcagcaagtgttgaagagctggaaaaacagattgaaaaactgagtaaacaacagagtcagtacagaaggaagctctttgatgcgtctcactcattgcgttcagtgatgtttggccaagatcgttacagacgccggtactggattcttccccaatgtggggggatttttgtagaaggcatggagagtggtgaaggactagaagaaattgcaaaagaaagagaaaaactgaaaaaggcagaaagtgtccagatcaaagaagaaatgtttgagacttctggggacagtttaaattgttcaaatacagatcactgtgaacaaaaggaagatcttaaagaaaaagataacacaaatctattccttcagaaacctggctctttttccaaattaagcaagcttttggaagtagctaagatgcctcctgagtcagaggttatgacccccaaaccaaatgctggtgcaaatgggtgcacgttgtcttatcagaacagtggaaaacattcactgggcagcgttcagtcaacagcaacgcaaagcaatgtggaaaaggcagactctaataatctgtttaatactggttcaagtggtccagggaagttctacagtcctctccccaatgaccagttactaaaaacgctgactgaaaagaatagacaatggtttagtcttttgccacgaacaccctgtgatgacacttcacttactcatgccgatatgtcaactgcttctttggtgactcctcagtctcagccaccatctaagtcaccttcacctaccccagctcctcttggatcttctgctcagaatcctgttggcttaaatccatttgctttatcacctcttcaggtgaaaggtggagtatctatgatgggacttcagttttgtggatggcccactggtgtggttacttctaatattccatttacatnatctgtacctagtctaggatcggggttagggttatcagaaggaaatggtaattcattcttgacttccaatgttgcttcaagtaaaagtgaatctccagtaccacagaatgaaaaggccacttcagctcaacctgcagctgttgaagtagcaaaaccagtagattttcctagtccaaaacctattccagaagaaatgcagtttggttggtggagaattattgacccagaggacctaaaagctttgctcaaagtgctgcatctcagaggaataagagaaaaggcattacaaaaacaaattcagaaacatttggattatattactcaagcctgcctcaagaataaggatgttgctattattgaactgaatgaaaatgaagaaaaccaagtaactcgagatattgtggagaactggtcagtagaagaacaagcaatggaaatggatttgagtgtccttcaacaggtagaagatctagaaaggagagttgcatcagcaagtttgcaagtgaagggttggatgtgtccagagcctgcatcagaaagggaggacttggtatattttgaacataaatcatttactaaattgtgcaaggagcatgatggagaatttactggcgaagacgaaagcagtgcacatgcactagaacggaagagtgacaaccccctagatatagctgtaaccaggctggctgatttggagcggaacattgaaagaagaattgaagaggatattgctccagggctcagggtatggagaagggcattatcagaagctcgcagtgctgcacaggtagctctgtgcattcagcaattacagaaatcaatagcatgggaaaaatcaattatgaaagtttactgccaaatctgtcgaaagggagataatgaagaactgcttcttctttgtgatggctgtgacaaaggctgtcatacctactgccatagacccaagattacaacaatcccagatggagactggttttgtccagcttgcattgctaaggcaagtggtcaaactctaaaaatcaaaaaacttcatgtcaaaggaaaaaagactaatgagtcaaagaaaggcaagaaggtaactttaacaggagatactgaagatgaagactctgcatctacaagtagttcactaaaaagaggaaacaaagacctcaagaaaagaaaaatggaggaaaacacttctattaacttgtcaaaacaagaaagttttacttcagttaagaaacctaaaagagatgactccaaggacctagctctttgcagtatgattctgactgaaatggaaactcatgaggatgcatggccttttctacttcctgtaaacttgaaacttgttcctggttataagaaagttattaagaagcctatggatttttccacaattagagagaaactaagtagtggacagtatccaaaccttgaaacctttgctctagatgtcaggcttgtttttgacaactgtgaaacatttaatgaagatgattctgatataggcagagctggccacaatatgaggaagtattttgaaaaaaagtggacagatactttcaaagtgagctgaagttataataatctctttatttttttccttctaaacaaggacaaatgagaccagcaatgtgaactgtatttacataaacgtgcaaggcacatacataatgactttctttttccttaagtataaaaaaaaagtatcagaagaatgataccatttttaaaggcttcattcctacaacaaccaaggccctcggttattggtttgtgtgatttatcagctaatttaggtagaacagggaagcacacccaaagaattttcaaaggaaagggtgttatagtgcaatagcaattaaaatatatcaaatcgcactgaatactcaacaccagagctctaatgtgggaaatggttctcctttccctctcaataaatatctatttttcatttttttactttgtagtttattttttagtgaatgtatttaattttatgaattatttatgattaaaccacatccagaatcttcgttttctgtgaaaaggaagaactagaaaattgctttaaatcttgaaaatacaaggaatgttttaaaatataaaacaaagccaagttaaactgtttacactgatgtgctataaaagcaccaaaaagaaactttactgtagagttacaagtacatttatatatatatgttgctgcatcacttgtgtagttaaattgtatttcaaaacagtgaaaaaattgacatgtatatactgttcattcttgtttatattaagtcttgttttaaatatgtattatgtgtatatattgtttgcagacattattgttcatgccttagaggattgtagcattttattttcgtctgaaggtaatgatagctatacagtctgtacagtaattatcctctaccaacactgtggcgtctccttaatcttggtagtgcctgcctttgaaacagggtgtaggggatattagttttccatttttctattttgttatataattttaagccaccagggcctaaattaaagtataatcatttgtatccatgtggaataaaattgtgacaatttcctacgcacacagtattttttcatagaaacatttccctcccatttgccttgcctcagaaataaatttaaaagacgtttgtaaccactgtgttttatctactgtgtgttgtggtggcctgttggaggcaaatagatcagattttttttgtacctacgtaagagtacttgaagttttatttaaaataaaatgttgtggaaaaggtagcattctttttttaggagtgttatttttcactatgtgtggcacggatacaataaaagacttttacaaactaa

SEQ ID NO: 371198 - DNA, 7848 bp, Homo sapiens
  misc_feature (4950)..(4950): n is a, c, g, or t
agaagaatcatctcctgcttcaatctgctgctggataggaactaatcagagagagagaagcggaagacggagaaggagggagtcgaaggctttcccgatcacaaatctcacctccactacaactctctttatacttttcttgcagaaataataatagaaataaggaggtggtggggtttccaaaaatcttaaccttcaaccatctggggaaaaggcaaaaatcccatctaccgcaactctcagttcgagagtaaaggtttcccaacagtgatgtcacaagattgaccacattgatcacaatatggagtctggagaacggttaccatcctcagcagcctcctctactacaccaacttcatcttcgacaccttctgtggcttcagtagtttcaaaaggtggcctttccactggagttgcttcacttagctctacaatcaacccatgtggacatttattcagaacagctggggatcaaccgtttaacctgtccacagtgtcgagtgccttcccaatggtcagccacccagtctttggtctacattcagccagctcagggcattcagaatttggtggtttggggacacttggtacacccacagccttagccgcacatccccaactagcatcttttccagcagaatggtggcgaacaactgatgctcatactcgtacaggagcaaccttctttccaccattactgggaattccaccactatttgctcccccagcccagaatcatgattcttcttcattccattcaaggacttcgggaaaaagtaatcgaaatggtcccgaaaaaggtgtaaatgggtcaataaatggaagtaatacatcatctgtaattggtatcaacacatctgtactatccactactgcttcaagttccatgggacaaactaaaagtacaagctcaggtggaggaaatcgaaaatgtaatcaggaacaaagcaaaaaccagcctttggatgctagagttgacaaaatcaaagataagaaaccaaggaagaaagcaatggaaagttctagcaacagtgatagtgattcaggcacatcatcagacacctcaagtgaaggcattagtagcagtgattcagatgatctagaagaagatgaagaagaagaagatcaaagtattgaagaaagtgaagatgatgattctgattcagagagtgaagcacaacataaaagtaacaaccaggtgctattacatggtatttcagacccaaaagcagatggacagaaagcaactgaaaaagcccaggaaaaaagaatacaccagccattacctcttgcgtctgaatcccagactcactcattccaatcccagcagaagcagcctcaggttttgtcacagcagcttccatttattttccaaagctctcaggcaaaggaggaatctgtgaacaaacacaccagtgtaatacagtctacgggattggtgtccaatgtgaaacctttatctttggtaaatcaagccaaaaaggaaacttacatgaaactcatagttccttctcctgatgttcttaaagcagggaataaaaatacctctgaagaatctagtttattgaccagtgaattgagatccaaacgggaacaatataaacaggcattcccatcacagttaaagaaacaagagtcatcgaagagcctgaagaaggttattgcagctttgtcaaatccaaaagcaacctctagttcaccagcacatccaaaacaaacattagaaaacaaccacccaaatccattcttgacaaatgcacttttaggtaatcaccaaccaaatggagttattcaaagtgtcattcaagaagctcctctagcacttactaccaaaactaaaatgcagagcaagattaatgaaaacattgctgctgcaagtagcacccctttttcctcacctgtaaatctgagtacaagtgggagaagaacccctggcaatcagacacctgtaatgccctctgcctctcccatcctgcatagtcaagggaaggaaaaagcagttagcaataatgtaaacccagtaaaaacacagcatcactcccatcctgcaaaatctttagtggaacaattcagaggaacagattcagacattcccagtagtaaagattctgaagattcaaatgaggatgaagaggaagatgatgaagaagaagatgaggaagatgatgaagatgatgaatctgatgacagccaatcaggcacttccaaaagaagaagagtaacagatgaacgtgaactgcgtattccattggaatatggctggcagagagagacaagaataagaaactttggagggcgccttcaaggagaagtagcatattatgctccatgtggaaagaaacttaggcagtaccctgaagtaataaagtatctcagcagaaatggaataatggatatctcaagggacaatttcagcttcagtgcaaaaataagagtgggtgacttctatgaagccagagatggaccgcagggaatgcagtggtgtcttttgaaagaagaggatgtcattcctcgtatcagggcaatggaaggtcgtagaggaagaccaccaaatccagatagacaacgagcaagagaggaatccaggatgagacgtcggaaaggtcgacctccaaatgttggcaatgctgaattcctagataacgcagatgcaaagttgctaagaaaactgcaagctcaagaaatagccaggcaagcagcacaaataaagcttttgagaaaacttcaaaagcaggaacaggctcgggttgctaaagaagccaaaaaacaacaagcaataatggctgctgaggagaagcggaagcaaaaagaacagataaagattatgaaacagcaggaaaaaattaagagaatacagcaaatcagaatggaaaaagaacttcgagctcagcaaattctagaggctaaaaagaaaaagaaggaagaagcggcaaatgccaaattattggaggccgagaaacgaataaaggaaaaagaaatgagaagacaacaagctgttcttctgaaacatcaggaacgagagcgaaggcgacaacacatgatgcttatgaaagctatggaagctcgtaaaaaagcagaagaaaaagagcggttgaaacaagaaaaacgtgatgagaaaagattaaataaagagcgtaaactagagcagcgaagattagaattagaaatggcaaaggaactaaagaagcctaatgaagacatgtgcttagcagaccaaaagcctttgccagagttgcctcgtattccaggacttgttctctctggaagtacattttcagactgtctcatggtggtgcagttcttacgaaactttggtaaagttttgggctttgatgtgaatattgatgttccaaacctgagtgttcttcaagagggattgctaaatataggggacagcatgggtgaagtacaagacttgcttgtgaggctcctctcagctgctgtatgtgatccaggtctaataacaggatacaaggctaaaacagctcttggagaacatttgctgaatgttggtgtgaatcgagacaatgtttccgagattttacagatatttatggaagcccactgtggacaaactgagcttactgaaagtctgaagaccaaagcttttcaggctcacactccagcacagaaagcttcagtcctggctttcctgatcaatgaactggcatgcagcaagagtgtggtcagtgaaatcgacaagaacattgattatatgtcaaacttgaggagagataaatgggtggtagaaggtaaactccgcaagctcagaatcattcatgctaagaaaacaggcaaaagagacacttcaggtggcattgatctgggagaagagcagcatcccttgggcacacccactccaggacgcaagcgaagaaggaagggaggagacagtgattatgacgatgatgatgacgatgacagtgatgaccaaggggatgaagatgatgaggatgaagaagataaagaagacaaaaaaggaaaaaagactgatatctgtgaagatgaggatgaaggtgaccaagcagcaagtgttgaagagctggaaaaacagattgaaaaactgagtaaacaacagagtcagtacagaaggaagctctttgatgcgtctcactcattgcgttcagtgatgtttggccaagatcgttacagacgccggtactggattcttccccaatgtggggggatttttgtagaaggcatggagagtggtgaaggactagaagaaattgcaaaagaaagagaaaaactgaaaaaggcagaaagtgtccagatcaaagaagaaatgtttgagacttctggggacagtttaaattgttcaaatacagatcactgtgaacaaaaggaagatcttaaagaaaaagataacacaaatctattccttcagaaacctggctctttttccaaattaagcaagcttttggaagtagctaagatgcctcctgagtcagaggttatgacccccaaaccaaatgctggtgcaaatgggtgcacgttgtcttatcagaacagtggaaaacattcactgggcagcgttcagtcaacagcaacgcaaagcaatgtggaaaaggcagactctaataatctgtttaatactggttcaagtggtccagggaagttctacagtcctctccccaatgaccagttactaaaaacgctgactgaaaagaatagacaatggtttagtcttttgccacgaacaccctgtgatgacacttcacttactcatgccgatatgtcaactgcttctttggtgactcctcagtctcagccaccatctaagtcaccttcacctaccccagctcctcttggatcttctgctcagaatcctgttggcttaaatccatttgctttatcacctcttcaggtgaaaggtggagtatctatgatgggacttcagttttgtggatggcccactggtgtggttacttctaatattccatttacatnatctgtacctagtctaggatcggggttagggttatcagaaggaaatggtaattcattcttgacttccaatgttgcttcaagtaaaagtgaatctccagtaccacagaatgaaaaggccacttcagctcaacctgcagctgttgaagtagcaaaaccagtagattttcctagtccaaaacctattccagaagaaatgcagtttggttggtggagaattattgacccagaggacctaaaagctttgctcaaagtgctgcatctcagaggaataagagaaaaggcattacaaaaacaaattcagaaacatttggattatattactcaagcctgcctcaagaataaggatgttgctattattgaactgaatgaaaatgaagaaaaccaagtaactcgagatattgtggagaactggtcagtagaagaacaagcaatggaaatggatttgagtgtccttcaacaggtagaagatctagaaaggagagttgcatcagcaagtttgcaagtgaagggttggatgtgtccagagcctgcatcagaaagggaggacttggtatattttgaacataaatcatttactaaattgtgcaaggagcatgatggagaatttactggcgaagacgaaagcagtgcacatgcactagaacggaagagtgacaaccccctagatatagctgtaaccaggctggctgatttggagcggaacattgaaagaaggtatctgaagagccccttaagtaccaccattcagatcaaactggataatgtgggcacagttactgtccctgctcctgcaccatccgttagtggtgatggtgacggaattgaagaggatattgctccagggctcagggtatggagaagggcattatcagaagctcgcagtgctgcacaggtagctctgtgcattcagcaattacagaaatcaatagcatgggaactgcttcttctttgtgatggctgtgacaaaggctgtcatacctactgccatagacccaagattacaacaatcccagatggagactggttttgtccagcttgcattgctaaggcaagtggtcaaactctaaaaatcaaaaaacttcatgtcaaaggaaaaaagactaatgagtcaaagaaaggcaagaaggtaactttaacaggagatactgaagatgaagactctgcatctacaagtagttcactaaaaagaggaaacaaagacctcaagaaaagaaaaatggaggaaaacacttctattaacttgtcaaaacaagaaagttttacttcagttaagaaacctaaaagagatgactccaaggacctagctctttgcagtatgattctgactgaaatggaaactcatgaggatgcatggccttttctacttcctgtaaacttgaaacttgttcctggttataagaaagttattaagaagcctatggatttttccacaattagagagaaactaagtagtggacagtatccaaaccttgaaacctttgctctagatgtcaggcttgtttttgacaactgtgaaacatttaatgaagatgattctgatataggcagagctggccacaatatgaggaagtattttgaaaaaaagtggacagatactttcaaagtgagctgaagttataataatctctttatttttttccttctaaacaaggacaaatgagaccagcaatgtgaactgtatttacataaacgtgcaaggcacatacataatgactttctttttccttaagtataaaaaaaaagtatcagaagaatgataccatttttaaaggcttcattcctacaacaaccaaggccctcggttattggtttgtgtgatttatcagctaatttaggtagaacagggaagcacacccaaagaattttcaaaggaaagggtgttatagtgcaatagcaattaaaatatatcaaatcgcactgaatactcaacaccagagctctaatgtgggaaatggttctcctttccctctcaataaatatctatttttcatttttttactttgtagtttattttttagtgaatgtatttaattttatgaattatttatgattaaaccacatccagaatcttcgttttctgtgaaaaggaagaactagaaaattgctttaaatcttgaaaatacaaggaatgttttaaaatataaaacaaagccaagttaaactgtttacactgatgtgctataaaagcaccaaaaagaaactttactgtagagttacaagtacatttatatatatatgttgctgcatcacttgtgtagttaaattgtatttcaaaacagtgaaaaaattgacatgtatatactgttcattcttgtttatattaagtcttgttttaaatatgtattatgtgtatatattgtttgcagacattattgttcatgccttagaggattgtagcattttattttcgtctgaaggtaatgatagctatacagtctgtacagtaattatcctctaccaacactgtggcgtctccttaatcttggtagtgcctgcctttgaaacagggtgtaggggatattagttttccatttttctattttgttatataattttaagccaccagggcctaaattaaagtataatcatttgtatccatgtggaataaaattgtgacaatttcctacgcacacagtattttttcatagaaacatttccctcccatttgccttgcctcagaaataaatttaaaagacgtttgtaaccactgtgttttatctactgtgtgttgtggtggcctgttggaggcaaatagatcagattttttttgtacctacgtaagagtacttgaagttttatttaaaataaaatgttgtggaaaaggtagcattctttttttaggagtgttatttttcactatgtgtggcacggatacaataaaagacttttacaaactaa

SEQ ID NO: 371199 - DNA, 8286 bp, Homo sapiens
  misc_feature (4950)..(4950): n is a, c, g, or t
agaagaatcatctcctgcttcaatctgctgctggataggaactaatcagagagagagaagcggaagacggagaaggagggagtcgaaggctttcccgatcacaaatctcacctccactacaactctctttatacttttcttgcagaaataataatagaaataaggaggtggtggggtttccaaaaatcttaaccttcaaccatctggggaaaaggcaaaaatcccatctaccgcaactctcagttcgagagtaaaggtttcccaacagtgatgtcacaagattgaccacattgatcacaatatggagtctggagaacggttaccatcctcagcagcctcctctactacaccaacttcatcttcgacaccttctgtggcttcagtagtttcaaaaggtggcctttccactggagttgcttcacttagctctacaatcaacccatgtggacatttattcagaacagctggggatcaaccgtttaacctgtccacagtgtcgagtgccttcccaatggtcagccacccagtctttggtctacattcagccagctcagggcattcagaatttggtggtttggggacacttggtacacccacagccttagccgcacatccccaactagcatcttttccagcagaatggtggcgaacaactgatgctcatactcgtacaggagcaaccttctttccaccattactgggaattccaccactatttgctcccccagcccagaatcatgattcttcttcattccattcaaggacttcgggaaaaagtaatcgaaatggtcccgaaaaaggtgtaaatgggtcaataaatggaagtaatacatcatctgtaattggtatcaacacatctgtactatccactactgcttcaagttccatgggacaaactaaaagtacaagctcaggtggaggaaatcgaaaatgtaatcaggaacaaagcaaaaaccagcctttggatgctagagttgacaaaatcaaagataagaaaccaaggaagaaagcaatggaaagttctagcaacagtgatagtgattcaggcacatcatcagacacctcaagtgaaggcattagtagcagtgattcagatgatctagaagaagatgaagaagaagaagatcaaagtattgaagaaagtgaagatgatgattctgattcagagagtgaagcacaacataaaagtaacaaccaggtgctattacatggtatttcagacccaaaagcagatggacagaaagcaactgaaaaagcccaggaaaaaagaatacaccagccattacctcttgcgtctgaatcccagactcactcattccaatcccagcagaagcagcctcaggttttgtcacagcagcttccatttattttccaaagctctcaggcaaaggaggaatctgtgaacaaacacaccagtgtaatacagtctacgggattggtgtccaatgtgaaacctttatctttggtaaatcaagccaaaaaggaaacttacatgaaactcatagttccttctcctgatgttcttaaagcagggaataaaaatacctctgaagaatctagtttattgaccagtgaattgagatccaaacgggaacaatataaacaggcattcccatcacagttaaagaaacaagagtcatcgaagagcctgaagaaggttattgcagctttgtcaaatccaaaagcaacctctagttcaccagcacatccaaaacaaacattagaaaacaaccacccaaatccattcttgacaaatgcacttttaggtaatcaccaaccaaatggagttattcaaagtgtcattcaagaagctcctctagcacttactaccaaaactaaaatgcagagcaagattaatgaaaacattgctgctgcaagtagcacccctttttcctcacctgtaaatctgagtacaagtgggagaagaacccctggcaatcagacacctgtaatgccctctgcctctcccatcctgcatagtcaagggaaggaaaaagcagttagcaataatgtaaacccagtaaaaacacagcatcactcccatcctgcaaaatctttagtggaacaattcagaggaacagattcagacattcccagtagtaaagattctgaagattcaaatgaggatgaagaggaagatgatgaagaagaagatgaggaagatgatgaagatgatgaatctgatgacagccaatcaggcacttccaaaagaagaagagtaacagatgaacgtgaactgcgtattccattggaatatggctggcagagagagacaagaataagaaactttggagggcgccttcaaggagaagtagcatattatgctccatgtggaaagaaacttaggcagtaccctgaagtaataaagtatctcagcagaaatggaataatggatatctcaagggacaatttcagcttcagtgcaaaaataagagtgggtgacttctatgaagccagagatggaccgcagggaatgcagtggtgtcttttgaaagaagaggatgtcattcctcgtatcagggcaatggaaggtcgtagaggaagaccaccaaatccagatagacaacgagcaagagaggaatccaggatgagacgtcggaaaggtcgacctccaaatgttggcaatgctgaattcctagataacgcagatgcaaagttgctaagaaaactgcaagctcaagaaatagccaggcaagcagcacaaataaagcttttgagaaaacttcaaaagcaggaacaggctcgggttgctaaagaagccaaaaaacaacaagcaataatggctgctgaggagaagcggaagcaaaaagaacagataaagattatgaaacagcaggaaaaaattaagagaatacagcaaatcagaatggaaaaagaacttcgagctcagcaaattctagaggctaaaaagaaaaagaaggaagaagcggcaaatgccaaattattggaggccgagaaacgaataaaggaaaaagaaatgagaagacaacaagctgttcttctgaaacatcaggaacgagagcgaaggcgacaacacatgatgcttatgaaagctatggaagctcgtaaaaaagcagaagaaaaagagcggttgaaacaagaaaaacgtgatgagaaaagattaaataaagagcgtaaactagagcagcgaagattagaattagaaatggcaaaggaactaaagaagcctaatgaagacatgtgcttagcagaccaaaagcctttgccagagttgcctcgtattccaggacttgttctctctggaagtacattttcagactgtctcatggtggtgcagttcttacgaaactttggtaaagttttgggctttgatgtgaatattgatgttccaaacctgagtgttcttcaagagggattgctaaatataggggacagcatgggtgaagtacaagacttgcttgtgaggctcctctcagctgctgtatgtgatccaggtctaataacaggatacaaggctaaaacagctcttggagaacatttgctgaatgttggtgtgaatcgagacaatgtttccgagattttacagatatttatggaagcccactgtggacaaactgagcttactgaaagtctgaagaccaaagcttttcaggctcacactccagcacagaaagcttcagtcctggctttcctgatcaatgaactggcatgcagcaagagtgtggtcagtgaaatcgacaagaacattgattatatgtcaaacttgaggagagataaatgggtggtagaaggtaaactccgcaagctcagaatcattcatgctaagaaaacaggcaaaagagacacttcaggtggcattgatctgggagaagagcagcatcccttgggcacacccactccaggacgcaagcgaagaaggaagggaggagacagtgattatgacgatgatgatgacgatgacagtgatgaccaaggggatgaagatgatgaggatgaagaagataaagaagacaaaaaaggaaaaaagactgatatctgtgaagatgaggatgaaggtgaccaagcagcaagtgttgaagagctggaaaaacagattgaaaaactgagtaaacaacagagtcagtacagaaggaagctctttgatgcgtctcactcattgcgttcagtgatgtttggccaagatcgttacagacgccggtactggattcttccccaatgtggggggatttttgtagaaggcatggagagtggtgaaggactagaagaaattgcaaaagaaagagaaaaactgaaaaaggcagaaagtgtccagatcaaagaagaaatgtttgagacttctggggacagtttaaattgttcaaatacagatcactgtgaacaaaaggaagatcttaaagaaaaagataacacaaatctattccttcagaaacctggctctttttccaaattaagcaagcttttggaagtagctaagatgcctcctgagtcagaggttatgacccccaaaccaaatgctggtgcaaatgggtgcacgttgtcttatcagaacagtggaaaacattcactgggcagcgttcagtcaacagcaacgcaaagcaatgtggaaaaggcagactctaataatctgtttaatactggttcaagtggtccagggaagttctacagtcctctccccaatgaccagttactaaaaacgctgactgaaaagaatagacaatggtttagtcttttgccacgaacaccctgtgatgacacttcacttactcatgccgatatgtcaactgcttctttggtgactcctcagtctcagccaccatctaagtcaccttcacctaccccagctcctcttggatcttctgctcagaatcctgttggcttaaatccatttgctttatcacctcttcaggtgaaaggtggagtatctatgatgggacttcagttttgtggatggcccactggtgtggttacttctaatattccatttacatnatctgtacctagtctaggatcggggttagggttatcagaaggaaatggtaattcattcttgacttccaatgttgcttcaagtaaaagtgaatctccagtaccacagaatgaaaaggccacttcagctcaacctgcagctgttgaagtagcaaaaccagtagattttcctagtccaaaacctattccagaagaaatgcagtttggttggtggagaattattgacccagaggacctaaaagctttgctcaaagtgctgcatctcagaggaataagagaaaaggcattacaaaaacaaattcagaaacatttggattatattactcaagcctgcctcaagaataaggatgttgctattattgaactgaatgaaaatgaagaaaaccaagtaactcgagatattgtggagaactggtcagtagaagaacaagcaatggaaatggatttgagtgtccttcaacaggtagaagatctagaaaggagagttgcatcagcaagtttgcaagtgaagggttggatgtgtccagagcctgcatcagaaagggaggacttggtatattttgaacataaatcatttactaaattgtgcaaggagcatgatggagaatttactggcgaagacgaaagcagtgcacatgcactagaacggaagagtgacaaccccctagatatagctgtaaccaggctggctgatttggagcggaacattgaaagaaggtatctgaagagccccttaagtaccaccattcagatcaaactggataatgtgggcacagttactgtccctgctcctgcaccatccgttagtggtgatggtgacgggtaggttattgagattaacttgaaaaattattgtgcttctttgctaattggagcctattttctattgcctgttatctatgtatcttcttgtatgtctgtgatccatacggatcatgctatttgcatggtgctttgtaaaaactttttttttgttatgtgcgttgataatcctgcaaagtgatcttacatctacctggttgtgactaagctttgaggcacgtagccacagtctgtgcactacatcaaatttagttgcttaaaccttatacttattggctgttacatgtttttgtcattgcttggctttcagtgtgatgattgtttcacattccgtaatcgtaagtgtggacatgacctacttaatttttctatatttcaatgcagaattgaagaggatattgctccagggctcagggtatggagaagggcattatcagaagctcgcagtgctgcacaggtagctctgtgcattcagcaattacagaaatcaatagcatgggaaaaatcaattatgaaagtttactgccaaatctgtcgaaagggagataatgaagaactgcttcttctttgtgatggctgtgacaaaggctgtcatacctactgccatagacccaagattacaacaatcccagatggagactggttttgtccagcttgcattgctaaggcaagtggtcaaactctaaaaatcaaaaaacttcatgtcaaaggaaaaaagactaatgagtcaaagaaaggcaagaaggtaactttaacaggagatactgaagatgaagactctgcatctacaagtagttcactaaaaagaggaaacaaagacctcaagaaaagaaaaatggaggaaaacacttctattaacttgtcaaaacaagaaagttttacttcagttaagaaacctaaaagagatgactccaaggacctagctctttgcagtatgattctgactgaaatggaaactcatgaggatgcatggccttttctacttcctgtaaacttgaaacttgttcctggttataagaaagttattaagaagcctatggatttttccacaattagagagaaactaagtagtggacagtatccaaaccttgaaacctttgctctagatgtcaggcttgtttttgacaactgtgaaacatttaatgaagatgattctgatataggcagagctggccacaatatgaggaagtattttgaaaaaaagtggacagatactttcaaagtgagctgaagttataataatctctttatttttttccttctaaacaaggacaaatgagaccagcaatgtgaactgtatttacataaacgtgcaaggcacatacataatgactttctttttccttaagtataaaaaaaaagtatcagaagaatgataccatttttaaaggcttcattcctacaacaaccaaggccctcggttattggtttgtgtgatttatcagctaatttaggtagaacagggaagcacacccaaagaattttcaaaggaaagggtgttatagtgcaatagcaattaaaatatatcaaatcgcactgaatactcaacaccagagctctaatgtgggaaatggttctcctttccctctcaataaatatctatttttcatttttttactttgtagtttattttttagtgaatgtatttaattttatgaattatttatgattaaaccacatccagaatcttcgttttctgtgaaaaggaagaactagaaaattgctttaaatcttgaaaatacaaggaatgttttaaaatataaaacaaagccaagttaaactgtttacactgatgtgctataaaagcaccaaaaagaaactttactgtagagttacaagtacatttatatatatatgttgctgcatcacttgtgtagttaaattgtatttcaaaacagtgaaaaaattgacatgtatatactgttcattcttgtttatattaagtcttgttttaaatatgtattatgtgtatatattgtttgcagacattattgttcatgccttagaggattgtagcattttattttcgtctgaaggtaatgatagctatacagtctgtacagtaattatcctctaccaacactgtggcgtctccttaatcttggtagtgcctgcctttgaaacagggtgtaggggatattagttttccatttttctattttgttatataattttaagccaccagggcctaaattaaagtataatcatttgtatccatgtggaataaaattgtgacaatttcctacgcacacagtattttttcatagaaacatttccctcccatttgccttgcctcagaaataaatttaaaagacgtttgtaaccactgtgttttatctactgtgtgttgtggtggcctgttggaggcaaatagatcagattttttttgtacctacgtaagagtacttgaagttttatttaaaataaaatgttgtggaaaaggtagcattctttttttaggagtgttatttttcactatgtgtggcacggatacaataaaagacttttacaaactaa

SEQ ID NO: 371200 - DNA, 4958 bp, Homo sapiens
  misc_feature (2111)..(2111): n is a, c, g, or t
tacttttgaaatgtttatattttatttaatttttgctccagttatataatccatgttttgttaatatggatatgtcagttgattgaatatgcaagttgattaaaattaatgtctcttttgcaaagatctaagttcataattgagttcaaccaaaatttattaatggttgcttacttgtatgaagatacttcaagacactatgcttagttccatgggggttacagaaatgcccccagagaatttagcatcccaaaggaagctactggtacaatacaagaggggaaaaaaggtagcagcttattttactttagaagaatcgaaatcatggcttttaaaaaattaagctgtttttattttatttgtatttcattttattttcagcctttgccagagttgcctcgtattccaggacttgttctctctggaagtacattttcagactgtctcatggtggtgcagttcttacgaaactttggtaaagttttgggctttgatgtgaatattgatgttccaaacctgagtgttcttcaagagggattgctaaatataggggacagcatgggtgaagtacaagacttgcttgtgaggctcctctcagctgctgtatgtgatccaggtctaataacaggatacaaggctaaaacagctcttggagaacatttgctgaatgttggtgtgaatcgagacaatgtttccgagattttacagatatttatggaagcccactgtggacaaactgagcttactgaaagtctgaagaccaaagcttttcaggctcacactccagcacagaaagcttcagtcctggctttcctgatcaatgaactggcatgcagcaagagtgtggtcagtgaaatcgacaagaacattgattatatgtcaaacttgaggagagataaatgggtggtagaaggtaaactccgcaagctcagaatcattcatgctaagaaaacaggcaaaagagacacttcaggtggcattgatctgggagaagagcagcatcccttgggcacacccactccaggacgcaagcgaagaaggaagggaggagacagtgattatgacgatgatgatgacgatgacagtgatgaccaaggggatgaagatgatgaggatgaagaagataaagaagacaaaaaaggaaaaaagactgatatctgtgaagatgaggatgaaggtgaccaagcagcaagtgttgaagagctggaaaaacagattgaaaaactgagtaaacaacagagtcagtacagaaggaagctctttgatgcgtctcactcattgcgttcagtgatgtttggccaagatcgttacagacgccggtactggattcttccccaatgtggggggatttttgtagaaggcatggagagtggtgaaggactagaagaaattgcaaaagaaagagaaaaactgaaaaaggcagaaagtgtccagatcaaagaagaaatgtttgagacttctggggacagtttaaattgttcaaatacagatcactgtgaacaaaaggaagatcttaaagaaaaagataacacaaatctattccttcagaaacctggctctttttccaaattaagcaagcttttggaagtagctaagatgcctcctgagtcagaggttatgacccccaaaccaaatgctggtgcaaatgggtgcacgttgtcttatcagaacagtggaaaacattcactgggcagcgttcagtcaacagcaacgcaaagcaatgtggaaaaggcagactctaataatctgtttaatactggttcaagtggtccagggaagttctacagtcctctccccaatgaccagttactaaaaacgctgactgaaaagaatagacaatggtttagtcttttgccacgaacaccctgtgatgacacttcacttactcatgccgatatgtcaactgcttctttggtgactcctcagtctcagccaccatctaagtcaccttcacctaccccagctcctcttggatcttctgctcagaatcctgttggcttaaatccatttgctttatcacctcttcaggtgaaaggtggagtatctatgatgggacttcagttttgtggatggcccactggtgtggttacttctaatattccatttacatnatctgtacctagtctaggatcggggttagggttatcagaaggaaatggtaattcattcttgacttccaatgttgcttcaagtaaaagtgaatctccagtaccacagaatgaaaaggccacttcagctcaacctgcagctgttgaagtagcaaaaccagtagattttcctagtccaaaacctattccagaagaaatgcagtttggttggtggagaattattgacccagaggacctaaaagctttgctcaaagtgctgcatctcagaggaataagagaaaaggcattacaaaaacaaattcagaaacatttggattatattactcaagcctgcctcaagaataaggatgttgctattattgaactgaatgaaaatgaagaaaaccaagtaactcgagatattgtggagaactggtcagtagaagaacaagcaatggaaatggatttgagtgtccttcaacaggtagaagatctagaaaggagagttgcatcagcaagtttgcaagtgaagggttggatgtgtccagagcctgcatcagaaagggaggacttggtatattttgaacataaatcatttactaaattgtgcaaggagcatgatggagaatttactggcgaagacgaaagcagtgcacatgcactagaacggaagagtgacaaccccctagatatagctgtaaccaggctggctgatttggagcggaacattgaaagaagaattgaagaggatattgctccagggctcagggtatggagaagggcattatcagaagctcgcagtgctgcacaggtagctctgtgcattcagcaattacagaaatcaatagcatgggaaaaatcaattatgaaagtttactgccaaatctgtcgaaagggagataatgaagaactgcttcttctttgtgatggctgtgacaaaggctgtcatacctactgccatagacccaagattacaacaatcccagatggagactggttttgtccagcttgcattgctaaggcaagtggtcaaactctaaaaatcaaaaaacttcatgtcaaaggaaaaaagactaatgagtcaaagaaaggcaagaaggtaactttaacaggagatactgaagatgaagactctgcatctacaagtagttcactaaaaagaggaaacaaagacctcaagaaaagaaaaatggaggaaaacacttctattaacttgtcaaaacaagaaagttttacttcagttaagaaacctaaaagagatgactccaaggacctagctctttgcagtatgattctgactgaaatggaaactcatgaggatgcatggccttttctacttcctgtaaacttgaaacttgttcctggttataagaaagttattaagaagcctatggatttttccacaattagagagaaactaagtagtggacagtatccaaaccttgaaacctttgctctagatgtcaggcttgtttttgacaactgtgaaacatttaatgaagatgattctgatataggcagagctggccacaatatgaggaagtattttgaaaaaaagtggacagatactttcaaagtgagctgaagttataataatctctttatttttttccttctaaacaaggacaaatgagaccagcaatgtgaactgtatttacataaacgtgcaaggcacatacataatgactttctttttccttaagtataaaaaaaaagtatcagaagaatgataccatttttaaaggcttcattcctacaacaaccaaggccctcggttattggtttgtgtgatttatcagctaatttaggtagaacagggaagcacacccaaagaattttcaaaggaaagggtgttatagtgcaatagcaattaaaatatatcaaatcgcactgaatactcaacaccagagctctaatgtgggaaatggttctcctttccctctcaataaatatctatttttcatttttttactttgtagtttattttttagtgaatgtatttaattttatgaattatttatgattaaaccacatccagaatcttcgttttctgtgaaaaggaagaactagaaaattgctttaaatcttgaaaatacaaggaatgttttaaaatataaaacaaagccaagttaaactgtttacactgatgtgctataaaagcaccaaaaagaaactttactgtagagttacaagtacatttatatatatatgttgctgcatcacttgtgtagttaaattgtatttcaaaacagtgaaaaaattgacatgtatatactgttcattcttgtttatattaagtcttgttttaaatatgtattatgtgtatatattgtttgcagacattattgttcatgccttagaggattgtagcattttattttcgtctgaaggtaatgatagctatacagtctgtacagtaattatcctctaccaacactgtggcgtctccttaatcttggtagtgcctgcctttgaaacagggtgtaggggatattagttttccatttttctattttgttatataattttaagccaccagggcctaaattaaagtataatcatttgtatccatgtggaataaaattgtgacaatttcctacgcacacagtattttttcatagaaacatttccctcccatttgccttgcctcagaaataaatttaaaagacgtttgtaaccactgtgttttatctactgtgtgttgtggtggcctgttggaggcaaatagatcagattttttttgtacctacgtaagagtacttgaagttttatttaaaataaaatgttgtggaaaaggtagcattctttttttaggagtgttatttttcactatgtgtggcacggatacaataaaagacttttacaaactaa

SEQ ID NO: 371201 - DNA, 4870 bp, Homo sapiens
  misc_feature (2023)..(2023): n is a, c, g, or t
tgccgtccaccagtaactgaatactgaaagggggtagctgggaaaaagaaatgagaagacaacaagctgttcttctgaaacatcaggaacgagagcgaaggcgacaacacatgatgcttatgaaagctatggaagctcgtaaaaaagcagaagaaaaagagcggttgaaacaagaaaaacgtgatgagaaaagattaaataaagagcgtaaactagagcagcgaagattagaattagaaatggcaaaggaactaaagaagcctaatgaagacatgtgcttagcagaccaaaagcctttgccagagttgcctcgtattccaggacttgttctctctggaagtacattttcagactgtctcatggtggtgcagttcttacgaaactttggtaaagttttgggctttgatgtgaatattgatgttccaaacctgagtgttcttcaagagggattgctaaatataggggacagcatgggtgaagtacaagacttgcttgtgaggctcctctcagctgctgtatgtgatccaggtctaataacaggatacaaggctaaaacagctcttggagaacatttgctgaatgttggtgtgaatcgagacaatgtttccgagattttacagatatttatggaagcccactgtggacaaactgagcttactgaaagtctgaagaccaaagcttttcaggctcacactccagcacagaaagcttcagtcctggctttcctgatcaatgaactggcatgcagcaagagtgtggtcagtgaaatcgacaagaacattgattatatgtcaaacttgaggagagataaatgggtggtagaaggtaaactccgcaagctcagaatcattcatgctaagaaaacaggcaaaagagacacttcaggtggcattgatctgggagaagagcagcatcccttgggcacacccactccaggacgcaagcgaagaaggaagggaggagacagtgattatgacgatgatgatgacgatgacagtgatgaccaaggggatgaagatgatgaggatgaagaagataaagaagacaaaaaaggaaaaaagactgatatctgtgaagatgaggatgaaggtgaccaagcagcaagtgttgaagagctggaaaaacagattgaaaaactgagtaaacaacagagtcagtacagaaggaagctctttgatgcgtctcactcattgcgttcagtgatgtttggccaagatcgttacagacgccggtactggattcttccccaatgtggggggatttttgtagaaggcatggagagtggtgaaggactagaagaaattgcaaaagaaagagaaaaactgaaaaaggcagaaagtgtccagatcaaagaagaaatgtttgagacttctggggacagtttaaattgttcaaatacagatcactgtgaacaaaaggaagatcttaaagaaaaagataacacaaatctattccttcagaaacctggctctttttccaaattaagcaagcttttggaagtagctaagatgcctcctgagtcagaggttatgacccccaaaccaaatgctggtgcaaatgggtgcacgttgtcttatcagaacagtggaaaacattcactgggcagcgttcagtcaacagcaacgcaaagcaatgtggaaaaggcagactctaataatctgtttaatactggttcaagtggtccagggaagttctacagtcctctccccaatgaccagttactaaaaacgctgactgaaaagaatagacaatggtttagtcttttgccacgaacaccctgtgatgacacttcacttactcatgccgatatgtcaactgcttctttggtgactcctcagtctcagccaccatctaagtcaccttcacctaccccagctcctcttggatcttctgctcagaatcctgttggcttaaatccatttgctttatcacctcttcaggtgaaaggtggagtatctatgatgggacttcagttttgtggatggcccactggtgtggttacttctaatattccatttacatnatctgtacctagtctaggatcggggttagggttatcagaaggaaatggtaattcattcttgacttccaatgttgcttcaagtaaaagtgaatctccagtaccacagaatgaaaaggccacttcagctcaacctgcagctgttgaagtagcaaaaccagtagattttcctagtccaaaacctattccagaagaaatgcagtttggttggtggagaattattgacccagaggacctaaaagctttgctcaaagtgctgcatctcagaggaataagagaaaaggcattacaaaaacaaattcagaaacatttggattatattactcaagcctgcctcaagaataaggatgttgctattattgaactgaatgaaaatgaagaaaaccaagtaactcgagatattgtggagaactggtcagtagaagaacaagcaatggaaatggatttgagtgtccttcaacaggtagaagatctagaaaggagagttgcatcagcaagtttgcaagtgaagggttggatgtgtccagagcctgcatcagaaagggaggacttggtatattttgaacataaatcatttactaaattgtgcaaggagcatgatggagaatttactggcgaagacgaaagcagtgcacatgcactagaacggaagagtgacaaccccctagatatagctgtaaccaggctggctgatttggagcggaacattgaaagaagaattgaagaggatattgctccagggctcagggtatggagaagggcattatcagaagctcgcagtgctgcacaggtagctctgtgcattcagcaattacagaaatcaatagcatgggaaaaatcaattatgaaagtttactgccaaatctgtcgaaagggagataatgaagaactgcttcttctttgtgatggctgtgacaaaggctgtcatacctactgccatagacccaagattacaacaatcccagatggagactggttttgtccagcttgcattgctaaggcaagtggtcaaactctaaaaatcaaaaaacttcatgtcaaaggaaaaaagactaatgagtcaaagaaaggcaagaaggtaactttaacaggagatactgaagatgaagactctgcatctacaagtagttcactaaaaagaggaaacaaagacctcaagaaaagaaaaatggaggaaaacacttctattaacttgtcaaaacaagaaagttttacttcagttaagaaacctaaaagagatgactccaaggacctagctctttgcagtatgattctgactgaaatggaaactcatgaggatgcatggccttttctacttcctgtaaacttgaaacttgttcctggttataagaaagttattaagaagcctatggatttttccacaattagagagaaactaagtagtggacagtatccaaaccttgaaacctttgctctagatgtcaggcttgtttttgacaactgtgaaacatttaatgaagatgattctgatataggcagagctggccacaatatgaggaagtattttgaaaaaaagtggacagatactttcaaagtgagctgaagttataataatctctttatttttttccttctaaacaaggacaaatgagaccagcaatgtgaactgtatttacataaacgtgcaaggcacatacataatgactttctttttccttaagtataaaaaaaaagtatcagaagaatgataccatttttaaaggcttcattcctacaacaaccaaggccctcggttattggtttgtgtgatttatcagctaatttaggtagaacagggaagcacacccaaagaattttcaaaggaaagggtgttatagtgcaatagcaattaaaatatatcaaatcgcactgaatactcaacaccagagctctaatgtgggaaatggttctcctttccctctcaataaatatctatttttcatttttttactttgtagtttattttttagtgaatgtatttaattttatgaattatttatgattaaaccacatccagaatcttcgttttctgtgaaaaggaagaactagaaaattgctttaaatcttgaaaatacaaggaatgttttaaaatataaaacaaagccaagttaaactgtttacactgatgtgctataaaagcaccaaaaagaaactttactgtagagttacaagtacatttatatatatatgttgctgcatcacttgtgtagttaaattgtatttcaaaacagtgaaaaaattgacatgtatatactgttcattcttgtttatattaagtcttgttttaaatatgtattatgtgtatatattgtttgcagacattattgttcatgccttagaggattgtagcattttattttcgtctgaaggtaatgatagctatacagtctgtacagtaattatcctctaccaacactgtggcgtctccttaatcttggtagtgcctgcctttgaaacagggtgtaggggatattagttttccatttttctattttgttatataattttaagccaccagggcctaaattaaagtataatcatttgtatccatgtggaataaaattgtgacaatttcctacgcacacagtattttttcatagaaacatttccctcccatttgccttgcctcagaaataaatttaaaagacgtttgtaaccactgtgttttatctactgtgtgttgtggtggcctgttggaggcaaatagatcagattttttttgtacctacgtaagagtacttgaagttttatttaaaataaaatgttgtggaaaaggtagcattctttttttaggagtgttatttttcactatgtgtggcacggatacaataaaagacttttacaaactaa

SEQ ID NO: 371202 - DNA, 6412 bp, Homo sapiens
  misc_feature (4950)..(4950): n is a, c, g, or t
agaagaatcatctcctgcttcaatctgctgctggataggaactaatcagagagagagaagcggaagacggagaaggagggagtcgaaggctttcccgatcacaaatctcacctccactacaactctctttatacttttcttgcagaaataataatagaaataaggaggtggtggggtttccaaaaatcttaaccttcaaccatctggggaaaaggcaaaaatcccatctaccgcaactctcagttcgagagtaaaggtttcccaacagtgatgtcacaagattgaccacattgatcacaatatggagtctggagaacggttaccatcctcagcagcctcctctactacaccaacttcatcttcgacaccttctgtggcttcagtagtttcaaaaggtggcctttccactggagttgcttcacttagctctacaatcaacccatgtggacatttattcagaacagctggggatcaaccgtttaacctgtccacagtgtcgagtgccttcccaatggtcagccacccagtctttggtctacattcagccagctcagggcattcagaatttggtggtttggggacacttggtacacccacagccttagccgcacatccccaactagcatcttttccagcagaatggtggcgaacaactgatgctcatactcgtacaggagcaaccttctttccaccattactgggaattccaccactatttgctcccccagcccagaatcatgattcttcttcattccattcaaggacttcgggaaaaagtaatcgaaatggtcccgaaaaaggtgtaaatgggtcaataaatggaagtaatacatcatctgtaattggtatcaacacatctgtactatccactactgcttcaagttccatgggacaaactaaaagtacaagctcaggtggaggaaatcgaaaatgtaatcaggaacaaagcaaaaaccagcctttggatgctagagttgacaaaatcaaagataagaaaccaaggaagaaagcaatggaaagttctagcaacagtgatagtgattcaggcacatcatcagacacctcaagtgaaggcattagtagcagtgattcagatgatctagaagaagatgaagaagaagaagatcaaagtattgaagaaagtgaagatgatgattctgattcagagagtgaagcacaacataaaagtaacaaccaggtgctattacatggtatttcagacccaaaagcagatggacagaaagcaactgaaaaagcccaggaaaaaagaatacaccagccattacctcttgcgtctgaatcccagactcactcattccaatcccagcagaagcagcctcaggttttgtcacagcagcttccatttattttccaaagctctcaggcaaaggaggaatctgtgaacaaacacaccagtgtaatacagtctacgggattggtgtccaatgtgaaacctttatctttggtaaatcaagccaaaaaggaaacttacatgaaactcatagttccttctcctgatgttcttaaagcagggaataaaaatacctctgaagaatctagtttattgaccagtgaattgagatccaaacgggaacaatataaacaggcattcccatcacagttaaagaaacaagagtcatcgaagagcctgaagaaggttattgcagctttgtcaaatccaaaagcaacctctagttcaccagcacatccaaaacaaacattagaaaacaaccacccaaatccattcttgacaaatgcacttttaggtaatcaccaaccaaatggagttattcaaagtgtcattcaagaagctcctctagcacttactaccaaaactaaaatgcagagcaagattaatgaaaacattgctgctgcaagtagcacccctttttcctcacctgtaaatctgagtacaagtgggagaagaacccctggcaatcagacacctgtaatgccctctgcctctcccatcctgcatagtcaagggaaggaaaaagcagttagcaataatgtaaacccagtaaaaacacagcatcactcccatcctgcaaaatctttagtggaacaattcagaggaacagattcagacattcccagtagtaaagattctgaagattcaaatgaggatgaagaggaagatgatgaagaagaagatgaggaagatgatgaagatgatgaatctgatgacagccaatcaggcacttccaaaagaagaagagtaacagatgaacgtgaactgcgtattccattggaatatggctggcagagagagacaagaataagaaactttggagggcgccttcaaggagaagtagcatattatgctccatgtggaaagaaacttaggcagtaccctgaagtaataaagtatctcagcagaaatggaataatggatatctcaagggacaatttcagcttcagtgcaaaaataagagtgggtgacttctatgaagccagagatggaccgcagggaatgcagtggtgtcttttgaaagaagaggatgtcattcctcgtatcagggcaatggaaggtcgtagaggaagaccaccaaatccagatagacaacgagcaagagaggaatccaggatgagacgtcggaaaggtcgacctccaaatgttggcaatgctgaattcctagataacgcagatgcaaagttgctaagaaaactgcaagctcaagaaatagccaggcaagcagcacaaataaagcttttgagaaaacttcaaaagcaggaacaggctcgggttgctaaagaagccaaaaaacaacaagcaataatggctgctgaggagaagcggaagcaaaaagaacagataaagattatgaaacagcaggaaaaaattaagagaatacagcaaatcagaatggaaaaagaacttcgagctcagcaaattctagaggctaaaaagaaaaagaaggaagaagcggcaaatgccaaattattggaggccgagaaacgaataaaggaaaaagaaatgagaagacaacaagctgttcttctgaaacatcaggaacgagagcgaaggcgacaacacatgatgcttatgaaagctatggaagctcgtaaaaaagcagaagaaaaagagcggttgaaacaagaaaaacgtgatgagaaaagattaaataaagagcgtaaactagagcagcgaagattagaattagaaatggcaaaggaactaaagaagcctaatgaagacatgtgcttagcagaccaaaagcctttgccagagttgcctcgtattccaggacttgttctctctggaagtacattttcagactgtctcatggtggtgcagttcttacgaaactttggtaaagttttgggctttgatgtgaatattgatgttccaaacctgagtgttcttcaagagggattgctaaatataggggacagcatgggtgaagtacaagacttgcttgtgaggctcctctcagctgctgtatgtgatccaggtctaataacaggatacaaggctaaaacagctcttggagaacatttgctgaatgttggtgtgaatcgagacaatgtttccgagattttacagatatttatggaagcccactgtggacaaactgagcttactgaaagtctgaagaccaaagcttttcaggctcacactccagcacagaaagcttcagtcctggctttcctgatcaatgaactggcatgcagcaagagtgtggtcagtgaaatcgacaagaacattgattatatgtcaaacttgaggagagataaatgggtggtagaaggtaaactccgcaagctcagaatcattcatgctaagaaaacaggcaaaagagacacttcaggtggcattgatctgggagaagagcagcatcccttgggcacacccactccaggacgcaagcgaagaaggaagggaggagacagtgattatgacgatgatgatgacgatgacagtgatgaccaaggggatgaagatgatgaggatgaagaagataaagaagacaaaaaaggaaaaaagactgatatctgtgaagatgaggatgaaggtgaccaagcagcaagtgttgaagagctggaaaaacagattgaaaaactgagtaaacaacagagtcagtacagaaggaagctctttgatgcgtctcactcattgcgttcagtgatgtttggccaagatcgttacagacgccggtactggattcttccccaatgtggggggatttttgtagaaggcatggagagtggtgaaggactagaagaaattgcaaaagaaagagaaaaactgaaaaaggcagaaagtgtccagatcaaagaagaaatgtttgagacttctggggacagtttaaattgttcaaatacagatcactgtgaacaaaaggaagatcttaaagaaaaagataacacaaatctattccttcagaaacctggctctttttccaaattaagcaagcttttggaagtagctaagatgcctcctgagtcagaggttatgacccccaaaccaaatgctggtgcaaatgggtgcacgttgtcttatcagaacagtggaaaacattcactgggcagcgttcagtcaacagcaacgcaaagcaatgtggaaaaggcagactctaataatctgtttaatactggttcaagtggtccagggaagttctacagtcctctccccaatgaccagttactaaaaacgctgactgaaaagaatagacaatggtttagtcttttgccacgaacaccctgtgatgacacttcacttactcatgccgatatgtcaactgcttctttggtgactcctcagtctcagccaccatctaagtcaccttcacctaccccagctcctcttggatcttctgctcagaatcctgttggcttaaatccatttgctttatcacctcttcaggtgaaaggtggagtatctatgatgggacttcagttttgtggatggcccactggtgtggttacttctaatattccatttacatnatctgtacctagtctaggatcggggttagggttatcagaaggaaatggtaattcattcttgacttccaatgttgcttcaagtaaaagtgaatctccagtaccacagaatgaaaaggccacttcagctcaacctgcagctgttgaagtagcaaaaccagtagattttcctagtccaaaacctattccagaagaaatgcagtttggttggtggagaattattgacccagaggacctaaaagctttgctcaaagtgctgcatctcagaggaataagagaaaaggcattacaaaaacaaattcagaaacatttggattatattactcaagcctgcctcaagaataaggatgttgctattattgaactgaatgaaaatgaagaaaaccaagtaactcgagatattgtggagaactggtcagtagaagaacaagcaatggaaatggatttgagtgtccttcaacaggtagaagatctagaaaggagagttgcatcagcaagtttgcaagtgaagggttggatgtgtccagagcctgcatcagaaagggaggacttggtatattttgaacataaatcatttactaaattgtgcaaggagcatgatggagaatttactggcgaagacgaaagcagtgcacatgcactagaacggaagagtgacaaccccctagatatagctgtaaccaggctggctgatttggagcggaacattgaaagaaggtatctgaagagccccttaagtaccaccattcagatcaaactggataatgtgggcacagttactgtccctgctcctgcaccatccgttagtggtgatggtgacgggtaggttattgagattaacttgaaaaattattgtgcttctttgctaattggagcctattttctattgcctgttatctatgtatcttcttgtatgtctgtgatccatacggatcatgctatttgcatggtgctttgtaaaaactttttttttgttatgtgcgttgataatcctgcaaagtgatcttacatctacctggttgtgactaagctttgaggcacgtagccacagtctgtgcactacatcaaatttagttgcttaaaccttatacttattggctgttacatgtttttgtcattgcttggctttcagtgtgatgattgtttcacattccgtaatcgtaagtgtggacatgacctacttaatttttctatatttcaatgcagaattgaagaggatattgctccagggctcagggtatggagaagggcattatcagaagctcgcagtgctgcacaggtagctctgtgcattcagcaattacagaaatcaatagcatgggaaaaatcaattatgaaagttgtaagtgtttttatttaagaaatattataactaatttactttgtcctgtttcttccaacctccagatctttcttaattatacattacctattgtcataataatgtatgctatacttgagagtt

SEQ ID NO: 371203 - DNA, 5756 bp, Homo sapiens
  misc_feature (4950)..(4950): n is a, c, g, or t
  misc_feature (5705)..(5705): n is a, c, g, or t
agaagaatcatctcctgcttcaatctgctgctggataggaactaatcagagagagagaagcggaagacggagaaggagggagtcgaaggctttcccgatcacaaatctcacctccactacaactctctttatacttttcttgcagaaataataatagaaataaggaggtggtggggtttccaaaaatcttaaccttcaaccatctggggaaaaggcaaaaatcccatctaccgcaactctcagttcgagagtaaaggtttcccaacagtgatgtcacaagattgaccacattgatcacaatatggagtctggagaacggttaccatcctcagcagcctcctctactacaccaacttcatcttcgacaccttctgtggcttcagtagtttcaaaaggtggcctttccactggagttgcttcacttagctctacaatcaacccatgtggacatttattcagaacagctggggatcaaccgtttaacctgtccacagtgtcgagtgccttcccaatggtcagccacccagtctttggtctacattcagccagctcagggcattcagaatttggtggtttggggacacttggtacacccacagccttagccgcacatccccaactagcatcttttccagcagaatggtggcgaacaactgatgctcatactcgtacaggagcaaccttctttccaccattactgggaattccaccactatttgctcccccagcccagaatcatgattcttcttcattccattcaaggacttcgggaaaaagtaatcgaaatggtcccgaaaaaggtgtaaatgggtcaataaatggaagtaatacatcatctgtaattggtatcaacacatctgtactatccactactgcttcaagttccatgggacaaactaaaagtacaagctcaggtggaggaaatcgaaaatgtaatcaggaacaaagcaaaaaccagcctttggatgctagagttgacaaaatcaaagataagaaaccaaggaagaaagcaatggaaagttctagcaacagtgatagtgattcaggcacatcatcagacacctcaagtgaaggcattagtagcagtgattcagatgatctagaagaagatgaagaagaagaagatcaaagtattgaagaaagtgaagatgatgattctgattcagagagtgaagcacaacataaaagtaacaaccaggtgctattacatggtatttcagacccaaaagcagatggacagaaagcaactgaaaaagcccaggaaaaaagaatacaccagccattacctcttgcgtctgaatcccagactcactcattccaatcccagcagaagcagcctcaggttttgtcacagcagcttccatttattttccaaagctctcaggcaaaggaggaatctgtgaacaaacacaccagtgtaatacagtctacgggattggtgtccaatgtgaaacctttatctttggtaaatcaagccaaaaaggaaacttacatgaaactcatagttccttctcctgatgttcttaaagcagggaataaaaatacctctgaagaatctagtttattgaccagtgaattgagatccaaacgggaacaatataaacaggcattcccatcacagttaaagaaacaagagtcatcgaagagcctgaagaaggttattgcagctttgtcaaatccaaaagcaacctctagttcaccagcacatccaaaacaaacattagaaaacaaccacccaaatccattcttgacaaatgcacttttaggtaatcaccaaccaaatggagttattcaaagtgtcattcaagaagctcctctagcacttactaccaaaactaaaatgcagagcaagattaatgaaaacattgctgctgcaagtagcacccctttttcctcacctgtaaatctgagtacaagtgggagaagaacccctggcaatcagacacctgtaatgccctctgcctctcccatcctgcatagtcaagggaaggaaaaagcagttagcaataatgtaaacccagtaaaaacacagcatcactcccatcctgcaaaatctttagtggaacaattcagaggaacagattcagacattcccagtagtaaagattctgaagattcaaatgaggatgaagaggaagatgatgaagaagaagatgaggaagatgatgaagatgatgaatctgatgacagccaatcaggcacttccaaaagaagaagagtaacagatgaacgtgaactgcgtattccattggaatatggctggcagagagagacaagaataagaaactttggagggcgccttcaaggagaagtagcatattatgctccatgtggaaagaaacttaggcagtaccctgaagtaataaagtatctcagcagaaatggaataatggatatctcaagggacaatttcagcttcagtgcaaaaataagagtgggtgacttctatgaagccagagatggaccgcagggaatgcagtggtgtcttttgaaagaagaggatgtcattcctcgtatcagggcaatggaaggtcgtagaggaagaccaccaaatccagatagacaacgagcaagagaggaatccaggatgagacgtcggaaaggtcgacctccaaatgttggcaatgctgaattcctagataacgcagatgcaaagttgctaagaaaactgcaagctcaagaaatagccaggcaagcagcacaaataaagcttttgagaaaacttcaaaagcaggaacaggctcgggttgctaaagaagccaaaaaacaacaagcaataatggctgctgaggagaagcggaagcaaaaagaacagataaagattatgaaacagcaggaaaaaattaagagaatacagcaaatcagaatggaaaaagaacttcgagctcagcaaattctagaggctaaaaagaaaaagaaggaagaagcggcaaatgccaaattattggaggccgagaaacgaataaaggaaaaagaaatgagaagacaacaagctgttcttctgaaacatcaggaacgagagcgaaggcgacaacacatgatgcttatgaaagctatggaagctcgtaaaaaagcagaagaaaaagagcggttgaaacaagaaaaacgtgatgagaaaagattaaataaagagcgtaaactagagcagcgaagattagaattagaaatggcaaaggaactaaagaagcctaatgaagacatgtgcttagcagaccaaaagcctttgccagagttgcctcgtattccaggacttgttctctctggaagtacattttcagactgtctcatggtggtgcagttcttacgaaactttggtaaagttttgggctttgatgtgaatattgatgttccaaacctgagtgttcttcaagagggattgctaaatataggggacagcatgggtgaagtacaagacttgcttgtgaggctcctctcagctgctgtatgtgatccaggtctaataacaggatacaaggctaaaacagctcttggagaacatttgctgaatgttggtgtgaatcgagacaatgtttccgagattttacagatatttatggaagcccactgtggacaaactgagcttactgaaagtctgaagaccaaagcttttcaggctcacactccagcacagaaagcttcagtcctggctttcctgatcaatgaactggcatgcagcaagagtgtggtcagtgaaatcgacaagaacattgattatatgtcaaacttgaggagagataaatgggtggtagaaggtaaactccgcaagctcagaatcattcatgctaagaaaacaggcaaaagagacacttcaggtggcattgatctgggagaagagcagcatcccttgggcacacccactccaggacgcaagcgaagaaggaagggaggagacagtgattatgacgatgatgatgacgatgacagtgatgaccaaggggatgaagatgatgaggatgaagaagataaagaagacaaaaaaggaaaaaagactgatatctgtgaagatgaggatgaaggtgaccaagcagcaagtgttgaagagctggaaaaacagattgaaaaactgagtaaacaacagagtcagtacagaaggaagctctttgatgcgtctcactcattgcgttcagtgatgtttggccaagatcgttacagacgccggtactggattcttccccaatgtggggggatttttgtagaaggcatggagagtggtgaaggactagaagaaattgcaaaagaaagagaaaaactgaaaaaggcagaaagtgtccagatcaaagaagaaatgtttgagacttctggggacagtttaaattgttcaaatacagatcactgtgaacaaaaggaagatcttaaagaaaaagataacacaaatctattccttcagaaacctggctctttttccaaattaagcaagcttttggaagtagctaagatgcctcctgagtcagaggttatgacccccaaaccaaatgctggtgcaaatgggtgcacgttgtcttatcagaacagtggaaaacattcactgggcagcgttcagtcaacagcaacgcaaagcaatgtggaaaaggcagactctaataatctgtttaatactggttcaagtggtccagggaagttctacagtcctctccccaatgaccagttactaaaaacgctgactgaaaagaatagacaatggtttagtcttttgccacgaacaccctgtgatgacacttcacttactcatgccgatatgtcaactgcttctttggtgactcctcagtctcagccaccatctaagtcaccttcacctaccccagctcctcttggatcttctgctcagaatcctgttggcttaaatccatttgctttatcacctcttcaggtgaaaggtggagtatctatgatgggacttcagttttgtggatggcccactggtgtggttacttctaatattccatttacatnatctgtacctagtctaggatcggggttagggttatcagaaggaaatggtaattcattcttgacttccaatgttgcttcaagtaaaagtgaatctccagtaccacagaatgaaaaggccacttcagctcaacctgcagctgttgaagtagcaaaaccagtagattttcctagtccaaaacctattccagaagaaatgcagtttggttggtggagaattattgacccagaggacctaaaagctttgctcaaagtgctgcatctcagaggaataagagaaaaggcattacaaaaacaaattcagaaacatttggattatattactcaagcctgcctcaagaataaggatgttgctattattgaactgaatgaaaatgaagaaaaccaagtaactcgagatattgtggagaactggtcagtagaagaacaagcaatggaaatggatttgagtgtccttcaacaggtagaagatctagaaaggagagttgcatcagcaagtttgcaagtgaagggttggatgtgtccagagcctgcatcagaaagggaggacttggtatattttgaacataaatcatttactaaattgtgcaaggagcatgatggagaatttactggcgaagacgaaagcagtgcacatgcactagaacggaagagtgacaaccccctagatatagctgtaaccaggctggctgatttggagcggaacattgaaagaaggtatctgaagagccccttaagtaccaccattcagatcaaanaataaatgtttgagacttctggggacaggttattgttctccagatccttgt

SEQ ID NO: 371204 - DNA, 2307 bp, Homo sapiens
ctaatgtcatgttaattatttcatatgttaatgtgtacatgcttctgaagtgtgtgcaaggcattctgcctctagctttgttctttgcagtgtacttgaaatgtgcatttaccccaatagaactgctcacccgtcatgtggtccatatctgtgtaacgaaagatacatagatgtgtatggctactgtatatttgtaagcaagcggaatgttcattactaatataaattaggaattatggtgtgtttaacatcccaataactattattcatggcagagcgttaattttaaatgatttttcatgtattatagtactgccaaatctgtcgaaagggagataatgaagaactgcttcttctttgtgatggctgtgacaaaggctgtcatacctactgccatagacccaagattacaacaatcccagatggagactggttttgtccagcttgcattgctaaggcaagtggtcaaactctaaaaatcaaaaaacttcatgtcaaaggaaaaaagactaatgagtcaaagaaaggcaagaaggtaactttaacaggagatactgaagatgaagactctgcatctacaagtagttcactaaaaagaggaaacaaagacctcaagaaaagaaaaatggaggaaaacacttctattaacttgtcaaaacaagaaagttttacttcagttaagaaacctaaaagagatgactccaaggacctagctctttgcagtatgattctgactgaaatggaaactcatgaggatgcatggccttttctacttcctgtaaacttgaaacttgttcctggttataagaaagttattaagaagcctatggatttttccacaattagagagaaactaagtagtggacagtatccaaaccttgaaacctttgctctagatgtcaggcttgtttttgacaactgtgaaacatttaatgaagatgattctgatataggcagagctggccacaatatgaggaagtattttgaaaaaaagtggacagatactttcaaagtgagctgaagttataataatctctttatttttttccttctaaacaaggacaaatgagaccagcaatgtgaactgtatttacataaacgtgcaaggcacatacataatgactttctttttccttaagtataaaaaaaaagtatcagaagaatgataccatttttaaaggcttcattcctacaacaaccaaggccctcggttattggtttgtgtgatttatcagctaatttaggtagaacagggaagcacacccaaagaattttcaaaggaaagggtgttatagtgcaatagcaattaaaatatatcaaatcgcactgaatactcaacaccagagctctaatgtgggaaatggttctcctttccctctcaataaatatctatttttcatttttttactttgtagtttattttttagtgaatgtatttaattttatgaattatttatgattaaaccacatccagaatcttcgttttctgtgaaaaggaagaactagaaaattgctttaaatcttgaaaatacaaggaatgttttaaaatataaaacaaagccaagttaaactgtttacactgatgtgctataaaagcaccaaaaagaaactttactgtagagttacaagtacatttatatatatatgttgctgcatcacttgtgtagttaaattgtatttcaaaacagtgaaaaaattgacatgtatatactgttcattcttgtttatattaagtcttgttttaaatatgtattatgtgtatatattgtttgcagacattattgttcatgccttagaggattgtagcattttattttcgtctgaaggtaatgatagctatacagtctgtacagtaattatcctctaccaacactgtggcgtctccttaatcttggtagtgcctgcctttgaaacagggtgtaggggatattagttttccatttttctattttgttatataattttaagccaccagggcctaaattaaagtataatcatttgtatccatgtggaataaaattgtgacaatttcctacgcacacagtattttttcatagaaacatttccctcccatttgccttgcctcagaaataaatttaaaagacgtttgtaaccactgtgttttatctactgtgtgttgtggtggcctgttggaggcaaatagatcagattttttttgtacctacgtaagagtacttgaagttttatttaaaataaaatgttgtggaaaaggtagcattctttttttaggagtgttatttttcactatgtgtggcacggatacaataaaagacttttacaaactaa

SEQ ID NO: 371205 - DNA, 211 bp, Homo sapiens
catgcagcaagagtgtggtcaggtgagcatatgcccaggcttttccgtgatttttccattttgaatttttctaatcaaaaagtaatacaaattgattatagaaaattggaaagttacagactagcacaaagaagaaaattaaaattgtacttatctcagtatttagagatggccactaataatattttcatgtatttctttgtagtgtatt

SEQ ID NO: 371206 - DNA, 407 bp, Homo sapiens
tgcaaattcaaacatgttacttccactttcctgctgtaaatcatttgcttgctggagccacactaaaatttgtgctaataactttatttaataagatatgtagttgcccatgttcattttatgtacctgcttgtattaataagtattttattcttataacttggcaaatgattgaacaaattttgaataacaaaatagtctaggtcaaatctaatattgatattaaatatatacagtcataagattattttgaaaattagagagtaagattaatgaaaagcaaaataattcaatgttgctacataattctaagtttattccaacatatataatgattaagaagaatatgtgtacatggttttctttttaaggaaaaagagcggttgaaacaagaaaaacgtgatgag

SEQ ID NO: 371207 - DNA, 7724 bp, Homo sapiens
  misc_feature (4950)..(4950): n is a, c, g, or t
agaagaatcatctcctgcttcaatctgctgctggataggaactaatcagagagagagaagcggaagacggagaaggagggagtcgaaggctttcccgatcacaaatctcacctccactacaactctctttatacttttcttgcagaaataataatagaaataaggaggtggtggggtttccaaaaatcttaaccttcaaccatctggggaaaaggcaaaaatcccatctaccgcaactctcagttcgagagtaaaggtttcccaacagtgatgtcacaagattgaccacattgatcacaatatggagtctggagaacggttaccatcctcagcagcctcctctactacaccaacttcatcttcgacaccttctgtggcttcagtagtttcaaaaggtggcctttccactggagttgcttcacttagctctacaatcaacccatgtggacatttattcagaacagctggggatcaaccgtttaacctgtccacagtgtcgagtgccttcccaatggtcagccacccagtctttggtctacattcagccagctcagggcattcagaatttggtggtttggggacacttggtacacccacagccttagccgcacatccccaactagcatcttttccagcagaatggtggcgaacaactgatgctcatactcgtacaggagcaaccttctttccaccattactgggaattccaccactatttgctcccccagcccagaatcatgattcttcttcattccattcaaggacttcgggaaaaagtaatcgaaatggtcccgaaaaaggtgtaaatgggtcaataaatggaagtaatacatcatctgtaattggtatcaacacatctgtactatccactactgcttcaagttccatgggacaaactaaaagtacaagctcaggtggaggaaatcgaaaatgtaatcaggaacaaagcaaaaaccagcctttggatgctagagttgacaaaatcaaagataagaaaccaaggaagaaagcaatggaaagttctagcaacagtgatagtgattcaggcacatcatcagacacctcaagtgaaggcattagtagcagtgattcagatgatctagaagaagatgaagaagaagaagatcaaagtattgaagaaagtgaagatgatgattctgattcagagagtgaagcacaacataaaagtaacaaccaggtgctattacatggtatttcagacccaaaagcagatggacagaaagcaactgaaaaagcccaggaaaaaagaatacaccagccattacctcttgcgtctgaatcccagactcactcattccaatcccagcagaagcagcctcaggttttgtcacagcagcttccatttattttccaaagctctcaggcaaaggaggaatctgtgaacaaacacaccagtgtaatacagtctacgggattggtgtccaatgtgaaacctttatctttggtaaatcaagccaaaaaggaaacttacatgaaactcatagttccttctcctgatgttcttaaagcagggaataaaaatacctctgaagaatctagtttattgaccagtgaattgagatccaaacgggaacaatataaacaggcattcccatcacagttaaagaaacaagagtcatcgaagagcctgaagaaggttattgcagctttgtcaaatccaaaagcaacctctagttcaccagcacatccaaaacaaacattagaaaacaaccacccaaatccattcttgacaaatgcacttttaggtaatcaccaaccaaatggagttattcaaagtgtcattcaagaagctcctctagcacttactaccaaaactaaaatgcagagcaagattaatgaaaacattgctgctgcaagtagcacccctttttcctcacctgtaaatctgagtacaagtgggagaagaacccctggcaatcagacacctgtaatgccctctgcctctcccatcctgcatagtcaagggaaggaaaaagcagttagcaataatgtaaacccagtaaaaacacagcatcactcccatcctgcaaaatctttagtggaacaattcagaggaacagattcagacattcccagtagtaaagattctgaagattcaaatgaggatgaagaggaagatgatgaagaagaagatgaggaagatgatgaagatgatgaatctgatgacagccaatcaggcacttccaaaagaagaagagtaacagatgaacgtgaactgcgtattccattggaatatggctggcagagagagacaagaataagaaactttggagggcgccttcaaggagaagtagcatattatgctccatgtggaaagaaacttaggcagtaccctgaagtaataaagtatctcagcagaaatggaataatggatatctcaagggacaatttcagcttcagtgcaaaaataagagtgggtgacttctatgaagccagagatggaccgcagggaatgcagtggtgtcttttgaaagaagaggatgtcattcctcgtatcagggcaatggaaggtcgtagaggaagaccaccaaatccagatagacaacgagcaagagaggaatccaggatgagacgtcggaaaggtcgacctccaaatgttggcaatgctgaattcctagataacgcagatgcaaagttgctaagaaaactgcaagctcaagaaatagccaggcaagcagcacaaataaagcttttgagaaaacttcaaaagcaggaacaggctcgggttgctaaagaagccaaaaaacaacaagcaataatggctgctgaggagaagcggaagcaaaaagaacagataaagattatgaaacagcaggaaaaaattaagagaatacagcaaatcagaatggaaaaagaacttcgagctcagcaaattctagaggctaaaaagaaaaagaaggaagaagcggcaaatgccaaattattggaggccgagaaacgaataaaggaaaaagaaatgagaagacaacaagctgttcttctgaaacatcaggaacgagagcgaaggcgacaacacatgatgcttatgaaagctatggaagctcgtaaaaaagcagaagaaaaagagcggttgaaacaagaaaaacgtgatgagaaaagattaaataaagagcgtaaactagagcagcgaagattagaattagaaatggcaaaggaactaaagaagcctaatgaagacatgtgcttagcagaccaaaagcctttgccagagttgcctcgtattccaggacttgttctctctggaagtacattttcagactgtctcatggtggtgcagttcttacgaaactttggtaaagttttgggctttgatgtgaatattgatgttccaaacctgagtgttcttcaagagggattgctaaatataggggacagcatgggtgaagtacaagacttgcttgtgaggctcctctcagctgctgtatgtgatccaggtctaataacaggatacaaggctaaaacagctcttggagaacatttgctgaatgttggtgtgaatcgagacaatgtttccgagattttacagatatttatggaagcccactgtggacaaactgagcttactgaaagtctgaagaccaaagcttttcaggctcacactccagcacagaaagcttcagtcctggctttcctgatcaatgaactggcatgcagcaagagtgtggtcagtgaaatcgacaagaacattgattatatgtcaaacttgaggagagataaatgggtggtagaaggtaaactccgcaagctcagaatcattcatgctaagaaaacaggcaaaagagacacttcaggtggcattgatctgggagaagagcagcatcccttgggcacacccactccaggacgcaagcgaagaaggaagggaggagacagtgattatgacgatgatgatgacgatgacagtgatgaccaaggggatgaagatgatgaggatgaagaagataaagaagacaaaaaaggaaaaaagactgatatctgtgaagatgaggatgaaggtgaccaagcagcaagtgttgaagagctggaaaaacagattgaaaaactgagtaaacaacagagtcagtacagaaggaagctctttgatgcgtctcactcattgcgttcagtgatgtttggccaagatcgttacagacgccggtactggattcttccccaatgtggggggatttttgtagaaggcatggagagtggtgaaggactagaagaaattgcaaaagaaagagaaaaactgaaaaaggcagaaagtgtccagatcaaagaagaaatgtttgagacttctggggacagtttaaattgttcaaatacagatcactgtgaacaaaaggaagatcttaaagaaaaagataacacaaatctattccttcagaaacctggctctttttccaaattaagcaagcttttggaagtagctaagatgcctcctgagtcagaggttatgacccccaaaccaaatgctggtgcaaatgggtgcacgttgtcttatcagaacagtggaaaacattcactgggcagcgttcagtcaacagcaacgcaaagcaatgtggaaaaggcagactctaataatctgtttaatactggttcaagtggtccagggaagttctacagtcctctccccaatgaccagttactaaaaacgctgactgaaaagaatagacaatggtttagtcttttgccacgaacaccctgtgatgacacttcacttactcatgccgatatgtcaactgcttctttggtgactcctcagtctcagccaccatctaagtcaccttcacctaccccagctcctcttggatcttctgctcagaatcctgttggcttaaatccatttgctttatcacctcttcaggtgaaaggtggagtatctatgatgggacttcagttttgtggatggcccactggtgtggttacttctaatattccatttacatnatctgtacctagtctaggatcggggttagggttatcagaaggaaatggtaattcattcttgacttccaatgttgcttcaagtaaaagtgaatctccagtaccacagaatgaaaaggccacttcagctcaacctgcagctgttgaagtagcaaaaccagtagattttcctagtccaaaacctattccagaagaaatgcagtttggttggtggagaattattgacccagaggacctaaaagctttgctcaaagtgctgcatctcagaggaataagagaaaaggcattacaaaaacaaattcagaaacatttggattatattactcaagcctgcctcaagaataaggatgttgctattattgaactgaatgaaaatgaagaaaaccaagtaactcgagatattgtggagaactggtcagtagaagaacaagcaatggaaatggatttgagtgtccttcaacaggtagaagatctagaaaggagagttgcatcagcaagtttgcaagtgaagggttggatgtgtccagagcctgcatcagaaagggaggacttggtatattttgaacataaatcatttactaaattgtgcaaggagcatgatggagaatttactggcgaagacgaaagcagtgcacatgcactagaacggaagagtgacaaccccctagatatagctgtaaccaggctggctgatttggagcggaacattgaaagaagaattgaagaggatattgctccagggctcagggtatggagaagggcattatcagaagctcgcagtgctgcacaggtagctctgtgcattcagcaattacagaaatcaatagcatgggaaaaatcaattatgaaagtttactgccaaatctgtcgaaagggagataatgaagaactgcttcttctttgtgatggctgtgacaaaggctgtcatacctactgccatagacccaagattacaacaatcccagatggagactggttttgtccagcttgcattgctaaggcaagtggtcaaactctaaaaatcaaaaaacttcatgtcaaaggaaaaaagactaatgagtcaaagaaaggcaagaaggtaactttaacaggagatactgaagatgaagactctgcatctacaagtagttcactaaaaagaggaaacaaagacctcaagaaaagaaaaatggaggaaaacacttctattaacttgtcaaaacaagaaagttttacttcagttaagaaacctaaaagagatgactccaaggacctagctctttgcagtatgattctgactgaaatggaaactcatgaggatgcatggccttttctacttcctgtaaacttgaaacttgttcctggttataagaaagttattaagaagcctatggatttttccacaattagagagaaactaagtagtggacagtatccaaaccttgaaacctttgctctagatgtcaggcttgtttttgacaactgtgaaacatttaatgaagatgattctgatataggcagagctggccacaatatgaggaagtattttgaaaaaaagtggacagatactttcaaagtgagctgaagttataataatctctttatttttttccttctaaacaaggacaaatgagaccagcaatgtgaactgtatttacataaacgtgcaaggcacatacataatgactttctttttccttaagtataaaaaaaaagtatcagaagaatgataccatttttaaaggcttcattcctacaacaaccaaggccctcggttattggtttgtgtgatttatcagctaatttaggtagaacagggaagcacacccaaagaattttcaaaggaaagggtgttatagtgcaatagcaattaaaatatatcaaatcgcactgaatactcaacaccagagctctaatgtgggaaatggttctcctttccctctcaataaatatctatttttcatttttttactttgtagtttattttttagtgaatgtatttaattttatgaattatttatgattaaaccacatccagaatcttcgttttctgtgaaaaggaagaactagaaaattgctttaaatcttgaaaatacaaggaatgttttaaaatataaaacaaagccaagttaaactgtttacactgatgtgctataaaagcaccaaaaagaaactttactgtagagttacaagtacatttatatatatatgttgctgcatcacttgtgtagttaaattgtatttcaaaacagtgaaaaaattgacatgtatatactgttcattcttgtttatattaagtcttgttttaaatatgtattatgtgtatatattgtttgcagacattattgttcatgccttagaggattgtagcattttattttcgtctgaaggtaatgatagctatacagtctgtacagtaattatcctctaccaacactgtggcgtctccttaatcttggtagtgcctgcctttgaaacagggtgtaggggatattagttttccatttttctattttgttatataattttaagccaccagggcctaaattaaagtataatcatttgtatccatgtggaataaaattgtgacaatttcctacgcacacagtattttttcatagaaacatttccctcccatttgccttgcctcagaaataaatttaaaagacgtttgtaaccactgtgttttatctactgtgtgttgtggtggcctgttggaggcaaatagatcagattttttttgtacctacgtaagagtacttgaagttttatttaaaataaaatgttgtggaaaaggt

SEQ ID NO: 371208 - DNA, 7916 bp, Homo sapiens
  misc_feature (5142)..(5142): n is a, c, g, or t
agaagaatcatctcctgcttcaatctgctgctggataggaactaatcagagagagagaagcggaagacggagaaggagggagtcgaaggctttcccgatcacaaatctcacctccactacaactctctttatacttttcttgcagaaataataatagaaataaggaggtggtggggtttccaaaaatcttaaccttcaaccatctggggaaaaggcaaaaatcccatctaccgcaactctcagttcgagagtaaaggtttcccaacagtgatgtcacaagattgaccacattgatcacaatatggagtctggagaacggttaccatcctcagcagcctcctctactacaccaacttcatcttcgacaccttctgtggcttcagtagtttcaaaaggtggcctttccactggagttgcttcacttagctctacaatcaacccatgtggacatttattcagaacagctggggatcaaccgtttaacctgtccacagtgtcgagtgccttcccaatggtcagccacccagtctttggtctacattcagccagctcagggcattcagaatttggtggtttggggacacttggtacacccacagccttagccgcacatccccaactagcatcttttccagcagaatggtggcgaacaactgatgctcatactcgtacaggagcaaccttctttccaccattactgggaattccaccactatttgctcccccagcccagaatcatgattcttcttcattccattcaaggacttcgggaaaaagtaatcgaaatggtcccgaaaaaggtgtaaatgggtcaataaatggaagtaatacatcatctgtaattggtatcaacacatctgtactatccactactgcttcaagttccatgggacaaactaaaagtacaagctcaggtggaggaaatcgaaaatgtaatcaggaacaaagcaaaaaccagcctttggatgctagagttgacaaaatcaaagataagaaaccaaggaagaaagcaatggaaagttctagcaacagtgatagtgattcaggcacatcatcagacacctcaagtgaaggcattagtagcagtgattcagatgatctagaagaagatgaagaagaagaagatcaaagtattgaagaaagtgaagatgatgattctgattcagagagtgaagcacaacataaaagtaacaaccaggtgctattacatggtatttcagacccaaaagcagatggacagaaagcaactgaaaaagcccaggaaaaaagaatacaccagccattacctcttgcgtctgaatcccagactcactcattccaatcccagcagaagcagcctcaggttttgtcacagcagcttccatttattttccaaagctctcaggcaaaggaggaatctgtgaacaaacacaccagtgtaatacagtctacgggattggtgtccaatgtgaaacctttatctttggtaaatcaagccaaaaaggaaacttacatgaaactcatagttccttctcctgatgttcttaaagcagggaataaaaatacctctgaagaatctagtttattgaccagtgaattgagatccaaacgggaacaatataaacaggcattcccatcacagttaaagaaacaagagtcatcgaagagcctgaagaaggttattgcagctttgtcaaatccaaaagcaacctctagttcaccagcacatccaaaacaaacattagaaaacaaccacccaaatccattcttgacaaatgcacttttaggtaatcaccaaccaaatggagttattcaaagtgtcattcaagaagctcctctagcacttactaccaaaactaaaatgcagagcaagattaatgaaaacattgctgctgcaagtagcacccctttttcctcacctgtaaatctgagtacaagtgggagaagaacccctggcaatcagacacctgtaatgccctctgcctctcccatcctgcatagtcaagggaaggaaaaagcagttagcaataatgtaaacccagtaaaaacacagcatcactcccatcctgcaaaatctttagtggaacaattcagaggaacagattcagacattcccagtagtaaagattctgaagattcaaatgaggatgaagaggaagatgatgaagaagaagatgaggaagatgatgaagatgatgaatctgatgacagccaatcagaatcagatagtaattcagaatcagatacagaaggatcagaagaagaagatgatgatgataaagaccaagatgaatcagatagtgatactgaaggagagaaaacttcaatgaaactgaataaaacaacttcctctgtcaaaagcccttccatgagtctcacaggtcactcaacacctcgtaacctccacatagcaaaagccccaggctctgctcctgctgccttatgttctgaatcccagtcacctgcttttcttggtacatcttcttccacacttacttcaagcccacactctggcacttccaaaagaagaagagtaacagatgaacgtgaactgcgtattccattggaatatggctggcagagagagacaagaataagaaactttggagggcgccttcaaggagaagtagcatattatgctccatgtggaaagaaacttaggcagtaccctgaagtaataaagggaatgcagtggtgtcttttgaaagaagaggatgtcattcctcgtatcagggcaatggaaggtcgtagaggaagaccaccaaatccagatagacaacgagcaagagaggaatccaggatgagacgtcggaaaggtcgacctccaaatgttggcaatgctgaattcctagataacgcagatgcaaagttgctaagaaaactgcaagctcaagaaatagccaggcaagcagcacaaataaagcttttgagaaaacttcaaaagcaggaacaggctcgggttgctaaagaagccaaaaaacaacaagcaataatggctgctgaggagaagcggaagcaaaaagaacagataaagattatgaaacagcaggaaaaaattaagagaatacagcaaatcagaatggaaaaagaacttcgagctcagcaaattctagaggctaaaaagaaaaagaaggaagaagcggcaaatgccaaattattggaggccgagaaacgaataaaggaaaaagaaatgagaagacaacaagctgttcttctgaaacatcaggaacgagagcgaaggcgacaacacatgatgcttatgaaagctatggaagctcgtaaaaaagcagaagaaaaagagcggttgaaacaagaaaaacgtgatgagaaaagattaaataaagagcgtaaactagagcagcgaagattagaattagaaatggcaaaggaactaaagaagcctaatgaagacatgtgcttagcagaccaaaagcctttgccagagttgcctcgtattccaggacttgttctctctggaagtacattttcagactgtctcatggtggtgcagttcttacgaaactttggtaaagttttgggctttgatgtgaatattgatgttccaaacctgagtgttcttcaagagggattgctaaatataggggacagcatgggtgaagtacaagacttgcttgtgaggctcctctcagctgctgtatgtgatccaggtctaataacaggatacaaggctaaaacagctcttggagaacatttgctgaatgttggtgtgaatcgagacaatgtttccgagattttacagatatttatggaagcccactgtggacaaactgagcttactgaaagtctgaagaccaaagcttttcaggctcacactccagcacagaaagcttcagtcctggctttcctgatcaatgaactggcatgcagcaagagtgtggtcagtgaaatcgacaagaacattgattatatgtcaaacttgaggagagataaatgggtggtagaaggtaaactccgcaagctcagaatcattcatgctaagaaaacaggcaaaagagacacttcaggtggcattgatctgggagaagagcagcatcccttgggcacacccactccaggacgcaagcgaagaaggaagggaggagacagtgattatgacgatgatgatgacgatgacagtgatgaccaaggggatgaagatgatgaggatgaagaagataaagaagacaaaaaaggaaaaaagactgatatctgtgaagatgaggatgaaggtgaccaagcagcaagtgttgaagagctggaaaaacagattgaaaaactgagtaaacaacagagtcagtacagaaggaagctctttgatgcgtctcactcattgcgttcagtgatgtttggccaagatcgttacagacgccggtactggattcttccccaatgtggggggatttttgtagaaggcatggagagtggtgaaggactagaagaaattgcaaaagaaagagaaaaactgaaaaaggcagaaagtgtccagatcaaagaagaaatgtttgagacttctggggacagtttaaattgttcaaatacagatcactgtgaacaaaaggaagatcttaaagaaaaagataacacaaatctattccttcagaaacctggctctttttccaaattaagcaagcttttggaagtagctaagatgcctcctgagtcagaggttatgacccccaaaccaaatgctggtgcaaatgggtgcacgttgtcttatcagaacagtggaaaacattcactgggcagcgttcagtcaacagcaacgcaaagcaatgtggaaaaggcagactctaataatctgtttaatactggttcaagtggtccagggaagttctacagtcctctccccaatgaccagttactaaaaacgctgactgaaaagaatagacaatggtttagtcttttgccacgaacaccctgtgatgacacttcacttactcatgccgatatgtcaactgcttctttggtgactcctcagtctcagccaccatctaagtcaccttcacctaccccagctcctcttggatcttctgctcagaatcctgttggcttaaatccatttgctttatcacctcttcaggtgaaaggtggagtatctatgatgggacttcagttttgtggatggcccactggtgtggttacttctaatattccatttacatnatctgtacctagtctaggatcggggttagggttatcagaaggaaatggtaattcattcttgacttccaatgttgcttcaagtaaaagtgaatctccagtaccacagaatgaaaaggccacttcagctcaacctgcagctgttgaagtagcaaaaccagtagattttcctagtccaaaacctattccagaagaaatgcagtttggttggtggagaattattgacccagaggacctaaaagctttgctcaaagtgctgcatctcagaggaataagagaaaaggcattacaaaaacaaattcagaaacatttggattatattactcaagcctgcctcaagaataaggatgttgctattattgaactgaatgaaaatgaagaaaaccaagtaactcgagatattgtggagaactggtcagtagaagaacaagcaatggaaatggatttgagtgtccttcaacaggtagaagatctagaaaggagagttgcatcagcaagtttgcaagtgaagggttggatgtgtccagagcctgcatcagaaagggaggacttggtatattttgaacataaatcatttactaaattgtgcaaggagcatgatggagaatttactggcgaagacgaaagcagtgcacatgcactagaacggaagagtgacaaccccctagatatagctgtaaccaggctggctgatttggagcggaacattgaaagaagaattgaagaggatattgctccagggctcagggtatggagaagggcattatcagaagctcgcagtgctgcacaggtagctctgtgcattcagcaattacagaaatcaatagcatgggaaaaatcaattatgaaagtttactgccaaatctgtcgaaagggagataatgaagaactgcttcttctttgtgatggctgtgacaaaggctgtcatacctactgccatagacccaagattacaacaatcccagatggagactggttttgtccagcttgcattgctaaggcaagtggtcaaactctaaaaatcaaaaaacttcatgtcaaaggaaaaaagactaatgagtcaaagaaaggcaagaaggtaactttaacaggagatactgaagatgaagactctgcatctacaagtagttcactaaaaagaggaaacaaagacctcaagaaaagaaaaatggaggaaaacacttctattaacttgtcaaaacaagaaagttttacttcagttaagaaacctaaaagagatgactccaaggacctagctctttgcagtatgattctgactgaaatggaaactcatgaggatgcatggccttttctacttcctgtaaacttgaaacttgttcctggttataagaaagttattaagaagcctatggatttttccacaattagagagaaactaagtagtggacagtatccaaaccttgaaacctttgctctagatgtcaggcttgtttttgacaactgtgaaacatttaatgaagatgattctgatataggcagagctggccacaatatgaggaagtattttgaaaaaaagtggacagatactttcaaagtgagctgaagttataataatctctttatttttttccttctaaacaaggacaaatgagaccagcaatgtgaactgtatttacataaacgtgcaaggcacatacataatgactttctttttccttaagtataaaaaaaaagtatcagaagaatgataccatttttaaaggcttcattcctacaacaaccaaggccctcggttattggtttgtgtgatttatcagctaatttaggtagaacagggaagcacacccaaagaattttcaaaggaaagggtgttatagtgcaatagcaattaaaatatatcaaatcgcactgaatactcaacaccagagctctaatgtgggaaatggttctcctttccctctcaataaatatctatttttcatttttttactttgtagtttattttttagtgaatgtatttaattttatgaattatttatgattaaaccacatccagaatcttcgttttctgtgaaaaggaagaactagaaaattgctttaaatcttgaaaatacaaggaatgttttaaaatataaaacaaagccaagttaaactgtttacactgatgtgctataaaagcaccaaaaagaaactttactgtagagttacaagtacatttatatatatatgttgctgcatcacttgtgtagttaaattgtatttcaaaacagtgaaaaaattgacatgtatatactgttcattcttgtttatattaagtcttgttttaaatatgtattatgtgtatatattgtttgcagacattattgttcatgccttagaggattgtagcattttattttcgtctgaaggtaatgatagctatacagtctgtacagtaattatcctctaccaacactgtggcgtctccttaatcttggtagtgcctgcctttgaaacagggtgtaggggatattagttttccatttttctattttgttatataattttaagccaccagggcctaaattaaagtataatcatttgtatccatgtggaataaaattgtgacaatttcctacgcacacagtattttttcatagaaacatttccctcccatttgccttgcctcagaaataaatttaaaagacgtttgtaaccactgtgttttatctactgtgtgttgtggtggcctgttggaggcaaatagatcagattttttttgtacctacgtaagagtacttgaagttttatttaaaataaaatgttgtggaaaaggt

SEQ ID NO: 371209 - DNA, 8279 bp, Homo sapiens
  misc_feature (5505)..(5505): n is a, c, g, or t
agaagaatcatctcctgcttcaatctgctgctggataggaactaatcagagagagagaagcggaagacggagaaggagggagtcgaaggctttcccgatcacaaatctcacctccactacaactctctttatacttttcttgcagaaataataatagaaataaggaggtggtggggtttccaaaaatcttaaccttcaaccatctggggaaaaggcaaaaatcccatctaccgcaactctcagttcgagagtaaaggtgagtttaaaatcctcgggcgtgaggggtgcgggtgaggatgtaaattcccagtgttacaaagccggtggaaacagcagcggagaaactgcgctcgggcaagcgggggactccggagttgctgcgtggaggcgctcgccccgccgccctctcgccctccgccgctgtttatcctcgccggtcggtgcggctctttgttgtggtggccggaaggctggggtggttctcggggtcccgagtggagtttgggggaggaggacacggagatgtgccgtcctgggtgggaggtggggggtgcggcctcaggagaacgtaaactttattcctagaagccggtgcgggacttcgctggagtagggccgtgggttgtgctcccggccgggcaggcgctgccgccgcgagtccgccgcctttgtgccggccgccctggcttcgcgtctccttcctcttccccttcggcttccagcgctcaggtcgccgccaacagttttgcttctgggaaggtctatgtcagcacgcagaaggtttgaggagcattgcttctcatacagtaaggtttcccaacagtgatgtcacaagattgaccacattgatcacaatatggagtctggagaacggttaccatcctcagcagcctcctctactacaccaacttcatcttcgacaccttctgtggcttcagtagtttcaaaaggtggcctttccactggagttgcttcacttagctctacaatcaacccatgtggacatttattcagaacagctggggatcaaccgtttaacctgtccacagtgtcgagtgccttcccaatggtcagccacccagtctttggtctacattcagccagctcagggcattcagaatttggtggtttggggacacttggtacacccacagccttagccgcacatccccaactagcatcttttccagcagaatggtggcgaacaactgatgctcatactcgtacaggagcaaccttctttccaccattactgggaattccaccactatttgctcccccagcccagaatcatgattcttcttcattccattcaaggacttcgggaaaaagtaatcgaaatggtcccgaaaaaggtgtaaatgggtcaataaatggaagtaatacatcatctgtaattggtatcaacacatctgtactatccactactgcttcaagttccatgggacaaactaaaagtacaagctcaggtggaggaaatcgaaaatgtaatcaggaacaaagcaaaaaccagcctttggatgctagagttgacaaaatcaaagataagaaaccaaggaagaaagcaatggaaagttctagcaacagtgatagtgattcaggcacatcatcagacacctcaagtgaaggcattagtagcagtgattcagatgatctagaagaagatgaagaagaagaagatcaaagtattgaagaaagtgaagatgatgattctgattcagagagtgaagcacaacataaaagtaacaaccaggtgctattacatggtatttcagacccaaaagcagatggacagaaagcaactgaaaaagcccaggaaaaaagaatacaccagccattacctcttgcgtctgaatcccagactcactcattccaatcccagcagaagcagcctcaggttttgtcacagcagcttccatttattttccaaagctctcaggcaaaggaggaatctgtgaacaaacacaccagtgtaatacagtctacgggattggtgtccaatgtgaaacctttatctttggtaaatcaagccaaaaaggaaacttacatgaaactcatagttccttctcctgatgttcttaaagcagggaataaaaatacctctgaagaatctagtttattgaccagtgaattgagatccaaacgggaacaatataaacaggcattcccatcacagttaaagaaacaagagtcatcgaagagcctgaagaaggttattgcagctttgtcaaatccaaaagcaacctctagttcaccagcacatccaaaacaaacattagaaaacaaccacccaaatccattcttgacaaatgcacttttaggtaatcaccaaccaaatggagttattcaaagtgtcattcaagaagctcctctagcacttactaccaaaactaaaatgcagagcaagattaatgaaaacattgctgctgcaagtagcacccctttttcctcacctgtaaatctgagtacaagtgggagaagaacccctggcaatcagacacctgtaatgccctctgcctctcccatcctgcatagtcaagggaaggaaaaagcagttagcaataatgtaaacccagtaaaaacacagcatcactcccatcctgcaaaatctttagtggaacaattcagaggaacagattcagacattcccagtagtaaagattctgaagattcaaatgaggatgaagaggaagatgatgaagaagaagatgaggaagatgatgaagatgatgaatctgatgacagccaatcaggcacttccaaaagaagaagagtaacagatgaacgtgaactgcgtattccattggaatatggctggcagagagagacaagaataagaaactttggagggcgccttcaaggagaagtagcatattatgctccatgtggaaagaaacttaggcagtaccctgaagtaataaagtatctcagcagaaatggaataatggatatctcaagggacaatttcagcttcagtgcaaaaataagagtgggtgacttctatgaagccagagatggaccgcagggaatgcagtggtgtcttttgaaagaagaggatgtcattcctcgtatcagggcaatggaaggtcgtagaggaagaccaccaaatccagatagacaacgagcaagagaggaatccaggatgagacgtcggaaaggtcgacctccaaatgttggcaatgctgaattcctagataacgcagatgcaaagttgctaagaaaactgcaagctcaagaaatagccaggcaagcagcacaaataaagcttttgagaaaacttcaaaagcaggaacaggctcgggttgctaaagaagccaaaaaacaacaagcaataatggctgctgaggagaagcggaagcaaaaagaacagataaagattatgaaacagcaggaaaaaattaagagaatacagcaaatcagaatggaaaaagaacttcgagctcagcaaattctagaggctaaaaagaaaaagaaggaagaagcggcaaatgccaaattattggaggccgagaaacgaataaaggaaaaagaaatgagaagacaacaagctgttcttctgaaacatcaggaacgagagcgaaggcgacaacacatgatgcttatgaaagctatggaagctcgtaaaaaagcagaagaaaaagagcggttgaaacaagaaaaacgtgatgagaaaagattaaataaagagcgtaaactagagcagcgaagattagaattagaaatggcaaaggaactaaagaagcctaatgaagacatgtgcttagcagaccaaaagcctttgccagagttgcctcgtattccaggacttgttctctctggaagtacattttcagactgtctcatggtggtgcagttcttacgaaactttggtaaagttttgggctttgatgtgaatattgatgttccaaacctgagtgttcttcaagagggattgctaaatataggggacagcatgggtgaagtacaagacttgcttgtgaggctcctctcagctgctgtatgtgatccaggtctaataacaggatacaaggctaaaacagctcttggagaacatttgctgaatgttggtgtgaatcgagacaatgtttccgagattttacagatatttatggaagcccactgtggacaaactgagcttactgaaagtctgaagaccaaagcttttcaggctcacactccagcacagaaagcttcagtcctggctttcctgatcaatgaactggcatgcagcaagagtgtggtcagtgaaatcgacaagaacattgattatatgtcaaacttgaggagagataaatgggtggtagaaggtaaactccgcaagctcagaatcattcatgctaagaaaacaggcaaaagagacacttcaggtggcattgatctgggagaagagcagcatcccttgggcacacccactccaggacgcaagcgaagaaggaagggaggagacagtgattatgacgatgatgatgacgatgacagtgatgaccaaggggatgaagatgatgaggatgaagaagataaagaagacaaaaaaggaaaaaagactgatatctgtgaagatgaggatgaaggtgaccaagcagcaagtgttgaagagctggaaaaacagattgaaaaactgagtaaacaacagagtcagtacagaaggaagctctttgatgcgtctcactcattgcgttcagtgatgtttggccaagatcgttacagacgccggtactggattcttccccaatgtggggggatttttgtagaaggcatggagagtggtgaaggactagaagaaattgcaaaagaaagagaaaaactgaaaaaggcagaaagtgtccagatcaaagaagaaatgtttgagacttctggggacagtttaaattgttcaaatacagatcactgtgaacaaaaggaagatcttaaagaaaaagataacacaaatctattccttcagaaacctggctctttttccaaattaagcaagcttttggaagtagctaagatgcctcctgagtcagaggttatgacccccaaaccaaatgctggtgcaaatgggtgcacgttgtcttatcagaacagtggaaaacattcactgggcagcgttcagtcaacagcaacgcaaagcaatgtggaaaaggcagactctaataatctgtttaatactggttcaagtggtccagggaagttctacagtcctctccccaatgaccagttactaaaaacgctgactgaaaagaatagacaatggtttagtcttttgccacgaacaccctgtgatgacacttcacttactcatgccgatatgtcaactgcttctttggtgactcctcagtctcagccaccatctaagtcaccttcacctaccccagctcctcttggatcttctgctcagaatcctgttggcttaaatccatttgctttatcacctcttcaggtgaaaggtggagtatctatgatgggacttcagttttgtggatggcccactggtgtggttacttctaatattccatttacatnatctgtacctagtctaggatcggggttagggttatcagaaggaaatggtaattcattcttgacttccaatgttgcttcaagtaaaagtgaatctccagtaccacagaatgaaaaggccacttcagctcaacctgcagctgttgaagtagcaaaaccagtagattttcctagtccaaaacctattccagaagaaatgcagtttggttggtggagaattattgacccagaggacctaaaagctttgctcaaagtgctgcatctcagaggaataagagaaaaggcattacaaaaacaaattcagaaacatttggattatattactcaagcctgcctcaagaataaggatgttgctattattgaactgaatgaaaatgaagaaaaccaagtaactcgagatattgtggagaactggtcagtagaagaacaagcaatggaaatggatttgagtgtccttcaacaggtagaagatctagaaaggagagttgcatcagcaagtttgcaagtgaagggttggatgtgtccagagcctgcatcagaaagggaggacttggtatattttgaacataaatcatttactaaattgtgcaaggagcatgatggagaatttactggcgaagacgaaagcagtgcacatgcactagaacggaagagtgacaaccccctagatatagctgtaaccaggctggctgatttggagcggaacattgaaagaagaattgaagaggatattgctccagggctcagggtatggagaagggcattatcagaagctcgcagtgctgcacaggtagctctgtgcattcagcaattacagaaatcaatagcatgggaaaaatcaattatgaaagtttactgccaaatctgtcgaaagggagataatgaagaactgcttcttctttgtgatggctgtgacaaaggctgtcatacctactgccatagacccaagattacaacaatcccagatggagactggttttgtccagcttgcattgctaaggcaagtggtcaaactctaaaaatcaaaaaacttcatgtcaaaggaaaaaagactaatgagtcaaagaaaggcaagaaggtaactttaacaggagatactgaagatgaagactctgcatctacaagtagttcactaaaaagaggaaacaaagacctcaagaaaagaaaaatggaggaaaacacttctattaacttgtcaaaacaagaaagttttacttcagttaagaaacctaaaagagatgactccaaggacctagctctttgcagtatgattctgactgaaatggaaactcatgaggatgcatggccttttctacttcctgtaaacttgaaacttgttcctggttataagaaagttattaagaagcctatggatttttccacaattagagagaaactaagtagtggacagtatccaaaccttgaaacctttgctctagatgtcaggcttgtttttgacaactgtgaaacatttaatgaagatgattctgatataggcagagctggccacaatatgaggaagtattttgaaaaaaagtggacagatactttcaaagtgagctgaagttataataatctctttatttttttccttctaaacaaggacaaatgagaccagcaatgtgaactgtatttacataaacgtgcaaggcacatacataatgactttctttttccttaagtataaaaaaaaagtatcagaagaatgataccatttttaaaggcttcattcctacaacaaccaaggccctcggttattggtttgtgtgatttatcagctaatttaggtagaacagggaagcacacccaaagaattttcaaaggaaagggtgttatagtgcaatagcaattaaaatatatcaaatcgcactgaatactcaacaccagagctctaatgtgggaaatggttctcctttccctctcaataaatatctatttttcatttttttactttgtagtttattttttagtgaatgtatttaattttatgaattatttatgattaaaccacatccagaatcttcgttttctgtgaaaaggaagaactagaaaattgctttaaatcttgaaaatacaaggaatgttttaaaatataaaacaaagccaagttaaactgtttacactgatgtgctataaaagcaccaaaaagaaactttactgtagagttacaagtacatttatatatatatgttgctgcatcacttgtgtagttaaattgtatttcaaaacagtgaaaaaattgacatgtatatactgttcattcttgtttatattaagtcttgttttaaatatgtattatgtgtatatattgtttgcagacattattgttcatgccttagaggattgtagcattttattttcgtctgaaggtaatgatagctatacagtctgtacagtaattatcctctaccaacactgtggcgtctccttaatcttggtagtgcctgcctttgaaacagggtgtaggggatattagttttccatttttctattttgttatataattttaagccaccagggcctaaattaaagtataatcatttgtatccatgtggaataaaattgtgacaatttcctacgcacacagtattttttcatagaaacatttccctcccatttgccttgcctcagaaataaatttaaaagacgtttgtaaccactgtgttttatctactgtgtgttgtggtggcctgttggaggcaaatagatcagattttttttgtacctacgtaagagtacttgaagttttatttaaaataaaatgttgtggaaaaggt

SEQ ID NO: 371210 - DNA, 7979 bp, Homo sapiens
  misc_feature (5205)..(5205): n is a, c, g, or t
agaagaatcatctcctgcttcaatctgctgctggataggaactaatcagagagagagaagcggaagacggagaaggagggagtcgaaggctttcccgatcacaaatctcacctccactacaactctctttatacttttcttgcagaaataataatagaaataaggaggtggtggggtttccaaaaatcttaaccttcaaccatctggggaaaaggcaaaaatcccatctaccgcaactctcagttcgagagtaaaggtttcccaacagtgatgtcacaagattgaccacattgatcacaatatggagtctggagaacggttaccatcctcagcagcctcctctactacaccaacttcatcttcgacaccttctgtggcttcagtagtttcaaaaggtggcctttccactggagttgcttcacttagctctacaatcaacccatgtggacatttattcagaacagctggggatcaaccgtttaacctgtccacagtgtcgagtgccttcccaatggtcagccacccagtctttggtctacattcagccagctcagggcattcagaatttggtggtttggggacacttggtacacccacagccttagccgcacatccccaactagcatcttttccagcagaatggtggcgaacaactgatgctcatactcgtacaggagcaaccttctttccaccattactgggaattccaccactatttgctcccccagcccagaatcatgattcttcttcattccattcaaggacttcgggaaaaagtaatcgaaatggtcccgaaaaaggtgtaaatgggtcaataaatggaagtaatacatcatctgtaattggtatcaacacatctgtactatccactactgcttcaagttccatgggacaaactaaaagtacaagctcaggtggaggaaatcgaaaatgtaatcaggaacaaagcaaaaaccagcctttggatgctagagttgacaaaatcaaagataagaaaccaaggaagaaagcaatggaaagttctagcaacagtgatagtgattcaggcacatcatcagacacctcaagtgaaggcattagtagcagtgattcagatgatctagaagaagatgaagaagaagaagatcaaagtattgaagaaagtgaagatgatgattctgattcagagagtgaagcacaacataaaagtaacaaccaggtgctattacatggtatttcagacccaaaagcagatggacagaaagcaactgaaaaagcccaggaaaaaagaatacaccagccattacctcttgcgtctgaatcccagactcactcattccaatcccagcagaagcagcctcaggttttgtcacagcagcttccatttattttccaaagctctcaggcaaaggaggaatctgtgaacaaacacaccagtgtaatacagtctacgggattggtgtccaatgtgaaacctttatctttggtaaatcaagccaaaaaggaaacttacatgaaactcatagttccttctcctgatgttcttaaagcagggaataaaaatacctctgaagaatctagtttattgaccagtgaattgagatccaaacgggaacaatataaacaggcattcccatcacagttaaagaaacaagagtcatcgaagagcctgaagaaggttattgcagctttgtcaaatccaaaagcaacctctagttcaccagcacatccaaaacaaacattagaaaacaaccacccaaatccattcttgacaaatgcacttttaggtaatcaccaaccaaatggagttattcaaagtgtcattcaagaagctcctctagcacttactaccaaaactaaaatgcagagcaagattaatgaaaacattgctgctgcaagtagcacccctttttcctcacctgtaaatctgagtacaagtgggagaagaacccctggcaatcagacacctgtaatgccctctgcctctcccatcctgcatagtcaagggaaggaaaaagcagttagcaataatgtaaacccagtaaaaacacagcatcactcccatcctgcaaaatctttagtggaacaattcagaggaacagattcagacattcccagtagtaaagattctgaagattcaaatgaggatgaagaggaagatgatgaagaagaagatgaggaagatgatgaagatgatgaatctgatgacagccaatcagaatcagatagtaattcagaatcagatacagaaggatcagaagaagaagatgatgatgataaagaccaagatgaatcagatagtgatactgaaggagagaaaacttcaatgaaactgaataaaacaacttcctctgtcaaaagcccttccatgagtctcacaggtcactcaacacctcgtaacctccacatagcaaaagccccaggctctgctcctgctgccttatgttctgaatcccagtcacctgcttttcttggcacttccaaaagaagaagagtaacagatgaacgtgaactgcgtattccattggaatatggctggcagagagagacaagaataagaaactttggagggcgccttcaaggagaagtagcatattatgctccatgtggaaagaaacttaggcagtaccctgaagtaataaagtatctcagcagaaatggaataatggatatctcaagggacaatttcagcttcagtgcaaaaataagagtgggtgacttctatgaagccagagatggaccgcagggaatgcagtggtgtcttttgaaagaagaggatgtcattcctcgtatcagggcaatggaaggtcgtagaggaagaccaccaaatccagatagacaacgagcaagagaggaatccaggatgagacgtcggaaaggtcgacctccaaatgttggcaatgctgaattcctagataacgcagatgcaaagttgctaagaaaactgcaagctcaagaaatagccaggcaagcagcacaaataaagcttttgagaaaacttcaaaagcaggaacaggctcgggttgctaaagaagccaaaaaacaacaagcaataatggctgctgaggagaagcggaagcaaaaagaacagataaagattatgaaacagcaggaaaaaattaagagaatacagcaaatcagaatggaaaaagaacttcgagctcagcaaattctagaggctaaaaagaaaaagaaggaagaagcggcaaatgccaaattattggaggccgagaaacgaataaaggaaaaagaaatgagaagacaacaagctgttcttctgaaacatcaggaacgagagcgaaggcgacaacacatgatgcttatgaaagctatggaagctcgtaaaaaagcagaagaaaaagagcggttgaaacaagaaaaacgtgatgagaaaagattaaataaagagcgtaaactagagcagcgaagattagaattagaaatggcaaaggaactaaagaagcctaatgaagacatgtgcttagcagaccaaaagcctttgccagagttgcctcgtattccaggacttgttctctctggaagtacattttcagactgtctcatggtggtgcagttcttacgaaactttggtaaagttttgggctttgatgtgaatattgatgttccaaacctgagtgttcttcaagagggattgctaaatataggggacagcatgggtgaagtacaagacttgcttgtgaggctcctctcagctgctgtatgtgatccaggtctaataacaggatacaaggctaaaacagctcttggagaacatttgctgaatgttggtgtgaatcgagacaatgtttccgagattttacagatatttatggaagcccactgtggacaaactgagcttactgaaagtctgaagaccaaagcttttcaggctcacactccagcacagaaagcttcagtcctggctttcctgatcaatgaactggcatgcagcaagagtgtggtcagtgaaatcgacaagaacattgattatatgtcaaacttgaggagagataaatgggtggtagaaggtaaactccgcaagctcagaatcattcatgctaagaaaacaggcaaaagagacacttcaggtggcattgatctgggagaagagcagcatcccttgggcacacccactccaggacgcaagcgaagaaggaagggaggagacagtgattatgacgatgatgatgacgatgacagtgatgaccaaggggatgaagatgatgaggatgaagaagataaagaagacaaaaaaggaaaaaagactgatatctgtgaagatgaggatgaaggtgaccaagcagcaagtgttgaagagctggaaaaacagattgaaaaactgagtaaacaacagagtcagtacagaaggaagctctttgatgcgtctcactcattgcgttcagtgatgtttggccaagatcgttacagacgccggtactggattcttccccaatgtggggggatttttgtagaaggcatggagagtggtgaaggactagaagaaattgcaaaagaaagagaaaaactgaaaaaggcagaaagtgtccagatcaaagaagaaatgtttgagacttctggggacagtttaaattgttcaaatacagatcactgtgaacaaaaggaagatcttaaagaaaaagataacacaaatctattccttcagaaacctggctctttttccaaattaagcaagcttttggaagtagctaagatgcctcctgagtcagaggttatgacccccaaaccaaatgctggtgcaaatgggtgcacgttgtcttatcagaacagtggaaaacattcactgggcagcgttcagtcaacagcaacgcaaagcaatgtggaaaaggcagactctaataatctgtttaatactggttcaagtggtccagggaagttctacagtcctctccccaatgaccagttactaaaaacgctgactgaaaagaatagacaatggtttagtcttttgccacgaacaccctgtgatgacacttcacttactcatgccgatatgtcaactgcttctttggtgactcctcagtctcagccaccatctaagtcaccttcacctaccccagctcctcttggatcttctgctcagaatcctgttggcttaaatccatttgctttatcacctcttcaggtgaaaggtggagtatctatgatgggacttcagttttgtggatggcccactggtgtggttacttctaatattccatttacatnatctgtacctagtctaggatcggggttagggttatcagaaggaaatggtaattcattcttgacttccaatgttgcttcaagtaaaagtgaatctccagtaccacagaatgaaaaggccacttcagctcaacctgcagctgttgaagtagcaaaaccagtagattttcctagtccaaaacctattccagaagaaatgcagtttggttggtggagaattattgacccagaggacctaaaagctttgctcaaagtgctgcatctcagaggaataagagaaaaggcattacaaaaacaaattcagaaacatttggattatattactcaagcctgcctcaagaataaggatgttgctattattgaactgaatgaaaatgaagaaaaccaagtaactcgagatattgtggagaactggtcagtagaagaacaagcaatggaaatggatttgagtgtccttcaacaggtagaagatctagaaaggagagttgcatcagcaagtttgcaagtgaagggttggatgtgtccagagcctgcatcagaaagggaggacttggtatattttgaacataaatcatttactaaattgtgcaaggagcatgatggagaatttactggcgaagacgaaagcagtgcacatgcactagaacggaagagtgacaaccccctagatatagctgtaaccaggctggctgatttggagcggaacattgaaagaagaattgaagaggatattgctccagggctcagggtatggagaagggcattatcagaagctcgcagtgctgcacaggtagctctgtgcattcagcaattacagaaatcaatagcatgggaaaaatcaattatgaaagtttactgccaaatctgtcgaaagggagataatgaagaactgcttcttctttgtgatggctgtgacaaaggctgtcatacctactgccatagacccaagattacaacaatcccagatggagactggttttgtccagcttgcattgctaaggcaagtggtcaaactctaaaaatcaaaaaacttcatgtcaaaggaaaaaagactaatgagtcaaagaaaggcaagaaggtaactttaacaggagatactgaagatgaagactctgcatctacaagtagttcactaaaaagaggaaacaaagacctcaagaaaagaaaaatggaggaaaacacttctattaacttgtcaaaacaagaaagttttacttcagttaagaaacctaaaagagatgactccaaggacctagctctttgcagtatgattctgactgaaatggaaactcatgaggatgcatggccttttctacttcctgtaaacttgaaacttgttcctggttataagaaagttattaagaagcctatggatttttccacaattagagagaaactaagtagtggacagtatccaaaccttgaaacctttgctctagatgtcaggcttgtttttgacaactgtgaaacatttaatgaagatgattctgatataggcagagctggccacaatatgaggaagtattttgaaaaaaagtggacagatactttcaaagtgagctgaagttataataatctctttatttttttccttctaaacaaggacaaatgagaccagcaatgtgaactgtatttacataaacgtgcaaggcacatacataatgactttctttttccttaagtataaaaaaaaagtatcagaagaatgataccatttttaaaggcttcattcctacaacaaccaaggccctcggttattggtttgtgtgatttatcagctaatttaggtagaacagggaagcacacccaaagaattttcaaaggaaagggtgttatagtgcaatagcaattaaaatatatcaaatcgcactgaatactcaacaccagagctctaatgtgggaaatggttctcctttccctctcaataaatatctatttttcatttttttactttgtagtttattttttagtgaatgtatttaattttatgaattatttatgattaaaccacatccagaatcttcgttttctgtgaaaaggaagaactagaaaattgctttaaatcttgaaaatacaaggaatgttttaaaatataaaacaaagccaagttaaactgtttacactgatgtgctataaaagcaccaaaaagaaactttactgtagagttacaagtacatttatatatatatgttgctgcatcacttgtgtagttaaattgtatttcaaaacagtgaaaaaattgacatgtatatactgttcattcttgtttatattaagtcttgttttaaatatgtattatgtgtatatattgtttgcagacattattgttcatgccttagaggattgtagcattttattttcgtctgaaggtaatgatagctatacagtctgtacagtaattatcctctaccaacactgtggcgtctccttaatcttggtagtgcctgcctttgaaacagggtgtaggggatattagttttccatttttctattttgttatataattttaagccaccagggcctaaattaaagtataatcatttgtatccatgtggaataaaattgtgacaatttcctacgcacacagtattttttcatagaaacatttccctcccatttgccttgcctcagaaataaatttaaaagacgtttgtaaccactgtgttttatctactgtgtgttgtggtggcctgttggaggcaaatagatcagattttttttgtacctacgtaagagtacttgaagttttatttaaaataaaatgttgtggaaaaggt

SEQ ID NO: 371211 - DNA, 4980 bp, Homo sapiens
  misc_feature (2206)..(2206): n is a, c, g, or t
gttgtactgatactttactactatatgtctcttgacaaagatatttatagaagctgaacgaaaaagaatagataaagattatgaaacagcaggaaaaaattaagagaatacagcaaatcagaatggaaaaagaacttcgagctcagcaaattctagaggctaaaaagaaaaagaaggaagaagcggcaaatgccaaattattggaggccgagaaacgaataaaggaaaaagaaatgagaagacaacaagctgttcttctgaaacatcaggaacgagagcgaaggcgacaacacatgatgcttatgaaagctatggaagctcgtaaaaaagcagaagaaaaagagcggttgaaacaagaaaaacgtgatgagaaaagattaaataaagagcgtaaactagagcagcgaagattagaattagaaatggcaaaggaactaaagaagcctaatgaagacatgtgcttagcagaccaaaagcctttgccagagttgcctcgtattccaggacttgttctctctggaagtacattttcagactgtctcatggtggtgcagttcttacgaaactttggtaaagttttgggctttgatgtgaatattgatgttccaaacctgagtgttcttcaagagggattgctaaatataggggacagcatgggtgaagtacaagacttgcttgtgaggctcctctcagctgctgtatgtgatccaggtctaataacaggatacaaggctaaaacagctcttggagaacatttgctgaatgttggtgtgaatcgagacaatgtttccgagattttacagatatttatggaagcccactgtggacaaactgagcttactgaaagtctgaagaccaaagcttttcaggctcacactccagcacagaaagcttcagtcctggctttcctgatcaatgaactggcatgcagcaagagtgtggtcagtgaaatcgacaagaacattgattatatgtcaaacttgaggagagataaatgggtggtagaaggtaaactccgcaagctcagaatcattcatgctaagaaaacaggcaaaagagacacttcaggtggcattgatctgggagaagagcagcatcccttgggcacacccactccaggacgcaagcgaagaaggaagggaggagacagtgattatgacgatgatgatgacgatgacagtgatgaccaaggggatgaagatgatgaggatgaagaagataaagaagacaaaaaaggaaaaaagactgatatctgtgaagatgaggatgaaggtgaccaagcagcaagtgttgaagagctggaaaaacagattgaaaaactgagtaaacaacagagtcagtacagaaggaagctctttgatgcgtctcactcattgcgttcagtgatgtttggccaagatcgttacagacgccggtactggattcttccccaatgtggggggatttttgtagaaggcatggagagtggtgaaggactagaagaaattgcaaaagaaagagaaaaactgaaaaaggcagaaagtgtccagatcaaagaagaaatgtttgagacttctggggacagtttaaattgttcaaatacagatcactgtgaacaaaaggaagatcttaaagaaaaagataacacaaatctattccttcagaaacctggctctttttccaaattaagcaagcttttggaagtagctaagatgcctcctgagtcagaggttatgacccccaaaccaaatgctggtgcaaatgggtgcacgttgtcttatcagaacagtggaaaacattcactgggcagcgttcagtcaacagcaacgcaaagcaatgtggaaaaggcagactctaataatctgtttaatactggttcaagtggtccagggaagttctacagtcctctccccaatgaccagttactaaaaacgctgactgaaaagaatagacaatggtttagtcttttgccacgaacaccctgtgatgacacttcacttactcatgccgatatgtcaactgcttctttggtgactcctcagtctcagccaccatctaagtcaccttcacctaccccagctcctcttggatcttctgctcagaatcctgttggcttaaatccatttgctttatcacctcttcaggtgaaaggtggagtatctatgatgggacttcagttttgtggatggcccactggtgtggttacttctaatattccatttacatnatctgtacctagtctaggatcggggttagggttatcagaaggaaatggtaattcattcttgacttccaatgttgcttcaagtaaaagtgaatctccagtaccacagaatgaaaaggccacttcagctcaacctgcagctgttgaagtagcaaaaccagtagattttcctagtccaaaacctattccagaagaaatgcagtttggttggtggagaattattgacccagaggacctaaaagctttgctcaaagtgctgcatctcagaggaataagagaaaaggcattacaaaaacaaattcagaaacatttggattatattactcaagcctgcctcaagaataaggatgttgctattattgaactgaatgaaaatgaagaaaaccaagtaactcgagatattgtggagaactggtcagtagaagaacaagcaatggaaatggatttgagtgtccttcaacaggtagaagatctagaaaggagagttgcatcagcaagtttgcaagtgaagggttggatgtgtccagagcctgcatcagaaagggaggacttggtatattttgaacataaatcatttactaaattgtgcaaggagcatgatggagaatttactggcgaagacgaaagcagtgcacatgcactagaacggaagagtgacaaccccctagatatagctgtaaccaggctggctgatttggagcggaacattgaaagaagaattgaagaggatattgctccagggctcagggtatggagaagggcattatcagaagctcgcagtgctgcacaggtagctctgtgcattcagcaattacagaaatcaatagcatgggaaaaatcaattatgaaagtttactgccaaatctgtcgaaagggagataatgaagaactgcttcttctttgtgatggctgtgacaaaggctgtcatacctactgccatagacccaagattacaacaatcccagatggagactggttttgtccagcttgcattgctaaggcaagtggtcaaactctaaaaatcaaaaaacttcatgtcaaaggaaaaaagactaatgagtcaaagaaaggcaagaaggtaactttaacaggagatactgaagatgaagactctgcatctacaagtagttcactaaaaagaggaaacaaagacctcaagaaaagaaaaatggaggaaaacacttctattaacttgtcaaaacaagaaagttttacttcagttaagaaacctaaaagagatgactccaaggacctagctctttgcagtatgattctgactgaaatggaaactcatgaggatgcatggccttttctacttcctgtaaacttgaaacttgttcctggttataagaaagttattaagaagcctatggatttttccacaattagagagaaactaagtagtggacagtatccaaaccttgaaacctttgctctagatgtcaggcttgtttttgacaactgtgaaacatttaatgaagatgattctgatataggcagagctggccacaatatgaggaagtattttgaaaaaaagtggacagatactttcaaagtgagctgaagttataataatctctttatttttttccttctaaacaaggacaaatgagaccagcaatgtgaactgtatttacataaacgtgcaaggcacatacataatgactttctttttccttaagtataaaaaaaaagtatcagaagaatgataccatttttaaaggcttcattcctacaacaaccaaggccctcggttattggtttgtgtgatttatcagctaatttaggtagaacagggaagcacacccaaagaattttcaaaggaaagggtgttatagtgcaatagcaattaaaatatatcaaatcgcactgaatactcaacaccagagctctaatgtgggaaatggttctcctttccctctcaataaatatctatttttcatttttttactttgtagtttattttttagtgaatgtatttaattttatgaattatttatgattaaaccacatccagaatcttcgttttctgtgaaaaggaagaactagaaaattgctttaaatcttgaaaatacaaggaatgttttaaaatataaaacaaagccaagttaaactgtttacactgatgtgctataaaagcaccaaaaagaaactttactgtagagttacaagtacatttatatatatatgttgctgcatcacttgtgtagttaaattgtatttcaaaacagtgaaaaaattgacatgtatatactgttcattcttgtttatattaagtcttgttttaaatatgtattatgtgtatatattgtttgcagacattattgttcatgccttagaggattgtagcattttattttcgtctgaaggtaatgatagctatacagtctgtacagtaattatcctctaccaacactgtggcgtctccttaatcttggtagtgcctgcctttgaaacagggtgtaggggatattagttttccatttttctattttgttatataattttaagccaccagggcctaaattaaagtataatcatttgtatccatgtggaataaaattgtgacaatttcctacgcacacagtattttttcatagaaacatttccctcccatttgccttgcctcagaaataaatttaaaagacgtttgtaaccactgtgttttatctactgtgtgttgtggtggcctgttggaggcaaatagatcagattttttttgtacctacgtaagagtacttgaagttttatttaaaataaaatgttgtggaaaaggt

SEQ ID NO: 371212 - DNA, 7725 bp, Homo sapiens
  misc_feature (4878)..(4878): n is a, c, g, or t
agaagaatcatctcctgcttcaatctgctgctggataggaactaatcagagagagagaagcggaagacggagaaggagggagtcgaaggctttcccgatcacaaatctcacctccactacaactctctttatacttttcttgcagaaataataatagaaataaggaggtggtggggtttccaaaaatcttaaccttcaaccatctggggaaaaggcaaaaatcccatctaccgcaactctcagttcgagagtaaaggtttcccaacagtgatgtcacaagattgaccacattgatcacaatatggagtctggagaacggttaccatcctcagcagcctcctctactacaccaacttcatcttcgacaccttctgtggcttcagtagtttcaaaaggtggcctttccactggagttgcttcacttagctctacaatcaacccatgtggacatttattcagaacagctggggatcaaccgtttaacctgtccacagtgtcgagtgccttcccaatggtcagccacccagtctttggtctacattcagccagctcagggcattcagaatttggtggtttggggacacttggtacacccacagccttagccgcacatccccaactagcatcttttccagcagaatggtggcgaacaactgatgctcatactcgtacaggagcaaccttctttccaccattactgggaattccaccactatttgctcccccagcccagaatcatgattcttcttcattccattcaaggacttcgggaaaaagtaatcgaaatggtcccgaaaaaggtgtaaatgggtcaataaatggaagtaatacatcatctgtaattggtatcaacacatctgtactatccactactgcttcaagttccatgggacaaactaaaagtacaagctcaggtggaggaaatcgaaaatgtaatcaggaacaaagcaaaaaccagcctttggatgctagagttgacaaaatcaaagataagaaaccaaggaagaaagcaatggaaagttctagcaacagtgatagtgattcaggcacatcatcagacacctcaagtgaaggcattagtagcagtgattcagatgatctagaagaagatgaagaagaagaagatcaaagtattgaagaaagtgaagatgatgattctgattcagagagtgaagcacaacataaaagtaacaaccaggtgctattacatggtatttcagacccaaaagcagatggacagaaagcaactgaaaaagcccaggaaaaaagaatacaccagccattacctcttgcgtctgaatcccagactcactcattccaatcccagcagaagcagcctcaggttttgtcacagcagcttccatttattttccaaagctctcaggcaaaggaggaatctgtgaacaaacacaccagtgtaatacagtctacgggattggtgtccaatgtgaaacctttatctttggtaaatcaagccaaaaaggaaacttacatgaaactcatagttccttctcctgatgttcttaaagcagggaataaaaatacctctgaagaatctagtttattgaccagtgaattgagatccaaacgggaacaatataaacaggcattcccatcacagttaaagaaacaagagtcatcgaagagcctgaagaaggttattgcagctttgtcaaatccaaaagcaacctctagttcaccagcacatccaaaacaaacattagaaaacaaccacccaaatccattcttgacaaatgcacttttaggtaatcaccaaccaaatggagttattcaaagtgtcattcaagaagctcctctagcacttactaccaaaactaaaatgcagagcaagattaatgaaaacattgctgctgcaagtagcacccctttttcctcacctgtaaatctgagtacaagtgggagaagaacccctggcaatcagacacctgtaatgccctctgcctctcccatcctgcatagtcaagggaaggaaaaagcagttagcaataatgtaaacccagtaaaaacacagcatcactcccatcctgcaaaatctttagtggaacaattcagaggaacagattcagacattcccagtagtaaagattctgaagattcaaatgaggatgaagaggaagatgatgaagaagaagatgaggaagatgatgaagatgatgaatctgatgacagccaatcaggcacttccaaaagaagaagagtaacagatgaacgtgaactgcgtattccattggaatatggctggcagagagagacaagaataagaaactttggagggcgccttcaaggagaagtagcatattatgctccatgtggaaagaaacttaggcagtaccctgaagtaataaagtatctcagcagaaatggaataatggatatctcaagggacaatttcagcttcagtgcaaaaataagagtgggtgacttctatgaagccagagatggaccgcagggaatgcagtggtgtcttttgaaagaagaggatgtcattcctcgtatcagggcaatggaaggtcgtagaggaagaccaccaaatccagatagacaacgagcaagagaggaatccaggatgagacgtcggaaaggtcgacctccaaatgttggcaatgctgaattcctagataacgcagatgcaaagttgctaagaaaactgcaagctcaagaaatagccaggcaagcagcacaaataaagcttttgagaaaacttcaaaagcaggaacaggctcgggttgctaaagaagccaaaaaacaacaagcaataatggctgctgaggagaagcggaagcaaaaagaacagataaagattatgaaacagcaggaaaaaattaagagaatacagcaaatcagaatggaaaaagaacttcgagctcagcaaattctagaggctaaaaagaaaaagaaggaagaagcggcaaatgccaaattattggaggccgagaaacgaataaaggaaaaagaaatgagaagacaacaagctgttcttctgaaacatcaggaacgagagcgaaggcgacaacacatgatgcttatgaaagctatggaagctcgtaaaaaagcagaagaaaaagagcggttgaaacaagaaaaacgtgatgagaaaagattaaataaagagcgtaaactagagcagcgaagattagaattagaaatggcaaaggaactaaagaagcctaatgaagacatgtgcttagcagaccaaaagcctttgccagagttgcctcgtattccaggacttgttctctctggaagtacattttcagactgtctcatggtggtgcagttcttacgaaactttggtaaagttttgggctttgatgtgaatattgatgttccaaacctgagtgttcttcaagagggattgctaaatataggggacagcatgggtgaagtacaagacttgcttgtgaggctcctctcagctgctgtatgtgatccaggtctaataacaggatacaagatatttatggaagcccactgtggacaaactgagcttactgaaagtctgaagaccaaagcttttcaggctcacactccagcacagaaagcttcagtcctggctttcctgatcaatgaactggcatgcagcaagagtgtggtcagtgaaatcgacaagaacattgattatatgtcaaacttgaggagagataaatgggtggtagaaggtaaactccgcaagctcagaatcattcatgctaagaaaacaggcaaaagagacacttcaggtggcattgatctgggagaagagcagcatcccttgggcacacccactccaggacgcaagcgaagaaggaagggaggagacagtgattatgacgatgatgatgacgatgacagtgatgaccaaggggatgaagatgatgaggatgaagaagataaagaagacaaaaaaggaaaaaagactgatatctgtgaagatgaggatgaaggtgaccaagcagcaagtgttgaagagctggaaaaacagattgaaaaactgagtaaacaacagagtcagtacagaaggaagctctttgatgcgtctcactcattgcgttcagtgatgtttggccaagatcgttacagacgccggtactggattcttccccaatgtggggggatttttgtagaaggcatggagagtggtgaaggactagaagaaattgcaaaagaaagagaaaaactgaaaaaggcagaaagtgtccagatcaaagaagaaatgtttgagacttctggggacagtttaaattgttcaaatacagatcactgtgaacaaaaggaagatcttaaagaaaaagataacacaaatctattccttcagaaacctggctctttttccaaattaagcaagcttttggaagtagctaagatgcctcctgagtcagaggttatgacccccaaaccaaatgctggtgcaaatgggtgcacgttgtcttatcagaacagtggaaaacattcactgggcagcgttcagtcaacagcaacgcaaagcaatgtggaaaaggcagactctaataatctgtttaatactggttcaagtggtccagggaagttctacagtcctctccccaatgaccagttactaaaaacgctgactgaaaagaatagacaatggtttagtcttttgccacgaacaccctgtgatgacacttcacttactcatgccgatatgtcaactgcttctttggtgactcctcagtctcagccaccatctaagtcaccttcacctaccccagctcctcttggatcttctgctcagaatcctgttggcttaaatccatttgctttatcacctcttcaggtgaaaggtggagtatctatgatgggacttcagttttgtggatggcccactggtgtggttacttctaatattccatttacatnatctgtacctagtctaggatcggggttagggttatcagaaggaaatggtaattcattcttgacttccaatgttgcttcaagtaaaagtgaatctccagtaccacagaatgaaaaggccacttcagctcaacctgcagctgttgaagtagcaaaaccagtagattttcctagtccaaaacctattccagaagaaatgcagtttggttggtggagaattattgacccagaggacctaaaagctttgctcaaagtgctgcatctcagaggaataagagaaaaggcattacaaaaacaaattcagaaacatttggattatattactcaagcctgcctcaagaataaggatgttgctattattgaactgaatgaaaatgaagaaaaccaagtaactcgagatattgtggagaactggtcagtagaagaacaagcaatggaaatggatttgagtgtccttcaacaggtagaagatctagaaaggagagttgcatcagcaagtttgcaagtgaagggttggatgtgtccagagcctgcatcagaaagggaggacttggtatattttgaacataaatcatttactaaattgtgcaaggagcatgatggagaatttactggcgaagacgaaagcagtgcacatgcactagaacggaagagtgacaaccccctagatatagctgtaaccaggctggctgatttggagcggaacattgaaagaagaattgaagaggatattgctccagggctcagggtatggagaagggcattatcagaagctcgcagtgctgcacaggtagctctgtgcattcagcaattacagaaatcaatagcatgggaaaaatcaattatgaaagtttactgccaaatctgtcgaaagggagataatgaagaactgcttcttctttgtgatggctgtgacaaaggctgtcatacctactgccatagacccaagattacaacaatcccagatggagactggttttgtccagcttgcattgctaaggcaagtggtcaaactctaaaaatcaaaaaacttcatgtcaaaggaaaaaagactaatgagtcaaagaaaggcaagaaggtaactttaacaggagatactgaagatgaagactctgcatctacaagtagttcactaaaaagaggaaacaaagacctcaagaaaagaaaaatggaggaaaacacttctattaacttgtcaaaacaagaaagttttacttcagttaagaaacctaaaagagatgactccaaggacctagctctttgcagtatgattctgactgaaatggaaactcatgaggatgcatggccttttctacttcctgtaaacttgaaacttgttcctggttataagaaagttattaagaagcctatggatttttccacaattagagagaaactaagtagtggacagtatccaaaccttgaaacctttgctctagatgtcaggcttgtttttgacaactgtgaaacatttaatgaagatgattctgatataggcagagctggccacaatatgaggaagtattttgaaaaaaagtggacagatactttcaaagtgagctgaagttataataatctctttatttttttccttctaaacaaggacaaatgagaccagcaatgtgaactgtatttacataaacgtgcaaggcacatacataatgactttctttttccttaagtataaaaaaaaagtatcagaagaatgataccatttttaaaggcttcattcctacaacaaccaaggccctcggttattggtttgtgtgatttatcagctaatttaggtagaacagggaagcacacccaaagaattttcaaaggaaagggtgttatagtgcaatagcaattaaaatatatcaaatcgcactgaatactcaacaccagagctctaatgtgggaaatggttctcctttccctctcaataaatatctatttttcatttttttactttgtagtttattttttagtgaatgtatttaattttatgaattatttatgattaaaccacatccagaatcttcgttttctgtgaaaaggaagaactagaaaattgctttaaatcttgaaaatacaaggaatgttttaaaatataaaacaaagccaagttaaactgtttacactgatgtgctataaaagcaccaaaaagaaactttactgtagagttacaagtacatttatatatatatgttgctgcatcacttgtgtagttaaattgtatttcaaaacagtgaaaaaattgacatgtatatactgttcattcttgtttatattaagtcttgttttaaatatgtattatgtgtatatattgtttgcagacattattgttcatgccttagaggattgtagcattttattttcgtctgaaggtaatgatagctatacagtctgtacagtaattatcctctaccaacactgtggcgtctccttaatcttggtagtgcctgcctttgaaacagggtgtaggggatattagttttccatttttctattttgttatataattttaagccaccagggcctaaattaaagtataatcatttgtatccatgtggaataaaattgtgacaatttcctacgcacacagtattttttcatagaaacatttccctcccatttgccttgcctcagaaataaatttaaaagacgtttgtaaccactgtgttttatctactgtgtgttgtggtggcctgttggaggcaaatagatcagattttttttgtacctacgtaagagtacttgaagttttatttaaaataaaatgttgtggaaaaggtagcattctttttttaggagtgttatttttcactatgtgtggcacggatacaataaaagacttttacaaactaa

SEQ ID NO: 371213 - DNA, 7791 bp, Homo sapiens
  misc_feature (4950)..(4950): n is a, c, g, or t
agaagaatcatctcctgcttcaatctgctgctggataggaactaatcagagagagagaagcggaagacggagaaggagggagtcgaaggctttcccgatcacaaatctcacctccactacaactctctttatacttttcttgcagaaataataatagaaataaggaggtggtggggtttccaaaaatcttaaccttcaaccatctggggaaaaggcaaaaatcccatctaccgcaactctcagttcgagagtaaaggtttcccaacagtgatgtcacaagattgaccacattgatcacaatatggagtctggagaacggttaccatcctcagcagcctcctctactacaccaacttcatcttcgacaccttctgtggcttcagtagtttcaaaaggtggcctttccactggagttgcttcacttagctctacaatcaacccatgtggacatttattcagaacagctggggatcaaccgtttaacctgtccacagtgtcgagtgccttcccaatggtcagccacccagtctttggtctacattcagccagctcagggcattcagaatttggtggtttggggacacttggtacacccacagccttagccgcacatccccaactagcatcttttccagcagaatggtggcgaacaactgatgctcatactcgtacaggagcaaccttctttccaccattactgggaattccaccactatttgctcccccagcccagaatcatgattcttcttcattccattcaaggacttcgggaaaaagtaatcgaaatggtcccgaaaaaggtgtaaatgggtcaataaatggaagtaatacatcatctgtaattggtatcaacacatctgtactatccactactgcttcaagttccatgggacaaactaaaagtacaagctcaggtggaggaaatcgaaaatgtaatcaggaacaaagcaaaaaccagcctttggatgctagagttgacaaaatcaaagataagaaaccaaggaagaaagcaatggaaagttctagcaacagtgatagtgattcaggcacatcatcagacacctcaagtgaaggcattagtagcagtgattcagatgatctagaagaagatgaagaagaagaagatcaaagtattgaagaaagtgaagatgatgattctgattcagagagtgaagcacaacataaaagtaacaaccaggtgctattacatggtatttcagacccaaaagcagatggacagaaagcaactgaaaaagcccaggaaaaaagaatacaccagccattacctcttgcgtctgaatcccagactcactcattccaatcccagcagaagcagcctcaggttttgtcacagcagcttccatttattttccaaagctctcaggcaaaggaggaatctgtgaacaaacacaccagtgtaatacagtctacgggattggtgtccaatgtgaaacctttatctttggtaaatcaagccaaaaaggaaacttacatgaaactcatagttccttctcctgatgttcttaaagcagggaataaaaatacctctgaagaatctagtttattgaccagtgaattgagatccaaacgggaacaatataaacaggcattcccatcacagttaaagaaacaagagtcatcgaagagcctgaagaaggttattgcagctttgtcaaatccaaaagcaacctctagttcaccagcacatccaaaacaaacattagaaaacaaccacccaaatccattcttgacaaatgcacttttaggtaatcaccaaccaaatggagttattcaaagtgtcattcaagaagctcctctagcacttactaccaaaactaaaatgcagagcaagattaatgaaaacattgctgctgcaagtagcacccctttttcctcacctgtaaatctgagtacaagtgggagaagaacccctggcaatcagacacctgtaatgccctctgcctctcccatcctgcatagtcaagggaaggaaaaagcagttagcaataatgtaaacccagtaaaaacacagcatcactcccatcctgcaaaatctttagtggaacaattcagaggaacagattcagacattcccagtagtaaagattctgaagattcaaatgaggatgaagaggaagatgatgaagaagaagatgaggaagatgatgaagatgatgaatctgatgacagccaatcaggcacttccaaaagaagaagagtaacagatgaacgtgaactgcgtattccattggaatatggctggcagagagagacaagaataagaaactttggagggcgccttcaaggagaagtagcatattatgctccatgtggaaagaaacttaggcagtaccctgaagtaataaagtatctcagcagaaatggaataatggatatctcaagggacaatttcagcttcagtgcaaaaataagagtgggtgacttctatgaagccagagatggaccgcagggaatgcagtggtgtcttttgaaagaagaggatgtcattcctcgtatcagggcaatggaaggtcgtagaggaagaccaccaaatccagatagacaacgagcaagagaggaatccaggatgagacgtcggaaaggtcgacctccaaatgttggcaatgctgaattcctagataacgcagatgcaaagttgctaagaaaactgcaagctcaagaaatagccaggcaagcagcacaaataaagcttttgagaaaacttcaaaagcaggaacaggctcgggttgctaaagaagccaaaaaacaacaagcaataatggctgctgaggagaagcggaagcaaaaagaacagataaagattatgaaacagcaggaaaaaattaagagaatacagcaaatcagaatggaaaaagaacttcgagctcagcaaattctagaggctaaaaagaaaaagaaggaagaagcggcaaatgccaaattattggaggccgagaaacgaataaaggaaaaagaaatgagaagacaacaagctgttcttctgaaacatcaggaacgagagcgaaggcgacaacacatgatgcttatgaaagctatggaagctcgtaaaaaagcagaagaaaaagagcggttgaaacaagaaaaacgtgatgagaaaagattaaataaagagcgtaaactagagcagcgaagattagaattagaaatggcaaaggaactaaagaagcctaatgaagacatgtgcttagcagaccaaaagcctttgccagagttgcctcgtattccaggacttgttctctctggaagtacattttcagactgtctcatggtggtgcagttcttacgaaactttggtaaagttttgggctttgatgtgaatattgatgttccaaacctgagtgttcttcaagagggattgctaaatataggggacagcatgggtgaagtacaagacttgcttgtgaggctcctctcagctgctgtatgtgatccaggtctaataacaggatacaaggctaaaacagctcttggagaacatttgctgaatgttggtgtgaatcgagacaatgtttccgagattttacagatatttatggaagcccactgtggacaaactgagcttactgaaagtctgaagaccaaagcttttcaggctcacactccagcacagaaagcttcagtcctggctttcctgatcaatgaactggcatgcagcaagagtgtggtcagtgaaatcgacaagaacattgattatatgtcaaacttgaggagagataaatgggtggtagaaggtaaactccgcaagctcagaatcattcatgctaagaaaacaggcaaaagagacacttcaggtggcattgatctgggagaagagcagcatcccttgggcacacccactccaggacgcaagcgaagaaggaagggaggagacagtgattatgacgatgatgatgacgatgacagtgatgaccaaggggatgaagatgatgaggatgaagaagataaagaagacaaaaaaggaaaaaagactgatatctgtgaagatgaggatgaaggtgaccaagcagcaagtgttgaagagctggaaaaacagattgaaaaactgagtaaacaacagagtcagtacagaaggaagctctttgatgcgtctcactcattgcgttcagtgatgtttggccaagatcgttacagacgccggtactggattcttccccaatgtggggggatttttgtagaaggcatggagagtggtgaaggactagaagaaattgcaaaagaaagagaaaaactgaaaaaggcagaaagtgtccagatcaaagaagaaatgtttgagacttctggggacagtttaaattgttcaaatacagatcactgtgaacaaaaggaagatcttaaagaaaaagataacacaaatctattccttcagaaacctggctctttttccaaattaagcaagcttttggaagtagctaagatgcctcctgagtcagaggttatgacccccaaaccaaatgctggtgcaaatgggtgcacgttgtcttatcagaacagtggaaaacattcactgggcagcgttcagtcaacagcaacgcaaagcaatgtggaaaaggcagactctaataatctgtttaatactggttcaagtggtccagggaagttctacagtcctctccccaatgaccagttactaaaaacgctgactgaaaagaatagacaatggtttagtcttttgccacgaacaccctgtgatgacacttcacttactcatgccgatatgtcaactgcttctttggtgactcctcagtctcagccaccatctaagtcaccttcacctaccccagctcctcttggatcttctgctcagaatcctgttggcttaaatccatttgctttatcacctcttcaggtgaaaggtggagtatctatgatgggacttcagttttgtggatggcccactggtgtggttacttctaatattccatttacatnatctgtacctagtctaggatcggggttagggttatcagaaggaaatggtaattcattcttgacttccaatgttgcttcaagtaaaagtgaatctccagtaccacagaatgaaaaggccacttcagctcaacctgcagctgttgaagtagcaaaaccagtagattttcctagtccaaaacctattccagaagaaatgcagtttggttggtggagaattattgacccagaggacctaaaagctttgctcaaagtgctgcatctcagaggaataagagaaaaggcattacaaaaacaaattcagaaacatttggattatattactcaagcctgcctcaagaataaggatgttgctattattgaactgaatgaaaatgaagaaaaccaagtaactcgagatattgtggagaactggtcagtagaagaacaagcaatggaaatggatttgagtgtccttcaacaggtagaagatctagaaaggagagttgcatcagcaagtttgcaagtgaagggttggatgtgtccagagcctgcatcagaaagggaggacttggtatattttgaacataaatcatttactaaattgtgcaaggagcatgatggagaatttactggcgaagacgaaagcagtgcacatgcactagaacggaagagtgacaaccccctagatatagctgtaaccaggctggctgatttggagcggaacattgaaagaaggtatctgaagagccccttaagtaccaccattcagatcaaactggataatgtgggcacagttactgtccctgctcctgcaccatccgttagtggtgatggtgacggaattgaagaggatattgctccagggctcagggtatggagaagggcattatcagaagctcgcagtgctgcacaggtagctctgtgcattcagcaattacagaaatcaatagcatgggaactgcttcttctttgtgatggctgtgacaaaggctgtcatacctactgccatagacccaagattacaacaatcccagatggagactggttttgtccagcttgcattgctaaggcaagtggtcaaactctaaaaatcaaaaaacttcatgtcaaaggaaaaaagactaatgagtcaaagaaaggcaagaaggtaactttaacaggagatactgaagatgaagactctgcatctacaagtagttcactaaaaagaggaaacaaagacctcaagaaaagaaaaatggaggaaaacacttctattaacttgtcaaaacaagaaagttttacttcagttaagaaacctaaaagagatgactccaaggacctagctctttgcagtatgattctgactgaaatggaaactcatgaggatgcatggccttttctacttcctgtaaacttgaaacttgttcctggttataagaaagttattaagaagcctatggatttttccacaattagagagaaactaagtagtggacagtatccaaaccttgaaacctttgctctagatgtcaggcttgtttttgacaactgtgaaacatttaatgaagatgattctgatataggcagagctggccacaatatgaggaagtattttgaaaaaaagtggacagatactttcaaagtgagctgaagttataataatctctttatttttttccttctaaacaaggacaaatgagaccagcaatgtgaactgtatttacataaacgtgcaaggcacatacataatgactttctttttccttaagtatcaaggccctcggttattggtttgtgtgatttatcagctaatttaggtagaacagggaagcacacccaaagaattttcaaaggaaagggtgttatagtgcaatagcaattaaaatatatcaaatcgcactgaatactcaacaccagagctctaatgtgggaaatggttctcctttccctctcaataaatatctatttttcatttttttactttgtagtttattttttagtgaatgtatttaattttatgaattatttatgattaaaccacatccagaatcttcgttttctgtgaaaaggaagaactagaaaattgctttaaatcttgaaaatacaaggaatgttttaaaatataaaacaaagccaagttaaactgtttacactgatgtgctataaaagcaccaaaaagaaactttactgtagagttacaagtacatttatatatatatgttgctgcatcacttgtgtagttaaattgtatttcaaaacagtgaaaaaattgacatgtatatactgttcattcttgtttatattaagtcttgttttaaatatgtattatgtgtatatattgtttgcagacattattgttcatgccttagaggattgtagcattttattttcgtctgaaggtaatgatagctatacagtctgtacagtaattatcctctaccaacactgtggcgtctccttaatcttggtagtgcctgcctttgaaacagggtgtaggggatattagttttccatttttctattttgttatataattttaagccaccagggcctaaattaaagtataatcatttgtatccatgtggaataaaattgtgacaatttcctacgcacacagtattttttcatagaaacatttccctcccatttgccttgcctcagaaataaatttaaaagacgtttgtaaccactgtgttttatctactgtgtgttgtggtggcctgttggaggcaaatagatcagattttttttgtacctacgtaagagtacttgaagttttatttaaaataaaatgttgtggaaaaggtagcattctttttttaggagtgttatttttcactatgtgtggcacggatacaataaaagacttttacaaactaa

SEQ ID NO: 371214 - DNA, 4701 bp, Homo sapiens
  misc_feature (1854)..(1854): n is a, c, g, or t
cccctttaggccaaccgaggccaaatgttattttttttatggtatctgaatttttctattatgattattttcttttaaaaaattaagctgtttttattttatttgtatttcattttattttcagcctttgccagagttgcctcgtattccaggacttgttctctctggaagtacattttcagactgtctcatggtggtgcagttcttacgaaactttggtaaagttttgggctttgatgtgaatattgatgttccaaacctgagtgttcttcaagagggattgctaaatataggggacagcatgggtgaagtacaagacttgcttgtgaggctcctctcagctgctgtatgtgatccaggtctaataacaggatacaaggctaaaacagctcttggagaacatttgctgaatgttggtgtgaatcgagacaatgtttccgagattttacagatatttatggaagcccactgtggacaaactgagcttactgaaagtctgaagaccaaagcttttcaggctcacactccagcacagaaagcttcagtcctggctttcctgatcaatgaactggcatgcagcaagagtgtggtcagtgaaatcgacaagaacattgattatatgtcaaacttgaggagagataaatgggtggtagaaggtaaactccgcaagctcagaatcattcatgctaagaaaacaggcaaaagagacacttcaggtggcattgatctgggagaagagcagcatcccttgggcacacccactccaggacgcaagcgaagaaggaagggaggagacagtgattatgacgatgatgatgacgatgacagtgatgaccaaggggatgaagatgatgaggatgaagaagataaagaagacaaaaaaggaaaaaagactgatatctgtgaagatgaggatgaaggtgaccaagcagcaagtgttgaagagctggaaaaacagattgaaaaactgagtaaacaacagagtcagtacagaaggaagctctttgatgcgtctcactcattgcgttcagtgatgtttggccaagatcgttacagacgccggtactggattcttccccaatgtggggggatttttgtagaaggcatggagagtggtgaaggactagaagaaattgcaaaagaaagagaaaaactgaaaaaggcagaaagtgtccagatcaaagaagaaatgtttgagacttctggggacagtttaaattgttcaaatacagatcactgtgaacaaaaggaagatcttaaagaaaaagataacacaaatctattccttcagaaacctggctctttttccaaattaagcaagcttttggaagtagctaagatgcctcctgagtcagaggttatgacccccaaaccaaatgctggtgcaaatgggtgcacgttgtcttatcagaacagtggaaaacattcactgggcagcgttcagtcaacagcaacgcaaagcaatgtggaaaaggcagactctaataatctgtttaatactggttcaagtggtccagggaagttctacagtcctctccccaatgaccagttactaaaaacgctgactgaaaagaatagacaatggtttagtcttttgccacgaacaccctgtgatgacacttcacttactcatgccgatatgtcaactgcttctttggtgactcctcagtctcagccaccatctaagtcaccttcacctaccccagctcctcttggatcttctgctcagaatcctgttggcttaaatccatttgctttatcacctcttcaggtgaaaggtggagtatctatgatgggacttcagttttgtggatggcccactggtgtggttacttctaatattccatttacatnatctgtacctagtctaggatcggggttagggttatcagaaggaaatggtaattcattcttgacttccaatgttgcttcaagtaaaagtgaatctccagtaccacagaatgaaaaggccacttcagctcaacctgcagctgttgaagtagcaaaaccagtagattttcctagtccaaaacctattccagaagaaatgcagtttggttggtggagaattattgacccagaggacctaaaagctttgctcaaagtgctgcatctcagaggaataagagaaaaggcattacaaaaacaaattcagaaacatttggattatattactcaagcctgcctcaagaataaggatgttgctattattgaactgaatgaaaatgaagaaaaccaagtaactcgagatattgtggagaactggtcagtagaagaacaagcaatggaaatggatttgagtgtccttcaacaggtagaagatctagaaaggagagttgcatcagcaagtttgcaagtgaagggttggatgtgtccagagcctgcatcagaaagggaggacttggtatattttgaacataaatcatttactaaattgtgcaaggagcatgatggagaatttactggcgaagacgaaagcagtgcacatgcactagaacggaagagtgacaaccccctagatatagctgtaaccaggctggctgatttggagcggaacattgaaagaagaattgaagaggatattgctccagggctcagggtatggagaagggcattatcagaagctcgcagtgctgcacaggtagctctgtgcattcagcaattacagaaatcaatagcatgggaaaaatcaattatgaaagtttactgccaaatctgtcgaaagggagataatgaagaactgcttcttctttgtgatggctgtgacaaaggctgtcatacctactgccatagacccaagattacaacaatcccagatggagactggttttgtccagcttgcattgctaaggcaagtggtcaaactctaaaaatcaaaaaacttcatgtcaaaggaaaaaagactaatgagtcaaagaaaggcaagaaggtaactttaacaggagatactgaagatgaagactctgcatctacaagtagttcactaaaaagaggaaacaaagacctcaagaaaagaaaaatggaggaaaacacttctattaacttgtcaaaacaagaaagttttacttcagttaagaaacctaaaagagatgactccaaggacctagctctttgcagtatgattctgactgaaatggaaactcatgaggatgcatggccttttctacttcctgtaaacttgaaacttgttcctggttataagaaagttattaagaagcctatggatttttccacaattagagagaaactaagtagtggacagtatccaaaccttgaaacctttgctctagatgtcaggcttgtttttgacaactgtgaaacatttaatgaagatgattctgatataggcagagctggccacaatatgaggaagtattttgaaaaaaagtggacagatactttcaaagtgagctgaagttataataatctctttatttttttccttctaaacaaggacaaatgagaccagcaatgtgaactgtatttacataaacgtgcaaggcacatacataatgactttctttttccttaagtataaaaaaaaagtatcagaagaatgataccatttttaaaggcttcattcctacaacaaccaaggccctcggttattggtttgtgtgatttatcagctaatttaggtagaacagggaagcacacccaaagaattttcaaaggaaagggtgttatagtgcaatagcaattaaaatatatcaaatcgcactgaatactcaacaccagagctctaatgtgggaaatggttctcctttccctctcaataaatatctatttttcatttttttactttgtagtttattttttagtgaatgtatttaattttatgaattatttatgattaaaccacatccagaatcttcgttttctgtgaaaaggaagaactagaaaattgctttaaatcttgaaaatacaaggaatgttttaaaatataaaacaaagccaagttaaactgtttacactgatgtgctataaaagcaccaaaaagaaactttactgtagagttacaagtacatttatatatatatgttgctgcatcacttgtgtagttaaattgtatttcaaaacagtgaaaaaattgacatgtatatactgttcattcttgtttatattaagtcttgttttaaatatgtattatgtgtatatattgtttgcagacattattgttcatgccttagaggattgtagcattttattttcgtctgaaggtaatgatagctatacagtctgtacagtaattatcctctaccaacactgtggcgtctccttaatcttggtagtgcctgcctttgaaacagggtgtaggggatattagttttccatttttctattttgttatataattttaagccaccagggcctaaattaaagtataatcatttgtatccatgtggaataaaattgtgacaatttcctacgcacacagtattttttcatagaaacatttccctcccatttgccttgcctcagaaataaatttaaaagacgtttgtaaccactgtgttttatctactgtgtgttgtggtggcctgttggaggcaaatagatcagattttttttgtacctacgtaagagtacttgaagttttatttaaaataaaatgttgtggaaaaggtagcattctttttttaggagtgttatttttcactatgtgtggcacggatacaataaaagacttttacaaactaa

SEQ ID NO: 371215 - DNA, 6820 bp, Homo sapiens
  misc_feature (4950)..(4950): n is a, c, g, or t
agaagaatcatctcctgcttcaatctgctgctggataggaactaatcagagagagagaagcggaagacggagaaggagggagtcgaaggctttcccgatcacaaatctcacctccactacaactctctttatacttttcttgcagaaataataatagaaataaggaggtggtggggtttccaaaaatcttaaccttcaaccatctggggaaaaggcaaaaatcccatctaccgcaactctcagttcgagagtaaaggtttcccaacagtgatgtcacaagattgaccacattgatcacaatatggagtctggagaacggttaccatcctcagcagcctcctctactacaccaacttcatcttcgacaccttctgtggcttcagtagtttcaaaaggtggcctttccactggagttgcttcacttagctctacaatcaacccatgtggacatttattcagaacagctggggatcaaccgtttaacctgtccacagtgtcgagtgccttcccaatggtcagccacccagtctttggtctacattcagccagctcagggcattcagaatttggtggtttggggacacttggtacacccacagccttagccgcacatccccaactagcatcttttccagcagaatggtggcgaacaactgatgctcatactcgtacaggagcaaccttctttccaccattactgggaattccaccactatttgctcccccagcccagaatcatgattcttcttcattccattcaaggacttcgggaaaaagtaatcgaaatggtcccgaaaaaggtgtaaatgggtcaataaatggaagtaatacatcatctgtaattggtatcaacacatctgtactatccactactgcttcaagttccatgggacaaactaaaagtacaagctcaggtggaggaaatcgaaaatgtaatcaggaacaaagcaaaaaccagcctttggatgctagagttgacaaaatcaaagataagaaaccaaggaagaaagcaatggaaagttctagcaacagtgatagtgattcaggcacatcatcagacacctcaagtgaaggcattagtagcagtgattcagatgatctagaagaagatgaagaagaagaagatcaaagtattgaagaaagtgaagatgatgattctgattcagagagtgaagcacaacataaaagtaacaaccaggtgctattacatggtatttcagacccaaaagcagatggacagaaagcaactgaaaaagcccaggaaaaaagaatacaccagccattacctcttgcgtctgaatcccagactcactcattccaatcccagcagaagcagcctcaggttttgtcacagcagcttccatttattttccaaagctctcaggcaaaggaggaatctgtgaacaaacacaccagtgtaatacagtctacgggattggtgtccaatgtgaaacctttatctttggtaaatcaagccaaaaaggaaacttacatgaaactcatagttccttctcctgatgttcttaaagcagggaataaaaatacctctgaagaatctagtttattgaccagtgaattgagatccaaacgggaacaatataaacaggcattcccatcacagttaaagaaacaagagtcatcgaagagcctgaagaaggttattgcagctttgtcaaatccaaaagcaacctctagttcaccagcacatccaaaacaaacattagaaaacaaccacccaaatccattcttgacaaatgcacttttaggtaatcaccaaccaaatggagttattcaaagtgtcattcaagaagctcctctagcacttactaccaaaactaaaatgcagagcaagattaatgaaaacattgctgctgcaagtagcacccctttttcctcacctgtaaatctgagtacaagtgggagaagaacccctggcaatcagacacctgtaatgccctctgcctctcccatcctgcatagtcaagggaaggaaaaagcagttagcaataatgtaaacccagtaaaaacacagcatcactcccatcctgcaaaatctttagtggaacaattcagaggaacagattcagacattcccagtagtaaagattctgaagattcaaatgaggatgaagaggaagatgatgaagaagaagatgaggaagatgatgaagatgatgaatctgatgacagccaatcaggcacttccaaaagaagaagagtaacagatgaacgtgaactgcgtattccattggaatatggctggcagagagagacaagaataagaaactttggagggcgccttcaaggagaagtagcatattatgctccatgtggaaagaaacttaggcagtaccctgaagtaataaagtatctcagcagaaatggaataatggatatctcaagggacaatttcagcttcagtgcaaaaataagagtgggtgacttctatgaagccagagatggaccgcagggaatgcagtggtgtcttttgaaagaagaggatgtcattcctcgtatcagggcaatggaaggtcgtagaggaagaccaccaaatccagatagacaacgagcaagagaggaatccaggatgagacgtcggaaaggtcgacctccaaatgttggcaatgctgaattcctagataacgcagatgcaaagttgctaagaaaactgcaagctcaagaaatagccaggcaagcagcacaaataaagcttttgagaaaacttcaaaagcaggaacaggctcgggttgctaaagaagccaaaaaacaacaagcaataatggctgctgaggagaagcggaagcaaaaagaacagataaagattatgaaacagcaggaaaaaattaagagaatacagcaaatcagaatggaaaaagaacttcgagctcagcaaattctagaggctaaaaagaaaaagaaggaagaagcggcaaatgccaaattattggaggccgagaaacgaataaaggaaaaagaaatgagaagacaacaagctgttcttctgaaacatcaggaacgagagcgaaggcgacaacacatgatgcttatgaaagctatggaagctcgtaaaaaagcagaagaaaaagagcggttgaaacaagaaaaacgtgatgagaaaagattaaataaagagcgtaaactagagcagcgaagattagaattagaaatggcaaaggaactaaagaagcctaatgaagacatgtgcttagcagaccaaaagcctttgccagagttgcctcgtattccaggacttgttctctctggaagtacattttcagactgtctcatggtggtgcagttcttacgaaactttggtaaagttttgggctttgatgtgaatattgatgttccaaacctgagtgttcttcaagagggattgctaaatataggggacagcatgggtgaagtacaagacttgcttgtgaggctcctctcagctgctgtatgtgatccaggtctaataacaggatacaaggctaaaacagctcttggagaacatttgctgaatgttggtgtgaatcgagacaatgtttccgagattttacagatatttatggaagcccactgtggacaaactgagcttactgaaagtctgaagaccaaagcttttcaggctcacactccagcacagaaagcttcagtcctggctttcctgatcaatgaactggcatgcagcaagagtgtggtcagtgaaatcgacaagaacattgattatatgtcaaacttgaggagagataaatgggtggtagaaggtaaactccgcaagctcagaatcattcatgctaagaaaacaggcaaaagagacacttcaggtggcattgatctgggagaagagcagcatcccttgggcacacccactccaggacgcaagcgaagaaggaagggaggagacagtgattatgacgatgatgatgacgatgacagtgatgaccaaggggatgaagatgatgaggatgaagaagataaagaagacaaaaaaggaaaaaagactgatatctgtgaagatgaggatgaaggtgaccaagcagcaagtgttgaagagctggaaaaacagattgaaaaactgagtaaacaacagagtcagtacagaaggaagctctttgatgcgtctcactcattgcgttcagtgatgtttggccaagatcgttacagacgccggtactggattcttccccaatgtggggggatttttgtagaaggcatggagagtggtgaaggactagaagaaattgcaaaagaaagagaaaaactgaaaaaggcagaaagtgtccagatcaaagaagaaatgtttgagacttctggggacagtttaaattgttcaaatacagatcactgtgaacaaaaggaagatcttaaagaaaaagataacacaaatctattccttcagaaacctggctctttttccaaattaagcaagcttttggaagtagctaagatgcctcctgagtcagaggttatgacccccaaaccaaatgctggtgcaaatgggtgcacgttgtcttatcagaacagtggaaaacattcactgggcagcgttcagtcaacagcaacgcaaagcaatgtggaaaaggcagactctaataatctgtttaatactggttcaagtggtccagggaagttctacagtcctctccccaatgaccagttactaaaaacgctgactgaaaagaatagacaatggtttagtcttttgccacgaacaccctgtgatgacacttcacttactcatgccgatatgtcaactgcttctttggtgactcctcagtctcagccaccatctaagtcaccttcacctaccccagctcctcttggatcttctgctcagaatcctgttggcttaaatccatttgctttatcacctcttcaggtgaaaggtggagtatctatgatgggacttcagttttgtggatggcccactggtgtggttacttctaatattccatttacatnatctgtacctagtctaggatcggggttagggttatcagaaggaaatggtaattcattcttgacttccaatgttgcttcaagtaaaagtgaatctccagtaccacagaatgaaaaggccacttcagctcaacctgcagctgttgaagtagcaaaaccagtagattttcctagtccaaaacctattccagaagaaatgcagtttggttggtggagaattattgacccagaggacctaaaagctttgctcaaagtgctgcatctcagaggaataagagaaaaggcattacaaaaacaaattcagaaacatttggattatattactcaagcctgcctcaagaataaggatgttgctattattgaactgaatgaaaatgaagaaaaccaagtaactcgagatattgtggagaactggtcagtagaagaacaagcaatggaaatggatttgagtgtccttcaacaggtagaagatctagaaaggagagttgcatcagcaagtttgcaagtgaagggttggatgtgtccagagcctgcatcagaaagggaggacttggtatattttgaacataaatcatttactaaattgtgcaaggagcatgatggagaatttactggcgaagacgaaagcagtgcacatgcactagaacggaagagtgacaaccccctagatatagctgtaaccaggctggctgatttggagcggaacattgaaagaaggtatctgaagagccccttaagtaccaccattcagatcaaactggataatgtgggcacagttactgtccctgctcctgcaccatccgttagtggtgatggtgacggaattgaagaggatattgctccagggctcagggtatggagaagggcattatcagaagctcgcagtgctgcacaggtagctctgtgcattcagcaattacagaaatcaatagcatgggaactgcttcttctttgtgatggctgtgacaaaggctgtcatacctactgccatagacccaagattacaacaatcccagatggagactggttttgtccagcttgcattgctaaggcaagtggtcaaactctaaaaatcaaaaaacttcatgtcaaaggaaaaaagactaatgagtcaaagaaaggcaagaaggtaactttaacaggagatactgaagatgaagactctgcatctacaagtagttcactaaaaagaggaaacaaagacctcaagaaaagaaaaatggaggaaaacacttctattaacttgtcaaaacaagaaagttttacttcagttaagaaacctaaaagagatgactccaaggacctagctctttgcagtatgattctgactgaaatggaaactcatgaggatgcatggccttttctacttcctgtaaacttgaaacttgttcctggttataagaaagttattaagaagcctatggatttttccacaattagagagaaactaagtagtggacagtatccaaaccttgaaacctttgctctagatgtcaggcttgtttttgacaactgtgaaacatttaatgaagatgattctgatataggcagagctggccacaatatgaggaagtattttgaaaaaaagtggacagatactttcaaaccactatgttatgaggatgctttagcagcccagccctatggagcagccaatagctaccaccagcttaccagccctgtgcctgaggcatcttagaagtggatcctttagcccaagttaaacattcagatgaccggagccccagccaacatctcgactgaaacttcataagcaaccctgagccagaactatccagctaagccactcctgatttcttgacccacaaaaactatgagataataaatgtttattgttggtttaaaaaaatcc

SEQ ID NO: 371216 - DNA, 4070 bp, Homo sapiens
agaagaatcatctcctgcttcaatctgctgctggataggaactaatcagagagagagaagcggaagacggagaaggagggagtcgaaggctttcccgatcacaaatctcacctccactacaactctctttatacttttcttgcagaaataataatagaaataaggaggtggtggggtttccaaaaatcttaaccttcaaccatctggggaaaaggcaaaaatcccatctaccgcaactctcagttcgagagtaaaggtttcccaacagtgatgtcacaagattgaccacattgatcacaatatggagtctggagaacggttaccatcctcagcagcctcctctactacaccaacttcatcttcgacaccttctgtggcttcagtagtttcaaaaggtggcctttccactggagttgcttcacttagctctacaatcaacccatgtggacatttattcagaacagctggggatcaaccgtttaacctgtccacagtgtcgagtgccttcccaatggtcagccacccagtctttggtctacattcagccagctcagggcattcagaatttggtggtttggggacacttggtacacccacagccttagccgcacatccccaactagcatcttttccagcagaatggtggcgaacaactgatgctcatactcgtacaggagcaaccttctttccaccattactgggaattccaccactatttgctcccccagcccagaatcatgattcttcttcattccattcaaggacttcgggaaaaagtaatcgaaatggtcccgaaaaaggtgtaaatgggtcaataaatggaagtaatacatcatctgtaattggtatcaacacatctgtactatccactactgcttcaagttccatgggacaaactaaaagtacaagctcaggtggaggaaatcgaaaatgtaatcaggaacaaagcaaaaaccagcctttggatgctagagttgacaaaatcaaagataagaaaccaaggaagaaagcaatggaaagttctagcaacagtgatagtgattcaggcacatcatcagacacctcaagtgaaggcattagtagcagtgattcagatgatctagaagaagatgaagaagaagaagatcaaagtattgaagaaagtgaagatgatgattctgattcagagagtgaagcacaacataaaagtaacaaccaggtgctattacatggtatttcagacccaaaagcagatggacagaaagcaactgaaaaagcccaggaaaaaagaatacaccagccattacctcttgcgtctgaatcccagactcactcattccaatcccagcagaagcagcctcaggttttgtcacagcagcttccatttattttccaaagctctcaggcaaaggaggaatctgtgaacaaacacaccagtgtaatacagtctacgggattggtgtccaatgtgaaacctttatctttggtaaatcaagccaaaaaggaaacttacatgaaactcatagttccttctcctgatgttcttaaagcagggaataaaaatacctctgaagaatctagtttattgaccagtgaattgagatccaaacgggaacaatataaacaggcattcccatcacagttaaagaaacaagagtcatcgaagagcctgaagaaggttattgcagctttgtcaaatccaaaagcaacctctagttcaccagcacatccaaaacaaacattagaaaacaaccacccaaatccattcttgacaaatgcacttttaggtaatcaccaaccaaatggagttattcaaagtgtcattcaagaagctcctctagcacttactaccaaaactaaaatgcagagcaagattaatgaaaacattgctgctgcaagtagcacccctttttcctcacctgtaaatctgagtacaagtgggagaagaacccctggcaatcagacacctgtaatgccctctgcctctcccatcctgcatagtcaagggaaggaaaaagcagttagcaataatgtaaacccagtaaaaacacagcatcactcccatcctgcaaaatctttagtggaacaattcagaggaacagattcagacattcccagtagtaaagattctgaagattcaaatgaggatgaagaggaagatgatgaagaagaagatgaggaagatgatgaagatgatgaatctgatgacagccaatcaggcacttccaaaagaagaagagtaacagatgaacgtgaactgcgtattccattggaatatggctggcagagagagacaagaataagaaactttggagggcgccttcaaggagaagtagcatattatgctccatgtggaaagaaacttaggcagtaccctgaagtaataaagtatctcagcagaaatggaataatggatatctcaagggacaatttcagcttcagtgcaaaaataagagtgggtgacttctatgaagccagagatggaccgcagggaatgcagtggtgtcttttgaaagaagaggatgtcattcctcgtatcagggcaatggaaggtcgtagaggaagaccaccaaatccagatagacaacgagcaagagaggaatccaggatgagacgtcggaaaggtcgacctccaaatgttggcaatgctgaattcctagataacgcagatgcaaagttgctaagaaaactgcaagctcaagaaatagccaggcaagcagcacaaataaagcttttgagaaaacttcaaaagcaggaacaggctcgggttgctaaagaagccaaaaaacaacaagcaataatggctgctgaggagaagcggaagcaaaaagaacagataaagattatgaaacagcaggaaaaaattaagagaatacagcaaatcagaatggaaaaagaacttcgagctcagcaaattctagaggctaaaaagaaaaagaaggaagaagcggcaaatgccaaattattggaggccgagaaacgaataaaggaaaaagaaatgagaagacaacaagctgttcttctgaaacatcaggaacgagagcgaaggcgacaacacatgatgcttatgaaagctatggaagctcgtaaaaaagcagaagaaaaagagcggttgaaacaagaaaaacgtgatgagaaaagattaaataaagagcgtaaactagagcagcgaagattagaattagaaatggcaaaggaactaaagaagcctaatgaagacatgtgcttagcagaccaaaagcctttgccagagttgcctcgtattccaggacttgttctctctggaagtacattttcagactgtctcatggtggtgcagttcttacgaaactttggtaaagttttgggctttgatgtgaatattgatgttccaaacctgagtgttcttcaagagggattgctaaatataggggacagcatgggtgaagtacaagacttgcttgtgaggctcctctcagctgctgtatgtgatccaggtctaataacaggatacaaggctaaaacagctcttggagaacatttgctgaatgttggtgtgaatcgagacaatgtttccgagattttacagatatttatggaagcccactgtggacaaactgagcttactgaaagtctgaagaccaaagcttttcaggctcacactccagcacagaaagcttcagtcctggctttcctgatcaatgaactggcatgcagcaagagtgtggtcagtgaaatcgacaagaacattgattatatgtcaaacttgaggagagataaatgggtggtagaaggtaaactccgcaagctcagaatcattcatgctaagaaaacaggcaaaagagacacttcaggtggcattgatctgggagaagagcagcatcccttgggcacacccactccaggacgcaagcgaagaaggaagggaggagacagtgattatgacgatgatgatgacgatgacagtgatgaccaaggggatgaagatgatgaggatgaagaagataaagaagacaaaaaaggaaaaaagactgatatctgtgaagatgaggatgaaggtgaccaagcagcagtcttgagacactcggggtcctctagagtcacctcagcat

SEQ ID NO: 371217 - DNA, 312 bp, Homo sapiens
acctgtagctgagactacaagcgtgtgcctctatacctggctaattttttttattttaagtagagatggggtcttgaactcctgagctgaagcgatatccttccaccgtggccttccaaagtaccaggattacaggcatgagccaccacacccagccagattttaacttctcattatatactacgcaaacatatactaaggccagcaggagtatatatatgtgtactgtacttgaatttcacatccattttcttcgacattagcaactgggagatactgaaaggaagtttcaaaatattttagtgtggccag

SEQ ID NO: 371218 - DNA, 382 bp, Homo sapiens
catagtcctaacataaatattttcttttttacttttgagatggagtcttgccctgtcgcccaggctggagtgcagtggtgcaatctcagctcactgcaacctccacctcctggactcaagtgattctcccacctcagcctcccgagtagctggactacaggtgtgcgcccctgtgcccagctaaaaagtattttctatatgtttgatttttttaggagacagtatgccaaattccttaaatttggcagattctcatagtatatgatctcatgctctgaaagagggaaatagaccactggaaaaatggatagttctcagctagtgcattacacgcacatgcatacacacattagaaacaaaagaagcaaaaacgaaaacccaa

SEQ ID NO: 371219 - DNA, 551 bp, Homo sapiens
ttgcacgctggcctgcttgtgggctccctccgaggttcacactgactcctccttcctgtctaccttaatcatgaaaccgaattcatggggttgtattctccccaccctcagctcctcactgttctcagagggatgtgagggaactgaactctggtgccgtgctagggggtaggggcctctccctcactgctggactggagctgggctcctgtagacctgaggggtccctctctctagggtctcctgtagggcttatgactgtgaatccttgatgtcatgattttatgtgacgattcctaggagtccctgcccctagagtaggagcagggctggaccccaagcccctccctcttccatggagagaagagtgatctggcttctcctcggacctctgtgaatatttattctatttatggttcccgggaagttgtttggtgaaggaagcccctccctgggcattttctgcctatgctggaatagctccctcttctggtcctggctcagggggctgggattttgatatattttctaataaaggactttgtctcgca

SEQ ID NO: 371220 - DNA, 1971 bp, Homo sapiens
tggctagtacgaggctgtggttatcggcgagaccccgcccccgcagcgcccgcttccaagatggcggcagcgatgcctgcccggctgttggggtggcggtgacgacaggcagcaaaagaccagctggtcccagattcgctgctggagtgctggatggagcctttctctgccctctgtgacatttccaattttagataatgcctcacatctctgtccccccgggaccccctggagcccccatgatccctaagaagacagcttgaacctagatctcacccccaggatgttgcggaggctgctggagcggccttgcacgctggccctgcttgtgggctcccagctggctgtcatgatgtacctgtcactggggggcttccgaagtctcagtgccctatttggccgagatcagggaccgacatttgactattctcaccctcgtgatgtctacagtaacctcagtcacctgcctggggccccagggggtcctccagctcctcaaggtctgccctactgtccagaacgatctcctctcttagtgggtcctgtgtcggtgtcctttagcccagtgccatcactggcagagattgtggagcggaatccccgggtagaaccagggggccggtaccgccctgcaggttgtgagccccgctcccgaacagccatcattgtgcctcatcgtgcccgggagcaccacctgcgcctgctgctctaccacctgcaccccttcttgcagcgccagcagcttgcttatggcatctatgtcatccaccaggctggaaatggaacatttaacagggcaaaactgttgaacgttggggtgcgagaggccctgcgtgatgaagagtgggactgcctgttcttgcacgatgtggacctcttgccagaaaatgaccacaatctgtatgtgtgtgacccccggggaccccgccatgttgccgttgctatgaacaagtttggatacagcctcccgtacccccagtacttcggaggagtctcagcacttactcctgaccagtacctgaagatgaatggcttccccaatgaatactggggctggggtggtgaggatgacgacattgctaccagggtgcgcctggctgggatgaagatctctcggccccccacatctgtaggacactataagatggtgaagcaccgaggagataagggcaatgaggaaaatccccacagatttgacctcctggtccgtacccagaattcctggacgcaagatgggatgaactcactgacataccagttgctggctcgagagctggggcctctttataccaacatcacagcagacattgggactgaccctcggggtcctcgggctccttctgggccacgttacccacctggttcctcccaagccttccgtcaagagatgctgcaacgccggcccccagccaggcctgggcctctatctactgccaaccacacagccctccgaggttcacactgactcctccttcctgtctaccttaatcatgaaaccgaattcatggggttgtattctccccaccctcagctcctcactgttctcagagggatgtgagggaactgaactctggtgccgtgctagggggtaggggcctctccctcactgctggactggagctgggctcctgtagacctgaggggtccctctctctagggtctcctgtagggcttatgactgtgaatccttgatgtcatgattttatgtgacgattcctaggagtccctgcccctagagtaggagcagggctggaccccaagcccctccctcttccatggagagaagagtgatctggcttctcctcggacctctgtgaatatttattctatttatggttcccgggaagttgtttggtgaaggaagcccctccctgggcattttctgcctatgctggaatagctccctcttctggtcctggctcagggggctgggattttgatatattttctaataaaggactttgtctcgca

SEQ ID NO: 371221 - DNA, 1992 bp, Homo sapiens
tggctagtacgaggctgtggttatcggcgagaccccgcccccgcagcgcccgcttccaagatggcggcagcgatgcctgcccggctgttggggtggcggtgacgacaggcagcaaaagaccagctggtcccagattcgctgctggagtgctggatggagcctttctctgccctctgtgacatttccaattttagataatgcctcacatctctgtccccccgggaccccctggagcccccatgatccctaagaagacagcttgaacctagaattcccctctccctccctagatctcacccccaggatgttgcggaggctgctggagcggccttgcacgctggccctgcttgtgggctcccagctggctgtcatgatgtacctgtcactggggggcttccgaagtctcagtgccctatttggccgagatcagggaccgacatttgactattctcaccctcgtgatgtctacagtaacctcagtcacctgcctggggccccagggggtcctccagctcctcaaggtctgccctactgtccagaacgatctcctctcttagtgggtcctgtgtcggtgtcctttagcccagtgccatcactggcagagattgtggagcggaatccccgggtagaaccagggggccggtaccgccctgcaggttgtgagccccgctcccgaacagccatcattgtgcctcatcgtgcccgggagcaccacctgcgcctgctgctctaccacctgcaccccttcttgcagcgccagcagcttgcttatggcatctatgtcatccaccaggctggaaatggaacatttaacagggcaaaactgttgaacgttggggtgcgagaggccctgcgtgatgaagagtgggactgcctgttcttgcacgatgtggacctcttgccagaaaatgaccacaatctgtatgtgtgtgacccccggggaccccgccatgttgccgttgctatgaacaagtttggatacagcctcccgtacccccagtacttcggaggagtctcagcacttactcctgaccagtacctgaagatgaatggcttccccaatgaatactggggctggggtggtgaggatgacgacattgctaccagggtgcgcctggctgggatgaagatctctcggccccccacatctgtaggacactataagatggtgaagcaccgaggagataagggcaatgaggaaaatccccacagatttgacctcctggtccgtacccagaattcctggacgcaagatgggatgaactcactgacataccagttgctggctcgagagctggggcctctttataccaacatcacagcagacattgggactgaccctcggggtcctcgggctccttctgggccacgttacccacctggttcctcccaagccttccgtcaagagatgctgcaacgccggcccccagccaggcctgggcctctatctactgccaaccacacagccctccgaggttcacactgactcctccttcctgtctaccttaatcatgaaaccgaattcatggggttgtattctccccaccctcagctcctcactgttctcagagggatgtgagggaactgaactctggtgccgtgctagggggtaggggcctctccctcactgctggactggagctgggctcctgtagacctgaggggtccctctctctagggtctcctgtagggcttatgactgtgaatccttgatgtcatgattttatgtgacgattcctaggagtccctgcccctagagtaggagcagggctggaccccaagcccctccctcttccatggagagaagagtgatctggcttctcctcggacctctgtgaatatttattctatttatggttcccgggaagttgtttggtgaaggaagcccctccctgggcattttctgcctatgctggaatagctccctcttctggtcctggctcagggggctgggattttgatatattttctaataaaggactttgtctcgca

SEQ ID NO: 371222 - DNA, 1900 bp, Homo sapiens
tggctagtacgaggctgtggttatcggcgagaccccgcccccgcagcgcccgcttccaagatggcggcagcgatgcctgcccggctgttggggtggcggtgacgacaggcagcaaaagaccagataatgcctcacatctctgtccccccgggaccccctggagcccccatgatccctaagaagacagcttgaacctagatctcacccccaggatgttgcggaggctgctggagcggccttgcacgctggccctgcttgtgggctcccagctggctgtcatgatgtacctgtcactggggggcttccgaagtctcagtgccctatttggccgagatcagggaccgacatttgactattctcaccctcgtgatgtctacagtaacctcagtcacctgcctggggccccagggggtcctccagctcctcaaggtctgccctactgtccagaacgatctcctctcttagtgggtcctgtgtcggtgtcctttagcccagtgccatcactggcagagattgtggagcggaatccccgggtagaaccagggggccggtaccgccctgcaggttgtgagccccgctcccgaacagccatcattgtgcctcatcgtgcccgggagcaccacctgcgcctgctgctctaccacctgcaccccttcttgcagcgccagcagcttgcttatggcatctatgtcatccaccaggctggaaatggaacatttaacagggcaaaactgttgaacgttggggtgcgagaggccctgcgtgatgaagagtgggactgcctgttcttgcacgatgtggacctcttgccagaaaatgaccacaatctgtatgtgtgtgacccccggggaccccgccatgttgccgttgctatgaacaagtttggatacagcctcccgtacccccagtacttcggaggagtctcagcacttactcctgaccagtacctgaagatgaatggcttccccaatgaatactggggctggggtggtgaggatgacgacattgctaccagggtgcgcctggctgggatgaagatctctcggccccccacatctgtaggacactataagatggtgaagcaccgaggagataagggcaatgaggaaaatccccacagatttgacctcctggtccgtacccagaattcctggacgcaagatgggatgaactcactgacataccagttgctggctcgagagctggggcctctttataccaacatcacagcagacattgggactgaccctcggggtcctcgggctccttctgggccacgttacccacctggttcctcccaagccttccgtcaagagatgctgcaacgccggcccccagccaggcctgggcctctatctactgccaaccacacagccctccgaggttcacactgactcctccttcctgtctaccttaatcatgaaaccgaattcatggggttgtattctccccaccctcagctcctcactgttctcagagggatgtgagggaactgaactctggtgccgtgctagggggtaggggcctctccctcactgctggactggagctgggctcctgtagacctgaggggtccctctctctagggtctcctgtagggcttatgactgtgaatccttgatgtcatgattttatgtgacgattcctaggagtccctgcccctagagtaggagcagggctggaccccaagcccctccctcttccatggagagaagagtgatctggcttctcctcggacctctgtgaatatttattctatttatggttcccgggaagttgtttggtgaaggaagcccctccctgggcattttctgcctatgctggaatagctccctcttctggtcctggctcagggggctgggattttgatatattttctaataaaggactttgtctcgca

SEQ ID NO: 371223 - DNA, 1992 bp, Homo sapiens
  misc_feature (1)..(1): n is a, c, g, or t
nccaggctgtaccggccccgggtgttaggccctgactgtctctgcccctgctctccctctccctttctcttcagcagtaaccctcctccccacccccgctagaagaggggaaaggtagaaaagctggtcccagattcgctgctggagtgctggatggagcctttctctgccctctgtgacatttccaattttagataatgcctcacatctctgtccccccgggaccccctggagcccccatgatccctaagaagacagcttgaacctagaattcccctctccctccctagatctcacccccaggatgttgcggaggctgctggagcggccttgcacgctggccctgcttgtgggctcccagctggctgtcatgatgtacctgtcactggggggcttccgaagtctcagtgccctatttggccgagatcagggaccgacatttgactattctcaccctcgtgatgtctacagtaacctcagtcacctgcctggggccccagggggtcctccagctcctcaaggtctgccctactgtccagaacgatctcctctcttagtgggtcctgtgtcggtgtcctttagcccagtgccatcactggcagagattgtggagcggaatccccgggtagaaccagggggccggtaccgccctgcaggttgtgagccccgctcccgaacagccatcattgtgcctcatcgtgcccgggagcaccacctgcgcctgctgctctaccacctgcaccccttcttgcagcgccagcagcttgcttatggcatctatgtcatccaccaggctggaaatggaacatttaacagggcaaaactgttgaacgttggggtgcgagaggccctgcgtgatgaagagtgggactgcctgttcttgcacgatgtggacctcttgccagaaaatgaccacaatctgtatgtgtgtgacccccggggaccccgccatgttgccgttgctatgaacaagtttggatacagcctcccgtacccccagtacttcggaggagtctcagcacttactcctgaccagtacctgaagatgaatggcttccccaatgaatactggggctggggtggtgaggatgacgacattgctaccagggtgcgcctggctgggatgaagatctctcggccccccacatctgtaggacactataagatggtgaagcaccgaggagataagggcaatgaggaaaatccccacagatttgacctcctggtccgtacccagaattcctggacgcaagatgggatgaactcactgacataccagttgctggctcgagagctggggcctctttataccaacatcacagcagacattgggactgaccctcggggtcctcgggctccttctgggccacgttacccacctggttcctcccaagccttccgtcaagagatgctgcaacgccggcccccagccaggcctgggcctctatctactgccaaccacacagccctccgaggttcacactgactcctccttcctgtctaccttaatcatgaaaccgaattcatggggttgtattctccccaccctcagctcctcactgttctcagagggatgtgagggaactgaactctggtgccgtgctagggggtaggggcctctccctcactgctggactggagctgggctcctgtagacctgaggggtccctctctctagggtctcctgtagggcttatgactgtgaatccttgatgtcatgattttatgtgacgattcctaggagtccctgcccctagagtaggagcagggctggaccccaagcccctccctcttccatggagagaagagtgatctggcttctcctcggacctctgtgaatatttattctatttatggttcccgggaagttgtttggtgaaggaagcccctccctgggcattttctgcctatgctggaatagctccctcttctggtcctggctcagggggctgggattttgatatattttctaataaaggactttgtctcgca

SEQ ID NO: 371224 - DNA, 2137 bp, Homo sapiens
taggctaggtacgaggctgggtgtgaatcggccgaggggcagcgatgcctgcccggctgttggggtggcggtgacgacaggcagcaaaagaccagagtaaccctcctccccacccccgctagaagaggggaaaggtagaaaaggtagaggacgccacccccaccctactctccgccgagctccggggctgttcgcttacagcccccaggtggtcacggtccctgcacctgaggagttggcacccaggcacatgaagaatagaaggagcctgtttcctacttcgccctggctggtcccagattcgctgctggagtgctggatggagcctttctctgccctctgtgacatttccaattttagataatgcctcacatctctgtccccccgggaccccctggagcccccatgatccctaagaagacagcttgaacctagatctcacccccaggatgttgcggaggctgctggagcggccttgcacgctggccctgcttgtgggctcccagctggctgtcatgatgtacctgtcactggggggcttccgaagtctcagtgccctatttggccgagatcagggaccgacatttgactattctcaccctcgtgatgtctacagtaacctcagtcacctgcctggggccccagggggtcctccagctcctcaaggtctgccctactgtccagaacgatctcctctcttagtgggtcctgtgtcggtgtcctttagcccagtgccatcactggcagagattgtggagcggaatccccgggtagaaccagggggccggtaccgccctgcaggttgtgagccccgctcccgaacagccatcattgtgcctcatcgtgcccgggagcaccacctgcgcctgctgctctaccacctgcaccccttcttgcagcgccagcagcttgcttatggcatctatgtcatccaccaggctggaaatggaacatttaacagggcaaaactgttgaacgttggggtgcgagaggccctgcgtgatgaagagtgggactgcctgttcttgcacgatgtggacctcttgccagaaaatgaccacaatctgtatgtgtgtgacccccggggaccccgccatgttgccgttgctatgaacaagtttggatacagcctcccgtacccccagtacttcggaggagtctcagcacttactcctgaccagtacctgaagatgaatggcttccccaatgaatactggggctggggtggtgaggatgacgacattgctaccagggtgcgcctggctgggatgaagatctctcggccccccacatctgtaggacactataagatggtgaagcaccgaggagataagggcaatgaggaaaatccccacagatttgacctcctggtccgtacccagaattcctggacgcaagatgggatgaactcactgacataccagttgctggctcgagagctggggcctctttataccaacatcacagcagacattgggactgaccctcggggtcctcgggctccttctgggccacgttacccacctggttcctcccaagccttccgtcaagagatgctgcaacgccggcccccagccaggcctgggcctctatctactgccaaccacacagccctccgaggttcacactgactcctccttcctgtctaccttaatcatgaaaccgaattcatggggttgtattctccccaccctcagctcctcactgttctcagagggatgtgagggaactgaactctggtgccgtgctagggggtaggggcctctccctcactgctggactggagctgggctcctgtagacctgaggggtccctctctctagggtctcctgtagggcttatgactgtgaatccttgatgtcatgattttatgtgacgattcctaggagtccctgcccctagagtaggagcagggctggaccccaagcccctccctcttccatggagagaagagtgatctggcttctcctcggacctctgtgaatatttattctatttatggttcccgggaagttgtttggtgaaggaagcccctccctgggcattttctgcctatgctggaatagctccctcttctggtcctggctcagggggctgggattttgatatattttctaataaaggactttgtctcgca

SEQ ID NO: 371225 - DNA, 2295 bp, Homo sapiens
  misc_feature (15)..(15): n is a, c, g, or t
ggctgtactggtccnacgtcgttaaatagggcagcgatgcctgcccggctgttggggtggcggtgacgacaggcagcaaaagaccagctggtcccagattcgctgctggagtgctggatggagcctttctctgccctctgtgacatttccaattttagataatgcctcacatctctgtccccccgggaccccctggagcccccatgatccctaagaagacagcttgaacctagggtgagtctatctcttcccttctaaaattggaagagggggttctctagagactttctgaaatgaacatgagatttgaatgatgtaaacatttttgggggtgaggactgacagtagatggtgggagtggtttggggggaggtagaggagagcgaaacttgggctgaagtgacaggtggtagggttactggtggttacattctgtttccttgcgtgactgtgcacctgtgtgctcccttctgtgactttgttttctgctttttcctctttacccctggcatcaccttcaaccctacctactgacctctctgctggcttgctctcttcctgcctacccccagaattcccctctccctccctagatctcacccccaggatgttgcggaggctgctggagcggccttgcacgctggccctgcttgtgggctcccagctggctgtcatgatgtacctgtcactggggggcttccgaagtctcagtgccctatttggccgagatcagggaccgacatttgactattctcaccctcgtgatgtctacagtaacctcagtcacctgcctggggccccagggggtcctccagctcctcaaggtctgccctactgtccagaacgatctcctctcttagtgggtcctgtgtcggtgtcctttagcccagtgccatcactggcagagattgtggagcggaatccccgggtagaaccagggggccggtaccgccctgcaggttgtgagccccgctcccgaacagccatcattgtgcctcatcgtgcccgggagcaccacctgcgcctgctgctctaccacctgcaccccttcttgcagcgccagcagcttgcttatggcatctatgtcatccaccaggctggaaatggaacatttaacagggcaaaactgttgaacgttggggtgcgagaggccctgcgtgatgaagagtgggactgcctgttcttgcacgatgtggacctcttgccagaaaatgaccacaatctgtatgtgtgtgacccccggggaccccgccatgttgccgttgctatgaacaagtttggatacagcctcccgtacccccagtacttcggaggagtctcagcacttactcctgaccagtacctgaagatgaatggcttccccaatgaatactggggctggggtggtgaggatgacgacattgctaccagggtgcgcctggctgggatgaagatctctcggccccccacatctgtaggacactataagatggtgaagcaccgaggagataagggcaatgaggaaaatccccacagatttgacctcctggtccgtacccagaattcctggacgcaagatgggatgaactcactgacataccagttgctggctcgagagctggggcctctttataccaacatcacagcagacattgggactgaccctcggggtcctcgggctccttctgggccacgttacccacctggttcctcccaagccttccgtcaagagatgctgcaacgccggcccccagccaggcctgggcctctatctactgccaaccacacagccctccgaggttcacactgactcctccttcctgtctaccttaatcatgaaaccgaattcatggggttgtattctccccaccctcagctcctcactgttctcagagggatgtgagggaactgaactctggtgccgtgctagggggtaggggcctctccctcactgctggactggagctgggctcctgtagacctgaggggtccctctctctagggtctcctgtagggcttatgactgtgaatccttgatgtcatgattttatgtgacgattcctaggagtccctgcccctagagtaggagcagggctggaccccaagcccctccctcttccatggagagaagagtgatctggcttctcctcggacctctgtgaatatttattctatttatggttcccgggaagttgtttggtgaaggaagcccctccctgggcattttctgcctatgctggaatagctccctcttctggtcctggctcagggggctgggattttgatatattttctaataaaggactttgtctcgca

SEQ ID NO: 371226 - DNA, 1946 bp, Homo sapiens
tggctagtacgaggctgtggttatcggcgagaccccgcccccgcagcgcccgcttccaagatggcggcagcgatgcctgcccggctgttggggtggcggtgacgacaggcagcaaaagaccagctggtcccagattcgctgctggagtgctggatggagcctttctctgccctctgtgacatttccaattttagataatgcctcacatctctgtccccccgggaccccctggagcccccatgatccctaagaagacagcttgaacctagatctcacccccaggatgttgcggaggctgctggagcggccttgcacgctggccctgcttgtgggctcccagctggctgtcatgatgtacctgtcactggggggcttccgaagtctcagtgccctatttggccgagatcagggaccgacatttgactattctcaccctcgtgatgtctacagtaacctcagtcacctgcctggggccccagggggtcctccagctcctcaaggtctgccctactgtccagaacgatctcctctcttagtgggtcctgtgtcggtgtcctttagcccagtgccatcactggcagagattgtggagcggaatccccgggtagaaccagggggccggtaccgccctgcaggttgtgagccccgctcccgaacagccatcattgtgcctcatcgtgcccgggagcaccacctgcgcctgctgctctaccacctgcaccccttcttgcagcgccagcagcttgcttatggcatctatgtcatccaccaggctggaaatggaacatttaacagggcaaaactgttgaacgttggggtgcgagaggccctgcgtgatgaagagtgggactgcctgttcttgcacgatgtggacctcttgccagaaaatgaccacaatctgtatgtgtgtgacccccggggaccccgccatgttgccgttgctatgaacaagtttggatacagcctcccgtacccccagtacttcggaggagtctcagcacttactcctgaccagtacctgaagatgaatggcttccccaatgaatactggggctggggtggtgaggatgacgacattgctaccagggtgcgcctggctgggatgaagatctctcggccccccacatctgtaggacactataagatggtgaagcaccgaggagataagggcaatgaggaaaatccccacagaattcctggacgcaagatgggatgaactcactgacataccagttgctggctcgagagctggggcctctttataccaacatcacagcagacattgggactgaccctcggggtcctcgggctccttctgggccacgttacccacctggttcctcccaagccttccgtcaagagatgctgcaacgccggcccccagccaggcctgggcctctatctactgccaaccacacagccctccgaggttcacactgactcctccttcctgtctaccttaatcatgaaaccgaattcatggggttgtattctccccaccctcagctcctcactgttctcagagggatgtgagggaactgaactctggtgccgtgctagggggtaggggcctctccctcactgctggactggagctgggctcctgtagacctgaggggtccctctctctagggtctcctgtagggcttatgactgtgaatccttgatgtcatgattttatgtgacgattcctaggagtccctgcccctagagtaggagcagggctggaccccaagcccctccctcttccatggagagaagagtgatctggcttctcctcggacctctgtgaatatttattctatttatggttcccgggaagttgtttggtgaaggaagcccctccctgggcattttctgcctatgctggaatagctccctcttctggtcctggctcagggggctgggattttgatatattttctaataaaggactttgtctcgca

SEQ ID NO: 371227 - DNA, 1713 bp, Homo sapiens
tggctagtacgaggctgtggttatcggcgagaccccgcccccgcagcgcccgcttccaagatggcggcagcgatgcctgcccggctgttggggtggcggtgacgacaggcagcaaaagaccagctggtcccagattcgctgctggagtgctggatggagcctttctctgccctctgtgacatttccaattttagataatgcctcacatctctgtcccccagggggtcctccagctcctcaaggtctgccctactgtccagaacgatctcctctcttagtgggtcctgtgtcggtgtcctttagcccagtgccatcactggcagagattgtggagcggaatccccgggtagaaccagggggccggtaccgccctgcaggttgtgagccccgctcccgaacagccatcattgtgcctcatcgtgcccgggagcaccacctgcgcctgctgctctaccacctgcaccccttcttgcagcgccagcagcttgcttatggcatctatgtcatccaccaggctggaaatggaacatttaacagggcaaaactgttgaacgttggggtgcgagaggccctgcgtgatgaagagtgggactgcctgttcttgcacgatgtggacctcttgccagaaaatgaccacaatctgtatgtgtgtgacccccggggaccccgccatgttgccgttgctatgaacaagtttggatacagcctcccgtacccccagtacttcggaggagtctcagcacttactcctgaccagtacctgaagatgaatggcttccccaatgaatactggggctggggtggtgaggatgacgacattgctaccagggtgcgcctggctgggatgaagatctctcggccccccacatctgtaggacactataagatggtgaagcaccgaggagataagggcaatgaggaaaatccccacagatttgacctcctggtccgtacccagaattcctggacgcaagatgggatgaactcactgacataccagttgctggctcgagagctggggcctctttataccaacatcacagcagacattgggactgaccctcggggtcctcgggctccttctgggccacgttacccacctggttcctcccaagccttccgtcaagagatgctgcaacgccggcccccagccaggcctgggcctctatctactgccaaccacacagccctccgaggttcacactgactcctccttcctgtctaccttaatcatgaaaccgaattcatggggttgtattctccccaccctcagctcctcactgttctcagagggatgtgagggaactgaactctggtgccgtgctagggggtaggggcctctccctcactgctggactggagctgggctcctgtagacctgaggggtccctctctctagggtctcctgtagggcttatgactgtgaatccttgatgtcatgattttatgtgacgattcctaggagtccctgcccctagagtaggagcagggctggaccccaagcccctccctcttccatggagagaagagtgatctggcttctcctcggacctctgtgaatatttattctatttatggttcccgggaagttgtttggtgaaggaagcccctccctgggcattttctgcctatgctggaatagctccctcttctggtcctggctcagggggctgggattttgatatattttctaataaaggactttgtctcgca

SEQ ID NO: 371228 - DNA, 1892 bp, Homo sapiens
tggctagtacgaggctgtggttatcggcgagaccccgcccccgcagcgcccgcttccaagatggcggcagcgatgcctgcccggctgttggggtggcggtgacgacaggcagcaaaagaccagctggtcccagattcgctgctggagtgctggatggagcctttctctgccctctgtgacatttccaattttagataatgcctcacatctctgtccccccgggaccccctggagcccccatgatccctaagaagacagcttgaacctagatctcacccccaggatgttgcggaggctgctggagcggccttgcacgctggccctgcttgtgggctcccagctggctgtcatgatgtacctgtcactggggggcttccgaagtctcagtgccctatttggccgagatcagggaccgacatttgactattctcaccctcgtgatgtctacagtaacctcagtcacctgcctggggccccagggggtcctccagctcctcaaggtctgccctactgtccagaacgatctcctctcttagtgggtcctgtgtcggtgtcctttagcccagtgccatcactggcagagattgtggagcggaatccccgggtagaaccagggggccgctgctgctctaccacctgcaccccttcttgcagcgccagcagcttgcttatggcatctatgtcatccaccaggctggaaatggaacatttaacagggcaaaactgttgaacgttggggtgcgagaggccctgcgtgatgaagagtgggactgcctgttcttgcacgatgtggacctcttgccagaaaatgaccacaatctgtatgtgtgtgacccccggggaccccgccatgttgccgttgctatgaacaagtttggatacagcctcccgtacccccagtacttcggaggagtctcagcacttactcctgaccagtacctgaagatgaatggcttccccaatgaatactggggctggggtggtgaggatgacgacattgctaccagggtgcgcctggctgggatgaagatctctcggccccccacatctgtaggacactataagatggtgaagcaccgaggagataagggcaatgaggaaaatccccacagatttgacctcctggtccgtacccagaattcctggacgcaagatgggatgaactcactgacataccagttgctggctcgagagctggggcctctttataccaacatcacagcagacattgggactgaccctcggggtcctcgggctccttctgggccacgttacccacctggttcctcccaagccttccgtcaagagatgctgcaacgccggcccccagccaggcctgggcctctatctactgccaaccacacagccctccgaggttcacactgactcctccttcctgtctaccttaatcatgaaaccgaattcatggggttgtattctccccaccctcagctcctcactgttctcagagggatgtgagggaactgaactctggtgccgtgctagggggtaggggcctctccctcactgctggactggagctgggctcctgtagacctgaggggtccctctctctagggtctcctgtagggcttatgactgtgaatccttgatgtcatgattttatgtgacgattcctaggagtccctgcccctagagtaggagcagggctggaccccaagcccctccctcttccatggagagaagagtgatctggcttctcctcggacctctgtgaatatttattctatttatggttcccgggaagttgtttggtgaaggaagcccctccctgggcattttctgcctatgctggaatagctccctcttctggtcctggctcagggggctgggattttgatatattttctaataaaggactttgtctcgca

SEQ ID NO: 371229 - DNA, 1867 bp, Homo sapiens
tggctagtacgaggctgtggttatcggcgagaccccgcccccgcagcgcccgcttccaagatggcggcagcgatgcctgcccggctgttggggtggcggtgacgacaggcagcaaaagaccagctggtcccagattcgctgctggagtgctggatggagcctttctctgccctctgtgacatttccaattttagataatgcctcacatctctgtccccccgggaccccctggagcccccatgatccctaagaagacagcttgaacctagatctcacccccaggatgttgcggaggctgctggagcggccttgcacgctggccctgcttgtgggctcccagctggctgtcatgatgtacctgtcactggggggcttccgaagtctcagtgccctatttggccgagatcagggaccgacatttgactattctcaccctcgtgatgtctacagtaacctcagtcacctgcctggggccccagggggtcctccagctcctcaaggtctgccctactgtccagaacgatctcctctcttagtgggtcctgtgtcggtgtcctttagcccagtgccatcactggcagagattgtggagcggaatccccgggtagaaccagggggccgctgctgctctaccacctgcaccccttcttgcagcgccagcagcttgcttatggcatctatgtcatccaccaggctggaaatggaacatttaacagggcaaaactgttgaacgttggggtgcgagaggccctgcgtgatgaagagtgggactgcctgttcttgcacgatgtggacctcttgccagaaaatgaccacaatctgtatgtgtgtgacccccggggaccccgccatgttgccgttgctatgaacaagtttggatacagcctcccgtacccccagtacttcggaggagtctcagcacttactcctgaccagtacctgaagatgaatggcttccccaatgaatactggggctggggtggtgaggatgacgacattgctaccagggtgcgcctggctgggatgaagatctctcggccccccacatctgtaggacactataagatggtgaagcaccgaggagataagggcaatgaggaaaatccccacagaattcctggacgcaagatgggatgaactcactgacataccagttgctggctcgagagctggggcctctttataccaacatcacagcagacattgggactgaccctcggggtcctcgggctccttctgggccacgttacccacctggttcctcccaagccttccgtcaagagatgctgcaacgccggcccccagccaggcctgggcctctatctactgccaaccacacagccctccgaggttcacactgactcctccttcctgtctaccttaatcatgaaaccgaattcatggggttgtattctccccaccctcagctcctcactgttctcagagggatgtgagggaactgaactctggtgccgtgctagggggtaggggcctctccctcactgctggactggagctgggctcctgtagacctgaggggtccctctctctagggtctcctgtagggcttatgactgtgaatccttgatgtcatgattttatgtgacgattcctaggagtccctgcccctagagtaggagcagggctggaccccaagcccctccctcttccatggagagaagagtgatctggcttctcctcggacctctgtgaatatttattctatttatggttcccgggaagttgtttggtgaaggaagcccctccctgggcattttctgcctatgctggaatagctccctcttctggtcctggctcagggggctgggattttgatatattttctaataaaggactttgtctcgca

SEQ ID NO: 371230 - DNA, 1422 bp, Homo sapiens
aagggaattcgtgctggtgctaagggaattcgtgctggtgctaagggaattcgtgctggtgctaagggaattgtaccgccctgcaggttgtgagccccgctcccgaacagccatcattgtgcctcatcgtgcccgggagcaccacctgcgcctgctgctctaccacctgcaccccttcttgcagcgccagcagcttgcttatggcatctatgtcatccaccaggctggaaatggaacatttaacagggcaaaactgttgaacgttggggtgcgagaggccctgcgtgatgaagagtgggactgcctgttcttgcacgatgtggacctcttgccagaaaatgaccacaatctgtatgtgtgtgacccccggggaccccgccatgttgccgttgctatgaacaagtttggatacagcctcccgtacccccagtacttcggaggagtctcagcacttactcctgaccagtacctgaagatgaatggcttccccaatgaatactggggctggggtggtgaggatgacgacattgctaccagggtgcgcctggctgggatgaagatctctcggccccccacatctgtaggacactataagatggtgaagcaccgaggagataagggcaatgaggaaaatccccacagatttgacctcctggtccgtacccagaattcctggacgcaagatgggatgaactcactgacataccagttgctggctcgagagctggggcctctttataccaacatcacagcagacattgggactgaccctcggggtcctcgggctccttctgggccacgttacccacctggttcctcccaagccttccgtcaagagatgctgcaacgccggcccccagccaggcctgggcctctatctactgccaaccacacagccctccgaggttcacactgactcctccttcctgtctaccttaatcatgaaaccgaattcatggggttgtattctccccaccctcagctcctcactgttctcagagggatgtgagggaactgaactctggtgccgtgctagggggtaggggcctctccctcactgctggactggagctgggctcctgtagacctgaggggtccctctctctagggtctcctgtagggcttatgactgtgaatccttgatgtcatgattttatgtgacgattcctaggagtccctgcccctagagtaggagcagggctggaccccaagcccctccctcttccatggagagaagagtgatctggcttctcctcggacctctgtgaatatttattctatttatggttcccgggaagttgtttggtgaaggaagcccctccctgggcattttctgcctatgctggaatagctccctcttctggtcctggctcagggggctgggattttgatatattttctaataaaggactttgtctcgca

SEQ ID NO: 371231 - DNA, 1167 bp, Homo sapiens
ttctagaggatcccataaggcggccctgcgtgatgaagagtgggactgcctgttcttgcacgatgtggacctcttgccagaaaatgaccacaatctgtatgtgtgtgacccccggggaccccgccatgttgccgttgctatgaacaagtttggatacagcctcccgtacccccagtacttcggaggagtctcagcacttactcctgaccagtacctgaagatgaatggcttccccaatgaatactggggctggggtggtgaggatgacgacattgctaccagggtgcgcctggctgggatgaagatctctcggccccccacatctgtaggacactataagatggtgaagcaccgaggagataagggcaatgaggaaaatccccacagatttgacctcctggtccgtacccagaattcctggacgcaagatgggatgaactcactgacataccagttgctggctcgagagctggggcctctttataccaacatcacagcagacattgggactgaccctcggggtcctcgggctccttctgggccacgttacccacctggttcctcccaagccttccgtcaagagatgctgcaacgccggcccccagccaggcctgggcctctatctactgccaaccacacagccctccgaggttcacactgactcctccttcctgtctaccttaatcatgaaaccgaattcatggggttgtattctccccaccctcagctcctcactgttctcagagggatgtgagggaactgaactctggtgccgtgctagggggtaggggcctctccctcactgctggactggagctgggctcctgtagacctgaggggtccctctctctagggtctcctgtagggcttatgactgtgaatccttgatgtcatgattttatgtgacgattcctaggagtccctgcccctagagtaggagcagggctggaccccaagcccctccctcttccatggagagaagagtgatctggcttctcctcggacctctgtgaatatttattctatttatggttcccgggaagttgtttggtgaaggaagcccctccctgggcattttctgcctatgctggaatagctccctcttctggtcctggctcagggggctgggattttgatatattttctaataaaggactttgtctcgca

SEQ ID NO: 371232 - DNA, 1101 bp, Homo sapiens
tgtgtgtacagaaacatttaatcccttccttgcttttctctactctggatcccccatgataccctcacttttcccatagggtgcgcctggctgggatgaagatctctcggccccccacatctgtaggacactataagatggtgaagcaccgaggagataagggcaatgaggaaaatccccacaggtaggaagaaggaaggactgcctgggaattgttactggatcctcagggttctgtacccctagccaggaaaatcctaaaggtccctagatttctggctgttcctttctgggtcttagtctccaacctctaaccctcagatttgacctcctggtccgtacccagaattcctggacgcaagatgggatgaactcactgacataccagttgctggctcgagagctggggcctctttataccaacatcacagcagacattgggactgaccctcggggtcctcgggctccttctgggccacgttacccacctggttcctcccaagccttccgtcaagagatgctgcaacgccggcccccagccaggcctgggcctctatctactgccaaccacacagccctccgaggttcacactgactcctccttcctgtctaccttaatcatgaaaccgaattcatggggttgtattctccccaccctcagctcctcactgttctcagagggatgtgagggaactgaactctggtgccgtgctagggggtaggggcctctccctcactgctggactggagctgggctcctgtagacctgaggggtccctctctctagggtctcctgtagggcttatgactgtgaatccttgatgtcatgattttatgtgacgattcctaggagtccctgcccctagagtaggagcagggctggaccccaagcccctccctcttccatggagagaagagtgatctggcttctcctcggacctctgtgaatatttattctatttatggttcccgggaagttgtttggtgaaggaagcccctccctgggcattttctgcctatgctggaatagctccctcttctggtcctggctcagggggctgggattttgatatattttctaataaaggactttgtctcgca

SEQ ID NO: 371233 - DNA, 1318 bp, Homo sapiens
tggctagtacgaggctgtggttatcggcgagaccccgcccccgcagcgcccgcttccaagatggcggcagcgatgcctgcccggctgttggggtggcggtgacgacaggcagcaaaagaccagctggtcccagattcgctgctggagtgctggatggagcctttctctgccctctgtgacatttccaattttagataatgcctcacatctctgtccccccgggaccccctggagcccccatgatccctaagaagacagcttgaacctagatctcacccccaggatgttgcggaggctgctggagcggccttgcacgctggccctgcttgtgggctcccagctggctgtcatgatgtacctgtcactggggggcttccgaagtctcagtgccctatttggccgagatcagggaccgacatttgactattctcaccctcgtgatgtctacagtaacctcagtcacctgcctggggccccagggggtcctccagctcctcaaggtctgccctactgtccagaacgatctcctctcttagtgggtcctgtgtcggtgtcctttagcccagtgccatcactggcagagattgtggagcggaatccccgggtagaaccagggggccggtaccgccctgcaggttgtgagccccgctcccgaacagccatcattgtgcctcatcgtgcccgggagcaccacctgcgcctgctgctctaccacctgcaccccttcttgcagcgccagcagcttgcttatggcatctatgtcatccaccaggctggaaatggaacatttaacagggcaaaactgttgaacgttggggtgcgagaggccctgcgtgatgaagagtgggactgcctgttcttgcacgatgtggacctcttgccagaaaatgaccacaatctgtatgtgtgtgacccccggggaccccgccatgttgccgttgctatgaacaagtttggatacagcctcccgtacccccagtacttcggaggagtctcagcacttactcctgaccagtacctgaagatgaatggcttccccaatgaatactggggctggggtggtgaggatgacgacattgctaccagggtgcgcctggctgggatgaagatctctcggccccccacatctgtaggacactataagatggtgaagcaccgaggagataagggcaatgaggaaaatccccacagattgactcctggttccgtcccagaattctgacgcagatgggtaactcctgcactccgtggtggccaaaacggggccttttacaacttcagaattggatagctcgcggccggggcctttgggcaggtc

SEQ ID NO: 371234 - DNA, 868 bp, Homo sapiens
tggctagtacgaggctgtggttatcggcgagaccccgcccccgcagcgcccgcttccaagatggcggcagcgatgcctgcccggctgttggggtggcggtgacgacaggcagcaaaagaccagctggtcccagattcgctgctggagtgctggatggagcctttctctgccctctgtgacatttccaattttagataatgcctcacatctctgtccccccgggaccccctggagcccccatgatccctaagaagacagcttgaacctagaattcccctctccctccctagatctcacccccaggatgttgcggaggctgctggagcggccttgcacgctggccctgcttgtgggctcccagctggctgtcatgatgtacctgtcactggggggcttccgaagtctcagtgccctatttggccgagatcagggaccgacatttgactattctcaccctcgtgatgtctacagtaacctcagtcacctgcctggggccccagggggtcctccagctcctcaaggtctgccctactgtccagaacgatctcctctcttagctcctgtagggcttatgactgtgaatccttgatgtcatgattttatgtgacgattcctaggagtccctgcccctagagtaggagcagggctggaccccaagcccctccctcttccatggagagaagagtgatctggcttctcctcggacctctgtgaatatttattctatttatggttcccgggaagttgtttggtgaaggaagcccctccctgggcattttctgcctatgctggaatagctccctcttctggtcctggctcagggggctgggattttgatatattttctaataaaggactttgtctcgca

SEQ ID NO: 371235 - DNA, 158 bp, Homo sapiens
gggatgtgtccccagaagactcggggtatgcaaggatctttctctccctagcctcccgtacccccagtacttcggaggagtctcagcacttactcctgaccagtacctgaagatgaatggcttccccaatgaatactggggctggggtggtgaggatg

SEQ ID NO: 371236 - DNA, 1943 bp, Homo sapiens
taggctaggtacgaggctgggtgtgaatcggccgaggggcagcgatgcctgcccggctgttggggtggcggtgacgacaggcagcaaaagaccagctggtcccagattcgctgctggagtgctggatggagcctttctctgccctctgtgacatttccaattttagataatgcctcacatctctgtccccccgggaccccctggagcccccatgatccctaagaagacagcttgaacctagatctcacccccaggatgttgcggaggctgctggagcggccttgcacgctggccctgcttgtgggctcccagctggctgtcatgatgtacctgtcactggggggcttccgaagtctcagtgccctatttggccgagatcagggaccgacatttgactattctcaccctcgtgatgtctacagtaacctcagtcacctgcctggggccccagggggtcctccagctcctcaaggtctgccctactgtccagaacgatctcctctcttagtgggtcctgtgtcggtgtcctttagcccagtgccatcactggcagagattgtggagcggaatccccgggtagaaccagggggccggtaccgccctgcaggttgtgagccccgctcccgaacagccatcattgtgcctcatcgtgcccgggagcaccacctgcgcctgctgctctaccacctgcaccccttcttgcagcgccagcagcttgcttatggcatctatgtcatccaccaggctggaaatggaacatttaacagggcaaaactgttgaacgttggggtgcgagaggccctgcgtgatgaagagtgggactgcctgttcttgcacgatgtggacctcttgccagaaaatgaccacaatctgtatgtgtgtgacccccggggaccccgccatgttgccgttgctatgaacaagtttggatacagcctcccgtacccccagtacttcggaggagtctcagcacttactcctgaccagtacctgaagatgaatggcttccccaatgaatactggggctggggtggtgaggatgacgacattgctaccagggtgcgcctggctgggatgaagatctctcggccccccacatctgtaggacactataagatggtgaagcaccgaggagataagggcaatgaggaaaatccccacagatttgacctcctggtccgtacccagaattcctggacgcaagatgggatgaactcactgacataccagttgctggctcgagagctggggcctctttataccaacatcacagcagacattgggactgaccctcggggtcctcgggctccttctgggccacgttacccacctggttcctcccaagccttccgtcaagagatgctgcaacgccggcccccagccaggcctgggcctctatctactgccaaccacacagccctccgaggttcacactgactcctccttcctgtctaccttaatcatgaaaccgaattcatggggttgtattctccccaccctcagctcctcactgttctcagagggatgtgagggaactgaactctggtgccgtgctagggggtaggggcctctccctcactgctggactggagctgggctcctgtagacctgaggggtccctctctctagggtctcctgtagggcttatgactgtgaatccttgatgtcatgattttatgtgacgattcctaggagtccctgcccctagagtaggagcagggctggaccccaagcccctccctcttccatggagagaagagtgatctggcttctcctcggacctctgtgaatatttattctatttatggttcccgggaagttgtttggtgaaggaagcccctccctgggcattttctgcctatgctggaatagctccctcttctggtcctggctcagggggctgggattttgatatattttctaataaaggactttgtctcgca

SEQ ID NO: 371237 - DNA, 1921 bp, Homo sapiens
tggctagtacgaggctgtggttatcggcgagaccccgcccccgcagcgcccgcttccaagatggcggcagcgatgcctgcccggctgttggggtggcggtgacgacaggcagcaaaagaccagataatgcctcacatctctgtccccccgggaccccctggagcccccatgatccctaagaagacagcttgaacctagaattcccctctccctccctagatctcacccccaggatgttgcggaggctgctggagcggccttgcacgctggccctgcttgtgggctcccagctggctgtcatgatgtacctgtcactggggggcttccgaagtctcagtgccctatttggccgagatcagggaccgacatttgactattctcaccctcgtgatgtctacagtaacctcagtcacctgcctggggccccagggggtcctccagctcctcaaggtctgccctactgtccagaacgatctcctctcttagtgggtcctgtgtcggtgtcctttagcccagtgccatcactggcagagattgtggagcggaatccccgggtagaaccagggggccggtaccgccctgcaggttgtgagccccgctcccgaacagccatcattgtgcctcatcgtgcccgggagcaccacctgcgcctgctgctctaccacctgcaccccttcttgcagcgccagcagcttgcttatggcatctatgtcatccaccaggctggaaatggaacatttaacagggcaaaactgttgaacgttggggtgcgagaggccctgcgtgatgaagagtgggactgcctgttcttgcacgatgtggacctcttgccagaaaatgaccacaatctgtatgtgtgtgacccccggggaccccgccatgttgccgttgctatgaacaagtttggatacagcctcccgtacccccagtacttcggaggagtctcagcacttactcctgaccagtacctgaagatgaatggcttccccaatgaatactggggctggggtggtgaggatgacgacattgctaccagggtgcgcctggctgggatgaagatctctcggccccccacatctgtaggacactataagatggtgaagcaccgaggagataagggcaatgaggaaaatccccacagatttgacctcctggtccgtacccagaattcctggacgcaagatgggatgaactcactgacataccagttgctggctcgagagctggggcctctttataccaacatcacagcagacattgggactgaccctcggggtcctcgggctccttctgggccacgttacccacctggttcctcccaagccttccgtcaagagatgctgcaacgccggcccccagccaggcctgggcctctatctactgccaaccacacagccctccgaggttcacactgactcctccttcctgtctaccttaatcatgaaaccgaattcatggggttgtattctccccaccctcagctcctcactgttctcagagggatgtgagggaactgaactctggtgccgtgctagggggtaggggcctctccctcactgctggactggagctgggctcctgtagacctgaggggtccctctctctagggtctcctgtagggcttatgactgtgaatccttgatgtcatgattttatgtgacgattcctaggagtccctgcccctagagtaggagcagggctggaccccaagcccctccctcttccatggagagaagagtgatctggcttctcctcggacctctgtgaatatttattctatttatggttcccgggaagttgtttggtgaaggaagcccctccctgggcattttctgcctatgctggaatagctccctcttctggtcctggctcagggggctgggattttgatatattttctaataaaggactttgtctcgca

SEQ ID NO: 371238 - DNA, 2490 bp, Homo sapiens
taggctaggtacgaggctgggtgtgaatcggccgaggggcagcgatgcctgcccggctgttggggtggcggtgacgacaggcagcaaaagaccagagtaaccctcctccccacccccgctagaagaggggaaaggtagaaaaggtagaggacgccacccccaccctactctccgccgagctccggggctgttcgcttacagcccccaggtggtcacggtccctgcacctgaggagttggcacccaggcacatgaagaatagaaggagcctgtttcctacttcgccctgggtactccttaggccactccacggtcctgtcatgactctgtcgccacttcaactggttcttggtctgggggaaaacaatgtttccattagctgtcctgtccccactccccaatctgtcctgttggggtgggggtacgggggtggttaagtatgaacctgacacttatcattccagggtagcacgggagataggcgagggacctaccatctcctgctcctcctcttcctttccaaccactttccttcacttcgcctgctgggaaaccagcttcaccctgatcctgatctctggcggtgcaggtagctagttatcctttaccacttctgttccagctggtcccagattcgctgctggagtgctggatggagcctttctctgccctctgtgacatttccaattttagataatgcctcacatctctgtccccccgggaccccctggagcccccatgatccctaagaagacagcttgaacctagaattcccctctccctccctagatctcacccccaggatgttgcggaggctgctggagcggccttgcacgctggccctgcttgtgggctcccagctggctgtcatgatgtacctgtcactggggggcttccgaagtctcagtgccctatttggccgagatcagggaccgacatttgactattctcaccctcgtgatgtctacagtaacctcagtcacctgcctggggccccagggggtcctccagctcctcaaggtctgccctactgtccagaacgatctcctctcttagtgggtcctgtgtcggtgtcctttagcccagtgccatcactggcagagattgtggagcggaatccccgggtagaaccagggggccggtaccgccctgcaggttgtgagccccgctcccgaacagccatcattgtgcctcatcgtgcccgggagcaccacctgcgcctgctgctctaccacctgcaccccttcttgcagcgccagcagcttgcttatggcatctatgtcatccaccaggctggaaatggaacatttaacagggcaaaactgttgaacgttggggtgcgagaggccctgcgtgatgaagagtgggactgcctgttcttgcacgatgtggacctcttgccagaaaatgaccacaatctgtatgtgtgtgacccccggggaccccgccatgttgccgttgctatgaacaagtttggatacagcctcccgtacccccagtacttcggaggagtctcagcacttactcctgaccagtacctgaagatgaatggcttccccaatgaatactggggctggggtggtgaggatgacgacattgctaccagggtgcgcctggctgggatgaagatctctcggccccccacatctgtaggacactataagatggtgaagcaccgaggagataagggcaatgaggaaaatccccacagatttgacctcctggtccgtacccagaattcctggacgcaagatgggatgaactcactgacataccagttgctggctcgagagctggggcctctttataccaacatcacagcagacattgggactgaccctcggggtcctcgggctccttctgggccacgttacccacctggttcctcccaagccttccgtcaagagatgctgcaacgccggcccccagccaggcctgggcctctatctactgccaaccacacagccctccgaggttcacactgactcctccttcctgtctaccttaatcatgaaaccgaattcatggggttgtattctccccaccctcagctcctcactgttctcagagggatgtgagggaactgaactctggtgccgtgctagggggtaggggcctctccctcactgctggactggagctgggctcctgtagacctgaggggtccctctctctagggtctcctgtagggcttatgactgtgaatccttgatgtcatgattttatgtgacgattcctaggagtccctgcccctagagtaggagcagggctggaccccaagcccctccctcttccatggagagaagagtgatctggcttctcctcggacctctgtgaatatttattctatttatggttcccgggaagttgtttggtgaaggaagcccctccctgggcattttctgcctatgctggaatagctccctcttctggtcctggctcagggggctgggattttgatatattttctaataaaggactttgtctcgca

SEQ ID NO: 371239 - DNA, 2829 bp, Homo sapiens
taggctaggtacgaggctgggtgtgaatcggccgaggggcagcgatgcctgcccggctgttggggtggcggtgacgacaggcagcaaaagaccagagtaaccctcctccccacccccgctagaagaggggaaaggtagaaaaggtagaggacgccacccccaccctactctccgccgagctccggggctgttcgcttacagcccccaggtggtcacggtccctgcacctgaggagttggcacccaggcacatgaagaatagaaggagcctgtttcctacttcgccctgggtactccttaggccactccacggtcctgtcatgactctgtcgccacttcaactggttcttggtctgggggaaaacaatgtttccattagctgtcctgtccccactccccaatctgtcctgttggggtgggggtacgggggtggttaagtatgaacctgacacttatcattccagggtagcacgggagataggcgagggacctaccatctcctgctcctcctcttcctttccaaccactttccttcacttcgcctgctgggaaaccagcttcaccctgatcctgatctctggcggtgcaggtagctagttatcctttaccacttctgttccagctggtcccagattcgctgctggagtgctggatggagcctttctctgccctctgtgacatttccaattttagataatgcctcacatctctgtccccccgggaccccctggagcccccatgatccctaagaagacagcttgaacctagggtgagtctatctcttcccttctaaaattggaagagggggttctctagagactttctgaaatgaacatgagatttgaatgatgtaaacatttttgggggtgaggactgacagtagatggtgggagtggtttggggggaggtagaggagagcgaaacttgggctgaagtgacaggtggtagggttactggtggttacattctgtttccttgcgtgactgtgcacctgtgtgctcccttctgtgactttgttttctgctttttcctctttacccctggcatcaccttcaaccctacctactgacctctctgctggcttgctctcttcctgcctacccccagaattcccctctccctccctagatctcacccccaggatgttgcggaggctgctggagcggccttgcacgctggccctgcttgtgggctcccagctggctgtcatgatgtacctgtcactggggggcttccgaagtctcagtgccctatttggccgagatcagggaccgacatttgactattctcaccctcgtgatgtctacagtaacctcagtcacctgcctggggccccagggggtcctccagctcctcaaggtctgccctactgtccagaacgatctcctctcttagtgggtcctgtgtcggtgtcctttagcccagtgccatcactggcagagattgtggagcggaatccccgggtagaaccagggggccggtaccgccctgcaggttgtgagccccgctcccgaacagccatcattgtgcctcatcgtgcccgggagcaccacctgcgcctgctgctctaccacctgcaccccttcttgcagcgccagcagcttgcttatggcatctatgtcatccaccaggctggaaatggaacatttaacagggcaaaactgttgaacgttggggtgcgagaggccctgcgtgatgaagagtgggactgcctgttcttgcacgatgtggacctcttgccagaaaatgaccacaatctgtatgtgtgtgacccccggggaccccgccatgttgccgttgctatgaacaagtttggatacagcctcccgtacccccagtacttcggaggagtctcagcacttactcctgaccagtacctgaagatgaatggcttccccaatgaatactggggctggggtggtgaggatgacgacattgctaccagggtgcgcctggctgggatgaagatctctcggccccccacatctgtaggacactataagatggtgaagcaccgaggagataagggcaatgaggaaaatccccacagatttgacctcctggtccgtacccagaattcctggacgcaagatgggatgaactcactgacataccagttgctggctcgagagctggggcctctttataccaacatcacagcagacattgggactgaccctcggggtcctcgggctccttctgggccacgttacccacctggttcctcccaagccttccgtcaagagatgctgcaacgccggcccccagccaggcctgggcctctatctactgccaaccacacagccctccgaggttcacactgactcctccttcctgtctaccttaatcatgaaaccgaattcatggggttgtattctccccaccctcagctcctcactgttctcagagggatgtgagggaactgaactctggtgccgtgctagggggtaggggcctctccctcactgctggactggagctgggctcctgtagacctgaggggtccctctctctagggtctcctgtagggcttatgactgtgaatccttgatgtcatgattttatgtgacgattcctaggagtccctgcccctagagtaggagcagggctggaccccaagcccctccctcttccatggagagaagagtgatctggcttctcctcggacctctgtgaatatttattctatttatggttcccgggaagttgtttggtgaaggaagcccctccctgggcattttctgcctatgctggaatagctccctcttctggtcctggctcagggggctgggattttgatatattttctaataaaggactttgtctcgca

SEQ ID NO: 371240 - DNA, 2108 bp, Homo sapiens
tggctagtacgaggctgtggttatcggcgagaccccgcccccgcagcgcccgcttccaagatggcggcagcgatgcctgcccggctgttggggtggcggtgacgacaggcagcaaaagaccagctggtcccagattcgctgctggagtgctggatggagcctttctctgccctctgtgacatttccaattttagataatgcctcacatctctgtccccccgggaccccctggagcccccatgatccctaagaagacagcttgaacctagatctcacccccaggatgttgcggaggctgctggagcggccttgcacgctggccctgcttgtgggctcccagctggctgtcatgatgtacctgtcactggggggcttccgaagtctcagtgccctatttggccgagatcagggaccgacatttgactattctcaccctcgtgatgtctacagtaacctcagtcacctgcctggggccccagggggtcctccagctcctcaaggtctgccctactgtccagaacgatctcctctcttagtgggtcctgtgtcggtgtcctttagcccagtgccatcactggcagagattgtggagcggaatccccgggtagaaccagggggccggtaccgccctgcaggttgtgagccccgctcccgaacagccatcattgtgcctcatcgtgcccgggagcaccacctgcgcctgctgctctaccacctgcaccccttcttgcagcgccagcagcttgcttatggcatctatgtcatccaccaggctggaaatggaacatttaacagggcaaaactgttgaacgttggggtgcgagaggccctgcgtgatgaagagtgggactgcctgttcttgcacgatgtggacctcttgccagaaaatgaccacaatctgtatgtgtgtgacccccggggaccccgccatgttgccgttgctatgaacaagtttggatacagcctcccgtacccccagtacttcggaggagtctcagcacttactcctgaccagtacctgaagatgaatggcttccccaatgaatactggggctggggtggtgaggatgacgacattgctaccagggtgcgcctggctgggatgaagatctctcggccccccacatctgtaggacactataagatggtgaagcaccgaggagataagggcaatgaggaaaatccccacaggtaggaagaaggaaggactgcctgggaattgttactggatcctcagggttctgtacccctagccaggaaaatcctaaaggtccctagatttctggctgttcctttctgggtcttagtctccaacctctaaccctcagatttgacctcctggtccgtacccagaattcctggacgcaagatgggatgaactcactgacataccagttgctggctcgagagctggggcctctttataccaacatcacagcagacattgggactgaccctcggggtcctcgggctccttctgggccacgttacccacctggttcctcccaagccttccgtcaagagatgctgcaacgccggcccccagccaggcctgggcctctatctactgccaaccacacagccctccgaggttcacactgactcctccttcctgtctaccttaatcatgaaaccgaattcatggggttgtattctccccaccctcagctcctcactgttctcagagggatgtgagggaactgaactctggtgccgtgctagggggtaggggcctctccctcactgctggactggagctgggctcctgtagacctgaggggtccctctctctagggtctcctgtagggcttatgactgtgaatccttgatgtcatgattttatgtgacgattcctaggagtccctgcccctagagtaggagcagggctggaccccaagcccctccctcttccatggagagaagagtgatctggcttctcctcggacctctgtgaatatttattctatttatggttcccgggaagttgtttggtgaaggaagcccctccctgggcattttctgcctatgctggaatagctccctcttctggtcctggctcagggggctgggattttgatatattttctaataaaggactttgtctcgca

SEQ ID NO: 371241 - DNA, 1556 bp, Homo sapiens
ctatggcgctggtacgccccggagttacgggatagtaacctcagtcacctgcctggggccccagggggtcctccagctcctcaaggtctgccctactgtccagaacgatctcctctcttagtgggtcctgtgtcggtgtcctttagcccagtgccatcactggcagagattgtggagcggaatccccgggtagaaccagggggccggtaccgccctgcaggttgtgagccccgctcccgaacagccatcattgtgcctcatcgtgcccgggagcaccacctgcgcctgctgctctaccacctgcaccccttcttgcagcgccagcagcttgcttatggcatctatgtcatccaccaggctggaaatggaacatttaacagggcaaaactgttgaacgttggggtgcgagaggccctgcgtgatgaagagtgggactgcctgttcttgcacgatgtggacctcttgccagaaaatgaccacaatctgtatgtgtgtgacccccggggaccccgccatgttgccgttgctatgaacaagtttggatacagcctcccgtacccccagtacttcggaggagtctcagcacttactcctgaccagtacctgaagatgaatggcttccccaatgaatactggggctggggtggtgaggatgacgacattgctaccagggtgcgcctggctgggatgaagatctctcggccccccacatctgtaggacactataagatggtgaagcaccgaggagataagggcaatgaggaaaatccccacagatttgacctcctggtccgtacccagaattcctggacgcaagatgggatgaactcactgacataccagttgctggctcgagagctggggcctctttataccaacatcacagcagacattgggactgaccctcggggtcctcgggctccttctgggccacgttacccacctggttcctcccaagccttccgtcaagagatgctgcaacgccggcccccagccaggcctgggcctctatctactgccaaccacacagccctccgaggttcacactgactcctccttcctgtctaccttaatcatgaaaccgaattcatggggttgtattctccccaccctcagctcctcactgttctcagagggatgtgagggaactgaactctggtgccgtgctagggggtaggggcctctccctcactgctggactggagctgggctcctgtagacctgaggggtccctctctctagggtctcctgtagggcttatgactgtgaatccttgatgtcatgattttatgtgacgattcctaggagtccctgcccctagagtaggagcagggctggaccccaagcccctccctcttccatggagagaagagtgatctggcttctcctcggacctctgtgaatatttattctatttatggttcccgggaagttgtttggtgaaggaagcccctccctgggcattttctgcctatgctggaatagctccctcttctggtcctggctcagggggctgggattttgatatattttctaataaaggactttgtctcgca

SEQ ID NO: 371242 - DNA, 1491 bp, Homo sapiens
atctggtatacgtcgagcttggtgttaattcggacgaggcagaacatctctctctttgggtcctgtgtcggtgtcctttagcccagtgccatcactggcagagattgtggagcggaatccccgggtagaaccagggggccggtaccgccctgcaggttgtgagccccgctcccgaacagccatcattgtgcctcatcgtgcccgggagcaccacctgcgcctgctgctctaccacctgcaccccttcttgcagcgccagcagcttgcttatggcatctatgtcatccaccaggctggaaatggaacatttaacagggcaaaactgttgaacgttggggtgcgagaggccctgcgtgatgaagagtgggactgcctgttcttgcacgatgtggacctcttgccagaaaatgaccacaatctgtatgtgtgtgacccccggggaccccgccatgttgccgttgctatgaacaagtttggatacagcctcccgtacccccagtacttcggaggagtctcagcacttactcctgaccagtacctgaagatgaatggcttccccaatgaatactggggctggggtggtgaggatgacgacattgctaccagggtgcgcctggctgggatgaagatctctcggccccccacatctgtaggacactataagatggtgaagcaccgaggagataagggcaatgaggaaaatccccacagatttgacctcctggtccgtacccagaattcctggacgcaagatgggatgaactcactgacataccagttgctggctcgagagctggggcctctttataccaacatcacagcagacattgggactgaccctcggggtcctcgggctccttctgggccacgttacccacctggttcctcccaagccttccgtcaagagatgctgcaacgccggcccccagccaggcctgggcctctatctactgccaaccacacagccctccgaggttcacactgactcctccttcctgtctaccttaatcatgaaaccgaattcatggggttgtattctccccaccctcagctcctcactgttctcagagggatgtgagggaactgaactctggtgccgtgctagggggtaggggcctctccctcactgctggactggagctgggctcctgtagacctgaggggtccctctctctagggtctcctgtagggcttatgactgtgaatccttgatgtcatgattttatgtgacgattcctaggagtccctgcccctagagtaggagcagggctggaccccaagcccctccctcttccatggagagaagagtgatctggcttctcctcggacctctgtgaatatttattctatttatggttcccgggaagttgtttggtgaaggaagcccctccctgggcattttctgcctatgctggaatagctccctcttctggtcctggctcagggggctgggattttgatatattttctaataaaggactttgtctcgca

SEQ ID NO: 371243 - DNA, 1950 bp, Homo sapiens
tggctagtacgaggctgtggttatcggcgagaccccgcccccgcagcgcccgcttccaagatggcggcagcgatgcctgcccggctgttggggtggcggtgacgacaggcagcaaaagaccagctggtcccagattcgctgctggagtgctggatggagcctttctctgccctctgtgacatttccaattttagataatgcctcacatctctgtccccccgggaccccctggagcccccatgatccctaagaagacagcttgaacctagatctcacccccaggatgttgcggaggctgctggagcggccttgcacgctggccctgcttgtgggctcccagctggctgtcatgatgtacctgtcactggggggcttccgaagtctcagtgccctatttggccgagatcagggaccgacatttgactattctcaccctcgtgatgtctacagtaacctcagtcacctgcctggggccccagggggtcctccagctcctcaaggtctgccctactgtccagaacgatctcctctcttagtgggtcctgtgtcggtgtcctttagcccagtgccatcactggcagagattgtggagcggaatccccgggtagaaccagggggccggtaccgccctgcaggttgtgagccccgctcccgaacagccatcattgtgcctcatcgtgcccgggagcaccacctgcgcctgctgctctaccacctgcaccccttcttgcagcgccagcagcttgcttatggcatctatgtcatccaccaggctggaaatggaacatttaacagggcaaaactgttgaacgttggggtgcgagaggccctgcgtgatgaagagtgggactgcctgttcttgcacgatgtggacctcttgccagaaaatgaccacaatctgtatgtgtgtgacccccggggaccccgccatgttgccgttgctatgaacaagtttggatacagcctcccgtacccccagtacttcggaggagtctcagcacttactcctgaccagtacctgaagatgaatggcttccccaatgaatactggggctggggtggtgaggatgacgacattgctaccagggtgcgcctggctgggatgaagatctctcggccccccacatctgtaggacactataagatggtgaagcaccgaggagataagggcaatgaggaaaatccccacagatttgacctcctggtccgtacccagaattcctggacgcaagatgggatgaactcactgacataccagttgctggctcgagagctggggcctctttataccaacatcacagcagacattgggactgaccctcggggtcctcgggctccttctgggccacgttacccacctggttcctcccaagccttccgtcaagagatgctgcaacgccggcccccagccaggcctgggcctctatctactgccaaccacacagccctccgaggttcacactgactcctccttcctgtctaccttaatcatgaaaccgaattcatggggttgtattctccccaccctcagctcctcactgttctcagagggatgtgagggaactgaactctggtgccgtgctagggggtaggggcctctccctcactgctggactggagctgggctcctgtagacctgaggggtccctctctctagggtctcctgtagggcttatgactgtgatgtgacgattcctaggagtccctgcccctagagtaggagcagggctggaccccaagcccctccctcttccatggagagaagagtgatctggcttctcctcggacctctgtgaatatttattctatttatggttcccgggaagttgtttggtgaaggaagcccctccctgggcattttctgcctatgctggaatagctccctcttctggtcctggctcagggggctgggattttgatatattttctaataaaggactttgtctcgca

SEQ ID NO: 371244 - DNA, 964 bp, Homo sapiens
tgtgtgtacagaaacatttaatcccttccttgcttttctctactctggatcccccatgataccctcacttttcccatagggtgcgcctggctgggatgaagatctctcggccccccacatctgtaggacactataagatggtgaagcaccgaggagataagggcaatgaggaaaatccccacagatttgacctcctggtccgtacccagaattcctggacgcaagatgggatgaactcactgacataccagttgctggctcgagagctggggcctctttataccaacatcacagcagacattgggactgaccctcggggtcctcgggctccttctgggccacgttacccacctggttcctcccaagccttccgtcaagagatgctgcaacgccggcccccagccaggcctgggcctctatctactgccaaccacacagccctccgaggttcacactgactcctccttcctgtctaccttaatcatgaaaccgaattcatggggttgtattctccccaccctcagctcctcactgttctcagagggatgtgagggaactgaactctggtgccgtgctagggggtaggggcctctccctcactgctggactggagctgggctcctgtagacctgaggggtccctctctctagggtctcctgtagggcttatgactgtgaatccttgatgtcatgattttatgtgacgattcctaggagtccctgcccctagagtaggagcagggctggaccccaagcccctccctcttccatggagagaagagtgatctggcttctcctcggacctctgtgaatatttattctatttatggttcccgggaagttgtttggtgaaggaagcccctccctgggcattttctgcctatgctggaatagctccctcttctggtcctggctcagggggctgggattttgatatattttctaataaaggactttgtctcgca

SEQ ID NO: 371245 - DNA, 847 bp, Homo sapiens
tggctagtacgaggctgtggttatcggcgagaccccgcccccgcagcgcccgcttccaagatggcggcagcgatgcctgcccggctgttggggtggcggtgacgacaggcagcaaaagaccagctggtcccagattcgctgctggagtgctggatggagcctttctctgccctctgtgacatttccaattttagataatgcctcacatctctgtccccccgggaccccctggagcccccatgatccctaagaagacagcttgaacctagatctcacccccaggatgttgcggaggctgctggagcggccttgcacgctggccctgcttgtgggctcccagctggctgtcatgatgtacctgtcactggggggcttccgaagtctcagtgccctatttggccgagatcagggaccgacatttgactattctcaccctcgtgatgtctacagtaacctcagtcacctgcctggggccccagggggtcctccagctcctcaaggtctgccctactgtccagaacgatctcctctcttagctcctgtagggcttatgactgtgaatccttgatgtcatgattttatgtgacgattcctaggagtccctgcccctagagtaggagcagggctggaccccaagcccctccctcttccatggagagaagagtgatctggcttctcctcggacctctgtgaatatttattctatttatggttcccgggaagttgtttggtgaaggaagcccctccctgggcattttctgcctatgctggaatagctccctcttctggtcctggctcagggggctgggattttgatatattttctaataaaggactttgtctcgca

SEQ ID NO: 371246 - DNA, 269 bp, Homo sapiens
attttcatatggaattctatttcagaaatatgccaatttatccattctactgttgatagatacatgaattgtttccagttttaagctatttcaaatatgctattataaaaatggtagatattgcatgaatttctgtcaggtatacagctaggagttaaatggctgggtcagagtttatttggcttaactagagaatgccaaagtggttgtactaatttttcttcccacaggcagtgtatgagagttccacttgttctacaccctctcca

SEQ ID NO: 371247 - DNA, 252 bp, Homo sapiens
aatatgtgctaggtaccaagctaagtgctttgcctagatcacctcagttaagcctcgcactaattctatgaggtaggtgccaatatttgcctattttacaaatgaggaaactgaggctcagagaggtgaggtcccatctgcagttggactgtgagtaaacggcagagtgaggaccagaactcaagtgtgtcttactgcagagtcttggcttacgcagttcctagccatcttccgtgttagtttgttcttctg

SEQ ID NO: 371248 - DNA, 872 bp, Homo sapiens
gggttcctccgcagcggaggaaagaggatggcgacctcgtcgatgccggagtcagagaggaacgtggctacgaaagcctcggagtgaagttcccagaccctacgccccgctgtcaggcagcccgccgatcagatggaggagaacgaggtggagagcagcagcgacgcggcccctgggcctggccggcccgaggagccctctgagagcggcctgggtgtgggcacctcagaagccgtgtccgccgacagcagcgacgccgcggccgccccggggcaggcagaggccgatgactctggcgtggggcaaagctcggaccgcggcagccgttctcaggaggaggtatctgagagcagctcgagcgcagaccccctgcctaatagctacctccctgattcatcgtctgtgtctcatgggccagtggcaggggtgacaggcggtcccccagcacttgtgcactctagtgcactcccagaccccaacatgctggtgtccgactgcacagcttcctcctcggacctgggctcggccatcgacaagatcatcgagtccaccatcgggcccgacctcatccagaactgcatcactgtgaccagtgctgaggatggcggggccgagaccacacggtacctgatcctacagggcccagatgatggagccccattgacatcaccaatggccagttcccaggaactctgagataccgccagagggaaactttccagtcatcttgaggtcctcattgctctgtctgaaccctgggtgggccaccattatttccagagagctgagagtcgaaggatggcagcagaaagcttggtttttgtgaactgatgtccgggactgggggaagcctgcgtgtggtgatcgcaatt

SEQ ID NO: 371249 - DNA, 4459 bp, Homo sapiens
gggttcctccgcagcggaggaaagaggatggcgacctcgtcgatgccggagtcagagaggaacgtggctacgaaagcctcggagtgaagttcccagaccctacgccccgctgtcaggcagcccgccgatcagatggaggagaacgaggtggagagcagcagcgacgcggcccctgggcctggccggcccgaggagccctctgagagcggcctgggtgtgggcacctcagaagccgtgtccgccgacagcagcgacgccgcggccgccccggggcaggcagaggccgatgactctggcgtggggcaaagctcggaccgcggcagccgttctcaggaggaggtatctgagagcagctcgagcgcagaccccctgcctaatagctacctccctgattcatcgtctgtgtctcatgggccagtggcaggggtgacaggcggtcccccagcacttgtgcactctagtgcactcccagaccccaacatgctggtgtccgactgcacagcttcctcctcggacctgggctcggccatcgacaagatcatcgagtccaccatcgggcccgacctcatccagaactgcatcactgtgaccagtgctgaggatggcggggccgagaccacacggtacctgatcctacagggcccagatgatggagcccccatgacatcaccaatgtccagttccaccttggcccacagcctagcagccattgaggccctggcagatggccccacatccacatccacatgcctggaggcacagggtgggcccagctccccggtgcagctgcccccagcctccggtgccgaagagccggacctgcagagcctggaggccatgatggaggtggtggtggtgcagcagttcaaatgcaagatgtgccagtaccggagcagcaccaaggccacactgctgcgccacatgcgggaacgccacttccgtccagtagcagcagccgcagcagcagctggtaaaaaaggacgtctacggaagtggagcacctccaccaagagccaagaggaagagggaccagaggaggaggacgatgatgacattgtagacgctggagccattgatgacctggagggaggatagcgactataatccagctgaggatgagccccgaggccggcagcttcggctccagcgccccacccccagtaccccaaggccccgaaggagacctggccggccccggaagctgccccgcctggagatctcagacctcccagatggtgtggaaggagagcctctagtgagttcccagagtggacagagccctccagagccacaggatcccgaggctcccagctcctcaggcccaggacacctggtggccatgggcaaggtgagcaggacccctgtggaagctggtgtgagccagtcagatgcagagaacgcagccccctcctgcccggatgagcatgacactctgccccggcgccgaggtcgaccttccaggcgcttcctaggcaagaaataccgcaagtactattacaagtcgcccaaaccacttttgaggcccttcctgtgccgcatctgtggttctcgctttctgtcccacgaggacctgcgcttccacgtcaactcccatgaggctggcgatccccagctcttcaagtgcctgcagtgcagctatcgttcccgccgctggtcctcgctcaaggagcacatgttcaaccacgtgggcagcaagccctacaagtgtgacgagtgcagctacaccagtgtctaccggaaggacgtcattcggcacgccgctgtgcacagccgggaccggaagaagaggccagatccgactccaaagctgagctctttcccctgccctgtgtgtggccgtgtgtaccccatgcagaaaagactcacgcagcacatgaagacgcacagcactgagaagccccacatgtgtgacaagtgtggaaagtcctttaagaagcgctacaccttcaaaatgcacctgctcacgcacatccaggctgttgccaaccgcaggttcaagtgtgagttctgtgagtttgtttgtgaagacaagaaggcactgctgaaccaccagttgtcccacgtcagtgacaagcccttcaaatgcagcttttgtccctaccgcaccttccgagaggacttcttgctgtcccatgtggctgtcaagcacacaggggccaagcccttcgcctgtgagtactgccacttcagcacacggcacaagaagaacctgcgcctgcacgtacggtgccgacacgcaagcagcttcgaggaatgggggaggcgccaccctgaggagcccccctcccgccgtcgccccttcttctctctgcagcagattgaggagctgaagcagcagcacagtgcggcccctggaccacctcccagttccccaggacctcctgagatacccccagaggcgacaactttccagtcatctgaggctccctcattgctctgttctgacaccctgggcggcgccaccatcatctaccagcaaggagctgaggagtcgacagcgatggccacgcagacagccttggatcttctgctgaacatgagtgctcagcgggaactggggggcacagccctgcaggtggctgtggtgaagtcggaagatgtggaagcagggttagcatcccctggtgggcagccctcccctgaaggtgccactccacaggtggtcaccctccacgtggcagagccagggggcggtgcagcagccgagagccagctaggccctcctgacctaccgcagatcaccctggcacctggtccatttggtgggactggctacagtgtcatcacagcaccccctatggaggagggaacatcagctcctggcacaccttacagcgaggagcccgcaggagaggcagcccaggctgtggttgtgagtgacaccctaaaagaagctggcacccactacatcatggctactgatggtacccagttgcaccacattgagctcaccgcagatggctccatctccttcccaagtccagatgctctggcctctggtgccaaatggcccctgctgcagtgtgggggactgcccagagacggccctgagcccccatctccagccaagacccactgcgtaggggactcccagagctctgcctcctcacctcctgcaaccagcaaagccctgggcctggcagtgcccccgtcaccgccatctgcagccactgctgcatcaaagaagttttcctgcaagatctgtgccgaggccttccctggccgagctgagatggagagtcacaagcgggcccacgctgggcctggtgccttcaagtgccccgactgccccttcagtgcccgccagtggcccgaggtccgggcgcacatggcacagcactcaagcctacggccccaccagtgtagccagtgcagctttgcctccaagaacaagaaggacctgcgtcggcacatgctgactcacacaaaggagaagccttttgcatgccacctctgcgggcagcgtttcaaccgtaacgggcacctcaagttccacatccagcggctgcacagtcctgatgggaggaagtcaggaacccctacagcccgggcccctacccagaccccaacccagaccatcatcctgaacagtgatgacgaaacactggccaccctgcacactgcactccagtccagtcacggggtcctgggcccagagcggctacagcaggcactgagccaggaacacatcatcgttgcccaggaacagacagtgaccaatcaggaggaagccgcctacatccaagagatcaccacggcagatggccagaccgtacagcacctggtgacctccgacaaccaggtgcagtatatcatctcccaggatggtgtccagcacctgctcccccaggaatatgttgtggtccctgaaggccatcacatccaggtacaggagggccagatcacacacatccagtatgaacaaggagccccgttccttcaggagtcccagatccagtatgtgcctgtgtccccaggccagcagcttgtcacacaggctcaacttgaggctgcagcacactcagctgtcacagcagtggctgatgctgccatggcccaagcccagggcctgtttggtacagacgagacagtgcccgaacacattcaacagctgcagcaccagggcatcgagtacgacgtcatcaccctggccgatgactgagccccgagggcccaacacagatcatggatttgcggccagctctcctgggggtagggggccaccaggactcacctccctcttcatttaggatctccagatactggatagccagcatcctctcattcccagggagccagacctgtgctgttggggttaggggcagccatgggccccagccaggacatgctgggtgccccagcctgcaggcaggctttgggagagaaatttatttttgtttgggtggacccactggcctgtcagtctcaataaagggaccggagtccagtcctgaacagc

SEQ ID NO: 371250 - DNA, 3669 bp, Homo sapiens
gggttcctccgcagcggaggaaagaggatggcgacctcgtcgatgccggagtcagagaggaacgtggctacgaaagcctcggagtgaagttcccagaccctacgccccgctgtcaggcagcccgccgatcagatggaggagaacgaggtggagagcagcagcgacgcggcccctgggcctggccggcccgaggagccctctgagagcggcctgggtgtgggcacctcagaagccgtgtccgccgacagcagcgacgccgcggccgccccggggcaggcagaggccgatgactctggcgaggatagcgactataatccagctgaggatgagccccgaggccggcagcttcggctccagcgccccacccccagtaccccaaggccccgaaggagacctggccggccccggaagctgccccgcctggagatctcagacctcccagatggtgtggaaggagagcctctagtgagttcccagagtggacagagccctccagagccacaggatcccgaggctcccagctcctcaggcccaggacacctggtggccatgggcaaggtgagcaggacccctgtggaagctggtgtgagccagtcagatgcagagaacgcagccccctcctgcccggatgagcatgacactctgccccggcgccgaggtcgaccttccaggcgcttcctaggcaagaaataccgcaagtactattacaagtcgcccaaaccacttttgaggcccttcctgtgccgcatctgtggttctcgctttctgtcccacgaggacctgcgcttccacgtcaactcccatgaggctggcgatccccagctcttcaagtgcctgcagtgcagctatcgttcccgccgctggtcctcgctcaaggagcacatgttcaaccacgtgggcagcaagccctacaagtgtgacgagtgcagctacaccagtgtctaccggaaggacgtcattcggcacgccgctgtgcacagccgggaccggaagaagaggccagatccgactccaaagctgagctctttcccctgccctgtgtgtggccgtgtgtaccccatgcagaaaagactcacgcagcacatgaagacgcacagcactgagaagccccacatgtgtgacaagtgtggaaagtcctttaagaagcgctacaccttcaaaatgcacctgctcacgcacatccaggctgttgccaaccgcaggttcaagtgtgagttctgtgagtttgtttgtgaagacaagaaggcactgctgaaccaccagttgtcccacgtcagtgacaagcccttcaaatgcagcttttgtccctaccgcaccttccgagaggacttcttgctgtcccatgtggctgtcaagcacacaggggccaagcccttcgcctgtgagtactgccacttcagcacacggcacaagaagaacctgcgcctgcacgtacggtgccgacacgcaagcagcttcgaggaatgggggaggcgccaccctgaggagcccccctcccgccgtcgccccttcttctctctgcagcagattgaggagctgaagcagcagcacagtgcggcccctggaccacctcccagttccccaggacctcctgagatacccccagaggcgacaactttccagtcatctgaggctccctcattgctctgttctgacaccctgggcggcgccaccatcatctaccagcaaggagctgaggagtcgacagcgatggccacgcagacagccttggatcttctgctgaacatgagtgctcagcgggaactggggggcacagccctgcaggtggctgtggtgaagtcggaagatgtggaagcagggttagcatcccctggtgggcagccctcccctgaaggtgccactccacaggtggtcaccctccacgtggcagagccagggggcggtgcagcagccgagagccagctaggccctcctgacctaccgcagatcaccctggcacctggtccatttggtgggactggctacagtgtcatcacagcaccccctatggaggagggaacatcagctcctggcacaccttacagcgaggagcccgcaggagaggcagcccaggctgtggttgtgagtgacaccctaaaagaagctggcacccactacatcatggctactgatggtacccagttgcaccacattgagctcaccgcagatggctccatctccttcccaagtccagatgctctggcctctggtgccaaatggcccctgctgcagtgtgggggactgcccagagacggccctgagcccccatctccagccaagacccactgcgtaggggactcccagagctctgcctcctcacctcctgcaaccagcaaagccctgggcctggcagtgcccccgtcaccgccatctgcagccactgctgcatcaaagaagttttcctgcaagatctgtgccgaggccttccctggccgagctgagatggagagtcacaagcgggcccacgctgggcctggtgccttcaagtgccccgactgccccttcagtgcccgccagtggcccgaggtccgggcgcacatggcacagcactcaagcctacggccccaccagtgtagccagtgcagctttgcctccaagaacaagaaggacctgcgtcggcacatgctgactcacacaaaggagaagccttttgcatgccacctctgcgggcagcgtttcaaccgtaacgggcacctcaagttccacatccagcggctgcacagtcctgatgggaggaagtcaggaacccctacagcccgggcccctacccagaccccaacccagaccatcatcctgaacagtgatgacgaaacactggccaccctgcacactgcactccagtccagtcacggggtcctgggcccagagcggctacagcaggcactgagccaggaacacatcatcgttgcccaggaacagacagtgaccaatcaggaggaagccgcctacatccaagagatcaccacggcagatggccagaccgtacagcacctggtgacctccgacaaccaggtgcagtatatcatctcccaggatggtgtccagcacctgctcccccaggaatatgttgtggtccctgaaggccatcacatccaggtacaggagggccagatcacacacatccagtatgaacaaggagccccgttccttcaggagtcccagatccagtatgtgcctgtgtccccaggccagcagcttgtcacacaggctcaacttgaggctgcagcacactcagctgtcacagcagtggctgatgctgccatggcccaagcccagggcctgtttggtacagacgagacagtgcccgaacacattcaacagctgcagcaccagggcatcgagtacgacgtcatcaccctggccgatgactgagccccgagggcccaacacagatcatggatttgcggccagctctcctgggggtagggggccaccaggactcacctccctcttcatttaggatctccagatactggatagccagcatcctctcattcccagggagccagacctgtgctgttggggttaggggcagccatgggccccagccaggacatgctgggtgccccagcctgcaggcaggctttgggagagaaatttatttttgtttgggtggacccactggcctgtcagtctcaataaagggaccggagtccagtcctgaacagc

SEQ ID NO: 371251 - DNA, 3750 bp, Homo sapiens
tttagattgtccaaatggtttgcaagcatggaagtcacatctccctccttccctcccatcagccctccagctgcctgacctccctggggaatgccagtgttaaagcactcctattgcttcccgagccttagattgttctgtgaagtcaccaaagccgccattctggcctcccttggataaatggggcaaatgagactccgggagaggaatggctttgtctgtaggtgcacagcatgtcagtgacagagccgtgcctggaacccaggtctcctgactgggaggtcccagctctcgccgttgctctaatccaggccaggtcctactgtgctgacagaatgtcggctgttgggcggtagtatccatgctgccctctaaccacaggctgtctgtgtcatgtgactcaatgcacccatcagtggtctgtgatgagtgggtgggaggatattttggctggcctctggcccacttgtccacgtctgtcctggtgtgtcagtggctggcttgtgacctggcatgtccgtggcaggtgtggaaggagagcctctagtgagttcccagagtggacagagccctccagagccacaggatcccgaggctcccagctcctcaggcccaggacacctggtggccatgggcaaggtgagcaggacccctgtggaagctggtgtgagccagtcagatgcagagaacgcagccccctcctgcccggatgagcatgacactctgccccggcgccgaggtcgaccttccaggcgcttcctaggcaagaaataccgcaagtactattacaagtcgcccaaaccacttttgaggcccttcctgtgccgcatctgtggttctcgctttctgtcccacgaggacctgcgcttccacgtcaactcccatgaggctggcgatccccagctcttcaagtgcctgcagtgcagctatcgttcccgccgctggtcctcgctcaaggagcacatgttcaaccacgtgggcagcaagccctacaagtgtgacgagtgcagctacaccagtgtctaccggaaggacgtcattcggcacgccgctgtgcacagccgggaccggaagaagaggccagatccgactccaaagctgagctctttcccctgccctgtgtgtggccgtgtgtaccccatgcagaaaagactcacgcagcacatgaagacgcacagcactgagaagccccacatgtgtgacaagtgtggaaagtcctttaagaagcgctacaccttcaaaatgcacctgctcacgcacatccaggctgttgccaaccgcaggttcaagtgtgagttctgtgagtttgtttgtgaagacaagaaggcactgctgaaccaccagttgtcccacgtcagtgacaagcccttcaaatgcagcttttgtccctaccgcaccttccgagaggacttcttgctgtcccatgtggctgtcaagcacacaggggccaagcccttcgcctgtgagtactgccacttcagcacacggcacaagaagaacctgcgcctgcacgtacggtgccgacacgcaagcagcttcgaggaatgggggaggcgccaccctgaggagcccccctcccgccgtcgccccttcttctctctgcagcagattgaggagctgaagcagcagcacagtgcggcccctggaccacctcccagttccccaggacctcctgagatacccccagaggcgacaactttccagtcatctgaggctccctcattgctctgttctgacaccctgggcggcgccaccatcatctaccagcaaggagctgaggagtcgacagcgatggccacgcagacagccttggatcttctgctgaacatgagtgctcagcgggaactggggggcacagccctgcaggtggctgtggtgaagtcggaagatgtggaagcagggttagcatcccctggtgggcagccctcccctgaaggtgccactccacaggtggtcaccctccacgtggcagagccagggggcggtgcagcagccgagagccagctaggccctcctgacctaccgcagatcaccctggcacctggtccatttggtgggactggctacagtgtcatcacagcaccccctatggaggagggaacatcagctcctggcacaccttacagcgaggagcccgcaggagaggcagcccaggctgtggttgtgagtgacaccctaaaagaagctggcacccactacatcatggctactgatggtacccagttgcaccacattgagctcaccgcagatggctccatctccttcccaagtccagatgctctggcctctggtgccaaatggcccctgctgcagtgtgggggactgcccagagacggccctgagcccccatctccagccaagacccactgcgtaggggactcccagagctctgcctcctcacctcctgcaaccagcaaagccctgggcctggcagtgcccccgtcaccgccatctgcagccactgctgcatcaaagaagttttcctgcaagatctgtgccgaggccttccctggccgagctgagatggagagtcacaagcgggcccacgctgggcctggtgccttcaagtgccccgactgccccttcagtgcccgccagtggcccgaggtccgggcgcacatggcacagcactcaagcctacggccccaccagtgtagccagtgcagctttgcctccaagaacaagaaggacctgcgtcggcacatgctgactcacacaaaggagaagccttttgcatgccacctctgcgggcagcgtttcaaccgtaacgggcacctcaagttccacatccagcggctgcacagtcctgatgggaggaagtcaggaacccctacagcccgggcccctacccagaccccaacccagaccatcatcctgaacagtgatgacgaaacactggccaccctgcacactgcactccagtccagtcacggggtcctgggcccagagcggctacagcaggcactgagccaggaacacatcatcgttgcccaggaacagacagtgaccaatcaggaggaagccgcctacatccaagagatcaccacggcagatggccagaccgtacagcacctggtgacctccgacaaccaggtgcagtatatcatctcccaggatggtgtccagcacctgctcccccaggaatatgttgtggtccctgaaggccatcacatccaggtacaggagggccagatcacacacatccagtatgaacaaggagccccgttccttcaggagtcccagatccagtatgtgcctgtgtccccaggccagcagcttgtcacacaggctcaacttgaggctgcagcacactcagctgtcacagcagtggctgatgctgccatggcccaagcccagggcctgtttggtacagacgagacagtgcccgaacacattcaacagctgcagcaccagggcatcgagtacgacgtcatcaccctggccgatgactgagccccgagggcccaacacagatcatggatttgcggccagctctcctgggggtagggggccaccaggactcacctccctcttcatttaggatctccagatactggatagccagcatcctctcattcccagggagccagacctgtgctgttggggttaggggcagccatgggccccagccaggacatgctgggtgccccagcctgcaggcaggctttgggagagaaatttatttttgtttgggtggacccactggcctgtcagtctcaataaagggaccggagtccagtcctgaacagc

SEQ ID NO: 371252 - DNA, 4943 bp, Homo sapiens
tgcaacccggggggacgcgggggccgaagggctgaaccactgggcccggatggggctcacagagcggaacgctccacgagaatcgtgggggcgagggaaagggtcaagattaccagccattgaccaccctcccgggaagggccttagcctgggaagcacagcttctccgtcaagtttttcccgagctcccctcgcaatacaccaggaagctccgccccgtcggagactcaatcttcgcatctgcaaaatgggcgcaggggtgcaaatgggtggccgtggttgccggggctggggagatggcccacttgttccagccacggtcacctctcttctcagagtgaagttcccagaccctacgccccgctgtcaggcagcccgccgatcagatggaggagaacgaggtggagagcagcagcgacgcggcccctgggcctggccggcccgaggagccctctgagagcggcctgggtgtgggcacctcagaagccgtgtccgccgacagcagcgacgccgcggccgccccggggcaggcagaggccgatgactctggcgtggggcaaagctcggaccgcggcagccgttctcaggaggaggtatctgagagcagctcgagcgcagaccccctgcctaatagctacctccctgattcatcgtctgtgtctcatgggccagtggcaggggtgacaggcggtcccccagcacttgtgcactctagtgcactcccagaccccaacatgctggtgtccgactgcacagcttcctcctcggacctgggctcggccatcgacaagatcatcgagtccaccatcgggcccgacctcatccagaactgcatcactgtgaccagtgctgaggatggcggggccgagaccacacggtacctgatcctacagggcccagatgatggagcccccatgacatcaccaatgtccagttccaccttggcccacagcctagcagccattgaggccctggcagatggccccacatccacatccacatgcctggaggcacagggtgggcccagctccccggtgcagctgcccccagcctccggtgccgaagagccggacctgcagagcctggaggccatgatggaggtggtggtggtgcagcagttcaaatgcaagatgtgccagtaccggagcagcaccaaggccacactgctgcgccacatgcgggaacgccacttccgtccagtagcagcagccgcagcagcagctggtaaaaaaggacgtctacggaagtggagcacctccaccaagagccaagaggaagagggaccagaggaggaggacgatgatgacattgtagacgctggagccattgatgacctggagggaggatagcgactataatccagctgaggatgagccccgaggccggcagcttcggctccagcgccccacccccagtaccccaaggccccgaaggagacctggccggccccggaagctgccccgcctggagatctcagacctcccagatggtgtggaaggagagcctctagtgagttcccagagtggacagagccctccagagccacaggatcccgaggctcccagctcctcaggcccaggacacctggtggccatgggcaaggtgagcaggacccctgtggaagctggtgtgagccagtcagatgcagagaacgcagccccctcctgcccggatgagcatgacactctgccccggcgccgaggtcgaccttccaggcgcttcctaggcaagaaataccgcaagtactattacaagtcgcccaaaccacttttgaggcccttcctgtgccgcatctgtggttctcgctttctgtcccacgaggacctgcgcttccacgtcaactcccatgaggctggcgatccccagctcttcaagtgcctgcagtgcagctatcgttcccgccgctggtcctcgctcaaggagcacatgttcaaccacgtgggcagcaagccctacaagtgtgacgagtgcagctacaccagtgtctaccggaaggacgtcattcggcacgccgctgtgcacagccgggaccggaagaagaggccagatccgactccaaagctgagctctttcccctgccctgtgtgtggccgtgtgtaccccatgcagaaaagactcacgcagcacatgaagacgcacagcactgagaagccccacatgtgtgacaagtgtggaaagtcctttaagaagcgctacaccttcaaaatgcacctgctcacgcacatccaggctgttgccaaccgcaggttcaagtgtgagttctgtgagtttgtttgtgaagacaagaaggcactgctgaaccaccagttgtcccacgtcagtgacaagcccttcaaatgcagcttttgtccctaccgcaccttccgagaggacttcttgctgtcccatgtggctgtcaagcacacaggggccaagcccttcgcctgtgagtactgccacttcagcacacggcacaagaagaacctgcgcctgcacgtacggtgccgacacgcaagcagcttcgaggaatgggggaggcgccaccctgaggagcccccctcccgccgtcgccccttcttctctctgcagcagattgaggagctgaagcagcagcacagtgcggcccctggaccacctcccagttccccaggacctcctgagatacccccagaggcgacaactttccagtcatctgaggctccctcattgctctgttctgacaccctgggcggcgccaccatcatctaccagcaaggtgagctctgtaggaggataggagctcatggagggtaggacctctgagttgggcaggggcaggtcgtgctggtgggggctggaagatggggagggggtggtattgggtgccagttttctagcactttgtcaggcttaggtcccaccccacccaggagctgaggagtcgacagcgatggccacgcagacagccttggatcttctgctgaacatgagtgctcagcgggaactggggggcacagccctgcaggtggctgtggtgaagtcggaagatgtggaagcagggttagcatcccctggtgggcagccctcccctgaaggtgccactccacaggtggtcaccctccacgtggcagagccagggggcggtgcagcagccgagagccagctaggccctcctgacctaccgcagatcaccctggcacctggtccatttggtgggactggctacagtgtcatcacagcaccccctatggaggagggaacatcagctcctggcacaccttacagcgaggagcccgcaggagaggcagcccaggctgtggttgtgagtgacaccctaaaagaagctggcacccactacatcatggctactgatggtacccagttgcaccacattgaggtgaggcttggggatgccaaccactcccccacctccctccccttctcagtacctcatgctccctgtctctctacagctcaccgcagatggctccatctccttcccaagtccagatgctctggcctctggtgccaaatggcccctgctgcagtgtgggggactgcccagagacggccctgagcccccatctccagccaagacccactgcgtaggggactcccagagctctgcctcctcacctcctgcaaccagcaaagccctgggcctggcagtgcccccgtcaccgccatctgcagccactgctgcatcaaagaagttttcctgcaagatctgtgccgaggccttccctggccgagctgagatggagagtcacaagcgggcccacgctgggcctggtgccttcaagtgccccgactgccccttcagtgcccgccagtggcccgaggtccgggcgcacatggcacagcactcaagcctacggccccaccagtgtagccagtgcagctttgcctccaagaacaagaaggacctgcgtcggcacatgctgactcacacaaaggagaagccttttgcatgccacctctgcgggcagcgtttcaaccgtaacgggcacctcaagttccacatccagcggctgcacagtcctgatgggaggaagtcaggaacccctacagcccgggcccctacccagaccccaacccagaccatcatcctgaacagtgatgacgaaacactggccaccctgcacactgcactccagtccagtcacggggtcctgggcccagagcggctacagcaggcactgagccaggaacacatcatcgttgcccaggaacagacagtgaccaatcaggaggaagccgcctacatccaagagatcaccacggcagatggccagaccgtacagcacctggtgacctccgacaaccaggtgcagtatatcatctcccaggatggtgtccagcacctgctcccccaggaatatgttgtggtccctgaaggccatcacatccaggtacaggagggccagatcacacacatccagtatgaacaaggagccccgttccttcaggagtcccagatccagtatgtgcctgtgtccccaggccagcagcttgtcacacaggctcaacttgaggctgcagcacactcagctgtcacagcagtggctgatgctgccatggcccaagcccagggcctgtttggtacagacgagacagtgcccgaacacattcaacagctgcagcaccagggcatcgagtacgacgtcatcaccctggccgatgactgagccccgagggcccaacacagatcatggatttgcggccagctctcctgggggtagggggccaccaggactcacctccctcttcatttaggatctccagatactggatagccagcatcctctcattcccagggagccagacctgtgctgttggggttaggggcagccatgggccccagccaggacatgctgggtgccccagcctgcaggcaggctttgggagagaaatttatttttgtttgggtggacccactggcctgtcagtctcaataaagggaccggagtccagtcctgaacagc

SEQ ID NO: 371253 - DNA, 2597 bp, Homo sapiens
tgcaacccggggggacgcgggggccgaagggctgaaccactgggcccggatggggctcacagagcggaacgctccacgagaatcgtgggggcgagggaaagggtcaagattaccagccattgaccaccctcccgggaagggccttagcctgggaagcacagcttctccgtcaagtttttcccgagctcccctcgcaatacaccaggaagctccgccccgtcggagactcaatcttcgcatctgcaaaatgggcgcaggggtgcaaatgggtggccgtggttgccggggctggggagatggcccacttgttccagccacggtcacctctcttctcagagtgaagttcccagaccctacgccccgctgtcaggcagcccgccgatcagatggaggagaacgaggtggagagcagcagcgacgcggcccctgggcctggccggcccgaggagccctctgagagcggcctgggtgtgggcacctcagaagccgtgtccgccgacagcagcgacgccgcggccgccccggggcaggcagaggccgatgactctggcgtggggcaaagctcggaccgcggcagccgttctcaggaggaggtatctgagagcagctcgagcgcagaccccctgcctaatagctacctccctgattcatcgtctgtgtctcatgggccagtggcaggggtgacaggcggtcccccagcacttgtgcactctagtgcactcccagaccccaacatgctggtgtccgactgcacagcttcctcctcggacctgggctcggccatcgacaagatcatcgagtccaccatcgggcccgacctcatccagaactgcatcactgtgaccagtgctgaggatggcggggccgagaccacacggtacctgatcctacagggcccagatgatggagcccccatgacatcaccaatgtccagttccaccttggcccacagcctagcagccattgaggccctggcagatggccccacatccacatccacatgcctggaggcacagggtgggcccagctccccggtgcagctgcccccagcctccggtgccgaagagccggacctgcagagcctggaggccatgatggaggtggtggtggtgcagcagttcaaatgcaagatgtgccagtaccggagcagcaccaaggccacactgctgcgccacatgcgggaacgccacttccgtccagtagcagcagccgcagcagcagctggtaaaaaaggacgtctacggaagtggagcacctccaccaagagccaagaggaagagggaccagaggaggaggacgatgatgacattgtagacgctggagccattgatgacctggagggaggatagcgactataatccagctgaggatgagccccgaggccggcagcttcggctccagcgccccacccccagtaccccaaggccccgaaggagacctggccggccccggaagctgccccgcctggagatctcagacctcccagatggtgtggaaggagagcctctagtgagttcccagagtggacagagccctccagagccacaggatcccgaggctcccagctcctcaggcccaggacacctggtggccatgggcaaggtgagcaggacccctgtggaagctggtgtgagccagtcagatgcagagaacgcagccccctcctgcccggatgagcatgacactctgccccggcgccgaggtcgaccttccaggcgcttcctaggcaagaaataccgcaagtactattacaagtcgcccaaaccacttttgaggcccttcctgtgccgcatctgtggttctcgctttctgtcccacgaggacctgcgcttccacgtcaactcccatgaggctggcgatccccagctcttcaagtgcctgcagtgcagctatcgttcccgccgctggtcctcgctcaaggagcacatgttcaaccacgtgggcagcaagccctacaagtgtgacgagtgcagctacaccagtgtctaccggaaggacgtcattcggcacgccgctgtgcacagccgggaccggtcagtgtgggggtgggagggacctgggcaagagaggccaggttgggtggggaagtggaggcccgggataaccatggttcccacttaccgtgctcctgctctgagccagccccatttgctgcacactacaggcatgagcagaaaggcagttcaccccagttcatttggcttagaacaggacagtaccaggccttgaggtccccagctcagcctcttacctcttgtgagctttagtttctcatcaaacggggacagttgttgaagggattgaaggaaattgtgtacctaaaggagttcagtaaatgatccaagatcttctggactccagatcctactcatctctcacagggctgagagtgcacctgagacagagaaacacaagttcttatgcacctaatgattgctcacaggattataattcgatcccgagcttcaggaaggagttcgcttcatgagaggtggtgtgtgagcagaggttggagacagatcccctgggacagtagctccagctgtgtgtgtggaaaagccagcccaagatactttaaggtttcttttttttaaatg

SEQ ID NO: 371254 - DNA, 2512 bp, Homo sapiens
tgcaacccggggggacgcgggggccgaagggctgaaccactgggcccggatggggctcacagagcggaacgctccacgagaatcgtgggggcgagggaaagggtcaagattaccagccattgaccaccctcccgggaagggccttagcctgggaagcacagcttctccgtcaagtttttcccgagctcccctcgcaatacaccaggaagctccgccccgtcggagactcaatcttcgcatctgcaaaatgggcgcaggggtgcaaatgggtggccgtggttgccggggctggggagatggcccacttgttccagccacggtcacctctcttctcagagtgaagttcccagaccctacgccccgctgtcaggcagcccgccgatcagatggaggagaacgaggtggagagcagcagcgacgcggcccctgggcctggccggcccgaggagccctctgagagcggcctgggtgtgggcacctcagaagccgtgtccgccgacagcagcgacgccgcggccgccccggggcaggcagaggccgatgactctggcgtggggcaaagctcggaccgcggcagccgttctcaggaggaggtatctgagagcagctcgagcgcagaccccctgcctaatagctacctccctgattcatcgtctgtgtctcatgggccagtggcaggggtgacaggcggtcccccagcacttgtgcactctagtgcactcccagaccccaacatgctggtgtccgactgcacagcttcctcctcggacctgggctcggccatcgacaagatcatcgagtccaccatcgggcccgacctcatccagaactgcatcactgtgaccagtgctgaggatggcggggccgagaccacacggtacctgatcctacagggcccagatgatggagcccccatgacatcaccaatgtccagttccaccttggcccacagcctagcagccattgaggccctggcagatggccccacatccacatccacatgcctggaggcacagggtgggcccagctccccggtgcagctgcccccagcctccggtgccgaagagccggacctgcagagcctggaggccatgatggaggtggtggtggtgcagcagttcaaatgcaagatgtgccagtaccggagcagcaccaaggccacactgctgcgccacatgcgggaacgccacttccgtccagtagcagcagccgcagcagcagctggtaaaaaaggacgtctacggaagtggagcacctccaccaagagccaagaggaagagggaccagaggaggaggacgatgatgacattgtagacgctggagccattgatgacctggagggaggatagcgactataatccagctgaggatgagccccgaggccggcagcttcggctccagcgccccacccccagtaccccaaggccccgaaggagacctggccggccccggaagctgccccgcctggagatctcagacctcccagatggtgtggaaggagagcctctagtgagttcccagagtggacagagccctccagagccacaggatcccgaggctcccagctcctcaggcccaggacacctggtggccatgggcaaggtgagcaggacccctgtggaagctggtgtgagccagtcagatgcagagaacgcagccccctcctgcccggatgagcatgacactctgccccggcgccgaggtcgaccttccaggcgcttcctaggcaagaaataccgcaagtactattacaagtcgcccaaaccacttttgaggcccttcctgtgccgcatctgtggttctcgctttctgtcccacgaggacctgcgcttccacgtcaactcccatgaggctggcgatccccagctcttcaagtgcctgcagtgcagctatcgttcccgccgctggtcctcgctcaaggagcacatgttcaaccacgtgggcagcaagccctacaagtgtgacgagtgcagctacaccagtgtctaccggaaggacgtcattcggcacgccgctgtgcacagccgggaccggaagaagaggccagatccgactccaaagctgagctctttcccctgccctgtgtgtggccgtgtgtaccccatgcagaaaagactcacgcagcacatgaagacgcacagcactgagaagccccacatgtgtgacaagtgtggaaagtcctttaagaagcgctacaccttcaaaatgcacctgctcacgcacatccaggctgttgccaaccgcaggttcaagtgtgagttctgtgagtttgtttgtgaagacaagaaggcactgctgaaccaccagttgtcccacgtcagtgacaagcccttcaaatgcagcttttgtccctaccgcaccttccgagaggacttcttgctgtcccatgtggctgtcaagcacacaggggccaagcccttcgcctgtggttctcgctttctgtcccacgaggacctgcgcttccacgtcaactcccatgaggctggcgatccccagctctaacagtgccgta

SEQ ID NO: 371255 - DNA, 1205 bp, Homo sapiens
tgcaacccggggggacgcgggggccgaagggctgaaccactgggcccggatggggctcacagagcggaacgctccacgagaatcgtgggggcgagggaaagggtcaagattaccagccattgaccaccctcccgggaagggccttagcctgggaagcacagcttctccgtcaagtttttcccgagctcccctcgcaatacaccaggaagctccgccccgtcggagactcaatcttcgcatctgcaaaatgggcgcaggggtgcaaatgggtggccgtggttgccggggctggggagatggcccacttgttccagccacggtcacctctcttctcagagtgaagttcccagaccctacgccccgctgtcaggcagcccgccgatcagatggaggagaacgaggtggagagcagcagcgacgcggcccctgggcctggccggcccgaggagccctctgagagcggcctgggtgtgggcacctcagaagccgtgtccgccgacagcagcgacgccgcggccgccccggggcaggcagaggccgatgactctggcgtggggcaaagctcggaccgcggcagccgttctcaggaggaggtatctgagagcagctcgagcgcagaccccctgcctaatagctacctccctgattcatcgtctgtgtctcatgggccagtggcaggggtgacaggcggtcccccagcacttgtgcactctagtgcactcccagaccccaacatgctggtgtccgactgcacagcttcctcctcggacctgggctcggccatcgacaagatcatcgagtccaccatcgggcccgacctcatccagaactgcatcactgtgaccagtgctgaggatggcggggccgagaccacacggtacctgatcctacagggcccagatgatggagcccccatgacatcaccaatgtccagttccaccttggcccacagcctagcaccatgggccccagccaggacatgctgggtgccccagcctgcaggcaggctttgggagagaaatttatttttgtttgggtggacccactggcctgtcagtctcaataaagggaccggagtccagtcctgaacagcttactttgtctgcttgctgctgtagcctgtaccaggccaggtcttgtgaggtggaggctgcctggctccacagcgtgccctgtcctgccctgcccctgttaagtccggtgat

SEQ ID NO: 371256 - DNA, 2944 bp, Homo sapiens
gagtctggcgtgctggcctgggaagggaacctgcccgggggttgtttatgggggtgaggacaagaggggaggttttatcctccctcctccacttctttctccatctggccccttcttatgccttcctagactccaaagctgagctctttcccctgccctgtgtgtggccgtgtgtaccccatgcagaaaagactcacgcagcacatgaagacgcacagcactgagaagccccacatgtgtgacaagtgtggaaagtcctttaagaagcgctacaccttcaaaatgcacctgctcacgcacatccaggctgttgccaaccgcaggttcaagtgtgagttctgtgagtttgtttgtgaagacaagaaggcactgctgaaccaccagttgtcccacgtcagtgacaagcccttcaaatgcagcttttgtccctaccgcaccttccgagaggacttcttgctgtcccatgtggctgtcaagcacacaggggccaagcccttcgcctgtgagtactgccacttcagcacacggcacaagaagaacctgcgcctgcacgtacggtgccgacacgcaagcagcttcgaggaatgggggaggcgccaccctgaggagcccccctcccgccgtcgccccttcttctctctgcagcagattgaggagctgaagcagcagcacagtgcggcccctggaccacctcccagttccccaggacctcctgagatacccccagaggcgacaactttccagtcatctgaggctccctcattgctctgttctgacaccctgggcggcgccaccatcatctaccagcaaggtgagctctgtaggaggataggagctcatggagggtaggacctctgagttgggcaggggcaggtcgtgctggtgggggctggaagatggggagggggtggtattgggtgccagttttctagcactttgtcaggcttaggtcccaccccacccaggagctgaggagtcgacagcgatggccacgcagacagccttggatcttctgctgaacatgagtgctcagcgggaactggggggcacagccctgcaggtggctgtggtgaagtcggaagatgtggaagcagggttagcatcccctggtgggcagccctcccctgaaggtgccactccacaggtggtcaccctccacgtggcagagccagggggcggtgcagcagccgagagccagctaggccctcctgacctaccgcagatcaccctggcacctggtccatttggtgggactggctacagtgtcatcacagcaccccctatggaggagggaacatcagctcctggcacaccttacagcgaggagcccgcaggagaggcagcccaggctgtggttgtgagtgacaccctaaaagaagctggcacccactacatcatggctactgatggtacccagttgcaccacattgagctcaccgcagatggctccatctccttcccaagtccagatgctctggcctctggtgccaaatggcccctgctgcagtgtgggggactgcccagagacggccctgagcccccatctccagccaagacccactgcgtaggggactcccagagctctgcctcctcacctcctgcaaccagcaaagccctgggcctggcagtgcccccgtcaccgccatctgcagccactgctgcatcaaagaagttttcctgcaagatctgtgccgaggccttccctggccgagctgagatggagagtcacaagcgggcccacgctgggcctggtgccttcaagtgccccgactgccccttcagtgcccgccagtggcccgaggtccgggcgcacatggcacagcactcaagcctacggccccaccagtgtagccagtgcagctttgcctccaagaacaagaaggacctgcgtcggcacatgctgactcacacaaaggagaagccttttgcatgccacctctgcgggcagcgtttcaaccgtaacgggcacctcaagttccacatccagcggctgcacagtcctgatgggaggaagtcaggaacccctacagcccgggcccctacccagaccccaacccagaccatcatcctgaacagtgatgacgaaacactggccaccctgcacactgcactccagtccagtcacggggtcctgggcccagagcggctacagcaggcactgagccaggaacacatcatcgttgcccaggaacagacagtgaccaatcaggaggaagccgcctacatccaagagatcaccacggcagatggccagaccgtacagcacctggtgacctccgacaaccaggtgcagtatatcatctcccaggatggtgtccagcacctgctcccccaggaatatgttgtggtccctgaaggccatcacatccaggtacaggagggccagatcacacacatccagtatgaacaaggagccccgttccttcaggagtcccagatccagtatgtgcctgtgtccccaggccagcagcttgtcacacaggctcaacttgaggctgcagcacactcagctgtcacagcagtggctgatgctgccatggcccaagcccagggcctgtttggtacagacgagacagtgcccgaacacattcaacagctgcagcaccagggcatcgagtacgacgtcatcaccctggccgatgactgagccccgagggcccaacacagatcatggatttgcggccagctctcctgggggtagggggccaccaggactcacctccctcttcatttaggatctccagatactggatagccagcatcctctcattcccagggagccagacctgtgctgttggggttaggggcagccatgggccccagccaggacatgctgggtgccccagcctgcaggcaggctttgggagagaaatttatttttgtttgggtggacccactggcctgtcagtctcaataaagggaccggagtccagtcctgaacagc

SEQ ID NO: 371257 - DNA, 685 bp, Homo sapiens
tcgccatgcccgccccccccaccaacaggtgcagtatatcatctcccaggatggtgtccagcacctgctcccccaggaatatgttgtggtccctgaaggccatcacatccaggtacaggagggccagatcacacacatccagtatgaacaaggagccccgttccttcaggagtcccagatccagtatgtgcctgtgtccccaggccagcagcttgtcacacaggctcaacttgaggctgcagcacactcagctgtcacagcagtggctgatgctgccatggcccaagcccagggcctgtttggtacagacgagacagtgcccgaacacattcaacagctgcagcaccagggcatcgagtacgacgtcatcaccctggccgatgactgagccccgagggcccaacacagatcatggatttgcggccagctctcctgggggtagggggccaccaggactcacctccctcttcatttaggatctccagatactggatagccagcatcctctcattcccagggagccagacctgtgctgttggggttaggggcagccatgggccccagccaggacatgctgggtgccccagcctgcaggcaggctttgggagagaaatttatttttgtttgggtggacccactggcctgtcagtctcaataaagggaccggagtccagtcctgaacagc

SEQ ID NO: 371258 - DNA, 336 bp, Homo sapiens
atttacaagagacatggtagagggtcatttggtaacagggcagagccacagttgaaccctgggcccttctgacttgagtccatctgtggtgacagtcactcctcagttgatgcctgttgcttggggaagggggctcctgtggccctccatcttctcctagaaccttctccatgcccacagcgaggagcccgcaggagaggcagcccaggctgtggttgtgagtgacaccctaaaagaagctggcacccactacatcatggctactgatggtacccagttgcaccacattgaggtgaggcttggggatgccaaccactcccccacctccctcccctt

SEQ ID NO: 371259 - DNA, 1721 bp, Homo sapiens
tttagattgtccaaatggtttgcaagcatggaagtcacatctccctccttccctcccatcagccctccagctgcctgacctccctggggaatgccagtgttaaagcactcctattgcttcccgagccttagattgttctgtgaagtcaccaaagccgccattctggcctcccttggataaatggggcaaatgagactccgggagaggaatggctttgtctgtaggtgcacagcatgtcagtgacagagccgtgcctggaacccaggtctcctgactgggaggtcccagctctcgccgttgctctaatccaggccaggtcctactgtgctgacagaatgtcggctgttgggcggtagtatccatgctgccctctaaccacaggctgtctgtgtcatgtgactcaatgcacccatcagtggtctgtgatgagtgggtgggaggatattttggctggcctctggcccacttgtccacgtctgtcctggtgtgtcagtggctggcttgtgacctggcatgtccgtggcaggtgtggaaggagagcctctagtgagttcccagagtggacagagccctccagagccacaggatcccgaggctcccagctcctcaggcccaggacacctggtggccatgggcaaggtgagcaggacccctgtggaagctggtgtgagccagtcagatgcagagaacgcagccccctcctgcccggatgagcatgacactctgccccggcgccgaggtcgaccttccaggcgcttcctaggcaagaaataccgcaagtatgtggagcagaggtgagggtggggcatgcatgtggttaagccaccaaccccaccagacctttccgccacactctcatcctgcaggtactattacaagtcgcccaaaccacttttgaggcccttcctgtgccgcatctgtggttctcgctttctgtcccacgaggacctgcgcttccacgtcaactcccatgaggctggcgatccccagctcttcaagtgcctgcagtgcagctatcgttcccgccgctggtcctcgctcaaggagcacatgttcaaccacgtgggcagcaagccctacaagtgtgacgagtgcagctacaccagtgtctaccggaaggacgtcattcggcacgccgctgtgcacagccgggaccggtcagtgtgggggtgggagggacctgggcaagagaggccaggttgggtggggaagtggaggcccgggataaccatggttcccacttaccgtgctcctgctctgagccagccccatttgctgcacactacaggcatgagcagaaaggcagttcaccccagttcatttggcttagaacaggacagtaccaggccttgaggtccccagctcagcctcttacctcttgtgagctttagtttctcatcaaacggggacagttgttgaagggattgaaggaaattgtgtacctaaaggagttcagtaaatgatccaagatcttctggactccagatcctactcatctctcacagggctgagagtgcacctgagacagagaaacacaagttcttatgcacctaatgattgctcacaggattataattcgatcccgagcttcaggaaggagttcgcttcatgagaggtggtgtgtgagcagaggttggagacagatcccctgggacagtagctccagctgtgtgtgtggaaaagccagcccaagatactttaaggtttcttttttttaaatg

SEQ ID NO: 371260 - DNA, 4713 bp, Homo sapiens
tgcaacccggggggacgcgggggccgaagggctgaaccactgggcccggatggggctcacagagcggaacgctccacgagaatcgtgggggcgagggaaagggtcaagattaccagccattgaccaccctcccgggaagggccttagcctgggaagcacagcttctccgtcaagtttttcccgagctcccctcgcaatacaccaggaagctccgccccgtcggagactcaatcttcgcatctgcaaaatgggcgcaggggtgcaaatgggtggccgtggttgccggggctggggagatggcccacttgttccagccacggtcacctctcttctcagagtgaagttcccagaccctacgccccgctgtcaggcagcccgccgatcagatggaggagaacgaggtggagagcagcagcgacgcggcccctgggcctggccggcccgaggagccctctgagagcggcctgggtgtgggcacctcagaagccgtgtccgccgacagcagcgacgccgcggccgccccggggcaggcagaggccgatgactctggcgtggggcaaagctcggaccgcggcagccgttctcaggaggaggtatctgagagcagctcgagcgcagaccccctgcctaatagctacctccctgattcatcgtctgtgtctcatgggccagtggcaggggtgacaggcggtcccccagcacttgtgcactctagtgcactcccagaccccaacatgctggtgtccgactgcacagcttcctcctcggacctgggctcggccatcgacaagatcatcgagtccaccatcgggcccgacctcatccagaactgcatcactgtgaccagtgctgaggatggcggggccgagaccacacggtacctgatcctacagggcccagatgatggagcccccatgacatcaccaatgtccagttccaccttggcccacagcctagcagccattgaggccctggcagatggccccacatccacatccacatgcctggaggcacagggtgggcccagctccccggtgcagctgcccccagcctccggtgccgaagagccggacctgcagagcctggaggccatgatggaggtggtggtggtgcagcagttcaaatgcaagatgtgccagtaccggagcagcaccaaggccacactgctgcgccacatgcgggaacgccacttccgtccagtagcagcagccgcagcagcagctggtaaaaaaggacgtctacggaagtggagcacctccaccaagagccaagaggaagagggaccagaggaggaggacgatgatgacattgtagacgctggagccattgatgacctggagggaggatagcgactataatccagctgaggatgagccccgaggccggcagcttcggctccagcgccccacccccagtaccccaaggccccgaaggagacctggccggccccggaagctgccccgcctggagatctcagacctcccagatggtgtggaaggagagcctctagtgagttcccagagtggacagagccctccagagccacaggatcccgaggctcccagctcctcaggcccaggacacctggtggccatgggcaaggtgagcaggacccctgtggaagctggtgtgagccagtcagatgcagagaacgcagccccctcctgcccggatgagcatgacactctgccccggcgccgaggtcgaccttccaggcgcttcctaggcaagaaataccgcaagtactattacaagtcgcccaaaccacttttgaggcccttcctgtgccgcatctgtggttctcgctttctgtcccacgaggacctgcgcttccacgtcaactcccatgaggctggcgatccccagctcttcaagtgcctgcagtgcagctatcgttcccgccgctggtcctcgctcaaggagcacatgttcaaccacgtgggcagcaagccctacaagtgtgacgagtgcagctacaccagtgtctaccggaaggacgtcattcggcacgccgctgtgcacagccgggaccggaagaagaggccagatccgactccaaagctgagctctttcccctgccctgtgtgtggccgtgtgtaccccatgcagaaaagactcacgcagcacatgaagacgcacagcactgagaagccccacatgtgtgacaagtgtggaaagtcctttaagaagcgctacaccttcaaaatgcacctgctcacgcacatccaggctgttgccaaccgcaggttcaagtgtgagttctgtgagtttgtttgtgaagacaagaaggcactgctgaaccaccagttgtcccacgtcagtgacaagcccttcaaatgcagcttttgtccctaccgcaccttccgagaggacttcttgctgtcccatgtggctgtcaagcacacaggggccaagcccttcgcctgtgagtactgccacttcagcacacggcacaagaagaacctgcgcctgcacgtacggtgccgacacgcaagcagcttcgaggaatgggggaggcgccaccctgaggagcccccctcccgccgtcgccccttcttctctctgcagcagattgaggagctgaagcagcagcacagtgcggcccctggaccacctcccagttccccaggacctcctgagatacccccagaggcgacaactttccagtcatctgaggctccctcattgctctgttctgacaccctgggcggcgccaccatcatctaccagcaaggagctgaggagtcgacagcgatggccacgcagacagccttggatcttctgctgaacatgagtgctcagcgggaactggggggcacagccctgcaggtggctgtggtgaagtcggaagatgtggaagcagggttagcatcccctggtgggcagccctcccctgaaggtgccactccacaggtggtcaccctccacgtggcagagccagggggcggtgcagcagccgagagccagctaggccctcctgacctaccgcagatcaccctggcacctggtccatttggtgggactggctacagtgtcatcacagcaccccctatggaggagggaacatcagctcctggcacaccttacagcgaggagcccgcaggagaggcagcccaggctgtggttgtgagtgacaccctaaaagaagctggcacccactacatcatggctactgatggtacccagttgcaccacattgagctcaccgcagatggctccatctccttcccaagtccagatgctctggcctctggtgccaaatggcccctgctgcagtgtgggggactgcccagagacggccctgagcccccatctccagccaagacccactgcgtaggggactcccagagctctgcctcctcacctcctgcaaccagcaaagccctgggcctggcagtgcccccgtcaccgccatctgcagccactgctgcatcaaagaagttttcctgcaagatctgtgccgaggccttccctggccgagctgagatggagagtcacaagcgggcccacgctgggcctggtgccttcaagtgccccgactgccccttcagtgcccgccagtggcccgaggtccgggcgcacatggcacagcactcaagcctacggccccaccagtgtagccagtgcagctttgcctccaagaacaagaaggacctgcgtcggcacatgctgactcacacaaaggagaagccttttgcatgccacctctgcgggcagcgtttcaaccgtaacgggcacctcaagttccacatccagcggctgcacagtcctgatgggaggaagtcaggaacccctacagcccgggcccctacccagaccccaacccagaccatcatcctgaacagtgatgacgaaacactggccaccctgcacactgcactccagtccagtcacggggtcctgggcccagagcggctacagcaggcactgagccaggaacacatcatcgttgcccaggaacagacagtgaccaatcaggaggaagccgcctacatccaagagatcaccacggcagatggccagaccgtacagcacctggtgacctccgacaaccaggtgcagtatatcatctcccaggatggtgtccagcacctgctcccccaggaatatgttgtggtccctgaaggccatcacatccaggtacaggagggccagatcacacacatccagtatgaacaaggagccccgttccttcaggagtcccagatccagtatgtgcctgtgtccccaggccagcagcttgtcacacaggctcaacttgaggctgcagcacactcagctgtcacagcagtggctgatgctgccatggcccaagcccagggcctgtttggtacagacgagacagtgcccgaacacattcaacagctgcagcaccagggcatcgagtacgacgtcatcaccctggccgatgactgagccccgagggcccaacacagatcatggatttgcggccagctctcctgggggtagggggccaccaggactcacctccctcttcatttaggatctccagatactggatagccagcatcctctcattcccagggagccagacctgtgctgttggggttaggggcagccatgggccccagccaggacatgctgggtgccccagcctgcaggcaggctttgggagagaaatttatttttgtttgggtggacccactggcctgtcagtctcaataaagggaccggagtccagtcctgaacagc

SEQ ID NO: 371261 - DNA, 4825 bp, Homo sapiens
tgcaacccggggggacgcgggggccgaagggctgaaccactgggcccggatggggctcacagagcggaacgctccacgagaatcgtgggggcgagggaaagggtcaagattaccagccattgaccaccctcccgggaagggccttagcctgggaagcacagcttctccgtcaagtttttcccgagctcccctcgcaatacaccaggaagctccgccccgtcggagactcaatcttcgcatctgcaaaatgggcgcaggggtgcaaatgggtggccgtggttgccggggctggggagatggcccacttgttccagccacggtcacctctcttctcagagtgaagttcccagaccctacgccccgctgtcaggcagcccgccgatcagatggaggagaacgaggtggagagcagcagcgacgcggcccctgggcctggccggcccgaggagccctctgagagcggcctgggtgtgggcacctcagaagccgtgtccgccgacagcagcgacgccgcggccgccccggggcaggcagaggccgatgactctggcgtggggcaaagctcggaccgcggcagccgttctcaggaggaggtatctgagagcagctcgagcgcagaccccctgcctaatagctacctccctgattcatcgtctgtgtctcatgggccagtggcaggggtgacaggcggtcccccagcacttgtgcactctagtgcactcccagaccccaacatgctggtgtccgactgcacagcttcctcctcggacctgggctcggccatcgacaagatcatcgagtccaccatcgggcccgacctcatccagaactgcatcactgtgaccagtgctgaggatggcggggccgagaccacacggtacctgatcctacagggcccagatgatggagcccccatgacatcaccaatgtccagttccaccttggcccacagcctagcagccattgaggccctggcagatggccccacatccacatccacatgcctggaggcacagggtgggcccagctccccggtgcagctgcccccagcctccggtgccgaagagccggacctgcagagcctggaggccatgatggaggtggtggtggtgcagcagttcaaatgcaagatgtgccagtaccggagcagcaccaaggccacactgctgcgccacatgcgggaacgccacttccgtccagtagcagcagccgcagcagcagctggtaaaaaaggacgtctacggaagtggagcacctccaccaagagccaagaggaagagggaccagaggaggaggacgatgatgacattgtagacgctggagccattgatgacctggagggaggatagcgactataatccagctgaggatgagccccgaggccggcagcttcggctccagcgccccacccccagtaccccaaggccccgaaggagacctggccggccccggaagctgccccgcctggagatctcagacctcccagatggtgtggaaggagagcctctagtgagttcccagagtggacagagccctccagagccacaggatcccgaggctcccagctcctcaggcccaggacacctggtggccatgggcaaggtgagcaggacccctgtggaagctggtgtgagccagtcagatgcagagaacgcagccccctcctgcccggatgagcatgacactctgccccggcgccgaggtcgaccttccaggcgcttcctaggcaagaaataccgcaagtactattacaagtcgcccaaaccacttttgaggcccttcctgtgccgcatctgtggttctcgctttctgtcccacgaggacctgcgcttccacgtcaactcccatgaggctggcgatccccagctcttcaagtgcctgcagtgcagctatcgttcccgccgctggtcctcgctcaaggagcacatgttcaaccacgtgggcagcaagccctacaagtgtgacgagtgcagctacaccagtgtctaccggaaggacgtcattcggcacgccgctgtgcacagccgggaccggaagaagaggccagatccgactccaaagctgagctctttcccctgccctgtgtgtggccgtgtgtaccccatgcagaaaagactcacgcagcacatgaagacgcacagcactgagaagccccacatgtgtgacaagtgtggaaagtcctttaagaagcgctacaccttcaaaatgcacctgctcacgcacatccaggctgttgccaaccgcaggttcaagtgtgagttctgtgagtttgtttgtgaagacaagaaggcactgctgaaccaccagttgtcccacgtcagtgacaagcccttcaaatgcagcttttgtccctaccgcaccttccgagaggacttcttgctgtcccatgtggctgtcaagcacacaggggccaagcccttcgcctgtgagtactgccacttcagcacacggcacaagaagaacctgcgcctgcacgtacggtgccgacacgcaagcagcttcgaggaatgggggaggcgccaccctgaggagcccccctcccgccgtcgccccttcttctctctgcagcagattgaggagctgaagcagcagcacagtgcggcccctggaccacctcccagttccccaggacctcctgagatacccccagaggcgacaactttccagtcatctgaggctccctcattgctctgttctgacaccctgggcggcgccaccatcatctaccagcaaggagctgaggagtcgacagcgatggccacgcagacagccttggatcttctgctgaacatgagtgctcagcgggaactggggggcacagccctgcaggtggctgtggtgaagtcggaagatgtggaagcagggttagcatcccctggtgggcagccctcccctgaaggtgccactccacaggtggtcaccctccacgtggcagagccagggggcggtgcagcagccgagagccagctaggccctcctgacctaccgcagatcaccctggcacctggtccatttggtgggactggctacagtgtcatcacagcaccccctatggaggagggaacatcagctcctggcacaccttacagcgaggagcccgcaggagaggcagcccaggctgtggttgtgagtgacaccctaaaagaagctggcacccactacatcatggctactgatggtacccagttgcaccacattgagctcaccgcagatggctccatctccttcccaagtccagatgctctggcctctggtgccaaatggcccctgctgcagtgtgggggactgcccagagacggccctgagcccccatctccagccaagacccactgcgtaggggactcccagagctctgcctcctcacctcctgcaaccagcaaagccctgggcctggcagtgcccccgtcaccgccatctgcagccactgctgcatcaaagaagttttcctgcaagatctgtgccgaggccttccctggccgagctgagatggagagtcacaagcgggcccacgctgggcctggtgccttcaagtgccccgactgccccttcagtgcccgccagtggcccgaggtccgggcgcacatggcacagcactcaagcctacggccccaccagtgtagccagtgcagctttgcctccaagaacaagaaggacctgcgtcggcacatgctgactcacacaaaggagaagccttttgcatgccacctctgcgggcagcgtttcaaccgtaacgggcacctcaagttccacatccagcggctgcacagtcctgatgggaggaagtcaggaacccctacagcccgggcccctacccagaccccaacccagaccatcatcctgaacagtgatgacgaaacactggccaccctgcacactgcactccagtccagtcacggggtcctgggcccagagcggctacagcaggcactgagccaggaacacatcatcgttgcccaggaacagacagtgaccaatcaggaggaagccgcctacatccaagagatcaccacggcagatggccagaccgtacagcacctggtgacctccgacaaccaggtgcagtatatcatctcccaggatggtgtccagcacctgctcccccaggaatatgttgtggtccctgaaggccatcacatccaggtacaggagggccagatcacacacatccagtatgaacaaggagccccgttccttcaggagtcccagatccagtatgtgcctgtgtccccaggccagcagcttgtcacacaggctcaacttgaggctgcagcacactcagctgtcacagcagtggctgatgctgccatggcccaagcccagggcctgtttggtacagacgagacagtgcccgaacacattcaacagctgcagcaccagggcatcgagtacgacgtcatcaccctggccgatgactgagccccgagggcccaacacagatcatggatttgcggccagctctcctgggggtagggggccaccaggactcacctccctcttcatttaggatctccagatactggatagccagcatcctctcattcccagggagccagacctgtgctgttggggttaggggcagccatgggccccagccaggacatgctgggtgccccagcctgcaggcaggctttgggagagaaatttatttttgtttgggtggacccactggcctgtcagtctcaataaagggaccggagtccagtcctgaacagcttactttgtctgcttgctgctgtagcctgtaccaggccaggtcttgtgaggtggaggctgcctggctccacagcgtgccctgtcctgccctgcccctgttaagtccggtgat

SEQ ID NO: 371262 - DNA, 4867 bp, Homo sapiens
tgcaacccggggggacgcgggggccgaagggctgaaccactgggcccggatggggctcacagagcggaacgctccacgagaatcgtgggggcgagggaaagggtcaagattaccagccattgaccaccctcccgggaagggccttagcctgggaagcacagcttctccgtcaagtttttcccgagctcccctcgcaatacaccaggaagctccgccccgtcggagactcaatcttcgcatctgcaaaatgggcgcaggggtgcaaatgggtggccgtggttgccggggctggggagatggcccacttgttccagccacggtcacctctcttctcagagtgaagttcccagaccctacgccccgctgtcaggcagcccgccgatcagatggaggagaacgaggtggagagcagcagcgacgcggcccctgggcctggccggcccgaggagccctctgagagcggcctgggtgtgggcacctcagaagccgtgtccgccgacagcagcgacgccgcggccgccccggggcaggcagaggccgatgactctggcgtggggcaaagctcggaccgcggcagccgttctcaggaggaggtatctgagagcagctcgagcgcagaccccctgcctaatagctacctccctgattcatcgtctgtgtctcatgggccagtggcaggggtgacaggcggtcccccagcacttgtgcactctagtgcactcccagaccccaacatgctggtgtccgactgcacagcttcctcctcggacctgggctcggccatcgacaagatcatcgagtccaccatcgggcccgacctcatccagaactgcatcactgtgaccagtgctgaggatggcggggccgagaccacacggtacctgatcctacagggcccagatgatggagcccccatgacatcaccaatgtccagttccaccttggcccacagcctagcagccattgaggccctggcagatggccccacatccacatccacatgcctggaggcacagggtgggcccagctccccggtgcagctgcccccagcctccggtgccgaagagccggacctgcagagcctggaggccatgatggaggtggtggtggtgcagcagttcaaatgcaagatgtgccagtaccggagcagcaccaaggccacactgctgcgccacatgcgggaacgccacttccgtccagtagcagcagccgcagcagcagctggtaaaaaaggacgtctacggaagtggagcacctccaccaagagccaagaggaagagggaccagaggaggaggacgatgatgacattgtagacgctggagccattgatgacctggagggaggatagcgactataatccagctgaggatgagccccgaggccggcagcttcggctccagcgccccacccccagtaccccaaggccccgaaggagacctggccggccccggaagctgccccgcctggagatctcagacctcccagatggtgtggaaggagagcctctagtgagttcccagagtggacagagccctccagagccacaggatcccgaggctcccagctcctcaggcccaggacacctggtggccatgggcaaggtgagcaggacccctgtggaagctggtgtgagccagtcagatgcagagaacgcagccccctcctgcccggatgagcatgacactctgccccggcgccgaggtcgaccttccaggcgcttcctaggcaagaaataccgcaagtactattacaagtcgcccaaaccacttttgaggcccttcctgtgccgcatctgtggttctcgctttctgtcccacgaggacctgcgcttccacgtcaactcccatgaggctggcgatccccagctcttcaagtgcctgcagtgcagctatcgttcccgccgctggtcctcgctcaaggagcacatgttcaaccacgtgggcagcaagccctacaagtgtgacgagtgcagctacaccagtgtctaccggaaggacgtcattcggcacgccgctgtgcacagccgggaccggaagaagaggccagatccgactccaaagctgagctctttcccctgccctgtgtgtggccgtgtgtaccccatgcagaaaagactcacgcagcacatgaagacgcacagcactgagaagccccacatgtgtgacaagtgtggaaagtcctttaagaagcgctacaccttcaaaatgcacctgctcacgcacatccaggctgttgccaaccgcaggttcaagtgtgagttctgtgagtttgtttgtgaagacaagaaggcactgctgaaccaccagttgtcccacgtcagtgacaagcccttcaaatgcagcttttgtccctaccgcaccttccgagaggacttcttgctgtcccatgtggctgtcaagcacacaggggccaagcccttcgcctgtgagtactgccacttcagcacacggcacaagaagaacctgcgcctgcacgtacggtgccgacacgcaagcagcttcgaggaatgggggaggcgccaccctgaggagcccccctcccgccgtcgccccttcttctctctgcagcagattgaggagctgaagcagcagcacagtgcggcccctggaccacctcccagttccccaggacctcctgagatacccccagaggcgacaactttccagtcatctgaggctccctcattgctctgttctgacaccctgggcggcgccaccatcatctaccagcaaggtgagctctgtaggaggataggagctcatggagggtaggacctctgagttgggcaggggcaggtcgtgctggtgggggctggaagatggggagggggtggtattgggtgccagttttctagcactttgtcaggcttaggtcccaccccacccaggagctgaggagtcgacagcgatggccacgcagacagccttggatcttctgctgaacatgagtgctcagcgggaactggggggcacagccctgcaggtggctgtggtgaagtcggaagatgtggaagcagggttagcatcccctggtgggcagccctcccctgaaggtgccactccacaggtggtcaccctccacgtggcagagccagggggcggtgcagcagccgagagccagctaggccctcctgacctaccgcagatcaccctggcacctggtccatttggtgggactggctacagtgtcatcacagcaccccctatggaggagggaacatcagctcctggcacaccttacagcgaggagcccgcaggagaggcagcccaggctgtggttgtgagtgacaccctaaaagaagctggcacccactacatcatggctactgatggtacccagttgcaccacattgagctcaccgcagatggctccatctccttcccaagtccagatgctctggcctctggtgccaaatggcccctgctgcagtgtgggggactgcccagagacggccctgagcccccatctccagccaagacccactgcgtaggggactcccagagctctgcctcctcacctcctgcaaccagcaaagccctgggcctggcagtgcccccgtcaccgccatctgcagccactgctgcatcaaagaagttttcctgcaagatctgtgccgaggccttccctggccgagctgagatggagagtcacaagcgggcccacgctgggcctggtgccttcaagtgccccgactgccccttcagtgcccgccagtggcccgaggtccgggcgcacatggcacagcactcaagcctacggccccaccagtgtagccagtgcagctttgcctccaagaacaagaaggacctgcgtcggcacatgctgactcacacaaaggagaagccttttgcatgccacctctgcgggcagcgtttcaaccgtaacgggcacctcaagttccacatccagcggctgcacagtcctgatgggaggaagtcaggaacccctacagcccgggcccctacccagaccccaacccagaccatcatcctgaacagtgatgacgaaacactggccaccctgcacactgcactccagtccagtcacggggtcctgggcccagagcggctacagcaggcactgagccaggaacacatcatcgttgcccaggaacagacagtgaccaatcaggaggaagccgcctacatccaagagatcaccacggcagatggccagaccgtacagcacctggtgacctccgacaaccaggtgcagtatatcatctcccaggatggtgtccagcacctgctcccccaggaatatgttgtggtccctgaaggccatcacatccaggtacaggagggccagatcacacacatccagtatgaacaaggagccccgttccttcaggagtcccagatccagtatgtgcctgtgtccccaggccagcagcttgtcacacaggctcaacttgaggctgcagcacactcagctgtcacagcagtggctgatgctgccatggcccaagcccagggcctgtttggtacagacgagacagtgcccgaacacattcaacagctgcagcaccagggcatcgagtacgacgtcatcaccctggccgatgactgagccccgagggcccaacacagatcatggatttgcggccagctctcctgggggtagggggccaccaggactcacctccctcttcatttaggatctccagatactggatagccagcatcctctcattcccagggagccagacctgtgctgttggggttaggggcagccatgggccccagccaggacatgctgggtgccccagcctgcaggcaggctttgggagagaaatttatttttgtttgggtggacccactggcctgtcagtctcaataaagggaccggagtccagtcctgaacagc

SEQ ID NO: 371263 - DNA, 5034 bp, Homo sapiens
tgcaacccggggggacgcgggggccgaagggctgaaccactgggcccggatggggctcacagagcggaacgctccacgagaatcgtgggggcgagggaaagggtcaagattaccagccattgaccaccctcccgggaagggccttagcctgggaagcacagcttctccgtcaagtttttcccgagctcccctcgcaatacaccaggaagctccgccccgtcggagactcaatcttcgcatctgcaaaatgggcgcaggggtgcaaatgggtggccgtggttgccggggctggggagatggcccacttgttccagccacggtcacctctcttctcagagtgaagttcccagaccctacgccccgctgtcaggcagcccgccgatcagatggaggagaacgaggtggagagcagcagcgacgcggcccctgggcctggccggcccgaggagccctctgagagcggcctgggtgtgggcacctcagaagccgtgtccgccgacagcagcgacgccgcggccgccccggggcaggcagaggccgatgactctggcgtggggcaaagctcggaccgcggcagccgttctcaggaggaggtatctgagagcagctcgagcgcagaccccctgcctaatagctacctccctgattcatcgtctgtgtctcatgggccagtggcaggggtgacaggcggtcccccagcacttgtgcactctagtgcactcccagaccccaacatgctggtgtccgactgcacagcttcctcctcggacctgggctcggccatcgacaagatcatcgagtccaccatcgggcccgacctcatccagaactgcatcactgtgaccagtgctgaggatggcggggccgagaccacacggtacctgatcctacagggcccagatgatggagcccccatgacatcaccaatgtccagttccaccttggcccacagcctagcagccattgaggccctggcagatggccccacatccacatccacatgcctggaggcacagggtgggcccagctccccggtgcagctgcccccagcctccggtgccgaagagccggacctgcagagcctggaggccatgatggaggtggtggtggtgcagcagttcaaatgcaagatgtgccagtaccggagcagcaccaaggccacactgctgcgccacatgcgggaacgccacttccgtccagtagcagcagccgcagcagcagctggtaaaaaaggacgtctacggaagtggagcacctccaccaagagccaagaggaagagggaccagaggaggaggacgatgatgacattgtagacgctggagccattgatgacctggagggaggatagcgactataatccagctgaggatgagccccgaggccggcagcttcggctccagcgccccacccccagtaccccaaggccccgaaggagacctggccggccccggaagctgccccgcctggagatctcagacctcccagatggtgtggaaggagagcctctagtgagttcccagagtggacagagccctccagagccacaggatcccgaggctcccagctcctcaggcccaggacacctggtggccatgggcaaggtgagcaggacccctgtggaagctggtgtgagccagtcagatgcagagaacgcagccccctcctgcccggatgagcatgacactctgccccggcgccgaggtcgaccttccaggcgcttcctaggcaagaaataccgcaagtactattacaagtcgcccaaaccacttttgaggcccttcctgtgccgcatctgtggttctcgctttctgtcccacgaggacctgcgcttccacgtcaactcccatgaggctggcgatccccagctcttcaagtgcctgcagtgcagctatcgttcccgccgctggtcctcgctcaaggagcacatgttcaaccacgtgggcagcaagccctacaagtgtgacgagtgcagctacaccagtgtctaccggaaggacgtcattcggcacgccgctgtgcacagccgggaccggaagaagaggccagatccgactccaaagctgagctctttcccctgccctgtgtgtggccgtgtgtaccccatgcagaaaagactcacgcagcacatgaagacgcacagcactgagaagccccacatgtgtgacaagtgtggaaagtcctttaagaagcgctacaccttcaaaatgcacctgctcacgcacatccaggctgttgccaaccgcaggttcaagtgtgagttctgtgagtttgtttgtgaagacaagaaggcactgctgaaccaccagttgtcccacgtcagtgacaagcccttcaaatgcagcttttgtccctaccgcaccttccgagaggacttcttgctgtcccatgtggctgtcaagcacacaggggccaagcccttcgcctgtgagtactgccacttcagcacacggcacaagaagaacctgcgcctgcacgtacggtgccgacacgcaagcagcttcgaggaatgggggaggcgccaccctgaggagcccccctcccgccgtcgccccttcttctctctgcagcagattgaggagctgaagcagcagcacagtgcggcccctggaccacctcccagttccccaggacctcctgagatacccccagaggcgacaactttccagtcatctgaggctccctcattgctctgttctgacaccctgggcggcgccaccatcatctaccagcaaggtgagctctgtaggaggataggagctcatggagggtaggacctctgagttgggcaggggcaggtcgtgctggtgggggctggaagatggggagggggtggtattgggtgccagttttctagcactttgtcaggcttaggtcccaccccacccaggagctgaggagtcgacagcgatggccacgcagacagccttggatcttctgctgaacatgagtgctcagcgggaactggggggcacagccctgcaggtggctgtggtgaagtcggaagatgtggaagcagggttagcatcccctggtgggcagccctcccctgaaggtgccactccacaggtggtcaccctccacgtggcagagccagggggcggtgcagcagccgagagccagctaggccctcctgacctaccgcagatcaccctggcacctggtccatttggtgggactggctacagtgtcatcacagcaccccctatggaggagggaacatcagctcctggcacaccttacagcgaggagcccgcaggagaggcagcccaggctgtggttgtgagtgacaccctaaaagaagctggcacccactacatcatggctactgatggtacccagttgcaccacattgagctcaccgcagatggctccatctccttcccaagtccagatgctctggcctctggtgccaaatggcccctgctgcagtgtgggggactgcccagagacggccctgagcccccatctccagccaagacccactgcgtaggggactcccagagctctgcctcctcacctcctgcaaccagcaaagccctgggcctggcagtgcccccgtcaccgccatctgcagccactgctgcatcaaagaagttttcctgcaagatctgtgccgaggccttccctggccgagctgagatggagagtcacaagcgggcccacgctgggcctggtgccttcaagtgccccgactgccccttcagtgcccgccagtggcccgaggtccgggcgcacatggcacagcactcaagcctacggccccaccagtgtagccagtgcagctttgcctccaagaacaagaaggacctgcgtcggcacatgctgactcacacaaaggagaagccttttgcatgccacctctgcgggcagcgtttcaaccgtaacgggcacctcaagttccacatccagcggctgcacagtcctgatgggaggaagtcaggaacccctacagcccgggcccctacccagaccccaacccagaccatcatcctgaacagtgatgacgaaacactggccaccctgcacactgcactccagtccagtcacggggtcctgggcccagagcggctacagcaggcactgagccaggaacacatcatcgttgcccaggaacagacagtgaccaatcaggaggaagccgcctacatccaagagatcaccacggcagatggccagaccgtacagcacctggtgacctccgacaaccaggtgcagtatatcatctcccaggatggtgtccagcacctgctcccccaggaatatgttgtggtccctgaaggccatcacatccaggtaggccagacctgggatgagggtgctgtgtggtgaagggctgcatgacctctccctaggatcacagcttggcttcctctctgcaggtacaggagggccagatcacacacatccagtatgaacaaggagccccgttccttcaggagtcccaggtagggccgtggggggacagggagacctggggcacaggcaggtttctccaggccagcatcttatcagcttctcccctccagatccagtatgtgcctgtgtccccaggccagcagcttgtcacacaggctcaacttgaggctgcagcacactcagctgtcacagcagtggctgatgctgccatggcccaagcccagggcctgtttggtacagacgagacagtgcccgaacacattcaacagctgcagcaccagggcatcgagtacgacgtcatcaccctggccgatgactgagccccgagggcccaacacagatcatggatttgcggccagctctcctgggggtagggggccaccaggactcacctccctcttcatttaggatctccagatactggatagccagcatcctctcattcccagggagccagacctgtgctgttggggttaggggcagccatgggccccagccaggacatgctgggtgccccagcctgcaggcaggctttgggagagaaatttatttttgtttgggtggacccactggcctgtcagtctcaataaagggaccggagtccagtcctgaacagc

SEQ ID NO: 371264 - DNA, 1058 bp, Homo sapiens
tgcaacccggggggacgcgggggccgaagggctgaaccactgggcccggatggggctcacagagcggaacgctccacgagaatcgtgggggcgagggaaagggtcaagattaccagccattgaccaccctcccgggaagggccttagcctgggaagcacagcttctccgtcaagtttttcccgagctcccctcgcaatacaccaggaagctccgccccgtcggagactcaatcttcgcatctgcaaaatgggcgcaggggtgcaaatgggtggccgtggttgccggggctggggagatggcccacttgttccagccacggtcacctctcttctcagagtgaagttcccagaccctacgccccgctgtcaggcagcccgccgatcagatggaggagaacgaggtggagagcagcagcgacgcggcccctgggcctggccggcccgaggagccctctgagagcggcctgggtgtgggcacctcagaagccgtgtccgccgacagcagcgacgccgcggccgccccggggcaggcagaggccgatgactctggcgtggggcaaagctcggaccgcggcagccgttctcaggaggaggtatctgagagcagctcgagcgcagaccccctgcctaatagctacctccctgattcatcgtctgtgtctcatgggccagtggcaggggtgacaggcggtcccccagcacttgtgcactctagtgcactcccagaccccaacatgctggtgtccgactgcacagcttcctcctcggacctgggctcggccatcgacaagatcatcgagtccaccatcgggcccgacctcatccagagtgagtcaggcagaggagccccacaggggttttcctgcagtgtccggcagccagctgtgcccaccctagctgtgtgaactcaggcagattactttcccatgtggaatgtgcagagtgggaacagtcacccctgtctcatggtggtaaatgaggatttaatgagacaacactgtaaagttctcagcctagcgcctggcatgacagactctcaataaataatataaactgtt

SEQ ID NO: 371265 - DNA, 1018 bp, Homo sapiens
tgcaacccggggggacgcgggggccgaagggctgaaccactgggcccggatggggctcacagagcggaacgctccacgagaatcgtgggggcgagggaaagggtcaagattaccagccattgaccaccctcccgggaagggccttagcctgggaagcacagcttctccgtcaagtttttcccgagctcccctcgcaatacaccaggaagctccgccccgtcggagactcaatcttcgcatctgcaaaatgggcgcaggggtgcaaatgggtggccgtggttgccggggctggggagatggcccacttgttccagccacggtcacctctcttctcagagtgaagttcccagaccctacgccccgctgtcaggcagcccgccgatcagatggaggagaacgaggtggagagcagcagcgacgcggcccctgggcctggccggcccgaggagccctctgagagcggcctgggtgtgggcacctcagaagccgtgtccgccgacagcagcgacgccgcggccgccccggggcaggcagaggccgatgactctggcgtggggcaaagctcggaccgcggcagccgttctcaggtatggacccggctggacggcgtgggtggaggcaaggaccgcgagcagcagtgcctgacagccaagaggaaacaaggcttgtttgtagctaatacttggtgtttctggtttactgtgagccaggcaccaagccaaacccctaaaatggattttctcatttgagcttcataccttctaagacacataccattttttcccacatcttatagaaaaggatgccgaggtacagagtgcagacagagccaggattcaaatctaggctgtggtcttagctactatactacccacagtcctcacactttgagaggcagatgtctaggccaggagtggtagctcatcgcctgtaatcccagcactttggaaggctgaggtgggaggatcacttgagcccaggagttggagaccagcttgggcaaatagcgagacctcat

SEQ ID NO: 371266 - DNA, 1579 bp, Homo sapiens
gccagtaatccctgcaacttgggaggctgaggcgggagaatcgcttgaacccaggaggtggaggttgcagtgagccgagatcacgccattgcactccagcctctgggcaacaagagcaaaactgtctcaaaaaaaaaaaattcagggcccgatgggacctgcacaggtcccctcatctaacacctgtgttacatatgggtaaagtgagattttccaatttacctaataatgatggaatctatggcctttcattcttaggacacagcagcaccagatacggatccggcttggcctttctacccagcttcttgttagtgcacaggattttggttttcccaggtccactttgtctggttccctgaccagctgtcagcagggatccggggatttgttgccatctgtcctgacccagccaatgcccccaactctgccctctctgcaggcgcacatggcacagcactcaagcctacggccccaccagtgtagccagtgcagctttgcctccaagaacaagaaggacctgcgtcggcacatgctgactcacacaaaggagaagccttttgcatgccacctctgcgggcagcgtttcaaccgtaacgggcacctcaagttccacatccagcggctgcacagtcctgatgggaggaagtcaggaacccctacagcccgggcccctacccagaccccaacccagaccatcatcctgaacagtgatgacgaaacactggccaccctgcacactgcactccagtccagtcacggggtcctgggcccagagcggctacagcaggcactgagccaggaacacatcatcgttgcccaggaacagacagtgaccaatcaggaggaagccgcctacatccaagagatcaccacggcagatggccagaccgtacagcacctggtgacctccgacaaccaggtgcagtatatcatctcccaggatggtgtccagcacctgctcccccaggaatatgttgtggtccctgaaggccatcacatccaggtacaggagggccagatcacacacatccagtatgaacaaggagccccgttccttcaggagtcccagatccagtatgtgcctgtgtccccaggccagcagcttgtcacacaggctcaacttgaggctgcagcacactcagctgtcacagcagtggctgatgctgccatggcccaagcccagggcctgtttggtacagacgagacagtgcccgaacacattcaacagctgcagcaccagggcatcgagtacgacgtcatcaccctggccgatgactgagccccgagggcccaacacagatcatggatttgcggccagctctcctgggggtagggggccaccaggactcacctccctcttcatttaggatctccagatactggatagccagcatcctctcattcccagggagccagacctgtgctgttggggttaggggcagccatgggccccagccaggacatgctgggtgccccagcctgcaggcaggctttgggagagaaatttatttttgtttgggtggacccactggcctgtcagtctcaataaagggaccggagtccagtcctgaacagc

SEQ ID NO: 371267 - DNA, 484 bp, Homo sapiens
acagtagcagctggggcattgcaggttttcctggaccccaggtgagcatcctctcctctctgcccagctgcactccagtccagtcacggggtcctgggcccagagcggctacagcaggcactgagccaggaacacatcatcgttgcccaggaacagacagtgaccaatcaggtaagagtcaggactgggggccctctggccagcgacaggcaggggttggggtagagaaatgaggctagagctgtcttggtcctggcaggaggaagccgcctacatccaagagatcaccacggcagatggccagaccgtacagcacctggtgacctccgacaaccaggtgagctactagctactgttaatcccctcagctgtgacctcctaccctcccaaagacctaccttggggaggaatgatactttccaaaccacccctcctggggtccatgcttgccaacaactgcattgttgctggtggctgttcctag

SEQ ID NO: 371268 - DNA, 486 bp, Homo sapiens
cccaggtccccaaagctatgccccacagtactgggggcctcagagtccacaaggaacactagacagaatttttaaccatcacacatttttaaaacatgtaaggtggggaaaaggtgatgcccgtgtcctagtattgccttaacaaacggcgacaaactgggtgactaaaaacaaagaaatgccctccctcacagtcccagaggccagatgtccaaccccgctcccacaagaagctcttcaggagggtccttcctgccccttccagcatctggtgggcgccagcgcatcctggcttgtggccacaccactcccatctctgcctccatcttcacgtggccgcccctgtgtctgtgttttctcctcttctgtctctcataagggcccctgtcattgaatttcgggcccacttcttttttttttttagatggagttttgctcttgtgcaggctgcagtgcaatggcacgatctcggctcactgcaacctc

SEQ ID NO: 371269 - DNA, 200 bp, Homo sapiens
aatcactggtttttgcttaaggtatagtctgctattttatttttttgaaacaggttctcattttcattgcccagtctggagtgcagtggctcgatcgtgattcactgcattctcgacttctctgggctcaggtgattgtcccaccttggcctcttgcatacttggtaccacaggcattcaccagctaattttttgtattt

SEQ ID NO: 371270 - DNA, 415 bp, Homo sapiens
caggaatgcatttggcttgggtggcagggaggttttctctatgggatttggggcaagatcaatagtcctcaaatttcagcacctaaactattaatccctggtggatacaatcaatagttccctgcctcggccaggcgcggtggctcacgcctgtattcccagcactttgggaggccaaggcgggcggatcacgaggtcaggagatagagaccatccctggctaagatggtgaaaccccgtctctactaaaaatacaaaaaattagctgggtgtgatggcacgtgcctgtagtcccagctactcaggaggctgaggcaggagaatcggttgaagccaggtggcggaggttgcagtgggcggagattgcgccactgcactccagcctgggcaacagagcgagactccatctcaaaaa

SEQ ID NO: 371271 - DNA, 1370 bp, Homo sapiens
ggcagaagccctggattcaaatccgccacacattcagtttctttatctgtaaaatggagaccaccccccgccacgctgaacggtgattctgtgactggtaagagatgctacatttttggtgcttgttcaggtggaggaaagatgatagttaacactcaggtaataagtattttgaaggcagtataatataccttcttaaagagtatacctactcaaatgttggtaaatgttgacatgattgaatctaaatggcaaagagtattttagaaaaacattaagtccctgcagataaatgacagtgttgatttggatgcttaattacattcagacatgaactgttggatgtatccgaaatgttaaaagctttttctcaacatttccaaaagtctttccaagaaatcaatgttatgttttgttccagaagcaaatttgcatttgtgatctgtttctaaaaatggtacaagttagctctgtttagaaagtaaaaatatctgatgttagattggaagtatctcttcctggggaatccagaaagataagcatagcatattgtcttactgcaatagataagttgcttattgagaagtctggttgttattctatatggtaacaatacagttgatgtatattttatgatagatcctttatattttcctcatgactttagaagggggaagggggagaaaattatgatgaccagactagttaaagagcattgaaagtccacagtactgtagctaaagtagaagtttgggtttgttatagactttacattatatcaactaataagcagatactgtacagtattgctcaccattttatcatacttttgcatatgaactactccattgccttttatagatgttttatagctgatcttaccagttttcctggtaactttttttatttcttttttttttttttgagacggagtctcgccctaacacccaggttggagtgcagtgccgtgatctcggctcactgcaacctctgcctcccgggttcaagcaatcctcctgtctcagcctcccgagtacctgggactaccggttgcctgtctccacgcccggctaattttttgtatttgtagtagagacggggtttcaccgtgttaggccaggatggtctcgatctcctgacctcatgatctgcctgcctctgcctggacctcccaaagtgctgggattacaggcgtgagcccccgcgcccagccactttctttaatactataactaagaatttattaaaatgcacaaattgtctaagactgtaaagtttattggggagaggccatgactacctctgaatttagtaaatttaaaatatttctgattctcaataaagaactaatatccatataaaaaaaaatt

SEQ ID NO: 371272 - DNA, 632 bp, Homo sapiens
tctccctgcggtctcatatcgcacctgcactgctgcaacagcttactggtcccttgctcccagccttctcctcttcagtccatcgtccacacagcactggggaaggggagccacttgaaaccaaagtcaacaactggttgtagttcataaacacagagctgtttgtgtcccctgtatctggaatgccattatgacccactacattttttctttcctacccctctttataactcagttcaggtagcagctccactaggaagccttggctgaccataatcccattgtactccagcctgggtgaagaagtgagactctgtcttaaaaaaaaaaattggtgctgataaatattgatgaattctgctctctgctctctatggttgtcaacactgcagagttgaggcctcatatctcacctgcactgctgcaacagcttactggtcccttgctcccagccttctcctcttcagtccatcgtccacacagcactggggaaggggagccacttgaaacaaaagtcaacaactggttgtagttcataaacacagagctgtttgtgtcccctgtatctggaatgccattatgagaccccgccagggggatccttggagaatcaactaggccgggacctgcac

SEQ ID NO: 371273 - DNA, 547 bp, Homo sapiens
caaaaaaaactcataataatctgaatatcttgatcatttgtatttaaagaagcagtaattatatacttgaaagtacataatatagtattgcaaaaatgactttggtatattacaaattaaaagtatataagatgaaacttgatttgctatcaagccccaagcaatttttcaactgggcattgaattctaacttttctaagatagcaatttttgaagagacacgaacaaaaatctgaattagttcatgagccttaatgtaaatctcttgctgaaatagtttttaaaatcagaatttagttatctatcagactcaaaatcatttaaagactaacaaaacacaatcatgatattctaactgtggattacaggcgtgagcccccgcgcccagccactttctttaatactataactaagaatttattaaaatgcacaaattgtctaagactgtaaagtttattggggagaggccatgactacctctgaatttagtaaatttaaaatatttctgattctcaataaagaactaatatccatataaaaaaaaatt

SEQ ID NO: 371274 - DNA, 266 bp, Homo sapiens
tgagacaagagtctcgctctgtcacccaggctggagtgcaatggtgcgatcccagctcactgcaacctccgcttcctgagttcaagcgattctcctgcctcagcccccgagtagctgggattacaggggtgtgccaccatgcccagctaatttttttttttttaacctagaaagagtattttggagagagaaactaaggatcagaaggtttaagagtatcaaaaatctgaggccaggtgcctcacatctgtaatcccagcattttg

SEQ ID NO: 371275 - DNA, 4194 bp, Homo sapiens
ataacacccggccccgccgggcggccgcgggtgggtagaggtgcgcgcctgggacctgaacatggacttcccgtgcctctggctagggctgttgctgcctttggtagctgcgctggatttcaactaccaccgccaggaagggatggaagcgtttttgaagactgttgcccaaaactacagttctgtcactcacttacacagtattgggaaatctgtgaaaggtagaaacctgtgggttcttgttgtggggcggtttccaaaggaacacagaattgggattccagagttcaaatacgtggcaaatatgcatggagatgagactgttgggcgggagctgctgctccatctgattgactatctcgtaaccagtgatggcaaagaccctgaaatcacaaatctgatcaatagtacccggatacacatcatgccttccatgaacccagatggatttgaagccgtcaaaaagcctgactgttactacagcatcggaagggaaaattataaccagtatgacttgaatcgaaatttccccgatgcttttgaatataataatgtctcaaggcagcctgaaactgtggcagtcatgaagtggctgaaaacagagacgtttgtcctctctgcaaacctccatggtggtgccctcgtggccagttacccatttgataatggtgttcaagcaactggggcattatactcccgaagcttaacgcctgatgatgatgtttttcaatatcttgcacatacctatgcttcaagaaatcccaacatgaagaaaggagacgagtgtaaaaacaaaatgaactttcctaatggtgttacaaatggatactcttggtatccactccaaggtggaatgcaagattacaactacatctgggcccagtgttttgaaattacgttggagctgtcatgctgtaaatatcctcgtgaggagaagcttccatccttttggaataataacaaagcctcattaattgaatatataaagcaggtgcacctaggtgtaaagggtcaagtttttgatcagaatggaaatccattacccaatgtaattgtggaagtccaagacagaaaacatatctgcccctatagaaccaacaaatatggagagtattatctccttctcttgcctgggtcttatattataaatgttacagtccctggacatgatccacacatcacaaaggtgattattccggagaaatcccagaacttcagtgctcttaaaaaggatattctacttccattccaagggcaattggattctatcccagtatcaaatccttcatgcccaatgattcctctatacagaaatttgccagaccactcagctgcaacaaagcctagtttgttcttatttttagtgagtcttttgcacatattcttcaaataaagtaaaatgtgaaactcaacccacatcaccacctggaatcagggattgctcactccaggttactgcaaccctaactcactctagtgggaccttgactggagaaactccacgatcttcctgaagaagagaaatggatgtttccaaattccacaataagcaatatgtggtgataatgaaaagaatgattcagtcttgacggtgaatggaagacacttacctaacaagtactgctcatttacactcaaattaatcttgaagtagtcttaaaatgtgtaagaagttaaaacttgagaagcaaaaaaatgcctgcaaaaagaagatcattttgtatacagagaaccggatgaatataagcaatgaagatgaacatttattgatcttctacatacaagacttcaccataaggccaggagcagtggctcacaccttgtaatcccagcactttgggaggccaaggtgggcggatcaccttgaggtcaggagttcaagaccagcctgaccaacatggtgaaaccctgtctctactaaatattagcggggtgtggtggcgggcacctgtaatcgcagcctttcgggaggctgagacaggagaatcgcttgaaccctagaggcggagtttgcagtgagccgagatagtgccattgtactccagcttgggcaacagagtaagactctgtctcaaaaaaaaaaaaacaaaaacaaacaaacaaaaaaaacacctcaccatgagtgctacatgtgaatagatattaagtgccatatataattagttctcagaagaagggagaaatgatcataggactgggaattgttttgcaaacgttctaggagatgtgagagaaaatatgtaaccacatcttagtggcccaagaaaatacaggcctgaagggataagattgtgtctctatagagcttcaaagcatacaggtcaattaagaaagcccctctctctccagagccgtttccctagcttttggcacctggatgccacagtcctccattaggctgatgactccaaagatgtaactctagcctcttgcctgagcttcagactcgcgtcccactgcccacaggacacatccacctggatgtgactcacaggtacctccaacccatcatgtggagatactcatcctgttccccctagagctgctcttcctgctgcattctctctctcaattactgggaccaccaagctaggaacctgggagtcatccttgatactttctcttcctccttaatcctgtgtattcagcaagtaactaaaggttggtgttggccaggcatggtggctcatgcctgtaatcccagcattttgggaggccaaggcgggcggatcacttgaggtcaggagctcaagaccagcctggccaacatggtgaaaccccatctctactaaaaaaaaaaaaaaaattagtcgggcgtggtggtgcatgcctgtaatcccagctactggggaggctgaggcaggagaatcgcttgaacctgggaggcagaggttgcagtgagccgggattgcgccattgtactccagcctgggtgaagaagtgagactctgtcttaaaaaaaaaaattggtgctgataaatattgatgaattctgctctctgctctctatggttgtcaacactgcagagttgaggcctcatatctcacctgcactgctgcaacagcttactggtcccttgctcccagccttctcctcttcagtccatcgtccacacagcactggggaaggggagccacttgaaacaaaagtcaacaactggttgtagttcataaacacagagctgtttgtgtcccctgtatctggaatgccattatgacccactacattttttctttcctacccctcttaaaactcagttcaggtagcagctccactaggaagccttggctgaccataatcccattcaattccatttcacctcttcgcaggcagtctggggttagggaccctttctctttgctccccaaaataaactggttatctctactattggatttacaacattgtattataatcttctccatgtgtgccttctctagtagaatgtgagctctttgaggccaaggtctatttaatttgtttgaaaaattcattgttatatcctcaaagcctagcacatagtaggtactgaatgaatgaatgaacaaggggtgccaggagactgctactcccagtccttcccagaaactgcctagggctttgagtcattttatgaagctaggtcttaatgcgtaggcaacctcccagctcactatgaacgctgacagaagagtgttttcatgtctataatcaagaattccagatacattccttttactgaaccttgaattgatcctaagattggtagtaaaggtattatgttacctcctaacagcactacaaagtacctttttttatcagaaaaaaattttaccattaggactcaatttgaagtactaatgcttctcaagttctccactatgagagttaccctgtattagaccgttacctataagaattaaggggtaaagcactaaacagaaaagaaaaaaaaaatagcaactctggtgagcagatttctttcctttcttccttccttctcctcttcctaccttcctccctcctttccctctcctccccttctctccctttccctccccttcccttccttttcttctttcctccgctcccctccccttccctccccttcccatccttctttctcttttttttacttaatccccagtgtgacagtaatataggctgatttctagaagtgtggtgtattactcatggaaagtgagttgccttgg

SEQ ID NO: 371276 - DNA, 3327 bp, Homo sapiens
gcatttcttccttctgcgtatgggacaggaccctttctggaatgggggtcttatgacctacaatcaaacaagaacatggacttcccgtgcctctggctagggctgttgctgcctttggtagctgcgctggatttcaactaccaccgccaggaagggatggaagcgtttttgaagactgttgcccaaaactacagttctgtcactcacttacacagtattgggaaatctgtgaaaggtagaaacctgtgggttcttgttgtggggcggtttccaaaggaacacagaattgggattccagagttcaaatacgtggcaaatatgcatggagatgagactgttgggcgggagctgctgctccatctgattgactatctcgtaaccagtgatggcaaagaccctgaaatcacaaatctgatcaatagtacccggatacacatcatgccttccatgaacccagatggatttgaagccgtcaaaaagcctgactgttactacagcatcggaagggaaaattataaccagtatgacttgaatcgaaatttccccgatgcttttgaatataataatgtctcaaggcagcctgaaactgtggcagtcatgaagtggctgaaaacagagacgtttgtcctctctgcaaacctccatggtggtgccctcgtggccagttacccatttgataatggtgttcaagcaactggggcattatactcccgaagcttaacgcctgatgatgatgtttttcaatatcttgcacatacctatgcttcaagaaatcccaacatgaagaaaggagacgagtgtaaaaacaaaatgaactttcctaatggtgttacaaatggatactcttggtatccactccaaggtggaatgcaagattacaactacatctgggcccagtgttttgaaattacgttggagctgtcatgctgtaaatatcctcgtgaggagaagcttccatccttttggaataataacaaagcctcattaattgaatatataaagcaggtgcacctaggtgtaaagggtcaagtttttgatcagaatggaaatccattacccaatgtaattgtggaagtccaagacagaaaacatatctgcccctatagaaccaacaaatatggagagtattatctccttctcttgcctgggtcttatattataaatgttacagtccctggacatgatccacacatcacaaaggtgattattccggagaaatcccagaacttcagtgctcttaaaaaggatattctacttccattccaagggcaattggattctatcccagtatcaaatccttcatgcccaatgattcctctatacagaaatttgccagaccactcagctgcaacaaagcctagtttgttcttatttttagtgagtcttttgcacatattcttcaaataaagtaaaatgtgaaactcaacccacatcaccacctggaatcagggattgctcactccaggttactgcaaccctaactcactctagtgggaccttgactggagaaactccacgatcttcctgaagaagagaaatggatgtttccaaattccacaataagcaatatgtggtgataatgaaaagaatgattcagtcttgacggtgaatggaagacacttacctaacaagtactgctcatttacactcaaattaatcttgaagtagtcttaaaatgtgtaagaagttaaaacttgagaagcaaaaaaatgcctgcaaaaagaagatcattttgtatacagagaaccggatgaatataagcaatgaagatgaacatttattgatcttctacatacaagacttcaccataaggccaggagcagtggctcacaccttgtaatcccagcactttgggaggccaaggtgggcggatcaccttgaggtcaggagttcaagaccagcctgaccaacatggtgaaaccctgtctctactaaatattagcggggtgtggtggcgggcacctgtaatcgcagcctttcgggaggctgagacaggagaatcgcttgaaccctagaggcggagtttgcagtgagccgagatagtgccattgtactccagcttgggcaacagagtaagaactctgtcttaaaaaaaaaaattggtgctgataaatattgatgaattctgctctctgctctctatggttgtcaacactgcagagttgaggcctcatatctcacctgcactgctgcaacagcttactggtcccttgctcccagccttctcctcttcagtccatcgtccacacagcactggggaaggggagccacttgaaacaaaagtcaacaactggttgtagttcataaacacagagctgtttgtgtcccctgtatctggaatgccattatgacccactacattttttctttcctacccctcttaaaactcagttcaggtagcagctccactaggaagccttggctgaccataatcccattcaattccatttcacctcttcgcaggcagtctggggttagggaccctttctctttgctccccaaaataaactggttatctctactattggatttacaacattgtattataatcttctccatgtgtgccttctctagtagaatgtgagctctttgaggccaaggtctatttaatttgtttgaaaaattcattgttatatcctcaaagcctagcacatagtaggtactgaatgaatgaatgaacaaggggtgccaggagactgctactcccagtccttcccagaaactgcctagggctttgagtcattttatgaagctaggtcttaatgcgtaggcaacctcccagctcactatgaacgctgacagaagagtgttttcatgtctataatcaagaattccagatacattccttttactgaaccttgaattgatcctaagattggtagtaaaggtattatgttacctcctaacagcactacaaagtacctttttttatcagaaaaaaattttaccattaggactcaatttgaagtactaatgcttctcaagttctccactatgagagttaccctgtattagaccgttacctataagaattaaggggtaaagcactaaacagaaaagaaaaaaaaaatagcaactctggtgagcagatttctttcctttcttccttccttctcctcttcctaccttcctccctcctttccctctcctccccttctctccctttccctccccttcccttccttttcttctttcctccgctcccctccccttccctccccttcccatccttctttctcttttttttacttaatccccagtgtgacagtaatataggctgatttctagaagtgtggtgtattactcatggaaagtgagttgccttgg

SEQ ID NO: 371277 - DNA, 3272 bp, Homo sapiens
gcatttcttccttctgcgtatgggacaggaccctttctggaatgggggtcttatgacctacaatcaaacaagaacatggacttcccgtgcctctggctagggctgttgctgcctttggtagctgcgctggatttcaactaccaccgccaggaagggatggaagcgtttttgaagactgttgcccaaaactacagttctgtcactcacttacacagtattgggaaatctgtgaaaggtagaaacctgtgggttcttgttgtggggcggtttccaaaggaacacagaattgggattccagagttcaaatacgtggcaaatatgcatggagatgagactgttgggcgggagctgctgctccatctgattgactatctcgtaaccagtgatggcaaagaccctgaaatcacaaatctgatcaatagtacccggatacacatcatgccttccatgaacccagatggatttgaagccgtcaaaaagcctgactgttactacagcatcggaagggaaaattataaccagtatgacttgaatcgaaatttccccgatgcttttgaatataataatgtctcaaggcagcctgaaactgtggcagtcatgaagtggctgaaaacagagacgtttgtcctctctgcaaacctccatggtggtgccctcgtggccagttacccatttgataatggtgttcaagcaactggggcattatactcccgaagcttaacgcctgatgatgatgtttttcaatatcttgcacatacctatgcttcaagaaatcccaacatgaagaaaggagacgagtgtaaaaacaaaatgaactttcctaatggtgttacaaatggatactcttggtatccactccaaggtggaatgcaagattacaactacatctgggcccagtgttttgaaattacgttggagctgtcatgctgtaaatatcctcgtgaggagaagcttccatccttttggaataataacaaagcctcattaattgaatatataaagcaggtgcacctaggtgtaaagggtcaagtttttgatcagaatggaaatccattacccaatgtaattgtggaagtccaagacagaaaacatatctgcccctatagaaccaacaaatatggagagtattatctccttctcttgcctgggtcttatattataaatgttacagtccctggacatgatccacacatcacaaaggtgattattccggagaaatcccagaacttcagtgctcttaaaaaggatattctacttccattccaagggcaattggattctatcccagtatcaaatccttcatgcccaatgattcctctatacagaaatttgccagaccactcagctgcaacaaagcctagtttgttcttatttttagtgagtcttttgcacatattcttcaaataaagtaaaatgtgaaactcaacccacatcaccacctggaatcagggattgctcactccaggttactgcaaccctaactcactctagtgggaccttgactggagaaactccacgatcttcctgaagaagagaaatggatgtttccaaattccacaataagcaatatgtggtgataatgaaaagaatgattcagtcttgacggtgaatggaagacacttacctaacaagtactgctcatttacactcaaattaatcttgaagtagtcttaaaatgtgtaagaagttaaaacttgagaagcaaaaaaatgcctgcaaaaagaagatcattttgtatacagagaaccggatgaatataagcaatgaagatgaacatttattgatcttctacatacaagacttcaccataaggccaggagcagtggctcacaccttgtaatcccagcactttgggaggccaaggtgggcggatcaccttgaggtcaggagttcaagaccagcctgaccaacatggtgaaaccctgtctctactaaatattagcggggtgtggtggcgggcacctgtaatcgcagcctttcgggaggctgagacaggagaatcgcttgaaccctagaggcggagtttgcagtgagccgagatagtgccattgtactccagcttgggcaacagagtaagaactctgtcttaaaaaaaaaaattggtgctgataaatattgatgaattctgctctctgctctctatggttgtcaacactgcagagttgaggcctcatatctcacctgcactgctgcaacagcttactggtcccttgctcccagccttctcctcttcagtccatcgtccacacagcactggggaaggggagccacttgaaacaaaagtcaacaactggttgtagttcataaacacagagctgtttgtgtcccctgtatctggaatgccattatgacccactacattttttctttcctacccctccattcaattccatttcacctcttcgcaggcagtctggggttagggaccctttctctttgctccccaaaataaactggttatctctactattggatttacaacattgtattataatcttctccatgtgtgccttctctagtagaatgtgagctctttgaggccaaggtctatttaatttgtttgaaaaattcattgttatatcctcaaagcctagcacatagtaggtactgaatgaatgaatgaacaaggggtgccaggagactgctactcccagtccttcccagaaactgcctagggctttgagtcattttatgaagctaggtcttaatgcgtaggcaacctcccagctcactatgaacgctgacagaagagtgttttcatgtctataatcaagaattccagatacattccttttactgaaccttgaattgatcctaagattggtagtaaaggtattatgttacctcctaacagcactacaaagtacctttttttatcagaaaaaaattttaccattaggactcaatttgaagtactaatgcttctcaagttctccactatgagagttaccctgtattagaccgttacctataagaattaaggggtaaagcactaaacagaaaagaaaaaaaaaatagcaactctggtgagcagatttctttcctttcttccttccttctcctcttcctaccttcctccctcctttccctctcctccccttctctccctttccctccccttcccttccttttcttctttcctccgctcccctccccttccctccccttcccatccttctttctcttttttttacttaatccccagtgtgacagtaatataggctgatttctagaagtgtggtgtattactcatggaaagtgagttgccttgg

SEQ ID NO: 371278 - DNA, 4176 bp, Homo sapiens
ataacacccggccccgccgggcggccgcgggtgggtagagaacatggacttcccgtgcctctggctagggctgttgctgcctttggtagctgcgctggatttcaactaccaccgccaggaagggatggaagcgtttttgaagactgttgcccaaaactacagttctgtcactcacttacacagtattgggaaatctgtgaaaggtagaaacctgtgggttcttgttgtggggcggtttccaaaggaacacagaattgggattccagagttcaaatacgtggcaaatatgcatggagatgagactgttgggcgggagctgctgctccatctgattgactatctcgtaaccagtgatggcaaagaccctgaaatcacaaatctgatcaatagtacccggatacacatcatgccttccatgaacccagatggatttgaagccgtcaaaaagcctgactgttactacagcatcggaagggaaaattataaccagtatgacttgaatcgaaatttccccgatgcttttgaatataataatgtctcaaggcagcctgaaactgtggcagtcatgaagtggctgaaaacagagacgtttgtcctctctgcaaacctccatggtggtgccctcgtggccagttacccatttgataatggtgttcaagcaactggggcattatactcccgaagcttaacgcctgatgatgatgtttttcaatatcttgcacatacctatgcttcaagaaatcccaacatgaagaaaggagacgagtgtaaaaacaaaatgaactttcctaatggtgttacaaatggatactcttggtatccactccaaggtggaatgcaagattacaactacatctgggcccagtgttttgaaattacgttggagctgtcatgctgtaaatatcctcgtgaggagaagcttccatccttttggaataataacaaagcctcattaattgaatatataaagcaggtgcacctaggtgtaaagggtcaagtttttgatcagaatggaaatccattacccaatgtaattgtggaagtccaagacagaaaacatatctgcccctatagaaccaacaaatatggagagtattatctccttctcttgcctgggtcttatattataaatgttacagtccctggacatgatccacacatcacaaaggtgattattccggagaaatcccagaacttcagtgctcttaaaaaggatattctacttccattccaagggcaattggattctatcccagtatcaaatccttcatgcccaatgattcctctatacagaaatttgccagaccactcagctgcaacaaagcctagtttgttcttatttttagtgagtcttttgcacatattcttcaaataaagtaaaatgtgaaactcaacccacatcaccacctggaatcagggattgctcactccaggttactgcaaccctaactcactctagtgggaccttgactggagaaactccacgatcttcctgaagaagagaaatggatgtttccaaattccacaataagcaatatgtggtgataatgaaaagaatgattcagtcttgacggtgaatggaagacacttacctaacaagtactgctcatttacactcaaattaatcttgaagtagtcttaaaatgtgtaagaagttaaaacttgagaagcaaaaaaatgcctgcaaaaagaagatcattttgtatacagagaaccggatgaatataagcaatgaagatgaacatttattgatcttctacatacaagacttcaccataaggccaggagcagtggctcacaccttgtaatcccagcactttgggaggccaaggtgggcggatcaccttgaggtcaggagttcaagaccagcctgaccaacatggtgaaaccctgtctctactaaatattagcggggtgtggtggcgggcacctgtaatcgcagcctttcgggaggctgagacaggagaatcgcttgaaccctagaggcggagtttgcagtgagccgagatagtgccattgtactccagcttgggcaacagagtaagactctgtctcaaaaaaaaaaaaacaaaaacaaacaaacaaaaaaaacacctcaccatgagtgctacatgtgaatagatattaagtgccatatataattagttctcagaagaagggagaaatgatcataggactgggaattgttttgcaaacgttctaggagatgtgagagaaaatatgtaaccacatcttagtggcccaagaaaatacaggcctgaagggataagattgtgtctctatagagcttcaaagcatacaggtcaattaagaaagcccctctctctccagagccgtttccctagcttttggcacctggatgccacagtcctccattaggctgatgactccaaagatgtaactctagcctcttgcctgagcttcagactcgcgtcccactgcccacaggacacatccacctggatgtgactcacaggtacctccaacccatcatgtggagatactcatcctgttccccctagagctgctcttcctgctgcattctctctctcaattactgggaccaccaagctaggaacctgggagtcatccttgatactttctcttcctccttaatcctgtgtattcagcaagtaactaaaggttggtgttggccaggcatggtggctcatgcctgtaatcccagcattttgggaggccaaggcgggcggatcacttgaggtcaggagctcaagaccagcctggccaacatggtgaaaccccatctctactaaaaaaaaaaaaaaaattagtcgggcgtggtggtgcatgcctgtaatcccagctactggggaggctgaggcaggagaatcgcttgaacctgggaggcagaggttgcagtgagccgggattgcgccattgtactccagcctgggtgaagaagtgagactctgtcttaaaaaaaaaaattggtgctgataaatattgatgaattctgctctctgctctctatggttgtcaacactgcagagttgaggcctcatatctcacctgcactgctgcaacagcttactggtcccttgctcccagccttctcctcttcagtccatcgtccacacagcactggggaaggggagccacttgaaacaaaagtcaacaactggttgtagttcataaacacagagctgtttgtgtcccctgtatctggaatgccattatgacccactacattttttctttcctacccctcttaaaactcagttcaggtagcagctccactaggaagccttggctgaccataatcccattcaattccatttcacctcttcgcaggcagtctggggttagggaccctttctctttgctccccaaaataaactggttatctctactattggatttacaacattgtattataatcttctccatgtgtgccttctctagtagaatgtgagctctttgaggccaaggtctatttaatttgtttgaaaaattcattgttatatcctcaaagcctagcacatagtaggtactgaatgaatgaatgaacaaggggtgccaggagactgctactcccagtccttcccagaaactgcctagggctttgagtcattttatgaagctaggtcttaatgcgtaggcaacctcccagctcactatgaacgctgacagaagagtgttttcatgtctataatcaagaattccagatacattccttttactgaaccttgaattgatcctaagattggtagtaaaggtattatgttacctcctaacagcactacaaagtacctttttttatcagaaaaaaattttaccattaggactcaatttgaagtactaatgcttctcaagttctccactatgagagttaccctgtattagaccgttacctataagaattaaggggtaaagcactaaacagaaaagaaaaaaaaaatagcaactctggtgagcagatttctttcctttcttccttccttctcctcttcctaccttcctccctcctttccctctcctccccttctctccctttccctccccttcccttccttttcttctttcctccgctcccctccccttccctccccttcccatccttctttctcttttttttacttaatccccagtgtgacagtaatataggctgatttctagaagtgtggtgtattactcatggaaagtgagttgccttgg

SEQ ID NO: 371279 - DNA, 1981 bp, Homo sapiens
ataacacccggccccgccgggcggccgcgggtgggtagaggtgcgcgcctgggacctgaacatggacttcccgtgcctctggctagggctgttgctgcctttggtagctgcgctggatttcaactaccaccgccaggaagggatggaagcgtttttgaagactgttgcccaaaactacagttctgtcactcacttacacagtattgggaaatctgtgaaaggtagaaacctgtgggttcttgttgtggggcggtttccaaaggaacacagaattgggattccagagttcaaatacgtggcaaatatgcatggagatgagactgttgggcgggagctgctgctccatctgattgactatctcgtaaccagtgatggcaaagaccctgaaatcacaaatctgatcaatagtacccggatacacatcatgccttccatgaacccagatggatttgaagccgtcaaaaagcctgactgttactacagcatcggaagggaaaattataaccagtatgacttgaatcgaaatttccccgatgcttttgaatataataatgtctcaaggcagcctgaaactgtggcagtcatgaagtggctgaaaacagagacgtttgtcctctctgcaaacctccatggtggtgccctcgtggccagttacccatttgataatggtgttcaagcaactggggcattatactcccgaagcttaacgcctgatgatgatgtttttcaatatcttgcacatacctatgcttcaagaaatcccaacatgaagaaaggagacgagtgtaaaaacaaaatgaactttcctaatggtgttacaaatggatactcttggtatccactccaaggtggaatgcaagattacaactacatctgggcccagtgttttgaaattacgttggagctgtcatgctgtaaatatcctcgtgaggagaagcttccatccttttggaataataacaaagcctcattaattgaatatataaagcaggtgcacctaggtgtaaagggtcaagtttttgatcagaatggaaatccattacccaatgtaattgtggaagtccaagacagaaaacatatctgcccctatagaaccaacaaatatggagagtattatctccttctcttgcctgggtcttatattataaatgttacagtccctggacatgatccacacatcacaaaggtgattattccggagaaatcccagaacttcagtgctcttaaaaaggatattctacttccattccaagggcaattggattctatcccagtatcaaatccttcatgcccaatgattcctctatacagaaatttgccagaccactcagctgcaacaaagcctagtttgttcttatttttagtgagtcttttgcacatattcttcaaataaagtaaaatgtgaaactcaacccacatcaccacctggaatcagggattgctcactccaggttactgcaaccctaactcactctagtgggaccttgactggagaaactccacgatcttcctgaagaagagaaatggatgtttccaaattccacaataagcaatatgtggtgataatgaaaagaatgattcagtcttgacggtgaatggaagacacttacctaacaagtactgctcatttacactcaaattaatcttgaagtagtcttaaaatgtgtaagaagttaaaacttgagaagcaaaaaaatgcctgcaaaaagaagatcattttgtatacagagaaccggatgaatataagcaatgaagatgaacatttattgatcttctacatacaagacttcaccataaggccaggagcagtggctcacaccttgtaatcccagcactttgggaggccaagctgcgttcctttgcctgcaacaggggtcaagatgagttttgcctgacttctttgatgtcctgaactttccgtagtcctttttcttgaatttgttcattataaatatagcttggcatttgtttgatcttttca

SEQ ID NO: 371280 - DNA, 1559 bp, Homo sapiens
tctccctgcggtctcatatcgcacctgcactgctgcaacagcttactggtcccttgctcccagccttctcctcttcagtccatcgtccacacagcactggggaaggggagccacttgaaaccaaagtcaacaactggttgtagttcataaacacagagctgtttgtgtcccctgtatctggaatgccattatgacccactacattttttctttcctacccctctttataactcagttcaggtagcagctccactaggaagccttggctgaccataatcccattgtactccagcctgggtgaagaagtgagactctgtcttaaaaaaaaaaattggtgctgataaatattgatgaattctgctctctgctctctatggttgtcaacactgcagagttgaggcctcatatctcacctgcactgctgcaacagcttactggtcccttgctcccagccttctcctcttcagtccatcgtccacacagcactggggaaggggagccacttgaaacaaaagtcaacaactggttgtagttcataaacacagagctgtttgtgtcccctgtatctggaatgccattatgacccactacattttttctttcctacccctcttaaaactcagttcaggtagcagctccactaggaagccttggctgaccataatcccattcaattccatttcacctcttcgcaggcagtctggggttagggaccctttctctttgctccccaaaataaactggttatctctactattggatttacaacattgtattataatcttctccatgtgtgccttctctagtagaatgtgagctctttgaggccaaggtctatttaatttgtttgaaaaattcattgttatatcctcaaagcctagcacatagtaggtactgaatgaatgaatgaacaaggggtgccaggagactgctactcccagtccttcccagaaactgcctagggctttgagtcattttatgaagctaggtcttaatgcgtaggcaacctcccagctcactatgaacgctgacagaagagtgttttcatgtctataatcaagaattccagatacattccttttactgaaccttgaattgatcctaagattggtagtaaaggtattatgttacctcctaacagcactacaaagtacctttttttatcagaaaaaaattttaccattaggactcaatttgaagtactaatgcttctcaagttctccactatgagagttaccctgtattagaccgttacctataagaattaaggggtaaagcactaaacagaaaagaaaaaaaaaatagcaactctggtgagcagatttctttcctttcttccttccttctcctcttcctaccttcctccctcctttccctctcctccccttctctccctttccctccccttcccttccttttcttctttcctccgctcccctccccttccctccccttcccatccttctttctcttttttttacttaatccccagtgtgacagtaatataggctgatttctagaagtgtggtgtattactcatggaaagtgagttgccttgg

SEQ ID NO: 371281 - DNA, 395 bp, Homo sapiens
ttccatgaacccagatggatttgaagccgtcaaaaagcctgactgttactacagcatcggaaggtaaagaggggctggtctatctttacttgaaaacaacacaacacaaaggctcccgacaggcacctgttggccttggcaagaggagatgtgtcatggtgagagccctcagagccggtgtcatgtcgctgatgtgccaaagctcaaggcacatcagggctgcctccggcttgcaggaagaaatgcaaataaggctactttgccccggtgcccacctagcctctccatcttcatttgccactccttctctctcccctgcctcctcccctctaggcctccttcctggaagtaccaggtgctttcttacctcagcattttacacacaccgtttccct

SEQ ID NO: 371282 - DNA, 239 bp, Homo sapiens
  misc_feature (229)..(229): n is a, c, g, or t
tgggtgacttagaggatcccctctctccacactggctgtcacctgcattgtcactgtgtccaaaagcagcagccgggagcgcaccaggatgtcatgaccacccctgaaatcacaaatctgatcaatagtacccggatacacatcatgccttccatgaacccagatggatttgaagccgtcaaaaagcctgactgttactacagcatcggaagggaaaattataaccagngtggagagag

SEQ ID NO: 371283 - DNA, 3861 bp, Homo sapiens
  misc_feature (3395)..(3395): n is a, c, g, or t
  misc_feature (3399)..(3399): n is a, c, g, or t
  misc_feature (3402)..(3402): n is a, c, g, or t
  misc_feature (3406)..(3407): n is a, c, g, or t
  misc_feature (3416)..(3416): n is a, c, g, or t
  misc_feature (3424)..(3424): n is a, c, g, or t
  misc_feature (3426)..(3426): n is a, c, g, or t
  misc_feature (3430)..(3430): n is a, c, g, or t
ataacacccggccccgccgggcggccgcgggtgggtagaggtgcgcgcctgggacctgaacatggacttcccgtgcctctggctagggctgttgctgcctttggtagctgcgctggatttcaactaccaccgccaggaagggatggaagcgtttttgaagactgttgcccaaaactacagttctgtcactcacttacacagtattgggaaatctgtgaaaggtagaaacctgtgggttcttgttgtggggcggtttccaaaggaacacagaattgggattccagagttcaaatacgtggcaaatatgcatggagatgagactgttgggcgggagctgctgctccatctgattgactatctcgtaaccagtgatggcaaagaccctgaaatcacaaatctgatcaatagtacccggatacacatcatgccttccatgaacccagatggatttgaagccgtcaaaaagcctgactgttactacagcatcggaagggaaaattataaccagtatgacttgaatcgaaatttccccgatgcttttgaatataataatgtctcaaggcagcctgaaactgtggcagtcatgaagtggctgaaaacagagacgtttgtcctctctgcaaacctccatggtggtgccctcgtggccagttacccatttgataatggtgttcaagcaactggggcattatactcccgaagcttaacgcctgatgatgatgtttttcaatatcttgcacatacctatgcttcaagaaatcccaacatgaagaaaggagacgagtgtaaaaacaaaatgaactttcctaatggtgttacaaatggatactcttggtatccactccaaggtggaatgcaagattacaactacatctgggcccagtgttttgaaattacgttggagctgtcatgctgtaaatatcctcgtgaggagaagcttccatccttttggaataataacaaagcctcattaattgaatatataaagcaggtgcacctaggtgtaaagggtcaagtttttgatcagaatggaaatccattacccaatgtaattgtggaagtccaagacagaaaacatatctgcccctatagaaccaacaaatatggagagtattatctccttctcttgcctgggtcttatattataaatgttacagtccctggacatgatccacacatcacaaaggtgattattccggagaaatcccagaacttcagtgctcttaaaaaggatattctacttccattccaagggcaattggattctatcccagtatcaaatccttcatgcccaatgattcctctatacagaaatttgccagaccactcagctgcaacaaagcctagtttgttcttatttttagtgagtcttttgcacatattcttcaaataaagtaaaatgtgaaactcaacccacatcaccacctggaatcagggattgctcactccaggttactgcaaccctaactcactctagtgggaccttgactggagaaactccacgatcttcctgaagaagagaaatggatgtttccaaattccacaataagcaatatgtggtgataatgaaaagaatgattcagtcttgacggtgaatggaagacacttacctaacaagtactgctcatttacactcaaattaatcttgaagtagtcttaaaatgtgtaagaagttaaaacttgagaagcaaaaaaatgcctgcaaaaagaagatcattttgtatacagagaaccggatgaatataagcaatgaagatgaacatttattgatcttctacatacaagacttcaccataaggccaggagcagtggctcacaccttgtaatcccagcactttgggaggccaaggtgggcggatcaccttgaggtcaggagttcaagaccagcctgaccaacatggtgaaaccctgtctctactaaatattagcggggtgtggtggcgggcacctgtaatcgcagcctttcgggaggctgagacaggagaatcgcttgaaccctagaggcggagtttgcagtgagccgagatagtgccattgtactccagcttgggcaacagagtaagactctgtctcaaaaaaaaaaaaacaaaaacaaacaaacaaaaaaaacacctcaccatgagtgctacatgtgaatagatattaagtgccatatataattagttctcagaagaagggagaaatgatcataggactgggaattgttttgcaaacgttctaggagatgtgagagaaaatatgtaaccacatcttagtggcccaagaaaatacaggcctgaagggataagattgtgtctctatagagcttcaaagcatacaggtcaattaagaaagcccctctctctccagagccgtttccctagcttttggcacctggatgccacagtcctccattaggctgatgactccaaagatgtaactctagcctcttgcctgagcttcagactcgcgtcccactgcccacaggacacatccacctggatgtgactcacaggtacctccaacccatcatgtggagatactcatcctgttccccctagagctgctcttcctgctgcattctctctctcaattactgggaccaccaagctaggaacctgggagtcatccttgatactttctcttcctccttaatcctgtgtattcagcaagtaactaaaggttggtgttggccaggcatggtggctcatgcctgtaatcccagcattttgggaggccaaggcgggcggatcacttgaggtcaggagctcaagaccagcctggccaacatggtgaaaccccatctctactaaaaaaaaaaaaaaaattagtcgggcgtggtggtgcatgcctgtaatcccagctactggggaggctgaggcaggagaatcgcttgaacctgggaggcagaggttgcagtgagccgggattgcgccattgtactccagcctgggtgaagaagtgagactctgtcttaaaaaaaaaaattggtgctgataaatattgatgaattctgctctctgctctctatggttgtcaacactgcagagttgaggcctcatatctcacctgcactgctgcaacagcttactggtcccttgctcccagccttctcctcttcagtccatcgtccacacagcactggggaaggggagccacttgaaacaaaagtcaacaactggttgtagttcataaacacagagctgtttgtgtcccctgtatctggaatgccattatgacccactacattttttctttcctacccctcttaaaactcagttcaggtagcagctccactaggaagccttggctgaccataatcccattcaattccatttcacctcttcgcaggcagtctggggttagggaccctttctctttgctccccaaaataaactggttatctctaaaaaaanaaanaanaaannaaaaaaaanaaaaaaananaaanaaaaaaaaaaaaaaaaaaaaaaaaaaaaaaaaaaaaaaaaaaaaaaaaaaaaaaaaaaaaaaaaaacattggggcccccctggccccacccatttttaaattggggaaggtttttcctgggggccgaatttgggcccacttggccaattcccccttatgggggggggtttaaaaataaaggggcgggggtttaaaaccggggggcggggaaaaccccgggggtccccaaattaaatggcttggaagaaaacccccttttgccgggggggggaaaaacaaaaagggccccccccaccccccttccccacaagtggcccaccctaatgggaaagggaaaatttaagccttaaatttttggtaaaaatcgcggaaaattttggtaaaaaaaccaattttttaaccaaaagggccaaatggggaaaaaccctctt

SEQ ID NO: 371284 - DNA, 3286 bp, Homo sapiens
gcatttcttccttctgcgtatgggacaggaccctttctggaatgggggtcttatgacctacaatcaaacaagaacatggacttcccgtgcctctggctagggctgttgctgcctttggtagctgcgctggatttcaactaccaccgccaggaagggatggaagcgtttttgaagactgttgcccaaaactacagttctgtcactcacttacacagtattgggaaatctgtgaaaggtagaaacctgtgggttcttgttgtggggcggtttccaaaggaacacagaattgggattccagagttcaaatacgtggcaaatatgcatggagatgagactgttgggcgggagctgctgctccatctgattgactatctcgtaaccagtgatggcaaagaccctgaaatcacaaatctgatcaatagtacccggatacacatcatgccttccatgaacccagatggatttgaagccgtcaaaaagcctgactgttactacagcatcggaagggaaaattataaccagtatgacttgaatcgaaatttccccgatgcttttgaatataataatgtctcaaggcagcctgaaactgtggcagtcatgaagtggctgaaaacagagacgtttgtcctctctgcaaacctccatggtggtgccctcgtggccagttacccatttgataatggtgttcaagcaactggggcattatactcccgaagcttaacgcctgatgatgatgtttttcaatatcttgcacatacctatgcttcaagaaatcccaacatgaagaaaggagacgagtgtaaaaacaaaatgaactttcctaatggtgttacaaatggatactcttggtatccactccaaggtggaatgcaagattacaactacatctgggcccagtgttttgaaattacgttggagctgtcatgctgtaaatatcctcgtgaggagaagcttccatccttttggaataataacaaagcctcattaattgaatatataaagcaggtgcacctaggtgtaaagggtcaagtttttgatcagaatggaaatccattacccaatgtaattgtggaagtccaagacagaaaacatatctgcccctatagaaccaacaaatatggagagtattatctccttctcttgcctgggtcttatattataaatgttacagtccctggacatgatccacacatcacaaaggtgattattccggagaaatcccagaacttcagtgctcttaaaaaggatattctacttccattccaagggcaattggattctatcccagtatcaaatccttcatgcccaatgattcctctatacagaaatttgccagaccactcagctgcaacaaagcctagtttgttcttatttttagtgagtcttttgcacatattcttcaaataaagtaaaatgtgaaactcaacccacatcaccacctggaatcagggattgctcactccaggttactgcaaccctaactcactctagtgggaccttgactggagaaactccacgatcttcctgaagaagagaaatggatgtttccaaattccacaataagcaatatgtggtgataatgaaaagaatgattcagtcttgacggtgaatggaagacacttacctaacaagtactgctcatttacactcaaattaatcttgaagtagtcttaaaatgtgtaagaagttaaaacttgagaagcaaaaaaatgcctgcaaaaagaagatcattttgtatacagagaaccggatgaatataagcaatgaagatgaacatttattgatcttctacatacaagacttcaccataaggccaggagcagtggctcacaccttgtaatcccagcactttgggaggccaaggtgggcggatcaccttgaggtcaggagttcaagaccagcctgaccaacatggtgaaaccctgtctctactaaatattagcggggtgtggtggcgggcacctgtaatcgcagcctttcgggaggctgagacaggagaatcgcttgaaccctagaggcggagtttgcagtgagccgagatagtgccattgtactccagcttgggcaacagagtaagaactctgtcttaaaaaaaaaaattggtgctgataaatattgatgaattctgctctctgctctctatggttgtcaacactgcagagttgaggcctcatatctcacctgcactgctgcaacagcttactggtcccttgctcccagccttctcctcttcagtccatcgtccacacagcactggggaaggggagccacttgaaacaaaagtcaacaactggttgtagttcattatgacccactacattttttctttcctacccctcttaaaactcagttcaggtagcagctccactaggaagccttggctgaccataatcccattcaattccatttcacctcttcgcaggcagtctggggttagggaccctttctctttgctccccaaaataaactggttatctctactattggatttacaacattgtattataatcttctccatgtgtgccttctctagtagaatgtgagctctttgaggccaaggtctatttaatttgtttgaaaaattcattgttatatcctcaaagcctagcacatagtaggtactgaatgaatgaatgaacaaggggtgccaggagactgctactcccagtccttcccagaaactgcctagggctttgagtcattttatgaagctaggtcttaatgcgtaggcaacctcccagctcactatgaacgctgacagaagagtgttttcatgtctataatcaagaattccagatacattccttttactgaaccttgaattgatcctaagattggtagtaaaggtattatgttacctcctaacagcactacaaagtacctttttttatcagaaaaaaattttaccattaggactcaatttgaagtactaatgcttctcaagttctccactatgagagttaccctgtattagaccgttacctataagaattaaggggtaaagcactaaacagaaaagaaaaaaaaaatagcaactctggtgagcagatttctttcctttcttccttccttctcctcttcctaccttcctccctcctttccctctcctccccttctctccctttccctccccttcccttccttttcttctttcctccgctcccctccccttccctccccttcccatccttctttctcttttttttacttaatccccagtgtgacagtaatataggctgatttctagaagtgtggtgtattactcatggaaagtgagttgccttgg

SEQ ID NO: 371285 - DNA, 2996 bp, Homo sapiens
ataacacccggccccgccgggcggccgcgggtgggtagaggtgcgcgcctgggacctgaacatggacttcccgtgcctctggctagggctgttgctgcctttggtagctgcgctggatttcaactaccaccgccaggaagggatggaagcgtttttgaagactgttgcccaaaactacagttctgtcactcacttacacagtattgggaaatctgtgaaaggtagaaacctgtgggttcttgttgtggggcggtttccaaaggaacacagaattgggattccagagttcaaatacgtggcaaatatgcatggagatgagactgttgggcgggagctgctgctccatctgattgactatctcgtaaccagtgatggcaaagaccctgaaatcacaaatctgatcaatagtacccggatacacatcatgccttccatgaacccagatggatttgaagccgtcaaaaagcctgactgttactacagcatcggaagggaaaattataaccagtatgacttgaatcgaaatttccccgatgcttttgaatataataatgtctcaaggcagcctgaaactgtggcagtcatgaagtggctgaaaacagagacgtttgtcctctctgcaaacctccatggtggtgccctcgtggccagttacccatttgataatggtgttcaagcaactggggcattatactcccgaagcttaacgcctgatgatgatgtttttcaatatcttgcacatacctatgcttcaagaaatcccaacatgaagaaaggagacgagtgtaaaaacaaaatgaactttcctaatggtgttacaaatggatactcttggtatccactccaaggtggaatgcaagattacaactacatctgggcccagtgttttgaaattacgttggagctgtcatgctgtaaatatcctcgtgaggagaagcttccatccttttggaataataacaaagcctcattaattgaatatataaagcaggtgcacctaggtgtaaagggtcaagtttttgatcagaatggaaatccattacccaatgtaattgtggaagtccaagacagaaaacatatctgcccctatagaaccaacaaatatggagagtattatctccttctcttgcctgggtcttatattataaatgttacagtccctggacatgatccacacatcacaaaggtgattattccggagaaatcccagaacttcagtgctcttaaaaaggatattctacttccattccaagggcaattggattctatcccagtatcaaatccttcatgcccaatgattcctctatacagaaatttgccagaccactcagctgcaacaaagcctagtttgttcttatttttagtgagtcttttgcacatattcttcaaataaagtaaaatgtgaaactcaacccacatcaccacctggaatcagggattgctcactccaggttactgcaaccctaactcactctagtgggaccttgactggagaaactccacgatcttcctgaagaagagaaatggatgtttccaaattccacaataagcaatatgtggtgataatgaaaagaatgattcagtcttgacggtgaatggaagacacttacctaacaagtactgctcatttacactcaaattaatcttgaagtagtcttaaaatgtgtaagaagttaaaacttgagaagcaaaaaaatgcctgcaaaaagaagatcattttgtatacagagaaccggatgaatataagcaatgaagatgaacatttattgatcttctacatacaagacttcaccataaggccaggagcagtggctcacaccttgtaatcccagcactttgggaggccaaggtgggcggatcaccttgaggtcaggagttcaagaccagcctgaccaacatggtgaaaccctgtctctactaaatattagcggggtgtggtggcgggcacctgtaatcgcagcctttcgggaggctgagacaggagaatcgcttgaaccctagaggcggagtttgcagtgagccgagatagtgccattgtactccagcttgggcaacagagtaagactctgtctcaaaaaaaaaaaaacaaaaacaaacaaacaaaaaaaacacctcaccatgagtgctacatgtgaatagatattaagtgccatatataattagttctcagaagaagggagaaatgatcataggactgggaattgttttgcaaacgttctaggagatgtgagagaaaatatgtaaccacatcttagtggcccaagaaaatacaggcctgaagggataagattgtgtctctatagagcttcaaagcatacaggtcaattaagaaagcccctctctctccagagccgtttccctagcttttggcacctggatgccacagtcctccattaggctgatgactccaaagatgtaactctagcctcttgcctgagcttcagactcgcgtcccactgcccacaggacacatccacctggatgtgactcacaggtacctccaacccatcatgtggagatactcatcctgttccccctagagctgctcttcctgctgcattctctctctcaattactgggaccaccaagctaggaacctgggagtcatccttgatactttctcttcctccttaatcctgtgtattcagcaagtaactaaaggttggtgttggccaggcatggtggctcatgcctgtaatcccagcattttgggaggccaaggcgggcggatcacgtgttaggccaggatggtctcgatctcctgacctcatgatctgcctgcctctgcctggacctcccaaagtgctgggattacaggcgtgagcccccgcgcccagccactttctttaatactataactaagaatttattaaaatgcacaaattgtctaagactgtaaagtttattggggagaggccatgactacctctgaatttagtaaatttaaaatatttctgattctcaataaagaactaatatccatataaaaaaaaatt

SEQ ID NO: 371286 - DNA, 1072 bp, Homo sapiens
ataacacccggccccgccgggcggccgcgggtgggtagaggtgcgcgcctgggacctgaacatggacttcccgtgcctctggctagggctgttgctgcctttggtagctgcgctggatttcaactaccaccgccaggaagggatggaagcgtttttgaagactgttgcccaaaactacagttctgtcactcacttacacagtattgggaaatctgtgaaaggtagaaacctgtgggttcttgttgtggggcggtttccaaaggaacacagaattgggattccagagttcaaatacgtggcaaatatgcatggagatgagactgttgggcgggagctgctgctccatctgattgactatctcgtaaccagtgatggcaaagaccctgaaatcacaaatctgatcaatagtacccggatacacatcatgccttccatgaacccagatggatttgaagccgtcaaaaagcctgactgttactacagcatcggaagggaaaattataaccagtatgacttgaatcgaaatttccccgatgcttttgaatataataatgtctcaaggcagcctgaaactgtggcagtcatgaagtggctgaaaacagagacgtttgtcctctctgcaaacctccatggtggtgccctcgtggccagttacccatttgataatggtgttcaagcaactggggcattatactcccgaagcttaacgcctgatgatgatgtttttcaatatcttgcacatacctatgcttcaagaaatcccaacatgaagaaaggagacgagtgtaaaaacaaaatgaactttcctaatggtgttacaaatggatactcttggtatccactccaaggtggaatgcaagattacaactacatctgggcccagtgttttgaaattacgttggagctgtcatgctgtaaatatcctcgtgaggagaagcttccatccttttggaataataacaaagcctcattaattgaatatataaagcaggtgcacctaggtttgtaaaattttcttattaattccctattaatacaaaatagagcatctggcaagacctctgggttgact

SEQ ID NO: 371287 - DNA, 4777 bp, Homo sapiens
cggccgcatccttgccgcccgccccggcccagccgcgtcccggagccgtcgggcatggagccgtggaagcagtgcgcgcagtggctcatccattgcaaggtgctgcccaccaaccaccgggtgacctgggactcggctcaggtgttcgaccttgcgcagaccctccgcgatggagtcctgctctgccagctgcttaacaacctccgggcgcactccatcaacctgaaggagatcaacctgaggccgcagatgtcccagtttctctgtttgaagaacataaggacatttctcacggcctgttgtgagacgtttggaatgaggaaaagtgaacttttcgaggcatttgacttgtttgatgttcgtgactttggaaaggttatagaaacattatcacgactttctcgaacacctatagcattggccacaggaatcaggcccttcccaacagaagaaagcattaatgatgaagacatctacaaaggccttcctgatttaatagatgaaacccttgtggaagatgaagaagatctctatgactgtgtttatggggaagatgaaggtggagaagtctatgaggacttaatgaaggcagaggaagcacatcagcccaaatgtccagaaaatgatatacgaagttgttgtctagcagaaattaagcagacagaagaaaaatatacagaaactttggagtcaatagaaaagtatttcatggcaccactaaaaagatttctgacagcagcagaatttgattcagtattcatcaacattcctgaacttgtaaaacttcatcggaacctaatgcaagagattcatgattccattgtaaataaaaatgaccagaacttgtaccaagtttttattaactacaaggaaagattggttatttacgggcagtactgcagtggagtggagtcagccatctctagtttagactacatttctaagacaaaagaagatgtcaaactgaaattagaggaatgttccaaaagagcaaataatgggaaatttactcttcgagacttgcttgtggttcctatgcaacgtgttttaaagtaccaccttctcctccaggaactggtcaaacataccactgatccgactgagaaggcaaatctgaaactggctcttgatgccatgaaggacttggcacaatatgtgaatgaagtgaaaagagataatgagacccttcgtgaaattaaacagtttcagctatctatagagaatttgaaccaaccagttttgctttttggacgacctcagggagatggtgaaattcgaataaccactctagacaagcataccaaacaagaaaggcatatcttcttatttgatttggcagtgatcgtatgtaagagaaaaggtgataactatgaaatgaaggaaataatagatcttcagcagtacaagatagccaataatcctacaaccgataaagaaaacaaaaagtggtcttatggcttctacctcatccatacccaaggacaaaatgggttagaattttattgcaaaacaaaagatttaaagaagaaatggctagaacagtttgaaatggctttgtctaacataagaccagactatgcagactccaatttccacgacttcaagatgcataccttcactcgagtcacatcctgcaaagtctgccagatgctcctgaggggaacattttatcaaggctatttatgttttaagtgtggagcgagagcacacaaagaatgtttgggaagagtagacaattgtggcagagttaattctggtgaacaagggacactcaaactaccagagaaacggaccaatggactgcgaagaactcctaaacaggtggatccaggtttaccaaagatgcaggtcattaggaactattctggaacaccacccccagctctgcatgaaggaccccctttacagctccaggccggggataccgttgaacttctgaaaggagatgcacacagtctgttttggcagggcagaaatttagcatctggagaggttggattttttccaagtgatgcagtcaagccttgcccatgtgtgcccaaaccagtagattattcttgccaaccctggtatgctggagcaatggaaagattgcaagcagagaccgaacttattaatagggtaaatagtacttaccttgtgaggcacaggaccaaagagtcaggagaatatgcaattagcattaagtacaataatgaagcaaagcacatcaagattttaacaagagatggcttttttcacattgcagaaaatagaaaatttaaaagtttaatggaacttgtggagtactacaagcatcattctctcaaggaagggttcagaaccttagatacaactctgcagtttccatacaaggagccagaacattcagctggacagaggggtaatagagcaggcaacagcttgttaagtccaaaagtgctgggcattgccatcgctcggtatgacttctgtgcaagagatatgagagagttgtccttgttgaaaggagatgtggtgaagatttacacaaagatgagtgcaaatggctggtggagaggagaagtaaatggcagggtgggctggtttccatccacatatgtggaagaggatgaataaattcaaatcccgtgttgcaccctgcaccaaaaatttcagagaagggataaatagaagcctgcacagcatcgtgaattaactgaagtgtttaaaaagctgcatttctggctgttcaacatcctccctccttagcccctcctaagtcttaatgctgagatttctaaagatgctggtactgacagattaatggcttgcctagagctgtgcaagaaacagcctgccagtctgtcattgtcagggaccagggcaaaaccaagagctgttcttcccagaagagccctgcaaacacattggttcgtgcttccctttacttcttctggtcagataccatgaatgccagtcatcagtaaatcttaatacacttttgctttattctcacatgccattcaccagattatttgatggtacaaagaagcagaagtgtaattttccttttcccagcatgacgaaaaattggagttctgccatttgagcagcttactggaaagatccagccttacttgtcttaaattgtccaacaaggtgactcattgcccggcaaacacttttaccctcagatgttactcatgatattataaaatatgaggccagtgctcaggtttgcatcataagtgagctatccctgaagggttttaattacttatttggtgtcctgattatatttgcaaacttctttataaaaggtgaaaaaagcacacaaaagagagggtgtcttcatattaaaccttcacaaccttcatgatttcataggattattttggaaatatagcacttgactttatgaaaggatctgggctaggtatattaggggtagttgccaataacctgaagaagctggcattgtttacagaaacagatcaagggctataatttatgtcattttatagcagcagtatctattaatacatgccttttcctcccatccacctcccccgcacacacacaaagatgacctgggacatgatttttttattcccacattttcttggagcacaaacaactttgttgaggattttggaaggaaagcacaactgggtcctttattcatttctgggacagaaagagggtcagtggacttttgtgggcctccagcttctctcagagtctccccctctgcagcccatcctgggagtgtattaactggagggaagatgggtcttgcagtacatttgttttgcccagccatcactcttttttgtgaggagcctaaatacattcttcctggggtccagagtccccattcaaggcagtcaagttaagacactaacttggccctttcctgatggaaatatttcctccatagcagaagttgtgttctgacaagactgagagagttacatgttgggaaaaaaaagaagcattaacttagtagaactgaaccaggagcattaagttctgaaattttgaatcatctctgaaatgaagcaggtgtagcctgccctctcatcaatccgtctgggtgccagaactcaaggttcagtggacacatccccctgttagagaccctcatgggctaggacttttcatctaggatagattcaagacctttacctcagaattatgtaaactgtgattgtgttttagaaaaattattatttgctaaaaccatttaagtctttgtatatgtgtaaatgatcacaaaaatgtattttataaaatgttctgtacaataaagttacacctcaaagtgtactcttggaatggattctttcctgtaaagtcttatctgcgactctgtctcgggaatgttttgtctgttgccgtcagccgaactttgttatggagggagcagcctcacacaagcagaaacactcctgtggatggtattgtagcatgtattgtttattttagtcaatagaccctctccttataaatggtgtttagtcttcctgttgcatttcatgggcctgggggtttcctagcagaggatattggagcccctttttgtgacattaccaattacatctttgtccacgtttaatactttgttttggaaaatttaaatgctgcagatttgtgtagagttctaataccaaagacagaagtaaatgttttccatatactttgtcttgcctgtatgcagcccttgtgtaatatggtgaattagagtggtatttcactttgtattattttgtaaatatgtcaatataataaatagtgactaaattgaaaaaaaaaa

SEQ ID NO: 371288 - DNA, 241 bp, Homo sapiens
agcggggcccttctcaagatggcgctgcactcaatgcggaaagcgcgtgagcgctggagcttcatccgggcacttcataagggatccgcagctgctcccgctctccaggtaaccaaagacggcccttccctccgcggcttcccatcccgcgaggttcttctcatcccactgccctctatttatttctctcctcccgcttcttagggaaagtacatgccttccctcgcctaaggtctactcg

SEQ ID NO: 371289 - DNA, 2796 bp, Homo sapiens
agcggggcccttctcaagatggcgctgcactcaatgcggaaagcgcgtgagcgctggagcttcatccgggcacttcataagggatccgcagctgctcccgctctccagaaagacagcaagaagcgagtattttccggcattcaacctacaggaatcctccacctgggcaattacctgggagccattgagagctgggtgaggttacaggatgaatatgactctgtattatacagcattgttgacctccactccattactgtcccccaagacccagctgtccttcggcagagcatcctggacatgactgctgttcttcttgcctgtggcataaacccggaaaaaagcatccttttccaacaatctcaggtgtctgaacacacacaattaagttggatcctttcctgcatggtcagactacctcgattacaacatttacatcagtggaaggcaaagactaccaagcagaagcacgatggcacggtgggcctgctcacatacccagtactccaggcagccgacattctgttgtacaagtccacacacgttcctgttggggaggatcaagtccagcacatggaactagttcaggatctagcacaaggtttcaacaagaagtatggggagttctttccagtgcccgagtccattctcacatccatgaagaaggtaaaatccctacgtgatccttctgccaaaatgtcgaaatcagaccctgacaaactggccaccgtccgaataacagacagcccagaggagatagtgcagaaattccgcaaggctgtgacagacttcacctcggaggtcacctatgacccggctggccgcgctggcgtgtccaacatagtggcggtgcatgccgcggtgacggggctctccgtggaggaagtggtgcgccgcagcgcgggcatgaacactgctcgctacaagctggccgtggcagatgctgtgattgagaagtttgccccaattaagcgtgaaattgaaaaactgaagctggacaaggaccatttagagaaggttttacaaattggatcagcaaaagccaaagaattagcatacactgtgtgccaggaggtgaagaaattggtgggttttctataggaagtttcaacgaatcacagcaaggcttttgtgccttgcactccatgcattctgataacggcagctttcctaaaaagaaaaagttatagttttgggacatttaatttggtatagctgattattggctttatttgatgaatattgctttgtagctttgaaatacgacagtgttccaaatcccatcaacaaaatgctgtgaacaacaacaacaaaaaataaatcaagaaggcatagctgtctgaatccccaattattgaggcacactccttggcctgcagaaatgtgattgaagtaaggagtaatttgggaaatggagtatcatttgtgcttctctctggagtacttactgtaacagatgcacacgttatctacttcaacccttttataaagcaatatatagaggtcttagatgtataatccttgagatgccatttgatcagatgccaatttgtattcagagctcataaaaacaagtccattcttatagtttgtttgtcactgagacggtgcctgatttaatatatttaagctgcttaacttgttttccaagagataacaccaactgttccagcaataatttgttttttaattcagagatatgggatatgatcttctaaggaggttgcattattttgacctgatttatttattgtacaagagcccaagtccctgaattatattcttaataagtgctttcttgcattcatttcagtttagtctcaccaaccccctatgaattaggagaattattgtcattttacacatgaggaaagtgaggctgagagaatccaattagcttgtacgatatcactccataagagaagcaaatctgagagtaaaacccttaccccttattcttaagaatagtgcttgtttattcagtacaaaaaaaatgctgaaaggcagcgttttttagactctaaacattctgattttgaaggtgggtgttggaacgactgatgatgttttttatatcatcaattcagccaatggatgcgaacttaaaatctggattcacagaaccgtggtcacatttccccatcaaaatccccaaggcgggtcccaagttctctcctctacgctcattgcaggaaatacttggaaataggttctgccagtctacaatagcagtgaagactgacaaatcagatattcccaatgactgacagcttctcatcttgcctctacctcagttaagtaatgtcaccctgaaacctagcttttctgcacttccatttctgacacctgaaaatgaaaatgataatcctaacttatacaccaagacctgttagcaagatcgattttgtaacagaaattgcttataagttttttatcagtaaggaccatgatcaccatttgtacatacataactaggttgttgagcaaagcatttttgctcatgtttcttaaggaagtagagtagtccttgtgtcagaacacatgttaatccacaaaacgccgcatcccagattccaaattaaaacatcgtttttaggattcttggagctagcctggatcatgggtaaaggaaacattttgccttttgtatcttatactggaatgggatgtctgtaagtcctagaacctctttgagcatatttcttacaagcctctgttttttcccctttaaaggaaactttgaaaggattgtgaatactggaaaatgacaaaactaaaggtagatctatcaagcca

SEQ ID NO: 371290 - DNA, 3220 bp, Homo sapiens
agcggggcccttctcaagatggcgctgcactcaatgcggaaagcgcgtgagcgctggagcttcatccgggcacttcataagggatccgcagctgctcccgctctccagaaagacagcaagaagcgagtattttccggcattcaacctacaggaatcctccacctgggcaattacctgggagccattgagagctgggtgaggttacaggatgaatatgactctgtattatacagcattgttgacctccactccattactgtcccccaagacccagctgtccttcggcagagcatcctggacatgactgctgttcttcttgcctgtggcataaacccggaaaaaagcatccttttccaacaatctcaggtgtctgaacacacacaattaagttggatcctttcctgcatggtcagactacctcgattacaacatttacatcagtggaaggcaaagactaccaagcagaagcacgatggcacggtgggcctgctcacatacccagtactccaggcagccgacattctgttgtacaagtccacacacgttcctgttggggaggatcaagtccagcacatggaactagttcaggatctagcacaaggtttcaacaagaagtatggggagttctttccagtgcccgagtccattctcacatccatgaagaaggtaaaatccctacgtgatccttctgccaaaatgtcgaaatcagaccctgacaaactggccaccgtccgaataacagacagcccagaggagatagtgcagaaattccgcaaggctgtgacagacttcacctcggaggtcacctatgacccggctggccgcgctggcgtgtccaacatagtggcggtgcatgccgcggtgacggggctctccgtggaggaagtggtgcgccgcagcgcgggcatgaacactgctcgctacaagctggccgtggcagatgctgtgattgagaagtttgccccaattaagcgtgaaattgaaaaactgaagctggacaaggaccatttagagaaggttttacaaattggatcagcaaaagccaaagaattagcatacactgtgtgccaggaggtgaagaaattggtgggttttctataggaagtttcaacgaatcacagcaaggcttttgtgccttgcactccatgcattctgataacggcagctttcctaaaaagaaaaagttatagttttgggacatttaatttggtatagctgattattggctttatttgatgaatattgctttgtagctttgaaatacgacagtgttccaaatcccatcaacaaaatgctgtgaacaacaacaacaaaaaataaatcaagaaggcatagctgtctgaatccccaattattgaggcacactccttggcctgcagaaatgtgattgaagtaaggagtaatttgggaaatggagtatcatttgtgcttctctctggagtacttactgtaacagatgcacacgttatctacttcaacccttttataaagcaatatatagaggtcttagatgtataatccttgagatgccatttgatcagatgccaatttgtattcagagctcataaaaacaagtccattcttatagtttgtttgtcactgagacggtgcctgatttaatatatttaagctgcttaacttgttttccaagagataacaccaactgttccagcaataatttgttttttaattcagagatatgggatatgatcttctaaggaggttgcattattttgacctgatttatttattgtacaagagcccaagtccctgaattatattcttaataagtgctttcttgcattcatttcagtttagtctcaccaaccccctatgaattaggagaattattgtcattttacacatgaggaaagtgaggctgagagaatccaattagcttgtacgatatcactccataagagaagcaaatctgagagtaaaacccttaccccttattcttaagaatagtgcttgtttattcagtacaaaaaaaatgctgaaaggcagcgttttttagactctaaacattctgattttgaaggtgggtgttggaacgactgatgatgttttttatatcatcaattcagccaatggatgcgaacttaaaatctggattcacagaaccgtggtcacatttccccatcaaaatccccaaggcgggtcccaagttctctcctctacgctcattgcaggaaatacttggaaataggttctgccagtctacaatagcagtgaagactgacaaatcagatattcccaatgactgacagcttctcatcttgcctctacctcagttaagtaatgtcaccctgaaacctagcttttctgcacttccatttctgacacctgaaaatgaaaatgataatcctaacttatacaccaagacctgttagcaagatcgattttgtaacagaaattgcttataagttttttatcagtaaggaccatgatcaccatttgtacatacataactaggttgttgagcaaagcatttttgctcatgtttcttaaggaagtagagtagtccttgtgtcagaacacatgttaatccacaaaacgccgcatcccagattccaaattaaaacatcgtttttaggattcttggagctagcctggatcatgggtaaaggaaacattttgccttttgtatcttatactggaatgggatgtctgtaagtcctagaacctctttgagcatatttcttacaagcctctgttttttcccctttaaaggaaactttgaaaggattgtgaatactggaaaatgacaaaactaaaggtagatctatcaagccaattgtctgtttatctgtttgtgtggtttttacccccttgcaatacctttcctccaaaaaattaaggcactatggaaagaatctcagaggagaaaaacagataacttgtgataacttccagggaccgaagtctatgcattggtgagggtggacttgtttgcaacctgttgttattttttttaagtgacccaactgttcaagtccaaacttggcccataattattaagagaatcttatccggttaatcagtattaatcaggattcttcagagaaacaaaaccaataggatatatatctatatattagagaatttattatggggattagctcacccaattatgaaggctgagaagttccatgataggctatgtgcaagctggacccaagagagatgatggtgtgatacagtccaagtccttaggctg

SEQ ID NO: 371291 - DNA, 2633 bp, Homo sapiens
agcggggcccttctcaagatggcgctgcactcaatgcggaaagcgcgtgagcgctggagcttcatccgggcacttcataagggatccgcagctgctcccgctctccagaaagacagcaagaagcgagtattttccggcattcaacctacaggaatcctccacctgggcaattacctgggagccattgagagctgggtgaggttacaggatgaatatgactctgtattatacagcattgttgacctccactccattactgtcccccaagacccagctgtccttcggcagagcatcctggacatgactgctgttcttcttgcctgtggcataaacccggaaaaaagcatccttttccaacaatctcaggtgtctgaacacacacaattaagttggatcctttcctgcatggtcagactacctcgattacaacatttacatcagtggaaggcaaagactaccaagcagaagcacgatggcacggtgggcctgctcacatacccagtactccaggcagccgacattctgttgtacaagtccacacacgttcctgttggggaggatcaagtccagcacatggaactagttcaggatctagcacaaggtttcaacaagaagtatggggagttctttccagtgcccgagtccattctcacatccatgaagaaggtaaaatccctacgtgatccttctgccaaaatgtcgaaatcagaccctgacaaactggccaccgtccgaataacagacagcccagaggagatagtgcagaaattccgcaagatgctgtgattgagaagtttgccccaattaagcgtgaaattgaaaaactgaagctggacaaggaccatttagagaaggttttacaaattggatcagcaaaagccaaagaattagcatacactgtgtgccaggaggtgaagaaattggtgggttttctataggaagtttcaacgaatcacagcaaggcttttgtgccttgcactccatgcattctgataacggcagctttcctaaaaagaaaaagttatagttttgggacatttaatttggtatagctgattattggctttatttgatgaatattgctttgtagctttgaaatacgacagtgttccaaatcccatcaacaaaatgctgtgaacaacaacaacaaaaaataaatcaagaaggcatagctgtctgaatccccaattattgaggcacactccttggcctgcagaaatgtgattgaagtaaggagtaatttgggaaatggagtatcatttgtgcttctctctggagtacttactgtaacagatgcacacgttatctacttcaacccttttataaagcaatatatagaggtcttagatgtataatccttgagatgccatttgatcagatgccaatttgtattcagagctcataaaaacaagtccattcttatagtttgtttgtcactgagacggtgcctgatttaatatatttaagctgcttaacttgttttccaagagataacaccaactgttccagcaataatttgttttttaattcagagatatgggatatgatcttctaaggaggttgcattattttgacctgatttatttattgtacaagagcccaagtccctgaattatattcttaataagtgctttcttgcattcatttcagtttagtctcaccaaccccctatgaattaggagaattattgtcattttacacatgaggaaagtgaggctgagagaatccaattagcttgtacgatatcactccataagagaagcaaatctgagagtaaaacccttaccccttattcttaagaatagtgcttgtttattcagtacaaaaaaaatgctgaaaggcagcgttttttagactctaaacattctgattttgaaggtgggtgttggaacgactgatgatgttttttatatcatcaattcagccaatggatgcgaacttaaaatctggattcacagaaccgtggtcacatttccccatcaaaatccccaaggcgggtcccaagttctctcctctacgctcattgcaggaaatacttggaaataggttctgccagtctacaatagcagtgaagactgacaaatcagatattcccaatgactgacagcttctcatcttgcctctacctcagttaagtaatgtcaccctgaaacctagcttttctgcacttccatttctgacacctgaaaatgaaaatgataatcctaacttatacaccaagacctgttagcaagatcgattttgtaacagaaattgcttataagttttttatcagtaaggaccatgatcaccatttgtacatacataactaggttgttgagcaaagcatttttgctcatgtttcttaaggaagtagagtagtccttgtgtcagaacacatgttaatccacaaaacgccgcatcccagattccaaattaaaacatcgtttttaggattcttggagctagcctggatcatgggtaaaggaaacattttgccttttgtatcttatactggaatgggatgtctgtaagtcctagaacctctttgagcatatttcttacaagcctctgttttttcccctttaaaggaaactttgaaaggattgtgaatactggaaaatgacaaaactaaaggtagatctatcaagcca

SEQ ID NO: 371292 - DNA, 2825 bp, Homo sapiens
agcggggcccttctcaagatggcgctgcactcaatgcggaaagcgcgtgagcgctggagcttcatccgggcacttcataagggatccgcagctgctcccgctctccagaaagacagcaagaagcgagtattttccggcattcaacctacaggaatcctccacctgggcaattacctgggagccattgagagctgggtgaggttacaggatgaatatgactctgtattatacagcattgttgacctccactccattactgtcccccaagacccagctgtccttcggcagagcatcctggacatgactgctgttcttcttgcctgtggcataaacccggaaaaaagcatccttttccaacaatctcaggtgtctgaacacacacaattaagttggatcctttcctgcatggtcagactacctcgattacaacatttacatcagtggaaggcaaagactaccaagcagaagcacgatggcacggtgggcctgctcacatacccagtactccaggcagccgacattctgttgtacaagtccacacacgttcctgttggggaggatcaagtccagcacatggaactagttcaggatctagcacaaggtttcaacaagaagtatggggagttctttccagtgcccgagtccattctcagtatgtgtgtgttggtgtttttaacctagcatccatgaagaaggtaaaatccctacgtgatccttctgccaaaatgtcgaaatcagaccctgacaaactggccaccgtccgaataacagacagcccagaggagatagtgcagaaattccgcaaggctgtgacagacttcacctcggaggtcacctatgacccggctggccgcgctggcgtgtccaacatagtggcggtgcatgccgcggtgacggggctctccgtggaggaagtggtgcgccgcagcgcgggcatgaacactgctcgctacaagctggccgtggcagatgctgtgattgagaagtttgccccaattaagcgtgaaattgaaaaactgaagctggacaaggaccatttagagaaggttttacaaattggatcagcaaaagccaaagaattagcatacactgtgtgccaggaggtgaagaaattggtgggttttctataggaagtttcaacgaatcacagcaaggcttttgtgccttgcactccatgcattctgataacggcagctttcctaaaaagaaaaagttatagttttgggacatttaatttggtatagctgattattggctttatttgatgaatattgctttgtagctttgaaatacgacagtgttccaaatcccatcaacaaaatgctgtgaacaacaacaacaaaaaataaatcaagaaggcatagctgtctgaatccccaattattgaggcacactccttggcctgcagaaatgtgattgaagtaaggagtaatttgggaaatggagtatcatttgtgcttctctctggagtacttactgtaacagatgcacacgttatctacttcaacccttttataaagcaatatatagaggtcttagatgtataatccttgagatgccatttgatcagatgccaatttgtattcagagctcataaaaacaagtccattcttatagtttgtttgtcactgagacggtgcctgatttaatatatttaagctgcttaacttgttttccaagagataacaccaactgttccagcaataatttgttttttaattcagagatatgggatatgatcttctaaggaggttgcattattttgacctgatttatttattgtacaagagcccaagtccctgaattatattcttaataagtgctttcttgcattcatttcagtttagtctcaccaaccccctatgaattaggagaattattgtcattttacacatgaggaaagtgaggctgagagaatccaattagcttgtacgatatcactccataagagaagcaaatctgagagtaaaacccttaccccttattcttaagaatagtgcttgtttattcagtacaaaaaaaatgctgaaaggcagcgttttttagactctaaacattctgattttgaaggtgggtgttggaacgactgatgatgttttttatatcatcaattcagccaatggatgcgaacttaaaatctggattcacagaaccgtggtcacatttccccatcaaaatccccaaggcgggtcccaagttctctcctctacgctcattgcaggaaatacttggaaataggttctgccagtctacaatagcagtgaagactgacaaatcagatattcccaatgactgacagcttctcatcttgcctctacctcagttaagtaatgtcaccctgaaacctagcttttctgcacttccatttctgacacctgaaaatgaaaatgataatcctaacttatacaccaagacctgttagcaagatcgattttgtaacagaaattgcttataagttttttatcagtaaggaccatgatcaccatttgtacatacataactaggttgttgagcaaagcatttttgctcatgtttcttaaggaagtagagtagtccttgtgtcagaacacatgttaatccacaaaacgccgcatcccagattccaaattaaaacatcgtttttaggattcttggagctagcctggatcatgggtaaaggaaacattttgccttttgtatcttatactggaatgggatgtctgtaagtcctagaacctctttgagcatatttcttacaagcctctgttttttcccctttaaaggaaactttgaaaggattgtgaatactggaaaatgacaaaactaaaggtagatctatcaagcca

SEQ ID NO: 371293 - DNA, 2834 bp, Homo sapiens
cggccgcatccttgccgcccgccccggcccagccgcgtcccggagccgtcgggcatggagccgtggaagcagtgcgcgcagtggctcatccattgcaaggtgctgcccaccaaccaccgggtgacctgggactcggctcaggtgttcgaccttgcgcagaccctccgcgatggagtcctgctctgccagctgcttaacaacctccgggcgcactccatcaacctgaaggagatcaacctgaggccgcagatgtcccagtttctctgtttgaagaacataaggacatttctcacggcctgttgtgagacgtttggaatgaggaaaagtgaacttttcgaggcatttgacttgtttgatgttcgtgactttggaaaggtgtctgaacacacacaattaagttggatcctttcctgcatggtcagactacctcgattacaacatttacatcagtggaaggcaaagactaccaagcagaagcacgatggcacggtgggcctgctcacatacccagtactccaggcagccgacattctgttgtacaagtccacacacgttcctgttggggaggatcaagtccagcacatggaactagttcaggatctagcacaaggtttcaacaagaagtatggggagttctttccagtgcccgagtccattctcagtatgtgtgtgttggtgtttttaacctagcatccatgaagaaggtaaaatccctacgtgatccttctgccaaaatgtcgaaatcagaccctgacaaactggccaccgtccgaataacagacagcccagaggagatagtgcagaaattccgcaaggctgtgacagacttcacctcggaggtcacctatgacccggctggccgcgctggcgtgtccaacatagtggcggtgcatgccgcggtgacggggctctccgtggaggaagtggtgcgccgcagcgcgggcatgaacactgctcgctacaagctggccgtggcagatgctgtgattgagaagtttgccccaattaagcgtgaaattgaaaaactgaagctggacaaggaccatttagagaaggttttacaaattggatcagcaaaagccaaagaattagcatacactgtgtgccaggaggtgaagaaattggtgggttttctataggaagtttcaacgaatcacagcaaggcttttgtgccttgcactccatgcattctgataacggcagctttcctaaaaagaaaaagttatagttttgggacatttaatttggtatagctgattattggctttatttgatgaatattgctttgtagctttgaaatacgacagtgttccaaatcccatcaacaaaatgctgtgaacaacaacaacaaaaaataaatcaagaaggcatagctgtctgaatccccaattattgaggcacactccttggcctgcagaaatgtgattgaagtaaggagtaatttgggaaatggagtatcatttgtgcttctctctggagtacttactgtaacagatgcacacgttatctacttcaacccttttataaagcaatatatagaggtcttagatgtataatccttgagatgccatttgatcagatgccaatttgtattcagagctcataaaaacaagtccattcttatagtttgtttgtcactgagacggtgcctgatttaatatatttaagctgcttaacttgttttccaagagataacaccaactgttccagcaataatttgttttttaattcagagatatgggatatgatcttctaaggaggttgcattattttgacctgatttatttattgtacaagagcccaagtccctgaattatattcttaataagtgctttcttgcattcatttcagtttagtctcaccaaccccctatgaattaggagaattattgtcattttacacatgaggaaagtgaggctgagagaatccaattagcttgtacgatatcactccataagagaagcaaatctgagagtaaaacccttaccccttattcttaagaatagtgcttgtttattcagtacaaaaaaaatgctgaaaggcagcgttttttagactctaaacattctgattttgaaggtgggtgttggaacgactgatgatgttttttatatcatcaattcagccaatggatgcgaacttaaaatctggattcacagaaccgtggtcacatttccccatcaaaatccccaaggcgggtcccaagttctctcctctacgctcattgcaggaaatacttggaaataggttctgccagtctacaatagcagtgaagactgacaaatcagatattcccaatgactgacagcttctcatcttgcctctacctcagttaagtaatgtcaccctgaaacctagcttttctgcacttccatttctgacacctgaaaatgaaaatgataatcctaacttatacaccaagacctgttagcaagatcgattttgtaacagaaattgcttataagttttttatcagtaaggaccatgatcaccatttgtacatacataactaggttgttgagcaaagcatttttgctcatgtttcttaaggaagtagagtagtccttgtgtcagaacacatgttaatccacaaaacgccgcatcccagattccaaattaaaacatcgtttttaggattcttggagctagcctggatcatgggtaaaggaaacattttgccttttgtatcttatactggaatgggatgtctgtaagtcctagaacctctttgagcatatttcttacaagcctctgttttttcccctttaaaggaaactttgaaaggattgtgaatactggaaaatgacaaaactaaaggtagatctatcaagcca

SEQ ID NO: 371294 - DNA, 2539 bp, Homo sapiens
agcggggcccttctcaagatggcgctgcactcaatgcggaaagcgcgtgagcgctggagcttcatccgggcacttcataagggatccgcagctgctcccgctctccagaaagacagcaagaagcgagtattttccggcattcaacctacaggaatcctccacctgggcaattacctgggagccattgagagctgggtgtctgaacacacacaattaagttggatcctttcctgcatggtcagactacctcgattacaacatttacatcagtggaaggtccacacacgttcctgttggggaggatcaagtccagcacatggaactagttcaggatctagcacaaggtttcaacaagaagtatggggagttctttccagtgcccgagtccattctcacatccatgaagaaggtaaaatccctacgtgatccttctgccaaaatgtcgaaatcagaccctgacaaactggccaccgtccgaataacagacagcccagaggagatagtgcagaaattccgcaaggctgtgacagacttcacctcggaggtcacctatgacccggctggccgcgctggcgtgtccaacatagtggcggtgcatgccgcggtgacggggctctccgtggaggaagtggtgcgccgcagcgcgggcatgaacactgctcgctacaagctggccgtggcagatgctgtgattgagaagtttgccccaattaagcgtgaaattgaaaaactgaagctggacaaggaccatttagagaaggttttacaaattggatcagcaaaagccaaagaattagcatacactgtgtgccaggaggtgaagaaattggtgggttttctataggaagtttcaacgaatcacagcaaggcttttgtgccttgcactccatgcattctgataacggcagctttcctaaaaagaaaaagttatagttttgggacatttaatttggtatagctgattattggctttatttgatgaatattgctttgtagctttgaaatacgacagtgttccaaatcccatcaacaaaatgctgtgaacaacaacaacaaaaaataaatcaagaaggcatagctgtctgaatccccaattattgaggcacactccttggcctgcagaaatgtgattgaagtaaggagtaatttgggaaatggagtatcatttgtgcttctctctggagtacttactgtaacagatgcacacgttatctacttcaacccttttataaagcaatatatagaggtcttagatgtataatccttgagatgccatttgatcagatgccaatttgtattcagagctcataaaaacaagtccattcttatagtttgtttgtcactgagacggtgcctgatttaatatatttaagctgcttaacttgttttccaagagataacaccaactgttccagcaataatttgttttttaattcagagatatgggatatgatcttctaaggaggttgcattattttgacctgatttatttattgtacaagagcccaagtccctgaattatattcttaataagtgctttcttgcattcatttcagtttagtctcaccaaccccctatgaattaggagaattattgtcattttacacatgaggaaagtgaggctgagagaatccaattagcttgtacgatatcactccataagagaagcaaatctgagagtaaaacccttaccccttattcttaagaatagtgcttgtttattcagtacaaaaaaaatgctgaaaggcagcgttttttagactctaaacattctgattttgaaggtgggtgttggaacgactgatgatgttttttatatcatcaattcagccaatggatgcgaacttaaaatctggattcacagaaccgtggtcacatttccccatcaaaatccccaaggcgggtcccaagttctctcctctacgctcattgcaggaaatacttggaaataggttctgccagtctacaatagcagtgaagactgacaaatcagatattcccaatgactgacagcttctcatcttgcctctacctcagttaagtaatgtcaccctgaaacctagcttttctgcacttccatttctgacacctgaaaatgaaaatgataatcctaacttatacaccaagacctgttagcaagatcgattttgtaacagaaattgcttataagttttttatcagtaaggaccatgatcaccatttgtacatacataactaggttgttgagcaaagcatttttgctcatgtttcttaaggaagtagagtagtccttgtgtcagaacacatgttaatccacaaaacgccgcatcccagattccaaattaaaacatcgtttttaggattcttggagctagcctggatcatgggtaaaggaaacattttgccttttgtatcttatactggaatgggatgtctgtaagtcctagaacctctttgagcatatttcttacaagcctctgttttttcccctttaaaggaaactttgaaaggattgtgaatactggaaaatgacaaaactaaaggtagatctatcaagcca

SEQ ID NO: 371295 - DNA, 566 bp, Homo sapiens
gtctaacataagaccagactatgcagactccaatttccacgacttcaagatgcataccttcactcgagtcacatcctgcaaagtctgccagatgctcctgaggtaagcctgctcagtcctggttttcagtttaaaggaactgatataattgctaagtgtttcagacttttctaaccttctagccaataggttctaaagtggggaatttgccttagcagtctggatcccacaaacctttgccaggctttctgcctggacagtcctttcagaagctctggcaagctcgtctccctctaccaagggggtaccttgaagagcactgttgatactttttttcttcttcttgcagtaatttcatatgggcagaattttgcaccgtttaatataccactttcttatttcacctttcaggggaacattttatcaaggctatttatgttttaagtgtggagcgagagcacacaaagaatgtttgggaagagtagacaattgtggcagagttaattctggtggtaagtcatgtttattgttgcaattctgtttttaatgaggacataaaatttgct

SEQ ID NO: 371296 - DNA, 1336 bp, Homo sapiens
agcggggcccttctcaagatggcgctgcactcaatgcggaaagcgcgtgagcgctggagcttcatccgggcacttcataagggatccgcagctgctcccgctctccagaaagacagcaagaagcgagtattttccggcattcaacctacaggaatcctccacctgggcaattacctgggagccattgagagctgggtgaggttacaggatgaatatgactctgtattatacagcattgttgacctccactccattactgtcccccaagacccagctgtccttcggcagagcatcctggacatgactgctgttcttcttgcctgtggcataaacccggaaaaaagcatccttttccaacaatctcaggtgtctgaacacacacaattaagttggatcctttcctgcatggtcagactacctcgattacaacatttacatcagtggaaggcaaagactaccaagcagaagcacgatggcacggtgggcctgctcacatacccagtactccaggcagccgacattctgttgtacaagtccacacacgttcctgttggggaggatcaagtccagcacatggaactagttcaggatctagcacaaggtttcaacaagaagtatggggagttctttccagtgcccgagtccattctcacatccatgaagaaggtaaaatccctacgtgatccttctgccaaaatgtcgaaatcagaccctgacaaactggccaccgtccgaataacagacagcccagaggagatagtgcagaaattccgcaaggctgtgacagacttcacctcggaggtcacctatgacccggctggccgcgctggcgtgtccaacatagtggcggtgcatgccgcggtgacggggctctccgtggaggaagtggtgcgccgcagcgcgggcatgaacactgctcgctacaagctggccgtggcagatgctgtgattgagaagtttgccccaattaagcgtgaaattgaaaaactgaagctggacaaggaccatttagagaaggttttacaaattggatcagcaaaagccaaagaattagcatacactgtgtgccaggaggtgaagaaattggtgggttttctataggaagtttcaacgaatcacagcaaggcttttgtgccttgcactccatgcattctgataacggcagctttcctaaaaagaaaaagttatagttttgggacatttaatttggtatagctgattattggctttatttgatgaatattgctttgtagctttgaaatacgacagtgttccaaatcccatcaacaaaatgctgtgaacaacaacaacaaaaaataaatcaagaaggcatagc

SEQ ID NO: 371297 - DNA, 4581 bp, Homo sapiens
  misc_feature (4)..(4): n is a, c, g, or t
  misc_feature (6)..(6): n is a, c, g, or t
  misc_feature (8)..(12): n is a, c, g, or t
  misc_feature (42)..(42): n is a, c, g, or t
  misc_feature (116)..(116): n is a, c, g, or t
tgcncngnnnnntcagaaaccaggatgcaacatctgtgcctngagcctctgctgctagatagcaacctaatgttgtaggggtgtgatgccgtggaccccttcttgaacccccaagntcgtcttgcatttggggctctagcatgcagctgcctgattgcccttgcagagcccacctccctgttatagaaacattatcacgactttctcgaacacctatagcattggccacaggaatcaggcccttcccaacagaagaaagcattaatgatgaagacatctacaaaggccttcctgatttaatagatgaaacccttgtggaagatgaagaagatctctatgactgtgtttatggggaagatgaaggtggagaagtctatgaggacttaatgaaggcagaggaagcacatcagcccaaatgtccagaaaatgatatacgaagttgttgtctagcagaaattaagcagacagaagaaaaatatacagaaactttggagtcaatagaaaagtatttcatggcaccactaaaaagatttctgacagcagcagaatttgattcagtattcatcaacattcctgaacttgtaaaacttcatcggaacctaatgcaagagattcatgattccattgtaaataaaaatgaccagaacttgtaccaagtttttattaactacaaggaaagattggttatttacgggcagtactgcagtggagtggagtcagccatctctagtttagactacatttctaagacaaaagaagatgtcaaactgaaattagaggaatgttccaaaagagcaaataatgggaaatttactcttcgagacttgcttgtggttcctatgcaacgtgttttaaagtaccaccttctcctccaggaactggtcaaacataccactgatccgactgagaaggcaaatctgaaactggctcttgatgccatgaaggacttggcacaatatgtgaatgaagtgaaaagagataatgagacccttcgtgaaattaaacagtttcagctatctatagagaatttgaaccaaccagttttgctttttggacgacctcagggagatggtgaaattcgaataaccactctagacaagcataccaaacaagaaaggcatatcttcttatttgatttggcagtgatcgtatgtaagagaaaaggtgataactatgaaatgaaggaaataatagatcttcagcagtacaagatagccaataatcctacaaccgataaagaaaacaaaaagtggtcttatggcttctacctcatccatacccaaggacaaaatgggttagaattttattgcaaaacaaaagatttaaagaagaaatggctagaacagtttgaaatggctttgtctaacataagaccagactatgcagactccaatttccacgacttcaagatgcataccttcactcgagtcacatcctgcaaagtctgccagatgctcctgaggggaacattttatcaaggctatttatgttttaagtgtggagcgagagcacacaaagaatgtttgggaagagtagacaattgtggcagagttaattctggtgaacaagggacactcaaactaccagagaaacggaccaatggactgcgaagaactcctaaacaggtggatccaggtttaccaaagatgcaggtcattaggaactattctggaacaccacccccagctctgcatgaaggaccccctttacagctccaggccggggataccgttgaacttctgaaaggagatgcacacagtctgttttggcagggcagaaatttagcatctggagaggttggattttttccaagtgatgcagtcaagccttgcccatgtgtgcccaaaccagtagattattcttgccaaccctggtatgctggagcaatggaaagattgcaagcagagaccgaacttattaatagggtaaatagtacttaccttgtgaggcacaggaccaaagagtcaggagaatatgcaattagcattaagtacaataatgaagcaaagcacatcaagattttaacaagagatggcttttttcacattgcagaaaatagaaaatttaaaagtttaatggaacttgtggagtactacaagcatcattctctcaaggaagggttcagaaccttagatacaactctgcagtttccatacaaggagccagaacattcagctggacagaggggtaatagagcaggcaacagcttgttaagtccaaaagtgctgggcattgccatcgctcggtatgacttctgtgcaagagatatgagagagttgtccttgttgaaaggagatgtggtgaagatttacacaaagatgagtgcaaatggctggtggagaggagaagtaaatggcagggtgggctggtttccatccacatatgtggaagaggatgaataaattcaaatcccgtgttgcaccctgcaccaaaaatttcagagaagggataaatagaagcctgcacagcatcgtgaattaactgaagtgtttaaaaagctgcatttctggctgttcaacatcctccctccttagcccctcctaagtcttaatgctgagatttctaaagatgctggtactgacagattaatggcttgcctagagctgtgcaagaaacagcctgccagtctgtcattgtcagggaccagggcaaaaccaagagctgttcttcccagaagagccctgcaaacacattggttcgtgcttccctttacttcttctggtcagataccatgaatgccagtcatcagtaaatcttaatacacttttgctttattctcacatgccattcaccagattatttgatggtacaaagaagcagaagtgtaattttccttttcccagcatgacgaaaaattggagttctgccatttgagcagcttactggaaagatccagccttacttgtcttaaattgtccaacaaggtgactcattgcccggcaaacacttttaccctcagatgttactcatgatattataaaatatgaggccagtgctcaggtttgcatcataagtgagctatccctgaagggttttaattacttatttggtgtcctgattatatttgcaaacttctttataaaaggtgaaaaaagcacacaaaagagagggtgtcttcatattaaaccttcacaaccttcatgatttcataggattattttggaaatatagcacttgactttatgaaaggatctgggctaggtatattaggggtagttgccaataacctgaagaagctggcattgtttacagaaacagatcaagggctataatttatgtcattttatagcagcagtatctattaatacatgccttttcctcccatccacctcccccgcacacacacaaagatgacctgggacatgatttttttattcccacattttcttggagcacaaacaactttgttgaggattttggaaggaaagcacaactgggtcctttattcatttctgggacagaaagagggtcagtggacttttgtgggcctccagcttctctcagagtctccccctctgcagcccatcctgggagtgtattaactggagggaagatgggtcttgcagtacatttgttttgcccagccatcactcttttttgtgaggagcctaaatacattcttcctggggtccagagtccccattcaaggcagtcaagttaagacactaacttggccctttcctgatggaaatatttcctccatagcagaagttgtgttctgacaagactgagagagttacatgttgggaaaaaaaagaagcattaacttagtagaactgaaccaggagcattaagttctgaaattttgaatcatctctgaaatgaagcaggtgtagcctgccctctcatcaatccgtctgggtgccagaactcaaggttcagtggacacatccccctgttagagaccctcatgggctaggacttttcatctaggatagattcaagacctttacctcagaattatgtaaactgtgattgtgttttagaaaaattattatttgctaaaaccatttaagtctttgtatatgtgtaaatgatcacaaaaatgtattttataaaatgttctgtacaataaagttacacctcaaagtgtactcttggaatggattctttcctgtaaagtcttatctgcgactctgtctcgggaatgttttgtctgttgccgtcagccgaactttgttatggagggagcagcctcacacaagcagaaacactcctgtggatggtattgtagcatgtattgtttattttagtcaatagaccctctccttataaatggtgtttagtcttcctgttgcatttcatgggcctgggggtttcctagcagaggatattggagcccctttttgtgacattaccaattacatctttgtccacgtttaatactttgttttggaaaatttaaatgctgcagatttgtgtagagttctaataccaaagacagaagtaaatgttttccatatactttgtcttgcctgtatgcagcccttgtgtaatatggtgaattagagtggtatttcactttgtattattttgtaaatatgtcaatataataaatagtgactaaattgaaaaaaaaaa

SEQ ID NO: 371298 - DNA, 3117 bp, Homo sapiens
aaaagcagtggtgttttaccactctgcagagaaagctaaggttgctaaccaaacaaaataactttacactgacaatgccaatttttacatttctttcagaacaagggacactcaaactaccagagaaacggaccaatggactgcgaagaactcctaaacaggtggatccaggtttaccaaagatgcaggtcattaggaactattctggaacaccacccccagctctgcatgaaggaccccctttacagctccaggccggggataccgttgaacttctgaaaggagatgcacacagtctgttttggcagggcagaaatttagcatctggagaggttggattttttccaagtgatgcagtcaagccttgcccatgtgtgcccaaaccagtagattattcttgccaaccctggtatgctggagcaatggaaagattgcaagcagagaccgaacttattaatagggtaaatagtacttaccttgtgaggcacaggaccaaagagtcaggagaatatgcaattagcattaagtacaataatgaagcaaagcacatcaagattttaacaagagatggcttttttcacattgcagaaaatagaaaatttaaaagtttaatggaacttgtggagtactacaagcatcattctctcaaggaagggttcagaaccttagatacaactctgcagtttccatacaaggagccagaacattcagctggacagaggggtaatagagcaggcaacagcttgttaagtccaaaagtgctgggcattgccatcgctcggtatgacttctgtgcaagagatatgagagagttgtccttgttgaaaggagatgtggtgaagatttacacaaagatgagtgcaaatggctggtggagaggagaagtaaatggcagggtgggctggtttccatccacatatgtggaagaggatgaataaattcaaatcccgtgttgcaccctgcaccaaaaatttcagagaagggataaatagaagcctgcacagcatcgtgaattaactgaagtgtttaaaaagctgcatttctggctgttcaacatcctccctccttagcccctcctaagtcttaatgctgagatttctaaagatgctggtactgacagattaatggcttgcctagagctgtgcaagaaacagcctgccagtctgtcattgtcagggaccagggcaaaaccaagagctgttcttcccagaagagccctgcaaacacattggttcgtgcttccctttacttcttctggtcagataccatgaatgccagtcatcagtaaatcttaatacacttttgctttattctcacatgccattcaccagattatttgatggtacaaagaagcagaagtgtaattttccttttcccagcatgacgaaaaattggagttctgccatttgagcagcttactggaaagatccagccttacttgtcttaaattgtccaacaaggtgactcattgcccggcaaacacttttaccctcagatgttactcatgatattataaaatatgaggccagtgctcaggtttgcatcataagtgagctatccctgaagggttttaattacttatttggtgtcctgattatatttgcaaacttctttataaaaggtgaaaaaagcacacaaaagagagggtgtcttcatattaaaccttcacaaccttcatgatttcataggattattttggaaatatagcacttgactttatgaaaggatctgggctaggtatattaggggtagttgccaataacctgaagaagctggcattgtttacagaaacagatcaagggctataatttatgtcattttatagcagcagtatctattaatacatgccttttcctcccatccacctcccccgcacacacacaaagatgacctgggacatgatttttttattcccacattttcttggagcacaaacaactttgttgaggattttggaaggaaagcacaactgggtcctttattcatttctgggacagaaagagggtcagtggacttttgtgggcctccagcttctctcagagtctccccctctgcagcccatcctgggagtgtattaactggagggaagatgggtcttgcagtacatttgttttgcccagccatcactcttttttgtgaggagcctaaatacattcttcctggggtccagagtccccattcaaggcagtcaagttaagacactaacttggccctttcctgatggaaatatttcctccatagcagaagttgtgttctgacaagactgagagagttacatgttgggaaaaaaaagaagcattaacttagtagaactgaaccaggagcattaagttctgaaattttgaatcatctctgaaatgaagcaggtgtagcctgccctctcatcaatccgtctgggtgccagaactcaaggttcagtggacacatccccctgttagagaccctcatgggctaggacttttcatctaggatagattcaagacctttacctcagaattatgtaaactgtgattgtgttttagaaaaattattatttgctaaaaccatttaagtctttgtatatgtgtaaatgatcacaaaaatgtattttataaaatgttctgtacaataaagttacacctcaaagtgtactcttggaatggattctttcctgtaaagtcttatctgcgactctgtctcgggaatgttttgtctgttgccgtcagccgaactttgttatggagggagcagcctcacacaagcagaaacactcctgtggatggtattgtagcatgtattgtttattttagtcaatagaccctctccttataaatggtgtttagtcttcctgttgcatttcatgggcctgggggtttcctagcagaggatattggagcccctttttgtgacattaccaattacatctttgtccacgtttaatactttgttttggaaaatttaaatgctgcagatttgtgtagagttctaataccaaagacagaagtaaatgttttccatatactttgtcttgcctgtatgcagcccttgtgtaatatggtgaattagagtggtatttcactttgtattattttgtaaatatgtcaatataataaatagtgactaaattgaaaaaaaaaa

SEQ ID NO: 371299 - DNA, 2895 bp, Homo sapiens
agcggagatctgactcacctgcctgtgactttatgcaggttatttaacttagcagtgtccttccctagaaaatgatgcctatgattcctaccttcactacatgagatgaagtacatgaaagggccagggcatgtttctgatagctaaatttcatcacaagaaggaaaatacatctgcaaaagcattccatcacatgatagaaggatgaaagacagcaagaagcgagtattttccggcattcaacctacaggaatcctccacctgggcaattacctgggagccattgagagctgggtgaggttacaggatgaatatgactctgtattatacagcattgttgacctccactccattactgtcccccaagacccagctgtccttcggcagagcatcctggacatgactgctgttcttcttgcctgtggcataaacccggaaaaaagcatccttttccaacaatctcaggtgtctgaacacacacaattaagttggatcctttcctgcatggtcagactacctcgattacaacatttacatcagtggaaggcaaagactaccaagcagaagcacgatggcacggtgggcctgctcacatacccagtactccaggcagccgacattctgttgtacaagtccacacacgttcctgttggggaggatcaagtccagcacatggaactagttcaggatctagcacaaggtttcaacaagaagtatggggagttctttccagtgcccgagtccattctcacatccatgaagaaggtaaaatccctacgtgatccttctgccaaaatgtcgaaatcagaccctgacaaactggccaccgtccgaataacagacagcccagaggagatagtgcagaaattccgcaaggctgtgacagacttcacctcggaggtcacctatgacccggctggccgcgctggcgtgtccaacatagtggcggtgcatgccgcggtgacggggctctccgtggaggaagtggtgcgccgcagcgcgggcatgaacactgctcgctacaagctggccgtggcagatgctgtgattgagaagtttgccccaattaagcgtgaaattgaaaaactgaagctggacaaggaccatttagagaaggttttacaaattggatcagcaaaagccaaagaattagcatacactgtgtgccaggaggtgaagaaattggtgggttttctataggaagtttcaacgaatcacagcaaggcttttgtgccttgcactccatgcattctgataacggcagctttcctaaaaagaaaaagttatagttttgggacatttaatttggtatagctgattattggctttatttgatgaatattgctttgtagctttgaaatacgacagtgttccaaatcccatcaacaaaatgctgtgaacaacaacaacaaaaaataaatcaagaaggcatagctgtctgaatccccaattattgaggcacactccttggcctgcagaaatgtgattgaagtaaggagtaatttgggaaatggagtatcatttgtgcttctctctggagtacttactgtaacagatgcacacgttatctacttcaacccttttataaagcaatatatagaggtcttagatgtataatccttgagatgccatttgatcagatgccaatttgtattcagagctcataaaaacaagtccattcttatagtttgtttgtcactgagacggtgcctgatttaatatatttaagctgcttaacttgttttccaagagataacaccaactgttccagcaataatttgttttttaattcagagatatgggatatgatcttctaaggaggttgcattattttgacctgatttatttattgtacaagagcccaagtccctgaattatattcttaataagtgctttcttgcattcatttcagtttagtctcaccaaccccctatgaattaggagaattattgtcattttacacatgaggaaagtgaggctgagagaatccaattagcttgtacgatatcactccataagagaagcaaatctgagagtaaaacccttaccccttattcttaagaatagtgcttgtttattcagtacaaaaaaaatgctgaaaggcagcgttttttagactctaaacattctgattttgaaggtgggtgttggaacgactgatgatgttttttatatcatcaattcagccaatggatgcgaacttaaaatctggattcacagaaccgtggtcacatttccccatcaaaatccccaaggcgggtcccaagttctctcctctacgctcattgcaggaaatacttggaaataggttctgccagtctacaatagcagtgaagactgacaaatcagatattcccaatgactgacagcttctcatcttgcctctacctcagttaagtaatgtcaccctgaaacctagcttttctgcacttccatttctgacacctgaaaatgaaaatgataatcctaacttatacaccaagacctgttagcaagatcgattttgtaacagaaattgcttataagttttttatcagtaaggaccatgatcaccatttgtacatacataactaggttgttgagcaaagcatttttgctcatgtttcttaaggaagtagagtagtccttgtgtcagaacacatgttaatccacaaaacgccgcatcccagattccaaattaaaacatcgtttttaggattcttggagctagcctggatcatgggtaaaggaaacattttgccttttgtatcttatactggaatgggatgtctgtaagtcctagaacctctttgagcatatttcttacaagcctctgttttttcccctttaaaggaaactttgaaaggattgtgaatactggaaaatgacaaaactaaaggtagatctatcaagcca

SEQ ID NO: 371300 - DNA, 2654 bp, Homo sapiens
agcggggcccttctcaagatggcgctgcactcaatgcggaaagcgcgtgagcgctggagcttcatccgggcacttcataagggatccgcagctgctcccgctctccagaaagacagcaagaagcgagtattttccggcattcaacctacaggaatcctccacctgggcaattacctgggagccattgagagctgggtgtctgaacacacacaattaagttggatcctttcctgcatggtcagactacctcgattacaacatttacatcagtggaaggcaaagactaccaagcagaagcacgatggcacggtgggcctgctcacatacccagtactccaggcagccgacattctgttgtacaagtccacacacgttcctgttggggaggatcaagtccagcacatggaactagttcaggatctagcacaaggtttcaacaagaagtatggggagttctttccagtgcccgagtccattctcagtatgtgtgtgttggtgtttttaacctagcatccatgaagaaggtaaaatccctacgtgatccttctgccaaaatgtcgaaatcagaccctgacaaactggccaccgtccgaataacagacagcccagaggagatagtgcagaaattccgcaaggctgtgacagacttcacctcggaggtcacctatgacccggctggccgcgctggcgtgtccaacatagtggcggtgcatgccgcggtgacggggctctccgtggaggaagtggtgcgccgcagcgcgggcatgaacactgctcgctacaagctggccgtggcagatgctgtgattgagaagtttgccccaattaagcgtgaaattgaaaaactgaagctggacaaggaccatttagagaaggttttacaaattggatcagcaaaagccaaagaattagcatacactgtgtgccaggaggtgaagaaattggtgggttttctataggaagtttcaacgaatcacagcaaggcttttgtgccttgcactccatgcattctgataacggcagctttcctaaaaagaaaaagttatagttttgggacatttaatttggtatagctgattattggctttatttgatgaatattgctttgtagctttgaaatacgacagtgttccaaatcccatcaacaaaatgctgtgaacaacaacaacaaaaaataaatcaagaaggcatagctgtctgaatccccaattattgaggcacactccttggcctgcagaaatgtgattgaagtaaggagtaatttgggaaatggagtatcatttgtgcttctctctggagtacttactgtaacagatgcacacgttatctacttcaacccttttataaagcaatatatagaggtcttagatgtataatccttgagatgccatttgatcagatgccaatttgtattcagagctcataaaaacaagtccattcttatagtttgtttgtcactgagacggtgcctgatttaatatatttaagctgcttaacttgttttccaagagataacaccaactgttccagcaataatttgttttttaattcagagatatgggatatgatcttctaaggaggttgcattattttgacctgatttatttattgtacaagagcccaagtccctgaattatattcttaataagtgctttcttgcattcatttcagtttagtctcaccaaccccctatgaattaggagaattattgtcattttacacatgaggaaagtgaggctgagagaatccaattagcttgtacgatatcactccataagagaagcaaatctgagagtaaaacccttaccccttattcttaagaatagtgcttgtttattcagtacaaaaaaaatgctgaaaggcagcgttttttagactctaaacattctgattttgaaggtgggtgttggaacgactgatgatgttttttatatcatcaattcagccaatggatgcgaacttaaaatctggattcacagaaccgtggtcacatttccccatcaaaatccccaaggcgggtcccaagttctctcctctacgctcattgcaggaaatacttggaaataggttctgccagtctacaatagcagtgaagactgacaaatcagatattcccaatgactgacagcttctcatcttgcctctacctcagttaagtaatgtcaccctgaaacctagcttttctgcacttccatttctgacacctgaaaatgaaaatgataatcctaacttatacaccaagacctgttagcaagatcgattttgtaacagaaattgcttataagttttttatcagtaaggaccatgatcaccatttgtacatacataactaggttgttgagcaaagcatttttgctcatgtttcttaaggaagtagagtagtccttgtgtcagaacacatgttaatccacaaaacgccgcatcccagattccaaattaaaacatcgtttttaggattcttggagctagcctggatcatgggtaaaggaaacattttgccttttgtatcttatactggaatgggatgtctgtaagtcctagaacctctttgagcatatttcttacaagcctctgttttttcccctttaaaggaaactttgaaaggattgtgaatactggaaaatgacaaaactaaaggtagatctatcaagcca

SEQ ID NO: 371301 - DNA, 3039 bp, Homo sapiens
  misc_feature (4)..(4): n is a, c, g, or t
  misc_feature (6)..(6): n is a, c, g, or t
  misc_feature (8)..(12): n is a, c, g, or t
  misc_feature (42)..(42): n is a, c, g, or t
  misc_feature (116)..(116): n is a, c, g, or t
tgcncngnnnnntcagaaaccaggatgcaacatctgtgcctngagcctctgctgctagatagcaacctaatgttgtaggggtgtgatgccgtggaccccttcttgaacccccaagntcgtcttgcatttggggctctagcatgcagctgcctgattgcccttgcagagcccacctccctgttatagaaacattatcacgactttctcgaacacctatagcattggccacaggaatcaggcccttcccaacagaagaaagcattaatgatgaagacatctacaaaggccttcctgatttaatagatgaaacccttgtggaagatgaagaagatctctatgactgtgtttatggggaagatgaaggtggagaagtctatgaggacttaatgaaggcagaggaagcacatcagcccaaatgtccagaaaatgatatacgaagttgttgtctagcagaaattaagcagacagaagaaaaatatacagaaactttggagtcaatagaaaagtatttcatggcaccactaaaaagatttctgacagcagcagaatttgattcagtattcatcaacattcctgaacttgtaaaacttcatcggaacctaatgcaagagattcatgattccattgtaaataaaaatgaccagaacttgtaccaagtttttattaactacaaggaaagattggttatttacgggcagtactgcagtggagtggagtcagccatctctagtttagactacatttctaagacaaaagaagatgtcaaactgaaattagaggaatgttccaaaagagcaaataatgggaaatttactcttcgagacttgcttgtggttcctatgcaacgtgttttaaagtaccaccttctcctccaggaactggtcaaacataccactgatccgactgagaaggcaaatctgaaactggctcttgatgccatgaaggacttggcacaatatgtgaatgaagtgaaaagagataatgagacccttcgtgaaattaaacagtttcagctatctatagagaatttgaaccaaccagttttgctttttggacgacctcagggagatggtgaaattcgaataaccactctagacaagcataccaaacaagaaaggcatatcttcttatttgatttggcagtgatcgtatgtaagagaaaaggtgataactatgaaatgaaggaaataatagatcttcagcagtacaagatagccaataatcctacaaccgataaagaaaacaaaaagtggtcttatggcttctacctcatccatacccaaggacaaaatgggttagaattttattgcaaaacaaaagatttaaagaagaaatggctagaacagtttgaaatggctttgtctaacataagaccagactatgcagactccaatttccacgacttcaagatgcataccttcactcgagtcacatcctgcaaagtctgccagatgctcctgaggggaacattttatcaaggctatttatgttttaagtgtggagcgagagcacacaaagaatgtttgggaagagtagacaattgtggcagagttaattctggtgaacaagggacactcaaactaccagagaaacggaccaatggactgcgaagaactcctaaacaggtggatccaggtttaccaaagatgcaggtcattaggaactattctggaacaccacccccagctctgcatgaaggaccccctttacagctccaggccggggataccgttgaacttctgaaaggagatgcacacagtctgttttggcagggcagaaatttagcatctggagaggttggattttttccaagtgatgcagtcaagccttgcccatgtgtgcccaaaccagtagattattcttgccaaccctggtatgctggagcaatggaaagattgcaagcagagaccgaacttattaatagggtaaatagtacttaccttgtgaggcacaggaccaaagagtcaggagaatatgcaattagcattaagtacaataatgaagcaaagcacatcaagattttaacaagagatggcttttttcacattgcagaaaatagaaaatttaaaagtttaatggaacttgtggagtactacaagcatcattctctcaaggaagggttcagaaccttagatacaactctgcagtttccatacaaggagccagaacattcagctggacagaggggtaatagagcaggcaacagcttgttaagtccaaaagtgctgggcattgccatcgctcggtatgacttctgtgcaagagatatgagagagttgtccttgttgaaaggagatgtggtgaagatttacacaaagatgagtgcaaatggctggtggagaggagaagtaaatggcagggtgggctggtttccatccacatatgtggaagaggatgaataaattcaaatcccgtgttgcaccctgcaccaaaaatttcagagaagggataaatagaagcctgcacagcatcgtgaattaactgaagtgtttaaaaagctgcatttctggctgttcaacatcctccctccttagcccctcctaagtcttaatgctgagatttctaaagatgctggtactgacagattaatggcttgcctagagctgtgcaagaaacagcctgccagtctgtcattgtcagggaccagggcaaaaccaagagctgttcttcccagaagagccctgcaaacacattggttcgtgcttccctttacttcttctggtcagataccatgaatgccagtcatcagtaaatcttaatacacttttgctttattctcacatgccattcaccagattatttgatggtacaaagaagcagaagtgtaattttccttttcccagcatgacgaaaaattggagttctgccatttgagcagcttactggaaagatccagccttacttgtcttaaattgtccaacaaggtgactcattgcccggcaaacacttttaccctcagatgttactcatgatgcaaacgctgagcactggcctcatattttatctcagcagagcaccagcacgattcccggtatcctc

SEQ ID NO: 371302 - DNA, 520 bp, Homo sapiens
  misc_feature (27)..(27): n is a, c, g, or t
  misc_feature (45)..(45): n is a, c, g, or t
tgtttccctttgtctgggctgatctcnaattcctggtttcaagcnatcctctgcctcagccctctgagtatctgggactacaggcgcacactactgcacccagctaatgtttaaaatttttgcttttttaaaaagatatggtctcactttttgcccagcctggtttgaactcctgagttcaagcagtccttgagccttggcctctcaaaacttctgggattataggcatgagctgctgcacctagccaaataaaaaatctcatttcacagggtacattcattcaatctttttcttttcaaaatccaacacaactctgaaatagagatttcttctttttctttaatactctgtggatattttccaagtggaaaaagtggtgaatttgctttcccattacacatattttagatgaggcctcttgtacatattgagagtatatttgttctcaaatgactttaaatgttttgtcaacattttttttttattggtaaaccaaagagtttgctgggttttagacaa

SEQ ID NO: 371303 - DNA, 1255 bp, Homo sapiens
cgggccaagaaaaccagcgaaggcccggccccccagcagaggccggaccatggttgaccagttgcgggagcgcaccaccatggccgacccgctgcgggagcgcaccgagctgttgctggccgactacctggggtactgcgcccgggaacccggcacccccgagccggcgccatccacgcccgaggccgccgtgctgcgctccgcggccgccaggttacggcagattcaccggtcctttttctccgcctacctcggctaccccgggaaccgcttcgagctggtggcgctgatggcggattccgtgctctccgacagccccggccccacctggggcagagtggtgacgctcgtgaccttcgcagggacgctgctggagagagggccgctggtgaccgcccggtggaagaagtggggcttccagccgcggctaaaggagcaggagggcgacgtcgcccgggactgccagcgcctggtggccttgctgagctcgcggctcatggggcagcaccgcgcctggctgcaggctcagggcggctgggatggcttttgtcacttcttcaggaccccctttccactggctttttggagaaaacagctggtccaggcttttctgtcatgcttgttaacaacagccttcatttatctctggacacgattattatgagttttaaaacttttaacccgcttctacctgcccaactgtgaccaactaaatgacagatgtgtgagaacaagaactgagggaaagcaccttcccccaccccagacgtttttatctgaatgcatacaaggagtcctgaggtggtgatttggccagtgttttaacttgtgacaagtactcaggtgtgaggacaagaatgcaaatggctcttccttgagtgaaagaaatggggagtctagagcctctttatgccaaagaaccgcagaagaaactgcattccattaaatgggaaatacagtgctatttgcctaaaacttggataagagtgcgaacctctcatctctccacaacttcatgtgctgctgactaattttaaacatggccacagctggggcaaaataatccccaaagtagaaaaagtcccagtttaacaaagaatgtaatgttaaaatcacttataaggaattctttgaaaccaaatcctttgaaatctaattcctgggacttctaggtttttatagttaacatactaatttcttcaataattgttaactgcaaagttttaataaatttgtacctttaaaaaaaaattag

SEQ ID NO: 371304 - DNA, 1390 bp, Homo sapiens
ttttttaagactcatggacatagctttaattatctttgcctgacgcccaatacctgaaaattaagatgttcatgcaagataaagaggtaatttttctcctcctcccagtcatcacccgtagcatccggttaagaggctctccacctcgctcattttggtctaactggatttacacaaactcactgtgcacgtgcctggggcgggcaaacccggaaacgacgccgagtcccgcgggatccaggaggagccaactgcgccggaggaggggtttcggccgacacgtcgggattggcggctgcagccaggggtcctccgacgctgggcttccgtgagcggcgctctgccagatctctggaccggattcgtcccattctcgtcctcatggtggacaagaaactggtggtggttttcggaggcacaggtgcccagggtggctccgtggcccgcacactcctggaagatgggacattcaaggttcgagtggtgacccgaaaccctaggaagaaggcagcaaaggagctgaggctgcaaggtgcagaagtagtgcagggagaccaagatgaccaggtcatcatggagctggccctgaatggggcttacgccaccttcatcgtgaccaattactgggagagctgcagccaggagcaggaggtcaagcaggggaagctgctcgctgatctggccaggcgcctgggcctccactatgtggtctacagcggcctggagaacatcaagaagctgacggcagggagattggccgccgcgcactttgacggcaaaggggaggtggaggaatatttccgggacattggcgttcccatgaccagtgtgcggctgccctgctattttgagaacctcctctcccacttcttgccccagaaagccccagacggaaagagctacttgctgagcttgcccacaggtgacgttcccatggatggcatgtccgtgtctgacctgggtcctgtggtgctcagccttttgaagatgccagaaaaatacgtcggccagaacatcgggctgagcacttgcaggcacacggccgaggagtacgctgccctgctcaccaagcacacccgcaaggtcgtgcacgatgccaagatgactcctgaggactacgaaaagcttggctttcccggtgcccgggacctggccaacatgttccgtttctatgccctgagacccgaccgtgacatcgagctgaccctgagactcaaccccaaggccctgacgctggaccagtggctggaacagcacaaaggggacttcaacctgctgtgacctgcccgcctcgcggccccttgtggggatcgggggcaccagaggggcagaggcaccaacatctgaataaagccattgttctcccagatggcttccaggagaagaggac

SEQ ID NO: 371305 - DNA, 742 bp, Homo sapiens
cggacgcgtgggtcgacccacgcgtccgcggacgcgttgggtcgcggacgcgtgggtcagaacatcaagaagctgacggcagggagattggccgccgcgcactttgacggcaaaggggaggtggaggaatatttccgggacattggcgttcccatgaccagtgtgcggctgccctgctattttgagaacctcctctcccacttcttgccccagaaagccccagacggaaagagctacttgctgagcttgcccacaggtgacgttcccatggatggcatgtccgtgtctgacctgggtcctgtggtgctcagccttttgaagatgccagaaaaatacgtcggccagaacatcgggctgagcacttgcaggcacacggccgaggagtacgctgccctgctcaccaagcacacccgcaaggtcgtgcacgatgccaaggtgggcctcccgccccagatgactcctgaggactacgaaaagcttggctttcccggtgcccgggacctggccaacatgttccgtttctatgccctgagacccgaccgtgacatcgagctgaccctgagactcaaccccaaggccctgacgctggaccagtggctggaacagcacaaaggggacttcaacctgctgtgacctgcccgcctcgcggccccttgtggggatcgggggcaccagaggggcagaggcaccaacatctgaataaagccattgttctcccagatggcttccaggagaagaggac

SEQ ID NO: 371306 - DNA, 1156 bp, Homo sapiens
  misc_feature (22)..(22): n is a, c, g, or t
  misc_feature (24)..(24): n is a, c, g, or t
  misc_feature (27)..(27): n is a, c, g, or t
tgtgtcgtggtacggtcggaancnttngatggggtttcggccgacacgtcgggattggcggctgcagccaggggtcctccgacgctgggcttccgtgagcggcgctctgccagatctctggaccggattcgtcccattctcgtcctcatggtggacaagaaactggtggtggttttcggaggcacaggtgcccagggtggctccgtggcccgcacactcctggaagatgggacattcaaggttcgagtggtgacccgaaaccctaggaagaaggcagcaaaggagctgaggctgcaaggtgcagaagtagtgcagggagaccaagatgaccaggtcatcatggagctggccctgaatggggcttacgccaccttcatcgtgaccaattactgggagagctgcagccaggagcaggaggtcaagcaggggaagctgctcgctgatctggccaggcgcctgggcctccactatgtggtctacagcggcctggagaacatcaagaagctgacggcagggagattggccgccgcgcactttgacggcaaaggggaggtggaggaatatttccgggacattggcgttcccatgaccagtgtgcggctgccctgctattttgagaacctcctctcccacttcttgccccagaaagccccagacggaaagagctacttgctgagcttgcccacaggtgacgttcccatggatggcatgtccgtgtctgacctgggtcctgtggtgctcagccttttgaagatgccagaaaaatacgtcggccagaacatcgggctgagcacttgcaggcacacggccgaggagtacgctgccctgctcaccaagcacacccgcaaggtcgtgcacgatgccaagatgactcctgaggactacgaaaagcttggctttcccggtgcccgggacctggccaacatgttccgtttctatgccctgagacccgaccgtgacatcgagctgaccctgagactcaaccccaaggccctgacgctggaccagtggctggaacagcacaaaggggacttcaacctgctgtgacctgcccgcctcgcggccccttgtggggatcgggggcaccagaggggcagaggcaccaacatctgaataaagccattgttctcccagatggcttccaggagaagaggac

SEQ ID NO: 371307 - DNA, 1948 bp, Homo sapiens
ttttttaagactcatggacatagctttaattatctttgcctgacgcccaatacctgaaaattaagatgttcatgcaagataaagaggtaatttttctcctcctcccagtcatcacccgtagcatccggttaagaggctctccacctcgctcattttggtctaactggatttacacaaactcactgtgcacgtgcctggggcgggcaaacccggaaacgacgccgagtcccgcgggatccaggaggagccaactgcgccggaggaggggtttcggccgacacgtcgggattggcggctgcagccaggggtcctccgacgctgggcttccgtgagcggcgctctgccagccggagctgcggggagggagttggcgcctagcgcgcagctccatccccgcctctgcagtggactcggccgcagaatcggggtcccgggctcctggaacttgtcccgcccaggccgcggcgaggaggtcactccagccgcggtgggacccgggccggggggcgggtgactggaaccgggggaggcgggaaggaggaggggatcgggcccaagggacacgaggtgggtcgcgggaccccgatatctcgggacaggcgtcttgccgctccgggcccagccgcccccttcgacacatactcgatgcatagacaatgggggtgtcctttgtcgctcctggcgggaaccccggccccacccccaactccacgcctcccattacccccagatctctggaccggattcgtcccattctcgtcctcatggtggacaagaaactggtggtggttttcggaggcacagaggcggggtttcaccaagccaagatcgtgccactgcacttcagcctgggtgatagagtgagactccatctcaaaaaaataaaataaagtgtggtggagcactcccttcggggtttcgcccttcagtgggactttcaggtaggtctgacctgagaggtctttttgattctttgtaggtgcccagggtggctccgtggcccgcacactcctggaagatgggacattcaaggttcgagtggtgacccgaaaccctaggaagaaggcagcaaaggagctgaggctgcaaggtgcagaagtagtgcagggagaccaagatgaccaggtcatcatggagctggccctgaatggggcttacgccaccttcatcgtgaccaattactgggagagctgcagccaggagcaggaggtcaagcaggggaagctgctcgctgatctggccaggcgcctgggcctccactatgtggtctacagcggcctggagaacatcaagaagctgacggcagggagattggccgccgcgcactttgacggcaaaggggaggtggaggaatatttccgggacattggcgttcccatgaccagtgtgcggctgccctgctattttgagaacctcctctcccacttcttgccccagaaagccccagacggaaagagctacttgctgagcttgcccacaggtgacgttcccatggatggcatgtccgtgtctgacctgggtcctgtggtgctcagccttttgaagatgccagaaaaatacgtcggccagaacatcgggctgagcacttgcaggcacacggccgaggagtacgctgccctgctcaccaagcacacccgcaaggtcgtgcacgatgccaagatgactcctgaggactacgaaaagcttggctttcccggtgcccgggacctggccaacatgttccgtttctatgccctgagacccgaccgtgacatcgagctgaccctgagactcaaccccaaggccctgacgctggaccagtggctggaacagcacaaaggggacttcaacctgctgtgacctgcccgcctcgcggccccttgtggggatcgggggcaccagaggggcagaggcaccaacatctgaataaagccattgttctcccagatggcttccaggagaagaggac

SEQ ID NO: 371308 - DNA, 1621 bp, Homo sapiens
ttttttaagactcatggacatagctttaattatctttgcctgacgcccaatacctgaaaattaagatgttcatgcaagataaagaggtaatttttctcctcctcccagtcatcacccgtagcatccggttaagaggctctccacctcgctcattttggtctaactggatttacacaaactcactgtgcacgtgcctggggcgggcaaacccggaaacgacgccgagtcccgcgggatccaggaggagccaactgcgccggaggaggggtttcggccgacacgtcgggattggcggctgcagccaggggtcctccgacgctgggcttccgtgagcggcgctctgccagccggagctgcggggagggagttggcgcctagcgcgcagctccatccccgcctctgcagtggactcggccgcagaatcggggtcccgggctcctggaacttgtcccgcccaggccgcggcgaggaggtcactccagccgatctctggaccggattcgtcccattctcgtcctcatggtggacaagaaactggtggtggttttcggaggcacagagatatggtttcaccatgttgcccaggctggtctcaaactcctgagctcaagagatctgcgtgcctcagcctcccaaagtgtctggattacaggtgcccagggtggctccgtggcccgcacactcctggaagatgggacattcaaggttcgagtggtgacccgaaaccctaggaagaaggcagcaaaggagctgaggctgcaaggtgcagaagtagtgcagggagaccaagatgaccaggtcatcatggagctggccctgaatggggcttacgccaccttcatcgtgaccaattactgggagagctgcagccaggagcaggaggtcaagcaggggaagctgctcgctgatctggccaggcgcctgggcctccactatgtggtctacagcggcctggagaacatcaagaagctgacggcagggagattggccgccgcgcactttgacggcaaaggggaggtggaggaatatttccgggacattggcgttcccatgaccagtgtgcggctgccctgctattttgagaacctcctctcccacttcttgccccagaaagccccagacggaaagagctacttgctgagcttgcccacaggtgacgttcccatggatggcatgtccgtgtctgacctgggtcctgtggtgctcagccttttgaagatgccagaaaaatacgtcggccagaacatcgggctgagcacttgcaggcacacggccgaggagtacgctgccctgctcaccaagcacacccgcaaggtcgtgcacgatgccaagatgactcctgaggactacgaaaagcttggctttcccggtgcccgggacctggccaacatgttccgtttctatgccctgagacccgaccgtgacatcgagctgaccctgagactcaaccccaaggccctgacgctggaccagtggctggaacagcacaaaggggacttcaacctgctgtgacctgcccgcctcgcggccccttgtggggatcgggggcaccagaggggcagaggcaccaacatctgaataaagccattgttctcccagatggcttccaggagaagaggac

SEQ ID NO: 371309 - DNA, 1664 bp, Homo sapiens
ttttttaagactcatggacatagctttaattatctttgcctgacgcccaatacctgaaaattaagatgttcatgcaagataaagaggtaatttttctcctcctcccagtcatcacccgtagcatccggttaagaggctctccacctcgctcattttggtctaactggatttacacaaactcactgtgcacgtgcctggggcgggcaaacccggaaacgacgccgagtcccgcgggatccaggaggagccaactgcgccggaggaggggtttcggccgacacgtcgggattggcggctgcagccaggggtcctccgacgctgggcttccgtgagcggcgctctgccagccggagctgcggggagggagttggcgcctagcgcgcagctccatccccgcctctgcagtggactcggccgcagaatcggggtcccgggctcctggaacttgtcccgcccaggccgcggcgaggaggtcactccagccgatctctggaccggattcgtcccattctcgtcctcatggtggacaagaaactggtggtggttttcggaggcacagagatatggtttcaccatgttgcccaggctggtctcaaactcctgagctcaagagatctgcgtgcctcagcctcccaaagtgtctggattacaggcatgagcccctgggcccagctgcaacgcgcaaaatcttaagggtgcccagggtggctccgtggcccgcacactcctggaagatgggacattcaaggttcgagtggtgacccgaaaccctaggaagaaggcagcaaaggagctgaggctgcaaggtgcagaagtagtgcagggagaccaagatgaccaggtcatcatggagctggccctgaatggggcttacgccaccttcatcgtgaccaattactgggagagctgcagccaggagcaggaggtcaagcaggggaagctgctcgctgatctggccaggcgcctgggcctccactatgtggtctacagcggcctggagaacatcaagaagctgacggcagggagattggccgccgcgcactttgacggcaaaggggaggtggaggaatatttccgggacattggcgttcccatgaccagtgtgcggctgccctgctattttgagaacctcctctcccacttcttgccccagaaagccccagacggaaagagctacttgctgagcttgcccacaggtgacgttcccatggatggcatgtccgtgtctgacctgggtcctgtggtgctcagccttttgaagatgccagaaaaatacgtcggccagaacatcgggctgagcacttgcaggcacacggccgaggagtacgctgccctgctcaccaagcacacccgcaaggtcgtgcacgatgccaagatgactcctgaggactacgaaaagcttggctttcccggtgcccgggacctggccaacatgttccgtttctatgccctgagacccgaccgtgacatcgagctgaccctgagactcaaccccaaggccctgacgctggaccagtggctggaacagcacaaaggggacttcaacctgctgtgacctgcccgcctcgcggccccttgtggggatcgggggcaccagaggggcagaggcaccaacatctgaataaagccattgttctcccagatggcttccaggagaagaggac

SEQ ID NO: 371310 - DNA, 1503 bp, Homo sapiens
ttttttaagactcatggacatagctttaattatctttgcctgacgcccaatacctgaaaattaagatgttcatgcaagataaagaggtaatttttctcctcctcccagtcatcacccgtagcatccggttaagaggctctccacctcgctcattttggtctaactggatttacacaaactcactgtgcacgtgcctggggcgggcaaacccggaaacgacgccgagtcccgcgggatccaggaggagccaactgcgccggaggaggggtttcggccgacacgtcgggattggcggctgcagccaggggtcctccgacgctgggcttccgtgagcggcgctctgccagccggagctgcggggagggagttggcgcctagcgcgcagctccatccccgcctctgcagtggactcggccgcagaatcggggtcccgggctcctggaacttgtcccgcccaggccgcggcgaggaggtcactccagccgatctctggaccggattcgtcccattctcgtcctcatggtggacaagaaactggtggtggttttcggaggcacaggtgcccagggtggctccgtggcccgcacactcctggaagatgggacattcaaggttcgagtggtgacccgaaaccctaggaagaaggcagcaaaggagctgaggctgcaaggtgcagaagtagtgcagggagaccaagatgaccaggtcatcatggagctggccctgaatggggcttacgccaccttcatcgtgaccaattactgggagagctgcagccaggagcaggaggtcaagcaggggaagctgctcgctgatctggccaggcgcctgggcctccactatgtggtctacagcggcctggagaacatcaagaagctgacggcagggagattggccgccgcgcactttgacggcaaaggggaggtggaggaatatttccgggacattggcgttcccatgaccagtgtgcggctgccctgctattttgagaacctcctctcccacttcttgccccagaaagccccagacggaaagagctacttgctgagcttgcccacaggtgacgttcccatggatggcatgtccgtgtctgacctgggtcctgtggtgctcagccttttgaagatgccagaaaaatacgtcggccagaacatcgggctgagcacttgcaggcacacggccgaggagtacgctgccctgctcaccaagcacacccgcaaggtcgtgcacgatgccaagatgactcctgaggactacgaaaagcttggctttcccggtgcccgggacctggccaacatgttccgtttctatgccctgagacccgaccgtgacatcgagctgaccctgagactcaaccccggccgaggagtacgctgccctgctcaccaagcacacccgcaaggtcgcgcacgatgccaagatgactcctgaggactacgaaaagcttggctttcccggtgcccgggacctggccaacatgttccgtttctatgccctgagacc

SEQ ID NO: 371311 - DNA, 1621 bp, Homo sapiens
ttttttaagactcatggacatagctttaattatctttgcctgacgcccaatacctgaaaattaagatgttcatgcaagataaagaggtaatttttctcctcctcccagtcatcacccgtagcatccggttaagaggctctccacctcgctcattttggtctaactggatttacacaaactcactgtgcacgtgcctggggcgggcaaacccggaaacgacgccgagtcccgcgggatccaggaggagccaactgcgccggaggaggggtttcggccgacacgtcgggattggcggctgcagccaggggtcctccgacgctgggcttccgtgagcggcgctctgccagccggagctgcggggagggagttggcgcctagcgcgcagctccatccccgcctctgcagtggactcggccgcagaatcggggtcccgggctcctggaacttgtcccgcccaggccgcggcgaggaggtcactccagccgatctctggaccggattcgtcccattctcgtcctcatggtggacaagaaactggtggtggttttcggaggcacaggtgcccagggtggctccgtggcccgcacactcctggaagatgggacattcaaggttcgagtggtgacccgaaaccctaggaagaaggcagcaaaggagctgaggctgcaaggtgcagaagtagtgcagggagaccaagatgaccaggtcatcatggagctggccctgaatggggcttacgccaccttcatcgtgaccaattactgggagagctgcagccaggagcaggaggtcaagcaggggaagctgctcgctgatctggccaggcgcctgggcctccactatgtggtctacagcggcctggagaacatcaagaagctgacggcagggagattggccgccgcgcactttgacggcaaaggggaggtggaggaatatttccgggacattggcgttcccatgaccagtgtgcggctgccctgctattttgagaacctcctctcccacttcttgccccagaaagccccagacggaaagagctacttgctgagcttgcccacaggtgacgttcccatggatggcatgtccgtgtctgacctgggtcctgtggtgctcagccttttgaagatgccagaaaaatacgtcggccagaacatcgggctgagcacttgcaggcacacggccgaggagtacgctgccctgctcaccaagcacacccgcaaggtcgtgcacgatgccaaggagctaactggccacagagtgaaatttctggcttagatgttttgaccaaatagagagaaaagcttccaggaggagagggccataggagccaagatgactcctgaggactacgaaaagcttggctttcccggtgcccgggacctggccaacatgttccgtttctatgccctgagacccgaccgtgacatcgagctgaccctgagactcaaccccaaggccctgacgctggaccagtggctggaacagcacaaaggggacttcaacctgctgtgacctgcccgcctcgcggccccttgtggggatcgggggcaccagaggggcagaggcaccaacatctgaataaagccattgttctcccagatggcttccaggagaagaggac

SEQ ID NO: 371312 - DNA, 2034 bp, Homo sapiens
ttttttaagactcatggacatagctttaattatctttgcctgacgcccaatacctgaaaattaagatgttcatgcaagataaagaggtaatttttctcctcctcccagtcatcacccgtagcatccggttaagaggctctccacctcgctcattttggtctaactggatttacacaaactcactgtgcacgtgcctggggcgggcaaacccggaaacgacgccgagtcccgcgggatccaggaggagccaactgcgccggaggaggggtttcggccgacacgtcgggattggcggctgcagccaggggtcctccgacgctgggcttccgtgagcggcgctctgccagccggagctgcggggagggagttggcgcctagcgcgcagctccatccccgcctctgcagtggactcggccgcagaatcggggtcccgggctcctggaacttgtcccgcccaggccgcggcgaggaggtcactccagccgatctctggaccggattcgtcccattctcgtcctcatggtggacaagaaactggtggtggttttcggaggcacaggtgcccagggtggctccgtggcccgcacactcctggaagatgggacattcaaggttcgagtggtgacccgaaaccctaggaagaaggcagcaaaggagctgaggctgcaaggtgcagaagtagtgcagggagaccaagatgaccaggtcatcatggagctggccctgaatggggcttacgccaccttcatcgtgaccaattactgggagagctgcagccaggagcaggaggtcaagcaggggaagctgctcgctgatctggccaggcgcctgggcctccactatgtggtctacagcggcctggagaacatcaagaagctgacggcagggagattggccgccgcgcactttgacggcaaaggggaggtggaggaatatttccgggacattggcgttcccatgaccagtgtgcggctgccctgctattttgagaacctcctctcccacttcttgccccagaaagccccagacggaaagagctacttgctgagcttgcccacaggtgacgttcccatggatggcatgtccgtgtctgacctgggtcctgtggtgctcagccttttgaagatgccagaaaaatacgtcggccagaacatcgggctgagcacttgcaggcacacggccgaggagtacgctgccctgctcaccaagcacacccgcaaggtcgtgcacgatgccaaggtgggcctcccgccccaggtgactcaggcatccttgtcagggctttctagctcccgtagggagggtgtgtccagggctgcccacacctctgggcagtacatctaaattcattcgttcatcgtcaacgtttattttctgctgttccaggagctaactggccacagagtgaaatttctggcttagatgttttgaccaaatagagagaaaagcttccaggaggagagggccataggagccaaggcaaggaggggtgaaaatgcaggccctgccgggctcctctgtgggagggaatttgaagagaaaagagtctggaaagatagacccgacccctcccctgtgggaggggatttaaagggaaagaggctagaaagatagggccgacccctgcccccattggcctggctgggtgggcaggaggcctactggacagactcttgggtacctggtttctaatgtttgtcattaccattaggaaagtaagacatactcattaaagaatctgggaggctgggtgcagtagctcacgcctgtagtcccagcactttgggaggccgaggcaggtggatcacctgaggtcaggagtttgaggccagcctggccaacagggtgaaaccccatctctactaaaaataaacaaattagccgggtgtggtggcaggcgcctgtaatcccagctacttgggaggctgaggcaagagaatcgcttgaactcaggaggcagagtttgcagcgagccgagatgccactgcactccagactgggcgacagagcgagactccaactccaaaaaaaaaa

SEQ ID NO: 371313 - DNA, 346 bp, Homo sapiens
cggtaccggcagcgtactcctcggccgtgtgcccgcaaggtcgtgcacgatgccaagatgactcctgaggactacgaaaagcttggctttcccggtgcccgggacctggccaacatgttccgtttctatgccctgagacccgaccgtgacatcgagctgaccctgagactcaaccccaaggccctgacgctggaccagtggctggaacagcacaaaggggacttcaacctgctgtgacctgcccgcctcgcggccccttgtggggatcgggggcaccagaggggcagaggcaccaacatctgaataaagccattgttctcccagatggcttccaggagaagaggac

SEQ ID NO: 371314 - DNA, 676 bp, Homo sapiens
ttttttaagactcatggacatagctttaattatctttgcctgacgcccaatacctgaaaattaagatgttcatgcaagataaagaggtaatttttctcctcctcccagtcatcacccgtagcatccggttaagaggctctccacctcgctcattttggtctaactggatttacacaaactcactgtgcacgtgcctggggcgggcaaacccggaaacgacgccgagtcccgcgggatccaggaggagccaactgcgccggaggaggggtttcggccgacacgtcgggattggcggctgcagccaggggtcctccgacgctgggcttccgtgagcggcgctctgccagccggagctgcggggagggagttggcgcctagcgcgcagctccatccccgcctctgcagtggactcggccgcagaatcggggtcccgggctcctggaacttgtcccgcccaggccgcggcgaggaggtcactccagccgcggtgggacccgggccggggggcgggtgactggaaccgggggaggcgggaaggaggaggggatcgggcccaagggacacgaggtgggtcgcgggaccccgatatctcgggacaggcgtcttgccgctccgggcccagccgcccccttcgacacatactcgatgcatctgaataaagccattaaactcccaa

SEQ ID NO: 371315 - DNA, 564 bp, Homo sapiens
agtgcagggattacgggcatgagccacagcatctggccaagaacaatctttaaactgatctacaatgtcaggcagctcaggagagcagcagtttctgaactttcggctcttagaagttttcaaatgaccttgtacggaggacctgggtcagggaccgagacaatagtggctctgggtgtagcaggtcgggagaccccagcccatccggcctccctgccccgccacctcccggggcactggaggacgccggccacgacaggctcctctgcttccagatgactcctgaggactacgaaaagcttggctttcccggtgcccgggacctggccaacatgttccgtttctatgccctgagacccgaccgtgacatcgagctgaccctgagactcaaccccaaggccctgacgctggaccagtggctggaacagcacaaaggggacttcaacctgctgtgacctgcccgcctcgcggccccttgtggggatcgggggcaccagaggggcagaggcaccaacatctgaataaagccattgttctcccagatggcttccaggagaagaggac

SEQ ID NO: 371316 - DNA, 1528 bp, Homo sapiens
ttttttaagactcatggacatagctttaattatctttgcctgacgcccaatacctgaaaattaagatgttcatgcaagataaagaggtaatttttctcctcctcccagtcatcacccgtagcatccggttaagaggctctccacctcgctcattttggtctaactggatttacacaaactcactgtgcacgtgcctggggcgggcaaacccggaaacgacgccgagtcccgcgggatccaggaggagccaactgcgccggaggaggggtttcggccgacacgtcgggattggcggctgcagccaggggtcctccgacgctgggcttccgtgagcggcgctctgccagccggagctgcggggagggagttggcgcctagcgcgcagctccatccccgcctctgcagtggactcggccgcagaatcggggtcccgggctcctggaacttgtcccgcccaggccgcggcgaggaggtcactccagccgatctctggaccggattcgtcccattctcgtcctcatggtggacaagaaactggtggtggttttcggaggcacaggtgcccagggtggctccgtggcccgcacactcctggaagatgggacattcaaggttcgagtggtgacccgaaaccctaggaagaaggcagcaaaggagctgaggctgcaaggtgcagaagtagtgcagggagaccaagatgaccaggtcatcatggagctggccctgaatggggcttacgccaccttcatcgtgaccaattactgggagagctgcagccaggagcaggaggtcaagcaggggaagctgctcgctgatctggccaggcgcctgggcctccactatgtggtctacagcggcctggagaacatcaagaagctgacggcagggagattggccgccgcgcactttgacggcaaaggggaggtggaggaatatttccgggacattggcgttcccatgaccagtgtgcggctgccctgctattttgagaacctcctctcccacttcttgccccagaaagccccagacggaaagagctacttgctgagcttgcccacaggtgacgttcccatggatggcatgtccgtgtctgacctgggtcctgtggtgctcagccttttgaagatgccagaaaaatacgtcggccagaacatcgggctgagcacttgcaggcacacggccgaggagtacgctgccctgctcaccaagcacacccgcaaggtcgtgcacgatgccaagatgactcctgaggactacgaaaagcttggctttcccggtgcccgggacctggccaacatgttccgtttctatgccctgagacccgaccgtgacatcgagctgaccctgagactcaaccccaaggccctgacgctggaccagtggctggaacagcacaaaggggacttcaacctgctgtgacctgcccgcctcgcggccccttgtggggatcgggggcaccagaggggcagaggcaccaacatctgaataaagccattgttctcccagatggcttccaggagaagaggac

SEQ ID NO: 371317 - DNA, 1727 bp, Homo sapiens
agcggagtatgtggctttccccaggtctctggaggttgcaggctcaggctctgctcagcgggtcatcacccgtagcatccggttaagaggctctccacctcgctcattttggtctaactggatttacacaaactcactgtgcacgtgcctggggcgggcaaacccggaaacgacgccgagtcccgcgggatccaggaggagccaactgcgccggaggaggggtttcggccgacacgtcgggattggcggctgcagccaggggtcctccgacgctgggcttccgtgagcggcgctctgccagccggagctgcggggagggagttggcgcctagcgcgcagctccatccccgcctctgcagtggactcggccgcagaatcggggtcccgggctcctggaacttgtcccgcccaggccgcggcgaggaggtcactccagccgcggtgggacccgggccggggggcgggtgactggaaccgggggaggcgggaaggaggaggggatcgggcccaagggacacgaggtgggtcgcgggaccccgatatctcgggacaggcgtcttgccgctccgggcccagccgcccccttcgacacatactcgatgcatagacaatgggggtgtcctttgtcgctcctggcgggaaccccggccccacccccaactccacgcctcccattacccccagatctctggaccggattcgtcccattctcgtcctcatggtggacaagaaactggtggtggttttcggaggcacaggtgcccagggtggctccgtggcccgcacactcctggaagatgggacattcaaggttcgagtggtgacccgaaaccctaggaagaaggcagcaaaggagctgaggctgcaaggtgcagaagtagtgcagggagaccaagatgaccaggtcatcatggagctggccctgaatggggcttacgccaccttcatcgtgaccaattactgggagagctgcagccaggagcaggaggtcaagcaggggaagctgctcgctgatctggccaggcgcctgggcctccactatgtggtctacagcggcctggagaacatcaagaagctgacggcagggagattggccgccgcgcactttgacggcaaaggggaggtggaggaatatttccgggacattggcgttcccatgaccagtgtgcggctgccctgctattttgagaacctcctctcccacttcttgccccagaaagccccagacggaaagagctacttgctgagcttgcccacaggtgacgttcccatggatggcatgtccgtgtctgacctgggtcctgtggtgctcagccttttgaagatgccagaaaaatacgtcggccagaacatcgggctgagcacttgcaggcacacggccgaggagtacgctgccctgctcaccaagcacacccgcaaggtcgtgcacgatgccaagatgactcctgaggactacgaaaagcttggctttcccggtgcccgggacctggccaacatgttccgtttctatgccctgagacccgaccgtgacatcgagctgaccctgagactcaaccccaaggccctgacgctggaccagtggctggaacagcacaaaggggacttcaacctgctgtgacctgcccgcctcgcggccccttgtggggatcgggggcaccagaggggcagaggcaccaacatctgaataaagccattgttctcccagatggcttccaggagaagaggac

SEQ ID NO: 371318 - DNA, 2006 bp, Homo sapiens
ttttttaagactcatggacatagctttaattatctttgcctgacgcccaatacctgaaaattaagatgttcatgcaagataaagaggtaatttttctcctcctcccagtcatcacccgtagcatccggttaagaggctctccacctcgctcattttggtctaactggatttacacaaactcactgtgcacgtgcctggggcgggcaaacccggaaacgacgccgagtcccgcgggatccaggaggagccaactgcgccggaggaggggtttcggccgacacgtcgggattggcggctgcagccaggggtcctccgacgctgggcttccgtgagcggcgctctgccagccggagctgcggggagggagttggcgcctagcgcgcagctccatccccgcctctgcagtggactcggccgcagaatcggggtcccgggctcctggaacttgtcccgcccaggccgcggcgaggaggtcactccagccgcggtgggacccgggccggggggcgggtgactggaaccgggggaggcgggaaggaggaggggatcgggcccaagggacacgaggtgggtcgcgggaccccgatatctcgggacaggcgtcttgccgctccgggcccagccgcccccttcgacacatactcgatgcatagacaatgggggtgtcctttgtcgctcctggcgggaaccccggccccacccccaactccacgcctcccattacccccagatctctggaccggattcgtcccattctcgtcctcatggtggacaagaaactggtggtggttttcggaggcacagaggcggggtttcaccaagccaagatcgtgccactgcacttcagcctgggtgatagagtgagactccatctcaaaaaaataaaataaagaaaataaaaatacctgaatgagaatcgtcgttgagaaggtttcctggatgctccttgctgtggtggagcactcccttcggggtttcgcccttcagtgggactttcaggtaggtctgacctgagaggtctttttgattctttgtaggtgcccagggtggctccgtggcccgcacactcctggaagatgggacattcaaggttcgagtggtgacccgaaaccctaggaagaaggcagcaaaggagctgaggctgcaaggtgcagaagtagtgcagggagaccaagatgaccaggtcatcatggagctggccctgaatggggcttacgccaccttcatcgtgaccaattactgggagagctgcagccaggagcaggaggtcaagcaggggaagctgctcgctgatctggccaggcgcctgggcctccactatgtggtctacagcggcctggagaacatcaagaagctgacggcagggagattggccgccgcgcactttgacggcaaaggggaggtggaggaatatttccgggacattggcgttcccatgaccagtgtgcggctgccctgctattttgagaacctcctctcccacttcttgccccagaaagccccagacggaaagagctacttgctgagcttgcccacaggtgacgttcccatggatggcatgtccgtgtctgacctgggtcctgtggtgctcagccttttgaagatgccagaaaaatacgtcggccagaacatcgggctgagcacttgcaggcacacggccgaggagtacgctgccctgctcaccaagcacacccgcaaggtcgtgcacgatgccaagatgactcctgaggactacgaaaagcttggctttcccggtgcccgggacctggccaacatgttccgtttctatgccctgagacccgaccgtgacatcgagctgaccctgagactcaaccccaaggccctgacgctggaccagtggctggaacagcacaaaggggacttcaacctgctgtgacctgcccgcctcgcggccccttgtggggatcgggggcaccagaggggcagaggcaccaacatctgaataaagccattgttctcccagatggcttccaggagaagaggac

SEQ ID NO: 371319 - DNA, 1300 bp, Homo sapiens
agcggagtatgtggctttccccaggtctctggaggttgcaggctcaggctctgctcagcgggtcatcacccgtagcatccggttaagaggctctccacctcgctcattttggtctaactggatttacacaaactcactgtgcacgtgcctggggcgggcaaacccggaaacgacgccgagtcccgcgggatccaggaggagccaactgcgccggaggaggggtttcggccgacacgtcgggattggcggctgcagccaggggtcctccgacgctgggcttccgtgagcggcgctctgccagatctctggaccggattcgtcccattctcgtcctcatggtggacaagaaactggtggtggttttcggaggcacagaggcggggtttcaccaagccaagatcgtgccactgcacttcagcctgggtgatagagtgagactccatctcaaaaaaataaaataaagaaaataaaaatacctgaatgagaatcgtcgttgagaaggtttcctggatgctccttgctgtggtggagcactcccttcggggtttcgcccttcagtgggactttcaggggaagctgctcgctgatctggccaggcgcctgggcctccactatgtggtctacagcggcctggagaacatcaagaagctgacggcagggagattggccgccgcgcactttgacggcaaaggggaggtggaggaatatttccgggacattggcgttcccatgaccagtgtgcggctgccctgctattttgagaacctcctctcccacttcttgccccagaaagccccagacggaaagagctacttgctgagcttgcccacaggtgacgttcccatggatggcatgtccgtgtctgacctgggtcctgtggtgctcagccttttgaagatgccagaaaaatacgtcggccagaacatcgggctgagcacttgcaggcacacggccgaggagtacgctgccctgctcaccaagcacacccgcaaggtcgtgcacgatgccaagatgactcctgaggactacgaaaagcttggctttcccggtgcccgggacctggccaacatgttccgtttctatgccctgagacccgaccgtgacatcgagctgaccctgagactcaaccccaaggccctgacgctggaccagtggctggaacagcacaaaggggacttcaacctgctgtgacctgcccgcctcgcggccccttgtggggatcgggggcaccagaggggcagaggcaccaacatctgaataaagccattgttctcccagatggcttccaggagaagaggac

SEQ ID NO: 371320 - DNA, 1768 bp, Homo sapiens
ttttttaagactcatggacatagctttaattatctttgcctgacgcccaatacctgaaaattaagatgttcatgcaagataaagaggtaatttttctcctcctcccagtcatcacccgtagcatccggttaagaggctctccacctcgctcattttggtctaactggatttacacaaactcactgtgcacgtgcctggggcgggcaaacccggaaacgacgccgagtcccgcgggatccaggaggagccaactgcgccggaggaggggtttcggccgacacgtcgggattggcggctgcagccaggggtcctccgacgctgggcttccgtgagcggcgctctgccagccggagctgcggggagggagttggcgcctagcgcgcagctccatccccgcctctgcagtggactcggccgcagaatcggggtcccgggctcctggaacttgtcccgcccaggccgcggcgaggaggtcactccagccgatctctggaccggattcgtcccattctcgtcctcatggtggacaagaaactggtggtggttttcggaggcacaggtgcccagggtggctccgtggcccgcacactcctggaagatgggacattcaaggttcgagtggtgacccgaaaccctaggaagaaggcagcaaaggagctgaggctgcaaggtgcagaagtagtgcagggagaccaagatgaccaggtcatcatggagctggccctgaatggggcttacgccaccttcatcgtgaccaattactgggagagctgcagccaggagcaggaggtcaagcaggggaagctgctcgctgatctggccaggcgcctgggcctccactatgtggtctacagcggcctggagaacatcaagaagctgacggcagggagattggccgccgcgcactttgacggcaaaggggaggtggaggaatatttccgggacattggcgttcccatgaccagtgtgcggctgccctgctattttgagaacctcctctcccacttcttgccccagaaagccccagacggaaagagctacttgctgagcttgcccacaggtgacgttcccatggatggcatgtccgtgtctgacctgggtcctgtggtgctcagccttttgaagatgccagaaaaatacgtcggccagaacatcgggctgagcacttgcaggcacacggccgaggagtacgctgccctgctcaccaagcacacccgcaaggtcgtgcacgatgccaaggtgggcctcccgccccaggtgactcaggcatccttgtcagggctttctagctcccgtagggagggtgtgtccagggctgcccacacctctgggcagtacatctaaattcattcgttcatcgtcaacgtttattttctgctgttccaggagctaactggccacagagtgaaatttctggcttagatgttttgaccaaatagagagaaaagcttccaggaggagagggccataggagccaagatgactcctgaggactacgaaaagcttggctttcccggtgcccgggacctggccaacatgttccgtttctatgccctgagacccgaccgtgacatcgagctgaccctgagactcaaccccaaggccctgacgctggaccagtggctggaacagcacaaaggggacttcaacctgctgtgacctgcccgcctcgcggccccttgtggggatcgggggcaccagaggggcagaggcaccaacatctgaataaagccattgttctcccagatggcttccaggagaagaggac

SEQ ID NO: 371321 - DNA, 1326 bp, Homo sapiens
ttttttaagactcatggacatagctttaattatctttgcctgacgcccaatacctgaaaattaagatgttcatgcaagataaagaggtaatttttctcctcctcccagtcatcacccgtagcatccggttaagaggctctccacctcgctcattttggtctaactggatttacacaaactcactgtgcacgtgcctggggcgggcaaacccggaaacgacgccgagtcccgcgggatccaggaggagccaactgcgccggaggaggggtttcggccgacacgtcgggattggcggctgcagccaggggtcctccgacgctgggcttccgtgagcggcgctctgccagccggagctgcggggagggagttggcgcctagcgcgcagctccatccccgcctctgcagtggactcggccgcagaatcggggtcccgggctcctggaacttgtcccgcccaggccgcggcgaggaggtcactccagccgatctctggaccggattcgtcccattctcgtcctcatggtggacaagaaactggtggtggttttcggaggcacaggtgcccagggtggctccgtggcccgcacactcctggaagatgggacattcaaggttcgagtggtgacccgaaaccctaggaagaaggcagcaaaggagctgaggctgcaaggtgcagaagtagtgcagggagaccaagatgaccaggtcatcatggagctggccctgaatggggcttacgccaccttcatcgtgaccaattactgggagagctgcagccaggagcaggaggtcaagcaggggaagctgctcgctgatctggccaggcgcctgggcctccactatgtggcttgcccacaggtgacgttcccatggatggcatgtccgtgtctgacctgggtcctgtggtgctcagccttttgaagatgccagaaaaatacgtcggccagaacatcgggctgagcacttgcaggcacacggccgaggagtacgctgccctgctcaccaagcacacccgcaaggtcgtgcacgatgccaagatgactcctgaggactacgaaaagcttggctttcccggtgcccgggacctggccaacatgttccgtttctatgccctgagacccgaccgtgacatcgagctgaccctgagactcaaccccaaggccctgacgctggaccagtggctggaacagcacaaaggggacttcaacctgctgtgacctgcccgcctcgcggccccttgtggggatcgggggcaccagaggggcagaggcaccaacatctgaataaagccattgttctcccagatggcttccaggagaagaggac

SEQ ID NO: 371322 - DNA, 1010 bp, Homo sapiens
ggatttgaaatgagtgaatcgctgagtcccgcgatgagacagggtctgcattttgctcttaaaatctcgggggcgtcaggaccacatcccagctgagcaggctgagactgctgaggagtgcggacgggcgaggaggggacgcggaaaggagggagcggcgacaggcgacccgtccggcacgggtcccggcggtgcccggtccccccgggctccaggccgctcgccccccgcccctccccttcgctccccgcacagcctctcccgcccctccccacccggctccctcaagtctccacgaacggaaatgggagtcacagcgccggggaccagcggaaacaaaacacagaggcggccgcgggggggcccttgtgggggaaaaggccccggaacgaggccggcccgcgagggcccgcgctcccctcctccccggcggccgcactcacccactccggaatcggccctgtcgcccccgcccgcactccagagccggctgagaacggcagcggcgagggctccacgtgcagcgtctctccgggaatcagcatgattcttcagaggctcttcaggttctcctctgtcattcggtcagccgtctcagtccatttgcggaggaacattggtgttacagcagtggcatttaataaggaacttgatcctatacagaaactctttgtggacaagattagagaatacaaatctaagcgacagacatctggaggacctgttgatgctagttcagagtatcagcaagagctggagagggagctttttaagctcaagcaaatgtttggtaatgcagacatgaatacatttcccaccttcaaatttgaagatcccaaatttgaagtcatcgaaaaaccccaggcctgaagaaataaagtaaaattaatctggtaatttgtcacggattagttgtacaactagttagaagtttcagaataaacatgcatttcataactgtcaaatgttcttttaattctgagtccaaataaattatttggtgatgttga

SEQ ID NO: 371323 - DNA, 1184 bp, Homo sapiens
  misc_feature (1171)..(1171): n is a, c, g, or t
  misc_feature (1178)..(1178): n is a, c, g, or t
ggatttgaaatgagtgaatcgctgagtcccgcgatgagacagggtctgcattttgctcttaaaatctcgggggcgtcaggaccacatcccagctgagcaggctgagactgctgaggagtgcggacgggcgaggaggggacgcggaaaggagggagcggcgacaggcgacccgtccggcacgggtcccggcggtgcccggtccccccgggctccaggccgctcgccccccgcccctccccttcgctccccgcacagcctctcccgcccctccccacccggctccctcaagtctccacgaacggaaatgggagtcacagcgccggggaccagcggaaacaaaacacagaggcggccgcgggggggcccttgtgggggaaaaggccccggaacgaggccggcccgcgagggcccgcgctcccctcctccccggcggccgcactcacccactccggaatcggccctgtcgcccccgcccgcactccagagccggctgagaacggcagcggcgagggctccacgtgcagcgtctctccgggtaagacctgcagctcccgcgactagaagtgtgaggtcccagggcccttcccgcggaatcggcgctgagaagccccaacccccctcccgcctcccaggcaccttcgggtccaggactacaactcccggcagggtgcgcaaaacgaccgcccaaggcaacggaggctcacgaggaatcagcatgattcttcagaggctcttcaggttctcctctgtcattcggtcagccgtctcagtccatttgcggaggaacattggtgttacagcagtggcatttaataaggaacttgatcctatacagaaactctttgtggacaagattagagaatacaaatctaagcgacagacatctggaggacctgttgatgctagttcagagtatcagcaagagctggagagggagctttttaagctcaagcaaatgtttggtaatgcagacatgaatacatttcccaccttcaaatttgaagatcccaaatttgaagtcatcgaaaaaccccaggcctgaagaaataaagtaaaattaatctggtaatttgtcacggattagttgtacaactagttagaagtttcagaataaacatgcatttcataactgtcaaattgttctttttaattcctgaattccaaattaaanttatttnggtgaa

SEQ ID NO: 371324 - DNA, 622 bp, Homo sapiens
  misc_feature (18)..(18): n is a, c, g, or t
  misc_feature (41)..(41): n is a, c, g, or t
  misc_feature (50)..(50): n is a, c, g, or t
  misc_feature (480)..(480): n is a, c, g, or t
ggggagcggaggtttttncggcagtggggggcggagctctnaacttattncaagaatcagcatgattcttcagaggctcttcaggttctcctctgtcattcggtcagccgtctcagtccatttgcggaggaacattggtgttacagcagtggcatttaataaggaacttgatctttatacggggggggggggtactcaagattagggaatacaaaaataagccacgacatctggaggacctgttgatgctagttcagagtatcagcaagagctggagagggagcttttaaagctcaagtaaatgttcgattatgcaggcatcaacacattggccacctttaattttgaagatcccaactttgtagcactcggaataccccctcccccgcgtagtaaagcacctttaatatcggaattagcccggattcgctgtacaacatagttacaagcttagaataaacatacatggcgtacctctcnatctttatttgtcgatcacatcataaacacccggccctctctattcctcccgccttgtactaacgctgtttttcccccccccccgctcctggccccttcgcattggcgacctttttcctcccccatcccacacccttaccca

SEQ ID NO: 371325 - DNA, 1643 bp, Homo sapiens
ggatttgaaatgagtgaatcgctgagtcccgcgatgagacagggtctgcattttgctcttaaaatctcgggggcgtcaggaccacatcccagctgagcaggctgagactgctgaggagtgcggacgggcgaggaggggacgcggaaaggagggagcggcgacaggcgacccgtccggcacgggtcccggcggtgcccggtccccccgggctccaggccgctcgccccccgcccctccccttcgctccccgcacagcctctcccgcccctccccacccggctccctcaagtctccacgaacggaaatgggagtcacagcgccggggaccagcggaaacaaaacacagaggcggccgcgggggggcccttgtgggggaaaaggccccggaacgaggccggcccgcgagggcccgcgctcccctcctccccggcggccgcactcacccactccggaatcggccctgtcgcccccgcccgcactccagagccggctgagaacggcagcggcgagggctccacgtgcagcgtctctccgggtaagacctgcagctcccgcgactagaagtgtgaggtcccagggcccttcccgcggaatcggcgctgagaagccccaacccccctcccgcctcccaggcaccttcgggtccaggactacaactcccggcagggtgcgcaaaacgaccgcccaaggcaacggaggctcacgaggtacaaggaagcacaacgccccaatccgctttgttttacacagtctcactttccctgcacctttatacacttcgataaccctaacgaacaggacgctgactcggaggggagcttgaactaggggaaaggccactcaaagagcgcatgcgtacagagcaaggtttcaaggaggggaaaaagaacgggtcaaattaggcgaagaaaagatggcggaggctgtgccaggggacccggaagcacttaccctccacttcctcctcctgtttggcttctgtctcacctagacccgtccggtcgcagactgtctccgagacgcttcctgtccggtgagcgtcgaccgactgaaacggcggcccataatgcattgcgatggcgggtaggcgtgtgggggcggagccagggccggaagtagagcggaggtggtggcggcggaggctttggcagctcgggactgagtgcaagaatcagcatgattcttcagaggctcttcaggttctcctctgtcattcggtcagccgtctcagtccatttgcggaggaacattggtgttacagcagtggcatttaataaggaacttgatcctatacagaaactctttgtggacaagattagagaatacaaatctaagcgacagacatctggaggacctgttgatgctagttcagagtatcagcaagagctggagagggagctttttaagctcaagcaaatgtttggtaatgcagacatgaatacatttcccaccttcaaatttgaagatcccaaatttgaagtcatcgaaaaaccccaggcctgaagaaataaagtaaaattaatctggtaatttgtcacggattagttgtacaactagttagaagtttcagaataaacatgcatttcataactgtcaaatgttcttttaattctgagtccaaataaattatttggtgatgttga

SEQ ID NO: 371326 - DNA, 1557 bp, Homo sapiens
ggatttgaaatgagtgaatcgctgagtcccgcgatgagacagggtctgcattttgctcttaaaatctcgggggcgtcaggaccacatcccagctgagcaggctgagactgctgaggagtgcggacgggcgaggaggggacgcggaaaggagggagcggcgacaggcgacccgtccggcacgggtcccggcggtgcccggtccccccgggctccaggccgctcgccccccgcccctccccttcgctccccgcacagcctctcccgcccctccccacccggctccctcaagtctccacgaacggaaatgggagtcacagcgccggggaccagcggaaacaaaacacagaggcggccgcgggggggcccttgtgggggaaaaggccccggaacgaggccggcccgcgagggcccgcgctcccctcctccccggcggccgcactcacccactccggaatcggccctgtcgcccccgcccgcactccagagccggctgagaacggcagcggcgagggctccacgtgcagcgtctctccgggtaagacctgcagctcccgcgactagaagtgtgaggtcccagggcccttcccgcggaatcggcgctgagaagccccaacccccctcccgcctcccaggcaccttcgggtccaggactacaactcccggcagggtgcgcaaaacgaccgcccaaggcaacggaggctcacgaggtacaaggaagcacaacgccccaatccgctttgttttacacagtctcactttccctgcacctttatacacttcgataaccctaacgaacaggacgctgactcggaggggagcttgaactaggggaaaggccactcaaagagcgcatgcgtacagagcaaggtttcaaggaggggaaaaagaacgggtcaaattaggcgaagaaaagatggcggaggctgtgccaggggacccggaagcacttaccctccacttcctcctcctgtttggcttctgtctcacctagacccgtccggtcgcagactgtctccgagacgcttcctgtccggtgagcgtcgaccgactgaaacggcggcccataatgcattgcgatggcggaatcagcatgattcttcagaggctcttcaggttctcctctgtcattcggtcagccgtctcagtccatttgcggaggaacattggtgttacagcagtggcatttaataaggaacttgatcctatacagaaactctttgtggacaagattagagaatacaaatctaagcgacagacatctggaggacctgttgatgctagttcagagtatcagcaagagctggagagggagctttttaagctcaagcaaatgtttggtaatgcagacatgaatacatttcccaccttcaaatttgaagatcccaaatttgaagtcatcgaaaaaccccaggcctgaagaaataaagtaaaattaatctggtaatttgtcacggattagttgtacaactagttagaagtttcagaataaacatgcatttcataactgtcaaatgttcttttaattctgagtccaaataaattatttggtgatgttga

SEQ ID NO: 371327 - DNA, 1182 bp, Homo sapiens
ggatttgaaatgagtgaatcgctgagtcccgcgatgagacagggtctgcattttgctcttaaaatctcgggggcgtcaggaccacatcccagctgagcaggctgagactgctgaggagtgcggacgggcgaggaggggacgcggaaaggagggagcggcgacaggcgacccgtccggcacgggtcccggcggtgcccggtccccccgggctccaggccgctcgccccccgcccctccccttcgctccccgcacagcctctcccgcccctccccacccggctccctcaagtctccacgaacggaaatgggagtcacagcgccggggaccagcggaaacaaaacacagaggcggccgcgggggggcccttgtgggggaaaaggccccggaacgaggccggcccgcgagggcccgcgctcccctcctccccggcggccgcactcacccactccggaatcggccctgtcgcccccgcccgcactccagagccggctgagaacggcagcggcgagggctccacgtgcagcgtctctccgggtaagacctgcagctcccgcgactagaagtgtgaggtcccagggcccttcccgcggaatcggcgctgagaagccccaacccccctcccgcctcccaggcaccttcgggtccaggactacaactcccggcagggtgcgcaaaacgaccgcccaaggcaacggaggctcacgaggaatcagcatgattcttcagaggctcttcaggttctcctctgtcattcggtcagccgtctcagtccatttgcggaggaacattggtgttacagcagtggcatttaataaggaacttgatcctatacagaaactctttgtggacaagattagagaatacaaatctaagcgacagacatctggaggacctgttgatgctagttcagagtatcagcaagagctggagagggagctttttaagctcaagcaaatgtttggtaatgcagacatgaatacatttcccaccttcaaatttgaagatcccaaatttgaagtcatcgaaaaaccccaggcctgaagaaataaagtaaaattaatctggtaatttgtcacggattagttgtacaactagttagaagtttcagaataaacatgcatttcataactgtcaaatgttcttttaattctgagtccaaataaattatttggtgatgttga

SEQ ID NO: 371328 - DNA, 579 bp, Homo sapiens
gcggcccctctactactaaattcgcggccgcgtcgaccgagacgcttcctgtccggtgagcgtcgaccgactgaaacggcggcccataatgcattgcgatggcggaatcagcatgattcttcagaggctcttcaggttctcctctgtcattcggtcagccgtctcagtccatttgcggaggaacattggtgttacagcagtggcatttaataaggaacttgatcctatacagaaactctttgtggacaagattagagaatacaaatctaagcgacagacatctggaggacctgttgatgctagttcagagtatcagcaagagctggagagggagctttttaagctcaagcaaatgtttggtaatgcagacatgaatacatttcccaccttcaaatttgaagatcccaaatttgaagtcatcgaaaaaccccaggcctgaagaaataaagtaaaattaatctggtaatttgtcacggattagttgtacaactagttagaagtttcagaataaacatgcatttcataactgtcaaatgttcttttaattctgagtccaaataaattatttggtgatgttga

SEQ ID NO: 371329 - DNA, 1770 bp, Homo sapiens
ggatttgaaatgagtgaatcgctgagtcccgcgatgagacagggtctgcattttgctcttaaaatctcgggggcgtcaggaccacatcccagctgagcaggctgagactgctgaggagtgcggacgggcgaggaggggacgcggaaaggagggagcggcgacaggcgacccgtccggcacgggtcccggcggtgcccggtccccccgggctccaggccgctcgccccccgcccctccccttcgctccccgcacagcctctcccgcccctccccacccggctccctcaagtctccacgaacggaaatgggagtcacagcgccggggaccagcggaaacaaaacacagaggcggccgcgggggggcccttgtgggggaaaaggccccggaacgaggccggcccgcgagggcccgcgctcccctcctccccggcggccgcactcacccactccggaatcggccctgtcgcccccgcccgcactccagagccggctgagaacggcagcggcgagggctccacgtgcagcgtctctccgggtaagacctgcagctcccgcgactagaagtgtgaggtcccagggcccttcccgcggaatcggcgctgagaagccccaacccccctcccgcctcccaggcaccttcgggtccaggactacaactcccggcagggtgcgcaaaacgaccgcccaaggcaacggaggctcacgaggtacaaggaagcacaacgccccaatccgctttgttttacacagtctcactttccctgcacctttatacacttcgataaccctaacgaacaggacgctgactcggaggggagcttgaactaggggaaaggccactcaaagagcgcatgcgtacagagcaaggtttcaaggaggggaaaaagaacgggtcaaattaggcgaagaaaagatggcggaggctgtgccaggggacccggaagcacttaccctccacttcctcctcctgtttggcttctgtctcacctagacccgtccggtcgcagactgtctccgagacgcttcctgtccggtgagcgtcgaccgactgaaacggcggcccataatgcattgcgatggcgggtaggcgtgtgggggcggagccagggccggaagtagagcggaggtggtggcggcggaggctttggcagctcgggactgagtgcaagaatcagcatgattcttcagaggctcttcaggttctcctctgtcattcggtcagccgtctcagtccatttgcggaggaacattggtgttacagcagtggcatttaataaggaacttgatcctatacagaaactctttgtggacaagattagagaatacaaatctaagcgacagacatctggaggacctgttgatgctagttcagagtatcagcaagagctggagagggagctttttaagctcaagcaaatgtttggtaatgcagacatgaatacatttcccaccttcaaatttgaagatcccaaatttgaagtcatcgaaaaaccccaggcctgaagaaataaagtaaaattaatctggtaatttgtcacggattagttgtacaactagttagaagtttcagaataaacatgcatttcataactgtcaaatgttcttttaattctgagtccaaataaattatttggtgatgttgacaaaaaaaaaaaaaaacacaagcggccgcaattcgagctcaatttgcccaatccgcctatcgtgagccgattaccaatccattgcccgtggttttacaatgacacggctgggaaagccctggctttc

SEQ ID NO: 371330 - DNA, 1775 bp, Homo sapiens
ggatttgaaatgagtgaatcgctgagtcccgcgatgagacagggtctgcattttgctcttaaaatctcgggggcgtcaggaccacatcccagctgagcaggctgagactgctgaggagtgcggacgggcgaggaggggacgcggaaaggagggagcggcgacaggcgacccgtccggcacgggtcccggcggtgcccggtccccccgggctccaggccgctcgccccccgcccctccccttcgctccccgcacagcctctcccgcccctccccacccggctccctcaagtctccacgaacggaaatgggagtcacagcgccggggaccagcggaaacaaaacacagaggcggccgcgggggggcccttgtgggggaaaaggccccggaacgaggccggcccgcgagggcccgcgctcccctcctccccggcggccgcactcacccactccggaatcggccctgtcgcccccgcccgcactccagagccggctgagaacggcagcggcgagggctccacgtgcagcgtctctccgggtaagacctgcagctcccgcgactagaagtgtgaggtcccagggcccttcccgcggaatcggcgctgagaagccccaacccccctcccgcctcccaggcaccttcgggtccaggactacaactcccggcagggtgcgcaaaacgaccgcccaaggcaacggaggctcacgaggtacaaggaagcacaacgccccaatccgctttgttttacacagtctcactttccctgcacctttatacacttcgataaccctaacgaacaggacgctgactcggaggggagcttgaactaggggaaaggccactcaaagagcgcatgcgtacagagcaaggtttcaaggaggggaaaaagaacgggtcaaattaggcgaagaaaagatggcggaggctgtgccaggggacccggaagcacttaccctccacttcctcctcctgtttggcttctgtctcacctagacccgtccggtcgcagactgtctccgagacgcttcctgtccggtgagcgtcgaccgactgaaacggcggcccataatgcattgcgatggcgggtaggcgtgtgggggcggagccagggccggaagtagagcggaggtggtggcggcggaggctttggcagctcgggactgagtgcaagaatcagcatgattcttcagaggctcttcaggttctcctctgtcattcggtcagccgtctcagtccatttgcggaggaacattggtgttacagcagtggcatttaataaggaacttgatcctatacagaaactctttgtggacaagattagagaatacaaatctaagcgacagacatctggaggacctgttgatgctagttcagagtatcagcaagagctggagagggagctttttaagctcaagcaaatgtttggtaatgcagacatgaatacatttcccaccttcaaatttgaagatcccaaatttgaagtcatcgaaaaaccccaggcctgaagaaataaagtaaaattaatctggtaatttgtcacggattagttgtacaactagttagaagtttcagaataaacatgcatttcataactgtcaaatgttcttttaattctgagtccaaataaattatttggtgatgttgagtgtgttcttgatgaattgaaaaacataaattacttattctccttcaaataaaatccattggccgacgttatacaacgttgtgacttgtcctttgtcgtacccactttaatcgccttgaggcctctctcttg

SEQ ID NO: 371331 - DNA, 1750 bp, Homo sapiens
ggatttgaaatgagtgaatcgctgagtcccgcgatgagacagggtctgcattttgctcttaaaatctcgggggcgtcaggaccacatcccagctgagcaggctgagactgctgaggagtgcggacgggcgaggaggggacgcggaaaggagggagcggcgacaggcgacccgtccggcacgggtcccggcggtgcccggtccccccgggctccaggccgctcgccccccgcccctccccttcgctccccgcacagcctctcccgcccctccccacccggctccctcaagtctccacgaacggaaatgggagtcacagcgccggggaccagcggaaacaaaacacagaggcggccgcgggggggcccttgtgggggaaaaggccccggaacgaggccggcccgcgagggcccgcgctcccctcctccccggcggccgcactcacccactccggaatcggccctgtcgcccccgcccgcactccagagccggctgagaacggcagcggcgagggctccacgtgcagcgtctctccgggtaagacctgcagctcccgcgactagaagtgtgaggtcccagggcccttcccgcggaatcggcgctgagaagccccaacccccctcccgcctcccaggcaccttcgggtccaggactacaactcccggcagggtgcgcaaaacgaccgcccaaggcaacggaggctcacgaggtacaaggaagcacaacgccccaatccgctttgttttacacagtctcactttccctgcacctttatacacttcgataaccctaacgaacaggacgctgactcggaggggagcttgaactaggggaaaggccactcaaagagcgcatgcgtacagagcaaggtttcaaggaggggaaaaagaacgggtcaaattaggcgaagaaaagatggcggaggctgtgccaggggacccggaagcacttaccctccacttcctcctcctgtttggcttctgtctcacctagacccgtccggtcgcagactgtctccgagacgcttcctgtccggtgagcgtcgaccgactgaaacggcggcccataatgcattgcgatggcgggtaggcgtgtgggggcggagccagggccggaagtagagcggaggtggtggcggcggaggctttggcagctcgggactgagtgcaagaatcagcatgattcttcagaggctcttcaggttctcctctgtcattcggtcagccgtctcagtccatttgcggaggaacattggtgttacagcagtggcatttaataaggaacttgatcctatacagaaactctttgtggacaagattagagaatacaaatctaagcgacagacatctggaggacctgttgatgctagttcagagtatcagcaagagctggagagggagctttttaagctcaagcaaatgtttggtaatgcagacatgaatacatttcccaccttcaaatttgaagatcccaaatttgaagtcatcgaaaaaccccaggcctgaagaaataaagtaaaattaatctggtaatttgtcacggattagttgtacaactagttagaagtttcagaataaacatgcatttcataactgtcaaaaaactctcctctcttccctacactctcctccctcctcctttaccttccacctctcttctctcctaactccttcctcatctcttctcttaccctctctcccttctccacacactgtttccccttattttcctccactctctcttactcttgct

SEQ ID NO: 371332 - DNA, 3096 bp, Homo sapiens
ggatttgaaatgagtgaatcgctgagtcccgcgatgagacagggtctgcattttgctcttaaaatctcgggggcgtcaggaccacatcccagctgagcaggctgagactgctgaggagtgcggacgggcgaggaggggacgcggaaaggagggagcggcgacaggcgacccgtccggcacgggtcccggcggtgcccggtccccccgggctccaggccgctcgccccccgcccctccccttcgctccccgcacagcctctcccgcccctccccacccggctccctcaagtctccacgaacggaaatgggagtcacagcgccggggaccagcggaaacaaaacacagaggcggccgcgggggggcccttgtgggggaaaaggccccggaacgaggccggcccgcgagggcccgcgctcccctcctccccggcggccgcactcacccactccggaatcggccctgtcgcccccgcccgcactccagagccggctgagaacggcagcggcgagggctccacgtgcagcgtctctccgggtaagacctgcagctcccgcgactagaagtgtgaggtcccagggcccttcccgcggaatcggcgctgagaagccccaacccccctcccgcctcccaggcaccttcgggtccaggactacaactcccggcagggtgcgcaaaacgaccgcccaaggcaacggaggctcacgaggtacaaggaagcacaacgccccaatccgctttgttttacacagtctcactttccctgcacctttatacacttcgataaccctaacgaacaggacgctgactcggaggggagcttgaactaggggaaaggccactcaaagagcgcatgcgtacagagcaaggtttcaaggaggggaaaaagaacgggtcaaattaggcgaagaaaagatggcggaggctgtgccaggggacccggaagcacttaccctccacttcctcctcctgtttggcttctgtctcacctagacccgtccggtcgcagactgtctccgagacgcttcctgtccggtgagcgtcgaccgactgaaacggcggcccataatgcattgcgatggcgggtaggcgtgtgggggcggagccagggccggaagtagagcggaggtggtggcggcggaggctttggcagctcgggactgagtgcaagaatcagcatgattcttcagaggctcttcaggttctcctctgtcattcggtcagccgtctcagtccatttgcggaggaacattggtgttacagcagtggcatttaataaggaacttgatcctatacagaaactctttgtggacaagattagagaatacaaatctaagcgacagacatctggaggacctgttgatgctagttcagagtatcagcaagagctggagagggagctttttaagctcaagcaaatgtttggtaatgcagacatgaatacatttcccaccttcaaatttgaagagcatttttctcagcatttgagaagttggcagccatccagagatgatgacattctaatcttaagcagctaaccagcagctagccttgtagctacagaaggtaagagggtgtagtttcctgggttttatgaataacaataggtggatgactctttccctgcactgttatatggggctaaaaagtttaacaagttcagctatttttattagtgtagactttaatcgaacaaagccacctgtggaaaaaggaagttctttgcaaagttgtattgaaaagcaatcaattggtccagacttaggtcaaacctccaactaaaaataaattaaatctagttacaacagcaacaataattaaaacaaaacaaagcttgctaataagattttaaagccctaatctttacacaacacaattcactgcaggaaaataaagtcaaaatgctgtaagaattacaatgggattttaccagttgttagtgttcaagttcctcaagtaaacacaaatgcaaatacaagtctggacaccagtgacccacagatacatatatatacttttaataggaaattagtgctcaatactctgccctttgtgtgggggaaaacattcttttatacaaggatttttacctagctattacaatagtttaaggtaatgtacaatatatatttgacacagagagtgttattagatgttcgcactgcataaaatgaatcctctagcctttgatgtcttaaaaagaagttttacaactattagtgaagctaaggcactacatattttccttccacaatatgggatttgtgtcatttaaactgaagaagttgatcttgtgtgatgacaggtatgtctgaagaggcgtctttcagagtcatctatcctcttggcatgccaatgcaagagggaaagcattcctcaaaccaaagaaatcttccaaccaaaacataggtaacatttagcctgatttcttacaaaagcttgtagacaggtgtttttttctgtacttcaccaccatgagttgggaatctatgcctgtgggccaaatcttgtctgtgcctgctgtttttgtaaataaagtcttattggaacacagacatgactacttgcttgttttgtctgtggctgcctttgtgctacaatggcagagtcaagtagttgttaacagggaccttatgacttaaaatatctactttctggctctttaacagaaaatgtttgccgatccctgactcgcggtgaaaattttattttgggggcagagccatgttacagaagcccgacctcccaggaagggatctggtgagagacatagcatgtcatagacaagtcaaagggggagcatcttcccggtggcctggtgtcccaggcacatgctaggcactcagtgggtgcttaatccatttgttcggtgaatcctggggatttcttcgccaattgggtagaaagagcagactcttttgaaagaagattaacctgcccagtgcagtggctcatgcctataatcccagcactttgggaggctgatgggggtggatcatttgaggtcagaggtttgagaccagcctggccaacatggtgaaacccttctctactaaaatacaaaaattagccaggtgtggtggtacacgcctataatc

SEQ ID NO: 371333 - DNA, 1733 bp, Homo sapiens
ggatttgaaatgagtgaatcgctgagtcccgcgatgagacagggtctgcattttgctcttaaaatctcgggggcgtcaggaccacatcccagctgagcaggctgagactgctgaggagtgcggacgggcgaggaggggacgcggaaaggagggagcggcgacaggcgacccgtccggcacgggtcccggcggtgcccggtccccccgggctccaggccgctcgccccccgcccctccccttcgctccccgcacagcctctcccgcccctccccacccggctccctcaagtctccacgaacggaaatgggagtcacagcgccggggaccagcggaaacaaaacacagaggcggccgcgggggggcccttgtgggggaaaaggccccggaacgaggccggcccgcgagggcccgcgctcccctcctccccggcggccgcactcacccactccggaatcggccctgtcgcccccgcccgcactccagagccggctgagaacggcagcggcgagggctccacgtgcagcgtctctccgggtaagacctgcagctcccgcgactagaagtgtgaggtcccagggcccttcccgcggaatcggcgctgagaagccccaacccccctcccgcctcccaggcaccttcgggtccaggactacaactcccggcagggtgcgcaaaacgaccgcccaaggcaacggaggctcacgaggtacaaggaagcacaacgccccaatccgctttgttttacacagtctcactttccctgcacctttatacacttcgataaccctaacgaacaggacgctgactcggaggggagcttgaactaggggaaaggccactcaaagagcgcatgcgtacagagcaaggtttcaaggaggggaaaaagaacgggtcaaattaggcgaagaaaagatggcggaggctgtgccaggggacccggaagcacttaccctccacttcctcctcctgtttggcttctgtctcacctagacccgtccggtcgcagactgtctccgagacgcttcctgtccggtgagcgtcgaccgactgaaacggcggcccataatgcattgcgatggcgggtaggcgtgtgggggcggagccagggccggaagtagagcggaggtggtggcggcggaggctttggcagctcgggactgagtgcaagaatcagcatgattcttcagaggctcttcaggttctcctctgtcattcggtcagccgtctcagtccatttgcggaggaacattggtgttacagcagtggcatttaataaggaacttgatcctatacagaaactctttgtggacaagattagagaatacaaatctaagcgacagacatctggaggacctgttgatgctagttcagagtatcagcaagagctggagagggagctttttaagctcaagcaaatgtttggtaatgcagacatgaatacatttcccaccttcaaatttgaagatcccaaatttgaagtcatcgaaaaaccccaggcctgaagaaataaagtagaataaacatgcatttcataactgtcaaatgttcttttaattctgagtccaaataaattatttggtgatgttgaaataaacacccacctcacgtgcttctaacctcgcgcactccactatcttcgccgtgattcccctccacctcaccctcttcattatctttcgccctctctcactctctagctctctgcccttactcttcctttcacctcctctcc

SEQ ID NO: 371334 - DNA, 1589 bp, Homo sapiens
ggatttgaaatgagtgaatcgctgagtcccgcgatgagacagggtctgcattttgctcttaaaatctcgggggcgtcaggaccacatcccagctgagcaggctgagactgctgaggagtgcggacgggcgaggaggggacgcggaaaggagggagcggcgacaggcgacccgtccggcacgggtcccggcggtgcccggtccccccgggctccaggccgctcgccccccgcccctccccttcgctccccgcacagcctctcccgcccctccccacccggctccctcaagtctccacgaacggaaatgggagtcacagcgccggggaccagcggaaacaaaacacagaggcggccgcgggggggcccttgtgggggaaaaggccccggaacgaggccggcccgcgagggcccgcgctcccctcctccccggcggccgcactcacccactccggaatcggccctgtcgcccccgcccgcactccagagccggctgagaacggcagcggcgagggctccacgtgcagcgtctctccgggtaagacctgcagctcccgcgactagaagtgtgaggtcccagggcccttcccgcggaatcggcgctgagaagccccaacccccctcccgcctcccaggcaccttcgggtccaggactacaactcccggcagggtgcgcaaaacgaccgcccaaggcaacggaggctcacgaggtacaaggaagcacaacgccccaatccgctttgttttacacagtctcactttccctgcacctttatacacttcgataaccctaacgaacaggacgctgactcggaggggagcttgaactaggggaaaggccactcaaagagcgcatgcgtacagagcaaggtttcaaggaggggaaaaagaacgggtcaaattaggcgaagaaaagatggcggaggctgtgccaggggacccggaagcacttaccctccacttcctcctcctgtttggcttctgtctcacctagacccgtccggtcgcagactgtctccgagacgcttcctgtccggtgagcgtcgaccgactgaaacggcggcccataatgcattgcgatggcgggtaggcgtgtgggggcggagccagggccggaagtagagcggaggtggtggcggcggaggctttggcagctcgggactgagtgcaagaatcagcatgattcttcagaggctcttcaggttctcctctgtcattcggtcagccgtctcagtccatttgcggaggaacattggtgttacagcagtggcatttaataaggaacttgatcctatacagaaactctttgtggacaagattagagaatacaaatctaagcgacagacatctggaggacctgttgatgctagttcagagtatcagcaagagctggagagggagctttttaagctcaagcaaatgtttggtaatgcagacatgaatacatttcccaccttcaaatttgaagatcccaaatttgaagtcatcgaaaaaccccaggcctgaagaaataaagtagaataaacatgcatttcataactgtcaaatgttcttttaattctgagtccaaataaattatttggtgatgttga

SEQ ID NO: 371335 - DNA, 2192 bp, Homo sapiens
ggatttgaaatgagtgaatcgctgagtcccgcgatgagacagggtctgcattttgctcttaaaatctcgggggcgtcaggaccacatcccagctgagcaggctgagactgctgaggagtgcggacgggcgaggaggggacgcggaaaggagggagcggcgacaggcgacccgtccggcacgggtcccggcggtgcccggtccccccgggctccaggccgctcgccccccgcccctccccttcgctccccgcacagcctctcccgcccctccccacccggctccctcaagtctccacgaacggaaatgggagtcacagcgccggggaccagcggaaacaaaacacagaggcggccgcgggggggcccttgtgggggaaaaggccccggaacgaggccggcccgcgagggcccgcgctcccctcctccccggcggccgcactcacccactccggaatcggccctgtcgcccccgcccgcactccagagccggctgagaacggcagcggcgagggctccacgtgcagcgtctctccgggtaagacctgcagctcccgcgactagaagtgtgaggtcccagggcccttcccgcggaatcggcgctgagaagccccaacccccctcccgcctcccaggcaccttcgggtccaggactacaactcccggcagggtgcgcaaaacgaccgcccaaggcaacggaggctcacgaggtacaaggaagcacaacgccccaatccgctttgttttacacagtctcactttccctgcacctttatacacttcgataaccctaacgaacaggacgctgactcggaggggagcttgaactaggggaaaggccactcaaagagcgcatgcgtacagagcaaggtttcaaggaggggaaaaagaacgggtcaaattaggcgaagaaaagatggcggaggctgtgccaggggacccggaagcacttaccctccacttcctcctcctgtttggcttctgtctcacctagacccgtccggtcgcagactgtctccgagacgcttcctgtccggtgagcgtcgaccgactgaaacggcggcccataatgcattgcgatggcgggtaggcgtgtgggggcggagccagggccggaagtagagcggaggtggtggcggcggaggctttggcagctcgggactgagtgcaagaatcagcatgattcttcagaggctcttcaggttctcctctgtcattcggtcagccgtctcagtccatttgcggaggaacattggtgttacagcagtggcatttaataaggaacttgatcctatacagaaactctttgtggacaagattagagaatacaaatctaagcgacagacatctggaggacctgttgatgctagttcagagtatcagcaagagctggagagggagctttttaagctcaagcaaatgtttggtaatgcagacatgaatacatttcccaccttcaaatttgaaggtacgtcttataaatcacagattcattcttgtgggggataagtgaagaatatttacacttacctggatttttagagaactgaatgacagtgttgacatgtgaatttattaggaccatgacgtgtgcctgagaagctgccggctaaatgtttgctgttagaataagagcagtataggagatcacataacatagtgattaaatggtggggatctgaaatcgaactgcccaatcttgaatccttataatcactttcagctgtgtaatcttgagtaattaactggtgcatgtctcctcatctgacatttggggagaattatagtatcttctgcatatgtagttaaatgacataatatatgccaaagtccattaatggaatgcatggctcatagaaagtgttgcataaatgtttagctatatttctatgtaaatgtttacaaacagtgtttactaaaaaaatcagaaaattgatgagttaaatcttgagcattctacataatccattttattgcaatttggctaagcttgacccttttttccccctcttcttagatcccaaatttgaagtcatcgaaaaaccccaggcctgaagaaataaagtaaaattaatctggtaatttgtcacggattagttgtacaactagttagaagtttcagaataaacatgcatttcataactgtcaaatgttcttttaattctgagtccaaataaattatttggtgatgttga

SEQ ID NO: 371336 - DNA, 2714 bp, Homo sapiens
ggatttgaaatgagtgaatcgctgagtcccgcgatgagacagggtctgcattttgctcttaaaatctcgggggcgtcaggaccacatcccagctgagcaggctgagactgctgaggagtgcggacgggcgaggaggggacgcggaaaggagggagcggcgacaggcgacccgtccggcacgggtcccggcggtgcccggtccccccgggctccaggccgctcgccccccgcccctccccttcgctccccgcacagcctctcccgcccctccccacccggctccctcaagtctccacgaacggaaatgggagtcacagcgccggggaccagcggaaacaaaacacagaggcggccgcgggggggcccttgtgggggaaaaggccccggaacgaggccggcccgcgagggcccgcgctcccctcctccccggcggccgcactcacccactccggaatcggccctgtcgcccccgcccgcactccagagccggctgagaacggcagcggcgagggctccacgtgcagcgtctctccgggtaagacctgcagctcccgcgactagaagtgtgaggtcccagggcccttcccgcggaatcggcgctgagaagccccaacccccctcccgcctcccaggcaccttcgggtccaggactacaactcccggcagggtgcgcaaaacgaccgcccaaggcaacggaggctcacgaggtacaaggaagcacaacgccccaatccgctttgttttacacagtctcactttccctgcacctttatacacttcgataaccctaacgaacaggacgctgactcggaggggagcttgaactaggggaaaggccactcaaagagcgcatgcgtacagagcaaggtttcaaggaggggaaaaagaacgggtcaaattaggcgaagaaaagatggcggaggctgtgccaggggacccggaagcacttaccctccacttcctcctcctgtttggcttctgtctcacctagacccgtccggtcgcagactgtctccgagacgcttcctgtccggtgagcgtcgaccgactgaaacggcggcccataatgcattgcgatggcgggtaggcgtgtgggggcggagccagggccggaagtagagcggaggtggtggcggcggaggctttggcagctcgggactgagtgcaaaggtgactgggagggtagctagatcagcgtggccttttgggactccagttctgggttttttcacgaggcctgggctgcctctcacctttactaggaggagagagcagctctgtgtcctggggaccttcacggcctggcccggggtcacagctgacctctacgtttgtagaccttggagtttgccgtagacccagaaataagatcgataccctctctgagggcaaatcggggcggcgcggggggcagggaggcccgggggtctcgggcccgcagcctggctggggcaacccaaggtcaggcgcgcgggagagattttcggccaggcctacccgccccgggcgcacgggagcgtctaggctacttaggcagaacgtgtaccattaagagggaaaaaattagtcataatattgaaagtttgcatcccacctaaaaacgatggtgctaacacttcattaggcgactttatggattgttcataggaatatgcactgaagaggcagcgaacctactaacctttggccggaatcagcatgattcttcagaggctcttcaggttctcctctgtcattcggtcagccgtctcagtccatttgcggaggaacattggtgttacagcagtggcatttaataaggaacttgatcctatacagaaactctttgtggacaagattagagaatacaaatctaagcgacagacatctggaggacctgttgatgctagttcagagtatcagcaagagctggagagggagctttttaagctcaagcaaatgtttggtaatgcagacatgaatacatttcccaccttcaaatttgaaggtacgtcttataaatcacagattcattcttgtgggggataagtgaagaatatttacacttacctggatttttagagaactgaatgacagtgttgacatgtgaatttattaggaccatgacgtgtgcctgagaagctgccggctaaatgtttgctgttagaataagagcagtataggagatcacataacatagtgattaaatggtggggatctgaaatcgaactgcccaatcttgaatccttataatcactttcagctgtgtaatcttgagtaattaactggtgcatgtctcctcatctgacatttggggagaattatagtatcttctgcatatgtagttaaatgacataatatatgccaaagtccattaatggaatgcatggctcatagaaagtgttgcataaatgtttagctatatttctatgtaaatgtttacaaacagtgtttactaaaaaaatcagaaaattgatgagttaaatcttgagcattctacataatccattttattgcaatttggctaagcttgacccttttttccccctcttcttagatcccaaatttgaagtcatcgaaaaaccccaggcctgaagaaataaagtaaaattaatctggtaatttgtcacggattagttgtacaactagttagaagtttcagaataaacatgcatttcataactgtcaaatgttcttttaattctgagtccaaataaattatttggtgatgttga

SEQ ID NO: 371337 - DNA, 1466 bp, Homo sapiens
ggatttgaaatgagtgaatcgctgagtcccgcgatgagacagggtctgcattttgctcttaaaatctcgggggcgtcaggaccacatcccagctgagcaggctgagactgctgaggagtgcggacgggcgaggaggggacgcggaaaggagggagcggcgacaggcgacccgtccggcacgggtcccggcggtgcccggtccccccgggctccaggccgctcgccccccgcccctccccttcgctccccgcacagcctctcccgcccctccccacccggctccctcaagtctccacgaacggaaatgggagtcacagcgccggggaccagcggaaacaaaacacagaggcggccgcgggggggcccttgtgggggaaaaggccccggaacgaggccggcccgcgagggcccgcgctcccctcctccccggcggccgcactcacccactccggaatcggccctgtcgcccccgcccgcactccagagccggctgagaacggcagcggcgagggctccacgtgcagcgtctctccgggtaagacctgcagctcccgcgactagaagtgtgaggtcccagggcccttcccgcggaatcggcgctgagaagccccaacccccctcccgcctcccaggcaccttcgggtccaggactacaactcccggcagggtgcgcaaaacgaccgcccaaggcaacggaggctcacgaggtacaaggaagcacaacgccccaatccgctttgttttacacagtctcactttccctgcacctttatacacttcgataaccctaacgaacaggacgctgactcggaggggagcttgaactaggggaaaggccactcaaagagcgcatgcgtacagagcaaggtttcaaggaggggaaaaagaacgggtcaaattaggcgaagaaaagatggcggaggctgtgccaggggacccggaagcacttaccctccacttcctcctcctgtttggcttctgtctcacctagacccgtccggtcgcagactgtctccgagacgcttcctgtccggtgagcgtcgaccgactgaaacggcggcccataatgcattgcgatggcgggtaggcgtgtgggggcggagccagggccggaagtagagcggaggtggtggcggcggaggctttggcagctcgggactgagtgcaagaatcagcatgattcttcagaggctcttcaggttctcctctgtcattcggtcagccgtctcagtccatttgcggaggaacattggtgttacagcagtggcatttaataaggaacttgatcctatacagaaactctttgtggacaagattagagaatacaaatctaagcgacagacatctggaggacctgttgatgctagttcagagtatcagcaagagctggagagggagcttttaagtcaagcaatgtttgtaatcagcatgatcattcccacctcaatttgagtcccattgagtgt

SEQ ID NO: 371338 - DNA, 756 bp, Homo sapiens
gcggcccctctactactaaattcgcggccgcgtcgaccgagacgcttcctgtccggtgagcgtcgaccgactgaaacggcggcccataatgcattgcgatggcggaatcagcatgattcttcagaggctcttcaggttctcctctgtcattcggtcagccgtctcagtccatttgcggaggaacattggtgttacagcagtggcatttaataaggaacttgatcctatacagaaactctttgtggacaagattagagaatacaaatctaagcgacagacatctggaggacctgttgatgctagttcagagtatcagcaagagctggagagggagctttttaagctcaagcaaatgtttggtaatgcagacatgaatacatttcccaccttcaaatttgaagatcccaaatttgaagtcatcgaaaaaccccaggcctgaagaaataaagtaaaattaatctggtaatttgtcacggattagttgtacaactagttagaagtttcagaataaacatgcatttcataactgtcaaatgttcttttaattctgagtccaaataaattatttggtgatgttgacaaaaaaaaaaaaaaaaaaaattgtttggcggccggcccgaaaatttttacccctcggtgggcccggggccctggtttgtgccctggcacgtccagagacccggcgcctggtgtggtttcccaaaaaaccggggccggcgttgaccatccggcgtcgggcccggtctccggccggca

SEQ ID NO: 371339 - DNA, 1547 bp, Homo sapiens
ggatttgaaatgagtgaatcgctgagtcccgcgatgagacagggtctgcattttgctcttaaaatctcgggggcgtcaggaccacatcccagctgagcaggctgagactgctgaggagtgcggacgggcgaggaggggacgcggaaaggagggagcggcgacaggcgacccgtccggcacgggtcccggcggtgcccggtccccccgggctccaggccgctcgccccccgcccctccccttcgctccccgcacagcctctcccgcccctccccacccggctccctcaagtctccacgaacggaaatgggagtcacagcgccggggaccagcggaaacaaaacacagaggcggccgcgggggggcccttgtgggggaaaaggccccggaacgaggccggcccgcgagggcccgcgctcccctcctccccggcggccgcactcacccactccggaatcggccctgtcgcccccgcccgcactccagagccggctgagaacggcagcggcgagggctccacgtgcagcgtctctccggggcaccttcgggtccaggactacaactcccggcagggtgcgcaaaacgaccgcccaaggcaacggaggctcacgaggtacaaggaagcacaacgccccaatccgctttgttttacacagtctcactttccctgcacctttatacacttcgataaccctaacgaacaggacgctgactcggaggggagcttgaactaggggaaaggccactcaaagagcgcatgcgtacagagcaaggtttcaaggaggggaaaaagaacgggtcaaattaggcgaagaaaagatggcggaggctgtgccaggggacccggaagcacttaccctccacttcctcctcctgtttggcttctgtctcacctagacccgtccggtcgcagactgtctccgagacgcttcctgtccggtgagcgtcgaccgactgaaacggcggcccataatgcattgcgatggcgggtaggcgtgtgggggcggagccagggccggaagtagagcggaggtggtggcggcggaggctttggcagctcgggactgagtgcaagaatcagcatgattcttcagaggctcttcaggttctcctctgtcattcggtcagccgtctcagtccatttgcggaggaacattggtgttacagcagtggcatttaataaggaacttgatcctatacagaaactctttgtggacaagattagagaatacaaatctaagcgacagacatctggaggacctgttgatgctagttcagagtatcagcaagagctggagagggagctttttaagctcaagcaaatgtttggtaatgcagacatgaatacatttcccaccttcaaatttgaagatcccaaatttgaagtcatcgaaaaaccccaggcctgaagaaataaagtaaaattaatctggtaatttgtcacggattagttgtacaactagttagaagtttcagaataaacatgcatttcataactgtcaaatgttcttttaattctgagtccaaataaattatttggtgatgttga

SEQ ID NO: 371340 - DNA, 1507 bp, Homo sapiens
ggatttgaaatgagtgaatcgctgagtcccgcgatgagacagggtctgcattttgctcttaaaatctcgggggcgtcaggaccacatcccagctgagcaggctgagactgctgaggagtgcggacgggcgaggaggggacgcggaaaggagggagcggcgacaggcgacccgtccggcacgggtcccggcggtgcccggtccccccgggctccaggccgctcgccccccgcccctccccttcgctccccgcacagcctctcccgcccctccccacccggctccctcaagtctccacgaacggaaatgggagtcacagcgccggggaccagcggaaacaaaacacagaggcggccgcgggggggcccttgtgggggaaaaggccccggaacgaggccggcccgcgagggcccgcgctcccctcctccccggcggccgcactcacccactccggaatcggccctgtcgcccccgcccgcactccagagccggctgagaacggcagcggcgagggctccacgtgcagcgtctctccgggtaagacctgcagctcccgcgactagaagtgtgaggtcccagggcccttcccgcggaatcggcgctgagaagccccaacccccctcccgcctcccaggcaccttcgggtccaggactacaactcccggcagggtgcgcaaaacgaccgcccaaggcaacggaggctcacgaggtacaaggaagcacaacgccccaatccgctttgttttacacagtctcactttccctgcacctttatacacttcgataaccctaacgaacaggacgctgactcggaggggagcttgaactaggggaaaggccactcaaagagcgcatgcgtacagagcaaggtttcaaggaggggaaaaagaacgggtcaaattaggcgaagaaaagatggcggaggctgtgccaggggacccggaagcacttaccctccacttcctcctcctgtttggcttctgtctcacctagacccgtccggtcgcagactgtctccgagacgcttcctgtccgaatcagcatgattcttcagaggctcttcaggttctcctctgtcattcggtcagccgtctcagtccatttgcggaggaacattggtgttacagcagtggcatttaataaggaacttgatcctatacagaaactctttgtggacaagattagagaatacaaatctaagcgacagacatctggaggacctgttgatgctagttcagagtatcagcaagagctggagagggagctttttaagctcaagcaaatgtttggtaatgcagacatgaatacatttcccaccttcaaatttgaagatcccaaatttgaagtcatcgaaaaaccccaggcctgaagaaataaagtaaaattaatctggtaatttgtcacggattagttgtacaactagttagaagtttcagaataaacatgcatttcataactgtcaaatgttcttttaattctgagtccaaataaattatttggtgatgttga

SEQ ID NO: 371341 - DNA, 2165 bp, Homo sapiens
ggatttgaaatgagtgaatcgctgagtcccgcgatgagacagggtctgcattttgctcttaaaatctcgggggcgtcaggaccacatcccagctgagcaggctgagactgctgaggagtgcggacgggcgaggaggggacgcggaaaggagggagcggcgacaggcgacccgtccggcacgggtcccggcggtgcccggtccccccgggctccaggccgctcgccccccgcccctccccttcgctccccgcacagcctctcccgcccctccccacccggctccctcaagtctccacgaacggaaatgggagtcacagcgccggggaccagcggaaacaaaacacagaggcggccgcgggggggcccttgtgggggaaaaggccccggaacgaggccggcccgcgagggcccgcgctcccctcctccccggcggccgcactcacccactccggaatcggccctgtcgcccccgcccgcactccagagccggctgagaacggcagcggcgagggctccacgtgcagcgtctctccgggtaagacctgcagctcccgcgactagaagtgtgaggtcccagggcccttcccgcggaatcggcgctgagaagccccaacccccctcccgcctcccaggcaccttcgggtccaggactacaactcccggcagggtgcgcaaaacgaccgcccaaggcaacggaggctcacgaggtacaaggaagcacaacgccccaatccgctttgttttacacagtctcactttccctgcacctttatacacttcgataaccctaacgaacaggacgctgactcggaggggagcttgaactaggggaaaggccactcaaagagcgcatgcgtacagagcaaggtttcaaggaggggaaaaagaacgggtcaaattaggcgaagaaaagatggcggaggctgtgccaggggacccggaagcacttaccctccacttcctcctcctgtttggcttctgtctcacctagacccgtccggtcgcagactgtctccgagacgcttcctgtccggtgagcgtcgaccgactgaaacggcggcccataatgcattgcgatggcgggtaggcgtgtgggggcggagccagggccggaagtagagcggaggtggtggcggcggaggctttggcagctcgggactgagtgcaaaggtgactgggagggtagctagatcagcgtggccttttgggactccagttctgggttttttcacgaggcctgggctgcctctcacctttactaggaggagagagcagctctgtgtcctggggaccttcacggcctggcccggggtcacagctgacctctacgtttgtagaccttggagtttgccgtagacccagaaataagatcgataccctctctgagggcaaatcggggcggcgcggggggcagggaggcccgggggtctcgggcccgcagcctggctggggcaacccaaggtcaggcgcgcgggagagattttcggccaggcctacccgccccgggcgcacgggagcgtctaggctacttaggcagaacgtgtaccattaagagggaaaaaattagtcataatattgaaagtttgcatcccacctaaaaacgatggtgctaacacttcattaggcgactttatggattgttcataggaatatgcactgaagaggcagcgaacctactaacctttggccggaatcagcatgattcttcagaggctcttcaggttctcctctgtcattcggtcagccgtctcagtccatttgcggaggaacattggtgttacagcagtggcatttaataaggaacttgatcctatacagaaactctttgtggacaagattagagaatacaaatctaagcgacagacatctggaggacctgttgatgctagttcagagtatcagcaagagctggagagggagctttttaagctcaagcaaatgtttggtaatgcagacatgaatacatttcccaccttcaaatttgaagatcccaaatttgaagtcatcgaaaaaccccaggcctgaagaaataaagtaaaattaatctggtaatttgtcacggattagttgtacaactagttagaagtttcagaataaacatgcatttcataactgtcaaatgttcttttaattctgagtccaaataaattatttggtgatgttga

SEQ ID NO: 371342 - DNA, 1829 bp, Homo sapiens
  misc_feature (1658)..(1658): n is a, c, g, or t
  misc_feature (1672)..(1672): n is a, c, g, or t
ggatttgaaatgagtgaatcgctgagtcccgcgatgagacagggtctgcattttgctcttaaaatctcgggggcgtcaggaccacatcccagctgagcaggctgagactgctgaggagtgcggacgggcgaggaggggacgcggaaaggagggagcggcgacaggcgacccgtccggcacgggtcccggcggtgcccggtccccccgggctccaggccgctcgccccccgcccctccccttcgctccccgcacagcctctcccgcccctccccacccggctccctcaagtctccacgaacggaaatgggagtcacagcgccggggaccagcggaaacaaaacacagaggcggccgcgggggggcccttgtgggggaaaaggccccggaacgaggccggcccgcgagggcccgcgctcccctcctccccggcggccgcactcacccactccggaatcggccctgtcgcccccgcccgcactccagagccggctgagaacggcagcggcgagggctccacgtgcagcgtctctccgggtaagacctgcagctcccgcgactagaagtgtgaggtcccagggcccttcccgcggaatcggcgctgagaagccccaacccccctcccgcctcccaggcaccttcgggtccaggactacaactcccggcagggtgcgcaaaacgaccgcccaaggcaacggaggctcacgaggtacaaggaagcacaacgccccaatccgctttgttttacacagtctcactttccctgcacctttatacacttcgataaccctaacgaacaggacgctgactcggaggggagcttgaactaggggaaaggccactcaaagagcgcatgcgtacagagcaaggtttcaaggaggggaaaaagaacgggtcaaattaggcgaagaaaagatggcggaggctgtgccaggggacccggaagcacttaccctccacttcctcctcctgtttggcttctgtctcacctagacccgtccggtcgcagactgtctccgagacgcttcctgtccggtgagcgtcgaccgactgaaacggcggcccataatgcattgcgatggcgggtaggcgtgtgggggcggagccagggccggaagtagagcggaggtggtggcggcggaggctttggcagctcgggactgagtgcaagaatcagcatgattcttcagaggctcttcaggttctcctctgtcattcggtcagccgtctcagtccatttgcggaggaacattggtgttacagcagtggcatttaataaggaacttgatcctatacagaaactctttgtggacaagattagagaatacaaatctaagcgacagacatctggaggacctgttgatgctagttcagagtatcagcaagagctggagagggagctttttaagctcaagcaaatgtttggtaatgcagacatgaatacatttcccaccttcaaatttgaagatcccaaatttgaagtcatcgaaaaaccccaggcctgaagaaataaagtaaaattaatctggtaatttgtcacggattagttgtacaactagttagaagtttcagaataaacatgcatttcataactgtcaaaaaaaaaaaaaaaaaaaaaaaaaaaaaaaaaaaaaaaaaaaaaaaaaaaaaaaaaaaaaanaaaaaaaaaaaaancaagtttttgcttgcggccgaaattgggcgctattggcccaattccccctatggggagcggtttacatccacgggccggggttaacaggggggaatgggaaacccttggggttccaaattatgccttgggaaaaaccccttttcgcggggggggaac

SEQ ID NO: 371343 - DNA, 1550 bp, Homo sapiens
  misc_feature (1495)..(1495): n is a, c, g, or t
  misc_feature (1524)..(1524): n is a, c, g, or t
  misc_feature (1530)..(1530): n is a, c, g, or t
  misc_feature (1549)..(1550): n is a, c, g, or t
ggatttgaaatgagtgaatcgctgagtcccgcgatgagacagggtctgcattttgctcttaaaatctcgggggcgtcaggaccacatcccagctgagcaggctgagactgctgaggagtgcggacgggcgaggaggggacgcggaaaggagggagcggcgacaggcgacccgtccggcacgggtcccggcggtgcccggtccccccgggctccaggccgctcgccccccgcccctccccttcgctccccgcacagcctctcccgcccctccccacccggctccctcaagtctccacgaacggaaatgggagtcacagcgccggggaccagcggaaacaaaacacagaggcggccgcgggggggcccttgtgggggaaaaggccccggaacgaggccggcccgcgagggcccgcgctcccctcctccccggcggccgcactcacccactccggaatcggccctgtcgcccccgcccgcactccagagccggctgagaacggcagcggcgagggctccacgtgcagcgtctctccgggtaagacctgcagctcccgcgactagaagtgtgaggtcccagggcccttcccgcggaatcggcgctgagaagccccaacccccctcccgcctcccaggcaccttcgggtccaggactacaactcccggcagggtgcgcaaaacgaccgcccaaggcaacggaggctcacgaggtacaaggaagcacaacgccccaatccgctttgttttacacagtctcactttccctgcacctttatacacttcgataaccctaacgaacaggacgctgactcggaggggagcttgaactaggggaaaggccactcaaagagcgcatgcgtacagagcaaggtttcaaggaggggaaaaagaacgggtcaaattaggcgaagaaaagatggcggaggctgtgccaggggacccggaagcacttaccctccacttcctcctcctgtttggcttctgtctcacctagacccgtccggtcgcagactgtctccgagacgcttcctgtccggtgagcgtcgaccgactgaaacggcggcccataatgcattgcgatggcgggtaggcgtgtgggggcggagccagggccggaagtagagcggaggtggtggcggcggaggctttggcagctcgggactgagtgcaagaatcagcatgattcttcagaggctcttcaggttctcctctgtcattcggtcagccgtctcagtccatttgcggaggaacattggtgttacagcagtggcatttaataaggaacttgatcctatacagaaactctttgtggacaagattagagaatacaaatctaagcgacagacatctggaggacctgttgatgctagttcagagtatcagcaagagctggagagggagctttttaagctcaagcaaatgtttggtaatgcagacatgaatacatttcccaccttcaaatttgaagatcccaaatttgaagtcatcgattacccgncccaccagtcgaaccttcagaataccccncatttnacaccggcacaagctcccnn

SEQ ID NO: 371344 - DNA, 518 bp, Homo sapiens
gacttagtatgcggcacactgaagggcttgttctgattgcgaggggaggtgcttgccccgtcagcccctgattctttcccagacatgtcaggaataggagaatcctccataggggatataatattttcctccaccagggcctgcaggaggcgctgcgtcagggctatacagaaactctttgtggacaagattagagaatacaaatctaagcgacagacatctggaggacctgttgatgctagttcagagtatcagcaagagctggagagggagctttttaagctcaagcaaatgtttggtaatgcagacatgaatacatttcccaccttcaaatttgaagatcccaaatttgaagtcatcgaaaaaccccaggcctgaagaaataaagtaaaattaatctggtaatttgtcacggattagttgtacaactagttagaagtttcagaataaacatgcatttcataactgtcaaatgttcttttaattctgagtccaaataaattatttggtgatgttga

SEQ ID NO: 371345 - DNA, 2237 bp, Homo sapiens
ggatttgaaatgagtgaatcgctgagtcccgcgatgagacagggtctgcattttgctcttaaaatctcgggggcgtcaggaccacatcccagctgagcaggctgagactgctgaggagtgcggacgggcgaggaggggacgcggaaaggagggagcggcgacaggcgacccgtccggcacgggtcccggcggtgcccggtccccccgggctccaggccgctcgccccccgcccctccccttcgctccccgcacagcctctcccgcccctccccacccggctccctcaagtctccacgaacggaaatgggagtcacagcgccggggaccagcggaaacaaaacacagaggcggccgcgggggggcccttgtgggggaaaaggccccggaacgaggccggcccgcgagggcccgcgctcccctcctccccggcggccgcactcacccactccggaatcggccctgtcgcccccgcccgcactccagagccggctgagaacggcagcggcgagggctccacgtgcagcgtctctccgggtaagacctgcagctcccgcgactagaagtgtgaggtcccagggcccttcccgcggaatcggcgctgagaagccccaacccccctcccgcctcccaggcaccttcgggtccaggactacaactcccggcagggtgcgcaaaacgaccgcccaaggcaacggaggctcacgaggtacaaggaagcacaacgccccaatccgctttgttttacacagtctcactttccctgcacctttatacacttcgataaccctaacgaacaggacgctgactcggaggggagcttgaactaggggaaaggccactcaaagagcgcatgcgtacagagcaaggtttcaaggaggggaaaaagaacgggtcaaattaggcgaagaaaagatggcggaggctgtgccaggggacccggaagcacttaccctccacttcctcctcctgtttggcttctgtctcacctagacccgtccggtcgcagactgtctccgagacgcttcctgtccggtgagcgtcgaccgactgaaacggcggcccataatgcattgcgatggcgggtaggcgtgtgggggcggagccagggccggaagtagagcggaggtggtggcggcggaggctttggcagctcgggactgagtgcaaaggaatatgcactgaagaggcagcgaacctactaacctttggccggaatcagcatgattcttcagaggctcttcaggttctcctctgtcattcggtcagccgtctcagtccatttgcggaggaacattggtgttacagcagtggcatttaataaggaacttgatcctatacagaaactctttgtggacaagattagagaatacaaatctaagcgacagacatctggaggacctgttgatgctagttcagagtatcagcaagagctggagagggagctttttaagctcaagcaaatgtttggtaatgcagacatgaatacatttcccaccttcaaatttgaaggtacgtcttataaatcacagattcattcttgtgggggataagtgaagaatatttacacttacctggatttttagagaactgaatgacagtgttgacatgtgaatttattaggaccatgacgtgtgcctgagaagctgccggctaaatgtttgctgttagaataagagcagtataggagatcacataacatagtgattaaatggtggggatctgaaatcgaactgcccaatcttgaatccttataatcactttcagctgtgtaatcttgagtaattaactggtgcatgtctcctcatctgacatttggggagaattatagtatcttctgcatatgtagttaaatgacataatatatgccaaagtccattaatggaatgcatggctcatagaaagtgttgcataaatgtttagctatatttctatgtaaatgtttacaaacagtgtttactaaaaaaatcagaaaattgatgagttaaatcttgagcattctacataatccattttattgcaatttggctaagcttgacccttttttccccctcttcttagatcccaaatttgaagtcatcgaaaaaccccaggcctgaagaaataaagtaaaattaatctggtaatttgtcacggattagttgtacaactagttagaagtttcagaataaacatgcatttcataactgtcaaatgttcttttaattctgagtccaaataaattatttggtgatgttga

SEQ ID NO: 371346 - DNA, 1857 bp, Homo sapiens
ggatttgaaatgagtgaatcgctgagtcccgcgatgagacagggtctgcattttgctcttaaaatctcgggggcgtcaggaccacatcccagctgagcaggctgagactgctgaggagtgcggacgggcgaggaggggacgcggaaaggagggagcggcgacaggcgacccgtccggcacgggtcccggcggtgcccggtccccccgggctccaggccgctcgccccccgcccctccccttcgctccccgcacagcctctcccgcccctccccacccggctccctcaagtctccacgaacggaaatgggagtcacagcgccggggaccagcggaaacaaaacacagaggcggccgcgggggggcccttgtgggggaaaaggccccggaacgaggccggcccgcgagggcccgcgctcccctcctccccggcggccgcactcacccactccggaatcggccctgtcgcccccgcccgcactccagagccggctgagaacggcagcggcgagggctccacgtgcagcgtctctccgggtaagacctgcagctcccgcgactagaagtgtgaggtcccagggcccttcccgcggaatcggcgctgagaagccccaacccccctcccgcctcccaggcaccttcgggtccaggactacaactcccggcagggtgcgcaaaacgaccgcccaaggcaacggaggctcacgaggtacaaggaagcacaacgccccaatccgctttgttttacacagtctcactttccctgcacctttatacacttcgataaccctaacgaacaggacgctgactcggaggggagcttgaactaggggaaaggccactcaaagagcgcatgcgtacagagcaaggtttcaaggaggggaaaaagaacgggtcaaattaggcgaagaaaagatggcggaggctgtgccaggggacccggaagcacttaccctccacttcctcctcctgtttggcttctgtctcacctagacccgtccggtcgcagactgtctccgagacgcttcctgtccgaatcagcatgattcttcagaggctcttcaggttctcctctgtcattcggtcagccgtctcagtccatttgcggaggaacattggtgttacagcagtggcatttaataaggaacttgatcctatacagaaactctttgtggacaagattagagaatacaaatctaagcgacagacatctggaggacctgttgatgctagttcagagtatcagcaagagctggagagggagctttttaagctcaagcaaatgtttggtaatgcagacatgaatacatttcccaccttcaaatttgaagagcatttttctcagcatttgagaagttggcagccatccagagatgatgacattctaatcttaagcagctaaccagcagctagccttgtagctacagaagaaaatgtttgccgatccctgactcgcggtgaaaattttattttgggggcagagccatgttacagaagcccgacctcccaggaagggatctggtgagagacatagcatgtcatagacaagtcaaagggggagcatcttcccggtggcctggtgtcccaggcacatgctaggcactcagtgggtgcttaatccatttgttcggtgaatcctggggatttcttcgccaattgggtagaaagagcagactcttttgaaagaagattaacctgcccagtgcagtggctcatgcctataatcccagcactttgggaggctgatgggggtggatcatttgaggtcagaggtttgagaccagcctggccaacatggtgaaacccttctctactaaaatacaaaaattagccaggtgtggtggtacacgcctataatc

SEQ ID NO: 371347 - DNA, 1444 bp, Homo sapiens
ggatttgaaatgagtgaatcgctgagtcccgcgatgagacagggtctgcattttgctcttaaaatctcgggggcgtcaggaccacatcccagctgagcaggctgagactgctgaggagtgcggacgggcgaggaggggacgcggaaaggagggagcggcgacaggcgacccgtccggcacgggtcccggcggtgcccggtccccccgggctccaggccgctcgccccccgcccctccccttcgctccccgcacagcctctcccgcccctccccacccggctccctcaagtctccacgaacggaaatgggagtcacagcgccggggaccagcggaaacaaaacacagaggcggccgcgggggggcccttgtgggggaaaaggccccggaacgaggccggcccgcgagggcccgcgctcccctcctccccggcggccgcactcacccactccggaatcggccctgtcgcccccgcccgcactccagagccggctgagaacggcagcggcgagggctccacgtgcagcgtctctccgggtaagacctgcagctcccgcgactagaagtgtgaggtcccagggcccttcccgcggaatcggcgctgagaagccccaacccccctcccgcctcccaggcaccttcgggtccaggactacaactcccggcagggtgcgcaaaacgaccgcccaaggcaacggaggctcacgaggtacaaggaagcacaacgccccaatccgctttgttttacacagtctcactttccctgcacctttatacacttcgataaccctaacgaacaggacgctgactcggaggggagcttgaactaggggaaaggccactcaaagagcgcatgcgtacagagcaaggtttcaaggaggggaaaaagaacgggtcaaattaggcgaagaaaagatggcggaggctgtgccaggggacccggaagcacttaccctccacttcctcctcctgtttggcttctgtctcacctagacccgtccggtcgcagactgtctccgagacgcttcctgtccgaatcagcatgattcttcagaggctcttcaggttctcctctgtcattcggtcagccgtctcagtccatttgcggaggaacattggtgttacagcagtggcatttaataaggaacttgatcctatacagaaactctttgtggacaagattagagaatacaaatctaagcgacataagctcaagcaaatgtttggtaatgcagacatgaatacatttcccaccttcaaatttgaagatcccaaatttgaagtcatcgaaaaaccccaggcctgaagaaataaagtaaaattaatctggtaatttgtcacggattagttgtacaactagttagaagtttcagaataaacatgcatttcataactgtcaaatgttcttttaattctgagtccaaataaattatttggtgatgttga

SEQ ID NO: 371348 - DNA, 1452 bp, Homo sapiens
  misc_feature (1357)..(1357): n is a, c, g, or t
ggatttgaaatgagtgaatcgctgagtcccgcgatgagacagggtctgcattttgctcttaaaatctcgggggcgtcaggaccacatcccagctgagcaggctgagactgctgaggagtgcggacgggcgaggaggggacgcggaaaggagggagcggcgacaggcgacccgtccggcacgggtcccggcggtgcccggtccccccgggctccaggccgctcgccccccgcccctccccttcgctccccgcacagcctctcccgcccctccccacccggctccctcaagtctccacgaacggaaatgggagtcacagcgccggggaccagcggaaacaaaacacagaggcggccgcgggggggcccttgtgggggaaaaggccccggaacgaggccggcccgcgagggcccgcgctcccctcctccccggcggccgcactcacccactccggaatcggccctgtcgcccccgcccgcactccagagccggctgagaacggcagcggcgagggctccacgtgcagcgtctctccgggtaagacctgcagctcccgcgactagaagtgtgaggtcccagggcccttcccgcggaatcggcgctgagaagccccaacccccctcccgcctcccaggcaccttcgggtccaggactacaactcccggcagggtgcgcaaaacgaccgcccaaggcaacggaggctcacgaggtacaaggaagcacaacgccccaatccgctttgttttacacagtctcactttccctgcacctttatacacttcgataaccctaacgaacaggacgctgactcggaggggagcttgaactaggggaaaggccactcaaagagcgcatgcgtacagagcaaggtttcaaggaggggaaaaagaacgggtcaaattaggcgaagaaaagatggcggaggctgtgccaggggacccggaagcacttaccctccacttcctcctcctgtttggcttctgtctcacctagacccgtccggtcgcagactgtctccgagacgcttcctgtccgaatcagcatgattcttcagaggctcttcaggttctcctctgtcattcggtcagccgtctcagtccatttgcggaggaacattggtgttacagcagtggcatttaataaggaacttgatcctatacagaaactctttgtggacaagattagagaatacaaatctaagcgacacccttccgcagcccctgtggatgaaagtttttagtcatcaccgtatggggtgagagcaattgttttaggatcaagcaagtgtttggtgagtgtgacattaataagtttccctcatttttgtttcaaggtcgcttatttgtagtggtttttaanaccccaggcctgcaattgtaaagtacaattaatatggtcatgtggcacgccccacctgtgcttttaaaaaacagcatcaaaatttttttgcgttt

SEQ ID NO: 371349 - DNA, 1676 bp, Homo sapiens
ggatttgaaatgagtgaatcgctgagtcccgcgatgagacagggtctgcattttgctcttaaaatctcgggggcgtcaggaccacatcccagctgagcaggctgagactgctgaggagtgcggacgggcgaggaggggacgcggaaaggagggagcggcgacaggcgacccgtccggcacgggtcccggcggtgcccggtccccccgggctccaggccgctcgccccccgcccctccccttcgctccccgcacagcctctcccgcccctccccacccggctccctcaagtctccacgaacggaaatgggagtcacagcgccggggaccagcggaaacaaaacacagaggcggccgcgggggggcccttgtgggggaaaaggccccggaacgaggccggcccgcgagggcccgcgctcccctcctccccggcggccgcactcacccactccggaatcggccctgtcgcccccgcccgcactccagagccggctgagaacggcagcggcgagggctccacgtgcagcgtctctccgggtaagacctgcagctcccgcgactagaagtgtgaggtcccagggcccttcccgcggaatcggcgctgagaagccccaacccccctcccgcctcccaggcaccttcgggtccaggactacaactcccggcagggtgcgcggctcttcaggttctcctctgtcattcggtcagccgtctcagtccatttgcggaggaacattggtgttacagcagtggcatttaataaggaacttgatcctatacagaaactctttgtggacaagattagagaatacaaatctaagcgacagacatctggaggacctgttgatgctagttcagagtatcagcaagagctggagagggagctttttaagctcaagcaaatgtttggtaatgcagacatgaatacatttcccaccttcaaatttgaaggtacgtcttataaatcacagattcattcttgtgggggataagtgaagaatatttacacttacctggatttttagagaactgaatgacagtgttgacatgtgaatttattaggaccatgacgtgtgcctgagaagctgccggctaaatgtttgctgttagaataagagcagtataggagatcacataacatagtgattaaatggtggggatctgaaatcgaactgcccaatcttgaatccttataatcactttcagctgtgtaatcttgagtaattaactggtgcatgtctcctcatctgacatttggggagaattatagtatcttctgcatatgtagttaaatgacataatatatgccaaagtccattaatggaatgcatggctcatagaaagtgttgcataaatgtttagctatatttctatgtaaatgtttacaaacagtgtttactaaaaaaatcagaaaattgatgagttaaatcttgagcattctacataatccattttattgcaatttggctaagcttgacccttttttccccctcttcttagatcccaaatttgaagtcatcgaaaaaccccaggcctgaagaaataaagtaaaattaatctggtaatttgtcacggattagttgtacaactagttagaagtttcagaataaacatgcatttcataactgtcaaatgttcttttaattctgagtccaaataaattatttggtgatgttga

SEQ ID NO: 371350 - DNA, 3514 bp, Homo sapiens
cacagggagcctgggctggaagaggcagcaaaagggaaaatcagaagagtggacactggcaagaggagggcagcctttttcccagcttccttgcaccatggacagctcccattaagccacctctccatcctggggccaggactcttatgccccattcctgtcaaattgagatttcatccaccattctccaaggacagtgaagttataccctagttccagtgttgggatcagtggcccctctggacatgcctctcctggaaggttctgtgggggtggaggatcttgtcctcctggaacccttggtggaggagtcactgctcaagaatcttcagcttcgctatgaaaacaaggagatttatacctacattgggaatgtggtgatctcagtgaatccctatcaacagcttcccatctatgggccagagttcattgccaaatatcaagactatactttctatgagctgaagccccatatctacgcattggcaaatgtggcgtaccagtcactgagggacagggaccgagaccagtgtatcctcatcacaggcgagagtggatcagggaagactgaggccagcaagctggtgatgtcttatgtggctgccgtctgtgggaaaggagagcaggtgaactctgtgaaggagcagctgctacagtctaacccagtgctggaggcttttggcaatgccaagaccattcgcaacaacaattcctcccgatttggaaaatacatggatattgaatttgacttcaagggatcccccctcggtggtgtcatcacaaactatctgcttgagaaatcccgattagtgaagcagctcaaaggagaaaggaacttccacatcttctatcagctgctggctggagcagatgaacagctgctgaaggccctgaagcttgagcgggatacaactggctatgcctatctgaatcatgaagtatccagagtggatggcatggacgacgcctccagcttcagggctgtacagagtgcaatggcagtgattgggttctcggaggaggagattcgacaagtgctagaggtgacatccatggtgctaaagctggggaacgtgttggtggctgatgagttccaggccagtgggataccagcaagtggcatccgtgatgggagaggtgttcgggagattggggagatggtgggcttgaattcagaagaagtagagagagctttgtgctcgaggaccatggaaacagccaaggaaaaggtggtcactgcactgaatgttatgcaggctcagtatgctcgggacgccctggctaagaacatctacagccgcctctttgactggatagtgaatcgaatcaatgagagcatcaaggtgggcatcggggaaaagaagaaggtaatgggagtccttgatatctacggttttgagatattagaggataatagctttgagcaatttgtgatcaactactgcaatgagaagctgcagcaggtgttcatagagatgaccctgaaagaagagcaagaggaatataagagagaaggcataccgtggacaaaggtggactactttgataatggcatcatttgtaagctcattgagcataatcagcgaggtatcctggccatgttggatgaggagtgcctgcggcctggggtggtcagtgactccactttcctagcaaagctgaaccagctcttctccaagcatggccactacgagagcaaagtcacccagaatgcccagcgtcagtatgaccacaccatgggcctcagctgcttccgcatctgccactatgcgggcaaggtgacatacaacgtgaccagctttattgacaagaataatgacctactcttccgagacctgttgcaggccatgtggaaggcccagcaccccctccttcggtccttgtttcctgagggcaatcctaagcaggcatctctcaaacgccccccgactgctggggcccagttcaagagttctgtggccatcctcatgaagaatctgtattccaagagccccaactacatcaggtgcataaagcccaatgagcatcagcagcgaggtcagttctcttcagacctggtggcaacccaggctcggtacctgggactgctggagaacgtacgggtgcgacgggcaggctatgcccaccgccagggttatgggcccttcctggaaaggtaccgattgctgagccggagcacctggcctcactggaatgggggagaccgggaaggtgttgagaaggtcctgggggagctgagcatgtcctcgggggagctggcctttggcaagacaaagatcttcattagaagccccaagactcttttctacctcgaagaacagaggcgcctgagactccagcagctggccacactcatacagaagatttaccgaggctggcgctgccgcacccactaccaactgatgcgaaagagtcagatcctcatctcctcttggtttcggggaaacatgcaaaagaaatgctatgggaagataaaggcatccgtgttattgatccaggcttttgtgagagggtggaaggcccgaaagaattatcgcaaatatttccggtcagaggctgccctcaccttggcagatttcatctacaagagcatggtacagaaattcctactggggctgaagaacaatttgccatccacaaacgtcttagacaagacatggccagccgccccctacaagtgcctcagcacagcaaatcaggagctgcagcagctcttctaccagtggaagtgcaagaggttccgggatcagctgtccccgaagcaggtagagatcctgagggaaaagctctgtgccagtgaactgttcaagggcaagaaggcttcatatccccagagtgtccccattccattctgtggtgactacattgggctgcaagggaaccccaagctgcagaagctgaaaggcggggaggaggggcctgttctgatggcagaggccgtgaagaaggtcaatcgtggcaatggcaagacttcttctcggattctcctcctgaccaagggccatgtgattctcacagacaccaagaagtcccaggccaaaattgtcattgggctagacaatgtggctggggtgtcagtcaccagcctcaaggatgggctctttagcttgcatctgagtgagatgtcatcggtgggctccaagggggacttcctgctggtcagcgagcatgtgattgaactgctgaccaaaatgtaccgggctgtgctggatgccacgcagaggcagcttacagtcaccgtgactgagaagttctcagtgaggttcaaggagaacagtgtggctgtcaaggtcgtccagggccctgcaggtggtgacaacagcaagctacgctacaaaaaaaaggggagtcattgcttggaggtgactgtgcagtgaggagggggcaccatgcagagatggcagttgcttcctcctgaaccagcactaatccccctctgccctcctgtgtgggaggatctctaacccctctgatcgtggcgcatggcttggggattaaactacccttgaagagg

SEQ ID NO: 371351 - DNA, 3543 bp, Homo sapiens
cacagggagcctgggctggaagaggcagcaaaagggaaaatcagaagagtggacactggcaagaggagggcagcctttttcccagcttccttgcaccatggacagctcccattaagccacctctccatcctggggccaggactcttatgccccattcctgtcaaattgagatttcatccaccattctccaaggacagtgaagttataccctagttccagtgttgggatcagtggcccctctggacatgcctctcctggaaggttctgtgggggtggaggatcttgtcctcctggaacccttggtggaggagtcactgctcaagaatcttcagcttcgctatgaaaacaaggagatttatacctacattgggaatgtggtgatctcagtgaatccctatcaacagcttcccatctatgggccagagttcattgccaaatatcaagactatactttctatgagctgaagccccatatctacgcattggcaaatgtggcgtaccagtcactgagggacagggaccgagaccagtgtatcctcatcacaggcgagagtggatcagggaagactgaggccagcaagctggtgatgtcttatgtggctgccgtctgtgggaaaggagagcaggtgaactctgtgaaggagcagctgctacagtctaacccagtgctggaggcttttggcaatgccaagaccattcgcaacaacaattcctcccgatttggaaaatacatggatattgaatttgacttcaagggatcccccctcggtggtgtcatcacaaactatctgcttgagaaatcccgattagtgaagcagctcaaaggagaaaggaacttccacatcttctatcagctgctggctggagcagatgaacagctgctgaaggccctgaagcttgagcgggatacaactggctatgcctatctgaatcatgaagtatccagagtggatggcatggacgacgcctccagcttcagggctgtacagagtgcaatggcagtgattgggttctcggaggaggagattcgacaagtgctagaggtgacatccatggtgctaaagctggggaacgtgttggtggctgatgagttccaggccagtgggataccagcaagtggcatccgtgatgggagaggtgttcgggagattggggagatggtgggcttgaattcagaagaagtagagagagctttgtgctcgaggaccatggaaacagccaaggaaaaggtggtcactgcactgaatgttatgcaggctcagtatgctcgggacgccctggctaagaacatctacagccgcctctttgactggatagtgaatcgaatcaatgagagcatcaaggtgggcatcggggaaaagaagaaggtaatgggagtccttgatatctacggttttgagatattagaggataatagctttgagcaatttgtgatcaactactgcaatgagaagctgcagcaggtgttcatagagatgaccctgaaagaagagcaagaggaatataagagagaaggcataccgtggacaaaggtggactactttgataatggcatcatttgtaagctcattgagcataatcagcgaggtatcctggccatgttggatgaggagtgcctgcggcctggggtggtcagtgactccactttcctagcaaagctgaaccagctcttctccaagcatggccactacgagagcaaagtcacccagaatgcccagcgtcagtatgaccacaccatgggcctcagctgcttccgcatctgccactatgcgggcaaggtgacatacaacgtgaccagctttattgacaagaataatgacctactcttccgagacctgttgcaggccatgtggaaggcccagcaccccctccttcggtccttgtttcctgagggcaatcctaagcaggcatctctcaaacgccccccgactgctggggcccagttcaagagttctgtggccatcctcatgaagaatctgtattccaagagccccaactacatcaggtgcataaagcccaatgagcatcagcagcgaggtcagttctcttcagacctggtggcaacccaggctcggtacctgggactgctggagaacgtacgggtgcgacgggcaggctatgcccaccgccagggttatgggcccttcctggaaaggtaccgattgctgagccggagcacctggcctcactggaatgggggagaccgggaaggtgttgagaaggtcctgggggagctgagcatgtcctcgggggagctggcctttggcaagacaaagatcttcattagaagccccaagactcttttctacctcgaagaacagaggcgcctgagactccagcagctggccacactcatacagaagatttaccgaggctggcgctgccgcacccactaccaactgatgcgaaagagtcagatcctcatctcctcttggtttcggggaaacatggcccgaaagaattatcgcaaatatttccggtcagaggctgccctcaccttggcagatttcatctacaagagcatggtacagaaattcctactggggctgaagaacaatttgccatccacaaacgtcttagacaagacatggccagccgccccctacaagtgcctcagcacagcaaatcaggagctgcagcagctcttctaccagtggaagtgcaagaggttccgggatcagctgtccccgaagcaggtagagatcctgagggaaaagctctgtgccagtgaactgttcaagggcaagaaggcttcatatccccagagtgtccccattccattctgtggtgactacattgggctgcaagggaaccccaagctgcagaagctgaaaggcggggaggaggggcctgttctgatggcagaggccgtgaagaaggtcaatcgtggcaatggcaagacttcttctcggattctcctcctgaccaagggccatgtgattctcacagacaccaagaagtcccaggccaaaattgtcattgggctagacaatgtggctggggtgtcagtcaccagcctcaaggatgggctctttagcttgcatctgagtgagatgtcatcggtgggctccaagggggacttcctgctggtcagcgagcatgtgattgaactgctgaccaaaatgtaccgggctgtgctggatgccacgcagaggcagcttacagtcaccgtgactgagaagttctcagtgaggttcaaggagaacagtgtggctgtcaaggtcgtccagggccctgcaggtggtgacaacagcaagctacgctacaaaaaaaaggggagtcattgcttggaggtgactgtgcagtgaggagggggcaccatgcagagatggcagttgcttcctcctgaaccagcactaatccccctctgccctcctgtgtgggaggatctctaacccctctgatcgtggcgcatggcttggggattaaactacccttgaagaggacccttgtcccaaacccttcttgttctctcctccaaaagtagcttcctccaacccgcagcctctctgcacactaataaaacatgtggcttggaaaggt

SEQ ID NO: 371352 - DNA, 380 bp, Homo sapiens
atagtgaatcgaatcaatgagagcatcaaggcaagtggccgctctgctttctccatgctctcctgtctgcctcaccttcctgccctgtcaccagccctatatcttggtttctgagatgagcagagtagggaggatgatggggagggtacagttccttctaacagtgtgttgtcatggaaacatcactggcttttgagttagacaatctggatatatcatctacttacttaattcaaagtcatgtggactttcaattaagtaaaaagtcatgtggactttcaatttcacaaaggttctgggcctcagtgtcctgatttggaaatgcccactaagaaacactaatatgctgggtgtggtggtccatgcctgtaatcccagga

SEQ ID NO: 371353 - DNA, 275 bp, Homo sapiens
acaacaacaaaaattagtctatcatcacaggaattaatgatcccaaaacaaaggaggcaggggaagaacccaaaacaaaaatgactcctttggataagtgaatgaatccattagggcaagggctgtgaggtgtcaaggctggagggctccagagagcctgggtactaaccatcttccccaacactggccctcccagaggccctgaagcttgagcgggatacaactggctatgcctatctgaatcatgaagtatccagagtggatggcatggacga

SEQ ID NO: 371354 - DNA, 209 bp, Homo sapiens
gctgaactcctcccgcagctagtgcagagctgtgggctggcatctggagagcagatggcaggctgtgtttgcgccctgccaggtggagtgggggcaattaatcctgcctttcctcacccttgcctgttccgtccctagacttcttctcggattctcctcctgaccaagggccatgtgattctcacagacaccaagaagtcccaggccaa

SEQ ID NO: 371355 - DNA, 352 bp, Homo sapiens
atcagccggtccatgtgtgggtgggtgtctgggagtgagaggcctgtaggggagacctgtagaggtgtctgggtgggtagatgcctaacttggcagcagaactttgccttctgctctaagtgtcctcactgccaacttgtctgattttacttccaacttccagctacagtctcagctctttatcttactcaggtctttgcgtggttgaaaaatagtacaacctcttctagaatctgcctgtcttcactttggctcctttcttgtacttttctgccaggcccgaaagaattatcgcaaatatttccggtcagaggctgccctcaccttggcagatttcatctacaagagcatg

SEQ ID NO: 371356 - DNA, 3612 bp, Homo sapiens
cacagggagcctgggctggaagaggcagcaaaagggaaaatcagaagagtggacactggcaagaggagggcagcctttttcccagcttccttgcaccatggacagctcccattaagccacctctccatcctggggccaggactcttatgccccattcctgtcaaattgagatttcatccaccattctccaaggacagtgaagttataccctagttccagtgttgggatcagtggcccctctggacatgcctctcctggaaggttctgtgggggtggaggatcttgtcctcctggaacccttggtggaggagtcactgctcaagaatcttcagcttcgctatgaaaacaaggagatttatacctacattgggaatgtggtgatctcagtgaatccctatcaacagcttcccatctatgggccagagttcattgccaaatatcaagactatactttctatgagctgaagccccatatctacgcattggcaaatgtggcgtaccagtcactgagggacagggaccgagaccagtgtatcctcatcacaggcgagagtggatcagggaagactgaggccagcaagctggtgatgtcttatgtggctgccgtctgtgggaaaggagagcaggtgaactctgtgaaggagcagctgctacagtctaacccagtgctggaggcttttggcaatgccaagaccattcgcaacaacaattcctcccgatttggaaaatacatggatattgaatttgacttcaagggatcccccctcggtggtgtcatcacaaactatctgcttgagaaatcccgattagtgaagcagctcaaaggagaaaggaacttccacatcttctatcagctgctggctggagcagatgaacagctgctgaaggccctgaagcttgagcgggatacaactggctatgcctatctgaatcatgaagtatccagagtggatggcatggacgacgcctccagcttcagggctgtacagagtgcaatggcagtgattgggttctcggaggaggagattcgacaagtgctagaggtgacatccatggtgctaaagctggggaacgtgttggtggctgatgagttccaggccagtgggataccagcaagtggcatccgtgatgggagaggtgttcgggagattggggagatggtgggcttgaattcagaagaagtagagagagctttgtgctcgaggaccatggaaacagccaaggaaaaggtggtcactgcactgaatgttatgcaggctcagtatgctcgggacgccctggctaagaacatctacagccgcctctttgactggatagtgaatcgaatcaatgagagcatcaaggtgggcatcggggaaaagaagaaggtaatgggagtccttgatatctacggttttgagatattagaggataatagctttgagcaatttgtgatcaactactgcaatgagaagctgcagcaggtgttcatagagatgaccctgaaagaagagcaagaggaatataagagagaaggcataccgtggacaaaggtggactactttgataatggcatcatttgtaagctcattgagcataatcagcgaggtatcctggccatgttggatgaggagtgcctgcggcctggggtggtcagtgactccactttcctagcaaagctgaaccagctcttctccaagcatggccactacgagagcaaagtcacccagaatgcccagcgtcagtatgaccacaccatgggcctcagctgcttccgcatctgccactatgcgggcaaggtgacatacaacgtgaccagctttattgacaagaataatgacctactcttccgagacctgttgcaggccatgtggaaggcccagcaccccctccttcggtccttgtttcctgagggcaatcctaagcaggcatctctcaaacgccccccgactgctggggcccagttcaagagttctgtggccatcctcatgaagaatctgtattccaagagccccaactacatcaggtgcataaagcccaatgagcatcagcagcgaggtcagttctcttcagacctggtggcaacccaggctcggtacctgggactgctggagaacgtacgggtgcgacgggcaggctatgcccaccgccagggttatgggcccttcctggaaaggtaccgattgctgagccggagcacctggcctcactggaatgggggagaccgggaaggtgttgagaaggtcctgggggagctgagcatgtcctcgggggagctggcctttggcaagacaaagatcttcattagaagccccaagactcttttctacctcgaagaacagaggcgcctgagactccagcagctggccacactcatacagaagatttaccgaggctggcgctgccgcacccactaccaactgatgcgaaagagtcagatcctcatctcctcttggtttcggggaaacatgcaaaagaaatgctatgggaagataaaggcatccgtgttattgatccaggcttttgtgagagggtggaaggcccgaaagaattatcgcaaatatttccggtcagaggctgccctcaccttggcagatttcatctacaagagcatggtacagaaattcctactggggctgaagaacaatttgccatccacaaacgtcttagacaagacatggccagccgccccctacaagtgcctcagcacagcaaatcaggagctgcagcagctcttctaccagtggaagtgcaagaggttccgggatcagctgtccccgaagcaggtagagatcctgagggaaaagctctgtgccagtgaactgttcaagggcaagaaggcttcatatccccagagtgtccccattccattctgtggtgactacattgggctgcaagggaaccccaagctgcagaagctgaaaggcggggaggaggggcctgttctgatggcagaggccgtgaagaaggtcaatcgtggcaatggcaagacttcttctcggattctcctcctgaccaagggccatgtgattctcacagacaccaagaagtcccaggccaaaattgtcattgggctagacaatgtggctggggtgtcagtcaccagcctcaaggatgggctctttagcttgcatctgagtgagatgtcatcggtgggctccaagggggacttcctgctggtcagcgagcatgtgattgaactgctgaccaaaatgtaccgggctgtgctggatgccacgcagaggcagcttacagtcaccgtgactgagaagttctcagtgaggttcaaggagaacagtgtggctgtcaaggtcgtccagggccctgcaggtggtgacaacagcaagctacgctacaaaaaaaaggggagtcattgcttggaggtgactgtgcagtgaggagggggcaccatgcagagatggcagttgcttcctcctgaaccagcactaatccccctctgccctcctgtgtgggaggatctctaacccctctgatcgtggcgcatggcttggggattaaactacccttgaagaggacccttgtcccaaacccttcttgttctctcctccaaaagtagcttcctccaacccgcagcctctctgcacactaataaaacatgtggcttggaaaggt

SEQ ID NO: 371357 - DNA, 3019 bp, Homo sapiens
cacagggagcctgggctggaagaggcagcaaaagggaaaatcagaagagtggacactggcaagaggagggcagcctttttcccagcttccttgcaccatggacagctcccattaagccacctctccatcctggggccaggactcttatgccccattcctgtcaaattgagatttcatccaccattctccaaggacagtgaagttataccctagttccagtgttgggatcagtggcccctctggacatgcctctcctggaaggttctgtgggggtggaggatcttgtcctcctggaacccttggtggaggagtcactgctcaagaatcttcagcttcgctatgaaaacaaggagatttatacctacattgggaatgtggtgatctcagtgaatccctatcaacagcttcccatctatgggccagagttcattgccaaatatcaagactatactttctatgagctgaagccccatatctacgcattggcaaatgtggcgtaccagtcactgagggacagggaccgagaccagtgtatcctcatcacaggcgagagtggatcagggaagactgaggccagcaagctggtgatgtcttatgtggctgccgtctgtgggaaaggagagcaggtgaactctgtgaaggagcagctgctacagtctaacccagtgctggaggcttttggcaatgccaagaccattcgcaacaacaattcctcccgatttggaaaatacatggatattgaatttgacttcaagggatcccccctcggtggtgtcatcacaaactatctgcttgagaaatcccgattagtgaagcagctcaaaggagaaaggaacttccacatcttctatcagctgctggctggagcagatgaacagctgctgaaggccctgaagcttgagcgggatacaactggctatgcctatctgaatcatgaagtatccagagtggatggcatggacgacgcctccagcttcagggctgtacagagtgcaatggcagtgattgggttctcggaggaggagattcgacaagtgctagaggtgacatccatggtgctaaagctggggaacgtgttggtggctgatgagttccaggccagtgggataccagcaagtggcatccgtgatgggagaggtgttcgggagattggggagatggtgggcttgaattcagaagaagtagagagagctttgtgctcgaggaccatggaaacagccaaggaaaaggtggtcactgcactgaatgttatgcaggctcagtatgctcgggacgccctggctaagaacatctacagccgcctctttgactggatagtgaatcgaatcaatgagagcatcaaggtgggcatcggggaaaagaagaaggtaatgggagtccttgatatctacggttttgagatattagaggataatagctttgagcaatttgtgatcaactactgcaatgagaagctgcagcaggtgttcatagagatgaccctgaaagaagagcaagaggaatataagagagaaggcataccgtggacaaaggtggactactttgataatggcatcatttgtaagctcattgagcataatcagcgaggtatcctggccatgttggatgaggagtgcctgcggcctggggtggtcagtgactccactttcctagcaaagctgaaccagctcttctccaagcatggccactacgagagcaaagtcacccagaatgcccagcgtcagtatgaccacaccatgggcctcagctgcttccgcatctgccactatgcgggcaaggtgacatacaacgtgaccagctttattgacaagaataatgacctactcttccgagacctgttgcaggccatgtggaaggcccagcaccccctccttcggtccttgtttcctgagggcaatcctaagcaggcatctctcaaacgccccccgactgctggggcccagttcaagagttctgtggccatcctcatgaagaatctgtattccaagagccccaactacatcaggtgcataaagcccaatgagcatcagcagcgaggtcagttctcttcagacctggtggcaacccaggctcggtacctgggactgctggagaacgtacgggtgcgacgggcaggctatgcccaccgccagggttatgggcccttcctggaaaggtaccgattgctgagccggagcacctggcctcactggaatgggggagaccgggaaggtgttgagaaggtcctgggggagctgagcatgtcctcgggggagctggcctttggcaagacaaagatcttcattagaagccccaagactcttttctacctcgaagaacagaggcgcctgagactccagcagctggccacactcatacagaagatttaccgaggctggcgctgccgcacccactaccaactgatgcgaaagagtcagatcctcatctcctcttggtttcggggaaacatggcccgaaagaattatcgcaaatatttccggtcagaggctgccctcaccttggcagatttcatctacaagagcatggtacagaaattcctactggggctgaagaacaatttgccatccacaaacgtcttagacaagacatggccagccgccccctacaagtgcctcagcacagcaaatcaggagctgcagcagctcttctaccagtggaagtgcaagaggttccgggatcagctgtccccgaagcaggtagagatcctgagggaaaagctctgtgccagtgaactgttcaagggcaagaaggcttcatatccccagaggtgagggcctcccagaccctgcacagccagttccatcacgcagcagttctcaaacttgagcgtgccttagaatcacctggcaggattgtcacccccaggtgctgtgtccctcctcagagtctctgatccagcaggtcttggggtgaggaccaaaatttgcctttctaacaactccccaggtggtgctgatgtcttggtcctggactgtgctctgtggacactgacagaggatacgtggatgtgggggaaggg

SEQ ID NO: 371358 - DNA, 1449 bp, Homo sapiens
atgtgccctcctgcaaatgacttctgaaggccctattgtcaaaattattgataagttaaagtttttgtatgttactaggggaagaaaactagagtagatttagtgtaatttatcaagcatttatcgattgacactctggtaggcaacgtgtacggtcaactgacacgaagacaaataaaatgaagccatgccattaaggagcctgtccctgccacacccaccatgtgcccttctttttgagatgtcatactactaccttttttttctcattgtagttgtttttaaatttttcatcattgctacccagtagcacctttcccattttcgttgtccagtaagagacattgtaaatgatagtaaattaaagatagaaaacaaggaaaagctgggccatatcttttgtttgacccaggcaacatgtcacaaagttcagacaaacagtctcccatctgaagccagtattttcacaagcacctgctgtgtcatgaatttgacagaaatgcaaacccactttatcttcctgcttgcacatctaggccacagccttgcttccctatctggtgtcttgaactccatgctgaatattctgatgttcatgttttcctccttgactcttctatcctctctgtgactcagcaaccactgacatctgcatcctgtaggaaagagcccctgttcttaagcaatcccagtgccttcaaatatccctataaggccttacttctttcaggatcattttgattttccacataacttgttttgaccataccaaaaagattgaatggaaagtgaattcttaaacaatgtactgcttcacctcaagtatgtagccctagactataaacacatgaggttgcttcagtgtccatgcgtgaatatggatacgaagaaggaaagaacagtggacacattcactaactgtctatagttatacagaaaacagaggtgctgctagtttacctctgaatagagcctcactgtcagaggacctgtttgcttatctctctgccaatgttttctttttcaaaattttagttgactgatggtatctgctaacctagaatcaatccctgctatatgactatcatgccagacccttctctttatcttaactccccacatctcatccctaaatcattgtgctttacctcctcaatctgtttttcaaacttgtgttttgctctccatctgtatatttctagcatagtttattattcctcctgtggactattgcaattagggccacccctaacattttcagggcccaggcaagaatataaatggaggtcgctggcctaagacccaccttgtatcaaatagcccttcctcttcccacactgtatgggttctctggtgcacataagcggacaactcagcctacatacccaagacatgtccaccacatccaccataacttgtatccaccctccattgtctgttgggttagag

SEQ ID NO: 371359 - DNA, 518 bp, Homo sapiens
atccccagcagcagctcagacatctttcatatcaaaaaccctatctacaaagaccccttctgcagctcagaatcccatgatgacaaatgcttctgctacacaggccacactaacagcccaaaaattcaccacagcaaaagttgcatttacgcagagtccttcagcagcacgtaagtccactaatgtacattccccagtgactaatggtctcaagagtacacaaagattcccttctgctcatattacagcaacacggagtacacctgtttccaggacaaccaagcattttcatgaaacaaccccaaataaaggaagtggaaccacttcaggtactacccgtcttctatctgggcacacgtgtttcacgttgacaggtttgcttgggacgctagtaaccatgggcttgctgacttagccaaagaagagttaagaagaaaatacacacaagtatacagactgttcctagtttcttagacttatctgcatattggataaaataaatgcaattgtgctcttca

SEQ ID NO: 371360 - DNA, 2302 bp, Homo sapiens
tccccgagtctagggcccccaagggcgtatgacgccggagccctctgaccgcacctctgaccacaacaaacccctactccacccgtcttgtttgtcccacccttggtgacgcagagccccagcccagaccccgcccaaagcactcatttaactggtattgcggagccacgaggcttctgcttactgcaactcgctccggccgctgggcgtagctgcgactcggcggagtcccggcggcgcgtccttgttctaacccggcgcgccatgaccgtcgcgcggccgagcgtgcccgcggcgctgcccctcctcggggagctgccccggctgctgctgctggtgctgttgtgcctgccggccgtgtggggtgactgtggccttcccccagatgtacctaatgcccagccagctttggaaggccgtacaagttttcccgaggatactgtaataacgtacaaatgtgaagaaagctttgtgaaaattcctggcgagaaggactcagtgatctgccttaagggcagtcaatggtcagatattgaagagttctgcaatcgtagctgcgaggtgccaacaaggctaaattctgcatccctcaaacagccttatatcactcagaattattttccagtcggtactgttgtggaatatgagtgccgtccaggttacagaagagaaccttctctatcaccaaaactaacttgccttcagaatttaaaatggtccacagcagtcgaattttgtaaaaagaaatcatgccctaatccgggagaaatacgaaatggtcagattgatgtaccaggtggcatattatttggtgcaaccatctccttctcatgtaacacagggtacaaattatttggctcgacttctagtttttgtcttatttcaggcagctctgtccagtggagtgacccgttgccagagtgcagagaaatttattgtccagcaccaccacaaattgacaatggaataattcaaggggaacgtgaccattatggatatagacagtctgtaacgtatgcatgtaataaaggattcaccatgattggagagcactctatttattgtactgtgaataatgatgaaggagagtggagtggcccaccacctgaatgcagaggaaaatctctaacttccaaggtcccaccaacagttcagaaacctaccacagtaaatgttccaactacagaagtctcaccaacttctcagaaaaccaccacaaaaaccaccacaccaaatgctcaagcaacacggagtacacctgtttccaggacaaccaagcattttcatgaaacaaccccaaataaaggaagtggaaccacttcaggtactacccgtcttctatctgggcacacgtgtttcacgttgacaggtttgcttgggacgctagtaaccatgggcttgctgacttagccaaagaagagttaagaagaaaatacacacaagtatacagactgttcctagtttcttagacttatctgcatattggataaaataaatgcaattgtgctcttcatttaggatgctttcattgtctttaagatgtgttaggaatgtcaacagagcaaggagaaaaaaggcagtcctggaatcacattcttagcacacctacacctcttgaaaatagaacaacttgcagaattgagagtgattcctttcctaaaagtgtaagaaagcatagagatttgttcgtatttagaatgggatcacgaggaaaagagaaggaaagtgatttttttccacaagatctgtaatgttatttccacttataaaggaaataaaaaatgaaaaacattatttggatatcaaaagcaaataaaaacccaattcagtctcttctaagcaaaattgctaaagagagatgaaccacattataaagtaatctttggctgtaaggcattttcatctttccttcgggttggcaaaatattttaaaggtaaaacatgctggtgaaccaggggtgttgatggtgataagggaggaatatagaatgaaagactgaatcttcctttgttgcacaaatagagtttggaaaaagcctgtgaaaggtgtcttctttgacttaatgtctttaaaagtatccagagatactacaatattaacataagaaaagattatatattatttctgaatcgagatgtccatagtcaaatttgtaaatcttattcttttgtaatatttatttatatttatttatgacagtgaacattctgattttacatgtaaaacaagaaaagttgaagaagatatgtgaagaaaaatgtatttttcctaaatagaaataaatgatcccattttttggta

SEQ ID NO: 371361 - DNA, 2570 bp, Homo sapiens
tccccgagtctagggcccccaagggcgtatgacgccggagccctctgaccgcacctctgaccacaacaaacccctactccacccgtcttgtttgtcccacccttggtgacgcagagccccagcccagaccccgcccaaagcactcatttaactggtattgcggagccacgaggcttctgcttactgcaactcgctccggccgctgggcgtagctgcgactcggcggagtcccggcggcgcgtccttgttctaacccggcgcgccatgaccgtcgcgcggccgagcgtgcccgcggcgctgcccctcctcggggagctgccccggctgctgctgctggtgctgttgtgcctgccggccgtgtggggtgactgtggccttcccccagatgtacctaatgcccagccagctttggaaggccgtacaagttttcccgaggatactgtaataacgtacaaatgtgaagaaagctttgtgaaaattcctggcgagaaggactcagtgatctgccttaagggcagtcaatggtcagatattgaagagttctgcaatcgtagctgcgaggtgccaacaaggctaaattctgcatccctcaaacagccttatatcactcagaattattttccagtcggtactgttgtggaatatgagtgccgtccaggttacagaagagaaccttctctatcaccaaaactaacttgccttcagaatttaaaatggtccacagcagtcgaattttgtaaaaagaaatcatgccctaatccgggagaaatacgaaatggtcagattgatgtaccaggtggcatattatttggtgcaaccatctccttctcatgtaacacagggtacaaattatttggctcgacttctagtttttgtcttatttcaggcagctctgtccagtggagtgacccgttgccagagtgcagagaaatttattgtccagcaccaccacaaattgacaatggaataattcaaggggaacgtgaccattatggatatagacagtctgtaacgtatgcatgtaataaaggattcaccatgattggagagcactctatttattgtactgtgaataatgatgaaggagagtggagtggcccaccacctgaatgcagaggaaaatctctaacttccaaggtcccaccaacagttcagaaacctaccacagtaaatgttccaactacagaagtctcaccaacttctcagaaaaccaccacaaaaaccaccacaccaaatgctcaagcaacacggagtacacctgtttccaggacaaccaagcattttcatgaaacaaccccaaataaaggaagtggaaccacttcaggtactacccgtcttctatctgggcacacgtgtttcacgttgacaggtttgcttgggacgctagtaaccatgggcttgctgacttagccaaagaagagttaagaagaaaatacacacaagtatacagactgttcctagtttcttagacttatctgcatattggataaaataaatgcaattgtgctcttcatttaggatgctttcattgtctttaagatgtgttaggaatgtcaacagagcaaggagaaaaaaggcagtcctggaatcacattcttagcacacctacacctcttgaaaatagaacaacttgcagaattgagagtgattcctttcctaaaagtgtaagaaagcatagagatttgttcgtatttagaatgggatcacgaggaaaagagaaggaaagtgatttttttccacaagatctgtaatgttatttccacttataaaggaaataaaaaatgaaaaacattatttggatatcaaaagcaaataaaaacccaattcagtctcttctaagcaaaattgctaaagagagatgaaccacattataaagtaatctttggctgtaaggcattttcatctttccttcgggttggcaaaatattttaaaggtaaaacatgctggtgaaccaggggtgttgatggtgataagggaggaatatagaatgaaagactgaatcttcctttgttgcacaaatagagtttggaaaaagcctgtgaaaggtgtcttctttgacttaatgtctttaaaagtatccagagatactacaatattaacataagaaaagattatatattatttctgaatcgagatgtccatagtcaaatttgtaaatcttattcttttgtaatatttatttatatttatttatgacagtgaacattctgattttacatgtaaaacaagaaaagttgaagaagatatgtgaagaaaaatgtatttttcctaaatagaaataaatgatcccattttttggtaaaaaaaggaaaacgagagaaccaaacggtggtggggcgccctggcccccagagaagaggttgttaaacccatgcgcgtgtgggacaggggcccaactagtactgtgacagtggcctagacgtgctccagagaaaaaaccggggccaacgaacaaggcgcgtggttctcccacccaagaaaaacgcggcgggacaacgaacggtctgcaacaaacccagagggagctcggaaggcaacaggctatcacaggcgccaaaggagacggata

SEQ ID NO: 371362 - DNA, 2767 bp, Homo sapiens
tccccgagtctagggcccccaagggcgtatgacgccggagccctctgaccgcacctctgaccacaacaaacccctactccacccgtcttgtttgtcccacccttggtgacgcagagccccagcccagaccccgcccaaagcactcatttaactggtattgcggagccacgaggcttctgcttactgcaactcgctccggccgctgggcgtagctgcgactcggcggagtcccggcggcgcgtccttgttctaacccggcgcgccatgaccgtcgcgcggccgagcgtgcccgcggcgctgcccctcctcggggagctgccccggctgctgctgctggtgctgttgtgcctgccggccgtgtggggtgactgtggccttcccccagatgtacctaatgcccagccagctttggaaggccgtacaagttttcccgaggatactgtaataacgtacaaatgtgaagaaagctttgtgaaaattcctggcgagaaggactcagtgatctgccttaagggcagtcaatggtcagatattgaagagttctgcaatcgtagctgcgaggtgccaacaaggctaaattctgcatccctcaaacagccttatatcactcagaattattttccagtcggtactgttgtggaatatgagtgccgtccaggttacagaagagaaccttctctatcaccaaaactaacttgccttcagaatttaaaatggtccacagcagtcgaattttgtaaaaagaaatcatgccctaatccgggagaaatacgaaatggtcagattgatgtaccaggtggcatattatttggtgcaaccatctccttctcatgtaacacagggtacaaattatttggctcgacttctagtttttgtcttatttcaggcagctctgtccagtggagtgacccgttgccagagtgcagagaaatttattgtccagcaccaccacaaattgacaatggaataattcaaggggaacgtgaccattatggatatagacagtctgtaacgtatgcatgtaataaaggattcaccatgattggagagcactctatttattgtactgtgaataatgatgaaggagagtggagtggcccaccacctgaatgcagaggaaaatctctaacttccaaggtcccaccaacagttcagaaacctaccacagtaaatgttccaactacagaagtctcaccaacttctcagaaaaccaccacaaaaaccaccacaccaaatgctcaagcaacacggagtacacctgtttccaggacaaccaagcattttcatgaaacaaccccaaataaaggaagtggaaccacttcaggtactacccgtcttctatctgggcacacgtgtttcacgttgacaggtttgcttgggacgctagtaaccatgggcttgctgacttagccaaagaagagttaagaagaaaatacacacaagtatacagactgttcctagtttcttagacttatctgcatattggataaaataaatgcaattgtgctcttcatttaggatgctttcattgtctttaagatgtgttaggaatgtcaacagagcaaggagaaaaaaggcagtcctggaatcacattcttagcacacctacacctcttgaaaatagaacaacttgcagaattgagagtgattcctttcctaaaagtgtaagaaagcatagagatttgttcgtatttagaatgggatcacgaggaaaagagaaggaaagtgatttttttccacaagatctgtaatgttatttccacttataaaggaaataaaaaatgaaaaacattatttggatatcaaaagcaaataaaaacccaattcagtctcttctaagcaaaattgctaaagagagatgaaccacattataaagtaatctttggctgtaaggcattttcatctttccttcgggttggcaaaatattttaaaggtaaaacatgctggtgaaccaggggtgttgatggtgataagggaggaatatagaatgaaagactgaatcttcctttgttgcacaaatagagtttggaaaaagcctgtgaaaggtgtcttctttgacttaatgtctttaaaagtatccagagatactacaatattaacataagaaaagattatatattatttctgaatcgagatgtccatagtcaaatttgtaaatcttattcttttgtaatatttatttatatttatttatgacagtgaacattctgattttacatgtaaaacaagaaaagttgaagaagatatgtgaagaaaaatgtatttttcctaaatagaaataaatgatcccattttttggtatcatgtagtatgtgaaatttattcttaaacgtgactactttatttctaaataagaaattccctacctgcttcctacaagcagttcagaatgccatgccttggttgtcctagtgtgaataattttcagctactttaaaattatattgtactttctcaagcatgtcatatcctttcctattagagtatctatattacttgttactgatttacctgaaggcaatctgattaatttctaggtttttaccatattcttgtcatcttgccaattacattttaagtgttagactagactaagatgtactagttgtatagaatataactagatttattatggcaatgtttattttgtcattttgcttcatctgttttgttgttgaagtactttaaatttcatacgttcatggcatttcactgtaaagactttaatgtgtatttcttaaaataaaactttttttcctccttaac

SEQ ID NO: 371363 - DNA, 2300 bp, Homo sapiens
tccccgagtctagggcccccaagggcgtatgacgccggagccctctgaccgcacctctgaccacaacaaacccctactccacccgtcttgtttgtcccacccttggtgacgcagagccccagcccagaccccgcccaaagcactcatttaactggtattgcggagccacgaggcttctgcttactgcaactcgctccggccgctgggcgtagctgcgactcggcggagtcccggcggcgcgtccttgttctaacccggcgcgccatgaccgtcgcgcggccgagcgtgcccgcggcgctgcccctcctcggggagctgccccggctgctgctgctggtgctgttgtgcctgccggccgtgtggggtgactgtggccttcccccagatgtacctaatgcccagccagctttggaaggccgtacaagttttcccgaggatactgtaataacgtacaaatgtgaagaaagctttgtgaaaattcctggcgagaaggactcagtgatctgccttaagggcagtcaatggtcagatattgaagagttctgcaatcgtagctgcgaggtgccaacaaggctaaattctgcatccctcaaacagccttatatcactcagaattattttccagtcggtactgttgtggaatatgagtgccgtccaggttacagaagagaaccttctctatcaccaaaactaacttgccttcagaatttaaaatggtccacagcagtcgaattttgtaaaaagaaatcatgccctaatccgggagaaatacgaaatggtcagattgatgtaccaggtggcatattatttggtgcaaccatctccttctcatgtaacacagggtacaaattatttggctcgacttctagtttttgtcttatttcaggcagctctgtccagtggagtgacccgttgccagagtgcagagaaatttattgtccagcaccaccacaaattgacaatggaataattcaaggggaacgtgaccattatggatatagacagtctgtaacgtatgcatgtaataaaggattcaccatgattggagagcactctatttattgtactgtgaataatgatgaaggagagtggagtggcccaccacctgaatgcagaggaaaatctctaacttccaaggtcccaccaacagttcagaaacctaccacagtaaatgttccaactacagaagtctcaccaacttctcagaaaaccaccacaaaaaccaccacaccaaatgctcaagcaacacggagtacacctgtttccaggacaaccaagcattttcatgaaacaaccccaaataaaggaagtggaaccacttcaggtcagttgacactgttcagggcacacgtgtttcacgttgacaggtttgcttgggacgctagtaaccatgggcttgctgacttagccaaagaagagttaagaagaaaatacacacaagtatacagactgttcctagtttcttagacttatctgcatattggataaaataaatgcaattgtgctcttcatttaggatgctttcattgtctttaagatgtgttaggaatgtcaacagagcaaggagaaaaaaggcagtcctggaatcacattcttagcacacctacacctcttgaaaatagaacaacttgcagaattgagagtgattcctttcctaaaagtgtaagaaagcatagagatttgttcgtatttagaatgggatcacgaggaaaagagaaggaaagtgatttttttccacaagatctgtaatgttatttccacttataaaggaaataaaaaatgaaaaacattatttggatatcaaaagcaaataaaaacccaattcagtctcttctaagcaaaattgctaaagagagatgaaccacattataaagtaatctttggctgtaaggcattttcatctttccttcgggttggcaaaatattttaaaggtaaaacatgctggtgaaccaggggtgttgatggtgataagggaggaatatagaatgaaagactgaatcttcctttgttgcacaaatagagtttggaaaaagcctgtgaaaggtgtcttctttgacttaatgtctttaaaagtatccagagatactacaatattaacataagaaaagattatatattatttctgaatcgagatgtccatagtcaaatttgtaaatcttattcttttgtaatatttatttatatttatttatgacagtgaacattctgattttacatgtaaaacaagaaaagttgaagaagatatgtgaagaaaaatgtatttttcctaaatagaaataaatgatcccattttttggta

SEQ ID NO: 371364 - DNA, 2356 bp, Homo sapiens
tccccgagtctagggcccccaagggcgtatgacgccggagccctctgaccgcacctctgaccacaacaaacccctactccacccgtcttgtttgtcccacccttggtgacgcagagccccagcccagaccccgcccaaagcactcatttaactggtattgcggagccacgaggcttctgcttactgcaactcgctccggccgctgggcgtagctgcgactcggcggagtcccggcggcgcgtccttgttctaacccggcgcgccatgaccgtcgcgcggccgagcgtgcccgcggcgctgcccctcctcggggagctgccccggctgctgctgctggtgctgttgtgcctgccggccgtgtgggagtccagccgtgtggagcacacgatgctgcaaacttgcatgtcatctctttcaggtgactgtggccttcccccagatgtacctaatgcccagccagctttggaaggccgtacaagttttcccgaggatactgtaataacgtacaaatgtgaagaaagctttgtgaaaattcctggcgagaaggactcagtgatctgccttaagggcagtcaatggtcagatattgaagagttctgcaatcgtagctgcgaggtgccaacaaggctaaattctgcatccctcaaacagccttatatcactcagaattattttccagtcggtactgttgtggaatatgagtgccgtccaggttacagaagagaaccttctctatcaccaaaactaacttgccttcagaatttaaaatggtccacagcagtcgaattttgtaaaaagaaatcatgccctaatccgggagaaatacgaaatggtcagattgatgtaccaggtggcatattatttggtgcaaccatctccttctcatgtaacacagggtacaaattatttggctcgacttctagtttttgtcttatttcaggcagctctgtccagtggagtgacccgttgccagagtgcagagaaatttattgtccagcaccaccacaaattgacaatggaataattcaaggggaacgtgaccattatggatatagacagtctgtaacgtatgcatgtaataaaggattcaccatgattggagagcactctatttattgtactgtgaataatgatgaaggagagtggagtggcccaccacctgaatgcagaggaaaatctctaacttccaaggtcccaccaacagttcagaaacctaccacagtaaatgttccaactacagaagtctcaccaacttctcagaaaaccaccacaaaaaccaccacaccaaatgctcaagcaacacggagtacacctgtttccaggacaaccaagcattttcatgaaacaaccccaaataaaggaagtggaaccacttcaggtactacccgtcttctatctgggcacacgtgtttcacgttgacaggtttgcttgggacgctagtaaccatgggcttgctgacttagccaaagaagagttaagaagaaaatacacacaagtatacagactgttcctagtttcttagacttatctgcatattggataaaataaatgcaattgtgctcttcatttaggatgctttcattgtctttaagatgtgttaggaatgtcaacagagcaaggagaaaaaaggcagtcctggaatcacattcttagcacacctacacctcttgaaaatagaacaacttgcagaattgagagtgattcctttcctaaaagtgtaagaaagcatagagatttgttcgtatttagaatgggatcacgaggaaaagagaaggaaagtgatttttttccacaagatctgtaatgttatttccacttataaaggaaataaaaaatgaaaaacattatttggatatcaaaagcaaataaaaacccaattcagtctcttctaagcaaaattgctaaagagagatgaaccacattataaagtaatctttggctgtaaggcattttcatctttccttcgggttggcaaaatattttaaaggtaaaacatgctggtgaaccaggggtgttgatggtgataagggaggaatatagaatgaaagactgaatcttcctttgttgcacaaatagagtttggaaaaagcctgtgaaaggtgtcttctttgacttaatgtctttaaaagtatccagagatactacaatattaacataagaaaagattatatattatttctgaatcgagatgtccatagtcaaatttgtaaatcttattcttttgtaatatttatttatatttatttatgacagtgaacattctgattttacatgtaaaacaagaaaagttgaagaagatatgtgaagaaaaatgtatttttcctaaatagaaataaatgatcccattttttggta

SEQ ID NO: 371365 - DNA, 1513 bp, Homo sapiens
tccccgagtctagggcccccaagggcgtatgacgccggagccctctgaccgcacctctgaccacaacaaacccctactccacccgtcttgtttgtcccacccttggtgacgcagagccccagcccagaccccgcccaaagcactcatttaactggtattgcggagccacgaggcttctgcttactgcaactcgctccggccgctgggcgtagctgcgactcggcggagtcccggcggcgcgtccttgttctaacccggcgcgccatgaccgtcgcgcggccgagcgtgcccgcggcgctgcccctcctcggggagctgccccggctgctgctgctggtgctgttgtgcctgccggccgtgtggggtgactgtggccttcccccagatgtacctaatgcccagccagctttggaaggccgtacaagttttcccgaggatactgtaataacgtacaaatgtgaagaaagctttgtgaaaattcctggcgagaaggactcagtgatctgccttaagggcagtcaatggtcagatattgaagagttctgcaatcgtagctgcgaggtgccaacaaggctaaattctgcatccctcaaacagccttatatcactcagaattattttccagtcggtactgttgtggaatatgagtgccgtccaggttacagaagagaaccttctctatcaccaaaactaacttgccttcagaatttaaaatggtccacagcagtcgaattttgtaaaaagaaatcatgccctaatccgggagaaatacgaaatggtcagattgatgtaccaggtggcatattatttggtgcaaccatctccttctcatgtaacacagggtacaaattatttggctcgacttctagtttttgtcttatttcaggcagctctgtccagtggagtgacccgttgccagagtgcagagaaatttattgtccagcaccaccacaaattgacaatggaataattcaaggggaacgtgaccattatggatatagacagtctgtaacgtatgcatgtaataaaggattcaccatgattggagagcactctatttattgtactgtgaataatgatgaaggagagtggagtggcccaccacctgaatgcagaggaaaatctctaacttccaaggtcccaccaacagttcagaaacctaccacagtaaatgttccaactacagaagtctcaccaacttctcagaaaaccaccacaaaaaccaccacaccaaatgctcaagcaacacggagtacacctgtttccaggacaaccaagcattttcatgaaacaaccccaaataaaggaagtggaaccacttcaggtactacccgtcttctatctgggcacacgtgtttcacgttgacaggtttgcttgggacgctagtaaccatgggcttgctgacttagccaaagaagagttaagaagaaaatacacacaagtatacagactgttcctagtttcttagacttatctgcatattggataaaataaatgcaattgtgctcttca

SEQ ID NO: 371366 - DNA, 1679 bp, Homo sapiens
tccccgagtctagggcccccaagggcgtatgacgccggagccctctgaccgcacctctgaccacaacaaacccctactccacccgtcttgtttgtcccacccttggtgacgcagagccccagcccagaccccgcccaaagcactcatttaactggtattgcggagccacgaggcttctgcttactgcaactcgctccggccgctgggcgtagctgcgactcggcggagtcccggcggcgcgtccttgttctaacccggcgcgccatgaccgtcgcgcggccgagcgtgcccgcggcgctgcccctcctcggggagctgccccggctgctgctgctggtgctgttgtgcctgccggccgtgtggggtgactgtggccttcccccagatgtacctaatgcccagccagctttggaaggccgtacaagttttcccgaggatactgtaataacgtacaaatgtgaagaaagctttgtgaaaattcctggcgagaaggactcagtgatctgccttaagggcagtcaatggtcagatattgaagagttctgcaatcgtagctgcgaggtgccaacaaggctaaattctgcatccctcaaacagccttatatcactcagaattattttccagtcggtactgttgtggaatatgagtgccgtccaggttacagaagagaaccttctctatcaccaaaactaacttgccttcagaatttaaaatggtccacagcagtcgaattttgtaaaaagaaatcatgccctaatccgggagaaatacgaaatggtcagattgatgtaccaggtggcatattatttggtgcaaccatctccttctcatgtaacacagggtacaaattatttggctcgacttctagtttttgtcttatttcaggcagctctgtccagtggagtgacccgttgccagagtgcagagaaatttattgtccagcaccaccacaaattgacaatggaataattcaaggggaacgtgaccattatggatatagacagtctgtaacgtatgcatgtaataaaggattcaccatgattggagagcactctatttattgtactgtgaataatgatgaaggagagtggagtggcccaccacctgaatgcagaggaaaatctctaacttccaaggtcccaccaacagttcagaaacctaccacagtaaatgttccaactacagaagtctcaccaacttctcagaaaaccaccacaaaaaccaccacaccaaatgctcaagcaacacggagtacacctgtttccaggacaaccaagcattttcatgaaacaaccccaaataaaggaagtggaaccacttcaggtactacccgtcttctatctgggcacacgtgtttcacgttgacaggtttgcttgggacgctagtaaccatgggcttgctgacttagccaaagaagagttaagaagaaaatacacacaagtatacagactgttcctagtttcttagacttatctgcatattggataaaataaatgcaattgtgctcttcatttaggatgctttcattgtctttaagatgtgttaggaatgtcaacagagcaaggagaaaaaaggcagtcctgaagagttaagaagaaaatacacacaagtatacagactgttcctagtttcttagacttatctgcatattggataaaataaatgcaattgtgctct

SEQ ID NO: 371367 - DNA, 2248 bp, Homo sapiens
tccccgagtctagggcccccaagggcgtatgacgccggagccctctgaccgcacctctgaccacaacaaacccctactccacccgtcttgtttgtcccacccttggtgacgcagagccccagcccagaccccgcccaaagcactcatttaactggtattgcggagccacgaggcttctgcttactgcaactcgctccggccgctgggcgtagctgcgactcggcggagtcccggcggcgcgtccttgttctaacccggcgcgccatgaccgtcgcgcggccgagcgtgcccgcggcgctgcccctcctcggggagctgccccggctgctgctgctggtgctgttgtgcctgccggccgtgtggggtgactgtggccttcccccagatgtacctaatgcccagccagctttggaaggccgtacaagttttcccgaggatactgtaataacgtacaaatgtgaagaaagctttgtgaaaattcctggcgagaaggactcagtgatctgccttaagggcagtcaatggtcagatattgaagagttctgcaatcgtagctgcgaggtgccaacaaggctaaattctgcatccctcaaacagccttatatcactcagaattattttccagtcggtactgttgtggaatatgagtgccgtccaggttacagaagagaaccttctctatcaccaaaactaacttgccttcagaatttaaaatggtccacagcagtcgaattttgtaaaagtggcatattatttggtgcaaccatctccttctcatgtaacacagggtacaaattatttggctcgacttctagtttttgtcttatttcaggcagctctgtccagtggagtgacccgttgccagagtgcagagaaatttattgtccagcaccaccacaaattgacaatggaataattcaaggggaacgtgaccattatggatatagacagtctgtaacgtatgcatgtaataaaggattcaccatgattggagagcactctatttattgtactgtgaataatgatgaaggagagtggagtggcccaccacctgaatgcagaggaaaatctctaacttccaaggtcccaccaacagttcagaaacctaccacagtaaatgttccaactacagaagtctcaccaacttctcagaaaaccaccacaaaaaccaccacaccaaatgctcaagcaacacggagtacacctgtttccaggacaaccaagcattttcatgaaacaaccccaaataaaggaagtggaaccacttcaggtactacccgtcttctatctgggcacacgtgtttcacgttgacaggtttgcttgggacgctagtaaccatgggcttgctgacttagccaaagaagagttaagaagaaaatacacacaagtatacagactgttcctagtttcttagacttatctgcatattggataaaataaatgcaattgtgctcttcatttaggatgctttcattgtctttaagatgtgttaggaatgtcaacagagcaaggagaaaaaaggcagtcctggaatcacattcttagcacacctacacctcttgaaaatagaacaacttgcagaattgagagtgattcctttcctaaaagtgtaagaaagcatagagatttgttcgtatttagaatgggatcacgaggaaaagagaaggaaagtgatttttttccacaagatctgtaatgttatttccacttataaaggaaataaaaaatgaaaaacattatttggatatcaaaagcaaataaaaacccaattcagtctcttctaagcaaaattgctaaagagagatgaaccacattataaagtaatctttggctgtaaggcattttcatctttccttcgggttggcaaaatattttaaaggtaaaacatgctggtgaaccaggggtgttgatggtgataagggaggaatatagaatgaaagactgaatcttcctttgttgcacaaatagagtttggaaaaagcctgtgaaaggtgtcttctttgacttaatgtctttaaaagtatccagagatactacaatattaacataagaaaagattatatattatttctgaatcgagatgtccatagtcaaatttgtaaatcttattcttttgtaatatttatttatatttatttatgacagtgaacattctgattttacatgtaaaacaagaaaagttgaagaagatatgtgaagaaaaatgtatttttcctaaatagaaataaatgatcccattttttggta

SEQ ID NO: 371368 - DNA, 1578 bp, Homo sapiens
tccccgagtctagggcccccaagggcgtatgacgccggagccctctgaccgcacctctgaccacaacaaacccctactccacccgtcttgtttgtcccacccttggtgacgcagagccccagcccagaccccgcccaaagcactcatttaactggtattgcggagccacgaggcttctgcttactgcaactcgctccggccgctgggcgtagctgcgactcggcggagtcccggcggcgcgtccttgttctaacccggcgcgccatgaccgtcgcgcggccgagcgtgcccgcggcgctgcccctcctcggggagctgccccggctgctgctgctggtgctgttgtgcctgccggccgtgtggggtgactgtggccttcccccagatgtacctaatgcccagccagctttggaaggccgtacaagttttcccgaggatactgtaataacgtacaaatgtgaagaaagctttgtgaaaattcctggcgagaaggactcagtgatctgccttaagggcagtcaatggtcagatattgaagagttctgcaatcgtagctgcgaggtgccaacaaggctaaattctgcatccctcaaacagccttatatcactcagaattattttccagtcggtactgttgtggaatatgagtgccgtccaggttacagaagagaaccttctctatcaccaaaactaacttgccttcagaatttaaaatggtccacagcagtcgaattttgtaaaaagaaatcatgccctaatccgggagaaatacgaaatggtcagattgatgtaccaggtggcatattatttggtgcaaccatctccttctcatgtaacacagggtacaaattatttggctcgacttctagtttttgtcttatttcaggcagctctgtccagtggagtgacccgttgccagagtgcagagaaatttattgtccagcaccaccacaaattgacaatggaataattcaaggggaacgtgaccattatggatatagacagtctgtaacgtatgcatgtaataaaggattcaccatgattggagagcactctatttattgtactgtgaataatgatgaaggagagtggagtggcccaccacctgaatgcagaggaaaatctctaacttccaaggtcccaccaacagttcagaaacctaccacagtaaatgttccaactacagaagtctcaccaacttctcagaaaaccaccacaaaaaccaccacaccaaatgctcaagcaacacggagtacacctgtttccaggacaaccaagcattttcatgaaacaaccccaaataaaggaagtggaaccacttcaggtcagttgacactgttcaggtttactgagtatggatctaatgtgctatggtggaaatatgaacttgaccaagattgcaggattaaatggtctctaatttattgtagccagggtttttcatactaatactttttactttatttggaagcggacttggattgtactagggcaaatctttaaaaaaagaaacatttacaataatagagaaaaagactgtggccccattaaaaaaatgctaaattaagattggtaaaa

SEQ ID NO: 371369 - DNA, 1307 bp, Homo sapiens
atccccagcagcagctcagacatctttcatatcaaaaaccctatctacaaagaccccttctgcagctcagaatcccatgatgacaaatgcttctgctacacaggccacactaacagcccaaaaattcaccacagcaaaagttgcatttacgcagagtccttcagcagcacgtaagtccactaatgtacattccccagtgactaatggtctcaagagtacacaaagattcccttctgctcatattacagcaacacggagtacacctgtttccaggacaaccaagcattttcatgaaacaaccccaaataaaggaagtggaaccacttcaggtactacccgtcttctatctgggcacacgtgtttcacgttgacaggtttgcttgggacgctagtaaccatgggcttgctgacttagccaaagaagagttaagaagaaaatacacacaagtatacagactgttcctagtttcttagacttatctgcatattggataaaataaatgcaattgtgctcttcatttaggatgctttcattgtctttaagatgtgttaggaatgtcaacagagcaaggagaaaaaaggcagtcctggaatcacattcttagcacacctacacctcttgaaaatagaacaacttgcagaattgagagtgattcctttcctaaaagtgtaagaaagcatagagatttgttcgtatttagaatgggatcacgaggaaaagagaaggaaagtgatttttttccacaagatctgtaatgttatttccacttataaaggaaataaaaaatgaaaaacattatttggatatcaaaagcaaataaaaacccaattcagtctcttctaagcaaaattgctaaagagagatgaaccacattataaagtaatctttggctgtaaggcattttcatctttccttcgggttggcaaaatattttaaaggtaaaacatgctggtgaaccaggggtgttgatggtgataagggaggaatatagaatgaaagactgaatcttcctttgttgcacaaatagagtttggaaaaagcctgtgaaaggtgtcttctttgacttaatgtctttaaaagtatccagagatactacaatattaacataagaaaagattatatattatttctgaatcgagatgtccatagtcaaatttgtaaatcttattcttttgtaatatttatttatatttatttatgacagtgaacattctgattttacatgtaaaacaagaaaagttgaagaagatatgtgaagaaaaatgtatttttcctaaatagaaataaatgatcccattttttggta

SEQ ID NO: 371370 - DNA, 1055 bp, Homo sapiens
tagaggatccccggtcagtgatacccaacaagcatatcatgaaacaaccccaaataaaggaagtggaaccacttcaggtactacccgtcttctatctgggcacacgtgtttcacgttgacaggtttgcttgggacgctagtaaccatgggcttgctgacttagccaaagaagagttaagaagaaaatacacacaagtatacagactgttcctagtttcttagacttatctgcatattggataaaataaatgcaattgtgctcttcatttaggatgctttcattgtctttaagatgtgttaggaatgtcaacagagcaaggagaaaaaaggcagtcctggaatcacattcttagcacacctacacctcttgaaaatagaacaacttgcagaattgagagtgattcctttcctaaaagtgtaagaaagcatagagatttgttcgtatttagaatgggatcacgaggaaaagagaaggaaagtgatttttttccacaagatctgtaatgttatttccacttataaaggaaataaaaaatgaaaaacattatttggatatcaaaagcaaataaaaacccaattcagtctcttctaagcaaaattgctaaagagagatgaaccacattataaagtaatctttggctgtaaggcattttcatctttccttcgggttggcaaaatattttaaaggtaaaacatgctggtgaaccaggggtgttgatggtgataagggaggaatatagaatgaaagactgaatcttcctttgttgcacaaatagagtttggaaaaagcctgtgaaaggtgtcttctttgacttaatgtctttaaaagtatccagagatactacaatattaacataagaaaagattatatattatttctgaatcgagatgtccatagtcaaatttgtaaatcttattcttttgtaatatttatttatatttatttatgacagtgaacattctgattttacatgtaaaacaagaaaagttgaagaagatatgtgaagaaaaatgtatttttcctaaatagaaataaatgatcccattttttggta

SEQ ID NO: 371371 - DNA, 1116 bp, Homo sapiens
tccccgagtctagggcccccaagggcgtatgacgccggagccctctgaccgcacctctgaccacaacaaacccctactccacccgtcttgtttgtcccacccttggtgacgcagagccccagcccagaccccgcccaaagcactcatttaactggtattgcggagccacgaggcttctgcttactgcaactcgctccggccgctgggcgtagctgcgactcggcggagtcccggcggcgcgtccttgttctaacccggcgcgccatgaccgtcgcgcggccgagcgtgcccgcggcgctgcccctcctcggggagctgccccggctgctgctgctggtgctgttgtgcctgccggccgtgtggggtgactgtggccttcccccagatgtacctaatgcccagccagctttggaaggccgtacaagttttcccgaggatactgtaataacgtacaaatgtgaagaaagctttgtgaaaattcctggcgagaaggactcagtgatctgccttaagggcagtcaatggtcagatattgaagagttctgcaatcgtagctgcgaggtgccaacaaggctaaattctgcatccctcaaacagccttatatcactcagaattattttccagtcggtactgttgtggaatatgagtgccgtccaggttacagaagagaaccttctctatcaccaaaactaacttgccttcagaatttaaaatggtccacagcagtcgaattttgtaaaaagaaatcatgccctaatccgggagaaatacgaaatggtcagattgatgtaccaggtggcatattatttggtgcaaccatctccttctcatgtaacacagggtacaaattatttggctcgacttctagtttttgtcttatttcaggcagctctgtccagtggagtgacccgttgccagagtgcagagggcccaggcaagaatataaatggaggtcgctggcctaagacccaccttgtatcaaatagcccttcctcttcccacactgtatgggttctctggtgcacataagcggacaactcagcctacatacccaagacatgtccaccacatccaccataacttgtatccaccctccattgtctgttgggttagag

SEQ ID NO: 371372 - DNA, 383 bp, Homo sapiens
tgaaaacagcaactgtgaggacacttgatagtcatttccttcagttctgcttttgtctccctaggtgactgtggccttcccccagatgtacctaatgcccagccagctttggaaggccgtacaagttttcccgaggatactgtaataacgtacaaatgtgaagaaagctttgtgaaaattcctggcgagaaggactcagtgatctgccttaagggcagtcaatggtcagatattgaagagttctgcaatcgtaagttcttcatctttttagaaaagttctgggaatggaatgtatcttaaatttatttttatatacctttggagtgactagtaattgatagttctctagcgttactaaaccccagggtataccctgttggcac

SEQ ID NO: 371373 - DNA, 1720 bp, Homo sapiens
tccccgagtctagggcccccaagggcgtatgacgccggagccctctgaccgcacctctgaccacaacaaacccctactccacccgtcttgtttgtcccacccttggtgacgcagagccccagcccagaccccgcccaaagcactcatttaactggtattgcggagccacgaggcttctgcttactgcaactcgctccggccgctgggcgtagctgcgactcggcggagtcccggcggcgcgtccttgttctaacccggcgcgccatgaccgtcgcgcggccgagcgtgcccgcggcgctgcccctcctcggggagctgccccggctgctgctgctggtgctgttgtgcctgccggccgtgtggggtgactgtggccttcccccagatgtacctaatgcccagccagctttggaaggccgtacaagttttcccgaggatactgtaataacgtacaaatgtgaagaaagctttgtgaaaattcctggcgagaaggactcagtgatctgccttaagggcagtcaatggtcagatattgaagagttctgcaatcgtagctgcgaggtgccaacaaggctaaattctgcatccctcaaacagccttatatcactcagaattattttccagtcggtactgttgtggaatatgagtgccgtccaggttacagaagagaaccttctctatcaccaaaactaacttgccttcagaatttaaaatggtccacagcagtcgaattttgtaaaaagaaatcatgccctaatccgggagaaatacgaaatggtcagattgatgtaccaggtggcatattatttggtgcaaccatctccttctcatgtaacacagggtacaaattatttggctcgacttctagtttttgtcttatttcaggcagctctgtccagtggagtgacccgttgccagagtgcagagaaatttattgtccagcaccaccacaaattgacaatggaataattcaaggggaacgtgaccattatggatatagacagtctgtaacgtatgcatgtaataaaggattcaccatgattggagagcactctatttattgtactgtgaataatgatgaaggagagtggagtggcccaccacctgaatgcagaggaaaatctctaacttccaaggtcccaccaacagttcagaaacctaccacagtaaatgttccaactacagaagtctcaccaacttctcagaaaaccaccacaaaaaccaccacaccaaatgctcaagcaacacggagtacacctgtttccaggacaaccaagcattttcatgaaacaaccccaaataaaggaagtggaaccacttcaggtactacccgtcttctatctggttctcgtcctgtcacccaggctggtatgcggtggtgtgatcgtagctcactgcagtctcgaactcctgggttcaagcgatccttccacttcagcctcccaagtagctggtactacaggtgtgtgccacgacacccggctaagtttttgaaatttattttttgtagagacaggattttcctatgttgcccaggctggtttcaaactcctggccgtaagcgatttttccggcctcccaaaacgttgcgattataagtgtgagccactgcacctggccccacattttctttatccatttgtacattgatggacacttaagatgattccatatctttgctattgtgaatagtgcttcaataaatatgtgaatgcacat

SEQ ID NO: 371374 - DNA, 2184 bp, Homo sapiens
aaaaaaaaaaaaaaaaaaaaaaaaaaaaaaaaaaaaaaaaaaaaaaaaaaaaaaaaaaaaaattactgcaactcgctccggccgctgggcgtagctgcgactcggcggagtcccggcggcgcgtccttgttctaacccggcgcgccatgaccgtcgcgcggccgagcgtgcccgcggcgctgcccctcctcggggagctgccccggctgctgctgctggtgctgttgtgcctgccggccgtgtggggtgactgtggccttcccccagatgtacctaatgcccagccagctttggaaggccgtacaagttttcccgaggatactgtaataacgtacaaatgtgaagaaagctttgtgaaaattcctggcgagaaggactcagtgatctgccttaagggcagtcaatggtcagatattgaagagttctgcaatcgtagctgcgaggtgccaacaaggctaaattctgcatccctcaaacagccttatatcactcagaattattttccagtcggtactgttgtggaatatgagtgccgtccaggttacagaagagaaccttctctatcaccaaaactaacttgccttcagaatttaaaatggtccacagcagtcgaattttgtaaaaagaaatcatgccctaatccgggagaaatacgaaatggtcagattgatgtaccaggtggcatattatttggtgcaaccatctccttctcatgtaacacagggtacaaattatttggctcgacttctagtttttgtcttatttcaggcagctctgtccagtggagtgacccgttgccagagtgcagagaaatttattgtccagcaccaccacaaattgacaatggaataattcaaggggaacgtgaccattatggatatagacagtctgtaacgtatgcatgtaataaaggattcaccatgattggagagcactctatttattgtactgtgaataatgatgaaggagagtggagtggcccaccacctgaatgcagaggaaaatctctaacttccaaggtcccaccaacagttcagaaacctaccacagtaaatgttccaactacagaagtctcaccaacttctcagaaaaccaccacaaaaaccaccacaccaaatgctcaagcaacacggagtacacctgtttccaggacaaccaagcattttcatgaaacaaccccaaataaaggaagtggaaccacttcaggtactacccgtcttctatctgggcacacgtgtttcacgttgacaggtttgcttgggacgctagtaaccatgggcttgctgacttagccaaagaagagttaagaagaaaatacacacaagtatacagactgttcctagtttcttagacttatctgcatattggataaaataaatgcaattgtgctcttcatttaggatgctttcattgtctttaagatgtgttaggaatgtcaacagagcaaggagaaaaaaggcagtcctggaatcacattcttagcacacctacacctcttgaaaatagaacaacttgcagaattgagagtgattcctttcctaaaagtgtaagaaagcatagagatttgttcgtatttagaatgggatcacgaggaaaagagaaggaaagtgatttttttccacaagatctgtaatgttatttccacttataaaggaaataaaaaatgaaaaacattatttggatatcaaaagcaaataaaaacccaattcagtctcttctaagcaaaattgctaaagagagatgaaccacattataaagtaatctttggctgtaaggcattttcatctttccttcgggttggcaaaatattttaaaggtaaaacatgctggtgaaccaggggtgttgatggtgataagggaggaatatagaatgaaagactgaatcttcctttgttgcacaaatagagtttggaaaaagcctgtgaaaggtgtcttctttgacttaatgtctttaaaagtatccagagatactacaatattaacataagaaaagattatatattatttctgaatcgagatgtccatagtcaaatttgtaaatcttattcttttgtaatatttatttatatttatttatgacagtgaacattctgattttacatgtaaaacaagaaaagttgaagaagatatgtgaagaaaaatgtatttttcctaaatagaaataaatgatcccattttttggta

SEQ ID NO: 371375 - DNA, 2420 bp, Homo sapiens
tccccgagtctagggcccccaagggcgtatgacgccggagccctctgaccgcacctctgaccacaacaaacccctactccacccgtcttgtttgtcccacccttggtgacgcagagccccagcccagaccccgcccaaagcactcatttaactggtattgcggagccacgaggcttctgcttactgcaactcgctccggccgctgggcgtagctgcgactcggcggagtcccggcggcgcgtccttgttctaacccggcgcgccatgaccgtcgcgcggccgagcgtgcccgcggcgctgcccctcctcggggagctgccccggctgctgctgctggtgctgttgtgcctgccggccgtgtggggtgactgtggccttcccccagatgtacctaatgcccagccagctttggaaggccgtacaagttttcccgaggatactgtaataacgtacaaatgtgaagaaagctttgtgaaaattcctggcgagaaggactcagtgatctgccttaagggcagtcaatggtcagatattgaagagttctgcaatcgtagctgcgaggtgccaacaaggctaaattctgcatccctcaaacagccttatatcactcagaattattttccagtcggtactgttgtggaatatgagtgccgtccaggttacagaagagaaccttctctatcaccaaaactaacttgccttcagaatttaaaatggtccacagcagtcgaattttgtaaaaagaaatcatgccctaatccgggagaaatacgaaatggtcagattgatgtaccaggtggcatattatttggtgcaaccatctccttctcatgtaacacagggtacaaattatttggctcgacttctagtttttgtcttatttcaggcagctctgtccagtggagtgacccgttgccagagtgcagagaaatttattgtccagcaccaccacaaattgacaatggaataattcaaggggaacgtgaccattatggatatagacagtctgtaacgtatgcatgtaataaaggattcaccatgattggagagcactctatttattgtactgtgaataatgatgaaggagagtggagtggcccaccacctgaatgcagaggaaaatctctaacttccaaggtcccaccaacagttcagaaacctaccacagtaaatgttccaactacagaagtctcaccaacttctcagaaaaccaccacaaaaaccaccacaccaaatgctcaagcaacacggagtacacctgtttccaggacaaccaagcattttcatgaaacaaccccaaataaaggaagtggaaccacttcaggtactacccgtcttctatctggttctcgtcctgtcacccaggctggtatgcggtggtgtgatcgtagctcactgcagtctcgaactcctgggttcaagcgatccttccacttcagcctcccaagtagctggtactacagggcacacgtgtttcacgttgacaggtttgcttgggacgctagtaaccatgggcttgctgacttagccaaagaagagttaagaagaaaatacacacaagtatacagactgttcctagtttcttagacttatctgcatattggataaaataaatgcaattgtgctcttcatttaggatgctttcattgtctttaagatgtgttaggaatgtcaacagagcaaggagaaaaaaggcagtcctggaatcacattcttagcacacctacacctcttgaaaatagaacaacttgcagaattgagagtgattcctttcctaaaagtgtaagaaagcatagagatttgttcgtatttagaatgggatcacgaggaaaagagaaggaaagtgatttttttccacaagatctgtaatgttatttccacttataaaggaaataaaaaatgaaaaacattatttggatatcaaaagcaaataaaaacccaattcagtctcttctaagcaaaattgctaaagagagatgaaccacattataaagtaatctttggctgtaaggcattttcatctttccttcgggttggcaaaatattttaaaggtaaaacatgctggtgaaccaggggtgttgatggtgataagggaggaatatagaatgaaagactgaatcttcctttgttgcacaaatagagtttggaaaaagcctgtgaaaggtgtcttctttgacttaatgtctttaaaagtatccagagatactacaatattaacataagaaaagattatatattatttctgaatcgagatgtccatagtcaaatttgtaaatcttattcttttgtaatatttatttatatttatttatgacagtgaacattctgattttacatgtaaaacaagaaaagttgaagaagatatgtgaagaaaaatgtatttttcctaaatagaaataaatgatcccattttttggta

SEQ ID NO: 371376 - DNA, 2545 bp, Homo sapiens
tccccgagtctagggcccccaagggcgtatgacgccggagccctctgaccgcacctctgaccacaacaaacccctactccacccgtcttgtttgtcccacccttggtgacgcagagccccagcccagaccccgcccaaagcactcatttaactggtattgcggagccacgaggcttctgcttactgcaactcgctccggccgctgggcgtagctgcgactcggcggagtcccggcggcgcgtccttgttctaacccggcgcgccatgaccgtcgcgcggccgagcgtgcccgcggcgctgcccctcctcggggagctgccccggctgctgctgctggtgctgttgtgcctgccggccgtgtggggtgactgtggccttcccccagatgtacctaatgcccagccagctttggaaggccgtacaagttttcccgaggatactgtaataacgtacaaatgtgaagaaagctttgtgaaaattcctggcgagaaggactcagtgatctgccttaagggcagtcaatggtcagatattgaagagttctgcaatcgtagctgcgaggtgccaacaaggctaaattctgcatccctcaaacagccttatatcactcagaattattttccagtcggtactgttgtggaatatgagtgccgtccaggttacagaagagaaccttctctatcaccaaaactaacttgccttcagaatttaaaatggtccacagcagtcgaattttgtaaaaagaaatcatgccctaatccgggagaaatacgaaatggtcagattgatgtaccaggtggcatattatttggtgcaaccatctccttctcatgtaacacagggtacaaattatttggctcgacttctagtttttgtcttatttcaggcagctctgtccagtggagtgacccgttgccagagtgcagagaaatttattgtccagcaccaccacaaattgacaatggaataattcaaggggaacgtgaccattatggatatagacagtctgtaacgtatgcatgtaataaaggattcaccatgattggagagcactctatttattgtactgtgaataatgatgaaggagagtggagtggcccaccacctgaatgcagaggaaaatctctaacttccaaggtcccaccaacagttcagaaacctaccacagtaaatgttccaactacagaagtctcaccaacttctcagaaaaccaccacaaaaaccaccacaccaaatgctcaagcaacacggagtacacctgtttccaggacaaccaagcattttcatgaaacaaccccaaataaaggaagtggaaccacttcaggtactacccgtcttctatctggtttctctccatggaagaggagaagaccagaggcatctagtcagacatcttgaagccactccccatgatactgtcttaggaaaacaatcaacatgtagcattcatggataccaaagggaaaatggtagagacggtgtttcaccgtgttatccaggatggtcttgatctcctggcctcgagatctgcctgcctcggcctcccaaagtgctgggattacaggcgtgagccaccgcacctggccagggcacacgtgtttcacgttgacaggtttgcttgggacgctagtaaccatgggcttgctgacttagccaaagaagagttaagaagaaaatacacacaagtatacagactgttcctagtttcttagacttatctgcatattggataaaataaatgcaattgtgctcttcatttaggatgctttcattgtctttaagatgtgttaggaatgtcaacagagcaaggagaaaaaaggcagtcctggaatcacattcttagcacacctacacctcttgaaaatagaacaacttgcagaattgagagtgattcctttcctaaaagtgtaagaaagcatagagatttgttcgtatttagaatgggatcacgaggaaaagagaaggaaagtgatttttttccacaagatctgtaatgttatttccacttataaaggaaataaaaaatgaaaaacattatttggatatcaaaagcaaataaaaacccaattcagtctcttctaagcaaaattgctaaagagagatgaaccacattataaagtaatctttggctgtaaggcattttcatctttccttcgggttggcaaaatattttaaaggtaaaacatgctggtgaaccaggggtgttgatggtgataagggaggaatatagaatgaaagactgaatcttcctttgttgcacaaatagagtttggaaaaagcctgtgaaaggtgtcttctttgacttaatgtctttaaaagtatccagagatactacaatattaacataagaaaagattatatattatttctgaatcgagatgtccatagtcaaatttgtaaatcttattcttttgtaatatttatttatatttatttatgacagtgaacattctgattttacatgtaaaacaagaaaagttgaagaagatatgtgaagaaaaatgtatttttcctaaatagaaataaatgatcccattttttggta

SEQ ID NO: 371377 - DNA, 2818 bp, Homo sapiens
tccccgagtctagggcccccaagggcgtatgacgccggagccctctgaccgcacctctgaccacaacaaacccctactccacccgtcttgtttgtcccacccttggtgacgcagagccccagcccagaccccgcccaaagcactcatttaactggtattgcggagccacgaggcttctgcttactgcaactcgctccggccgctgggcgtagctgcgactcggcggagtcccggcggcgcgtccttgttctaacccggcgcgccatgaccgtcgcgcggccgagcgtgcccgcggcgctgcccctcctcggggagctgccccggctgctgctgctggtgctgttgtgcctgccggccgtgtggggtgagtaggggcccggcggccggggaagcccctgggctgggtgggaggtccaagtcggtctctgagacacgcacaggggccggcgacttggcaggtggggagcttggcccgcggtcgtggttcccgccgtcctgtgcctttaaggctctcgccgctcaccagcatttggggctcctgctgtgtcggcccccagctgacttggctttaggggtcggcttggagggttaaagaggccccggctgggtttgcggagcagccaagcctggcaaaatcgaaagggagggctcaaagagactgtatccttaacccccaaaaagctggtctaaaaggatgggaggccagaccgctgaccgttccccactctcgacagagtccagccgtgtggagcacacgatgctgcaaacttgcatgtcatctctttcaggtgtggcatttcaagggggcttgtgtcttgaaaacagcaactgtgaggacacttgatagtcatttccttcagttctgcttttgtctccctaggtgactgtggccttcccccagatgtacctaatgcccagccagctttggaaggccgtacaagttttcccgaggatactgtaataacgtacaaatgtgaagaaagctttgtgaaaattcctggcgagaaggactcagtgatctgccttaagggcagtcaatggtcagatattgaagagttctgcaatcgtagctgcgaggtgccaacaaggctaaattctgcatccctcaaacagccttatatcactcagaattattttccagtcggtactgttgtggaatatgagtgccgtccaggttacagaagagaaccttctctatcaccaaaactaacttgccttcagaatttaaaatggtccacagcagtcgaattttgtaaaaagaaatcatgccctaatccgggagaaatacgaaatggtcagattgatgtaccaggtggcatattatttggtgcaaccatctccttctcatgtaacacagggtacaaattatttggctcgacttctagtttttgtcttatttcaggcagctctgtccagtggagtgacccgttgccagagtgcagagaaatttattgtccagcaccaccacaaattgacaatggaataattcaaggggaacgtgaccattatggatatagacagtctgtaacgtatgcatgtaataaaggattcaccatgattggagagcactctatttattgtactgtgaataatgatgaaggagagtggagtggcccaccacctgaatgcagaggaaaatctctaacttccaaggtcccaccaacagttcagaaacctaccacagtaaatgttccaactacagaagtctcaccaacttctcagaaaaccaccacaaaaaccaccacaccaaatgctcaagcaacacggagtacacctgtttccaggacaaccaagcattttcatgaaacaaccccaaataaaggaagtggaaccacttcaggtactacccgtcttctatctgggcacacgtgtttcacgttgacaggtttgcttgggacgctagtaaccatgggcttgctgacttagccaaagaagagttaagaagaaaatacacacaagtatacagactgttcctagtttcttagacttatctgcatattggataaaataaatgcaattgtgctcttcatttaggatgctttcattgtctttaagatgtgttaggaatgtcaacagagcaaggagaaaaaaggcagtcctggaatcacattcttagcacacctacacctcttgaaaatagaacaacttgcagaattgagagtgattcctttcctaaaagtgtaagaaagcatagagatttgttcgtatttagaatgggatcacgaggaaaagagaaggaaagtgatttttttccacaagatctgtaatgttatttccacttataaaggaaataaaaaatgaaaaacattatttggatatcaaaagcaaataaaaacccaattcagtctcttctaagcaaaattgctaaagagagatgaaccacattataaagtaatctttggctgtaaggcattttcatctttccttcgggttggcaaaatattttaaaggtaaaacatgctggtgaaccaggggtgttgatggtgataagggaggaatatagaatgaaagactgaatcttcctttgttgcacaaatagagtttggaaaaagcctgtgaaaggtgtcttctttgacttaatgtctttaaaagtatccagagatactacaatattaacataagaaaagattatatattatttctgaatcgagatgtccatagtcaaatttgtaaatcttattcttttgtaatatttatttatatttatttatgacagtgaacattctgattttacatgtaaaacaagaaaagttgaagaagatatgtgaagaaaaatgtatttttcctaaatagaaataaatgatcccattttttggta

SEQ ID NO: 371378 - DNA, 2113 bp, Homo sapiens
tccccgagtctagggcccccaagggcgtatgacgccggagccctctgaccgcacctctgaccacaacaaacccctactccacccgtcttgtttgtcccacccttggtgacgcagagccccagcccagaccccgcccaaagcactcatttaactggtattgcggagccacgaggcttctgcttactgcaactcgctccggccgctgggcgtagctgcgactcggcggagtcccggcggcgcgtccttgttctaacccggcgcgccatgaccgtcgcgcggccgagcgtgcccgcggcgctgcccctcctcggggagctgccccggctgctgctgctggtgctgttgtgcctgccggccgtgtggggtgactgtggccttcccccagatgtacctaatgcccagccagctttggaaggccgtacaagttttcccgaggatactgtaataacgtacaaatgtgaagaaagctttgtgaaaattcctggcgagaaggactcagtgatctgccttaagggcagtcaatggtcagatattgaagagttctgcaatcgtagctgcgaggtgccaacaaggctaaattctgcatccctcaaacagccttatatcactcagaattattttccagtcggtactgttgtggaatatgagtgccgtccaggttacagaagagaaccttctctatcaccaaaactaacttgccttcagaatttaaaatggtccacagcagtcgaattttgtaaaaagaaatcatgccctaatccgggagaaatacgaaatggtcagattgatgtaccaggtggcatattatttggtgcaaccatctccttctcatgtaacacagggtacaaattatttggctcgacttctagtttttgtcttatttcaggcagctctgtccagtggagtgacccgttgccagagtgcagaggaaaatctctaacttccaaggtcccaccaacagttcagaaacctaccacagtaaatgttccaactacagaagtctcaccaacttctcagaaaaccaccacaaaaaccaccacaccaaatgctcaagcaacacggagtacacctgtttccaggacaaccaagcattttcatgaaacaaccccaaataaaggaagtggaaccacttcaggtactacccgtcttctatctgggcacacgtgtttcacgttgacaggtttgcttgggacgctagtaaccatgggcttgctgacttagccaaagaagagttaagaagaaaatacacacaagtatacagactgttcctagtttcttagacttatctgcatattggataaaataaatgcaattgtgctcttcatttaggatgctttcattgtctttaagatgtgttaggaatgtcaacagagcaaggagaaaaaaggcagtcctggaatcacattcttagcacacctacacctcttgaaaatagaacaacttgcagaattgagagtgattcctttcctaaaagtgtaagaaagcatagagatttgttcgtatttagaatgggatcacgaggaaaagagaaggaaagtgatttttttccacaagatctgtaatgttatttccacttataaaggaaataaaaaatgaaaaacattatttggatatcaaaagcaaataaaaacccaattcagtctcttctaagcaaaattgctaaagagagatgaaccacattataaagtaatctttggctgtaaggcattttcatctttccttcgggttggcaaaatattttaaaggtaaaacatgctggtgaaccaggggtgttgatggtgataagggaggaatatagaatgaaagactgaatcttcctttgttgcacaaatagagtttggaaaaagcctgtgaaaggtgtcttctttgacttaatgtctttaaaagtatccagagatactacaatattaacataagaaaagattatatattatttctgaatcgagatgtccatagtcaaatttgtaaatcttattcttttgtaatatttatttatatttatttatgacagtgaacattctgattttacatgtaaaacaagaaaagttgaagaagatatgtgaagaaaaatgtatttttcctaaatagaaataaatgatcccattttttggta

SEQ ID NO: 371379 - DNA, 1398 bp, Homo sapiens
tccccgagtctagggcccccaagggcgtatgacgccggagccctctgaccgcacctctgaccacaacaaacccctactccacccgtcttgtttgtcccacccttggtgacgcagagccccagcccagaccccgcccaaagcactcatttaactggtattgcggagccacgaggcttctgcttactgcaactcgctccggccgctgggcgtagctgcgactcggcggagtcccggcggcgcgtccttgttctaacccggcgcgccatgaccgtcgcgcggccgagcgtgcccgcggcgctgcccctcctcggggagctgccccggctgctgctgctggtgctgttgtgcctgccggccgtgtggggtgactgtggccttcccccagatgtacctaatgcccagccagctttggaaggccgtacaagttttcccgaggatactgtaataacgtacaaatgtgaagaaagctttgtgaaaattcctggcgagaaggactcagtgatctgccttaagggcagtcaatggtcagatattgaagagttctgcaatcgtagctgcgaggtgccaacaaggctaaattctgcatccctcaaacagccttatatcactcagaattattttccagtcggtactgttgtggaatatgagtgccgtccaggttacagaagagaaccttctctatcaccaaaactaacttgccttcagaatttaaaatggtccacagcagtcgaattttgtaaaaagaaatcatgccctaatccgggagaaatacgaaatggtcagattgatgtaccaggtggcatattatttggtgcaaccatctccttctcatgtaacacagggtacaaattatttggctcgacttctagtttttgtcttatttcaggcagctctgtccagtggagtgacccgttgccagagtgcagagaaatttattgtccagcaccaccacaaattgacaatggaataattcaaggggaacgtgaccattatggatatagacagtctgtaacgtatgcatgtaataaaggattcaccatgattggagagcactctatttattgtactgtgaataatgatgaaggagagtggagtggcccaccacctgaatgcagaggaaaatctctaacttccaaggtcccaccaacagttcagaaacctaccacagtaaatgttccaactacagaagtctcaccaacttctcagaaaaccaccacaaaaaccaccacaccaaatgctcaagcaacacggggtggctgataccgaattgtgactcggctaggtggggcaaggctgggcagtgtccgagagagcacccctctctgcatctgaccacgtgctacccccatgctggaggtgacatctcttacgcccaacccttccccactgcacacacct

SEQ ID NO: 371380 - DNA, 1091 bp, Homo sapiens
tccccgagtctagggcccccaagggcgtatgacgccggagccctctgaccgcacctctgaccacaacaaacccctactccacccgtcttgtttgtcccacccttggtgacgcagagccccagcccagaccccgcccaaagcactcatttaactggtattgcggagccacgaggcttctgcttactgcaactcgctccggccgctgggcgtagctgcgactcggcggagtcccggcggcgcgtccttgttctaacccggcgcgccatgaccgtcgcgcggccgagcgtgcccgcggcgctgcccctcctcggggagctgccccggctgctgctgctggtgctgttgtgcctgccggccgtgtggggtgactgtggccttcccccagatgtacctaatgcccagccagctttggaaggccgtacaagttttcccgaggatactgtaataacgtacaaatgtgaagaaagctttgtgaaaattcctggcgagaaggactcagtgatctgccttaagggcagtcaatggtcagatattgaagagttctgcaatcgtagctgcgaggtgccaacaaggctaaattctgcatccctcaaacagccttatatcactcagaattattttccagtcggtactgttgtggaatatgagtgccgtccaggttacagaagagaaccttctctatcaccaaaactaacttgccttcagaatttaaaatggtccacagcagtcgaattttgtaaaaagaaatcatgccctaatccgggagaaatacgaaatggtcagattgatgtaccaggtggcatattatttggtgcaaccatctccttctcatgtaacacagggtacaaattatttggctcgacttctagtttttgtcttatttcaggcagctctgtccagtggagtgacccgttgccagagtgcagagaaatttattgtccagcaccaccacaaattgacaatggaataattcccactgcgtgcagcgcagaccgagccctcacactacactgtgtctgttacttacgcgaccttcataatgtcacctccccttcactcggagagcaactggaagccctctactgtcaata

SEQ ID NO: 371381 - DNA, 555 bp, Homo sapiens
ggtttcttcagtcctataaaatagagattagttccttccagttctagtactctatgtttctttctatgatcatcacttagacctccaatgaataaatcactcactccaatggaatagaaacattaagtagcaatctttctttttttttgaataaatcctgggcaaaaggtatttatgggagcaaagaaatggatgaattattttcaaaacatatatgttcccttagatggaagagttcctgggatgaaatttttgttttataggagactggcttaggaaacccaagacagaatgtatatctattcatttctaggtcatagtgtgaaaacttccatttggaaatctgggagcagttcttaagtcaaaaaacagacctggaatcacagtatccatacataccagttggaggacaaaagacattgccccagagaccagaggcaccaaaatacactacacctagctacctgagaatgcctctagctggcaactccagcaaaggcccttttccccatccttgaccatcttgagtggaatgctaagaactgctgggaggaa

SEQ ID NO: 371382 - DNA, 482 bp, Homo sapiens
tctgtgagaaaaaacacttttaatagaccaacctcattacgcaaaagtcagagccaataaagcaacctataaaaatgtaaaccatttgatgcactcctaagaatcatatttccttttcatatttttgaataaccaaaggattaattttatgggattaataaatattaagactatagaagtcaggctgatggctgggcgtggtggctcacgcctgtaatcccagcactttgggaggctgaggtgggtggaccatgaggtcaggagttcgagaccatcctgaccaatatggtgaaaccccatctctactaaaaaatacaaaaattagccgggtgtggtggcatgcgcctgtggtcccagctactcgggaggctgaggcagcagaattgtttgaactggggatgtggaggttgctgtgagccaagatctcaccactgcactccagcctgggcgacaaagcgagacgccatctcaaaaaaaaaaaa

SEQ ID NO: 371383 - DNA, 379 bp, Homo sapiens
tattttacacaggcttggtatcatatatacaatccacagtcaacccatgtataaactcacacttgaatcaccagttgatgaaaaatattatctattcttggtatagtatgataatataatatatgtaataggatattataatatcatttatataacataagaatacctgtagcagaactgatctctacaagtctcatacattattagtcatattacaagaatttcctgtacattttagcattttattgtcctttatactttctatttcacattaagaaggttttttttttccgtcactttcctctatagccatcactcaatcttaaattgacaaagcaaatcctccagtggcatcaaatgcacaccatgtgttagccaa

SEQ ID NO: 371384 - DNA, 370 bp, Homo sapiens
ttttgagacagggtcttactctgtcgcccaggtggcaatgtagtgattgtggctcactgtggtctggacctcctagactcaagcaattctcccacctcagcctcctgagtagctgggactacagtgtgcaccaccatgcccagctaatttttgtaatttttttgtagaggtggggttttgccatgttgcccaggctgatctttaaactcctgggctcaagtgatctgcccaccttggcctcccaaagtgctgggattgcaggtgtgagccactttgcccagcccagtgtgcttttgaaaaaagccctttgcattccctagaatggctgggcacagtggctcatgccagtaatccctgcactttgggaggc

SEQ ID NO: 371385 - DNA, 484 bp, Homo sapiens
tcgtctcaaactcctgagctcaagcaatccacccgcctcagcctccgaaagtgctgggattgcaggtgtgagccactgcgcccagccaaaattttctgattttttgacataaggtttttcatagtaaattctcatcttattttggtagaagcttttttttcacataaccatacagttcacccatttgaagtgtaaaagtcaatgctttcagcacattcacagagttgtacagtcacaatcaaatttagaacaaatataaatgccagcccattatcagccacccttcattcttccctccctcaaccgtatgcagccaccactctgctttctgaccctgtagatttgcctgctctgggcatttcatatgagtagatcataccatatgtggccctttgtgactggctttcacaaagcataattttcacttagcataattttccttttatttttcttaagatggagccttgctctgtcacccaggcta

SEQ ID NO: 371386 - DNA, 456 bp, Homo sapiens
  misc_feature (376)..(376): n is a, c, g, or t
ggtcttaagaggttgctgccacttaggaaggttgcgttgtgctttgcttccctgagtgctagaaaagctcgcctttctgtcatgctgaactgtaacgccaatgaaaacctcagagtgctctgccaatgtttaaatgaccaaattgaaggcatcagggccactttcaggggttcctatgtttcctcctcctaattaggatttgccaggctcccctcctccttcatcctattacttaatacatctgcgccctgctactgtcttgttctgttctaaaggtaaaccctcagtagggcttactcagaggaggcgccgagagcgagcgagggctgtgaggactgccagcacgctgtcacctctcacaaccactctttccctnactcacctcaaccagaagttgcagtgagccaagatcacgtcactgcactccagcctgggtgacagagtgaccctgtctca

SEQ ID NO: 371387 - DNA, 635 bp, Homo sapiens
aaatggattttatgatttgtgaattatatattaaaaaataaagaaaaagtaggctagggctcaggccccttcctctggatggcagtggtggcaggggggtggtttggaaagactcccccccacacacacaccaggcctcaccccactccttccatctgggggacagaggcttcggctcaccgagagtgacaagctgcaggtgcagatccaggcgtacctggacaatatttttgatgtgggggcgctgctggaggacacagagaccaagaacgctgtgctggagcacatggaggaactgcaggagcaagtggcgctggtgagagtgggtcctgaccccagcccagcacatcataggcccacagggcacacgggccacagggccacgcaagcatgggcactgggcagcagacagtgttataattgtgcattggaggtgctgcctgcctggccccagagcctggcctgaatccaaagcctgaatctgttgggtgtctttctcaatgagtgtgggtgagcaccctcactgacaggcccctcctctacccaggctcagaccccaggtgaactgaaatgggtgcctggggcccctcccagctcagtctcctcctctccctccacctcccgcatcactggta

SEQ ID NO: 371388 - DNA, 499 bp, Homo sapiens
accggcggtgccagtgccgggctgcgggtcggggctcaccatgtgctggtgctacagctgacagagcggcttcgggacgcggagaacgaatccatggccaagattgcagaactggaaaaacagctaagccaggcgcgcaaggagttggagaccctgcgggagcgcttcagcgaatcgaccgccatgggcgcctccaggcgtcccccagagcctgagaaagcgcctcccgctgccccgacgcggccctcggccctggagctgaaggtggaggagctggaggagaaggggttaatccgtattctgcgggggccgggggatgctgtctccatcgagatcctccccgtcgctgtggcaactccgagcggcggtgatgctccgactccgggggtgccgaccggctcccccagcccagatctcgcacctgcagcagagccggctcccggagcagcgccaccgccgccgcccccactgcccggcctcccctccccgcaggaagccc

SEQ ID NO: 371389 - DNA, 1828 bp, Homo sapiens
ctccagtagtacccccagtgctcaccactgcccccaaacccccgtcccaggagtgaaggccaagaagcccatccagactaagttccgaatgccactcttgaactgggtggcactgaaacccagccagatcaccggcactgtcttcacagagctcaatgatgagaaggtgctgcaggagctagacatgagtgattttgaggaacagttcaagaccaagtcccaaggccccagcctggacctcagcgctctcaagagtaaggcagcccagaaggcccccagcaaggcgacactcattgaggccaaccgggccaagaacttggccatcaccctgcggaagggcaacctgggggccgagcgcatctgccaagccattgaggcgtacgacctgcaggctctgggcctggacttcctggagctgctgatgcgcttcctgcccacagagtatgagcgcagcctcatcacccgctttgagcgggagcagcggccaatggaggagctgtcagaggaggaccgcttcatgctatgcttcagccgcatcccgcgcctgccggagcgcatgaccacactcaccttcctgggcaacttcccggacacagcccagctgctcatgccgcaactgaatgccatcattgcagcctcaatgtccatcaagtcctctgacaaactccgccagatcctggagattgtcctggcctttggcaactacatgaacagtagcaagcgtggggcagcctatggcttccggctccagagcctggatgcgctgttggagatgaagtcgactgatcgcaagcagacgctgctgcactacctggtgaaggtcattgctgagaagtacccgcaactcacaggcttccacagcgacctgcacttcctggacaaggcgggctcagtgtccctggacagtgtcctggcggacgtgcgctccctgcagcgaggcctagagttgacacagagagagtttgtgcggcaggatgactgcatggtgctcaaggagttcctgagggccaactcgcccaccatggacaagctgctggcagacagcaagacggctcaggaggcctttgagtctgtggtggagtacttcggagagaaccccaagaccacatccccaggcctgttcttctccctctttagccgcttcattaaggcctacaagaaagctgagcaggaggtggaacagtggaaaaaagaagccgctgcccaggaggcaggcgctgataccccgggcaaaggggagcccccagcacccaagtcaccgccaaaggcccggcggccacagatggacctcatctctgagctgaaacggaggcagcagaaggagccactcatttatgagagcgaccgtgatggggccattgaagacatcatcacagatctgcggaaccagccctacatccgcgcagacacaggccgccgcagtgcccgtcggcgtcccccgggccccccactgcaggtcacctccgacctctcgctgtagccgctatttctgcaggtggattctgcaggggtgtggggccgtggacaggctgaggctcaaggaaggtggtcctcagctcggctggccgggcagcccctcctccgctgtggcccgcctcaaacgggctggtgcatcctcctcttggccacagagggcagcatcgcccgccccttcccccaaatgctgcttgcagcacccaccctaaagccccctccaaatagccatacttagcctcagcaggagcctggcctgtaacttataaagtgcacctcgcccccgcaagccccagccccgaggaccgtccatggaccttatttttatatgagattaataaagatgtttgcaaaa

SEQ ID NO: 371390 - DNA, 2120 bp, Homo sapiens
cgccaccacctccgggcactgacgggccggtgcctccgccgccgccgccgccgcgccgcctcccggaggtcctcctgatgccctaggaagacgcgactcagaattgggcccaggagtgaaggccaagaagcccatccagactaagttccgaatgccactcttgaactgggtggcactgaaacccagccagatcaccggcactgtcttcacagagctcaatgatgagaaggtgctgcaggagctagacatgagtgattttgaggaacagttcaagaccaagtcccaaggccccagcctggacctcagcgctctcaagagtaaggcagcccagaaggcccccagcaaggcgacactcattgaggccaaccgggccaagaacttggccatcaccctgcggaagggcaacctgggggccgagcgcatctgccaagccattgaggcgtacgacctgcaggctctgggcctggacttcctggagctgctgatgcgcttcctgcccacagagtatgagcgcagcctcatcacccgctttgagcgggagcagcggccaatggaggagctgtcagaggaggaccgcttcatgctatgcttcagccgcatcccgcgcctgccggagcgcatgaccacactcaccttcctgggcaacttcccggacacagcccagctgctcatgccggtgtgggcggagcgggcagggcggtgtgacttgggaggggatgggcaggaggcaactcccagcctgggctgcggcagggaacctgggagtacttgagcctccagatggaggaggctccaacttatcttacctcccccatcccacccccagcaactgaatgccatcattgcagcctcaatgtccatcaagtcctctgacaaactccgccagatcctggagattgtcctggcctttggcaactacatgaacagtagcaagcgtggggcagcctatggcttccggctccagagcctggatgcggtgaggaggggcccctggcttggggactggggctggggactggctggtggcctgtggcttacaatgggtccttgtgcagctgttggagatgaagtcgactgatcgcaagcagacgctgctgcactacctggtgaaggtcattgctgagaagtacccgcaactcacaggcttccacagcgacctgcacttcctggacaaggcgggctcagtgtccctggacagtgtcctggcggacgtgcgctccctgcagcgaggcctagagttgacacagagagagtttgtgcggcaggatgactgcatggtgctcaaggagttcctgagggccaactcgcccaccatggacaagctgctggcagacagcaagacggctcaggaggcctttgagtctgtggtggagtacttcggagagaaccccaagaccacatccccaggcctgttcttctccctctttagccgcttcattaaggcctacaagaaagctgagcaggaggtggaacagtggaaaaaagaagccgctgcccaggaggcaggcgctgataccccgggcaaaggggagcccccagcacccaagtcaccgccaaaggcccggcggccacagatggacctcatctctgagctgaaacggaggcagcagaaggagccactcatttatgagagcgaccgtgatggggccattgaagacatcatcacagatctgcggaaccagccctacatccgcgcagacacaggccgccgcagtgcccgtcggcgtcccccgggccccccactgcaggtcacctccgacctctcgctgtagccgctatttctgcaggtggattctgcaggggtgtggggccgtggacaggctgaggctcaaggaaggtggtcctcagctcggctggccgggcagcccctcctccgctgtggcccgcctcaaacgggctggtgcatcctcctcttggccacagagggcagcatcgcccgccccttcccccaaatgctgcttgcagcacccaccctaaagccccctccaaatagccatacttagcctcagcaggagcctggcctgtaacttataaagtgcacctcgcccccgcaagccccagccccgaggaccgtccatggaccttatttttatatgagattaataaagatgtttgcaaaa

SEQ ID NO: 371391 - DNA, 2298 bp, Homo sapiens
ctccagtagtacccccagtgctcaccactgcccccaaacccccgtcccaggagtgaaggccaagaagcccatccagactaagttccgaatgccactcttgaactgggtggcactgaaacccagccagatcaccggcactgtcttcacagagctcaatgatgagaaggtgctgcaggagctagacatgagtgattttgaggaacagttcaagaccaagtcccaaggccccagcctggacctcagcgctctcaagagtaaggcagcccagaaggcccccagcaaggcgacactcattgaggccaaccgggccaagaacttggccatcaccctgcggaagggcaacctgggggccgagcgcatctgccaagccattgaggcgtgagtgtccctgtcctgggtttgtgggcagtccggcccctttgctaggctggggttgtcaggcagatcctagtaaaagagcctcaatggtgagctctttcatcaggcttcataccaaccctggtccaggaaacttgtccccattttaaggtggagaaaactcagtccatgcctaaattaggatgtcccacttcctccctgcctctttgcctagctgtgagcacccaggctgtgggatttacagccgggcgtccgccgctgacgtacgatggggaccctggctgcccagttcccagtttctctggattcccagttcccagtttctctggattcctacctcttgctctctgaagctgttggcaaatagaaaatactgaaattcatttattcaatcaaggcaggggtagccctgctcccagggactggtgggtatggatgatgcccaatctcccctctcctccctctcacaggtacgacctgcaggctctgggcctggacttcctggagctgctgatgcgcttcctgcccacagagtatgagcgcagcctcatcacccgctttgagcgggagcagcggccaatggaggagctgtcagaggaggaccgcttcatgctatgcttcagccgcatcccgcgcctgccggagcgcatgaccacactcaccttcctgggcaacttcccggacacagcccagctgctcatgccgcaactgaatgccatcattgcagcctcaatgtccatcaagtcctctgacaaactccgccagatcctggagattgtcctggcctttggcaactacatgaacagtagcaagcgtggggcagcctatggcttccggctccagagcctggatgcgctgttggagatgaagtcgactgatcgcaagcagacgctgctgcactacctggtgaaggtcattgctgagaagtacccgcaactcacaggcttccacagcgacctgcacttcctggacaaggcgggctcagtgtccctggacagtgtcctggcggacgtgcgctccctgcagcgaggcctagagttgacacagagagagtttgtgcggcaggatgactgcatggtgctcaaggagttcctgagggccaactcgcccaccatggacaagctgctggcagacagcaagacggctcaggaggcctttgagtctgtggtggagtacttcggagagaaccccaagaccacatccccaggcctgttcttctccctctttagccgcttcattaaggcctacaagaaagctgagcaggaggtggaacagtggaaaaaagaagccgctgcccaggaggcaggcgctgataccccgggcaaaggggagcccccagcacccaagtcaccgccaaaggcccggcggccacagatggacctcatctctgagctgaaacggaggcagcagaaggagccactcatttatgagagcgaccgtgatggggccattgaagacatcatcacagatctgcggaaccagccctacatccgcgcagacacaggccgccgcagtgcccgtcggcgtcccccgggccccccactgcaggtcacctccgacctctcgctgtagccgctatttctgcaggtggattctgcaggggtgtggggccgtggacaggctgaggctcaaggaaggtggtcctcagctcggctggccgggcagcccctcctccgctgtggcccgcctcaaacgggctggtgcatcctcctcttggccacagagggcagcatcgcccgccccttcccccaaatgctgcttgcagcacccaccctaaagccccctccaaatagccatacttagcctcagcaggagcctggcctgtaacttataaagtgcacctcgcccccgcaagccccagccccgaggaccgtccatggaccttatttttatatgagattaataaagatgtttgcaaaa

SEQ ID NO: 371392 - DNA, 1275 bp, Homo sapiens
ggtgtcctcagctctggcattctgctgagcctttctcctgcctctcccagattgtcctggcctttggcaactacatgaacagtagcaagcgtggggcagcctatggcttccggctccagagcctggatgcggtgaggaggggcccctggcttggggactggggctggggactggctggtggcctgtggcttacaatgggtccttgtgcagctgttggagatgaagtcgactgatcgcaagcagacgctgctgcactacctggtgaaggtcattgctgagaagtacccgcaactcacaggcttccacagcgacctgcacttcctggacaaggcgggctcagtgtccctggacagtgtcctggcggacgtgcgctccctgcagcgaggcctagagttgacacagagagagtttgtgcggcaggatgactgcatggtgctcaaggagttcctgagggccaactcgcccaccatggacaagctgctggcagacagcaagacggctcaggaggcctttgagtctgtggtggagtacttcggagagaaccccaagaccacatccccaggcctgttcttctccctctttagccgcttcattaaggcctacaagaaagctgagcaggaggtggaacagtggaaaaaagaagccgctgcccaggaggcaggcgctgataccccgggcaaaggggagcccccagcacccaagtcaccgccaaaggcccggcggccacagatggacctcatctctgagctgaaacggaggcagcagaaggagccactcatttatgagagcgaccgtgatggggccattgaagacatcatcacagatctgcggaaccagccctacatccgcgcagacacaggccgccgcagtgcccgtcggcgtcccccgggccccccactgcaggtcacctccgacctctcgctgtagccgctatttctgcaggtggattctgcaggggtgtggggccgtggacaggctgaggctcaaggaaggtggtcctcagctcggctggccgggcagcccctcctccgctgtggcccgcctcaaacgggctggtgcatcctcctcttggccacagagggcagcatcgcccgccccttcccccaaatgctgcttgcagcacccaccctaaagccccctccaaatagccatacttagcctcagcaggagcctggcctgtaacttataaagtgcacctcgcccccgcaagccccagccccgaggaccgtccatggaccttatttttatatgagattaataaagatgtttgcaaaa

SEQ ID NO: 371393 - DNA, 1789 bp, Homo sapiens
cgccaccacctccgggcactgacgggccggtgcctccgccgccgccgccgccgcgccgcctcccggaggtcctcctgatgccctaggaagacgcgactcagaattgggcccaggagtgaaggccaagaagcccatccagactaagttccgaatgccactcttgaactgggtggcactgaaacccagccagatcaccggcactgtcttcacagagctcaatgatgagaaggtgctgcaggagctagacatgagtgattttgaggaacagttcaagaccaagtcccaaggccccagcctggacctcagcgctctcaagagtaaggcagcccagaaggcccccagcaaggcgacactcattgaggccaaccgggccaagaacttggccatcaccctgcggaagggcaacctgggggccgagcgcatctgccaagccattgaggcgtacgacctgcaggctctgggcctggacttcctggagctgctgatgcgcttcctgcccacagagtatgagcgcagcctcatcacccgctttgagcgggagcagcggccaatggaggagctgtcagaggaggaccgcttcatgctatgcttcagccgcatcccgcgcctgccggagcgcatgaccacactcaccttcctgggcaacttcccggacacagcccagctgctcatgccgcaactgaatgccatcattgcagcctcaatgtccatcaagtcctctgacaaactccgccagatcctggagattgtcctggcctttggcaactacatgaacagtagcaagcgtggggcagcctatggcttccggctccagagcctggatgcgctgttggagatgaagtcgactgatcgcaagcagacgctgctgcactacctggtgaaggtcattgctgagaagtacccgcaactcacaggcttccacagcgacctgcacttcctggacaaggcgggctcagtgtccctggacagtgtcctggcggacgtgcgctccctgcagcgaggcctagagttgacacagagagagtttgtgcggcaggatgactgcatggtgctcaaggagttcctgagggccaactcgcccaccatggacaagctgctggcagacagcaagacggctcagaaagctgagcaggaggtggaacagtggaaaaaagaagccgctgcccaggaggcaggcgctgataccccgggcaaaggggagcccccagcacccaagtcaccgccaaaggcccggcggccacagatggacctcatctctgagctgaaacggaggcagcagaaggagccactcatttatgagagcgaccgtgatggggccattgaagacatcatcacagatctgcggaaccagccctacatccgcgcagacacaggccgccgcagtgcccgtcggcgtcccccgggccccccactgcaggtcacctccgacctctcgctgtagccgctatttctgcaggtggattctgcaggggtgtggggccgtggacaggctgaggctcaaggaaggtggtcctcagctcggctggccgggcagcccctcctccgctgtggcccgcctcaaacgggctggtgcatcctcctcttggccacagagggcagcatcgcccgccccttcccccaaatgctgcttgcagcacccaccctaaagccccctccaaatagccatacttagcctcagcaggagcctggcctgtaacttataaagtgcacctcgcccccgcaagccccagccccgaggaccgtccatggaccttatttttatatgagattaataaagatgtttgcaaaa

SEQ ID NO: 371394 - DNA, 2325 bp, Homo sapiens
cgccaccacctccgggcactgacgggccggtgcctccgccgccgccgccgccgcgccgcctcccggaggtcctcctgatgccctaggaagacgcgactcagaattgggcccaggagtgaaggccaagaagcccatccagactaagttccgaatgccactcttgaactgggtggcactgaaacccagccagatcaccggcactgtcttcacagagctcaatgatgagaaggtgctgcaggagctagacatgagtgattttgaggaacagttcaagaccaagtcccaaggccccagcctggacctcagcgctctcaagagtaaggcagcccagaaggcccccagcaaggcgacactcattgaggccaaccgggccaagaacttggccatcaccctgcggaagggcaacctgggggccgagcgcatctgccaagccattgaggcgtacgacctgcaggctctgggcctggacttcctggagctgctgatgcgcttcctgcccacagagtatgagcgcagcctcatcacccgctttgagcgggagcagcggccaatggaggagctgtcagaggaggaccgcttcatgctatgcttcagccgcatcccgcgcctgccggagcgcatgaccacactcaccttcctgggcaacttcccggacacagcccagctgctcatgccgcaactgaatgccatcattgcagcctcaatgtccatcaagtcctctgacaaactccgccagatcctggagattgtcctggcctttggcaactacatgaacagtagcaagcgtggggcagcctatggcttccggctccagagcctggatgcgctgttggagatgaagtcgactgatcgcaagcagacgctgctgcactacctggtgaaggtcattgctgagaagtacccgcaactcacaggcttccacagcgacctgcacttcctggacaaggcgggctcagtgtccctggacagtgtcctggcggacgtgcgctccctgcagcgaggcctagagttgacacagagagagtttgtgcggcaggatgactgcatggtgctcaaggagttcctgagggccaactcgcccaccatggacaagctgctggcagacagcaagacggctcagaaagctgagcaggaggtggaacagtggaaaaaagaagccgctgcccaggaggcaggcgctgataccccgggcaaaggggagcccccagcacccaagtcaccgccaaaggcccggcggccacagatggacctcatctctgagctgaaacggaggcagcagaaggagccactcatttatgagagcgaccgtgatggggccattgaagacatcatcacaggtaagggcttggccaggccttggtcttatcctcagtctgtccttctatgctttcttctgacccaatgcgctatcctctgggggactggctgccacactgcttcttgctaccttttctgtttttctttcctttttcctttctctactccccttcacctgccccacccccactcagtgatcaagacggtgcccttcacggcccgcaccggcaagcggacatcccggctcctctgtgaggccagcctgggagaagagatgcccctctagcccctcaggtacccagatgacctggcctctgataccacgctgcccacagcccctgggacccttgggagaactgaggcatgctgccttctcctgggccagtggatggctgggatgtgatttgtggggtggaggggtctggcaaacataaacggtacccctgccatgtgcacacaatctgagtccttaggaggctaagctttgtgccctggagccatgctcccagctctgggcggactcctgaatggtaaatgtgtctccttcggctgccagatctgcggaaccagccctacatccgcgcagacacaggccgccgcagtgcccgtcggcgtcccccgggccccccactgcaggtcacctccgacctctcgctgtagccgctatttctgcaggtggattctgcaggggtgtggggccgtggacaggctgaggctcaaggaaggtggtcctcagctcggctggccgggcagcccctcctccgctgtggcccgcctcaaacgggctggtgcatcctcctcttggccacagagggcagcatcgcccgccccttcccccaaatgctgcttgcagcacccaccctaaagccccctccaaatagccatacttagcctcagcaggagcctggcctgtaacttataaagtgcacctcgcccccgcaagccccagccccgaggaccgtccatggaccttatttttatatgagattaataaagatgtttgcaaaa

SEQ ID NO: 371395 - DNA, 1368 bp, Homo sapiens
cgccaccacctccgggcactgacgggccggtgcctccgccgccgccgccgccgcgccgcctcccggaggtcctcctgatgccctaggaagacgcgactcagaattgggcccaggagtgaaggccaagaagcccatccagactaagttccgaatgccactcttgaactgggtggcactgaaacccagccagatcaccggcactgtcttcacagagctcaatgatgagaaggtgctgcaggagctagacatgagtgattttgaggaacagttcaagaccaagtcccaaggccccagcctggacctcagcgctctcaagagtaaggcagcccagaaggcccccagcaaggcgacactcattgaggccaaccgggccaagaacttggccatcaccctgcggaagggcaacctgggggccgagcgcatctgccaagccattgaggcgtacgacctgcaggctctgggcctggacttcctggagctgctgatgcgcttcctgcccacagagtatgagcgcagcctcatcacccgctttgagcgggagcagcggccaatggaggagctgtcagaggaggaccgcttcatgctatgcttcagccgcatcccgcgcctgccggagcgcatgaccacactcaccttcctgggcaacttcccggacacagcccagctgctcatgccgcaactgaatgccatcattgcagcctcaatgtccatcaagtcctctgacaaactccgccagatcctggagattgtcctggcctttggcaactacatgaacagtagcaagcgtggggcagcctatggcttccggctccagagcctggatgcgctgttggagatgaagtcgactgatcgcaagcagacgctgctgcactacctggtgaaggtcattgctgagaagtacccgcaactcacaggcttccacagcgacctgcacttcctggacaaggcgggctcagtgtccctggacagtgtcctggcggacgtgcgctccctgcagcgaggcctagagttgacacagagagagtttgtgcggcaggatgactgcatggtgctcaaggagttcctgagggccaactcgcccaccatggacaagctgctggcagacagcaagacggctcaggaggcctttgagtctgtggtggagtacttcggagagaaccccaagaccacatccccaggcctgttcttctccctctttagccgcttcattaaggcctacaagaaagctgagcaggaggtggaacagtggaaaaaagaagccgctgcccaggaggcaggcgctgataccccgggcaaaggggagcccccagcacccaaggtaggcaactgctcctgggcttggtactgggctgcagggatgcatggcat

SEQ ID NO: 371396 - DNA, 1272 bp, Homo sapiens
cgccaccacctccgggcactgacgggccggtgcctccgccgccgccgccgccgcgccgcctcccggaggtcctcctgatgccctaggaagacgcgactcagaattgggcccaggagtgaaggccaagaagcccatccagactaagttccgaatgccactcttgaactgggtggcactgaaacccagccagatcaccggcactgtcttcacagagctcaatgatgagaaggtgctgcaggagctagacatgagtgattttgaggaacagttcaagaccaagtcccaaggccccagcctggacctcagcgctctcaagagtaaggcagcccagaaggcccccagcaaggcgacactcattgaggccaaccgggccaagaacttggccatcaccctgcggaagggcaacctgggggccgagcgcatctgccaagccattgaggcgtacgacctgcaggctctgggcctggacttcctggagctgctgatgcgcttcctgcccacagagtatgagcgcagcctcatcacccgctttgagcgggagcagcggccaatggaggagctgtcagaggaggaccgcttcatgctatgcttcagccgcatcccgcgcctgccggagcgcatgaccacactcaccttcctgggcaacttcccggacacagcccagctgctcatgccgcaactgaatgccatcattgcagcctcaatgtccatcaagtcctctgacaaactccgccagatcctggagattgtcctggcctttggcaactacatgaacagtagcaagcgtggggcagcctatggcttccggctccagagcctggatgcgctgttggagatgaagtcgactgatcgcaagcagacgctgctgcactacctggtgaaggtcattgctgagaagtacccgcaactcacaggcttccacagcgacctgcacttcctggacaaggcgggctcagtgtccctggacagtgtcctggcggacgtgcgctccctgcagcgaggcctagagttgacacagagagagtttgtgcggcaggatgactgcatggtgctcaaggagttcctgagggccaactcgcccaccatggacaagctgctggcagacagcaagacggctcaggaggcctttgagtctgtggtggagtacttcggagagaaccccaagaccacatccccaggcctgttcttctccctctttagccgcttcattaaggcctacaaggtattcgggtctggggcaggctgggagccctgtagggcactgaagccttt

SEQ ID NO: 371397 - DNA, 1169 bp, Homo sapiens
  misc_feature (1166)..(1166): n is a, c, g, or t
cgccaccacctccgggcactgacgggccggtgcctccgccgccgccgccgccgcgccgcctcccggaggtcctcctgatgccctaggaagacgcgactcagaattgggcccaggagtgaaggccaagaagcccatccagactaagttccgaatgccactcttgaactgggtggcactgaaacccagccagatcaccggcactgtcttcacagagctcaatgatgagaaggtgctgcaggagctagacatgagtgattttgaggaacagttcaagaccaagtcccaaggccccagcctggacctcagcgctctcaagagtaaggcagcccagaaggcccccagcaaggcgacactcattgaggccaaccgggccaagaacttggccatcaccctgcggaagggcaacctgggggccgagcgcatctgccaagccattgaggcgtacgacctgcaggctctgggcctggacttcctggagctgctgatgcgcttcctgcccacagagtatgagcgcagcctcatcacccgctttgagcgggagcagcggccaatggaggagctgtcagaggaggaccgcttcatgctatgcttcagccgcatcccgcgcctgccggagcgcatgaccacactcaccttcctgggcaacttcccggacacagcccagctgctcatgccgcaactgaatgccatcattgcagcctcaatgtccatcaagtcctctgacaaactccgccagatcctggagattgtcctggcctttggcaactacatgaacagtagcaagcgtggggcagcctatggcttccggctccagagcctggatgcgctgttggagatgaagtcgactgatcgcaagcagacgctgctgcactacctggtgaaggtcattgctgagaagtacccgcaactcacaggcttccacagcgacctgcacttcctggacaaggcgggctcagtgtccctggacagtgtcctggcggacgtgcgctccctgcagcgaggcctagagttgacacagagagagtttgtgcggcaggatgactgcatggtgctcaaggagttcctgagggccaactcgcccaccatggacaagctgctggcagacagcaagacggctcaggtgcgccagggctggcctcacctggaggtggggcatgtaggagcantag

SEQ ID NO: 371398 - DNA, 623 bp, Homo sapiens
  misc_feature (47)..(47): n is a, c, g, or t
ttttggtgatggggaggcatcctggagctggagctataaattccccntagtcaccgccaaaggcccggcggccacagatggacctcatctctgagctgaaacggaggcagcagaaggagccactcatttatgagagcgaccgtgatggggccattgaagacatcatcacagatctgcggaaccagccctacatccgcgcagacacaggccgccgcagtgcccgtcggcgtcccccgggccccccactgcaggtcacctccgacctctcgctgtagccgctatttctgcaggtggattctgcaggggtgtggggccgtggacaggctgaggctcaaggaaggtggtcctcagctcggctggccgggcagcccctcctccgctgtggcccgcctcaaacgggctggtgcatcctcctcttggccacagagggcagcatcgcccgccccttcccccaaatgctgcttgcagcacccaccctaaagccccctccaaatagccatacttagcctcagcaggagcctggcctgtaacttataaagtgcacctcgcccccgcaagccccagccccgaggaccgtccatggaccttatttttatatgagattaataaagatgtttgcaaaa

SEQ ID NO: 371399 - DNA, 1351 bp, Homo sapiens
cgccaccacctccgggcactgacgggccggtgcctccgccgccgccgccgccgcgccgcctcccggaggtcctcctgatgccctaggaagacgcgactcagaattgggcccaggagtgaaggccaagaagcccatccagactaagttccgaatgccactcttgaactgggtggcactgaaacccagccagatcaccggcactgtcttcacagagctcaatgatgagaaggtgctgcaggagctagacatgagtgattttgaggaacagttcaagaccaagtcccaaggccccagcctggacctcagcgctctcaagagtaaggcagcccagaaggcccccagcaaggcgacactcattgaggccaaccgggccaagaacttggccatcaccctgcggaagggcaacctgggggccgagcgcatctgccaagccattgaggcgtacgacctgcaggctctgggcctggacttcctggagctgctgatgcgcttcctgcccacagagtatgagcgcagcctcatcacccgctttgagcgggagcagcggccaatggaggagctgtcagaggaggaccgcttcatgctatgcttcagccgcatcccgcgcctgccggagcgcatgaccacactcaccttcctgggcaacttcccggacacagcccagctgctcatgccggtgtgggcggagcgggcagggcggtgtgacttgggaggggatgggcaggaggcaactcccagcctgggctgcggcagggaacctgggagtacttgagcctccagatggaggaggctccaacttatcttacctcccccatcccacccccagcaactgaatgccatcattgcagcctcaatgtccatcaagtcctctgacaaactccgccagatcctggagattgtcctggcctttggcaactacatgaacagtagcaagcgtggggcagcctatggcttccggctccagagcctggatgcgctgttggagatgaagtcgactgatcgcaagcagacgctgctgcactacctggtgaaggtcattgctgagaagtacccgcaactcacaggcttccacagcgacctgcacttcctggacaaggcgggctcagtgtccctggacagtgtcctggcggacgtgcgctccctgcagcgaggcctagagttgacacagagagagtttgtgcggcaggatgactgcatggtgctcaaggagttcctgagggccaactcgcccaccatggacaagctgctggcagacagcaagacggctcaggaggcctttgagtctgtggtggagtacttcggagagaaccccaagggctcattcgaaacaattgccgggggtccgagccaa

SEQ ID NO: 371400 - DNA, 1013 bp, Homo sapiens
gctgaccccagcccacagcaggaaggccctgcggaattcccgcatcgtcagccagaaggacgacgtccacgtctgtattatgtgcctacgcgccatcatgaactaccagtctggcttcagccttgtcatgaaccacccagcctgtgtcaatgagattgctctgagcctcaacaacaagaaccccagaaccaaggctctggtgctggagctgctggcggccgtgtgcttggtgcggggaggacatgacatcatccttgcagcctttgacaacttcaaggaggtgtgtggggagcagcaccgctttgaaaagctgatggaatatttccggaatgaggacagcaacatcgacttcatggtggcctgcatgcagttcatcaacattgtggtacattcggtggagaacatgaacttccgtgtcttcctgcaatatgagttcacccacttgggcctggacctgtacttggagaggcttcggctcaccgagagtgacaagctgcaggtgcagatccaggcgtacctggacaatatttttgatgtgggggcgctgctggaggacacagagaccaagaacgctgtgctggagcacatggaggaactgcaggagcaagtggcgctgctgacagagcggcttcgggacgcggagaacgaatccatggccaagattgcagaactggaaaaacagctaagccaggcgcgcaaggagttggagaccctgcgggagcgcttcagcgaatcgaccgccatgggcgcctccaggcgtcccccagagcctgagaaagcgcctcccgctgccccgacgcggccctcggccctggagctgaaggtggaggagctggaggagaaggggttaatccgtattctgcgggggccgggggatgctgtctccatcgagatcctccccgtcgctgtggcaactccgagcggcggtgatgctccgactccgggggtgccgaccggctcccccagcccagatctcgcacctacagaccccatgcctacgggatcctctagac

SEQ ID NO: 371401 - DNA, 1058 bp, Homo sapiens
gctgaccccagcccacagcaggaaggccctgcggaattcccgcatcgtcagccagaaggacgacgtccacgtctgtattatgtgcctacgcgccatcatgaactaccagtctggcttcagccttgtcatgaaccacccagcctgtgtcaatgagattgctctgagcctcaacaacaagaaccccagaaccaaggctctggtgctggagctgctggcggccgtgtgcttggtgcggggaggacatgacatcatccttgcagcctttgacaacttcaaggaggtgtgtggggagcagcaccgctttgaaaagctgatggaatatttccggaatgaggacagcaacatcgacttcatggtggcctgcatgcagttcatcaacattgtggtacattcggtggagaacatgaacttccgtgtcttcctgcaatatgagttcacccacttgggcctggacctgtacttggagaggcttcggctcaccgagagtgacaagctgcaggtgcagatccaggcgtacctggacaatatttttgatgtgggggcgctgctggaggacacagagaccaagaacgctgtgctggagcacatggaggaactgcaggagcaagtggcgctgctgacagagcggcttcgggacgcggagaacgaatccatggccaagattgcagaactggaaaaacagctaagccaggcgcgcaaggagttggagaccctgcgggagcgcttcagcgaatcgaccgccatgggcgcctccaggcgtcccccagagcctgagaaagcgcctcccgctgccccgacgcggccctcggccctggagctgaaggtggaggagctggaggagaaggggttaatccgtattctgcgggggccgggggatgctgtctccatcgagatcctccccgtcgctgtggcaactccgagcggcggtgatgctccgactccgggggtgccgaccggctcccccagcccagatctcgcacctgcagcagagccggctcccggagcagcgccaccgccgccgcccccactgcccggcctcccctccccgcaggaagccc

SEQ ID NO: 371402 - DNA, 713 bp, Homo sapiens
aaatggattttatgatttgtgaattatatattaaaaaataaagaaaaagtaggctagggctcaggccccttcctctggatggcagtggtggcaggggggtggtttggaaagactcccccccacacacacaccaggcctcaccccactccttccatctgggggacagaggcttcggctcaccgagagtgacaagctgcaggtgcagatccaggcgtacctggacaatatttttgatgtgggggcgctgctggaggacacagagaccaagaacgctgtgctggagcacatggaggaactgcaggagcaagtggcgctgctgacagagcggcttcgggacgcggagaacgaatccatggccaagattgcagaactggaaaaacagctaagccaggcgcgcaaggagttggagaccctgcgggagcgcttcagcgaatcgaccgccatgggcgcctccaggcgtcccccagagcctgagaaagcgcctcccgctgccccgacgcggccctcggccctggagctgaaggtggaggagctggaggagaaggggttaatccgtattctgcgggggccgggggatgctgtctccatcgagatcctccccgtcgctgtggcaactccgagcggcggtgatgctccgactccgggggtgccgaccggctcccccagcccagatctcgcacctacagaccccatgcctacgggatcctctagac

SEQ ID NO: 371403 - DNA, 1891 bp, Homo sapiens
cgccaccacctccgggcactgacgggccggtgcctccgccgccgccgccgccgcgccgcctcccggaggtcctcctgatgccctaggaagacgcgactcagaattgggcccaggagtgaaggccaagaagcccatccagactaagttccgaatgccactcttgaactgggtggcactgaaacccagccagatcaccggcactgtcttcacagagctcaatgatgagaaggtgctgcaggagctagacatgagtgattttgaggaacagttcaagaccaagtcccaaggccccagcctggacctcagcgctctcaagagtaaggcagcccagaaggcccccagcaaggcgacactcattgaggccaaccgggccaagaacttggccatcaccctgcggaagggcaacctgggggccgagcgcatctgccaagccattgaggcgtacgacctgcaggctctgggcctggacttcctggagctgctgatgcgcttcctgcccacagagtatgagcgcagcctcatcacccgctttgagcgggagcagcggccaatggaggagctgtcagaggaggaccgcttcatgctatgcttcagccgcatcccgcgcctgccggagcgcatgaccacactcaccttcctgggcaacttcccggacacagcccagctgctcatgccgcaactgaatgccatcattgcagcctcaatgtccatcaagtcctctgacaaactccgccagatcctggagattgtcctggcctttggcaactacatgaacagtagcaagcgtggggcagcctatggcttccggctccagagcctggatgcgctgttggagatgaagtcgactgatcgcaagcagacgctgctgcactacctggtgaaggtcattgctgagaagtacccgcaactcacaggcttccacagcgacctgcacttcctggacaaggcgggctcagtgtccctggacagtgtcctggcggacgtgcgctccctgcagcgaggcctagagttgacacagagagagtttgtgcggcaggatgactgcatggtgctcaaggagttcctgagggccaactcgcccaccatggacaagctgctggcagacagcaagacggctcaggaggcctttgagtctgtggtggagtacttcggagagaaccccaagaccacatccccaggcctgttcttctccctctttagccgcttcattaaggcctacaagaaagctgagcaggaggtggaacagtggaaaaaagaagccgctgcccaggaggcaggcgctgataccccgggcaaaggggagcccccagcacccaagtcaccgccaaaggcccggcggccacagatggacctcatctctgagctgaaacggaggcagcagaaggagccactcatttatgagagcgaccgtgatggggccattgaagacatcatcacagatctgcggaaccagccctacatccgcgcagacacaggccgccgcagtgcccgtcggcgtcccccgggccccccactgcaggtcacctccgacctctcgctgtagccgctatttctgcaggtggattctgcaggggtgtggggccgtggacaggctgaggctcaaggaaggtggtcctcagctcggctggccgggcagcccctcctccgctgtggcccgcctcaaacgggctggtgcatcctcctcttggccacagagggcagcatcgcccgccccttcccccaaatgctgcttgcagcacccaccctaaagccccctccaaatagccatacttagcctcagcaggagcctggcctgtaacttataaagtgcacctcgcccccgcaagccccagccccgaggaccgtccatggaccttatttttatatgagattaataaagatgtttgcaaaa

SEQ ID NO: 371404 - DNA, 1703 bp, Homo sapiens
tgccagaccccagccccacccagctccgcctcctcaccctgtaccttcaggagctagacatgagtgattttgaggaacagttcaagaccaagtcccaaggccccagcctggacctcagcgctctcaagagtaaggcagcccagaaggcccccagcaaggcgacactcattgaggccaaccgggccaagaacttggccatcaccctgcggaagggcaacctgggggccgagcgcatctgccaagccattgaggcgtacgacctgcaggctctgggcctggacttcctggagctgctgatgcgcttcctgcccacagagtatgagcgcagcctcatcacccgctttgagcgggagcagcggccaatggaggagctgtcagaggaggaccgcttcatgctatgcttcagccgcatcccgcgcctgccggagcgcatgaccacactcaccttcctgggcaacttcccggacacagcccagctgctcatgccgcaactgaatgccatcattgcagcctcaatgtccatcaagtcctctgacaaactccgccagatcctggagattgtcctggcctttggcaactacatgaacagtagcaagcgtggggcagcctatggcttccggctccagagcctggatgcgctgttggagatgaagtcgactgatcgcaagcagacgctgctgcactacctggtgaaggtcattgctgagaagtacccgcaactcacaggcttccacagcgacctgcacttcctggacaaggcgggctcagtgtccctggacagtgtcctggcggacgtgcgctccctgcagcgaggcctagagttgacacagagagagtttgtgcggcaggatgactgcatggtgctcaaggagttcctgagggccaactcgcccaccatggacaagctgctggcagacagcaagacggctcaggaggcctttgagtctgtggtggagtacttcggagagaaccccaagaccacatccccaggcctgttcttctccctctttagccgcttcattaaggcctacaagaaagctgagcaggaggtggaacagtggaaaaaagaagccgctgcccaggaggcaggcgctgataccccgggcaaaggggagcccccagcacccaagtcaccgccaaaggcccggcggccacagatggacctcatctctgagctgaaacggaggcagcagaaggagccactcatttatgagagcgaccgtgatggggccattgaagacatcatcacagatctgcggaaccagccctacatccgcgcagacacaggccgccgcagtgcccgtcggcgtcccccgggccccccactgcaggtcacctccgacctctcgctgtagccgctatttctgcaggtggattctgcaggggtgtggggccgtggacaggctgaggctcaaggaaggtggtcctcagctcggctggccgggcagcccctcctccgctgtggcccgcctcaaacgggctggtgcatcctcctcttggccacagagggcagcatcgcccgccccttcccccaaatgctgcttgcagcacccaccctaaagccccctccaaatagccatacttagcctcagcaggagcctggcctgtaacttataaagtgcacctcgcccccgcaagccccagccccgaggaccgtccatggaccttatttttatatgagattaataaagatgtttgcaaaa

SEQ ID NO: 371405 - DNA, 1970 bp, Homo sapiens
cgccaccacctccgggcactgacgggccggtgcctccgccgccgccgccgccgcgccgcctcccggaggtcctcctgatgccctaggaagacgcgactcagaattgggcccaggagtgaaggccaagaagcccatccagactaagttccgaatgccactcttgaactgggtggcactgaaacccagccagatcaccggcactgtcttcacagagctcaatgatgagaaggtgctgcaggagctagacatgagtgattttgaggaacagttcaagaccaagtcccaaggccccagcctggacctcagcgctctcaagagtaaggcagcccagaaggcccccagcaaggcgacactcattgaggccaaccgggccaagaacttggccatcaccctgcggaagggcaacctgggggccgagcgcatctgccaagccattgaggcgtacgacctgcaggctctgggcctggacttcctggagctgctgatgcgcttcctgcccacagagtatgagcgcagcctcatcacccgctttgagcgggagcagcggccaatggaggagctgtcagaggaggaccgcttcatgctatgcttcagccgcatcccgcgcctgccggagcgcatgaccacactcaccttcctgggcaacttcccggacacagcccagctgctcatgccgcaactgaatgccatcattgcagcctcaatgtccatcaagtcctctgacaaactccgccagatcctggagattgtcctggcctttggcaactacatgaacagtagcaagcgtggggcagcctatggcttccggctccagagcctggatgcggtgaggaggggcccctggcttggggactggggctggggactggctggtggcctgtggcttacaatgggtccttgtgcagctgttggagatgaagtcgactgatcgcaagcagacgctgctgcactacctggtgaaggtcattgctgagaagtacccgcaactcacaggcttccacagcgacctgcacttcctggacaaggcgggctcagtgtccctggacagtgtcctggcggacgtgcgctccctgcagcgaggcctagagttgacacagagagagtttgtgcggcaggatgactgcatggtgctcaaggagttcctgagggccaactcgcccaccatggacaagctgctggcagacagcaagacggctcaggaggcctttgagtctgtggtggagtacttcggagagaaccccaagaccacatccccaggcctgttcttctccctctttagccgcttcattaaggcctacaagaaagctgagcaggaggtggaacagtggaaaaaagaagccgctgcccaggaggcaggcgctgataccccgggcaaaggggagcccccagcacccaagtcaccgccaaaggcccggcggccacagatggacctcatctctgagctgaaacggaggcagcagaaggagccactcatttatgagagcgaccgtgatggggccattgaagacatcatcacagatctgcggaaccagccctacatccgcgcagacacaggccgccgcagtgcccgtcggcgtcccccgggccccccactgcaggtcacctccgacctctcgctgtagccgctatttctgcaggtggattctgcaggggtgtggggccgtggacaggctgaggctcaaggaaggtggtcctcagctcggctggccgggcagcccctcctccgctgtggcccgcctcaaacgggctggtgcatcctcctcttggccacagagggcagcatcgcccgccccttcccccaaatgctgcttgcagcacccaccctaaagccccctccaaatagccatacttagcctcagcaggagcctggcctgtaacttataaagtgcacctcgcccccgcaagccccagccccgaggaccgtccatggaccttatttttatatgagattaataaagatgtttgcaaaa

SEQ ID NO: 371406 - DNA, 1177 bp, Homo sapiens
cgtctacgactccgacctcagtctcatgatcgtcgtgtgtttccggctgatgtacatgaacagtagcaagcgtggggcagcctatggcttccggctccagagcctggatgcgctgttggagatgaagtcgactgatcgcaagcagacgctgctgcactacctggtgaaggtcattgctgagaagtacccgcaactcacaggcttccacagcgacctgcacttcctggacaaggcgggctcagtgtccctggacagtgtcctggcggacgtgcgctccctgcagcgaggcctagagttgacacagagagagtttgtgcggcaggatgactgcatggtgctcaaggagttcctgagggccaactcgcccaccatggacaagctgctggcagacagcaagacggctcaggaggcctttgagtctgtggtggagtacttcggagagaaccccaagaccacatccccaggcctgttcttctccctctttagccgcttcattaaggcctacaagaaagctgagcaggaggtggaacagtggaaaaaagaagccgctgcccaggaggcaggcgctgataccccgggcaaaggggagcccccagcacccaagtcaccgccaaaggcccggcggccacagatggacctcatctctgagctgaaacggaggcagcagaaggagccactcatttatgagagcgaccgtgatggggccattgaagacatcatcacagatctgcggaaccagccctacatccgcgcagacacaggccgccgcagtgcccgtcggcgtcccccgggccccccactgcaggtcacctccgacctctcgctgtagccgctatttctgcaggtggattctgcaggggtgtggggccgtggacaggctgaggctcaaggaaggtggtcctcagctcggctggccgggcagcccctcctccgctgtggcccgcctcaaacgggctggtgcatcctcctcttggccacagagggcagcatcgcccgccccttcccccaaatgctgcttgcagcacccaccctaaagccccctccaaatagccatacttagcctcagcaggagcctggcctgtaacttataaagtgcacctcgcccccgcaagccccagccccgaggaccgtccatggaccttatttttatatgagattaataaagatgtttgcaaaa

SEQ ID NO: 371407 - DNA, 2427 bp, Homo sapiens
cgccaccacctccgggcactgacgggccggtgcctccgccgccgccgccgccgcgccgcctcccggaggtcctcctgatgccctaggaagacgcgactcagaattgggcccaggagtgaaggccaagaagcccatccagactaagttccgaatgccactcttgaactgggtggcactgaaacccagccagatcaccggcactgtcttcacagagctcaatgatgagaaggtgctgcaggagctagacatgagtgattttgaggaacagttcaagaccaagtcccaaggccccagcctggacctcagcgctctcaagagtaaggcagcccagaaggcccccagcaaggcgacactcattgaggccaaccgggccaagaacttggccatcaccctgcggaagggcaacctgggggccgagcgcatctgccaagccattgaggcgtacgacctgcaggctctgggcctggacttcctggagctgctgatgcgcttcctgcccacagagtatgagcgcagcctcatcacccgctttgagcgggagcagcggccaatggaggagctgtcagaggaggaccgcttcatgctatgcttcagccgcatcccgcgcctgccggagcgcatgaccacactcaccttcctgggcaacttcccggacacagcccagctgctcatgccgcaactgaatgccatcattgcagcctcaatgtccatcaagtcctctgacaaactccgccagatcctggagattgtcctggcctttggcaactacatgaacagtagcaagcgtggggcagcctatggcttccggctccagagcctggatgcgctgttggagatgaagtcgactgatcgcaagcagacgctgctgcactacctggtgaaggtcattgctgagaagtacccgcaactcacaggcttccacagcgacctgcacttcctggacaaggcgggctcagtgtccctggacagtgtcctggcggacgtgcgctccctgcagcgaggcctagagttgacacagagagagtttgtgcggcaggatgactgcatggtgctcaaggagttcctgagggccaactcgcccaccatggacaagctgctggcagacagcaagacggctcaggaggcctttgagtctgtggtggagtacttcggagagaaccccaagaccacatccccaggcctgttcttctccctctttagccgcttcattaaggcctacaagaaagctgagcaggaggtggaacagtggaaaaaagaagccgctgcccaggaggcaggcgctgataccccgggcaaaggggagcccccagcacccaagtcaccgccaaaggcccggcggccacagatggacctcatctctgagctgaaacggaggcagcagaaggagccactcatttatgagagcgaccgtgatggggccattgaagacatcatcacaggtaagggcttggccaggccttggtcttatcctcagtctgtccttctatgctttcttctgacccaatgcgctatcctctgggggactggctgccacactgcttcttgctaccttttctgtttttctttcctttttcctttctctactccccttcacctgccccacccccactcagtgatcaagacggtgcccttcacggcccgcaccggcaagcggacatcccggctcctctgtgaggccagcctgggagaagagatgcccctctagcccctcaggtacccagatgacctggcctctgataccacgctgcccacagcccctgggacccttgggagaactgaggcatgctgccttctcctgggccagtggatggctgggatgtgatttgtggggtggaggggtctggcaaacataaacggtacccctgccatgtgcacacaatctgagtccttaggaggctaagctttgtgccctggagccatgctcccagctctgggcggactcctgaatggtaaatgtgtctccttcggctgccagatctgcggaaccagccctacatccgcgcagacacaggccgccgcagtgcccgtcggcgtcccccgggccccccactgcaggtcacctccgacctctcgctgtagccgctatttctgcaggtggattctgcaggggtgtggggccgtggacaggctgaggctcaaggaaggtggtcctcagctcggctggccgggcagcccctcctccgctgtggcccgcctcaaacgggctggtgcatcctcctcttggccacagagggcagcatcgcccgccccttcccccaaatgctgcttgcagcacccaccctaaagccccctccaaatagccatacttagcctcagcaggagcctggcctgtaacttataaagtgcacctcgcccccgcaagccccagccccgaggaccgtccatggaccttatttttatatgagattaataaagatgtttgcaaaa

SEQ ID NO: 371408 - DNA, 1991 bp, Homo sapiens
cgccaccacctccgggcactgacgggccggtgcctccgccgccgccgccgccgcgccgcctcccggaggtcctcctgatgccctaggaagacgcgactcagaattgggcccaggagtgaaggccaagaagcccatccagactaagttccgaatgccactcttgaactgggtggcactgaaacccagccagatcaccggcactgtcttcacagagctcaatgatgagaaggtgctgcaggagctagacatgagtgattttgaggaacagttcaagaccaagtcccaaggccccagcctggacctcagcgctctcaagagtaaggcagcccagaaggcccccagcaaggcgacactcattgaggccaaccgggccaagaacttggccatcaccctgcggaagggcaacctgggggccgagcgcatctgccaagccattgaggcgtacgacctgcaggctctgggcctggacttcctggagctgctgatgcgcttcctgcccacagagtatgagcgcagcctcatcacccgctttgagcgggagcagcggccaatggaggagctgtcagaggaggaccgcttcatgctatgcttcagccgcatcccgcgcctgccggagcgcatgaccacactcaccttcctgggcaacttcccggacacagcccagctgctcatgccgcaactgaatgccatcattgcagcctcaatgtccatcaagtcctctgacaaactccgccagatcctggagattgtcctggcctttggcaactacatgaacagtagcaagcgtggggcagcctatggcttccggctccagagcctggatgcgctgttggagatgaagtcgactgatcgcaagcagacgctgctgcactacctggtgaaggtcattgctgagaagtacccgcaactcacaggcttccacagcgacctgcacttcctggacaaggcgggctcagtgtccctggacagtgtcctggcggacgtgcgctccctgcagcgaggcctagagttgacacagagagagtttgtgcggcaggatgactgcatggtgctcaaggagttcctgagggccaactcgcccaccatggacaagctgctggcagacagcaagacggctcaggaggcctttgagtctgtggtggagtacttcggagagaaccccaagaccacatccccaggcctgttcttctccctctttagccgcttcattaaggcctacaagaaagctgagcaggaggtggaacagtggaaaaaagaagccgctgcccaggaggcaggcgctgataccccgggcaaaggggagcccccagcacccaagtcaccgccaaaggcccggcggccacagatggacctcatctctgagctgaaacggaggcagcagaaggagccactcatttatgagagcgaccgtgatggggccattgaagacatcatcacagtgatcaagacggtgcccttcacggcccgcaccggcaagcggacatcccggctcctctgtgaggccagcctgggagaagagatgcccctctagcccctcagatctgcggaaccagccctacatccgcgcagacacaggccgccgcagtgcccgtcggcgtcccccgggccccccactgcaggtcacctccgacctctcgctgtagccgctatttctgcaggtggattctgcaggggtgtggggccgtggacaggctgaggctcaaggaaggtggtcctcagctcggctggccgggcagcccctcctccgctgtggcccgcctcaaacgggctggtgcatcctcctcttggccacagagggcagcatcgcccgccccttcccccaaatgctgcttgcagcacccaccctaaagccccctccaaatagccatacttagcctcagcaggagcctggcctgtaacttataaagtgcacctcgcccccgcaagccccagccccgaggaccgtccatggaccttatttttatatgagattaataaagatgtttgcaaaa

SEQ ID NO: 371409 - DNA, 985 bp, Homo sapiens
gggctgcctctccgattcactgacctgatactgccccatccctggcccagtgtccctggacagtgtcctggcggacgtgcgctccctgcagcgaggcctagagttgacacagagagagtttgtgcggcaggatgactgcatggtgctcaaggagttcctgagggccaactcgcccaccatggacaagctgctggcagacagcaagacggctcaggaggcctttgagtctgtggtggagtacttcggagagaaccccaagaccacatccccaggcctgttcttctccctctttagccgcttcattaaggcctacaagaaagctgagcaggaggtggaacagtggaaaaaagaagccgctgcccaggaggcaggcgctgataccccgggcaaaggggagcccccagcacccaagtcaccgccaaaggcccggcggccacagatggacctcatctctgagctgaaacggaggcagcagaaggagccactcatttatgagagcgaccgtgatggggccattgaagacatcatcacagatctgcggaaccagccctacatccgcgcagacacaggccgccgcagtgcccgtcggcgtcccccgggccccccactgcaggtcacctccgacctctcgctgtagccgctatttctgcaggtggattctgcaggggtgtggggccgtggacaggctgaggctcaaggaaggtggtcctcagctcggctggccgggcagcccctcctccgctgtggcccgcctcaaacgggctggtgcatcctcctcttggccacagagggcagcatcgcccgccccttcccccaaatgctgcttgcagcacccaccctaaagccccctccaaatagccatacttagcctcagcaggagcctggcctgtaacttataaagtgcacctcgcccccgcaagccccagccccgaggaccgtccatggaccttatttttatatgagattaataaagatgtttgcaaaa

SEQ ID NO: 371410 - DNA, 821 bp, Homo sapiens
tacaggctgtgagaggtctaagctggggggctgacaggctgtgcccacaggaggcctttgagtctgtggtggagtacttcggagagaaccccaagaccacatccccaggcctgttcttctccctctttagccgcttcattaaggcctacaagaaagctgagcaggaggtggaacagtggaaaaaagaagccgctgcccaggaggcaggcgctgataccccgggcaaaggggagcccccagcacccaagtcaccgccaaaggcccggcggccacagatggacctcatctctgagctgaaacggaggcagcagaaggagccactcatttatgagagcgaccgtgatggggccattgaagacatcatcacagatctgcggaaccagccctacatccgcgcagacacaggccgccgcagtgcccgtcggcgtcccccgggccccccactgcaggtcacctccgacctctcgctgtagccgctatttctgcaggtggattctgcaggggtgtggggccgtggacaggctgaggctcaaggaaggtggtcctcagctcggctggccgggcagcccctcctccgctgtggcccgcctcaaacgggctggtgcatcctcctcttggccacagagggcagcatcgcccgccccttcccccaaatgctgcttgcagcacccaccctaaagccccctccaaatagccatacttagcctcagcaggagcctggcctgtaacttataaagtgcacctcgcccccgcaagccccagccccgaggaccgtccatggaccttatttttatatgagattaataaagatgtttgcaaaa

SEQ ID NO: 371411 - DNA, 719 bp, Homo sapiens
ggtagggcagtagggagggccaccctcatggagactgccttggcccacagaaagctgagcaggaggtggaacagtggaaaaaagaagccgctgcccaggaggcaggcgctgataccccgggcaaaggggagcccccagcacccaagtcaccgccaaaggcccggcggccacagatggacctcatctctgagctgaaacggaggcagcagaaggagccactcatttatgagagcgaccgtgatggggccattgaagacatcatcacagatctgcggaaccagccctacatccgcgcagacacaggccgccgcagtgcccgtcggcgtcccccgggccccccactgcaggtcacctccgacctctcgctgtagccgctatttctgcaggtggattctgcaggggtgtggggccgtggacaggctgaggctcaaggaaggtggtcctcagctcggctggccgggcagcccctcctccgctgtggcccgcctcaaacgggctggtgcatcctcctcttggccacagagggcagcatcgcccgccccttcccccaaatgctgcttgcagcacccaccctaaagccccctccaaatagccatacttagcctcagcaggagcctggcctgtaacttataaagtgcacctcgcccccgcaagccccagccccgaggaccgtccatggaccttatttttatatgagattaataaagatgtttgcaaaa

SEQ ID NO: 371412 - DNA, 1006 bp, Homo sapiens
cgccaccacctccgggcactgacgggccggtgcctccgccgccgccgccgccgcgccgcctcccggaggtcctcctgatgccctaggaagacgcgactcagaattgggcccaggagtgaaggccaagaagcccatccagactaagttccgaatgccactcttgaactgggtggcactgaaacccagccagatcaccggcactgtcttcacagagctcaatgatgagaaggtgctgcaggagctagacatgagtgattttgaggaacagttcaagaccaagtcccaaggccccagcctggacctcagcgctctcaagagtaaggcagcccagaaggcccccagcaaggcgacactcattgaggccaaccgggccaagaacttggccatcaccctgcggaagggcaacctgggggccgagcgcatctgccaagccattgaggcgtacgacctgcaggctctgggcctggacttcctggagctgctgatgcgcttcctgcccacagagtatgagcgcagcctcatcacccgctttgagcgggagcagcggccaatggaggagctgtcagaggaggaccgcttcatgctatgcttcagccgcatcccgcgcctgccggagcgcatgaccacactcaccttcctgggcaacttcccggacacagcccagctgctcatgccgcaactgaatgccatcattgcagcctcaatgtccatcaagtcctctgacaaactccgccagatcctggagattgtcctggcctttggcaactacatgaacagtagcaagcgtggggcagcctatggcttccggctccagagcctggatgcgctgttggagatgaagtcgactgatcgcaagcagacgctgctgcactacctggtgaaggtcattgctgagaagtacccgcaactcacaggcttccacagcgacctgcacttcctggacaaggcgggctcaggtaggagacacacagatccttgggtgtggggaggggccgtgggctggggt

SEQ ID NO: 371413 - DNA, 795 bp, Homo sapiens
cgccaccacctccgggcactgacgggccggtgcctccgccgccgccgccgccgcgccgcctcccggaggtcctcctgatgccctaggaagacgcgactcagaattgggcccaggagtgaaggccaagaagcccatccagactaagttccgaatgccactcttgaactgggtggcactgaaacccagccagatcaccggcactgtcttcacagagctcaatgatgagaaggtgctgcaggagctagacatgagtgattttgaggaacagttcaagaccaagtcccaaggccccagcctggacctcagcgctctcaagagtaaggcagcccagaaggcccccagcaaggcgacactcattgaggccaaccgggccaagaacttggccatcaccctgcggaagggcaacctgggggccgagcgcatctgccaagccattgaggcgtacgacctgcaggctctgggcctggacttcctggagctgctgatgcgcttcctgcccacagagtatgagcgcagcctcatcacccgctttgagcgggagcagcggccaatggaggagctgtcagaggaggaccgcttcatgctatgcttcagccgcatcccgcgcctgccggagcgcatgaccacactcaccttcctgggcaacttcccggacacagcccagctgctcatgccgcaactgaatgccatcattgcagcctcaatgtccatcaagtcctctgacaaactccgccagatcctggaggtgaggggccaggaggtggggcccacccttgcctgttctggatagtgtga

SEQ ID NO: 371414 - DNA, 1120 bp, Homo sapiens
gctgaccccagcccacagcaggaaggccctgcggaattcccgcatcgtcagccagaaggacgacgtccacgtctgtattatgtgcctacgcgccatcatgaactaccagtctggcttcagccttgtcatgaaccacccagcctgtgtcaatgagattgctctgagcctcaacaacaagaaccccagaaccaaggctctggtgctggagctgctggcggccgtgtgcttggtgcggggaggacatgacatcatccttgcagcctttgacaacttcaaggaggtgtgtggggagcagcaccgctttgaaaagctgatggaatatttccggaatgaggacagcaacatcgacttcatggtggcctgcatgcagttcatcaacattgtggtacattcggtggagaacatgaacttccgtgtcttcctgcaatatgagttcacccacttgggcctggacctgtacttggagaggcttcggctcaccgagagtgacaagctgcaggtgcagatccaggcgtacctggacaatatttttgatgtgggggcgctgctggaggacacagagaccaagaacgctgtgctggagcacatggaggaactgcaggagcaagtggcgctgctgacagagcggcttcgggacgcggagaacgaatccatggccaagattgcagaactggaaaaacagctaagccaggcgcgcaaggagttggagaccctgcgggagcgcttcagcgaatcgaccgccatgggcgcctccaggcgtcccccagagcctgagaaagcgcctcccgctgccccgacgcggccctcggccctggagctgaaggtggaggagctggaggagaaggggttaatccgtattctgcgggggccgggggatgctgtctccatcgagatcctccccgtcgctgtggcaactccgagcggcggtgatgctccgactccgggggtgccgaccggctcccccagcccaggtgcgcaggagcttcaggctggcggggatgcggggcagggtctggaggggagcccaggggcatctgtggcgggcagagttgggcgagggaggtttggattgtaggctcggctcaggtaggagcgcatgcgtagagcggagaggcggaga

SEQ ID NO: 371415 - DNA, 610 bp, Homo sapiens
ctccagtagtacccccagtgctcaccactgcccccaaacccccgtcccaggagtgaaggccaagaagcccatccagactaagttccgaatgccactcttgaactgggtggcactgaaacccagccagatcaccggcactgtcttcacagagctcaatgatgagaaggtgctgcaggagctagacatgagtgattttgaggaacagttcaagaccaagtcccaaggccccagcctggacctcagcgctctcaagagtaaggcagcccagaaggcccccagcaaggcgacactcattgaggccaaccgggccaagaacttggccatcaccctgcggaagggcaacctgggggccgagcgcatctgccaagccattgaggcgtacgacctgcaggctctgggcctggacttcctggagctgctgatgcgcttcctgcccacagagtatgagcgcagcctcatcaccctaaagccccctccaaatagccatacttagcctcagcaggagcctggcctgtaacttataaagtgcacctcgcccccgcaagccccagccccgaggaccgtccatggaccttatttttatatgagattaataaagatgtttgcaaaa

SEQ ID NO: 371416 - DNA, 924 bp, Homo sapiens
gctgaccccagcccacagcaggaaggccctgcggaattcccgcatcgtcagccagaaggacgacgtccacgtctgtattatgtgcctacgcgccatcatgaactaccagtctggcttcagccttgtcatgaaccacccagcctgtgtcaatgagattgctctgagcctcaacaacaagaaccccagaaccaaggctctggtgctggagctgctggcggccgtgtgcttggtgcggggaggacatgacatcatccttgcagcctttgacaacttcaaggaggtgtgtggggagcagcaccgctttgaaaagctgatggaatatttccggaatgaggacagcaacatcgacttcatggtggcctgcatgcagttcatcaacattgtggtacattcggtggagaacatgaacttccgtgtcttcctgcaatatgagttcacccacttgggcctggacctgtacttggagaggcttcggctcaccgagagtgacaagctgcaggtgcagatccaggcgtacctggacaatatttttgatgtgggggcgctgctggaggacacagagaccaagaacgctgtgctggagcacatggaggaactgcaggagcaagtggcgctgctgacagagcggcttcgggacgcggagaacgaatccatggccaagattgcagaactggaaaaacagctaagccaggcgcgcaaggagttggagaccctgcgggagcgcttcagcgaatcgaccgccatgggcgcctccaggcgtcccccagagcctgagaaagcgcctcccgctgccccgacgcggccctcggccctggagctgaaggtggaggagctggaggagaaggggttaatccgcaagccccagccccgaggaccgtccatggaccttatttttatatgagattaataaagatgtttgcaaaa

SEQ ID NO: 371417 - DNA, 225 bp, Homo sapiens
ctccagtagtacccccagtgctcaccactgcccccaaacccccgtcccaggagtgaaggccaagaagcccatccagactaagttccgaatgccactcttgaactgggtggcactgaaacccagccagatcaccggcactgtcttcacagagctcaatgatgagaaggtgctgcaggtgagtggccctgcctggctccccatgtgggcaccggaggaagaggggag

SEQ ID NO: 371418 - DNA, 579 bp, Homo sapiens
  misc_feature (568)..(568): n is a, c, g, or t
tctcaggactgagtctcctgcagatgtgaagggctgggaaaagctgcacagagaggacgttgaggggtgcagtggggggcctcttttggggcttgtgtgtgtgttaaaccgtgacatgaggggctaaaggactggaagctgttgcctggagaaccggagtgcccataggggctccaaggctgatccaagcagcgcctggcctccccagtcctgctcctggccgcgggtggccgccagccagccctgtgtccatgccagctccaccacctccctctggacacagtgttctctcttgggatacggggcaaacgtgagcatcccagccccgtgggaaccagggcatcctgccaaccctttcattcattcacttatccatccagtcatttattcattcattcaggaactgtttgctgactgcctacaacatgccaggcaccacatgccagcagaggccatcgagacactctgcctctgtccccagtgccccacatatttccagctcacagatacgttttgtttggccttgcgacaattttaaagcttgtaaaataataaagtaatataaaantaaacatatta

SEQ ID NO: 371419 - DNA, 574 bp, Homo sapiens
tttttaagagacagggtttcactatgtagcccaggctggtctcgaactcctgggctcaagtgatccacccgccttgtccccccgcgcaatgcgctgggattgtaggtgtgagccactgcactcagcctgaaatagcttaaataaataaaatatcttaaaaaattttttaaagcacgttacatatgttttcaaacagttcttatacatttccatctttttgatagttttacaggacccagctattccttcaagcaaataccagagttccaactacaggacaggtgttgttctaggcaattgagatacagcagtaaataaaatagacaaagttcctgtccttaaggatctcgtattctaaagggaaagggagtaataatttcttcctgtattcccttttcctcacctactctacttcaaggaaagaagggaaaatgacagaatgaaaaacgtgtaggccattaaagatttttctataaatagtaataaattagaaaaaaaaaattgtgtagtatgtagttggctatgatcaaattcatttctctacaccagttgacactttttgttttttttgttt

SEQ ID NO: 371420 - DNA, 736 bp, Homo sapiens
  misc_feature (48)..(48): n is a, c, g, or t
ggacgcgtgggtcgacccacgcgtcgcgaccacgcgtcggtggtcgcnccagctctctgctctcccagcgcagcgccgccgcccggcccctccagcttcccggaccatggccaacctggagcgcaccttcatcgccatcaagccggacggcgtgcagcgcggcctggtgggcgagatcatcaagcgcttcgagcagaagggattccgcctcgtggccatgaagttcctccgggcctctgaagaacacctgaagcagcactacattgacctgaaagaccgaccattcttccctgggctggtgaagtacatgaactcagggccggttgtggccatggtctgggaggggctgaacgtggtgaagacaggccgagtgatgcttggggagaccaatccagcagattcaaagccaggcaccattcgtggggacttctgcattcaggttggcaggaacatcattcatggcagtgattcagtaaaaagtgctgaaaaagaaatcagcctatggtttaagcctgaagaactggttgactacaagtcttgtgctcatgactgggtctatgaataagaggtggacacaacagcagtctccttcagcacggcgtggtgtgtccctggacacagctcttcattccattgacttagaggcaacaggattgatcattcttttatagagcatatttgccaataaagctttggaagcggaaaaaagacagaaacacggcgaatcaaccaaggg

SEQ ID NO: 371421 - DNA, 439 bp, Homo sapiens
  misc_feature (51)..(51): n is a, c, g, or t
catacgatcagtaatgtacttatcaattttatacccaacaccccacaaaangcctagggtctgggaggggctgaacgtggtgaagacaggccgagtgatgcttggggagaccaatccagcagattcaaagccaggcaccattcgtggggacttctgcattcaggttggcaggaacatcattcatggcagtgattcagtaaaaagtgctgaaaaagaaatcagcctatggtttaagcctgaagaactggttgactacaagtcttgtgctcatgactgggtctatgaataagaggtggacacaacagcagtctccttcagcacggcgtggtgtgtccctggacacagctcttcattccattgacttagaggcaacaggattgatcattcttttatagagcatatttgccaataaagctctggcctcgttggcctcaagcgg

SEQ ID NO: 371422 - DNA, 1052 bp, Homo sapiens
  misc_feature (1049)..(1049): n is a, c, g, or t
tgtgtgtgtgtgtgtgtgtgtgtgtaggagcttttggggtcacgggaagtactgagaggtgaggagtgggatttgggacgtgcgtagttgaactcataggacgtccaggtggagaaggaatcacttcctgtctctggatccgtctcgatctctgcctggcgagggcgcgccccggctgggcgtggacactgttctccggccgcgtcgggccgggcgggtggggcgttcctgcgggttgggcggctgggccctccggggtgtggccaccccgcgctccgccctgcgcccctcctccgccgccggctcccgggtgtggtggtcgcaccagctctctgctctcccagcgcagcgccgccgcccggcccctccagcttcccggaccatggccaacctggagcgcaccttcatcgccatcaagccggacggcgtgcagcgcggcctggtgggcgagatcatcaagcgcttcgagcagaagggattccgcctcgtggccatgaagttcctccgggcctctgaagaacacctgaagcagcactacattgacctgaaagaccgaccattcttccctgggctggtgaagtacatgaactcagggccggttgtggccatggtctgggaggggctgaacgtggtgaagacaggccgagtgatgcttggggagaccaatccagcagattcaaagccaggcaccattcgtggggacttctgcattcaggttggcaggaacatcattcatggcagtgattcagtaaaaagtgctgaaaaagaaatcagcctatggtttaagcctgaagaactggttgactacaagtcttgtgctcatgactgggtctatgaataagaggtggacacaacagcagtctccttcagcacggcgtggtgtgtccctggacacagctcttcattccattgacttagaggcaacaggattgatcattcttttatagagcatatttgccaataaagcttttggaagccggaaaaaaaaaaaaaaaaaaaaaaaaaaaaaaaaaaaaacaaaaaaaaaaaacaaacagacaaaaaaaaanaac

SEQ ID NO: 371423 - DNA, 1170 bp, Homo sapiens
  misc_feature (1000)..(1000): n is a, c, g, or t
  misc_feature (1007)..(1007): n is a, c, g, or t
tgtgtgtgtgtgtgtgtgtgtgtgtaggagcttttggggtcacgggaagtactgagaggtgaggagtgggatttgggacgtgcgtagttgaactcataggacgtccaggtggagaaggaatcacttcctgtctctggatccgtctcgatctctgcctggcgagggcgcgccccggctgggcgtggacactgttctccggccgcgtcgggccgggcgggtggggcgttcctgcgggttgggcggctgggccctccggggtgtggccaccccgcgctccgccctgcgcccctcctccgccgccggctcccgggtgtggtggtcgcaccagctctctgctctcccagcgcagcgccgccgcccggcccctccagcttcccggaccatggccaacctggagcgcaccttcatcgccatcaagccggacggcgtgcagcgcggcctggtgggcgagatcatcaagcgcttcgagcagaagggattccgcctcgtggccatgaagttcctccgggcctctgaagaacacctgaagcagcactacattgacctgaaagaccgaccattcttccctgggctggtgaagtacatgaactcagggccggttgtggccatggtctgggaggggctgaacgtggtgaagacaggccgagtgatgcttggggagaccaatccagcagattcaaagccaggcaccattcgtggggacttctgcattcaggttggcaggaacatcattcatggcagtgattcagtaaaaagtgctgaaaaagaaatcagcctatggtttaagcctgaagaactggttgactacaagtcttgtgctcatgactgggtctatgaataagaggtggacacaacagcagtctccttcagcacggcgtggtgtgtccctggacacagctcttcattccattgacttagaggcaacaggattgatcattcttttatagagcatatttgccaataaagcttttggaagccggaaaaaaaaaaaaaaaaaaanacacacncacaccccccccccccccacccaaacacacaccgcgggcggcatctagcggcggggcggggaacacagcgctacaagcggcccgcggcacacgggcccaccccctttttcacaggggaaccgcggcccaagggggccaaacacgcaccgggccgtccccccaa

SEQ ID NO: 371424 - DNA, 1053 bp, Homo sapiens
tgtgtgtgtgtgtgtgtgtgtgtgtaggagcttttggggtcacgggaagtactgagaggtgaggagtgggatttgggacgtgcgtagttgaactcataggacgtccaggtggagaaggaatcacttcctgtctctggatccgtctcgatctctgcctggcgagggcgcgccccggctgggcgtggacactgttctccggccgcgtcgggccgggcgggtggggcgttcctgcgggttgggcggctgggccctccggggtgtggccaccccgcgctccgccctgcgcccctcctccgccgccggctcccgggtgtggtggtcgcaccagctctctgctctcccagcgcagcgccgccgcccggcccctccagcttcccggaccatggccaacctggagcgcaccttcatcgccatcaagccggacggcgtgcagcgcggcctggtgggcgagatcatcaagcgcttcgagcagaagggattccgcctcgtggccatgaagttcctccgggcctctgaagaacacctgaagcagcactacattgacctgaaagaccgaccattcttccctgggctggtgaagtacatgaactcagggccggttgtggccatggtctgggaggggctgaacgtggtgaagacaggccgagtgatgcttggggagaccaatccagcagattcaaagccaggcaccattcgtggggacttctgcattcaggttggcaggaacatcattcatggcagtgattcagtaaaaagtgctgaaaaagaaatcagcctatggtttaagcctgaagaactggttgactacaagtcttgtgctcatgactgggtctatgaataagaggtggacacaacagcagtctccttcagcacggcgtggtgtgtccctggacacagctcttcattccattgacttagaggcaacaggattgatcattcttttatagagcatatttgccaataaagcttttggaagccggaaaaaaaaaaaaaaaaaaagccactcgcgattagatcgacgcgtggtacaatcggaatccgagcgtaccagcc

SEQ ID NO: 371425 - DNA, 792 bp, Homo sapiens
  misc_feature (789)..(789): n is a, c, g, or t
tgtattctggaacccaaagatgagatactgcccaccacccccatctcagaacagaagggtgggaagcgctctctgctctcccagcgcagcgccgccgcccggcccctccagcttcccggaccatggccaacctggagcgcaccttcatcgccatcaagccggacggcgtgcagcgcggcctggtgggcgagatcatcaagcgcttcgagcagaagggattccgcctcgtggccatgaagttcctccgggcctctgaagaacacctgaagcagcactacattgacctgaaagaccgaccattcttccctgggctggtgaagtacatgaactcagggccggttgtggccatggtctgggaggggctgaacgtggtgaagacaggccgagtgatgcttggggagaccaatccagcagattcaaagccaggcaccattcgtggggacttctgcattcaggttggcaggaacatcattcatggcagtgattcagtaaaaagtgctgaaaaagaaatcagcctatggtttaagcctgaagaactggttgactacaagtcttgtgctcatgactgggtctatgaataagaggtggacacaacagcagtctccttcagcacggcgtggtgtgtccctggacacagctcttcattccattgacttagaggcaacaggattgatcattcttttatagagcatatttgccaataaagcttttggaagccggaaaaaaaaaaaaaaaaaaaaaaaaaaaaaaaaaaaaacaaaaaaaaaaaacaaacagacaaaaaaaaanaac

SEQ ID NO: 371426 - DNA, 1120 bp, Homo sapiens
  misc_feature (1117)..(1117): n is a, c, g, or t
tgtgtgtgtgtgtgtgtgtgtgtgtaggagcttttggggtcacgggaagtactgagaggtgaggagtgggatttgggacgtgcgtagttgaactcataggacgtccaggtggagaaggaatcacttcctgtctctggatccgtctcgatctctgcctggcgagggcgcgccccggctgggcgtggacactgttctccggccgcgtcgggccgggcgggtggggcgttcctgcgggttgggcggctgggccctccggggtgtggccaccccgcgctccgccctgcgcccctcctccgccgccggctcccgggtgtggtggtcgcaccagctctctgctctcccagcgcagcgccgccgcccggcccctccagcttcccggtaaggcggtgggggcgcatcccctggcgactcctcccgttccctcttccgcttgcgctgccgcaggggaccatggccaacctggagcgcaccttcatcgccatcaagccggacggcgtgcagcgcggcctggtgggcgagatcatcaagcgcttcgagcagaagggattccgcctcgtggccatgaagttcctccgggcctctgaagaacacctgaagcagcactacattgacctgaaagaccgaccattcttccctgggctggtgaagtacatgaactcagggccggttgtggccatggtctgggaggggctgaacgtggtgaagacaggccgagtgatgcttggggagaccaatccagcagattcaaagccaggcaccattcgtggggacttctgcattcaggttggcaggaacatcattcatggcagtgattcagtaaaaagtgctgaaaaagaaatcagcctatggtttaagcctgaagaactggttgactacaagtcttgtgctcatgactgggtctatgaataagaggtggacacaacagcagtctccttcagcacggcgtggtgtgtccctggacacagctcttcattccattgacttagaggcaacaggattgatcattcttttatagagcatatttgccaataaagcttttggaagccggaaaaaaaaaaaaaaaaaaaaaaaaaaaaaaaaaaaaacaaaaaaaaaaaacaaacagacaaaaaaaaanaac

SEQ ID NO: 371427 - DNA, 1499 bp, Homo sapiens
  misc_feature (1329)..(1329): n is a, c, g, or t
  misc_feature (1336)..(1336): n is a, c, g, or t
tgtgtgtgtgtgtgtgtgtgtgtgtaggagcttttggggtcacgggaagtactgagaggtgaggagtgggatttgggacgtgcgtagttgaactcataggacgtccaggtggagaaggaatcacttcctgtctctggatccgtctcgatctctgcctggcgagggcgcgccccggctgggcgtggacactgttctccggccgcgtcgggccgggcgggtggggcgttcctgcgggttgggcggctgggccctccggggtgtggccaccccgcgctccgccctgcgcccctcctccgccgccggctcccgggtgtggtggtcgcaccagctctctgctctcccagcgcagcgccgccgcccggcccctccagcttcccggtaaggcggtgggggcgcatcccctggcgactcctcccgttccctcttccgcttgcgctgccgcaggtgggcccggtctgtgggcgccccccgatttcccgcaggtcccgcgcggcgtcggagcgggagattcccttgcagcttgcgccccgcgggccttcgggctccgcagagggacgccggccctgcgcggggcggaagcggccgggaagccacgtgtccccgcggccgcgcgtggtgggggaggagggaccggcggcgcccacgtggcctccgcgggccccgccagagcctgcgcccgggccctgaccgcacctctcgccccgcaggaccatggccaacctggagcgcaccttcatcgccatcaagccggacggcgtgcagcgcggcctggtgggcgagatcatcaagcgcttcgagcagaagggattccgcctcgtggccatgaagttcctccgggcctctgaagaacacctgaagcagcactacattgacctgaaagaccgaccattcttccctgggctggtgaagtacatgaactcagggccggttgtggccatggtctgggaggggctgaacgtggtgaagacaggccgagtgatgcttggggagaccaatccagcagattcaaagccaggcaccattcgtggggacttctgcattcaggttggcaggaacatcattcatggcagtgattcagtaaaaagtgctgaaaaagaaatcagcctatggtttaagcctgaagaactggttgactacaagtcttgtgctcatgactgggtctatgaataagaggtggacacaacagcagtctccttcagcacggcgtggtgtgtccctggacacagctcttcattccattgacttagaggcaacaggattgatcattcttttatagagcatatttgccaataaagcttttggaagccggaaaaaaaaaaaaaaaaaaanacacacncacaccccccccccccccacccaaacacacaccgcgggcggcatctagcggcggggcggggaacacagcgctacaagcggcccgcggcacacgggcccaccccctttttcacaggggaaccgcggcccaagggggccaaacacgcaccgggccgtccccccaa

SEQ ID NO: 371428 - DNA, 821 bp, Homo sapiens
  misc_feature (818)..(818): n is a, c, g, or t
aaaatgggctctccggcagcggatctgcgcagaagcgttccgtgcgtgcaagtgctgcgaaccacgtgggtcccgggcgcgtttcgggtgctggcggctgcagccggagttcaaacctaagcagctggaaggaaccatggccaactgtgagcgtaccttcattgcgatcaaaccagatggggtccagcggggtcttgtgggagagattatcaagcgttttgagcagaaaggattccgccttgttggtctgaaattcatgcaaatgaagttcctccgggcctctgaagaacacctgaagcagcactacattgacctgaaagaccgaccattcttccctgggctggtgaagtacatgaactcagggccggttgtggccatggtctgggaggggctgaacgtggtgaagacaggccgagtgatgcttggggagaccaatccagcagattcaaagccaggcaccattcgtggggacttctgcattcaggttggcaggaacatcattcatggcagtgattcagtaaaaagtgctgaaaaagaaatcagcctatggtttaagcctgaagaactggttgactacaagtcttgtgctcatgactgggtctatgaataagaggtggacacaacagcagtctccttcagcacggcgtggtgtgtccctggacacagctcttcattccattgacttagaggcaacaggattgatcattcttttatagagcatatttgccaataaagcttttggaagccggaaaaaaaaaaaaaaaaaaaaaaaaaaaaaaaaaaaaacaaaaaaaaaaaacaaacagacaaaaaaaaanaac

SEQ ID NO: 371429 - DNA, 1062 bp, Homo sapiens
  misc_feature (998)..(998): n is a, c, g, or t
  misc_feature (1000)..(1001): n is a, c, g, or t
  misc_feature (1003)..(1004): n is a, c, g, or t
  misc_feature (1007)..(1007): n is a, c, g, or t
  misc_feature (1011)..(1011): n is a, c, g, or t
  misc_feature (1028)..(1028): n is a, c, g, or t
  misc_feature (1041)..(1042): n is a, c, g, or t
  misc_feature (1046)..(1046): n is a, c, g, or t
  misc_feature (1052)..(1052): n is a, c, g, or t
  misc_feature (1059)..(1059): n is a, c, g, or t
tgtgtgtgtgtgtgtgtgtgtgtgtaggagcttttggggtcacgggaagtactgagaggtgaggagtgggatttgggacgtgcgtagttgaactcataggacgtccaggtggagaaggaatcacttcctgtctctggatccgtctcgatctctgcctggcgagggcgcgccccggctgggcgtggacactgttctccggccgcgtcgggccgggcgggtggggcgttcctgcgggttgggcggctgggccctccggggtgtggccaccccgcgctccgccctgcgcccctcctccgccgccggctcccgggtgtggtggtcgcaccagctctctgctctcccagcgcagcgccgccgcccggcccctccagcttcccggaccatggccaacctggagcgcaccttcatcgccatcaagccggacggcgtgcagcgcggcctggtgggcgagatcatcaagcgcttcgagcagaagggattccgcctcgtggccatgaagttcctccgggcctctgaagaacacctgaagcagcactacattgacctgaaagaccgaccattcttccctgggctggtgaagtacatgaactcagggccggttgtggccatggtctgggaggggctgaacgtggtgaagacaggccgagtgatgcttggggagaccaatccagcagattcaaagccaggcaccattcgtggggacttctgcattcaggttggcaggaacatcattcatggcagtgattcagtaaaaagtgctgaaaaagaaatcagcctatggtttaagcctgaagaactggttgactacaagtcttgtgctcatgactgggtctatgaataagaggtggacacaacagcagtctccttcagcacggcgtggtgtgtccctggacacagctcttcattccattgacttagaggcaacaggattgatcattcttttatagagcatatttgccaataaagcttttggaagccggacacaacacaacaaacancnnannacnacancaccaccacacccaacnccacacaccaccnncacncacacnacccaancac

SEQ ID NO: 371430 - DNA, 1021 bp, Homo sapiens
tgtgtgtgtgtgtgtgtgtgtgtgtaggagcttttggggtcacgggaagtactgagaggtgaggagtgggatttgggacgtgcgtagttgaactcataggacgtccaggtggagaaggaatcacttcctgtctctggatccgtctcgatctctgcctggcgagggcgcgccccggctgggcgtggacactgttctccggccgcgtcgggccgggcgggtggggcgttcctgcgggttgggcggctgggccctccggggtgtggccaccccgcgctccgccctgcgcccctcctccgccgccggctcccgggtgtggtggtcgcaccagctctctgctctcccagcgcagcgccgccgcccggcccctccagcttcccggaccatggccaacctggagcgcaccttcatcgccatcaagccggacggcgtgcagcgcggcctggtgggcgagatcatcaagcgcttcgagcagaagggattccgcctcgtggccatgaagttcctccgggcctctgaagaacacctgaagcagcactacattgacctgaaagaccgaccattcttccctgggctggtgaagtacatgaactcagggccggttgtggccatggtctgggaggggctgaacgtggtgaagacaggccgagtgatgcttggggagaccaatccagcagattcaaagccaggcaccattcgtggggacttctgcattcaggttggcaggaacatcattcatggcagtgattcagtaaaaagtgctgaaaaagaaatcagcctatggtttaagcctgaagaactggttgactacaagtcttgtgctcatgactgggtctatgaataagaggtggacacaacagcagtctccttcagcacggcgtggtgtgtccctggacacagctcttcattccattgacttagaggcaacaggattgatcattcttttatagagcatatttgccaataaagctttggaagccggaaaacataattattctttcctatctttttaaacacataaaaa

SEQ ID NO: 371431 - DNA, 1023 bp, Homo sapiens
tgtgtgtgtgtgtgtgtgtgtgtgtaggagcttttggggtcacgggaagtactgagaggtgaggagtgggatttgggacgtgcgtagttgaactcataggacgtccaggtggagaaggaatcacttcctgtctctggatccgtctcgatctctgcctggcgagggcgcgccccggctgggcgtggacactgttctccggccgcgtcgggccgggcgggtggggcgttcctgcgggttgggcggctgggccctccggggtgtggccaccccgcgctccgccctgcgcccctcctccgccgccggctcccgggtgtggtggtcgcaccagctctctgctctcccagcgcagcgccgccgcccggcccctccagcttcccggaccatggccaacctggagcgcaccttcatcgccatcaagccggacggcgtgcagcgcggcctggtgggcgagatcatcaagcgcttcgagcagaagggattccgcctcgtggccatgaagttcctccgggcctctgaagaacacctgaagcagcactacattgacctgaaagaccgaccattcttccctgggctggtgaagtacatgaactcagggccggttgtggccatggtctgggaggggctgaacgtggtgaagacaggccgagtgatgcttggggagaccaatccagcagattcaaagccaggcaccattcgtggggacttctgcattcaggttggcaggaacatcattcatggcagtgattcagtaaaaagtgctgaaaaagaaatcagcctatggtttaagcctgaagaactggttgactacaagtcttgtgctcatgactgggtctatgaataagaggtggacacaacagcagtctccttcagcacggcgtggtgtgtccctggacacagctcttcattccattgacttagaggcaacaggattgatcattcttttatagagcatatttgccaataaagctcgatgcggccgtaataattccatacaaacaatgatagtagaacaccgcgtgacgc

SEQ ID NO: 371432 - DNA, 1086 bp, Homo sapiens
  misc_feature (1083)..(1083): n is a, c, g, or t
aaaatgggctctccggcagcggatctgcgcagaagcgttccgtgcgtgcaagtgctgcgaaccacgtgggtcccgggcgcgtttcgggtgctggcggctgcagccggagttcaaacctaagcagctggaaggaaccatggccaactgtgagcgtaccttcattgcgatcaaaccagatggggtccagcggggtcttgtgggagagattatcaagcgttttgagcagaaaggattccgccttgttggtctgaaattcatgcaagcttccgaagatcttctcaaggaacactacgttgacctgaaggaccgtccattctttgccggcctggtgaaatacatgcactcagggccggtagttgccatggtctgggaggggctgaatgtggtgaagacgggccgagtcatgctcggggagaccaaccctgcagactccaagcctgggaccatccgtggagacttctgcatacaagttggcaggaccatggccaacctggagcgcaccttcatcgccatcaagccggacggcgtgcagcgcggcctggtgggcgagatcatcaagcgcttcgagcagaagggattccgcctcgtggccatgaagttcctccgggcctctgaagaacacctgaagcagcactacattgacggtctgggaggggctgaacgtggtgaagacaggccgagtgatgcttggggagaccaatccagcagattcaaagccaggcaccattcgtggggacttctgcattcaggttggcaggaacatcattcatggcagtgattcagtaaaaagtgctgaaaaagaaatcagcctatggtttaagcctgaagaactggttgactacaagtcttgtgctcatgactgggtctatgaataagaggtggacacaacagcagtctccttcagcacggcgtggtgtgtccctggacacagctcttcattccattgacttagaggcaacaggattgatcattcttttatagagcatatttgccaataaagcttttggaagccggaaaaaaaaaaaaaaaaaaaaaaaaaaaaaaaaaaaaacaaaaaaaaaaaacaaacagacaaaaaaaaanaac

SEQ ID NO: 371433 - DNA, 497 bp, Homo sapiens
  misc_feature (494)..(494): n is a, c, g, or t
gcggccgcctactactactactactactactattaaattcgcggccgcgtcgacggtctgggaggggctgaacgtggtgaagacaggccgagtgatgcttggggagaccaatccagcagattcaaagccaggcaccattcgtggggacttctgcattcaggttggcaggaacatcattcatggcagtgattcagtaaaaagtgctgaaaaagaaatcagcctatggtttaagcctgaagaactggttgactacaagtcttgtgctcatgactgggtctatgaataagaggtggacacaacagcagtctccttcagcacggcgtggtgtgtccctggacacagctcttcattccattgacttagaggcaacaggattgatcattcttttatagagcatatttgccaataaagcttttggaagccggaaaaaaaaaaaaaaaaaaaaaaaaaaaaaaaaaaaaacaaaaaaaaaaaacaaacagacaaaaaaaaanaac

SEQ ID NO: 371434 - DNA, 1053 bp, Homo sapiens
  misc_feature (1050)..(1050): n is a, c, g, or t
aaaatgggctctccggcagcggatctgcgcagaagcgttccgtgcgtgcaagtgctgcgaaccacgtgggtcccgggcgcgtttcgggtgctggcggctgcagccggagttcaaacctaagcagctggaaggaaccatggccaactgtgagcgtaccttcattgcgatcaaaccagatggggtccagcggggtcttgtgggagagattatcaagcgttttgagcagaaaggattccgccttgttggtctgaaattcatgcaagtctgggaggggctgaatgtggtgaagacgggccgagtcatgctcggggagaccaaccctgcagactccaagcctgggaccatccgtggagacttctgcatacaagttggcaggaccatggccaacctggagcgcaccttcatcgccatcaagccggacggcgtgcagcgcggcctggtgggcgagatcatcaagcgcttcgagcagaagggattccgcctcgtggccatgaagttcctccgggcctctgaagaacacctgaagcagcactacattgacctgaaagaccgaccattcttccctgggctggtgaagtacatgaactcagggccggttgtggccatggtctgggaagggggctgaacgtgggtgaaagacaggccgagtgatgcttggggagaccaatccagcagattcaaagccaggcaccattcgtggggacttctgcattcaggttggcaggaacatcattcatggcagtgattcagtaaaaagtgctgaaaaagaaatcagcctatggtttaagcctgaagaactggttgactacaagtcttgtgctcatgactgggtctatgaataagaggtggacacaacagcagtctccttcagcacggcgtggtgtgtccctggacacagctcttcattccattgacttagaggcaacaggattgatcattcttttatagagcatatttgccaataaagcttttggaagccggaaaaaaaaaaaaaaaaaaaaaaaaaaaaaaaaaaaaacaaaaaaaaaaaacaaacagacaaaaaaaaanaac

SEQ ID NO: 371435 - DNA, 1714 bp, Homo sapiens
  misc_feature (1056)..(1056): n is a, c, g, or t
  misc_feature (1085)..(1085): n is a, c, g, or t
  misc_feature (1561)..(1561): n is a, c, g, or t
  misc_feature (1595)..(1595): n is a, c, g, or t
  misc_feature (1631)..(1631): n is a, c, g, or t
aaaatgggctctccggcagcggatctgcgcagaagcgttccgtgcgtgcaagtgctgcgaaccacgtgggtcccgggcgcgtttcgggtgctggcggctgcagccggagttcaaacctaagcagctggaaggaaccatggccaactgtgagcgtaccttcattgcgatcaaaccagatggggtccagcggggtcttgtgggagagattatcaagcgttttgagcagaaaggattccgccttgttggtctgaaattcatgcaagcttccgaagatcttctcaaggaacactacgttgacctgaaggaccgtccattctttgccggcctggtgaaatacatgcactcagggccggtagttgccatggtctgggaggggctgaatgtggtgaagacgggccgagtcatgctcggggagaccaaccctgcagactccaagcctgggaccatccgtggagacttctgcatacaagttggcaggaccatggccaacctggagcgcaccttcatcgccatcaagccggacggcgtgcagcgcggcctggtgggcgagatcatcaagcgcttcgagcagaagggattccgcctcgtggccatgaagttcctccgggcctctgaagaacacctgaagcagcactacattgacctgaaagaccgaccattcttccctgggctggtgaagtacatgaactcagggccggttgtggccatggaacatcattcatggcagtgattcagtaaaaagtgctgaaaaagaaatcagcctatggtttaagcctgaagaactggttgactacaagtcttgtgctcatgactgggtctatgaataagaggtggacacaacagcagtctccttcagcacggcgtggtgtgtccctggacacagctcttcattccattgacttagaggcaacaggattgatcattcttttatagagcatatttgccaataaagcttttggaagccggaaaaaaaaaaaaaaaaaaagggcggccgcccttttttttttttttgggggcattttcatggatttttcttttcattttggtaccaccagnctgtgtttagtttgttggttaaaaaaaancaaaaacaaaaaaaaaatcaaaacaatacaaaaaaaaaaaaacaaaacgggggcgcgcgcgccgacaaaaatactctcccgaggggcgcccaattatcgcaccccccctttttttgtaaaaaaggagggcgccataagaggaggaggcgttaataatcaaccacggacgcgggggcgcggtaacaaaccagctcgtgtggagggacacacgctagcttgtggggtcaactctgtcgggagaggagaaaccccaccatcgcgcgggcggggggcacatcaagtggcgggaacaccaccccaccccaagaaggagagcaatatatagagagcgaaccgcggaggcgacacaattaacaaaaaatgtgggagcccgctgttatagcgtgcgtgtctcacacaacacccgaggccctttaatattagtctcgtcgcgttcccgtagccagaacaaacttgtgctccaccagccagagaanatgcgtaattacggaacacaatctttttttcccncgccgtgcgctgctcggttagttaacgtcgcgggcnatccttccactaagtcccagaaccaggactcactgccagacaacagctacggcaaggagtgacgaaaatgaaccccagtataa

SEQ ID NO: 371436 - DNA, 1140 bp, Homo sapiens
  misc_feature (482)..(482): n is a, c, g, or t
  misc_feature (511)..(511): n is a, c, g, or t
  misc_feature (987)..(987): n is a, c, g, or t
  misc_feature (1021)..(1021): n is a, c, g, or t
  misc_feature (1057)..(1057): n is a, c, g, or t
agtaatgctagggtgagtggtaggaagttttttcataggaggtgtatgagttggtcgtagcggaatcgggggtatgctgttcgaattcataagaacagggaggtcagaagtagacttctgcattcaggttggcaggaacatcattcatggcagtgattcagtaaaaagtgctgaaaaagaaatcagcctatggtttaagcctgaagaactggttgactacaagtcttgtgctcatgactgggtctatgaataagaggtggacacaacagcagtctccttcagcacggcgtggtgtgtccctggacacagctcttcattccattgacttagaggcaacaggattgatcattcttttatagagcatatttgccaataaagcttttggaagccggaaaaaaaaaaaaaaaaaaagggcggccgcccttttttttttttttgggggcattttcatggatttttcttttcattttggtaccaccagnctgtgtttagtttgttggttaaaaaaaancaaaaacaaaaaaaaaatcaaaacaatacaaaaaaaaaaaaacaaaacgggggcgcgcgcgccgacaaaaatactctcccgaggggcgcccaattatcgcaccccccctttttttgtaaaaaaggagggcgccataagaggaggaggcgttaataatcaaccacggacgcgggggcgcggtaacaaaccagctcgtgtggagggacacacgctagcttgtggggtcaactctgtcgggagaggagaaaccccaccatcgcgcgggcggggggcacatcaagtggcgggaacaccaccccaccccaagaaggagagcaatatatagagagcgaaccgcggaggcgacacaattaacaaaaaatgtgggagcccgctgttatagcgtgcgtgtctcacacaacacccgaggccctttaatattagtctcgtcgcgttcccgtagccagaacaaacttgtgctccaccagccagagaanatgcgtaattacggaacacaatctttttttcccncgccgtgcgctgctcggttagttaacgtcgcgggcnatccttccactaagtcccagaaccaggactcactgccagacaacagctacggcaaggagtgacgaaaatgaaccccagtataa

SEQ ID NO: 371437 - DNA, 1212 bp, Homo sapiens
  misc_feature (554)..(554): n is a, c, g, or t
  misc_feature (583)..(583): n is a, c, g, or t
  misc_feature (1059)..(1059): n is a, c, g, or t
  misc_feature (1093)..(1093): n is a, c, g, or t
  misc_feature (1129)..(1129): n is a, c, g, or t
tacagttgaaacaaggaatgttttaaatcaagcacttttacagttgtatagctgcttttaaaaggaaatgctttgggggtataaattggtctgttgcttcaagtggcaatttggctgaaagagtctggagtgctgtccattgcggtacccattaaacagacttttgcactttaaaacatggcaacttgtaattgttttctttcttaggaacatcattcatggcagtgattcagtaaaaagtgctgaaaaagaaatcagcctatggtttaagcctgaagaactggttgactacaagtcttgtgctcatgactgggtctatgaataagaggtggacacaacagcagtctccttcagcacggcgtggtgtgtccctggacacagctcttcattccattgacttagaggcaacaggattgatcattcttttatagagcatatttgccaataaagcttttggaagccggaaaaaaaaaaaaaaaaaaagggcggccgcccttttttttttttttgggggcattttcatggatttttcttttcattttggtaccaccagnctgtgtttagtttgttggttaaaaaaaancaaaaacaaaaaaaaaatcaaaacaatacaaaaaaaaaaaaacaaaacgggggcgcgcgcgccgacaaaaatactctcccgaggggcgcccaattatcgcaccccccctttttttgtaaaaaaggagggcgccataagaggaggaggcgttaataatcaaccacggacgcgggggcgcggtaacaaaccagctcgtgtggagggacacacgctagcttgtggggtcaactctgtcgggagaggagaaaccccaccatcgcgcgggcggggggcacatcaagtggcgggaacaccaccccaccccaagaaggagagcaatatatagagagcgaaccgcggaggcgacacaattaacaaaaaatgtgggagcccgctgttatagcgtgcgtgtctcacacaacacccgaggccctttaatattagtctcgtcgcgttcccgtagccagaacaaacttgtgctccaccagccagagaanatgcgtaattacggaacacaatctttttttcccncgccgtgcgctgctcggttagttaacgtcgcgggcnatccttccactaagtcccagaaccaggactcactgccagacaacagctacggcaaggagtgacgaaaatgaaccccagtataa

SEQ ID NO: 371438 - DNA, 790 bp, Homo sapiens
aaaatgggctctccggcagcggatctgcgcagaagcgttccgtgcgtgcaagtgctgcgaaccacgtgggtcccgggcgcgtttcgggtgctggcggctgcagccggagttcaaacctaagcagctggaaggaaccatggccaactgtgagcgtaccttcattgcgatcaaaccagatggggtccagcggggtcttgtgggagagattatcaagcgttttgagcagaaaggattccgccttgttggtctgaaattcatgcaagcttccgaagatcttctcaaggaacactacgttgacctgaaggaccgtccattctttgccggcctggtgaaatacatgcactcagggccggtagttgccatggtctgggaggggctgaatgtggtgaagacgggccgagtcatgctcggggagaccaaccctgcagactccaagcctgggaccatccgtggagacttctgcatacaagttggcaggaccatggccaacctggagcgcaccttcatcgccatcaagccggacggcgtgcagcgcggcctggtgggcgagatcatcaagcgcttcgagcagaagggattccgcctcgtggccatgaagttcctccgggcctctgaagaacacctgaagcagcactacattgacctaacatacaattctaaagtaaaatgtttcactcttcggtgaggtctttgattatcactagcgaaatctctacaaatacagaaacatgaactgctgcggtctggttaggcctgtcttgcaggggttgaaaagttccgttgaagccgt

SEQ ID NO: 371439 - DNA, 765 bp, Homo sapiens
ggaatgagagaaaatgaggaaaaagtgctcagtgttctttgttagacatctccctcagctaatctaaattttattttatgaatggaacctgctgaagttacttaactgagcaactaggagcttgggaggagaaagcaaatcagaccttagaaatgggaaggatgttagctgggtgtggtggtgcacggctgtaatctcagctacttgggaggctgaggtaggagaattgcttgaacctgggaggcggaggttgcagtgagccgagatcgtgccactgcactccagcctgggcaacagagcgagactctgtctcgacaaagaaaaaagatatgggaaggactttttcaggtacatgtctctatggttaaatagaatctcactgcctgcaagagtggtaaattttcgggccaggcttggtggctcatgcctgtaatcccagcgctttggaaggctgaggcgggtggatcacctgaggccaggagttaatcccagttactcagggggctgaagcacgagaatcgcttgaacttgggaggcggaggttgcagtgagccgagatcatgccactgcactccagcctgggcgacagcaagactccatctcaaaaaaaaataatactcaatttcttctgtttgacaagtgttttagaccttaatgtttcctagattaaaaaactttatcctattttctcatgaaaaattcaaaggtaaggatgtaagaagttctcaatcctatactagaagcagtttcttctggatggtgcta

SEQ ID NO: 371440 - DNA, 1113 bp, Homo sapiens
tgtgtgtgtgtgtgtgtgtgtgtgtaggagcttttggggtcacgggaagtactgagaggtgaggagtgggatttgggacgtgcgtagttgaactcataggacgtccaggtggagaaggaatcacttcctgtctctggatccgtctcgatctctgcctggcgagggcgcgccccggctgggcgtggacactgttctccggccgcgtcgggccgggcgggtggggcgttcctgcgggttgggcggctgggccctccggggtgtggccaccccgcgctccgccctgcgcccctcctccgccgccggctcccgggtgtggtggtcgcaccagctctctgctctcccagcgcagcgccgccgcccggcccctccagcttcccggaccatggccaacctggagcgcaccttcatcgccatcaagccggacggcgtgcagcgcggcctggtgggcgagatcatcaagcgcttcgagcagaagggattccgcctcgtggccatgaagttcctccgggcctctgaagaacacctgaagcagcactacattgacctgaaagaccgaccattcttccctgggctggtgaagtacatgaactcagggccggttgtggccatggtctgggaggggctgaacgtggtgaagacaggccgagtgatgcttggggagaccaatccagcagattcaaagccaggcaccattcgtggggacttctgcattcaggttggcaggaacatcattcatggcagtgattcagtaaaaagtgctgaaaaagaaatcagcctatggtttaagcctgaagaactggttgactacaagtcttgtgctcatgactgggtctatgaataagaggtggacacaacagcagtctccttcagcacggcgtggtgtgtccctggacacagctcttcattccattgacttagaggcaacaggattgatcattcttttatagagcatatttgccaataaagcttttggaagccggaaaaaaaaaaaaaaaaaaacaacaaaaaaaagagggggtttttggggggggaaaaaggtacaaaggcgctggttcaatttcgcacccctttttgaaaagggaaagggggccaaggaggggaaatgaaccgacg

SEQ ID NO: 371441 - DNA, 693 bp, Homo sapiens
caaagggagcttgtttgccagggacactgcaagtaggaagtgtctacaggtcgatgacaggcctaatctctatgacagggtctagactttcctcagggtccaggggcgcacctcagggtgaactggaaaactcgaccgcactttagtgccaggggaccatggccaacctggagcgcaccttcatcgccatcaagccggacggcgtgcagcgcggcctggtgggcgagatcatcaagcgcttcgagcagaagggattccgcctcgtggccatgaagttcctccgggcctctgaagaacacctgaagcagcactacattgacctgaaagaccgaccattcttccctgggctggtgaagtacatgaactcagggccggttgtggccatggtctgggaggggctgaacgtggtgaagacaggccgagtgatgcttggggagaccaatccagcagattcaaagccaggcaccattcgtggggacttctgcattcaggttggcaggaacatcattcatggcagtgattcagtaaaaagtgctgaaaaagaaatcagcctatggtttaagcctgaagaactggttgactacaagtcttgtgctcatactgggctatgatagcagtgacacacagagttcttagacgcgtgggtgcctgaccagtctcatcatgcttaagacagatgactcttatgcttgc

SEQ ID NO: 371442 - DNA, 1386 bp, Homo sapiens
tgtgtgtgtgtgtgtgtgtgtgtgtaggagcttttggggtcacgggaagtactgagaggtgaggagtgggatttgggacgtgcgtagttgaactcataggacgtccaggtggagaaggaatcacttcctgtctctggatccgtctcgatctctgcctggcgagggcgcgccccggctgggcgtggacactgttctccggccgcgtcgggccgggcgggtggggcgttcctgcgggttgggcggctgggccctccggggtgtggccaccccgcgctccgccctgcgcccctcctccgccgccggctcccgggtgtggtggtcgcaccagctctctgctctcccagcgcagcgccgccgcccggcccctccagcttcccggaccatggccaacctggagcgcaccttcatcgccatcaagccggacggcgtgcagcgcggcctggtgggcgagatcatcaagcgcttcgagcagaagggattccgcctcgtggccatgaagttcctccgggcctctgaagaacacctgaagcagcactacattgacctgaaagaccgaccattcttccctgggctggtgaagtacatgaactcagggccggttgtggccatggtctgggaggggctgaacgtggtgaagacaggccgagtgatgcttggggagaccaatccagcagattcaaagccaggcaccattcgtggggacttctgcattcaggttggcaggaacatcattcatggcagtgattcagtaaaaagtgctgaaaaagaaatcagcctatggtttaagcctgaagaactggttgactacaagtcttgtgctcatgactgggtctatgaataagaggtggacacaacagcagtctccttcagcacggcgtggtgtgtccctggacacagctcttcattccattgacttagaggcaacaggattgatcattcttttatagagcatatttgccaataaagcttttggaagccggaaaaaaaaaaaaaaaaaaaaaaaaaaaaaaaaaaaaacaaaaaaaaaaggggggggggcaaaaaatatcccgcggagggggacccgatatagtgccggaccccgcttttttcgtgtaacagggggcccccaaaaggaggcagcgataaaagaaggacgcgggggccgcgttaaacaggtctggggggggaaacggtgcgctgccggctcttggggaaggacccctctcctgtcgcgtgccatctttggaccccccccagggagattaagagcccggggaaaataaactcgggttttggtgtcacccggctttgctgtcggggattgtcctggttttgctacgcgtccgcattcacatagccctaaacgccagcaagaggggttatgtgagtgagagatgtcgctgc

SEQ ID NO: 371443 - DNA, 1728 bp, Homo sapiens
  misc_feature (1070)..(1070): n is a, c, g, or t
  misc_feature (1099)..(1099): n is a, c, g, or t
  misc_feature (1575)..(1575): n is a, c, g, or t
  misc_feature (1609)..(1609): n is a, c, g, or t
  misc_feature (1645)..(1645): n is a, c, g, or t
tgtgtgtgtgtgtgtgtgtgtgtgtaggagcttttggggtcacgggaagtactgagaggtgaggagtgggatttgggacgtgcgtagttgaactcataggacgtccaggtggagaaggaatcacttcctgtctctggatccgtctcgatctctgcctggcgagggcgcgccccggctgggcgtggacactgttctccggccgcgtcgggccgggcgggtggggcgttcctgcgggttgggcggctgggccctccggggtgtggccaccccgcgctccgccctgcgcccctcctccgccgccggctcccgggtgtggtggtcgcaccagctctctgctctcccagcgcagcgccgccgcccggcccctccagcttcccggaccatggccaacctggagcgcaccttcatcgccatcaagccggacggcgtgcagcgcggcctggtgggcgagatcatcaagcgcttcgagcagaagggattccgcctcgtggccatgaagttcctccgggcctctgaagaacacctgaagcagcactacattgacctgaaagaccgaccattcttccctgggctggtgaagtacatgaactcagggccggttgtggccatggtctgggaggggctgaacgtggtgaagacaggccgagtgatgcttggggagaccaatccagcagattcaaagccaggcaccattcgtggggacttctgcattcaggttggcaggaacatcattcatggcagtgattcagtaaaaagtgctgaaaaagaaatcagcctatggtttaagcctgaagaactggttgactacaagtcttgtgctcatgactgggtctatgaataagaggtggacacaacagcagtctccttcagcacggcgtggtgtgtccctggacacagctcttcattccattgacttagaggcaacaggattgatcattcttttatagagcatatttgccaataaagcttttggaagccggaaaaaaaaaaaaaaaaaaagggcggccgcccttttttttttttttgggggcattttcatggatttttcttttcattttggtaccaccagnctgtgtttagtttgttggttaaaaaaaancaaaaacaaaaaaaaaatcaaaacaatacaaaaaaaaaaaaacaaaacgggggcgcgcgcgccgacaaaaatactctcccgaggggcgcccaattatcgcaccccccctttttttgtaaaaaaggagggcgccataagaggaggaggcgttaataatcaaccacggacgcgggggcgcggtaacaaaccagctcgtgtggagggacacacgctagcttgtggggtcaactctgtcgggagaggagaaaccccaccatcgcgcgggcggggggcacatcaagtggcgggaacaccaccccaccccaagaaggagagcaatatatagagagcgaaccgcggaggcgacacaattaacaaaaaatgtgggagcccgctgttatagcgtgcgtgtctcacacaacacccgaggccctttaatattagtctcgtcgcgttcccgtagccagaacaaacttgtgctccaccagccagagaanatgcgtaattacggaacacaatctttttttcccncgccgtgcgctgctcggttagttaacgtcgcgggcnatccttccactaagtcccagaaccaggactcactgccagacaacagctacggcaaggagtgacgaaaatgaaccccagtataa

SEQ ID NO: 371444 - DNA, 1151 bp, Homo sapiens
  misc_feature (1148)..(1148): n is a, c, g, or t
aaaatgggctctccggcagcggatctgcgcagaagcgttccgtgcgtgcaagtgctgcgaaccacgtgggtcccgggcgcgtttcgggtgctggcggctgcagccggagttcaaacctaagcagctggaaggaaccatggccaactgtgagcgtaccttcattgcgatcaaaccagatggggtccagcggggtcttgtgggagagattatcaagcgttttgagcagaaaggattccgccttgttggtctgaaattcatgcaagcttccgaagatcttctcaaggaacactacgttgacctgaaggaccgtccattctttgccggcctggtgaaatacatgcactcagggccggtagttgccatggtctgggaggggctgaatgtggtgaagacgggccgagtcatgctcggggagaccaaccctgcagactccaagcctgggaccatccgtggagacttctgcatacaagttggcaggaccatggccaacctggagcgcaccttcatcgccatcaagccggacggcgtgcagcgcggcctggtgggcgagatcatcaagcgcttcgagcagaagggattccgcctcgtggccatgaagttcctccgggcctctgaagaacacctgaagcagcactacattgacctgaaagaccgaccattcttccctgggctggtgaagtacatgaactcagggccggttgtggccatggtctgggaggggctgaacgtggtgaagacaggccgagtgatgcttggggagaccaatccagcagattcaaagccaggcaccattcgtggggacttctgcattcaggttggcaggaacatcattcatggcagtgattcagtaaaaagtgctgaaaaagaaatcagcctatggtttaagcctgaagaactggttgactacaagtcttgtgctcatgactgggtctatgaataagaggtggacacaacagcagtctccttcagcacggcgtggtgtgtccctggacacagctcttcattccattgacttagaggcaacaggattgatcattcttttatagagcatatttgccaataaagcttttggaagccggaaaaaaaaaaaaaaaaaaaaaaaaaaaaaaaaaaaaacaaaaaaaaaaaacaaacagacaaaaaaaaanaac

SEQ ID NO: 371445 - DNA, 1381 bp, Homo sapiens
  misc_feature (1378)..(1378): n is a, c, g, or t
tgtgtgtgtgtgtgtgtgtgtgtgtaggagcttttggggtcacgggaagtactgagaggtgaggagtgggatttgggacgtgcgtagttgaactcataggacgtccaggtggagaaggaatcacttcctgtctctggatccgtctcgatctctgcctggcgagggcgcgccccggctgggcgtggacactgttctccggccgcgtcgggccgggcgggtggggcgttcctgcgggttgggcggctgggccctccggggtgtggccaccccgcgctccgccctgcgcccctcctccgccgccggctcccgggtgtggtggtcgcaccagctctctgctctcccagcgcagcgccgccgcccggcccctccagcttcccggtaaggcggtgggggcgcatcccctggcgactcctcccgttccctcttccgcttgcgctgccgcaggtgggcccggtctgtgggcgccccccgatttcccgcaggtcccgcgcggcgtcggagcgggagattcccttgcagcttgcgccccgcgggccttcgggctccgcagagggacgccggccctgcgcggggcggaagcggccgggaagccacgtgtccccgcggccgcgcgtggtgggggaggagggaccggcggcgcccacgtggcctccgcgggccccgccagagcctgcgcccgggccctgaccgcacctctcgccccgcaggaccatggccaacctggagcgcaccttcatcgccatcaagccggacggcgtgcagcgcggcctggtgggcgagatcatcaagcgcttcgagcagaagggattccgcctcgtggccatgaagttcctccgggcctctgaagaacacctgaagcagcactacattgacctgaaagaccgaccattcttccctgggctggtgaagtacatgaactcagggccggttgtggccatggtctgggaggggctgaacgtggtgaagacaggccgagtgatgcttggggagaccaatccagcagattcaaagccaggcaccattcgtggggacttctgcattcaggttggcaggaacatcattcatggcagtgattcagtaaaaagtgctgaaaaagaaatcagcctatggtttaagcctgaagaactggttgactacaagtcttgtgctcatgactgggtctatgaataagaggtggacacaacagcagtctccttcagcacggcgtggtgtgtccctggacacagctcttcattccattgacttagaggcaacaggattgatcattcttttatagagcatatttgccaataaagcttttggaagccggaaaaaaaaaaaaaaaaaaaaaaaaaaaaaaaaaaaaacaaaaaaaaaaaacaaacagacaaaaaaaaanaac

SEQ ID NO: 371446 - DNA, 1178 bp, Homo sapiens
  misc_feature (996)..(997): n is a, c, g, or t
tgtgtgtgtgtgtgtgtgtgtgtgtaggagcttttggggtcacgggaagtactgagaggtgaggagtgggatttgggacgtgcgtagttgaactcataggacgtccaggtggagaaggaatcacttcctgtctctggatccgtctcgatctctgcctggcgagggcgcgccccggctgggcgtggacactgttctccggccgcgtcgggccgggcgggtggggcgttcctgcgggttgggcggctgggccctccggggtgtggccaccccgcgctccgccctgcgcccctcctccgccgccggctcccgggtgtggtggtcgcaccagctctctgctctcccagcgcagcgccgccgcccggcccctccagcttcccggaccatggccaacctggagcgcaccttcatcgccatcaagccggacggcgtgcagcgcggcctggtgggcgagatcatcaagcgcttcgagcagaagggattccgcctcgtggccatgaagttcctccgggcctctgaagaacacctgaagcagcactacattgacctgaaagaccgaccattcttccctgggctggtgaagtacatgaactcagggccggttgtggccatggtctgggaggggctgaacgtggtgaagacaggccgagtgatgcttggggagaccaatccagcagattcaaagccaggcaccattcgtggggacttctgcattcaggttggcaggaacatcattcatggcagtgattcagtaaaaagtgctgaaaaagaaatcagcctatggtttaagcctgaagaactggttgactacaagtcttgtgctcatgactgggtctatgaataagaggtggacacaacagcagtctccttcagcacggcgtggtgtgtccctggacacagctcttcattccattgacttagaggcaacaggattgatcattcttttatagagcatatttgccaataaagcttttggaagccggaaacaaaagaccaaannacaaacccaaacctaagcccggcaagagcaacgaagacacaacaacacaaagacaaaaagaggcgggcacaaaaacacccgcgaggacccaaaaaagcacacaggagctcacaggggccccaaggagcaaaaaagaggcgggcgaaacaaaaggggggaaacggcgagaccgaggacccag

SEQ ID NO: 371447 - DNA, 991 bp, Homo sapiens
tgtgtgtgtgtgtgtgtgtgtgtgtaggagcttttggggtcacgggaagtactgagaggtgaggagtgggatttgggacgtgcgtagttgaactcataggacgtccaggtggagaaggaatcacttcctgtctctggatccgtctcgatctctgcctggcgagggcgcgccccggctgggcgtggacactgttctccggccgcgtcgggccgggcgggtggggcgttcctgcgggttgggcggctgggccctccggggtgtggccaccccgcgctccgccctgcgcccctcctccgccgccggctcccgggtgtggtggtcgcaccagctctctgctctcccagcgcagcgccgccgcccggcccctccagcttcccggaccatggccaacctggagcgcaccttcatcgccatcaagccggacggcgtgcagcgcggcctggtgggcgagatcatcaagcgcttcgagcagaagggattccgcctcgtggccatgaagttcctccgggcctctgaagaacacctgaagcagcactacattgacctgaaagaccgaccattcttccctgggctggtgaagtacatgaactcagggccggttgtggccatggtctgggaggggctgaacgtggtgaagacaggccgagtgatgcttggggagaccaatccagcagattcaaagccaggcaccattcgtggggacttctgcattcaggttggcaggaacatcattcatggcagtgattcagtaaaaagtgctgaaaaagaaatcagcctatggtttaagcctgaagaactggttgactacaagtcttgtgctcatgactgggtctatgaataagaggtggacacaacagcagtctccttcagcacggcgtggtgtgtccctggacacagctcttcattccattgacttagaggcaacaggattgatcattcttttatagagcatatttgccaataaagctctggcctcgttggcctcaagcgg

SEQ ID NO: 371448 - DNA, 1012 bp, Homo sapiens
tgtgtgtgtgtgtgtgtgtgtgtgtaggagcttttggggtcacgggaagtactgagaggtgaggagtgggatttgggacgtgcgtagttgaactcataggacgtccaggtggagaaggaatcacttcctgtctctggatccgtctcgatctctgcctggcgagggcgcgccccggctgggcgtggacactgttctccggccgcgtcgggccgggcgggtggggcgttcctgcgggttgggcggctgggccctccggggtgtggccaccccgcgctccgccctgcgcccctcctccgccgccggctcccgggtgtggtggtcgcaccagctctctgctctcccagcgcagcgccgccgcccggcccctccagcttcccggaccatggccaacctggagcgcaccttcatcgccatcaagccggacggcgtgcagcgcggcctggtgggcgagatcatcaagcgcttcgagcagaagggattccgcctcgtggccatgaagttcctccgggcctctgaagaacacctgaagcagcactacattgacctgaaagaccgaccattcttccctgggctggtgaagtacatgaactcagggccggttgtggccatggtctgggaggggctgaacgtggtgaagacaggccgagtgatgcttggggagaccaatccagcagattcaaagccaggcaccattcgtggggacttctgcattcaggttggcaggaacatcattcatggcagtgattcagtaaaaagtgctgaaaaagaaatcagcctatggtttaagcctgaagaactggttgactacaagtcttgtgctcatgactgggtctatgaataagaggtggacacaacagcagtctccttcagcacggcgtggtgtgtccctggacacagctcttcattccattgacttagaggcaacaggattgatcattcttttatagagcatatttgccaataaagctttggaagcggaaaaaagacagaaacacggcgaatcaaccaaggg

SEQ ID NO: 371449 - DNA, 1112 bp, Homo sapiens
  misc_feature (1109)..(1109): n is a, c, g, or t
aaaatgggctctccggcagcggatctgcgcagaagcgttccgtgcgtgcaagtgctgcgaaccacgtgggtcccgggcgcgtttcgggtgctggcggctgcagccggagttcaaacctaagcagctggaaggaaccatggccaactgtgagcgtaccttcattgcgatcaaaccagatggggtccagcggggtcttgtgggagagattatcaagcgttttgagcagaaaggattccgccttgttggtctgaaattcatgcaagcttccgaagatcttctcaaggaacactacgttgacctgaaggaccgtccattctttgccggcctggtgaaatacatgcactcagggccggtagttgccatggtctgggaggggctgaatgtggtgaagacgggccgagtcatgctcggggagaccaaccctgcagactccaagcctgggaccatccgtggagacttctgcatacaagttggcaggaccatggccaacctggagcgcaccttcatcgccatcaagccggacggcgtgcagcgcggcctggtgggcgagatcatcaagcgcttcgagcagaagggattccgcctcgtggccatgaagttcctccgggcctctgaagaacacctgaagcagcactacattgacctgaaagaccgaccattcttccctggggtctgggaggggctgaacgtggtgaagacaggccgagtgatgcttggggagaccaatccagcagattcaaagccaggcaccattcgtggggacttctgcattcaggttggcaggaacatcattcatggcagtgattcagtaaaaagtgctgaaaaagaaatcagcctatggtttaagcctgaagaactggttgactacaagtcttgtgctcatgactgggtctatgaataagaggtggacacaacagcagtctccttcagcacggcgtggtgtgtccctggacacagctcttcattccattgacttagaggcaacaggattgatcattcttttatagagcatatttgccaataaagcttttggaagccggaaaaaaaaaaaaaaaaaaaaaaaaaaaaaaaaaaaaacaaaaaaaaaaaacaaacagacaaaaaaaaanaac

SEQ ID NO: 371450 - DNA, 1149 bp, Homo sapiens
tgtgtgtgtgtgtgtgtgtgtgtgtaggagcttttggggtcacgggaagtactgagaggtgaggagtgggatttgggacgtgcgtagttgaactcataggacgtccaggtggagaaggaatcacttcctgtctctggatccgtctcgatctctgcctggcgagggcgcgccccggctgggcgtggacactgttctccggccgcgtcgggccgggcgggtggggcgttcctgcgggttgggcggctgggccctccggggtgtggccaccccgcgctccgccctgcgcccctcctccgccgccggctcccgggtgtggtggtcgcaccagctctctgctctcccagcgcagcgccgccgcccggcccctccagcttcccggaccatggccaacctggagcgcaccttcatcgccatcaagccggacggcgtgcagcgcggcctggtgggcgagatcatcaagcgcttcgagcagaagggattccgcctcgtggccatgaagttcctccgggcctctgaagaacacctgaagcagcactacattgacctgaaagaccgaccattcttccctgggctggtgaagtacatgaactcagggccggttgtggccatggtctgggaggggctgaacgtggtgaagacaggccgagtgatgcttggggagaccaatccagcagattcaaagccaggcaccattcgtggggacttctgcattcaggttggcaggaacatcattcatggcagtgattcagtaaaaagtgctgaaaaagaaatcagcctatggtttaagcctgaagaactggttgactacaagtcttgtgctcatgactgggtctatgaataagaggtggacacaacagcagtctccttcagcacggcgtggtgtgtccctggacacgaatgcttcatgaacattcgtgtccatgtatatggcttgcatgtgtgtgcttgtgcacacgcaggagtgtatgtgtgtgccatgtgagtgcctgtgtacatgtgcaagagtgggctcaggtgtatccacatgttgcatggtatacctcggccggtcctagaccctagtcatcagactctgctgctcctcactggcatgaaggcagacctgaagctgggcatgggacacgaatgtaacaggtggcgagctcgatt

SEQ ID NO: 371451 - DNA, 471 bp, Homo sapiens
  misc_feature (468)..(468): n is a, c, g, or t
caattaagtagacaaaaaccccccccttcagtctgcggagggctgacttggtgaagacaggccgagtgatgcttggggagaccaatccagcagattcaaagccaggcaccattcgtggggacttctgcattcaggttggcaggaacatcattcatggcagtgattcagtaaaaagtgctgaaaaagaaatcagcctatggtttaagcctgaagaactggttgactacaagtcttgtgctcatgactgggtctatgaataagaggtggacacaacagcagtctccttcagcacggcgtggtgtgtccctggacacagctcttcattccattgacttagaggcaacaggattgatcattcttttatagagcatatttgccaataaagcttttggaagccggaaaaaaaaaaaaaaaaaaaaaaaaaaaaaaaaaaaaacaaaaaaaaaaaacaaacagacaaaaaaaaanaac

SEQ ID NO: 371452 - DNA, 1615 bp, Homo sapiens
  misc_feature (957)..(957): n is a, c, g, or t
  misc_feature (986)..(986): n is a, c, g, or t
  misc_feature (1462)..(1462): n is a, c, g, or t
  misc_feature (1496)..(1496): n is a, c, g, or t
  misc_feature (1532)..(1532): n is a, c, g, or t
tgtgtgtgtgtgtgtgtgtgtgtgtaggagcttttggggtcacgggaagtactgagaggtgaggagtgggatttgggacgtgcgtagttgaactcataggacgtccaggtggagaaggaatcacttcctgtctctggatccgtctcgatctctgcctggcgagggcgcgccccggctgggcgtggacactgttctccggccgcgtcgggccgggcgggtggggcgttcctgcgggttgggcggctgggccctccggggtgtggccaccccgcgctccgccctgcgcccctcctccgccgccggctcccgggtgtggtggtcgcaccagctctctgctctcccagcgcagcgccgccgcccggcccctccagcttcccggaccatggccaacctggagcgcaccttcatcgccatcaagccggacggcgtgcagcgcggcctggtgggcgagatcatcaagcgcttcgagcagaagggattccgcctcgtggccatgaagttcctccgggcctctgaagaacacctgaagcagcactacattgacctgaaagaccgaccattcttccctgggctggtgaagtacatgaactcagggccggttgtggccatggaacatcattcatggcagtgattcagtaaaaagtgctgaaaaagaaatcagcctatggtttaagcctgaagaactggttgactacaagtcttgtgctcatgactgggtctatgaataagaggtggacacaacagcagtctccttcagcacggcgtggtgtgtccctggacacagctcttcattccattgacttagaggcaacaggattgatcattcttttatagagcatatttgccaataaagcttttggaagccggaaaaaaaaaaaaaaaaaaagggcggccgcccttttttttttttttgggggcattttcatggatttttcttttcattttggtaccaccagnctgtgtttagtttgttggttaaaaaaaancaaaaacaaaaaaaaaatcaaaacaatacaaaaaaaaaaaaacaaaacgggggcgcgcgcgccgacaaaaatactctcccgaggggcgcccaattatcgcaccccccctttttttgtaaaaaaggagggcgccataagaggaggaggcgttaataatcaaccacggacgcgggggcgcggtaacaaaccagctcgtgtggagggacacacgctagcttgtggggtcaactctgtcgggagaggagaaaccccaccatcgcgcgggcggggggcacatcaagtggcgggaacaccaccccaccccaagaaggagagcaatatatagagagcgaaccgcggaggcgacacaattaacaaaaaatgtgggagcccgctgttatagcgtgcgtgtctcacacaacacccgaggccctttaatattagtctcgtcgcgttcccgtagccagaacaaacttgtgctccaccagccagagaanatgcgtaattacggaacacaatctttttttcccncgccgtgcgctgctcggttagttaacgtcgcgggcnatccttccactaagtcccagaaccaggactcactgccagacaacagctacggcaaggagtgacgaaaatgaaccccagtataa

SEQ ID NO: 371453 - DNA, 1885 bp, Homo sapiens
aaaatgggctctccggcagcggatctgcgcagaagcgttccgtgcgtgcaagtgctgcgaaccacgtgggtcccgggcgcgtttcgggtgctggcggctgcagccggagttcaaacctaagcagctggaaggaaccatggccaactgtgagcgtaccttcattgcgatcaaaccagatggggtccagcggggtcttgtgggagagattatcaagcgttttgagcagaaaggattccgccttgttggtctgaaattcatgcaagcttccgaagatcttctcaaggaacactacgttgacctgaaggaccgtccattctttgccggcctggtgaaatacatgcactcagggccggtagttgccatggtctgggaggggctgaatgtggtgaagacgggccgagtcatgctcggggagaccaaccctgcagactccaagcctgggaccatccgtggagacttctgcatacaagttggcaggaccatggccaacctggagcgcaccttcatcgccatcaagccggacggcgtgcagcgcggcctggtgggcgagatcatcaagcgcttcgagcagaagggattccgcctcgtggccatgaagttcctccgggcctctgaagaacacctgaagcagcactacattgacctgaaagaccgaccattcttccctgggctggtgaagtacatgaactcagggccggttgtggccatggaatgagagaaaatgaggaaaaagtgctcagtgttctttgttagacatctccctcagctaatctaaattttattttatgaatggaacctgctgaagttacttaactgagcaactaggagcttgggaggagaaagcaaatcagaccttagaaatgggaaggatgttagctgggtgtggtggtgcacggctgtaatctcagctacttgggaggctgaggtaggagaattgcttgaacctgggaggcggaggttgcagtgagccgagatcgtgccactgcactccagcctgggcaacagagcgagactctgtctcgacaaagaaaaaagatatgggaaggactttttcaggtacatgtctctatggttaaatagaatctcactgcctgcaagagtggtaaattttcgggccaggcttggtggctcatgcctgtaatcccagctactcagggggctgaagcacgagaatcgcttgaacttgggaggcggaggttgcagtgagccgagatcatgccactgcactccagcctgggcgacagcaagactccatctcaaaaaaaaataatactcaatttcttctgtttgacaagtgttttagaccttaatgtttcctagattaaaaaactttatcctattttctcatgaaaaattcaaaggtaaggatgtaagaagttctcaatcctatactagaagcagtttcttctggatggtgctaatgtccatttgggagtggagagaatatgaggagagagtggctgggattacaggcgtgagtcactgcacctggccgaacttttctttttaaattaatattttcttcattaagttagtgctgtaaactgtgtatcacatggctgttgtggggctttaaagaatacagtatctaaaatggcctaatatgatgtatgtactcattaagtatttgatgtctgaataaatgatgcccaccatatgaattattatgcatacctatttaatcatgatttaccacactctctaatagaactatagtagtgttagttaggattattgatggtttactgcatgccaagtttcttgctaaattttttatataaattaatttaatcttttccagaaaacgtatgccatgggaactatgataattccttttacaaattgtccacatggaggttccagaatttccacagcacttcagtcc

SEQ ID NO: 371454 - DNA, 963 bp, Homo sapiens
  misc_feature (305)..(305): n is a, c, g, or t
  misc_feature (334)..(334): n is a, c, g, or t
  misc_feature (810)..(810): n is a, c, g, or t
  misc_feature (844)..(844): n is a, c, g, or t
  misc_feature (880)..(880): n is a, c, g, or t
gcggccgcctactactactactgctcgaattcaagcttctaacgatgtacggggacatgactgggtctatgaataagaggtggacacaacagcagtctccttcagcacggcgtggtgtgtccctggacacagctcttcattccattgacttagaggcaacaggattgatcattcttttatagagcatatttgccaataaagcttttggaagccggaaaaaaaaaaaaaaaaaaagggcggccgcccttttttttttttttgggggcattttcatggatttttcttttcattttggtaccaccagnctgtgtttagtttgttggttaaaaaaaancaaaaacaaaaaaaaaatcaaaacaatacaaaaaaaaaaaaacaaaacgggggcgcgcgcgccgacaaaaatactctcccgaggggcgcccaattatcgcaccccccctttttttgtaaaaaaggagggcgccataagaggaggaggcgttaataatcaaccacggacgcgggggcgcggtaacaaaccagctcgtgtggagggacacacgctagcttgtggggtcaactctgtcgggagaggagaaaccccaccatcgcgcgggcggggggcacatcaagtggcgggaacaccaccccaccccaagaaggagagcaatatatagagagcgaaccgcggaggcgacacaattaacaaaaaatgtgggagcccgctgttatagcgtgcgtgtctcacacaacacccgaggccctttaatattagtctcgtcgcgttcccgtagccagaacaaacttgtgctccaccagccagagaanatgcgtaattacggaacacaatctttttttcccncgccgtgcgctgctcggttagttaacgtcgcgggcnatccttccactaagtcccagaaccaggactcactgccagacaacagctacggcaaggagtgacgaaaatgaaccccagtataa

SEQ ID NO: 371455 - DNA, 169 bp, Homo sapiens
ccagggctccatcttctaactctgtgtgggaaggtgaaagcacaccctcgttccgtaaacgcttcccaggggtgctgtggggttgtcacagggactgaaggaccagctttggactggatcaggcttggaaagctttagagagaagatacccggaaaaagaagtattttg

SEQ ID NO: 371456 - DNA, 1090 bp, Homo sapiens
tgcgtgcagtgttgcctcgcccaaagaagactacaatctccagggaaacctggggcgtctcgcgcaaacgtccataactgaaagtagctaaggcaccccagccggaggaagtgagctctcctggggcgtggttgttcgtgatccttgcatctgttacttagggtcaaggcttgggtcttgccccgcagacccttgggacgacccggccccagcgcagctatgaacctggagcgagtgtccaatgaggagaaattgaacctgtgccggaagtactacctgggggggtttgctttcctgccttttctctggttggtcaacatcttctggttcttccgagaggccttccttgtcccagcctacacagaacagagccaaatcaaaggctatgtctggcgctcagctgtgggcttcctcttctgggtgatagtgctcacctcctggatcaccatcttccagatctaccggccccgctggggtgcccttggggactacctctccttcaccatacccctgggcaccccctgacaacttctgcacatactggggccctgcttattctcccaggacaggctccttaaagcagaggagcctgtcctgggagccccttctcaaactcctaagacttgttttcatgtcccacgttctctgctgacatcccccaataaaggaccctaactttcgatactgacttcctgggatcttttagaggttgaggcataaatgattattaatatttaaaaacatctgttgagagctttgtacgaggcttagtatttagacatgatgtacattttttacagtgcatactactcataatcttctgaactaggaactttcctgctcaggaaactattagatgagaaactaagaaaggaatagtgcttccatttctttttcttttttcttttttttttttttttttgagacagagtcttgctctgtcagccaggctggagtgcagtggtaggatcggcctagtgcttccatttctaggggctgttatcctgtactggtagtcgtgaattcaaaaatataactttcctactgtgggctgcagtattctcatcagaagtgtagatcacgatgctac

SEQ ID NO: 371457 - DNA, 713 bp, Homo sapiens
tgcgtgcagtgttgcctcgcccaaagaagactacaatctccagggaaacctggggcgtctcgcgcaaacgtccataactgaaagtagctaaggcaccccagccggaggaagtgagctctcctggggcgtggttgttcgtgatccttgcatctgttacttagggtcaaggcttgggtcttgccccgcagacccttgggacgacccggccccagcgcagctatgaacctggagcgagtgtccaatgaggagaaattgaacctgtgccggaagtactacctgggggggtttgctttcctgccttttctctggttggtcaacatcttctggttcttccgagaggccttccttgtcccagcctacacagaacagagccaaatcaaaggctatgtctggcgctcagctgtgggcttcctcttctgggtgatagtgctcacctcctggatcaccatcttccagatctaccggccccgctggggtgcccttggggactacctctccttcaccatacccctgggcaccccctgacaacttctgcacatactggggccctgcttattctcccaggacaggctccttaaagcagaggagcctgtcctgggagccccttctcaaactcctaagacttgttttcatgtcccacgttctctgctgacatccccataaggacctatggaagaaaaacaaaaaaaaaatttggggcggcagaaaattaa

SEQ ID NO: 371458 - DNA, 416 bp, Homo sapiens
gctggacacaaccaaaggcggaggacccgtggcccacgaagctcatctttgaactgtccccgccttctcccgccttgacttgtgaccctaggccctttggggcgcctctgacccagctagccagatcccggacccaaaccatgttccctgtgaaggtgaaagtggagaaatcagagctggagatggccaaagcccggaaccaactggatgctgtcttgcagtgtctgctggagaagagtcacatggacagggagcgtctggatgaggaagctgggaaaacaccctcagacacccacaataagtgagtttttctgattggatttggagttgagagttcgtggttggtaacttctttccttatccaagccctgaccgctcagcccagcgctacctccatcgtggcccggaccactcca

SEQ ID NO: 371459 - DNA, 1135 bp, Homo sapiens
tgcgtgcagtgttgcctcgcccaaagaagactacaatctccagggaaacctggggcgtctcgcgcaaacgtccataactgaaagtagctaaggcaccccagccggaggaagtgagctctcctggggcgtggttgttcgtgatccttgcatctgttacttagggtcaaggcttgggtcttgccccgcagacccttgggacgacccggccccagcgcagctatgaacctggagcgagtgtccaatgaggagaaattgaacctgtgccggaagtactacctgggggggtttgctttcctgccttttctctggttggtcaacatcttctggttcttccgagaggccttccttgtcccagcctacacagaacagagccaaatcaaaggctagctggagatggccaaagcccggaaccaactggatgctgtcttgcagtgtctgctggagaagagtcacatggacagggagcgtctggatgaggaagctgggaaaacaccctcagacacccacaataaggactgctccatcgcagccactggcaaaaggccatctgcccgcttcccccaccagcggaggaagaagaggagggagatggatgatgggctggctgagggagggccgcagcgatccaacacatatgtgatcaagctgttcgaccggagcgtggacttggcccagttcagcgagaacacgccactgtacccaatctgccgcgcctggatgcgcaacagcccctctgtgcgcgagcgtgaatgctctcccagctcacccctgcccccgctgcctgaggatgaggagggctcagaggtaaccaacagcaagagtcgtgatgtgtacaagctgccgccacccacacccccggggccacccggagatgcctgcagatcccgcatcccatctccactgcagcctgagatgcagggcacccctgacgatgagccctctgagcccgagccctcaccctccacactcatctatcgcaacatgcagcgctggaaacgcatccgccagaggtggaaggaggcctctcatcggaaccagcttcgttactcagaaagcatgaagatcctacgagagatgtacgaacgacagtgatgttcccaggtccccccacaccagtaaacatcccccagctcca

SEQ ID NO: 371460 - DNA, 1129 bp, Homo sapiens
tgcgtgcagtgttgcctcgcccaaagaagactacaatctccagggaaacctggggcgtctcgcgcaaacgtccataactgaaagtagctaaggcaccccagccggaggaagtgagctctcctggggcgtggttgttcgtgatccttgcatctgttacttagggtcaaggcttgggtcttgccccgcagacccttgggacgacccggccccagcgcagctatgaacctggagcgagtgtccaatgaggagaaattgaacctgtgccggaagtactacctgggggggtttgctttcctgccttttctctggttggtcaacatcttctggttcttccgagaggccttccttgtcccagcctacacagaacagagccaaatcaaaggctagctggagatggccaaagcccggaaccaactggatgctgtcttgcagtgtctgctggagaagagtcacatggacagggagcgtctggatgaggaagctgggaaaacaccctcagacacccacaataactgacactccctctccctacgcaggccatctgcccgcttcccccaccagcggaggaagaagaggagggagatggatgatgggctggctgagggagggccgcagcgatccaacacatatgtgatcaagctgttcgaccggagcgtggacttggcccagttcagcgagaacacgccactgtacccaatctgccgcgcctggatgcgcaacagcccctctgtgcgcgagcgtgaatgctctcccagctcacccctgcccccgctgcctgaggatgaggagggctcagaggtaaccaacagcaagagtcgtgatgtgtacaagctgccgccacccacacccccggggccacccggagatgcctgcagatcccgcatcccatctccactgcagcctgagatgcagggcacccctgacgatgagccctctgagcccgagccctcaccctccacactcatctatcgcaacatgcagcgctggaaacgcatccgccagaggtggaaggaggcctctcatcggaaccagcttcgttactcagaaagcatgaagatcctacgagagatgtacgaacgacagtgatgttcccaggtccccccacaccagtaaacatcccccagctcca

SEQ ID NO: 371461 - DNA, 970 bp, Homo sapiens
tcgggaccatcgggttgacagggtgtggagtcccggtggaagggagtatcgcggaaaggggactgcacgacttttccctgaagcccacctgacaatcgctgtatcaggcagcgagcgttgcctgccaccttcacaccctcccggtgtgcgcttgaagtcgctttgagattgaatggggtggctcgggcaatgacgtgcgtggtaggacatggggaatcctgagccgagctggagatggccaaagcccggaaccaactggatgctgtcttgcagtgtctgctggagaagagtcacatggacagggagcgtctggatgaggaagctgggaaaacaccctcagacacccacaataactgacactccctctccctacgcaggccatctgcccgcttcccccaccagcggaggaagaagaggagggagatggatgatgggctggctgagggagggccgcagcgatccaacacatatgtgatcaagctgttcgaccggagcgtggacttggcccagttcagcgagaacacgccactgtacccaatctgccgcgcctggatgcgcaacagcccctctgtgcgcgagcgtgaatgctctcccagctcacccctgcccccgctgcctgaggatgaggagggctcagaggtaaccaacagcaagagtcgtgatgtgtacaagctgccgccacccacacccccggggccacccggagatgcctgcagatcccgcatcccatctccactgcagcctgagatgcagggcacccctgacgatgagccctctgagcccgagccctcaccctccacactcatctatcgcaacatgcagcgctggaaacgcatccgccagaggtggaaggaggcctctcatcggaaccagcttcgttactcagaaagcatgaagatcctacgagagatgtacgaacgacagtgatgttcccaggtccccccacaccagtaaacatcccccagctcca

SEQ ID NO: 371462 - DNA, 773 bp, Homo sapiens
atccccagggtgccctctgcagggttttgcacaggcgtttgtctgagggtcaactgtctttccccacagggactgctccatcgcagccactggcaaaagggtaaggtggcagggtcccagccagctgactagaggctcccagctcctaccccagtcctgacactccctctccctacgcaggccatctgcccgcttcccccaccagcggaggaagaagaggagggagatggatgatgggctggctgagggagggccgcagcgatccaacacatatgtgatcaagctgttcgaccggagcgtggacttggcccagttcagcgagaacacgccactgtacccaatctgccgcgcctggatgcgcaacagcccctctgtgcgcgagcgtgaatgctctcccagctcacccctgcccccgctgcctgaggatgaggagggctcagaggtaaccaacagcaagagtcgtgatgtgtacaagctgccgccacccacacccccggggccacccggagatgcctgcagatcccgcatcccatctccactgcagcctgagatgcagggcacccctgacgatgagccctctgagcccgagccctcaccctccacactcatctatcgcaacatgcagcgctggaaacgcatccgccagaggtggaaggaggcctctcatcggaaccagcttcgttactcagaaagcatgaagatcctacgagagatgtacgaacgacagtgatgttcccaggtccccccacaccagtaaacatcccccagctcca

SEQ ID NO: 371463 - DNA, 738 bp, Homo sapiens
tgaacgaggcagtgaatcgagctcgtgtacctgttggagtgttgttggagaagagccatgtacaggagcgtctggatgaggaagctgggaaaacaccctcagacacccacaataaggactgctccatcgcagccactggcaaaaggccatctgcccgcttcccccaccagcggaggaagaagaggagggagatggatgatgggctggctgagggagggccgcagcgatccaacacatatgtgatcaagctgttcgaccggagcgtggacttggcccagttcagcgagaacacgccactgtacccaatctgccgcgcctggatgcgcaacagcccctctgtgcgcgagcgtgaatgctctcccagctcacccctgcccccgctgcctgaggatgaggagggctcagaggtaaccaacagcaagagtcgtgatgtgtacaagctgccgccacccacacccccggggccacccggagatgcctgcagatcccgcatcccatctccactgcagcctgagatgcagggcacccctgacgatgagccctctgagcccgagccctcaccctccacactcatctatcgcaacatgcagcgctggaaacgcatccgccagaggtggaaggaggcctctcatcggaaccagcttcgttactcagaaagcatgaagatcctacgagagatgtacgaacgacagtgatgttcccaggtccccccacaccagtaaacatcccccagctcca

SEQ ID NO: 371464 - DNA, 875 bp, Homo sapiens
gctggacacaaccaaaggcggaggacccgtggcccacgaagctcatctttgaactgtccccgccttctcccgccttgacttgtgaccctaggccctttggggcgcctctgacccagctagccagatcccggacccaaaccatgttccctgtgaaggtgaaagtggagaaatcagagctggagatggccaaagcccggaaccaactggatgctgtcttgcagtgtctgctggagaagagtcacatggacagggagcgtctggatgaggaagctgggaaaacaccctcagacacccacaataaggactgctccatcgcagccactggcaaaaggatgatgggctggctgagggagggccgcagcgatccaacacatatgtgatcaagctgttcgaccggagcgtggacttggcccagttcagcgagaacacgccactgtacccaatctgccgcgcctggatgcgcaacagcccctctgtgcgcgagcgtgaatgctctcccagctcacccctgcccccgctgcctgaggatgaggagggctcagaggtaaccaacagcaagagtcgtgatgtgtacaagctgccgccacccacacccccggggccacccggagatgcctgcagatcccgcatcccatctccactgcagcctgagatgcagggcacccctgacgatgagccctctgagcccgagccctcaccctccacactcatctatcgcaacatgcagcgctggaaacgcatccgccagaggtggaaggaggcctctcatcggaaccagcttcgttactcagaaagcatgaagatcctacgagagatgtacgaacgacagtgatgttcccaggtccccccacaccagtaaacatcccccagctcca

SEQ ID NO: 371465 - DNA, 1274 bp, Homo sapiens
tgcgtgcagtgttgcctcgcccaaagaagactacaatctccagggaaacctggggcgtctcgcgcaaacgtccataactgaaagtagctaaggcaccccagccggaggaagtgagctctcctggggcgtggttgttcgtgatccttgcatctgttacttagggtcaaggcttgggtcttgccccgcagacccttgggacgacccggccccagcgcagctatgaacctggagcgagtgtccaatgaggagaaattgaacctgtgccggaagtactacctgggggggtttgctttcctgccttttctctggttggtcaacatcttctggttcttccgagaggccttccttgtcccagcctacacagaacagagccaaatcaaaggctgtgagtctagagcacagaggagggaggccagtggcaggggagagggggaagcggggaatcttggtgggaagggacaatggaggatccaaaatgttggggctctgggtgagaagggaaggctggtctagggaagtctggagagcagccggaggccaacccttccagcttctgtttcccatgacagatgtctggcgctcagctgtgggcttcctcttctgggtgatagtgctcacctcctggatcaccatcttccagatctaccggccccgctggggtgcccttggggactacctctccttcaccatacccctgggcaccccctgacaacttctgcacatactggggccctgcttattctcccaggacaggctccttaaagcagaggagcctgtcctgggagccccttctcaaactcctaagacttgttttcatgtcccacgttctctgctgacatcccccaataaaggaccctaactttcgatactgacttcctgggatcttttagaggttgaggcataaatgattattaatatttaaaaacatctgttgagagctttgtacgaggcttagtatttagacatgatgtacattttttacagtgcatactactcataatcttctgaactaggaactttcctgctcaggaaactattagatgagaaactaagaaaggaatagtgcttccatttctttttcttttttcttttttttttttttttttgagacagagtcttgctctgtcagccaggctggagtgcagtggtaggatcggcctagtgcttccatttctaggggctgttatcctgtactggtagtcgtgaattcaaaaatataactttcctactgtgggctgcagtattctcatcagaagtgtagatcacgatgctac

SEQ ID NO: 371466 - DNA, 967 bp, Homo sapiens
  misc_feature (677)..(677): n is a, c, g, or t
  misc_feature (687)..(687): n is a, c, g, or t
  misc_feature (692)..(692): n is a, c, g, or t
  misc_feature (810)..(810): n is a, c, g, or t
tgcgtgcagtgttgcctcgcccaaagaagactacaatctccagggaaacctggggcgtctcgcgcaaacgtccataactgaaagtagctaaggcaccccagccggaggaagtgagctctcctggggcgtggttgttcgtgatccttgcatctgttacttagggtcaaggcttgggtcttgccccgcagacccttgggacgacccggccccagcgcagctatgaacctggagcgagtgtccaatgaggagaaattgaacctgtgccggaagtactacctgggggggtttgctttcctgccttttctctggttggtcaacatcttctggttcttccgagaggccttccttgtcccagcctacacagaacagagccaaatcaaaggctatgtctggcgctcagctgtgggcttcctcttctgggtgatagtgctcacctcctggatcaccatcttccagatctaccggccccgctggggtgcccttggggactacctctccttcaccatacccctgggcaccccctgacaacttctcctgggagccccttctcaaactcctaagacttgttttcatgtcccacgttctctgctgacatcccccaataaaggaccctaactttcgaaaaaaaaaaaaaaaaaaaaaaaaaaaaaaccggggggtttttttggggggggganaaaaggggtngaaanggcatgggatagggttccgggcccccgtttgtggtcgcagggggaaactgggagagccccccagaggagggcggataattcgaaagccggggttcgatatctctcctctacacaaganaaagaaggagagacgaggagggcgacacgtgtaacacgcgggcgaagacgaggagaagagatggatcaacgaaagaggccggacacggaggctagaaaagaaaagacaaagagaaaagaggagaacaggcacagagaagacgcgcagaggcgagggg

SEQ ID NO: 371467 - DNA, 1058 bp, Homo sapiens
tgcgtgcagtgttgcctcgcccaaagaagactacaatctccagggaaacctggggcgtctcgcgcaaacgtccataactgaaagtagctaaggcaccccagccggaggaagtgagctctcctggggcgtggttgttcgtgatccttgcatctgttacttagggtcaaggcttgggtcttgccccgcagacccttgggacgacccggccccagcgcagctatgaacctggagcgagtgtccaatgaggagaaattgaacctgtgccggaagtactacctgggggggtttgctttcctgccttttctctggttggtcaacatcttctggttcttccgagaggccttccttgtcccagcctacacagaacagagccaaatcaaaggctatgtctggcgctcagctgtgggcttcctcttctgggtgatagtgctcacctcctggatcaccatcttccagatctaccggccccgctggggtgcccttggggactacctctccttcaccatacccctgggcaccccctgacaacttctgcacatactggggccctgcttattctctcctgggagccccttctcaaactcctaagacttgttttcatgtcccacgttctctgctgacatcccccaataaaggaccctaactttcgatactgacttcctgggatcttttagaggttgaggcataaatgattattaatatttaaaaacatctgttgagagctttgtacgaggcttagtatttagacatgatgtacattttttacagtgcatactactcataatcttctgaactaggaactttcctgctcaggaaactattagatgagaaactaagaaaggaatagtgcttccatttctttttcttttttcttttttttttttttttttgagacagagtcttgctctgtcagccaggctggagtgcagtggtaggatcggcctagtgcttccatttctaggggctgttatcctgtactggtagtcgtgaattcaaaaatataactttcctactgtgggctgcagtattctcatcagaagtgtagatcacgatgctac

SEQ ID NO: 371468 - DNA, 1050 bp, Homo sapiens
tgcgtgcagtgttgcctcgcccaaagaagactacaatctccagggaaacctggggcgtctcgcgcaaacgtccataactgaaagtagctaaggcaccccagccggaggaagtgagctctcctggggcgtggttgttcgtgatccttgcatctgttacttagggtcaaggcttgggtcttgccccgcagacccttgggacgacccggccccagcgcagctatgaacctggagcgagtgtccaatgaggagaaattgaacctgtgccggaagtactacctgggggggtttgctttcctgccttttctctggttggtcaacatcttctggttcttccgagaggccttcatgtctggcgctcagctgtgggcttcctcttctgggtgatagtgctcacctcctggatcaccatcttccagatctaccggccccgctggggtgcccttggggactacctctccttcaccatacccctgggcaccccctgacaacttctgcacatactggggccctgcttattctcccaggacaggctccttaaagcagaggagcctgtcctgggagccccttctcaaactcctaagacttgttttcatgtcccacgttctctgctgacatcccccaataaaggaccctaactttcgatactgacttcctgggatcttttagaggttgaggcataaatgattattaatatttaaaaacatctgttgagagctttgtacgaggcttagtatttagacatgatgtacattttttacagtgcatactactcataatcttctgaactaggaactttcctgctcaggaaactattagatgagaaactaagaaaggaatagtgcttccatttctttttcttttttcttttttttttttttttttgagacagagtcttgctctgtcagccaggctggagtgcagtggtaggatcggcctagtgcttccatttctaggggctgttatcctgtactggtagtcgtgaattcaaaaatataactttcctactgtgggctgcagtattctcatcagaagtgtagatcacgatgctac

SEQ ID NO: 371469 - DNA, 1024 bp, Homo sapiens
tgcgtgcagtgttgcctcgcccaaagaagactacaatctccagggaaacctggggcgtctcgcgcaaacgtccataactgaaagtagctaaggcaccccagccggaggaagtgagctctcctggggcgtggttgttcgtgatccttgcatctgttacttagggtcaaggcttgggtcttgccccgcagacccttgggacgacccggccccagcgcagctatgaacctggagcgagtgtccaatgaggagaaattgaacctgtgccggaagtactacctgggggggtttgctttcctgccttttctctggttggtcaacatcttctggttcttccgagaggccttccttgtcccagcctacacagaacagagccaaatcaaaggctatgtctggcgctcagctgtgggcttcctcttctgggtgatagtgctcacctcctggatcaccatcttccagatctaccggctgcacatactggggccctgcttattctcccaggacaggctccttaaagcagaggagcctgtcctgggagccccttctcaaactcctaagacttgttttcatgtcccacgttctctgctgacatcccccaataaaggaccctaactttcgatactgacttcctgggatcttttagaggttgaggcataaatgattattaatatttaaaaacatctgttgagagctttgtacgaggcttagtatttagacatgatgtacattttttacagtgcatactactcataatcttctgaactaggaactttcctgctcaggaaactattagatgagaaactaagaaaggaatagtgcttccatttctttttcttttttcttttttttttttttttttgagacagagtcttgctctgtcagccaggctggagtgcagtggtaggatcggcctagtgcttccatttctaggggctgttatcctgtactggtagtcgtgaattcaaaaatataactttcctactgtgggctgcagtattctcatcagaagtgtagatcacgatgctac

SEQ ID NO: 371470 - DNA, 1687 bp, Homo sapiens
gctggacacaaccaaaggcggaggacccgtggcccacgaagctcatctttgaactgtccccgccttctcccgccttgacttgtgaccctaggccctttggggcgcctctgacccagctagccagatcccggacccaaaccatgttccctgtgaaggtgaaagtggagaaatcagagctggagatggccaaagcccggaaccaactggatgctgtcttgcagtgtctgctggagaagagtcacatggacagggagcgtctggatgaggaagctgggaaaacaccctcagacacccacaataaggactgctccatcgcagccactggcaaaaggccatctgcccgcttcccccaccagcggaggaagaagaggagggagatggatgatgggctggctgagggagggccgcagcgatccaacacatatgtgatcaagctgttcgaccggagcgtggacttggcccagttcagcgagaacacgccactgtacccaatctgccgcgcctggatgcgcaacagcccctctgtgcgcgagcgtgaatgctctcccagctcacccctgcccccgctgcctgaggatgaggaggtgggatgggtagtgggtcccagcccagcagcctggtgccagggcagtgggtggataggctcaaaggatcctgcccctaagctagtgggatagacagacacaggtccctcacgtgaatcctggatcaggctaggcacacagatgtgcactcttaggttggggtgtggatcagagtccctagggaagacatacgtaaccacctggcctgggagacagggaacagggttaccctggacagttagatgtggacctccaagatcaggggttcccaagagccgaggggctagacaagggtccttagtacagacagaagtggccaccaggccttgaggagcaggggctgggcaggaatggatgggagtctataagccatctgacccagcggggtagacaagggtccccaggacagacatataggacccttcagacatataggactgtcagaaatggacagagcttcctaggtggcacagacgtgaccccctagacaggattccctgaggcaggcagacgcgactccctgggctgacaggtgtagatggagtctctgggctggataggagaagacaggggtccctggggcaggcacacttgacccgctggctggttgaggtgtctgcccttcatacatgcctcctgtctgagtcccttagcgagcccctcatgccatttgttgctgggaaaggcaggagggatgaatgtggattcccagcccctctgctttgactctcttgggcctggcatggggcccttgtgtccccagggctcagaggtaaccaacagcaagagtcgtgatgtgtacaagctgccgccacccacacccccggggccacccggagatgcctgcagatcccgcatcccatctccactgcagcctgagatgcagggcacccctgacgatgagccctctgagcccgagccctcaccctccacactcatctatcgcaacatgcagcgctggaaacgcatccgccagaggtggaaggaggcctctcatcggaaccagcttcgttactcagaaagcatgaagatcctacgagagatgtacgaacgacagtgatgttcccaggtccccccacaccagtaaacatcccccagctcca

SEQ ID NO: 371471 - DNA, 935 bp, Homo sapiens
tgcgtgcagtgttgcctcgcccaaagaagactacaatctccagggaaacctggggcgtctcgcgcaaacgtccataactgaaagtagctaaggcaccccagccggaggaagtgagctctcctggggcgtggttgttcgtgatccttgcatctgttacttagggtcaaggcttgggtcttgccccgcagacccttgggacgacccggccccagcgcagctatgaacctggagcgagtgtccaatgaggagaaattgaacctgtgccggaagtactacctgggggggtttgctttcctgccttttctctggttggtcaacatcttctggttcttccgagaggccttccttgtcccagcctacacagaacagagccaaatcaaaggctatgtctggcgctcagctgtgggcttcctcttctgggtgatagtgctcacctctcctgggagccccttctcaaactcctaagacttgttttcatgtcccacgttctctgctgacatcccccaataaaggaccctaactttcgatactgacttcctgggatcttttagaggttgaggcataaatgattattaatatttaaaaacatctgttgagagctttgtacgaggcttagtatttagacatgatgtacattttttacagtgcatactactcataatcttctgaactaggaactttcctgctcaggaaactattagatgagaaactaagaaaggaatagtgcttccatttctttttcttttttcttttttttttttttttttgagacagagtcttgctctgtcagccaggctggagtgcagtggtaggatcggcctagtgcttccatttctaggggctgttatcctgtactggtagtcgtgaattcaaaaatataactttcctactgtgggctgcagtattctcatcagaagtgtagatcacgatgctac

SEQ ID NO: 371472 - DNA, 1289 bp, Homo sapiens
tgcgtgcagtgttgcctcgcccaaagaagactacaatctccagggaaacctggggcgtctcgcgcaaacgtccataactgaaagtagctaaggcaccccagccggaggaagtgagctctcctggggcgtggttgttcgtgatccttgcatctgttacttagggtcaaggcttgggtcttgccccgcagacccttgggacgacccggccccagcgcagctatgaacctggagcgagtgtccaatgaggagaaattgaacctgtgccggaagtactacctgggggggtttgctttcctgccttttctctggttggtcaacatcttctggttcttccgagaggccttccttgtcccagcctacacagaacagagccaaatcaaaggctagctggagatggccaaagcccggaaccaactggatgctgtcttgcagtgtctgctggagaagagtcacatggacagggagcgtctggatgaggaagctgggaaaacaccctcagacacccacaataaggactgctccatcgcagccactggcaaaagggtaaggtggcagggtcccagccagctgactagaggctcccagctcctaccccagtcctgacactccctctccctacgcaggccatctgcccgcttcccccaccagcggaggaagaagaggagggagatggatgatgggctggctgagggagggccgcagcgatccaacacatatgtgatcaagctgttcgaccggagcgtggacttggcccagttcagcgagaacacgccactgtacccaatctgccgcgcctggatgcgcaacagcccctctgtgcgcgagcgtgaatgctctcccagctcacccctgcccccgctgcctgaggatgaggagggctcagaggtaaccaacagcaagagtcgtgatgtgtacaagctgccgccacccacacccccggggccacccggagatgcctgcagatcccgcatcccatctccactgcagcctgagatgcagggcacccctgacgatgagccctctgagcccgagccctcaccctccacactcatctatcgcaacatgcagcgctggaaacgcatccgccagaggtgagcgtcccccagcctgcttgcccctcgtagggccctttgcaactgctgagtctcccctctgcctccccaggtggaaggaggcctctcatcggaaccagcttcgttactcagaaagcatgaagatcctacgagagatgtacgaacgacagtgatgttcccaggtccccccacaccagtaaacatcccccagctcca

SEQ ID NO: 371473 - DNA, 960 bp, Homo sapiens
tgcgtgcagtgttgcctcgcccaaagaagactacaatctccagggaaacctggggcgtctcgcgcaaacgtccataactgaaagtagctaaggcaccccagccggaggaagtgagctctcctggggcgtggttgttcgtgatccttgcatctgttacttagggtcaaggcttgggtcttgccccgcagacccttgggacgacccggccccagcgcagctatgaacctggagcgagtgtccaatgaggagaaattgaacctgtgccggaagtactacctgggggggtttgctttcctgccttttctctggttggtcaacatcttctggttcttccgagaggccttccttgtcccagcctacacagaacagagccaaatcaaaggctagctggagatggccaaagcccggaaccaactggatgctgtcttgcagtgtctgctggagaagagtcacatggacagggagcgtctggatgaggaagctgggaaaacaccctcagacacccacaataaggactgctccatcgcagccactggcaaaaggccatctgcccgcttcccccaccagcggaggaagaagaggagggagatggatgatgggctggctgagggagggccgcagcgatccaacacatatgtgatcaagctgttcgaccggagcgtggacttggcccagttcagcgagaacacgccactgtacccaatctgccgcgcctggatgcgcaacagcccctctgtgcgcgagcgtgaatgctctcccagccctctgagcccgagccctcaccctccacactcatctatcgcaacatgcagcgctggaaacgcatccgccagaggtggaaggaggcctctcatcggaaccagcttcgttactcagaaagcatgaagatcctacgagagatgtacgaacgacagtgatgttcccaggtccccccacaccagtaaacatcccccagctcca

SEQ ID NO: 371474 - DNA, 924 bp, Homo sapiens
gctggacacaaccaaaggcggaggacccgtggcccacgaagctcatctttgaactgtccccgccttctcccgccttgacttgtgaccctaggccctttggggcgcctctgacccagctagccagatcccggacccaaaccatgttccctgtgaaggtgaaagtggagaaatcagagctggagatggccaaagcccggaaccaactggatgctgtcttgcagtgtctgctggagaagagtcacatggacagggagcgtctggatgaggaagctgggaaaacaccctcagacacccacaataaggactgctccatcgcagccactggcaaaaggccatctgcccgcttcccccaccagcggaggaagaagaggagggagatggatgatgggctggctgagggagggccgcagcgatccaacacatatgtgatcaagctgttcgaccggagcgtggacttggcccagttcagcgagaacacgccactgtacccaatctgccgcgcctggatgcgcaacagcccctctgtgcgcgagcgtgaatgctctcccagctcacccctgcccccgctgcctgaggatgaggagggctcagaggtaaccaacagcaagagtcgtgatgtgtacaagctgccgccacccacacccccggggccacccggagatgcctgcagatcccgcatcccatctccactgcagcctgagatgcagggcacccctgacgatgagccctctgagcccgagccctcaccctccacactcatctatcgcaacatgcagcgctggaaacgcatccgccagaggtggaaggaggcctctcatcggaaccagcttcgttactcagaaagcatgaagatcctacgagagatgtacgaacgacagtgatgttcccaggtccccccacaccagtaaacatcccccagctcca

SEQ ID NO: 371475 - DNA, 921 bp, Homo sapiens
tgcgtgcagtgttgcctcgcccaaagaagactacaatctccagggaaacctggggcgtctcgcgcaaacgtccataactgaaagtagctaaggcaccccagccggaggaagtgagctctcctggggcgtggttgttcgtgatccttgcatctgttacttagggtcaaggcttgggtcttgccccgcagacccttgggacgacccggccccagcgcagctatgaacctggagcgagtgtccaatgaggagaaattgaacctgtgccggaagtactacctgggggggtttgctttcctgccttttctctggttggtcaacatcttctggttcttccgagaggccttccttgtcccagcctacacagaacagagccaaatcaaaggctatgtctggcgctcagctgtgggcttcctcttctgggtgatagtgctcacctcctggatcaccatcttccagatctaccggccccgctggggtgcccttggggactacctctccttcaccatacccctgggcaccccctgacaacttctgcacatactggggccctgcttattctcccaggacaggctccttaaagcagaggagcctgtcctgggagccccttctcaaactcctaagacttgttttcatgtcccacgttctctgctgacatcccccaataaaggaccctaactttcgaaaaaaaaaaaaaagaacaacgaacaaagaaaaaaaaacaccgccggcgggaccttaatatcgcggcggggggcaaaaagagcgcgtcttaaatgtggcaccatgtgccagaaggtggctcccgtgagccccacgttttgtgaccacacgggggaaaaaccggccgggggcccccataaagggggcgcggaaaaagttctgaaacgccggtaccgtgtctccacgacacatagcgaacat

SEQ ID NO: 371476 - DNA, 2372 bp, Homo sapiens
gctggacacaaccaaaggcggaggacccgtggcccacgaagctcatctttgaactgtccccgccttctcccgccttgacttgtgaccctaggccctttggggcgcctctgacccagctagccagatcccggacccaaaccatgttccctgtgaaggtgaaagtggagaaatcagagctggagatggccaaagcccggaaccaactggatgctgtcttgcagtgtctgctggagaagagtcacatggacagggagcgtctggatgaggaagctgggaaaacaccctcagacacccacaataaggactgctccatcgcagccactggcaaaaggccatctgcccgcttcccccaccagcggaggaagaagaggagggagatggatgatgggctggctgagggagggccgcagcgatccaacacatatgtgatcaagctgttcgaccggagcgtggacttggcccagttcagcgagaacacgccactgtacccaatctgccgcgcctggatgcgcaacagcccctctgtgcgcgagcgtgaatgctctcccagctcacccctgcccccgctgcctgaggatgaggaggtgggatgggtagtgggtcccagcccagcagcctggtgccagggcagtgggtggataggctcaaaggatcctgcccctaagctagtgggatagacagacacaggtccctcacgtgaatcctggatcaggctaggcacacagatgtgcactcttaggttggggtgtggatcagagtccctagggaagacatacgtaaccacctggcctgggagacagggaacagggttaccctggacagttagatgtggacctccaagatcaggggttcccaagagccgaggggctagacaagggtccttagtacagacagaagtggccaccaggccttgaggagcaggggctgggcaggaatggatgggagtctataagccatctgacccagcggggtagacaagggtccccaggacagacatataggacccttcagacatataggactgtcagaaatggacagagcttcctaggtggcacagacgtgaccccctagacaggattccctgaggcaggcagacgcgactccctgggctgacaggtgtagatggagtctctgggctggataggagaagacaggggtccctggggcaggcacacttgacccgctggctggttgaggtgtctgcccttcatacatgcctcctgtctgagtcccttagcgagcccctcatgccatttgttgctgggaaaggcaggagggatgaatgtggattcccagcccctctgctttgactctcttgggcctggcatggggcccttgtgtccccagggctcagaggtaaccaacagcaagagtcgtgatgtgtacaagctgccgccacccacacccccggggccacccggagatgcctgcagatcccgcatcccatctccactgcagcctgagatgcagggcacccctgacgatgagccctctgagcccgagccctcaccctccacactcatctatcgcaacatgcagcgctggaaacgcatccgccagaggtggaaggaggcctctcatcggaaccagcttcgttactcagaaagcatgaagatcctacgagagatgtacgaacgacagtgatgttcccaggtccccccacaccagtaaacatcccccagctccaaaagaaaaaaagacacccaaaaccagaaacagacaagcacaaaacaacaacaacttctacaaaaacaaacaccacgaaccaccacacaaaacacaaactgggggggcggcaggcccggccccggacaaaagaggcgtttttcacagacaccacacctcgggtgggggccacagcgccaccccccgaacgttgaatcgatgagaaccacgacggcgcccacaaaccggacgctgtcccccaaccgacaaactcccgcgcgtcacacacaaaacagagggcggggcatcatccaccaccataaaaacaaaaaccacccgccgggagtaacacaaccacccgcgcccctgacagaacaccacacctacacaagagcggcgcctccaagacggcgcccacataacaaggggggagctcacacaaccagccaggggagggctcccacaaccggaagcggccggccgcaacacaaaaaacataatacgcgccgccgccgcggagggagggagaacaaccacgacagccaccaacaccgaccccagactccatgcaccaaccaccgacgcaacgacggcacgacacagacgacaacgacgcgagaccatatgcaccgacaaccagaccaccaacacgatcaacatcgagaactacaacagccacccagagtagcacacgacaaacagaaacc

SEQ ID NO: 371477 - DNA, 1156 bp, Homo sapiens
tgcgtgcagtgttgcctcgcccaaagaagactacaatctccagggaaacctggggcgtctcgcgcaaacgtccataactgaaagtagctaaggcaccccagccggaggaagtgagctctcctggggcgtggttgttcgtgatccttgcatctgttacttagggtcaaggcttgggtcttgccccgcagacccttgggacgacccggccccagcgcagctatgaacctggagcgagtgtccaatgaggagaaattgaacctgtgccggaagtactacctgggggggtttgctttcctgccttttctctggttggtcaacatcttctggttcttccgagaggccttccttgtcccagcctacacagaacagagccaaatcaaaggctagctggagatggccaaagcccggaaccaactggatgctgtcttgcagtgtctgctggagaagagtcacatggacagggagcgtctggatgaggaagctgggaaaacaccctcagacacccacaataaggactgctccatcgcagccactggcaaaagggtaaggtggcagggtcccagccagctgactagaggctcccagctcctaccccagtcctgacactccctctccctacgcaggccatctgcccgcttcccccaccagcggaggaagaagaggagggagatggatgatgggctggctgagggagggccgcagcgatccaacacatatgtgatcaagctgttcgaccggagcgtggacttggcccagttcagcgagaacacgccactgtacccaatctgccgcgcctggatgcgcaacagcccctctggctcagaggtaaccaacagcaagagtcgtgatgtgtacaagctgccgccacccacacccccggggccacccggagatgcctgcagatcccgcatcccatctccactgcagcctgagatgcagggcacccctgacgatgagccctctgagcccgagccctcaccctccacactcatctatcgcaacatgcagcgctggaaacgcatccgccagaggtggaaggaggcctctcatcggaaccagcttcgttactcagaaagcatgaagatcctacgagagatgtacgaacgacagtgatgttcccaggtccccccacaccagtaaacatcccccagctcca

SEQ ID NO: 371478 - DNA, 1149 bp, Homo sapiens
tgcgtgcagtgttgcctcgcccaaagaagactacaatctccagggaaacctggggcgtctcgcgcaaacgtccataactgaaagtagctaaggcaccccagccggaggaagtgagctctcctggggcgtggttgttcgtgatccttgcatctgttacttagggtcaaggcttgggtcttgccccgcagacccttgggacgacccggccccagcgcagctatgaacctggagcgagtgtccaatgaggagaaattgaacctgtgccggaagtactacctgggggggtttgctttcctgccttttctctggttggtcaacatcttctggttcttccgagaggccttccttgtcccagcctacacagaacagagccaaatcaaaggctagctggagatggccaaagcccggaaccaactggatgctgtcttgcagtgtctgctggagaagagtcacatggacagggagcgtctggatgaggaagctgggaaaacaccctcagacacccacaataaggactgctccatcgcagccactggcaaaagggtaaggtggcagggtcccagccagctgactagaggctcccagctcctaccccagtcctgacactccctctccctacgcaggccatctgcccgcttcccccaccagcggaggaagaagaggagggagatggatgatgggctggctgagggagggccgcagcgatccaacacatatgtgatcaagctgttcgaccggagcgtggacttggcccagttcagcgagaacacgccactgtacccaatctgccgcgcctggatgcgcaacagcccctctgtgcgcgagcgtgaatgctctcccagctcacccctgcccccgctgcctgaggatgaggagcacccggagatgcctgcagatcccgcatcccatctccactgcagcctgagatgcagggcacccctgacgatgagccctctgagcccgagccctcaccctccacactcatctatcgcaacatgcagcgctggaaacgcatccgccagaggtggaaggaggcctctcatcggaaccagcttcgttactcagaaagcatgaagatcctacgagagatgtacgaacgacagtgatgttcccaggtccccccacaccagtaaacatcccccagctcca

SEQ ID NO: 371479 - DNA, 288 bp, Homo sapiens
cggcacgaggggctggaacaaggtagctcagctacgcgttctaagtgccatcacacgcaaattcaagctagagccatctgtgagcctggtaaacgtgctagattgctgccctccccagctgacgggcgcggacctctactctctctgcttctaagagaaaggcccatctactcaggaagagggccagggccttgggttctggggattgggccctgagagggctagttctgtggctgaaaataaagcatgtcccgccccctactggtgttgtggcatgaaaggttggag

SEQ ID NO: 371480 - DNA, 3386 bp, Homo sapiens
gcggaagcggccctcgcgcacactagtcgtctggctctctggctccggaagctgcgctccttcaccctcctcgttggtgtcctgtcaccatggcgctggctgtcttgcgggtcctggagccctttccgaccgagacacccccgttggcagtgctgctgccacccgggggcccgtggccggcggcggagctgggcctggtgctggccctgaggcctgcaggggagagcccggcagggccggcgctgctggtggcagccctggaggggccggacgcgggcaccgaagagcagggtcccgggccgccgcagctactggttagccgcgcgctgctgcggctcctggcactgggctccggggcctgggtgcgggcgcgggcggtgcggcggcccccggcgctaggttgggcactgcttggcacctcgctggggcctgggctcggaccgcgagtcgggccgctgctggtgaggcgcggagagaccctcccagtgcccggaccgcgggtgctggagacgcggccggcgttgcaagggctgctgggcccagggactcggctggctgtgactgagctccgcgggcgggccagactgtgtccagagtctggggacagcagtcggcccccacccccgcccgtggtgtcctcctttgcggtttctggcacagtgcggcgactccagggagttctgggagggactggagattcactaggggtgagccggagctgtctccgtggccttggcctcttccagggcgaatgggtgtgggtggcccaggccagagagtcatcgaacacttcacagccgcacttggctagggtgcaggtcctagaacctcgctgggacctctctgatagactgggacccggctctggaccgctgggagagcccctcgctgacggactggcgcttgtccctgccactttggcttttaatcttggctgtgaccccctggaaatgggagagctcagaattcagaggtacttggaaggctccatcgcccctgaagacaaaggaagctgctcattgctgcctgggcctccatttgccagagagttacacatcgaaattgtgtcttctccccactacagcactaatggaaattatgacggtgttctttaccggcactttcagatacccagggtagtccaggaaggggatgttctatgtgtgccaacaattgggcaagtagagatcctggaaggaagtccagagaaactgcccaggtggcgggaaatgttttttaaagtgaagaaaacagttggggaagctccagatggaccagccagtgcctacttggccgacaccacccatacctccttgtacatggtgggttctaccctgagccctgttccatggctcccttcagaggaatccactctctggagcagtttgtctcctccaggcctggaggccttggtgtctgaactctgtgctgtcctgaagcctcgcctccagccagggggtgccctgctgacaggaactagcagtgtccttctacggggccccccaggctgtgggaagaccacagtagttgctgctgcctgtagtcaccttgggctccacttactgaaggtgccctgctccagcctctgtgcagaaagtagtggggctgtggagacaaaactgcaggccatcttctcccgggcccgccgttgccggcctgcagtcctgttgctcacagctgtggaccttctgggccgggaccgtgatgggctgggtgaggatgcccgtgtgatggctgtgctgcgtcacctcctcctcaatgaggaccccctcaacagctgccctcccctcatggttgtggccaccacaagccgggcccaggacctgcctgctgatgtgcagacagcatttcctcatgagctcgaggtgcctgctctgtcagaggggcagcggctcagcatcctgcgggccctcactgcccaccttcccctgggccaggaggtgaacttggcacagctagcacggcggtgtgcaggctttgtggtaggggatctctatgcccttctgacccacagcagccgggcagcctgcaccaggatcaagaactcaggtttggcaggtggcttgactgaggaggatgagggggagctgtgtgctgccggctttcctctcctggctgaggactttgggcaggcactggagcaactgcagacagctcactcccaggccgttggagcccccaagatcccctcagtgtcctggcatgatgtgggtgggctgcaggaggtgaagaaggagatcctggagaccattcagctccccctggagcaccctgagctactgagcctgggcctgagacgctcaggccttctgctccatgggccccctggcaccggcaagacccttctggccaaggcagtagccactgagtgcagccttaccttcctcagcgtgaaggggccagagctcattaacatgtatgtgggccaaagtgaggagaatgtgcgggaagtgtttgccagggccagggctgcagctccatgcattatcttctttgatgaactggactctttggccccaagccgggggcgaagtggagattctggaggagtgatggacagggtggtgtctcagctccttgccgagctagatgggctgcacagcactcaggatgtgtttgtgattggagccaccaacagaccagatctcctggaccctgcccttctgcggcctggcagatttgacaagctggtgtttgtgggggcaaatgaggaccgggcctcccagctacgcgttctaagtgccatcacacgcaaattcaagctagagccatctgtgagcctggtaaacgtgctagattgctgccctccccagctgacgggcgcggacctctactctctctgctctgatgctatgacagctgccctcaaacgcagggttcatgacctggaggaagggctggaacaaggtagctcagcactgatgctcaccatggaggacttgctgcaggctgccgcccggctgcaaccctcagtcagtgagcaggagctgctccggtacaagcgcatccagcgcaagtttgctgcctgctaggagccccccagggtctgggaccccgctcagcatggctgcaggtaccttgatagcccacagagagatctgggaaggaagggctcctcctcaggctgctgccaacccacctggaggccacctccctccaggagatcccagggtgcaaagtggcattgagacagcagcaacagctcaagagatatctcctgcctacttgcccctccttccaggccggctctaagagaaaggcccatctactcaggaagagggccagggccttgggttctggggattgggccctgagagggctagttctgtggctgaaaataaagcatgtcccgccccctactggtgttgtggcatgaaaggttggag

SEQ ID NO: 371481 - DNA, 3302 bp, Homo sapiens
gcggaagcggccctcgcgcacactagtcgtctggctctctggctccggaagctgcgctccttcaccctcctcgttggtgtcctgtcaccatggcgctggctgtcttgcgggtcctggagccctttccgaccgagacacccccgttggcagtgctgctgccacccgggggcccgtggccggcggcggagctgggcctggtgctggccctgaggcctgcaggggagagcccggcagggccggcgctgctggtggcagccctggaggggccggacgcgggcaccgaagagcagggtcccgggccgccgcagctactggttagccgcgcgctgctgcggctcctggcactgggctccggggcctgggtgcgggcgcgggcggtgcggcggcccccggcgctaggttgggcactgcttggcacctcgctggggcctgggctcggaccgcgagtcgggccgctgctggtgaggcgcggagagaccctcccagtgcccggaccgcgggtgctggagacgcggccggcgttgcaagggctgctgggcccagggactcggctggctgtgactgagctccgcgggcgggccagactgtgtccagagtctggggacagcagtcggcccccacccccgcccgtggtgtcctcctttgcggtttctggcacagtgcggcgactccagggagttctgggagggactggagattcactaggggtgagccggagctgtctccgtggccttggcctcttccagggcgaatgggtgtgggtggcccaggccagagagtcatcgaacacttcacagccgcacttggctagggtgcaggtcctagaacctcgctgggacctctctgatagactgggacccggctctggaccgctgggagagcccctcgctgacggactggcgcttgtccctgccactttggcttttaatcttggctgtgaccccctggaaatgggagagctcagaattcagaggtacttggaaggctccatcgcccctgaagacaaaggaagctgctcattgctgcctgggcctccatttgccagagagttacacatcgaaattgtgtcttctccccactacagcactaatggaaattatgacggtgttctttaccggcactttcagatacccaggtggcgggaaatgttttttaaagtgaagaaaacagttggggaagctccagatggaccagccagtgcctacttggccgacaccacccatacctccttgtacatggtgggttctaccctgagccctgttccatggctcccttcagaggaatccactctctggagcagtttgtctcctccaggcctggaggccttggtgtctgaactctgtgctgtcctgaagcctcgcctccagccagggggtgccctgctgacaggaactagcagtgtccttctacggggccccccaggctgtgggaagaccacagtagttgctgctgcctgtagtcaccttgggctccacttactgaaggtgccctgctccagcctctgtgcagaaagtagtggggctgtggagacaaaactgcaggccatcttctcccgggcccgccgttgccggcctgcagtcctgttgctcacagctgtggaccttctgggccgggaccgtgatgggctgggtgaggatgcccgtgtgatggctgtgctgcgtcacctcctcctcaatgaggaccccctcaacagctgccctcccctcatggttgtggccaccacaagccgggcccaggacctgcctgctgatgtgcagacagcatttcctcatgagctcgaggtgcctgctctgtcagaggggcagcggctcagcatcctgcgggccctcactgcccaccttcccctgggccaggaggtgaacttggcacagctagcacggcggtgtgcaggctttgtggtaggggatctctatgcccttctgacccacagcagccgggcagcctgcaccaggatcaagaactcaggtttggcaggtggcttgactgaggaggatgagggggagctgtgtgctgccggctttcctctcctggctgaggactttgggcaggcactggagcaactgcagacagctcactcccaggccgttggagcccccaagatcccctcagtgtcctggcatgatgtgggtgggctgcaggaggtgaagaaggagatcctggagaccattcagctccccctggagcaccctgagctactgagcctgggcctgagacgctcaggccttctgctccatgggccccctggcaccggcaagacccttctggccaaggcagtagccactgagtgcagccttaccttcctcagcgtgaaggggccagagctcattaacatgtatgtgggccaaagtgaggagaatgtgcgggaagtgtttgccagggccagggctgcagctccatgcattatcttctttgatgaactggactctttggccccaagccgggggcgaagtggagattctggaggagtgatggacagggtggtgtctcagctccttgccgagctagatgggctgcacagcactcaggatgtgtttgtgattggagccaccaacagaccagatctcctggaccctgcccttctgcggcctggcagatttgacaagctggtgtttgtgggggcaaatgaggaccgggcctcccagctacgcgttctaagtgccatcacacgcaaattcaagctagagccatctgtgagcctggtaaacgtgctagattgctgccctccccagctgacgggcgcggacctctactctctctgctctgatgctatgacagctgccctcaaacgcagggttcatgacctggaggaagggctggaacaaggtagctcagcactgatgctcaccatggaggacttgctgcaggctgccgcccggctgcaaccctcagtcagtgagcaggagctgctccggtacaagcgcatccagcgcaagtttgctgcctgctaggagccccccagggtctgggaccccgctcagcatggctgcaggtaccttgatagcccacagagagatctgggaaggaagggctcctcctcaggctgctgccaacccacctggaggccacctccctccaggagatcccagggtgcaaagtggcattgagacagcagcaacagctcaagagatatctcctgcctacttgcccctccttccaggccggctctaagagaaaggcccatctactcaggaagagggccagggccttgggttctggggattgggccctgagagggctagttctgtggctgaaaataaagcatgtcccgccccctactggtgttgtggcatgaaaggttggag

SEQ ID NO: 371482 - DNA, 3640 bp, Homo sapiens
gcggaagcggccctcgcgcacactagtcgtctggctctctggctccggaagctgcgctccttcaccctcctcgttggtgtcctgtcaccatggcgctggctgtcttgcgggtcctggagccctttccgaccgagacacccccgttggcagtgctgctgccacccgggggcccgtggccggcggcggagctgggcctggtgctggccctgaggcctgcaggggagagcccggcagggccggcgctgctggtggcagccctggaggggccggacgcgggcaccgaagagcagggtcccgggccgccgcagctactggttagccgcgcgctgctgcggctcctggcactgggctccggggcctgggtgcgggcgcgggcggtgcggcggcccccggcgctaggttgggcactgcttggcacctcgctggggcctgggctcggaccgcgagtcgggccgctgctggtgaggcgcggagagaccctcccagtgcccggaccgcgggtgctggagacgcggccggcgttgcaagggctgctgggcccagggactcggctggctgtgactgagctccgcgggcgggccagactgtgtccagagtctggggacagcagtcggcccccacccccgcccgtggtgtcctcctttgcggtttctggcacagtgcggcgactccagggagttctgggagggactggagattcactaggggtgagccggagctgtctccgtggccttggcctcttccagggcgaatgggtgtgggtggcccaggccagagagtcatcgaacacttcacagccgcacttggctagggtgcaggtcctagaacctcgctgggacctctctgatagactgggacccggctctggaccgctgggagagcccctcgctgacggactggcgcttgtccctgccactttggcttttaatcttggctgtgaccccctggaaatgggagagctcagaattcagaggtacttggaaggctccatcgcccctgaagacaaaggaagctgctcattgctgcctgggcctccatttgccagagagttacacatcgaaattgtgtcttctccccactacagcactaatggaaattatgacggtgttctttaccggcactttcagatacccagggtagtccaggaaggggatgttctatgtgtgccaacaattgggcaagtagagatcctggaaggaagtccagagaaactgcccaggtggcgggaaatgttttttaaagtgaagaaaacagttggggaagctccagatggaccagccagtgcctacttggccgacaccacccatacctccttgtacatggtgggttctaccctgagccctgttccatggctcccttcagaggaatccactctctggagcagtttgtctcctccaggcctggaggccttggtgtctgaactctgtgctgtcctgaagcctcgcctccagccagggggtgccctgctgacaggaactagcagtgtccttctacggggccccccaggctgtgggaagaccacagtagttgctgctgcctgtagtcaccttgggctccacttactgaaggtgccctgctccagcctctgtgcagaaagtagtggggctgtggagacaaaactgcaggccatcttctcccgggcccgccgttgccggcctgcagtcctgttgctcacagctgtggaccttctgggccgggaccgtgatgggctgggtgaggatgcccgtgtgatggctgtgctgcgtcacctcctcctcaatgaggaccccctcaacagctgccctcccctcatggttgtggccaccacaagccgggcccaggacctgcctgctgatgtgcagacagcatttcctcatgagctcgaggtgcctgctctgtcagaggggcagcggctcagcatcctgcgggccctcactgcccaccttcccctgggccaggaggtgaacttggcacagctagcacggcggtgtgcaggctttgtggtaggggatctctatgcccttctgacccacagcagccgggcagcctgcaccaggatcaagaactcaggtttggcaggtggcttgactgaggaggatgagggggagctgtgtgctgccggctttcctctcctggctgaggactttgggcaggcactggagcaactgcagacagctcactcccaggccgttggagcccccaagatcccctcagtgtcctggcatgatgtgggtgggctgcaggaggtgaagaaggagatcctggagaccattcagctccccctggagcaccctgagctactgagcctgggcctgagacgctcaggccttctgctccatgggccccctggcaccggcaagacccttctggccaaggcagtagccactgagtgcagccttaccttcctcagcgtgaaggggccagagctcattaacatgtatgtgggccaaagtgaggagaatgtgcgggaaggtgagtgagcagggaggggcagggcgtcccatgcttcccaaaccccgatggcccccaagccaccccctactcccaggctactcatgatcattcctaatcctcctttctacaagtcaggttcctgcccagctgggtctagtacctgggatgccagtgctgtattgtcaggccccagtttccctccctgctctcacctaacttcaaccccccacaagccgagctttgccctcctgtgggcccctctctctcttcagtgtttgccagggccagggctgcagctccatgcattatcttctttgatgaactggactctttggccccaagccgggggcgaagtggagattctggaggagtgatggacagggtggtgtctcagctccttgccgagctagatgggctgcacagcactcaggatgtgtttgtgattggagccaccaacagaccagatctcctggaccctgcccttctgcggcctggcagatttgacaagctggtgtttgtgggggcaaatgaggaccgggcctcccagctacgcgttctaagtgccatcacacgcaaattcaagctagagccatctgtgagcctggtaaacgtgctagattgctgccctccccagctgacgggcgcggacctctactctctctgctctgatgctatgacagctgccctcaaacgcagggttcatgacctggaggaagggctggaacaaggtagctcagcactgatgctcaccatggaggacttgctgcaggctgccgcccggctgcaaccctcagtcagtgagcaggagctgctccggtacaagcgcatccagcgcaagtttgctgcctgctaggagccccccagggtctgggaccccgctcagcatggctgcaggtaccttgatagcccacagagagatctgggaaggaagggctcctcctcaggctgctgccaacccacctggaggccacctccctccaggagatcccagggtgcaaagtggcattgagacagcagcaacagctcaagagatatctcctgcctacttgcccctccttccaggccggctctaagagaaaggcccatctactcaggaagagggccagggccttgggttctggggattgggccctgagagggctagttctgtggctgaaaataaagcatgtcccgccccctactggtgttgtggcatgaaaggttggag

SEQ ID NO: 371483 - DNA, 3761 bp, Homo sapiens
gcggaagcggccctcgcgcacactagtcgtctggctctctggctccggaagctgcgctccttcaccctcctcgttggtgtcctgtcaccatggcgctggctgtcttgcgggtcctggagccctttccgaccgagacacccccgttggcagtgctgctgccacccgggggcccgtggccggcggcggagctgggcctggtgctggccctgaggcctgcaggggagagcccggcagggccggcgctgctggtggcagccctggaggggccggacgcgggcaccgaagagcagggtcccgggccgccgcagctactggttagccgcgcgctgctgcggctcctggcactgggctccggggcctgggtgcgggcgcgggcggtgcggcggcccccggcgctaggttgggcactgcttggcacctcgctggggcctgggctcggaccgcgagtcgggccgctgctggtgaggcgcggagagaccctcccagtgcccggaccgcgggtgctggagacgcggccggcgttgcaagggctgctgggcccagggactcggctggctgtgactgagctccgcgggcgggccagactgtgtccagagtctggggacagcagtcggcccccacccccgcccgtggtgtcctcctttgcggtttctggcacagtgcggcgactccagggagttctgggagggactggagattcactaggggtgagccggagctgtctccgtggccttggcctcttccagggcgaatgggtgtgggtggcccaggccagagagtcatcgaacacttcacagccgcacttggctagggtgcaggtcctagaacctcgctgggacctctctgatagactgggacccggctctggaccgctgggagagcccctcgctgacggactggcgcttgtccctgccactttggcttttaatcttggctgtgaccccctggaaatgggagagctcagaattcagaggtacttggaaggctccatcgcccctgaagacaaaggaagctgctcattgctgcctgggcctccatttgccagagagttacacatcgaaattgtgtcttctccccactacagcactaatggaaattatgacggtgttctttaccggcactttcagatacccagggtagtccaggaaggggatgttctatgtgtgccaacaattgggcaagtagagatcctggaaggaagtccagagaaactgcccaggtggcgggaaatgttttttaaagtgaagaaaacagttggggaagctccagatggaccagccagtgcctacttggccgacaccacccatacctccttgtacatggtgggttctaccctgagccctgttccatggctcccttcagaggaatccactctctggagcagtttgtctcctccaggcctggaggccttggtgtctgaactctgtgctgtcctgaagcctcgcctccagccagggggtgccctgctgacaggaactagcagtgtccttctacggggccccccaggctgtgggaagaccacagtagttgctgctgcctgtagtcaccttgggctccacttactgaaggtgagggtctctggagagtagaaccccagctacttcccctccccagctcatgttctccctctctgctgcttcctctcccctccctcctctgtctactcacaggccctagcacttcagcccagtgggtcaggcatattcccatgatgctgagctatggagaggtactttcaaggaggagggagttgcaagatattggtggacagtccagggaatgggatagggtaaaaaagaggtaggacttggccagggtaccttccctgtccctgccctccagagaaaaagatggcccacatcttccacctcctcctcccctgattctcctgcccttgtcatgctttccccttgctcacagacccattgggatcccctccccaggtgccctgctccagcctctgtgcagaaagtagtggggctgtggagacaaaactgcaggccatcttctcccgggcccgccgttgccggcctgcagtcctgttgctcacagctgtggaccttctgggccgggaccgtgatgggctgggtgaggatgcccgtgtgatggctgtgctgcgtcacctcctcctcaatgaggaccccctcaacagctgccctcccctcatggttgtggccaccacaagccgggcccaggacctgcctgctgatgtgcagacagcatttcctcatgagctcgaggtgcctgctctgtcagaggggcagcggctcagcatcctgcgggccctcactgcccaccttcccctgggccaggaggtgaacttggcacagctagcacggcggtgtgcaggctttgtggtaggggatctctatgcccttctgacccacagcagccgggcagcctgcaccaggatcaagaactcaggtttggcaggtggcttgactgaggaggatgagggggagctgtgtgctgccggctttcctctcctggctgaggactttgggcaggcactggagcaactgcagacagctcactcccaggccgttggagcccccaagatcccctcagtgtcctggcatgatgtgggtgggctgcaggaggtgaagaaggagatcctggagaccattcagctccccctggagcaccctgagctactgagcctgggcctgagacgctcaggccttctgctccatgggccccctggcaccggcaagacccttctggccaaggcagtagccactgagtgcagccttaccttcctcagcgtgaaggggccagagctcattaacatgtatgtgggccaaagtgaggagaatgtgcgggaagtgtttgccagggccagggctgcagctccatgcattatcttctttgatgaactggactctttggccccaagccgggggcgaagtggagattctggaggagtgatggacagggtggtgtctcagctccttgccgagctagatgggctgcacagcactcaggatgtgtttgtgattggagccaccaacagaccagatctcctggaccctgcccttctgcggcctggcagatttgacaagctggtgtttgtgggggcaaatgaggaccgggcctcccagctacgcgttctaagtgccatcacacgcaaattcaagctagagccatctgtgagcctggtaaacgtgctagattgctgccctccccagctgacgggcgcggacctctactctctctgctctgatgctatgacagctgccctcaaacgcagggttcatgacctggaggaagggctggaacaaggtagctcagcactgatgctcaccatggaggacttgctgcaggctgccgcccggctgcaaccctcagtcagtgagcaggagctgctccggtacaagcgcatccagcgcaagtttgctgcctgctaggagccccccagggtctgggaccccgctcagcatggctgcaggtaccttgatagcccacagagagatctgggaaggaagggctcctcctcaggctgctgccaacccacctggaggccacctccctccaggagatcccagggtgcaaagtggcattgagacagcagcaacagctcaagagatatctcctgcctacttgcccctccttccaggccggctctaagagaaaggcccatctactcaggaagagggccagggccttgggttctggggattgggccctgagagggctagttctgtggctgaaaataaagcatgtcccgccccctactggtgttgtggcatgaaaggttggag

SEQ ID NO: 371484 - DNA, 3308 bp, Homo sapiens
gcggaagcggccctcgcgcacactagtcgtctggctctctggctccggaagctgcgctccttcaccctcctcgttggtgtcctgtcaccatggcgctggctgtcttgcgggtcctggagccctttccgaccgagacacccccgttggcagtgctgctgccacccgggggcccgtggccggcggcggagctgggcctggtgctggccctgaggcctgcaggggagagcccggcagggccggcgctgctggtggcagccctggaggggccggacgcgggcaccgaagagcagggtcccgggccgccgcagctactggttagccgcgcgctgctgcggctcctggcactgggctccggggcctgggtgcgggcgcgggcggtgcggcggcccccggcgctaggttgggcactgcttggcacctcgctggggcctgggctcggaccgcgagtcgggccgctgctggtgaggcgcggagagaccctcccagtgcccggaccgcgggtgctggagacgcggccggcgttgcaagggctgctgggcccagggactcggctggctgtgactgagctccgcgggcgggccagactgtgtccagagtctggggacagcagtcggcccccacccccgcccgtggtgtcctcctttgcggtttctggcacagtgcggcgactccagggagttctgggagggactggagattcactaggggtgagccggagctgtctccgtggccttggcctcttccagggcgaatgggtgtgggtggcccaggccagagagtcatcgaacacttcacagccgcacttggctagggtgcaggtcctagaacctcgctgggacctctctgatagactgggacccggctctggaccgctgggagagcccctcgctgacggactggcgcttgtccctgccactttggcttttaatcttggctgtgaccccctggaaatgggagagctcagaattcagaggtacttggaaggctccatcgcccctgaagacaaaggaagctgctcattgctgcctgggcctccatttgccagagagttacacatcgaaattgtgtcttctccccactacagcactaatggaaattatgacggtgttctttaccggcactttcagatacccagggtagtccaggaaggggatgttctatgtgtgccaacaattgggcaagtagagatcctggaaggaagtccagagaaactgcccaggtggcgggaaatgttttttaaagtgaagaaaacagttggggaagctccagatggaccagccagtgcctacttggccgacaccacccatacctccttgtacatggtgggttctaccctgagccctgttccatggctcccttcagaggaatccactctctggagcagtttgtctcctccaggcctggaggccttggtgtctgaactctgtgctgtcctgaagcctcgcctccagccagggggtgccctgctgacaggaactagcagtgtccttctacggggccccccaggctgtgggaagaccacagtagttgctgctgcctgtagtcaccttgggctccacttactgaaggtgccctgctccagcctctgtgcagaaagtagtggggctgtggagacaaaactgcaggccatcttctcccgggcccgccgttgccggcctgcagtcctgttgctcacagctgtggaccttctgggccgggaccgtgatgggctgggtgaggatgcccgtgtgatggctgtgctgcgtcacctcctcctcaatgaggaccccctcaacagctgccctcccctcatggttgtggccaccacaagccgggcccaggacctgcctgctgatgtgcagacagcatttcctcatgagctcgaggtgcctgctctgtcagaggggcagcggctcagcatcctgcgggccctcactgcccaccttcccctgggccaggaggtgaacttggcacagctagcacggcggtgtgcaggctttgtggtaggggatctctatgcccttctgacccacagcagccgggcagcctgcaccaggatcaagaactcaggtttggcaggtggcttgactgaggaggatgagggggagctgtgtgctgccggctttcctctcctggctgaggactttgggcaggcactggagcaactgcagacagctcactcccaggccgttggagcccccaagatcccctcagtgtcctggcatgatgtgggtgggctgcaggaggtgaagaaggagatcctggagaccattcagctccccctggagcaccctgagctactgagcctgggcctgagacgctcaggccttctgctccatgggccccctggcaccggcaagacccttctggccaaggcagtagccactgagtgcagccttaccttcctcagcgtgaaggggccagagctcattaacatgtatgtgggccaaagtgaggagaatgtgcgggaagtgtttgccagggccagggctgcagctccatgcattatcttctttgatgaactggactctttggccccaagccgggggcgaagtggagattctggaggagtgatggacagggtggtgtctcagctccttgccgagctagatgggctgcacagcactcaggatgtgtttgtgattggagccaccaacagaccagatctcctggaccctgcccttctgcggcctggcagatttgacaagctggtgtttgtgggggcaaatgaggaccgggcctcccagctacgcgttctaagtgccatcacacgcaaattcaagctagagccatctgtgagcctggtaaacgtgctagattgctgccctccccagctgacgggcgcggacctctactctctctgctctgatgctatgacagctgccctcaaacgcagggttcatgacctggaggaagggctggaacaaggtagctcagcactgatgctcaccatggaggacttgctgcaggctgccgcccggctgcaaccctcagtcagtgagcaggagctgctccggtacaagcgcatccagcgcaagtttgctgcctgctaggagccccccagggtctgggaccccgctcagcatggctgcaggtaccttgatagcccacagagagatctgggaaggaagggctcctcctcaggctgctgccaacccacctggaggccacctccctccaggagatcccagggtgcaaagtggcattgagaaagagcagggttgtgggaggagtaagccctgggagagggtgggggggtgggcagcatgggagcctgatccttctgacataaataaacacaatgcatgcaggaactgaaaaagactata

SEQ ID NO: 371485 - DNA, 2358 bp, Homo sapiens
gcggaagcggccctcgcgcacactagtcgtctggctctctggctccggaagctgcgctccttcaccctcctcgttggtgtcctgtcaccatggcgctggctgtcttgcgggtcctggagccctttccgaccgagacacccccgttggcagtgctgctgccacccgggggcccgtggccggcggcggagctgggcctggtgctggccctgaggcctgcaggggagagcccggcagggccggcgctgctggtggcagccctggaggggccggacgcgggcaccgaagagcagggtcccgggccgccgcagctactggttagccgcgcgctgctgcggctcctggcactgggctccggggcctgggtgcgggcgcgggcggtgcggcggcccccggcgctaggttgggcactgcttggcacctcgctggggcctgggctcggaccgcgagtcgggccgctgctggtgaggcgcggagagaccctcccagtgcccggaccgcgggtgctggagacgcggccggcgttgcaagggctgctgggcccagggactcggctggctgtgactgagctccgcgggcgggccagactgtgtccagagtctggggacagcagtcggcccccacccccgcccgtggtgtcctcctttgcggtttctggcacagtgcggcgactccagggagttctgggagggactggagattcactaggggtgagccggagctgtctccgtggccttggcctcttccagggcgaatgggtgtgggtggcccaggccagagagtcatcgaacacttcacagccgcacttggctagggtgcaggtcctagaacctcgctgggacctctctgatagactgggacccggctctggaccgctgggagagcccctcgctgacggactggcgcttgtccctgccactttggcttttaatcttggctgtgaccccctggaaatgggagagctcagaattcagaggtacttggaaggctccatcgcccctgaagacaaaggaagctgctcattgctgcctgggcctccatttgccagagagttacacatcgaaattgtgtcttctccccactacagcactaatggaaattatgacggtgttctttaccggcactttcagatacccagggtagtccaggaaggggatgttctatgtgtgccaacaattgggcaagtagagatcctggaaggaagtccagagaaactgcccaggtggcgggaaatgttttttaaagtgaagaaaacagttggggaagctccagatggaccagccagtgcctacttggccgacaccacccatacctccttgtacatggtgggttctaccctgagccctgttccatggctcccttcagaggaatccactctctggagcagtttgtctcctccaggcctggaggccttggtgtctgaactctgtgctgtcctgaagcctcgcctccagccagggggtgccctgctgacaggaactagcagtgtccttctacggggccccccaggctgtgggaagaccacagtagttgctgctgcctgtagtcaccttgggctccacttactgaaggtgccctgctccagcctctgtgcagaaagtagtggggctgtggagacaaaactgcaggccatcttctcccgggcccgccgttgccggcctgcagtcctgttgctcacagctgtggaccttctgggccgggaccgtgatgggctgggtgaggatgcccgtgtgatggctgtgctgcgtcacctcctcctcaatgaggaccccctcaacagctgccctcccctcatggttgtggccaccacaagccgggcccaggacctgcctgctgatgtgcagacagcatttcctcatgagctcgaggtgcctgctctgtcagaggggcagcggctcagcatcctgcgggccctcactgcccaccttcccctgggccaggaggtgaacttggcacagctagcacggcggtgtgcagtgagtatcaagggagagtactggccctccctaggaggtccctggcttttgttacaagaactcagtcctgttgccttgtgagtgagagtagaaaacccagcgcgggcgccgtggctcacgcctgtaatcctagcactttgggaggccgaggtgggcggatcacctgaggttgggagtttgagaccagcctggccaacatggagaaaccccgtctctactaaaaatacaaagttagccaggtgtggtggcacatgcctgtaatcccagctacttgggaggctgaggtgagataatcgcttgaacccgggtggaagttgcggtgagccgagatcgcgccattgcactccagcctgagcaacaagagcaaaactccgtctcaaaaaaa

SEQ ID NO: 371486 - DNA, 780 bp, Homo sapiens
ccatacctccttgtacatggtgaggccccaaggatgggtgtagaccagcgcagggggtagaaacgatttttagaaacgaaagctttttattacctttcacaggtgggttctaccctgagccctgttccatggctcccttcagaggaatccactctctggagcagtttgtctcctccaggcctggaggccttggtgtctgaactctgtgctgtcctgaagcctcgcctccagccagggtgagtgaggtcatcaccccagggtgtgagaaaagcctgcttagaacatccctggaggagcagcagccagatgggtagttcctaatgaactggccagagtgggattgggaggaccttcctcaaaccagtatgtcctacacaaggccaccaggccactcctttctgtaagccaattcccaggctcctttcctgggataacctctgtcctccagggctggctctggaggaataatctccagcaggggcatctgtttctgagactgcccttccccttggggaactcactggccatcctgcactttactgccctggccctgaaggacacaactcctcataccagtggcccaggtgtggacgcagatccccacctcagtgccaccacaatgtctctcaataccattcagaccagtcataacgttgaggttttattggcagcacagcaatgccaaagggaattaattagtctttggctgttggatatgctggatgccccggccagagcaccgcaggtggtgtgggagacacagcctcactacatggggac

SEQ ID NO: 371487 - DNA, 292 bp, Homo sapiens
aaggccaccaggccactcctttctgtaagccaattcccaggctcctttcctgggataacctctgtcctccagggctggctctggaggaataatctccagcaggggcatctgtttctgagactgcccttccccttggggaactcactggccatcctgcactttactgccctggccctgaaggacacaactcctcataccagtggcccaggtgtggacgcagatccccacctcagtgccaccacaatgtctctcaataccattcagaccagtcataacgttgaggttttattgg

SEQ ID NO: 371488 - DNA, 3509 bp, Homo sapiens
gcggaagcggccctcgcgcacactagtcgtctggctctctggctccggaagctgcgctccttcaccctcctcgttggtgtcctgtcaccatggcgctggctgtcttgcgggtcctggagccctttccgaccgagacacccccgttggcagtgctgctgccacccgggggcccgtggccggcggcggagctgggcctggtgctggccctgaggcctgcaggggagagcccggcagggccggcgctgctggtggcagccctggaggggccggacgcgggcaccgaagagcagggtcccgggccgccgcagctactggttagccgcgcgctgctgcggctcctggcactgggctccggggcctgggtgcgggcgcgggcggtgcggcggcccccggcgctaggttgggcactgcttggcacctcgctggggcctgggctcggaccgcgagtcgggccgctgctggtgaggcgcggagagaccctcccagtgcccggaccgcgggtgctggagacgcggccggcgttgcaagggctgctgggcccagggactcggctggctgtgactgagctccgcgggcgggccagactgtgtccagagtctggggacagcagtcggcccccacccccgcccgtggtgtcctcctttgcggtttctggcacagtgcggcgactccagggagttctgggagggactggagattcactaggggtgagccggagctgtctccgtggccttggcctcttccagggcgaatgggtgtgggtggcccaggccagagagtcatcgaacacttcacagccgcacttggctagggtgcaggtcctagaacctcgctgggacctctctgatagactgggacccggctctggaccgctgggagagcccctcgctgacggactggcgcttgtccctgccactttggcttttaatcttggctgtgaccccctggaaatgggagagctcagaattcagaggtacttggaaggctccatcgcccctgaagacaaaggaagctgctcattgctgcctgggcctccatttgccagagagttacacatcgaaattgtgtcttctccccactacagcactaatggaaattatgacggtgttctttaccggcactttcagatacccagggtagtccaggaaggggatgttctatgtgtgccaacaattgggcaagtagagatcctggaaggaagtccagagaaactgcccaggtggcgggaaatgttttttaaagtgaagaaaacagttggggaagctccagatggaccagccagtgcctacttggccgacaccacccatacctccttgtacatggtgggttctaccctgagccctgttccatggctcccttcagaggaatccactctctggagcagtttgtctcctccaggcctggaggccttggtgtctgaactctgtgctgtcctgaagcctcgcctccagccagggggtgccctgctgacaggaactagcagtgtccttctacggggccccccaggctgtgggaagaccacagtagttgctgctgcctgtagtcaccttgggctccacttactgaaggtgccctgctccagcctctgtgcagaaagtagtggggctgtggagacaaaactgcaggccatcttctcccgggcccgccgttgccggcctgcagtcctgttgctcacagctgtggaccttctgggccgggaccgtgatgggctgggtgaggatgcccgtgtgatggctgtgctgcgtcacctcctcctcaatgaggaccccctcaacagctgccctcccctcatggttgtggccaccacaagccgggcccaggacctgcctgctgatgtgcagacagcatttcctcatgagctcgaggtgcctgctctgtcagaggggcagcggctcagcatcctgcgggccctcactgcccaccttcccctgggccaggaggtgaacttggcacagctagcacggcggtgtgcaggctttgtggtaggggatctctatgcccttctgacccacagcagccgggcagcctgcaccaggatcaagaactcaggtttggcaggtggcttgactgaggaggatgagggggagctgtgtgctgccggctttcctctcctggctgaggactttgggcaggcactggagcaactgcagacagctcactcccaggccgttggagcccccaagatcccctcagtgtcctggcatgatgtgggtgggctgcaggaggtgaagaaggagatcctggagaccattcagctccccctggagcaccctgagctactgagcctgggcctgagacgctcaggccttctgctccatgggccccctggcaccggcaagacccttctggccaaggcagtagccactgagtgcagccttaccttcctcagcgtgaaggggccagagctcattaacatgtatgtgggccaaagtgaggagaatgtgcgggaagtgtttgccagggccagggctgcagctccatgcattatcttctttgatgaactggactctttggccccaagccgggggcgaagtggagattctggaggagtgatggacagggtggtgtctcagctccttgccgagctagatgggctgcacagcactcaggatgtgtttgtgattggagccaccaacagaccagatctcctggaccctgcccttctgcggcctggcagatttgacaagctggtgtttgtgggggcaaatgaggaccgggcctcccagctacgcgttctaagtgccatcacacgcaaattcaagctagagccatctgtgagcctggtaaacgtgctagattgctgccctccccagctgacgggcgcggacctctactctctctgctctgatgctatgacagctgccctcaaacgcagggttcatgacctggaggaagggctggaacaaggtagctcagcactgatgctcaccatggaggacttgctgcaggctgccgcccggctgcaaccctcagtcagtgagcaggagctgctccggtacaagcgcatccagcgcaagtttgctgcctgctaggagccccccagggtctgggaccccgctcagcatggctgcaggtaccttgatagcccacagagagatctgggaaggaagggctcctcctcaggctgctgccaacccacctggaggccacctccctccaggagatcccagggtgcaaagtggcattgagacagcagcaacagctcaagagatatctcctgcctacttgcccctccttccaggccggctctaagagaaaggcccatctactcaggaagagggccagggccttgggttctggggattgggccctgagagggctagttctgtggctgaaaataaagcatgtcccgccccctactggtgttgtggcatgaaaggttggagtgagaaagagcagggttgtgggaggagtaagccctgggagagggtgggggggtgggcagcatgggagcctgatccttctgacataaataaacacaatgcatgcaggaactgaaaaagactata

SEQ ID NO: 371489 - DNA, 3182 bp, Homo sapiens
gcggaagcggccctcgcgcacactagtcgtctggctctctggctccggaagctgcgctccttcaccctcctcgttggtgtcctgtcaccatggcgctggctgtcttgcgggtcctggagccctttccgaccgagacacccccgttggcagtgctgctgccacccgggggcccgtggccggcggcggagctgggcctggtgctggccctgaggcctgcaggggagagcccggcagggccggcgctgctggtggcagccctggaggggccggacgcgggcaccgaagagcagggtcccgggccgccgcagctactggttagccgcgcgctgctgcggctcctggcactgggctccggggcctgggtgcgggcgcgggcggtgcggcggcccccggcgctaggttgggcactgcttggcacctcgctggggcctgggctcggaccgcgagtcgggccgctgctggtgaggcgcggagagaccctcccagtgcccggaccgcgggtgctggagacgcggccggcgttgcaagggctgctgggcccagggactcggctggctgtgactgagctccgcgggcgggccagactgtgtccagagtctggggacagcagtcggcccccacccccgcccgtggtgtcctcctttgcggtttctggcacagtgcggcgactccagggagttctgggagggactggagattcactaggggtgagccggagctgtctccgtggccttggcctcttccagggcgaatgggtgtgggtggcccaggccagagagtcatcgaacacttcacagccgcacttggctagggtgcaggtcctagaacctcgctgggacctctctgatagactgggacccggctctggaccgctgggagagcccctcgctgacggactggcgcttgtccctgccactttggcttttaatcttggctgtgaccccctggaaatgggagagctcagaattcagaggtacttggaaggctccatcgcccctgaagacaaaggaagctgctcattgctgcctgggcctccatttgccagagagttacacatcgaaattgtgtcttctccccactacagcactaatggaaattatgacggtgttctttaccggcactttcagatacccagggtagtccaggaaggggatgttctatgtgtgccaacaattgggcaagtagagatcctggaaggaagtccagagaaactgcccaggtggcgggaaatgttttttaaagtgaagaaaacagttggggaagctccagatggaccagccagtgcctacttggccgacaccacccatacctccttgtacatggtgggttctaccctgagccctgttccatggctcccttcagaggaatccactctctggagcagtttgtctcctccaggcctggaggccttggtgtctgaactctgtgctgtcctgaagcctcgcctccagccagggggtgccctgctgacaggaactagcagtgtccttctacggggccccccaggctgtgggaagaccacagtagttgctgctgcctgtagtcaccttgggctccacttactgaaggtgccctgctccagcctctgtgcagaaagtagtggggctgtggagacaaaactgcaggccatcttctcccgggcccgccgttgccggcctgcagtcctgttgctcacagctgtggaccttctgggccgggaccgtgatgggctgggtgaggatgcccgtgtgatggctgtgctgcgtcacctcctcctcaatgaggaccccctcaacagctgccctcccctcatggttgtggccaccacaagccgggcccaggacctgcctgctgatgtgcagacagcatttcctcatgagctcgaggtgcctgctctgtcagaggggcagcggctcagcatcctgcgggccctcactgcccaccttcccctgggccaggaggtgaacttggcacagctagcacggcggtgtgcaggctttgtggtaggggatctctatgcccttctgacccacagcagccgggcagcctgcaccaggatcaagaactcaggtttggcaggtggcttgactgaggaggatgagggggagctgtgtgctgccggctttcctctcctggctgaggactttgggcaggcactggagcaactgcagacagctcactcccaggccgttggagcccccaagatcccctcagtgtcctggcatgataacatgtatgtgggccaaagtgaggagaatgtgcgggaagtgtttgccagggccagggctgcagctccatgcattatcttctttgatgaactggactctttggccccaagccgggggcgaagtggagattctggaggagtgatggacagggtggtgtctcagctccttgccgagctagatgggctgcacagcactcaggatgtgtttgtgattggagccaccaacagaccagatctcctggaccctgcccttctgcggcctggcagatttgacaagctggtgtttgtgggggcaaatgaggaccgggcctcccagctacgcgttctaagtgccatcacacgcaaattcaagctagagccatctgtgagcctggtaaacgtgctagattgctgccctccccagctgacgggcgcggacctctactctctctgctctgatgctatgacagctgccctcaaacgcagggttcatgacctggaggaagggctggaacaaggtagctcagcactgatgctcaccatggaggacttgctgcaggctgccgcccggctgcaaccctcagtcagtgagcaggagctgctccggtacaagcgcatccagcgcaagtttgctgcctgctaggagccccccagggtctgggaccccgctcagcatggctgcaggtaccttgatagcccacagagagatctgggaaggaagggctcctcctcaggctgctgccaacccacctggaggccacctccctccaggagatcccagggtgcaaagtggcattgagacagcagcaacagctcaagagatatctcctgcctacttgcccctccttccaggccggctctaagagaaaggcccatctactcaggaagagggccagggccttgggttctggggattgggccctgagagggctagttctgtggctgaaaataaagcatgtcccgccccctactggtgttgtggcatgaaaggttggag

SEQ ID NO: 371490 - DNA, 1612 bp, Homo sapiens
  misc_feature (38)..(38): n is a, c, g, or t
  misc_feature (40)..(40): n is a, c, g, or t
  misc_feature (53)..(53): n is a, c, g, or t
  misc_feature (78)..(78): n is a, c, g, or t
  misc_feature (102)..(102): n is a, c, g, or t
  misc_feature (122)..(122): n is a, c, g, or t
  misc_feature (130)..(130): n is a, c, g, or t
aaggtatccaccctcgatgcaatccaccttgttttttntnagggtggaatgtnatgttcagcagcaaacttgcaacanactggccttctgtttgtaactttnaaaaggcccacatgatacanttagaganttcccacgcactttccatctcctagatcccctcagtgtcctggcatgatgtgggtgggctgcaggaggtgaagaaggagatcctggagaccattcagctccccctggagcaccctgagctactgagcctgggcctgagacgctcaggccttctgctccatgggccccctggcaccggcaagacccttctggccaaggcagtagccactgagtgcagccttaccttcctcagcgtgaaggggccagagctcattaacatgtatgtgggccaaagtgaggagaatgtgcgggaaggtgagtgagcagggaggggcagggcgtcccatgcttcccaaaccccgatggcccccaagccaccccctactcccaggctactcatgatcattcctaatcctcctttctacaagtcaggttcctgcccagctgggtctagtacctgggatgccagtgctgtattgtcaggccccagtttccctccctgctctcacctaacttcaaccccccacaagccgagctttgccctcctgtgggcccctctctctcttcagtgtttgccagggccagggctgcagctccatgcattatcttctttgatgaactggactctttggccccaagccgggggcgaagtggagattctggaggagtgatggacagggtggtgtctcagctccttgccgagctagatgggctgcacagcactcaggatgtgtttgtgattggagccaccaacagaccagatctcctggaccctgcccttctgcggcctggcagatttgacaagctggtgtttgtgggggcaaatgaggaccgggcctcccagctacgcgttctaagtgccatcacacgcaaattcaagctagagccatctgtgagcctggtaaacgtgctagattgctgccctccccagctgacgggcgcggacctctactctctctgctctgatgctatgacagctgccctcaaacgcagggttcatgacctggaggaagggctggaacaaggtagctcagcactgatgctcaccatggaggacttgctgcaggctgccgcccggctgcaaccctcagtcagtgagcaggagctgctccggtacaagcgcatccagcgcaagtttgctgcctgctaggagccccccagggtctgggaccccgctcagcatggctgcaggtaccttgatagcccacagagagatctgggaaggaagggctcctcctcaggctgctgccaacccacctggaggccacctccctccaggagatcccagggtgcaaagtggcattgagacagcagcaacagctcaagagatatctcctgcctacttgcccctccttccaggccggctctaagagaaaggcccatctactcaggaagagggccagggccttgggttctggggattgggccctgagagggctagttctgtggctgaaaataaagcatgtcccgccccctactggtgttgtggcatgaaaggttggag

SEQ ID NO: 371491 - DNA, 3391 bp, Homo sapiens
gcggaagcggccctcgcgcacactagtcgtctggctctctggctccggaagctgcgctccttcaccctcctcgttggtgtcctgtcaccatggcgctggctgtcttgcgggtcctggagccctttccgaccgagacacccccgttggcagtgctgctgccacccgggggcccgtggccggcggcggagctgggcctggtgctggccctgaggcctgcaggggagagcccggcagggccggcgctgctggtggcagccctggaggggccggacgcgggcaccgaagagcagggtcccgggccgccgcagctactggttagccgcgcgctgctgcggctcctggcactgggctccggggcctgggtgcgggcgcgggcggtgcggcggcccccggcgctaggttgggcactgcttggcacctcgctggggcctgggctcggaccgcgagtcgggccgctgctggtgaggcgcggagagaccctcccagtgcccggaccgcgggtgctggagacgcggccggcgttgcaagggctgctgggcccagggactcggctggctgtgactgagctccgcgggcgggccagactgtgtccagagtctggggacagcagtcggcccccacccccgcccgtggtgtcctcctttgcggtttctggcacagtgcggcgactccagggagttctgggagggactggagattcactaggggtgagccggagctgtctccgtggccttggcctcttccagggcgaatgggtgtgggtggcccaggccagagagtcatcgaacacttcacagccgcacttggctagggtgcaggtcctagaacctcgctgggacctctctgatagactgggacccggctctggaccgctgggagagcccctcgctgacggactggcgcttgtccctgccactttggcttttaatcttggctgtgaccccctggaaatgggagagctcagaattcagaggtacttggaaggctccatcgcccctgaagacaaaggaagctgctcattgctgcctgggcctccatttgccagagagttacacatcgaaattgtgtcttctccccactacagcactaatggaaattatgacggtgttctttaccggcactttcagatacccagggtagtccaggaaggggatgttctatgtgtgccaacaattgggcaagtagagatcctggaaggaagtccagagaaactgcccaggtggcgggaaatgttttttaaagtgaagaaaacagttggggaagctccagatggaccagccagtgcctacttggccgacaccacccatacctccttgtacatggtgggttctaccctgagccctgttccatggctcccttcagaggaatccactctctggagcagtttgtctcctccaggcctggaggccttggtgtctgaactctgtgctgtcctgaagcctcgcctccagccagggggtgccctgctgacaggaactagcagtgtccttctacggggccccccaggctgtgggaagaccacagtagttgctgctgcctgtagtcaccttgggctccacttactgaaggtgccctgctccagcctctgtgcagaaagtagtggggctgtggagacaaaactgcaggccatcttctcccgggcccgccgttgccggcctgcagtcctgttgctcacagctgtggaccttctgggccgggaccgtgatgggctgggtgaggatgcccgtgtgatggctgtgctgcgtcacctcctcctcaatgaggaccccctcaacagctgccctcccctcatggttgtggccaccacaagccgggcccaggacctgcctgctgatgtgcagacagcatttcctcatgagctcgaggtgcctgctctgtcagaggggcagcggctcagcatcctgcgggccctcactgcccaccttcccctgggccaggaggtgaacttggcacagctagcacggcggtgtgcaggctttgtggtaggggatctctatgcccttctgacccacagcagccgggcagcctgcaccaggatcaagaactcaggtttggcaggtggcttgactgaggaggatgagggggagctgtgtgctgccggctttcctctcctggctgaggactttgggcaggcactggagcaactgcagacagctcactcccaggccgttggagcccccaagatcccctcagtgtcctggcatgatgtgggtgggctgcaggaggtgaagaaggagatcctggagaccattcagctccccctggagcaccctgagctactgagcctgggcctgagacgctcaggccttctgctccatgggccccctggcaccggcaagacccttctggccaaggcagtagccactgagtgcagccttaccttcctcagcgtgaaggggccagagctcattaacatgtatgtgggccaaagtgaggagaatgtgcgggaagtgtttgccagggccagggctgcagctccatgcattatcttctttgatgaactggactctttggccccaagccgggggcgaagtggagattctggaggagtgatggacagggtggtgtctcagctccttgccgagctagatgggctgcacagcactcaggatgtgtttgtgattggagccaccaacagaccagatctcctggaccctgcccttctgcggcctggcagatttgacaagctggtgtttgtgggggcaaatgaggaccgggcctcccagctacgcgttctaagtgccatcacacgcaaattcaagctagagccatctgtgagcctggtaaacgtgctagattgctgccctccccagctgacgggcgcggacctctactctctctgctctgatgctatgacagctgccctcaaacgcagggttcatgacctggaggaagggctggaacaaggtagctcagcactgatgctcaccatggaggacttgctgcaggctgccgcccggctgcaaccctcagtcagtgagcaggagctgctccggtacaagcgcatccagcgcaagtttgctgcctgctaggagccccccagggtctgggaccccgctcagcatggctgcaggaaaacacaacactccacccccgcccccacttaaaggagccccaggcagaatgaacagtgttcctggtgactgggctgggggagcctggctagacctgcataccccacttgtcgaaggcgggctcgtgccgccggttccagcgctccttaagtgcatacttcagcatcttgtcactggcatccacactcgtcacactgaagccctcttccaccagcataatggagtccaccctgagtacggccagcgaggagaggcagagagaggcagttaggggagcctgggagggccaggaggagaccctgcactggacacttttg

SEQ ID NO: 371492 - DNA, 4969 bp, Homo sapiens
cgcgcggcggctcagcggcctggcagaggtttcagcgctgaggaggcctgagttccgtcatggccctctattatgaccaccagatagaagccccggatgcagcagggtcaccctcatttatcagctggcaccctgtccatccattcttggcagttgcttacatcagcacaacctcaacaggcagcgtggatatttacctggagcaaggggagtgcgtgccagatacacacgtcgagaggccgttccgggttgcttccctgtgctggcacccgacgcggctggtgctggctgtgggctgggagactggagaagtgacggtgtttaacaagcaggacaaggagcagcacacgatgcccctgacacacacagccgacatcaccgtgctccgttggagccccagtggaaactgcctgctgtctggggacaggcttggtgtcttgctcttgtggaggttggaccaaaggggccgagtgcaagggacgcctctgctgaaacacgagtatgggaaacacctcacgcactgcatcttccggctcccccctcctggcgaggacctggttcagttggcaaaggcagctgtgagcggtgatgagaaagccctggacatgtttaactggaagaagagcagttctggaagtttgctgaagatggggtctcacgaggggctgttgttctttgtcagtctgatggacgggacagtgcactatgtggatgagaagggcaagaccactcaggtggtgtccgcagacagcacgattcagatgctgttctacatggagaagagggaggcactggtggtggtcacagagaacctccggctgtccctgtacacggtgcctcctgagggcaaagcagaagaagtgatgaaggtcaagctgagcgggaaaaccggccgccgggcagacatcgctttgattgaaggcagccttctcgtgatggccgtcggggaggctgccctcagattctgggacatagaacgaggagagaattatatactgagtccagatgagaagtttggctttgagaaaggagagaatatgaactgtgtgtgttactgtaaagtcaaaggtcttctggccgctggtaccgacagagggcgagtagccatgtggaggaaagtaccagacttcctgggcagccccggggcagagggcaaggacaggtgggcccttcagacccctaccgagctccaaggaaacatcacgcaaatccagtggggttccaggaagaacctgctggcagtgaacagcgtcatctccgtggccatcctcagcgagcgggccatgtcgtcacacttccaccagcaagtggccgccatgcaggtctccccgagtctgctgaatgtgtgcttcctgtccacgggggtcgcacacagcctgcgcaccgacatgcacatcagtggagtgtttgccaccaaggatgctgtcgcagtctggaacggaaggcaggtggcgatcttcgagctttctggagccgcgatacggagtgcagggaccttcttgtgtgagacgcctgtgttagcaatgcatgaagaaaacgtttacacggtggagtcaaaccgagttcaagttcgaacctggcaggggactgtcaaacaactcctccttttctcggagactgaggggaatccctgcttcttggacatctgtgggaatttcctggttgtagggacagacttggctcactttaaaagctttgatctttcccgaagagaggccaaagcacactgtagctgcaggagcctggcggagctggtccctggggtggggggcatcgcttctctgcggtgcagcagcagcgggagcaccatcagcatcctccccagcaaggctgacaacagccctgattccaaaatctgcttctacgatgttgaaatggacacagtgaccgtctttgacttcaagactggacaaattgatcggagagagacgctgtcctttaatgagcaagagactaataagagccacctctttgtggatgagggactgaaaaattatgttcccgtgaaccacttctgggaccagagtgagccccggctgtttgtatgcgaagccgtgcaggagacgccgcgctcccagcctcagtctgcaaacgggcagccccaagatgggcgcgctggccctgcggcagatgttttgatcctgtccttcttcatttccgaagagcacggcttcctgcttcatgagagcttcccccggcctgccacctcccacagtctcctggggatggaagtgccttattactacttcacaagaaagcccgaagaagcagacagagaagacgaggtggagcctgggtgccaccacatccctcagatggtgtccaggagacccctgcgagactttgtggggctggaggactgcgacaaggccacccgggacgccatgctccacttcagcttctttgtcaccataggagacatggacgaagccttcaaatccatcaagctcatcaaaagtgaggccgtctgggagaacatggcgcgcatgtgcgtgaagacccagcggctggacgtggccaaggtgtgcctggggaacatgggccatgcccgcggggcccgagcgctgcgtgaggcggagcaggagccggagctagaggcccgcgtggccgtgctggccacgcagctgggcatgctggaggacgccgagcagctgtacaggaagtgcaagcgccacgacctcctgaacaagttctaccaggctgcgggccggtggcaggaggccctccaggtagccgagcaccacgatcgcgtgcacctgcgcagcacctaccaccgctatgccgggcacctggaggccagcgccgactgcagccgggccctcagttactacgagaagtcggacacgcaccgcttcgaggtgcccaggatgctgtcggaggacctgccgtccctggagctctacgtgaataaaatgaaggataagaccctgtggcggtggtgggcgcagtacctggagagccagggcgagatggacgccgcgctgcactactacgagctggcccgggaccacttctccctggtccgcatccactgcttccagggcaatgtccagaaggctgcgcaaatagccaacgagacaggaaacctggcggcctcctaccacctcgcccgccagtacgagagccaggaggaggtcgggcaggcggtgcacttctacacccgggcacaggccttcaagaatgccatccgcctgtgcaaggagaacggcctggacgaccagctcatgaacttggccctgctgagctcccccgaggacatgatcgaggcggcccgatactacgaggagaagggcgtgcagatggacagggcggtcatgctgtaccacaaggctggccacttctccaaggccctggagctggcctttgccacccagcagtttgtggccctacagctcatagcagaggacctggatgagacgtcagaccctgcgctcctggcccgctgctccgacttcttcatcgagcacagtcagtacgagagggcggtagagctgctgctggctgccaggaagtatcaggaagccctgcagctgtgcctggggcagaacatgagcatcaccgaggagatggcggaaaagatgaccgtggccaaggactcctcggacctgcctgaggagtcgcggcgggagctgctggagcagatagcagactgctgcatgcgccagggcagctaccacctggccaccaagaagtacacgcaggccggcaacaagctgaaggccatgagggcgctgctcaaatccggagacacggagaaaatcacgttcttcgcgagcgtgtccaggcagaaggaaatctacatcatggctgctaactacctgcagtccctggactggcggaaggagccggagatcatgaagaacatcatcggcttctacaccaaggggcgggccctggacctcctggctggcttttatgacgcttgtgcccaggtggagattgatgaataccagaactacgacaaagcccacggggcgctgaccgaggcctacaagtgcctggccaaggccaaggccaagagccccctggaccaggagaccaggctggcgcagctgcagagcaggatggcactggtgaagaggttcatccaggcccgcaggacgtacacagaggaccccaaggagtccatcaagcagtgtgagctgctcctggaggaaccagacctggacagcaccatccgcatcggggacgtctatggcttcctggtggagcactacgtgcggaaggaggaataccagacggcctacagattcctggaggagatgcggcggcggcttcccttggccaacatgtcctactacgtgagcccgcaggccgtggacgccgtgcaccgggggctgggtctcccactgccacgcaccgtccccgagcaggtccgccacaacagcatggaggacgccagggagctggacgaggaggtggtggaagaggcagatgacgacccctgaggggcctgggccccaggaccagcgtgctgctgcagaaaggcatcttctggaattttttcgtcagctgtggcaaagccagcatttttgctgggaaaaaacatgtctgtgttggaatacgcgacagagctgggcgagaacgcagcggcccgggccggcggagggtgtgacccgtctgcaccttgctctgtcccacctgcctctgggtgcccggcagctccactagatttttggattcattcctttgaagggagtcgggttcacccttccatcgtattctcccaactacacattgtaaagcctgagaaacttctagaacctcaggaagctgcagctggagggctggggcacctgcccccctgctccccacacatcatatcctccccatactcctgcagggcccacggctcctgagcaacagctgggacacccgggccttggcggctgcaccccctgctaggctctgcccaccggccaccaacactcctgtaattccaataaagcagtttattttctgagaaaac

SEQ ID NO: 371493 - DNA, 2995 bp, Homo sapiens
  misc_feature (1)..(4): n is a, c, g, or t
nnnngtcccagaggagaggccagggatgccgggtgcgggacagatccctcgtctcgcctgttgcttttaagcctggtggcccccggggcctggaggctggtactgagcgactattgcctgccctggggacttcacaccccccagccatccagttgcccccaggaccataggtacccccaggaccataggaaccacaagcctccccccgcccgtgtgttccaggcctgcccccgccacgggaatgctgccctcaaaaggggggcagatatcacaggattgctgggaaggggagagacccgtgtgcctggagggagcaagttcacccagacctgcagggccagggacctgtacttggaggacctcggggccagggacctgtacttggagggccttggggccagggacctgtacttggaggacctcggggccagggacctgtacttggaggacctcgaggccaggtcattcttaggtggcaagaaggtgaggccgtctgggagaacatggcgcgcatgtgcgtgaagacccagcggctggacgtggccaaggtgtgcctggggaacatgggccatgcccgcggggcccgagcgctgcgtgaggcggagcaggagccggagctagaggcccgcgtggccgtgctggccacgcagctgggcatgctggaggacgccgagcagctgtacaggaagtgcaagcgccacgacctcctgaacaagttctaccaggctgcgggccggtggcaggaggccctccaggtagccgagcaccacgatcgcgtgcacctgcgcagcacctaccaccgctatgccgggcacctggaggccagcgccgactgcagccgggccctcagttactacgagaagtcggacacgcaccgcttcgaggtgcccaggatgctgtcggaggacctgccgtccctggagctctacgtgaataaaatgaaggataagaccctgtggcggtggtgggcgcagtacctggagagccagggcgagatggacgccgcgctgcactactacgagctggcccgggaccacttctccctggtccgcatccactgcttccagggcaatgtccagaaggctgcgcaaatagccaacgagacaggaaacctggcggcctcctaccacctcgcccgccagtacgagagccaggaggaggtcgggcaggcggtgcacttctacacccgggcacaggccttcaagaatgccatccgcctgtgcaaggagaacggcctggacgaccagctcatgaacttggccctgctgagctcccccgaggacatgatcgaggcggcccgatactacgaggagaagggcgtgcagatggacagggcggtcatgctgtaccacaaggctggccacttctccaaggccctggagctggcctttgccacccagcagtttgtggccctacagctcatagcagaggacctggatgagacgtcagaccctgcgctcctggcccgctgctccgacttcttcatcgagcacagtcagtacgagagggcggtagagctgctgctggctgccaggaagtatcaggaagccctgcagctgtgcctggggcagaacatgagcatcaccgaggagatggcggaaaagatgaccgtggccaaggactcctcggacctgcctgaggagtcgcggcgggagctgctggagcagatagcagactgctgcatgcgccagggcagctaccacctggccaccaagaagtacacgcaggccggcaacaagctgaaggccatgagggcgctgctcaaatccggagacacggagaaaatcacgttcttcgcgagcgtgtccaggcagaaggaaatctacatcatggctgctaactacctgcagtccctggactggcggaaggagccggagatcatgaagaacatcatcggcttctacaccaaggggcgggccctggacctcctggctggcttttatgacgcttgtgcccaggtggagattgatgaataccagaactacgacaaagcccacggggcgctgaccgaggcctacaagtgcctggccaaggccaaggccaagagccccctggaccaggagaccaggctggcgcagctgcagagcaggatggcactggtgaagaggttcatccaggcccgcaggacgtacacagaggaccccaaggagtccatcaagcagtgtgagctgctcctggaggaaccagacctggacagcaccatccgcatcggggacgtctatggcttcctggtggagcactacgtgcggaaggaggaataccagacggcctacagattcctggaggagatgcggcggcggcttcccttggccaacatgtcctactacgtgagcccgcaggccgtggacgccgtgcaccgggggctgggtctcccactgccacgcaccgtccccgagcaggtccgccacaacagcatggaggacgccagggagctggacgaggaggtggtggaagaggcagatgacgacccctgaggggcctgggccccaggaccagcgtgctgctgcagaaaggcatcttctggaattttttcgtcagctgtggcaaagccagcatttttgctgggaaaaaacatgtctgtgttggaatacgcgacagagctgggcgagaacgcagcggcccgggccggcggagggtgtgacccgtctgcaccttgctctgtcccacctgcctctgggtgcccggcagctccactagatttttggattcattcctttgaagggagtcgggttcacccttccatcgtattctcccaactacacattgtaaagcctgagaaacttctagaacctcaggaagctgcagctggagggctggggcacctgcccccctgctccccacacatcatatcctccccatactcctgcagggcccacggctcctgagcaacagctgggacacccgggccttggcggctgcaccccctgctaggctctgcccaccggccaccaacactcctgtaattccaataaagcagtttattttctgagaaaac

SEQ ID NO: 371494 - DNA, 2100 bp, Homo sapiens
aagggcgtgcagatggacagggcggtcatgctgtaccacaaggctggccacttctccaaggccctggagctggcctttgccacccagcagtttgtggccctacagctcatagcagaggacctggatgagacgtcagaccctgcgctcctggcccgctgctccgacttcttcatcgagcacagtcagtacgagagggcggtagagctgctgctggctgtccacgggggtcgcacacagcctgcgcaccgacatgcacatcagtggagtgtttgccaccaaggatgctgtcgcagtctggaacggaaggcaggtggcgatcttcgagctttctggagccgcgatacggagtgcagggaccttcttgtgtgagacgcctgtgttagcaatgcatgaagaaaacgtttacacggtggagtcaaaccgagttcaagttcgaacctggcaggggactgtcaaacaactcctccttttctcggagactgaggggaatccctgcttcttggacatctgtgggaatttcctggttgtagggacagacttggctcactttaaaagctttgatctttcccgaagagaggccaaagcacactgtagctgcaggagcctggcggagctggtccctggggtggggggcatcgcttctctgcggtgcagcagcagcgggagcaccatcagcatcctccccagcaaggctgacaacagccctgattccaaaatctgcttctacgatgttgaaatggacacagtgaccgtctttgacttcaagactggacaggcttggtgtcttgctcttgtggaggttggaccaaaggggccgagtgcaagggacgcctctgctgaaacacgagtatgggaaacacctcacgcactgcatcttccggctcccccctcctggcgaggacctggttcagttggcaaaggcagctgtgagcggtgatgagaaagccctggacatgtttaactggaagaagagcagttctggaagtttgctgaagatggggtctcacgaggggctgttgttctttgtcagtctgatggacgggacagtgcactatgtggatgagaagggcaagaccactcaggtggtgtccgcagacagcacgattcagatgctgttctacatggagaagagggaggcactggtggtggtcacagagaacctccggctgtccctgtacacggtgcctcctgagggcaaagcagaagaagtgatgaaggtcaagctgagcgggaaaaccggccgccgggcagacatcgctttgattgaaggcagccttctcgtgatggccgtcggggaggctgccctcagattctgggacatagaacgaggagagaattatatactgagtccagatgagaagtttggctttgagaaaggagagaatatgaactgtgtgtgttactgtaaagtcaaaggtcttctggccgctggtaccgacagagggcgagtagccatgtggaggaaagtaccagactcccactgccacgcaccgtccccgagcaggtccgccacaacagcatggaggacgccagggagctggacgaggaggtggtggaagaggcagatgacgacccctgaggggcctgggccccaggaccagcgtgctgctgcagaaaggcatcttctggaattttttcgtcagctgtggcaaagccagcatttttgctgggaaaaaacatgtctgtgttggaatacgcgacagagctgggcgagaacgcagcggcccgggccggcggagggtgtgacccgtctgcaccttgctctgtcccacctgcctctgggtgcccggcagctccactagatttttggattcattcctttgaagggagtcgggttcacccttccatcgtattctcccaactacacattgtaaagcctgagaaacttctagaacctcaggaagctgcagctggagggctggggcacctgcccccctgctccccacacatcatatcctccccatactcctgcagggcccacggctcctgagcaacagctgggacacccgggccttggcggctgcaccccctgctaggctctgcccaccggccaccaacactcctgtaattccaataaagcagtttattttctgagaaaac

SEQ ID NO: 371495 - DNA, 486 bp, Homo sapiens
atgggcttaacagattctttcccaaaagctggtttgatggaggcacttgtagaggctctggagacgctggacgcctgaaagtttcagcgctgaggaggcctgagttccgtcatggccctctattatgaccaccagatagaagccccggatgcagcagggtcaccctcatttatcagctggcaccctgtccatccattcttggcagttgcttacatcagcacaacctcaacaggcagcgtggatatttacctggagcaaggggagtgcgtgccagatacacacgtcgagaggccgttccgggttgcttccctgtgctggcacccgacgcggctggtgctggctgtgggctgggagactggagaagtgacggtgtttaacaagcaggacaaggagcagcacacgatgcccctgacacacacagccgacatcaccgtgctccgttggagccccacactcagcacccttgtggctcccatcgccttaggg

SEQ ID NO: 371496 - DNA, 3831 bp, Homo sapiens
aagggcgtgcagatggacagggcggtcatgctgtaccacaaggctggccacttctccaaggccctggagctggcctttgccacccagcagtttgtggccctacagctcatagcagaggacctggatgagacgtcagaccctgcgctcctggcccgctgctccgacttcttcatcgagcacagtcagtacgagagggcggtagagctgctgctggctgtccacgggggtcgcacacagcctgcgcaccgacatgcacatcagtggagtgtttgccaccaaggatgctgtcgcagtctggaacggaaggcaggtggcgatcttcgagctttctggagccgcgatacggagtgcagggaccttcttgtgtgagacgcctgtgttagcaatgcatgaagaaaacgtttacacggtggagtcaaaccgagttcaagttcgaacctggcaggggactgtcaaacaactcctccttttctcggagactgaggggaatccctgcttcttggacatctgtgggaatttcctggttgtagggacagacttggctcactttaaaagctttgatctttcccgaagagaggccaaagcacactgtagctgcaggagcctggcggagctggtccctggggtggggggcatcgcttctctgcggtgcagcagcagcgggagcaccatcagcatcctccccagcaaggctgacaacagccctgattccaaaatctgcttctacgatgttgaaatggacacagtgaccgtctttgacttcaagactggacaaattgatcggagagagacgctgtcctttaatgagcaagagactaataagagccacctctttgtggatgagggactgaaaaattatgttcccgtgaaccacttctgggaccagagtgagccccggctgtttgtatgcgaagccgtgcaggagacgccgcgctcccagcctcagtctgcaaacgggcagccccaagatgggcgcgctggccctgcggcagatgttttgatcctgtccttcttcatttccgaagagcacggcttcctgcttcatgagagcttcccccggcctgccacctcccacagtctcctggggatggaagtgccttattactacttcacaagaaagcccgaagaagcagacagagaagacgaggtggagcctgggtgccaccacatccctcagatggtgtccaggagacccctgcgagactttgtggggctggaggactgcgacaaggccacccgggacgccatgctccacttcagcttctttgtcaccataggagacatggacgaagccttcaaatccatcaagctcatcaaaagtgaggccgtctgggagaacatggcgcgcatgtgcgtgaagacccagcggctggacgtggccaaggtgtgcctggggaacatgggccatgcccgcggggcccgagcgctgcgtgaggcggagcaggagccggagctagaggcccgcgtggccgtgctggccacgcagctgggcatgctggaggacgccgagcagctgtacaggaagtgcaagcgccacgacctcctgaacaagttctaccaggctgcgggccggtggcaggaggccctccaggtagccgagcaccacgatcgcgtgcacctgcgcagcacctaccaccgctatgccgggcacctggaggccagcgccgactgcagccgggccctcagttactacgagaagtcggacacgcaccgcttcgaggtgcccaggatgctgtcggaggacctgccgtccctggagctctacgtgaataaaatgaaggataagaccctgtggcggtggtgggcgcagtacctggagagccagggcgagatggacgccgcgctgcactactacgagctggcccgggaccacttctccctggtccgcatccactgcttccagggcaatgtccagaaggctgcgcaaatagccaacgagacaggaaacctggcggcctcctaccacctcgcccgccagtacgagagccaggaggaggtcgggcaggcggtgcacttctacacccgggcacaggccttcaagaatgccatccgcctgtgcaaggagaacggcctggacgaccagctcatgaacttggccctgctgagctcccccgaggacatgatcgaggcggcccgatactacgaggagaagggcgtgcagatggacagggcggtcatgctgtaccacaaggctggccacttctccaaggccctggagctggcctttgccacccagcagtttgtggccctacagctcatagcagaggacctggatgagacgtcagaccctgcgctcctggcccgctgctccgacttcttcatcgagcacagtcagtacgagagggcggtagagctgctgctggctgccaggaagtatcaggaagccctgcagctgtgcctggggcagaacatgagcatcaccgaggagatggcggaaaagatgaccgtggccaaggactcctcggacctgcctgaggagtcgcggcgggagctgctggagcagatagcagactgctgcatgcgccagggcagctaccacctggccaccaagaagtacacgcaggccggcaacaagctgaaggccatgagggcgctgctcaaatccggagacacggagaaaatcacgttcttcgcgagcgtgtccaggcagaaggaaatctacatcatggctgctaactacctgcagtccctggactggcggaaggagccggagatcatgaagaacatcatcggcttctacaccaaggggcgggccctggacctcctggctggcttttatgacgcttgtgcccaggtggagattgatgaataccagaactacgacaaagcccacggggcgctgaccgaggcctacaagtgcctggccaaggccaaggccaagagccccctggaccaggagaccaggctggcgcagctgcagagcaggatggcactggtgaagaggttcatccaggcccgcaggacgtacacagaggaccccaaggagtccatcaagcagtgtgagctgctcctggaggaaccagacctggacagcaccatccgcatcggggacgtctatggcttcctggtggagcactacgtgcggaaggaggaataccagacggcctacagattcctggaggagatgcggcggcggcttcccttggccaacatgtcctactacgtgagcccgcaggccgtggacgccgtgcaccgggggctgggtctcccactgccacgcaccgtccccgagcaggtccgccacaacagcatggaggacgccagggagctggacgaggaggtggtggaagaggcagatgacgacccctgaggggcctgggccccaggaccagcgtgctgctgcagaaaggcatcttctggaattttttcgtcagctgtggcaaagccagcatttttgctgggaaaaaacatgtctgtgttggaatacgcgacagagctgggcgagaacgcagcggcccgggccggcggagggtgtgacccgtctgcaccttgctctgtcccacctgcctctgggtgcccggcagctccactagatttttggattcattcctttgaagggagtcgggttcacccttccatcgtattctcccaactacacattgtaaagcctgagaaacttctagaacctcaggaagctgcagctggagggctggggcacctgcccccctgctccccacacatcatatcctccccatactcctgcagggcccacggctcctgagcaacagctgggacacccgggccttggcggctgcaccccctgctaggctctgcccaccggccaccaacactcctgtaattccaataaagcagtttattttctgagaaaac

SEQ ID NO: 371497 - DNA, 4355 bp, Homo sapiens
cgcgcggcggctcagcggcctggcagaggtttcagcgctgaggaggcctgagttccgtcatggccctctattatgaccaccagatagaagccccggatgcagcagggtcaccctcatttatcagctggcaccctgtccatccattcttggcagttgcttacatcagcacaacctcaacaggcagcgtggatatttacctggagcaaggggagtgcgtgccagatacacacgtcgagaggccgttccgggttgcttccctgtgctggcacccgacgcggctggtgctggctgtgggctgggagactggagaagtgacggtgtttaacaagcaggacaaggagcagcacacgatgcccctgacacacacagccgacatcaccgtgctccgttggagccccagtggaaactgcctgctgtctggggacaggcttggtgtcttgctcttgtggaggttggaccaaaggggccgagtgcaagggacgcctctgctgaaacacgagtatgggaaacacctcacgcactgcatcttccggctcccccctcctggcgaggacctggttcagttggcaaaggcagctgtgagcggtgatgagaaagccctggacatgtttaactggaagaagagcagttctggaagtttgctgaagatggggtctcacgaggggctgttgttctttgtcagtctgatggacgggacagtgcactatgtggatgagaagggcaagaccactcaggtggtgtccgcagacagcacgattcagatgctgttctacatggagaagagggaggcactggtggtggtcacagagaacctccggctgtccctgtacacggtgcctcctgagggcaaagcagaagaagtgatgaaggtcaagctgagcgggaaaaccggccgccgggcagacatcgctttgattgaaggcagccttctcgtgatggccgtcggggaggctgccctcagattctgggacatagaacgaggagagaattatatactgagtccagatgagaagtttggctttgagaaaggagagaatatgaactgtgtgtgttactgtaaagtcaaaggtcttctggccgctggtaccgacagagggcgagtagccatgtggaggaaagtaccagacttcctgggcagccccggggcagagggcaaggacaggtgggcccttcagacccctaccgagctccaaggaaacatcacgcaaatccagtggggttccaggaagaacctgctggcagtgaacagcgtcatctccgtggccatcctcagcgagcgggccatgtcgtcacacttccaccagcaagtggccgccatgcaggtctccccgagtctgctgaatgtgtgcttcctgtccacgggggtcgcacacagcctgcgcaccgacatgcacatcagtggagtgtttgccaccaaggatgctgtcgcagtctggaacggaaggcaggtggcgatcttcgagctttctggagccgcgatacggagtgcagggaccttcttgtgtgagacgcctgtgttagcaatgcatgaagaaaacgtttacacggtggagtcaaaccgagttcaagttcgaacctggcaggggactgtcaaacaactcctccttttctcggagactgaggggaatccctgcttcttggacatctgtgggaatttcctggttgtagggacagacttggctcactttaaaagctttgatctttcccgaagagaggccaaagcacactgtagctgcaggagcctggcggagctggtccctggggtggggggcatcgcttctctgcggtgcagcagcagcgggagcaccatcagcatcctccccagcaaggctgacaacagccctgattccaaaatctgcttctacgatgttgaaatggacacagtgaccgtctttgacttcaagactggacaaattgatcggagagagacgctgtcctttaatgagcaagagactaataagagccacctctttgtggatgagggactgaaaaattatgttcccgtgaaccacttctgggaccagagtgagccccggctgtttgtatgcgaagccgtgcaggagacgccgcgctcccagcctcagtctgcaaacgggcagccccaagatgggcgcgctggccctgcggcagatgttttgatcctgtccttcttcatttccgaagagcacggcttcctgcttcatgagagcttcccccggcctgccacctcccacagtctcctggggatggaagtgccttattactacttcacaagaaagcccgaagaagcagacagagaagacgaggtggagcctgggtgccaccacatccctcagatggtgtccaggagacccctgcgagactttgtggggctggaggactgcgacaaggccacccgggacgccatgctccacttcagcttctttgtcaccataggagacatggacgaagccttcaaatccatcaagctcatcaaaagtgaggccgtctgggagaacatggcgcgcatgtgcgtgaagacccagcggctggacgtggccaaggtgtgcctggggaacatgggccatgcccgcggggcccgagcgctgcgtgaggcggagcaggagccggagctagaggcccgcgtggccgtgctggccacgcagctgggcatgctggaggacgccgagcagctgtacaggaagtgcaagcgccacgacctcctgaacaagttctaccaggctgcgggccggtggcaggaggccctccaggtagccgagcaccacgatcgcgtgcacctgcgcagcacctaccaccgctatgccgggcacctggaggccagcgccgactgcagccgggccctcagttactacgagaagtcggacacgcaccgcttcgaggtgcccaggatgctgtcggaggacctgccgtccctggagctctacgtgaataaaatgaaggataagaccctgtggcggtggtgggcgcagtacctggagagccagggcgagatggacgccgcgctgcactactacgagctggcccgggaccacttctccctggtccgcatccactgcttccagggcaatgtccagaaggctgcgcaaatagccaacgagacaggaaacctggcggcctcctaccacctcgcccgccagtacgagagccaggaggaggtcgggcaggcggtgcacttctacacccgggcacaggccttcaagaatgccatccgcctgtgcaaggagaacggcctggacgaccagctcatgaacttggccctgctgagctcccccgaggacatgatcgaggcggcccgatactacgaggagaagggcgtgcagatggacagggcggtcatgctgtaccacaaggctggccacttctccaaggccctggagctggcctttgccacccagcagtttgtggccctacagctcatagcagaggacctggatgagacgtcagaccctgcgctcctggcccgctgctccgacttcttcatcgagcacagtcagtacgagagggcggtagagctgctgctggctgccaggaagtatcaggaagccctgcagctgtgcctggggcagaacatgagcatcaccgaggagatggcggaaaagatgaccgtggccaaggactcctcggacctgcctgaggagtcgcggcgggagctgctggagcagatagcagactgctgcatgcgccagggcagctaccacctggccaccaagaagtacacgcaggccggcaacaagctgaaggccatgagggcgctgctcaaatccggagacacggagaaaatcacgttcttcgcgagcgtgtccaggcagaaggaaatctacatcatggctgctaactacctgcagtccctggactggcggaaggagccggagatcatgaagaacatcatcggcttctacaccaaggggcgggccctggacctcctggctggcttttatgacgcttgtgcccaggtggagattgatgaataccagaactacgacaaagcccacggggcgctgaccgaggcctacaagtgcctggccaaggccaaggccaagagccccctggaccaggagaccaggctggcgcagctgcagagcaggatggcactggtgaagaggttcatccaggcccgcaggacgtacacagaggaccccaaggagtccatcaagcagtgtgagctgctcctggaggaaccagacctggacagcaccatccgcatcggggacgtctatggcttcctggtggagcactacgtgcggaaggaggaataccagacggtgaggcctgagtgctgctcactagcagcatcccgccacacaaggctcctgaaacgaaggcttaacggctcaaactgaggctgtgtgtggcggctcactcctgtaatcccagca

SEQ ID NO: 371498 - DNA, 3361 bp, Homo sapiens
  misc_feature (3287)..(3287): n is a, c, g, or t
cgcgcggcggctcagcggcctggcagaggtttcagcgctgaggaggcctgagttccgtcatggccctctattatgaccaccagatagaagccccggatgcagcagggtcaccctcatttatcagctggcaccctgtccatccattcttggcagttgcttacatcagcacaacctcaacaggcagcgtggatatttacctggagcaaggggagtgcgtgccagatacacacgtcgagaggccgttccgggttgcttccctgtgctggcacccgacgcggctggtgctggctgtgggctgggagactggagaagtgacggtgtttaacaagcaggacaaggagcagcacacgatgcccctgacacacacagccgacatcaccgtgctccgttggagccccagtggaaactgcctgctgtctggggacaggcttggtgtcttgctcttgtggaggttggaccaaaggggccgagtgcaagggacgcctctgctgaaacacgagtatgggaaacacctcacgcactgcatcttccggctcccccctcctggcgaggacctggttcagttggcaaaggcagctgtgagcggtgatgagaaagccctggacatgtttaactggaagaagagcagttctggaagtttgctgaagatggggtctcacgaggggctgttgttctttgtcagtctgatggacgggacagtgcactatgtggatgagaagggcaagaccactcaggtggtgtccgcagacagcacgattcagatgctgttctacatggagaagagggaggcactggtggtggtcacagagaacctccggctgtccctgtacacggtgcctcctgagggcaaagcagaagaagtgatgaaggtcaagctgagcgggaaaaccggccgccgggcagacatcgctttgattgaaggcagccttctcgtgatggccgtcggggaggctgccctcagattctgggacatagaacgaggagagaattatatactgagtccagatgagaagtttggctttgagaaaggagagaatatgaactgtgtgtgttactgtaaagtcaaaggtcttctggccgctggtaccgacagagggcgagtagccatgtggaggaaagtaccagacttcctgggcagccccggggcagagggcaaggacaggtgggcccttcagacccctaccgagctccaaggaaacatcacgcaaatccagtggggttccaggaagaacctgctggcagtgaacagcgtcatctccgtggccatcctcagcgagcgggccatgtcgtcacacttccaccagcaagtggccgccatgcaggtctccccgagtctgctgaatgtgtgcttcctgtccacgggggtcgcacacagcctgcgcaccgacatgcacatcagtggagtgtttgccaccaaggatgctgtcgcagtctggaacggaaggcaggtggcgatcttcgagctttctggagccgcgatacggagtgcagggaccttcttgtgtgagacgcctgtgttagcaatgcatgaagaaaacgtttacacggtggagtcaaaccgagttcaagttcgaacctggcaggggactgtcaaacaactcctccttttctcggagactgaggggaatccctgcttcttggacatctgtgggaatttcctggttgtagggacagacttggctcactttaaaagctttgatctttcccgaagagaggccaaagcacactgtagctgcaggagcctggcggagctggtccctggggtggggggcatcgcttctctgcggtgcagcagcagcgggagcaccatcagcatcctccccagcaaggctgacaacagccctgattccaaaatctgcttctacgatgttgaaatggacacagtgaccgtctttgacttcaagactggacaaattgatcggagagagacgctgtcctttaatgagcaagagactaataagagccacctctttgtggatgagggactgaaaaattatgttcccgtgaaccacttctgggaccagagtgagccccggctgtttgtatgcgaagccgtgcaggagacgccgcgctcccagcctcagtctgcaaacgggcagccccaagatgggcgcgctggccctgcggcagatgttttgatcctgtccttcttcatttccgaagagcacggcttcctgcttcatgagagcttcccccggcctgccacctcccacagtctcctggggatggaagtgccttattactacttcacaagaaagcccgaagaagcagacagagaagacgaggtggagcctgggtgccaccacatccctcagatggtgtccaggagacccctgcgagactttgtggggctggaggactgcgacaaggccacccgggacgccatgctccacttcagcttctttgtcaccataggagacatggacgaagccttcaaatccatcaagctcatcaaaagtgaggccgtctgggagaacatggcgcgcatgtgcgtgaagacccagcggctggacgtggccaaggtgtgcctggggaacatgggccatgcccgcggggcccgagcgctgcgtgaggcggagcaggagccggagctagaggcccgcgtggccgtgctggccacgcagctgggcatgctggaggacgccgagcagctgtacaggaagtgcaagcgccacgacctcctgaacaagttctaccaggctgcgggccggtggcaggaggccctccaggtagccgagcaccacgatcgcgtgcacctgcgcagcacctaccaccgctatgccgggcacctggaggccagcgccgactgcagccgggccctcagttactacgagaagtcggacacgcaccgcttcgaggtgcccaggatgctgtcggaggacctgccgtccctggagctctacgtgaataaaatgaaggataagaccccgtgggcggtgttggggccagacctggggagcctgggcgcttcgttccgcgtccgccaagcggccgcggcctccccgggcgcacccacgtggtccagggcacggtccaaagcgggtcgaaattcccgggacatgaaacagtgtgggggccacaacgtgtccaggcagatgaatactcgtgcttaggtggctgagggggggactactacagggacaaggactaaaaaagaatccaaggtgctgaaaactgtcgtgaagagacaatagtacgttaggtacccaggaagaagtgccggcgcaccagagaaggcgaagcgcaggagagtaagtcaagacagacacgagttacagcaggcagtnacaatccgaagttgcagcctgaagaaaataggctacggacgtgctagttcttatctcactatcatcagtacagt

SEQ ID NO: 371499 - DNA, 2839 bp, Homo sapiens
cgcgcggcggctcagcggcctggcagaggtttcagcgctgaggaggcctgagttccgtcatggccctctattatgaccaccagatagaagccccggatgcagcagggtcaccctcatttatcagctggcaccctgtccatccattcttggcagttgcttacatcagcacaacctcaacaggcagcgtggatatttacctggagcaaggggagtgcgtgccagatacacacgtcgagaggccgttccgggttgcttccctgtgctggcacccgacgcggctggtgctggctgtgggctgggagactggagaagtgacggtgtttaacaagcaggacaaggagcagcacacgatgcccctgacacacacagccgacatcaccgtgctccgttggagccccagtggaaactgcctgctgtctggggacaggcttggtgtcttgctcttgtggaggttggaccaaaggggccgagtgcaagggacgcctctgctgaaacacgagtatgggaaacacctcacgcactgcatcttccggctcccccctcctggcgaggacctggttcagttggcaaaggcagctgtgagcggtgatgagaaagccctggacatgtttaactggaagaagagcagttctggaagtttgctgaagatggggtctcacgaggggctgttgttctttgtcagtctgatggacgggacagtgcactatgtggatgagaagggcaagaccactcaggtggtgtccgcagacagcacgattcagatgctgttctacatggagaagagggaggcactggtggtggtcacagagaacctccggctgtccctgtacacggtgcctcctgagggcaaagcagaagaagtgatgaaggtcaagctgagcgggaaaaccggccgccgggcagacatcgctttgattgaaggcagccttctcgtgatggccgtcggggaggctgccctcagattctgggacatagaacgaggagagaattatatactgagtccagatgagaagtttggctttgagaaaggagagaatatgaactgtgtgtgttactgtaaagtcaaaggtcttctggccgctggtaccgacagagggcgagtagccatgtggaggaaagtaccagacttcctgggcagccccggggcagagggcaaggacaggtgggcccttcagacccctaccgagctccaaggaaacatcacgcaaatccagtggggttccaggaagaacctgctggcagtgaacagcgtcatctccgtggccatcctcagcgagcgggccatgtcgtcacacttccaccagcaagtggccgccatgcaggtctccccgagtctgctgaatgtgtgcttcctgtccacgggggtcgcacacagcctgcgcaccgacatgcacatcagtggagtgtttgccaccaaggatgctgtcgcagtctggaacggaaggcaggtggcgatcttcgagctttctggagccgcgatacggagtgcagggaccttcttgtgtgagacgcctgtgttagcaatgcatgaagaaaacgtttacacggtggagtcaaaccgagttcaagttcgaacctggcaggggactgtcaaacaactcctccttttctcggagactgaggggaatccctgcttcttggacatctgtgggaatttcctggttgtagggacagacttggctcactttaaaagctttgatctttcccgaagagaggccaaagcacactgtagctgcaggagcctggcggagctggtccctggggtggggggcatcgcttctctgcggtgcagcagcagcgggagcaccatcagcatcctccccagcaaggctgacaacagccctgattccaaaatctgcttctacgatgttgaaatggacacagtgaccgtctttgacttcaagactggacaaattgatcggagagagacgctgtcctttaatgagcaagagactaataagagccacctctttgtggatgagggactgaaaaattatgttcccgtgaaccacttctgggaccagagtgagccccggctgtttgtatgcgaagccgtgcaggagacgccgcgctcccagcctcagtctgcaaacgggcagccccaagatgggcgcgctggccctgcggcagatgttttgatcctgtccttcttcatttccgaagagcacggcttcctgcttcatgagagcttcccccggcctgccacctcccacagtctcctggggatggaagtgccttattactacttcacaagaaagcccgaagaagcagacagagaagacgaggtggagcctgggtgccaccacatccctcagatggtgtccaggagacccctgcgagactttgtggggctggaggactgcgacaaggccacccgggacgccatgctccacttcagcttctttgtcaccataggagacatggacgaagccttcaaatccatcaagctcatcaaaaggtgaggatcccgaccactgggatgttgggagatagcgcgtgctcacggctctttcctttctccctgtttgccttcttggttcgcctgttgaaatatttgactcctcatgactgcgtcatggtgtatttcatggtcttcccactcgatgaaatgctgcccagcttgcagatgccacgtgggaagctctcagcctctctggtgctgggagcctctcgggctgtttagctgcttcctagtggaaagttctgccgttcctaaacatctataatacccatccctctgggaataattgctcctaaacagaagtttggacaagtaaacactaaaaacagccaggtggaaacacaattaaaaatgctctgaaagagggtatcaatcaag

SEQ ID NO: 371500 - DNA, 314 bp, Homo sapiens
ggacagtgcactatgtggatgagaagggcaagaccactcaggtggtgtccgcagacagcacgattcagatgctgttctacatggagaagagggaggcactggtggtggtcacagagaacctccggctgtccctgtacacggtgcctcctgagggcaaagcagaagaagtgatgaaggtgagtgggagtgggcttgggggctcacgctggggatcttgggccaggttctctctggcctcgttgacggccctttctcttctggatagcaagactgaaaaaaagcctatcaactgagttagggcggctaacgtagct

SEQ ID NO: 371501 - DNA, 715 bp, Homo sapiens
cctgttggtaaatatctgtctgtctgcagagggatttctcccccataagggagctaaatccagaggacgaggtctgggtgagggcttcagctttacatatgaattaacaaacacatgggtcctttgtcatttagcccgaagaagcagacagagaagacgaggtggagcctgggtgccaccacatccctcagatggtgtccaggagacccctgcgagactttgtggggctggaggactgcgacaaggccacccgggacgccatgctccacttcagcttctttgtcaccataggagacatggacgaagccttcaaatccatcaagctcatcaaaaggtgaggatcccgaccactgggatgttgggagatagcgcgtgctcacggctctttcctttctccctgtttgccttcttggttcgcctgttgaaatatttgactcctcatgactgcgtcatggtgtatttcatggtcttcccactcgatgaaatgctgcccagcttgcagatgccacgtgggaagctctcagcctctctggtgctgggagcctctcgggctgtttagctgcttcctagtggaaagttctgccgttcctaaacatctataatacccatccctctgggaataattgctcctaaacagaagtttggacaagtaaacactaaaaacagccaggtggaaacacaattaaaaatgctctgaaagagggtatcaatcaag

SEQ ID NO: 371502 - DNA, 4246 bp, Homo sapiens
cgcgcggcggctcagcggcctggcagaggtttcagcgctgaggaggcctgagttccgtcatggccctctattatgaccaccagatagaagccccggatgcagcagggtcaccctcatttatcagctggcaccctgtccatccattcttggcagttgcttacatcagcacaacctcaacaggcagcgtggatatttacctggagcaaggggagtgcgtgccagatacacacgtcgagaggccgttccgggttgcttccctgtgctggcacccgacgcggctggtgctggctgtgggctgggagactggagaagtgacggtgtttaacaagcaggacaaggagcagcacacgatgcccctgacacacacagccgacatcaccgtgctccgttggagccccagtggaaactgcctgctgtctggggacaggcttggtgtcttgctcttgtggaggttggaccaaaggggccgagtgcaagggacgcctctgctgaaacacgagtatgggaaacacctcacgcactgcatcttccggctcccccctcctggcgaggacctggttcagttggcaaaggcagctgtgagcggtgatgagaaagccctggacatgtttaactggaagaagagcagttctggaagtttgctgaagatggggtctcacgaggggctgttgttctttgtcagtctgatggacgggacagtgcactatgtggatgagaagggcaagaccactcaggtggtgtccgcagacagcacgattcagatgctgttctacatggagaagagggaggcactggtggtggtcacagagaacctccggctgtccctgtacacggtgcctcctgagggcaaagcagaagaagtgatgaaggtcaagctgagcgggaaaaccggccgccgggcagacatcgctttgattgaaggcagccttctcgtgatggccgtcggggaggctgccctcagattctgggacatagaacgaggagagaattatatactgagtccagatgagaagtttggctttgagaaaggagagaatatgaactgtgtgtgttactgtaaagtcaaaggtcttctggccgctggtaccgacagagggcgagtagccatgtggaggaaagtaccagacttcctgggcagccccggggcagagggcaaggacaggtgggcccttcagacccctaccgagctccaaggaaacatcacgcaaatccagtggggttccaggaagaacctgctggcagtgaacagcgtcatctccgtggccatcctcagcgagcgggccatgtcgtcacacttccaccagcaagtggccgccatgcaggtctccccgagtctgctgaatgtgtgcttcctgtccacgggggtcgcacacagcctgcgcaccgacatgcacatcagtggagtgtttgccaccaaggatgctgtcgcagtctggaacggaaggcaggtggcgatcttcgagctttctggagccgcgatacggagtgcagggaccttcttgtgtgagacgcctgtgttagcaatgcatgaagaaaacgtttacacggtggagtcaaaccgagttcaagttcgaacctggcaggggactgtcaaacaactcctccttttctcggagactgaggggaatccctgcttcttggacatctgtgggaatttcctggttgtagggacagacttggctcactttaaaagctttgatctttcccgaagagaggccaaagcacactgtagctgcaggagcctggcggagctggtccctggggtggggggcatcgcttctctgcggtgcagcagcagcgggagcaccatcagcatcctccccagcaaggctgacaacagccctgattccaaaatctgcttctacgatgttgaaatggacacagtgaccgtctttgacttcaagactggacaaattgatcggagagagacgctgtcctttaatgagcaagagactaataagagccacctctttgtggatgagggactgaaaaattatgttcccgtgaaccacttctgggaccagagtgagccccggctgtttgtatgcgaagccgtgcaggagacgccgcgctcccagcctcagtctgcaaacgggcagccccaagatgggcgcgctggccctgcggcagatgttttgatcctgtccttcttcatttccgaagagcacggcttcctgcttcatgagagcttcccccggcctgccacctcccacagtctcctggggatggaagtgccttattactacttcacaagaaagcccgaagaagcagacagagaagacgaggtggagcctgggtgccaccacatccctcagatggtgtccaggagacccctgcgagactttgtggggctggaggactgcgacaaggccacccgggacgccatgctccacttcagcttctttgtcaccataggagacatggacgaagccttcaaatccatcaagctcatcaaaagtgaggccgtctgggagaacatggcgcgcatgtgcgtgaagacccagcggctggacgtggccaaggtgtgcctggggaacatgggccatgcccgcggggcccgagcgctgcgtgaggcggagcaggagccggagctagaggcccgcgtggccgtgctggccacgcagctgggcatgctggaggacgccgagcagctgtacaggaagtgcaagcgccacgacctcctgaacaagttctaccaggctgcgggccggtggcaggaggccctccaggtagccgagcaccacgatcgcgtgcacctgcgcagcacctaccaccgctatgccgggcactatcaggaagccctgcagctgtgcctggggcagaacatgagcatcaccgaggagatggcggaaaagatgaccgtggccaaggactcctcggacctgcctgaggagtcgcggcgggagctgctggagcagatagcagactgctgcatgcgccagggcagctaccacctggccaccaagaagtacacgcaggccggcaacaagctgaaggccatgagggcgctgctcaaatccggagacacggagaaaatcacgttcttcgcgagcgtgtccaggcagaaggaaatctacatcatggctgctaactacctgcagtccctggactggcggaaggagccggagatcatgaagaacatcatcggcttctacaccaaggggcgggccctggacctcctggctggcttttatgacgcttgtgcccaggtggagattgatgaataccagaactacgacaaagcccacggggcgctgaccgaggcctacaagtgcctggccaaggccaaggccaagagccccctggaccaggagaccaggctggcgcagctgcagagcaggatggcactggtgaagaggttcatccaggcccgcaggacgtacacagaggaccccaaggagtccatcaagcagtgtgagctgctcctggaggaaccagacctggacagcaccatccgcatcggggacgtctatggcttcctggtggagcactacgtgcggaaggaggaataccagacggcctacagattcctggaggagatgcggcggcggcttcccttggccaacatgtcctactacgtgagcccgcaggccgtggacgccgtgcaccgggggctgggtctcccactgccacgcaccgtccccgagcaggtccgccacaacagcatggaggacgccagggagctggacgaggaggtggtggaagaggcagatgacgacccctgaggggcctgggccccaggaccagcgtgctgctgcagaaaggcatcttctggaattttttcgtcagctgtggcaaagccagcatttttgctgggaaaaaacatgtctgtgttggaatacgcgacagagctgggcgagaacgcagcggcccgggccggcggagggtgtgacccgtctgcaccttgctctgtcccacctgcctctgggtgcccggcagctccactagatttttggattcattcctttgaagggagtcgggttcacccttccatcgtattctcccaactacacattgtaaagcctgagaaacttctagaacctcaggaagctgcagctggagggctggggcacctgcccccctgctccccacacatcatatcctccccatactcctgcagggcccacggctcctgagcaacagctgggacacccgggccttggcggctgcaccccctgctaggctctgcccaccggccaccaacactcctgtaattccaataaagcagtttattttctgagaaaac

SEQ ID NO: 371503 - DNA, 2621 bp, Homo sapiens
ccggcccctgcctcttggggttaggaaggccgtgggactcgtgacgggcacctctctgcatggcctgcagtcttgcccaggggcggagccgatgggtgaaggcccctcctcatgcccgtttggcagctgtgcctgatgactacttgccccaggagaaggggccgtagggccagggggccctgaggtgctgggcaggagcctcacagacccccgtctgcccacagtgaggccgtctgggagaacatggcgcgcatgtgcgtgaagacccagcggctggacgtggccaaggaggacgccgagcagctgtacaggaagtgcaagcgccacgacctcctgaacaagttctaccaggctgcgggccggtggcaggaggccctccaggtagccgagcaccacgatcgcgtgcacctgcgcagcacctaccaccgctatgccgggcacctggaggccagcgccgactgcagccgggccctcagttactacgagaagtcggacacgcaccgcttcgaggtgcccaggatgctgtcggaggacctgccgtccctggagctctacgtgaataaaatgaaggataagaccctgtggcggtggtgggcgcagtacctggagagccagggcgagatggacgccgcgctgcactactacgagctggcccgggaccacttctccctggtccgcatccactgcttccagggcaatgtccagaaggctgcgcaaatagccaacgagacaggaaacctggcggcctcctaccacctcgcccgccagtacgagagccaggaggaggtcgggcaggcggtgcacttctacacccgggcacaggccttcaagaatgccatccgcctgtgcaaggagaacggcctggacgaccagctcatgaacttggccctgctgagctcccccgaggacatgatcgaggcggcccgatactacgaggagaagggcgtgcagatggacagggcggtcatgctgtaccacaaggctggccacttctccaaggccctggagctggcctttgccacccagcagtttgtggccctacagctcatagcagaggacctggatgagacgtcagaccctgcgctcctggcccgctgctccgacttcttcatcgagcacagtcagtacgagagggcggtagagctgctgctggctgccaggaagtatcaggaagccctgcagctgtgcctggggcagaacatgagcatcaccgaggagatggcggaaaagatgaccgtggccaaggactcctcggacctgcctgaggagtcgcggcgggagctgctggagcagatagcagactgctgcatgcgccagggcagctaccacctggccaccaagaagtacacgcaggccggcaacaagctgaaggccatgagggcgctgctcaaatccggagacacggagaaaatcacgttcttcgcgagcgtgtccaggcagaaggaaatctacatcatggctgctaactacctgcagtccctggactggcggaaggagccggagatcatgaagaacatcatcggcttctacaccaaggggcgggccctggacctcctggctggcttttatgacgcttgtgcccaggtggagattgatgaataccagaactacgacaaagcccacggggcgctgaccgaggcctacaagtgcctggccaaggccaaggccaagagccccctggaccaggagaccaggctggcgcagctgcagagcaggatggcactggtgaagaggttcatccaggcccgcaggacgtacacagaggaccccaaggagtccatcaagcagtgtgagctgctcctggaggaaccagacctggacagcaccatccgcatcggggacgtctatggcttcctggtggagcactacgtgcggaaggaggaataccagacggcctacagattcctggaggagatgcggcggcggcttcccttggccaacatgtcctactacgtgagcccgcaggccgtggacgccgtgcaccgggggctgggtctcccactgccacgcaccgtccccgagcaggtccgccacaacagcatggaggacgccagggagctggacgaggaggtggtggaagaggcagatgacgacccctgaggggcctgggccccaggaccagcgtgctgctgcagaaaggcatcttctggaattttttcgtcagctgtggcaaagccagcatttttgctgggaaaaaacatgtctgtgttggaatacgcgacagagctgggcgagaacgcagcggcccgggccggcggagggtgtgacccgtctgcaccttgctctgtcccacctgcctctgggtgcccggcagctccactagatttttggattcattcctttgaagggagtcgggttcacccttccatcgtattctcccaactacacattgtaaagcctgagaaacttctagaacctcaggaagctgcagctggagggctggggcacctgcccccctgctccccacacatcatatcctccccatactcctgcagggcccacggctcctgagcaacagctgggacacccgggccttggcggctgcaccccctgctaggctctgcccaccggccaccaacactcctgtaattccaataaagcagtttattttctgagaaaac

SEQ ID NO: 371504 - DNA, 3347 bp, Homo sapiens
cgcgcggcggctcagcggcctggcagaggtttcagcgctgaggaggcctgagttccgtcatggccctctattatgaccaccagatagaagccccggatgcagcagggtcaccctcatttatcagctggcaccctgtccatccattcttggcagttgcttacatcagcacaacctcaacaggcagcgtggatatttacctggagcaaggggagtgcgtgccagatacacacgtcgagaggccgttccgggttgcttccctgtgctggcacccgacgcggctggtgctggctgtgggctgggagactggagaagtgacggtgtttaacaagcaggacaaggagcagcacacgatgcccctgacacacacagccgacatcaccgtgctccgttggagccccagtggaaactgcctgctgtctggggacaggcttggtgtcttgctcttgtggaggttggaccaaaggggccgagtgcaagggacgcctctgctgaaacacgagtatgggaaacacctcacgcactgcatcttccggctcccccctcctggcgaggacctggttcagttggcaaaggcagctgtgagcggtgatgagaaagccctggacatgtttaactggaagaagagcagttctggaagtttgctgaagatggggtctcacgaggggctgttgttctttgtcagtctgatggacgggacagtgcactatgtggatgagaagggcaagaccactcaggtggtgtccgcagacagcacgattcagatgctgttctacatggagaagagggaggcactggtggtggtcacagagaacctccggctgtccctgtacacggtgcctcctgagggcaaagcagaagaagtgatgaaggtcaagctgagcgggaaaaccggccgccgggcagacatcgctttgattgaaggcagccttctcgtgatggccgtcggggaggctgccctcagattctgggacatagaacgaggagagaattatatactgagtccagatgagaagtttggctttgagaaaggagagaatatgaactgtgtgtgttactgtaaagtcaaaggtcttctggccgctggtaccgacagagggcgagtagccatgtggaggaaagtaccagacttcctgggcagccccggggcagagggcaaggacaggtgggcccttcagacccctaccgagctccaaggaaacatcacgcaaatccagtggggttccaggaagaacctgctggcagtgaacagcgtcatctccgtggccatcctcagcgagcgggccatgtcgtcacacttccaccagcaagtggccgccatgcaggtctccccgagtctgctgaatgtgtgcttcctgtccacgggggtcgcacacagcctgcgcaccgacatgcacatcagtggagtgtttgccaccaaggatgctgtcgcagtctggaacggaaggcaggtggcgatcttcgagctttctggagccgcgatacggagtgcagggaccttcttgtgtgagacgcctgtgttagcaatgcatgaagaaaacgtttacacggtggagtcaaaccgagttcaagttcgaacctggcaggggactgtcaaacaactcctccttttctcggagactgaggggaatccctgcttcttggacatctgtgggaatttcctggttgtagggacagacttggctcactttaaaagctttgatctttcccgaagagaggccaaagcacactgtagctgcaggagcctggcggagctggtccctggggtggggggcatcgcttctctgcggtgcagcagcagcgggagcaccatcagcatcctccccagcaaggctgacaacagccctgattccaaaatctgcttctacgatgttgaaatggacacagtgaccgtctttgacttcaagactggacaaattgatcggagagagacgctgtcctttaatgagcaagagactaataagagccacctctttgtggatgagggactgaaaaattatgttcccgtgaaccacttctgggaccagagtgagccccggctgtttgtatgcgaagccgtgcaggagacgccgcgctcccagcctcagtctgcaaacgggcagccccaagatgggcgcgctggccctgcggcagatgttttgatcctgtccttcttcatttccgaagagcacggcttcctgcttcatgagagcttcccccggcctgccacctcccacagtctcctggggatggaagtgccttattactacttcacaagaaagcccgaagaagcagacagagaagacgaggtggagcctgggtgccaccacatccctcagatggtgtccaggagacccctgcgagactttgtggggctggaggactgcgacaaggccacccgggacgccatgctccacttcagcttctttgtcaccataggagacatggacgaagccttcaaatccatcaagctcatcaaaagtgaggccgtctgggagaacatggcgcgcatgtgcgtgaagacccagcggctggacgtggccaaggtgtgcctggggaacatgggccatgcccgcggggcccgagcgctgcgtgaggcggagcaggagccggagctagaggcccgcgtggccgtgctggccacgcagctgggcatgctggaggacgccgagcagctgtacaggaagtgcaagcgccacgacctcctgaacaagttctaccaggctgcgggccggtggcaggaggccctccaggtagccgagcaccacgatcgcgtgcacctgcgcagcacctaccaccgctatgccgggcacctggaggccagcgccgactgcagccgggccctcagttactacgagaagtcggacacgcaccgcttcgaggtgcccaggatgctgtcggaggacctgccgtccctggagctctacgtgaataaaatgaaggataagaccctgtggcggtggtgggcgcagtacctggagagccagggcgagatggacgccgcgctgcactactacgagctggcccgggaccacttctccctggtccgcatccactgcttccagggcaatgtccagaaggctgcgcaaatagccaacgagacaggaaacctggcggcctcctaccacctcgcccgccagtacgagagccaggaggaggtcgggcaggcggtgcacttctacacccgggcacaggccttcaagaatgccatccgcctgtgcaaggtaccacgggcccggggtggggagccggcgcttctcgaggtcccctgaggagagcttcaagtggaaaagtggacagagagaatcgtgtcagtgacacgtggtccggccagtgtctgccactcactgctcaccccgtctgcctcaccc

SEQ ID NO: 371505 - DNA, 2281 bp, Homo sapiens
cgcgcggcggctcagcggcctggcagaggtttcagcgctgaggaggcctgagttccgtcatggccctctattatgaccaccagatagaagccccggatgcagcagggtcaccctcatttatcagctggcaccctgtccatccattcttggcagttgcttacatcagcacaacctcaacaggcagcgtggatatttacctggagcaaggggagtgcgtgccagatacacacgtcgagaggccgttccgggttgcttccctgtgctggcacccgacgcggctggtgctggctgtgggctgggagactggagaagtgacggtgtttaacaagcaggacaaggagcagcacacgatgcccctgacacacacagccgacatcaccgtgctccgttggagccccagtggaaactgcctgctgtctggggacaggcttggtgtcttgctcttgtggaggttggaccaaaggggccgagtgcaagggacgcctctgctgaaacacgagtatgggaaacacctcacgcactgcatcttccggctcccccctcctggcgaggacctggttcagttggcaaaggcagctgtgagcggtgatgagaaagccctggacatgtttaactggaagaagagcagttctggaagtttgctgaagatggggtctcacgaggggctgttgttctttgtcagtctgatggacgggacagtgcactatgtggatgagaagggcaagaccactcaggtggtgtccgcagacagcacgattcagatgctgttctacatggagaagagggaggcactggtggtggtcacagagaacctccggctgtccctgtacacggtgcctcctgagggcaaagcagaagaagtgatgaaggtcaagctgagcgggaaaaccggccgccgggcagacatcgctttgattgaaggcagccttctcgtgatggccgtcggggaggctgccctcagattctgggacatagaacgaggagagaattatatactgagtccagatgagaagtttggctttgagaaaggagagaatatgaactgtgtgtgttactgtaaagtcaaaggtcttctggccgctggtaccgacagagggcgagtagccatgtggaggaaagtaccagacttcctgggcagccccggggcagagggcaaggacaggtgggcccttcagacccctaccgagctccaaggaaacatcacgcaaatccagtggggttccaggaagaacctgctggcagtgaacagcgtcatctccgtggccatcctcagcgagcgggccatgtcgtcacacttccaccagcaagtggccgccatgcaggtctccccgagtctgctgaatgtgtgcttcctgtccacgggggtcgcacacagcctgcgcaccgacatgcacatcagtggagtgtttgccaccaaggatgctgtcgcagtctggaacggaaggcaggtggcgatcttcgagctttctggagccgcgatacggagtgcagggaccttcttgtgtgagacgcctgtgttagcaatgcatgaagaaaacgtttacacggtggagtcaaaccgagttcaagttcgaacctggcaggggactgtcaaacaactcctccttttctcggagactgaggggaatccctgcttcttggacatctgtgggaatttcctggttgtagggacagacttggctcactttaaaagctttgatctttcccgaagagaggccaaagcacactgtagctgcaggagcctggcggagctggtccctggggtggggggcatcgcttctctgcggtgcagcagcagcgggagcaccatcagcatcctccccagcaaggctgacaacagccctgattccaaaatctgcttctacgatgttgaaatggacacagtgaccgtctttgacttcaagactggacaaattgatcggagagagacgctgtcctttaatgagcaagagactaataagagccacctctttgtggatgagggactgaaaaattatgttcccgtgaaccacttctgggaccagagtgagccccggctgtttgtatgcgaagccgtgcaggagacgccgcgctcccagcctcagtctgcaaacgggcagccccaagatgggcgcgctggccctgcggcagatgttttgatcctgtccttcttcatttccgaagagcacggcttcctgcttcatgagagcttcccccggcctgccacctcccacagtctcctggggatggaagtgccttattactacttcacaagaaaggtacgaagccacgacatccgcac

SEQ ID NO: 371506 - DNA, 1713 bp, Homo sapiens
atactacgcccttttacgtaagggacttgatcatcgcagattttgttatccacagggtcgtgaaaccaattcccccatgctgagggactcctggaataatactaacttcacagagttctgaggactaagccacagaacaaatgtagagtgcttgtcacagtgcctggcaggtcctaacccttaggaaatgttagctgtagtcacagaagctttcaaacagctcgtgtagactatagtcttatatatgttctagcttggggccaaaaaaggaagtttgggagctcagaaactggcaaacacatgctttaatgaaattgaaaaacaagctcaagctgcggataaaatgaaggagcaggaagacctggccaaggtggtatctaaagaagaatcaatgtaagtttaatttcattatattaatacattttcagggaataaaactattaactcaagattttgctttccaaatgccatgtatttttgtgtggggggggaagggagggtactgcaaaattcagttttatgaaaactgatattgcattggcatgtggattggaagggaaagagacgatgggggcagcaacactctgctgaggctgtaagggcagactggagtgacatcagtgagaagggaaagacagagatgcatggaggtgtttacacatgaaacatgcttcacattattagagttggggaaatgcaaatcaaggccacagtaagataccactgtgtactctctagggaagctataataaaaaaatcagtaacaggtgttggctaggatgtggagaaatttgaacccttgtacattgctgatggcaatgtgaaatggtgccactgttgtgaaaaacagtttggcagtccttcagaaagttaaatgtaaagtttccatgtgacccagcaaatctactcctaagtatatactcaagagaaattaaaacttacatctgtgcaaccacacacaaactcgtgcatgaatgttcatagtggcgttaatcctaatagccaaaaagtagaaataagctaaatgtctaccaactgataaatgagaaagaaaatgtggtatgtccatacaatggactattactcagccacaaaaaggaatgtagtcctgatattggccacaacatggataaaccttgaaaagtttatgctaagaaagaagccagtcataaaagatcacatgatatgattctgtctatatgcaatgtccagaataggcaaatccgtagagacagaaagcaacttactggttgccagggcctggggtgaggagagaatggagagtggctgctaatggtccaggcctgctttttggactgctgaaagtgttctggagttagtggtgatgatggcacagctttgtgaatgtgctgaaaccactgaatcatgcactttaacagggtgagttttacggtatgtgaattatatctgcataatgaaaaaagtatttataatctgaagccctgttggactctgtgactaaattctaaatacatgatggaagactatggctctggtcgtgtctccagaggttctgagcctggatcttggagagggagaaggaagagtttcagagaatgaagaaggtggaatgatcgtgtgtgtcgggggcctgcctgaagtggaggagttggaacgataatgtggagcaccttaaagtcaggctgtggttgtccacttacccaagagaaacagctccttcagcagtgctgt

SEQ ID NO: 371507 - DNA, 706 bp, Homo sapiens
tctctaaaaaaaaaaaaaaaaaaaaaaaaaaatagccagatgtggtggtgcgcacctgtgatcccaactactcaggaggctgaagtggaaggctcccttgatctgggaggtaatgccactgcactcagctaaggtgacagagcgagaccctgtctcaaaaaaaaaaaaaaagttgttgtaatatattttttaaatgctcctgaagaaagtactgagaggggcaagctcaggctctatttctcttcagtgtgctgttaaaaaaaaaaatacattttctctgagtttggagactgcgtggaaatactgaggacaccattttgacaaagttctgttaatccaaaatatgcttatcaacttgagtcttctggatgagaaactaaagtggaaaatgttatcatctcttaaataataaagtgcagtatcttagaattttaaaagacacactaaaaaagaaaaattatttctattggtcttactttttaatttttattttttggcagaggtatcctctatcataaaaaagaaaccaaatcaagctaaaaaaggcgtgagtattatgtactttatatataaaaatctggtagttaagctttaaaactaaaaagccgcttcgtcattttagttttattcttttgaaccatcttgtaataaatgtagctttgatataaggagtctatgttttgttcaaagagattaatgtcaaaga

SEQ ID NO: 371508 - DNA, 595 bp, Homo sapiens
tttaaagacggagttttccctcttgtttcccaggctgtagcgcaatggcgcgatctcggctcactgcaacatccacctcccgggttcaagcgattctcctgcctcagcctcccaactagctgggattataggcatgtgccaccacacctggctaattttgtatttttagtggagacggggtttcgccatgttggtcaggcttgtctcaaactcctgacctcaggtgatccacctgtcccaaagtgctgggattacaggcgtgagccaccacacctggccgacccttctgtcttaacaggaagaaatattcataatagactataaagtgggggaaaaatattactgaacatggaatataataatcatttttgtaaaaaaagaaaaacataccaaaaacgttctggaaagcacatagcaaattgttaaatagagagtgaaattactgaggatttttagttctcacttgatatagtgttgaagtgtctgaacttttataatgagtatgggttacttttatcatcaaaaacaaaatttcaatttaaaaacttataaaaatagttgatacataatgattcacatttggtgactttcttac

SEQ ID NO: 371509 - DNA, 2945 bp, Homo sapiens
cgcggctgaagcgagggcggggagggaaagcgagcggcgcctgcgccccggcggtggacgggcccggtcgtgggcggggattggggcggagcctgaccgttacgcgcagccccgcccccgcggcctcgtcgctcctgctgaggcggtagccgcttttcgtcgactcttaccggttggctgggccagctgcgccgcggctcacagctgacgatgggggaccccagcaagcaggacatcttgaccatcttcaagcgcctccgctcggtgcccactaacaaggtgtgttttgattgtggtgccaaaaatcccagctgggcaagcataacctatggagtgttcctttgcattgattgctcagggtcccaccggtcacttggtgttcacttgagttttattcgatctacagagttggattccaactggtcatggtttcagttgcgatgcatgcaagtcggaggaaacgctagtgcatcttccttttttcatcaacatgggtgttccaccaatgacaccaatgccaagtacaacagtcgtgctgctcagctctatagggagaaaatcaaatcgctcgcctctcaagcaacacggaagcatggcactgatctgtggcttgatagttgtgtggttccacctttgtcccctccaccaaaggaggaagatttttttgcctctcacgtttctcctgaggtgagtgacacagcgtgggcatcagcaatagcagaaccatcttctttaacatcaaggcctgtggaaaccactttggaaaataatgaaggtggacaagagcaaggaccaagtgtggaaggtcttaatgtaccaacaaaggctactttagaggtatcctctatcataaaaaagaaaccaaatcaagctaaaaaaggccttggggccaaaaaaggaagtttgggagctcagaaactggcaaacacatgctttaatgaaattgaaaaacaagctcaagctgcggataaaatgaaggagcaggaagacctggccaaggtggtatctaaagaagaatcaattgtttcatcattacgattagcctataaggatcttgaaattcaaatgaagaaagacgaaaagatgaacattagtggcaaaaaaaatgttgactcagacagactcggcatgggatttggaaattgcagaagtgttatttcacattcagtgacttcagatatgcagaccatagagcaggaatcacccattatggcaaaaccaagaaaaaagtataatgatgacagtgacgattcatattttacttccagctcaaggtactttgacgagccagtggagttaaggagcagttctttctctagctgggatgacagttcagattcctattggaaaaaagagaccagcaaagatactgaaacagttctgaaaaccacaggctattcagacagacctactgctcgccgcaagccagattatgagccagttgaaaatacagatgaggcccagaagaagtttggcaatgtcaaggccatttcatcagatatgtattttggaagacaatcccaggctgattatgagaccagggcccgcctagagaggctgtcagcaagttcctccataagctcggctgatctgttcgaggagccgaggaagcagccagcagggaactacagcctgtccagtgtgctgcccaacgcccccgacatggcgcagttcaagcagggagtgagatcggttgctggaaaactctccgtctttgctaatggagtcgtgacttcaattcaggatcgctacggttcttaatactgaagtcatgatgtgtatttcctggagaaattcctctttaaatgaacaagtaaccacatctcaggcggcagtgaagtccagatagttttgcagattgttttgctactttttcatatggtatatgtttctgatttttaatatttcttttgagaaattctgagttctgatgtaggagctttcctgtgatttctgtttcacgttccttcctgtcacaccctcctttggcgtctctgtgtatatccttgctttattttcttggaacctttgatttcaacactgagggcctggagacctcggctcctcctgctcctgaaccaggaggcttcatgtgggggaggaggagaggtctccatgtgacacatgggctcagggctgccagaatcagcggatgctggatgggcctgcagaaacaacactcaccacacacacttccttcaaaagaccaaaagtgactggtgtctcgtgtgacagattgcttcatttatgtttctacatagtaaggtgactgccaaataatatttgaagtcatctgtctctttgtaaattattttatatgacctataaatttaaaaatgtttttcagtgagtgcttttaacaaacttaagcttctgccctgccaagggaattaatgttatcttgtgaaaggtgttgctgtttgaattgatgagaaatggaagatgagaactccctaagagttctcataataaatcatctcatcacaaatcaatacggtatacagagttaaagtggaatgaggtaagaagatacagctacagaaaatagttgcgtgtatgggagaacagtcattgtaattgggtagttttgttaataaatatttttaaatcttgcttttcagaaattaccgaatgtgtataaacaaataaagaaaaataatttagctgtgttttagacagcattagaatatattgttcagcacagtaaaatatatttgaaatttgataagccaaaaatgtggttttgaatgaatattttgtgaatctttcttaaaagctcaaatttgtagacttctaaatagaataaacacttgcagcagaaaaaaaaaagagagccacacaacttggggcccgcgccgcaagaatcctaaccccgtggcggcggcccgtatacaagcacggtccgcaacgcgcgcagggggggtcccacaaaacggggggcgggt

SEQ ID NO: 371510 - DNA, 2767 bp, Homo sapiens
cgcggctgaagcgagggcggggagggaaagcgagcggcgcctgcgccccggcggtggacgggcccggtcgtgggcggggattggggcggagcctgaccgttacgcgcagccccgcccccgcggcctcgtcgctcctgctgaggcggtagccgcttttcgtcgactcttaccggttggctgggccagctgcgccgcggctcacagctgacgatgggggaccccagcaagcaggacatcttgaccatcttcaagcgcctccgctcggtgcccactaacaaggtgtgttttgattgtggtgccaaaaatcccagctgggcaagcataacctatggagtgttcctttgcattgattgctcagggtcccaccggtcacttggtgttcacttgagttttattcgatctacagagttggattccaactggtcatggtttcagttgcgatgcatgcaagtcggaggaaacgctagtgcatcttccttttttcatcaacatgggtgttccaccaatgacaccaatgccaagtacaacagtcgtgctgctcagctctatagggagaaaatcaaatcgctcgcctctcaagcaacacggaagcatggcactgatctgtggcttgatagttgtgtggttccacctttgtcccctccaccaaaggaggaagatttttttgcctctcacgtttctcctgaggtgagtgacacagcgtgggcatcagcaatagcagaaccatcttctttaacatcaaggcctgtggaaaccactttggaaaataatgaaggtggacaagagcaaggaccaagtgtggaaggtcttaatgtaccaacaaaggctactttagaggtatcctctatcataaaaaagaaaccaaatcaagctaaaaaaggccttggggccaaaaaaggaagtttgggagctcagaaactggcaaacacatgctttaatgaaattgaaaaacaagctcaagctgcggataaaatgaaggagcaggaagacctggccaaggtggtatctaaagaagaatcaattgtttcatcattacgattagcctataaggatcttgaaattcaaatgaagaaagacgaaaagatgaacattagtggcaaaaaaaatgttgactcagacagactcggcatgggatttggaaattgcagaagtgttatttcacattcagtgacttcagatatgcagaccatagagcaggaatcacccattatggcaaaaccaagaaaaaagtataatgatgacagtgacgattcatattttacttccagctcaaggtactttgacgagccagtggagttaaggagcagttctttctctagctgggatgacagttcagattcctattggaaaaaagagaccagcaaagatactgaaacagttctgaaaaccacaggctattcagacagacctactgctcgccgcaagccagattatgagccagttgaaaatacagatgaggcccagaagaagtttggcaatgtcaaggccatttcatcagatatgtattttggaagacaatcccaggctgattatgagaccagggcccgcctagagaggctgtcagcaagttcctccataagctcggctgatctgttcgaggagccgaggaagcagccagcagggaactacagcctgtccagtgtgctgcccaacgcccccgacatggcgcagttcaagcagggagtgagatcggttgctggaaaactctccgtctttgctaatggagtcgtgacttcaattcaggatcgctacggttcttaatactgaagtcatgatgtgtatttcctggagaaattcctctttaaatgaacaagtaaccacatctcaggcggcagtgaagtccagatagttttgcagattgttttgctactttttcatatggtatatgtttctgatttttaatatttcttttgagaaattctgagttctgatgtaggagctttcctgtgatttctgtttcacgttccttcctgtcacaccctcctttggcgtctctgtgtatatccttgctttattttcttggaacctttgatttcaacactgagggcctggagacctcggctcctcctgctcctgaaccaggaggcttcatgtgggggaggaggagaggtctccatgtgacacatgggctcagggctgccagaatcagcggatgctggatgggcctgcagaaacaacactcaccacacacacttccttcaaaagaccaaaagtgactggtgtctcgtgtgacagattgcttcatttatgtttctacatagtaaggtgactgccaaataatatttgaagtcatctgtctctttgtaaattattttatatgacctataaatttaaaaatgtttttcagtgagtgcttttaacaaacttaagcttctgccctgccaagggaattaatgttatcttgtgaaaggtgttgctgtttgaattgatgagaaatggaagatgagaactccctaagagttctcataataaatcatctcatcacaaatcaatacggtatacagagttaaagtggaatgaggtaagaagatacagctacagaaaatagttgcgtgtatgggagaacagtcattgtaattgggtagttttgttaataaatatttttaaatcttgcttttcagaaattaccgaatgtgtataaacaaataaagaaaaataatttagctgtgttttagacagcattagaatatattgttcagcacagtaaaatatatttgaaatggtcgccatccgattctattctactgctatccttgaatgtcgccat

SEQ ID NO: 371511 - DNA, 2798 bp, Homo sapiens
cgcggctgaagcgagggcggggagggaaagcgagcggcgcctgcgccccggcggtggacgggcccggtcgtgggcggggattggggcggagcctgaccgttacgcgcagccccgcccccgcggcctcgtcgctcctgctgaggcggtagccgcttttcgtcgactcttaccggttggctgggccagctgcgccgcggctcacagctgacgatgggggaccccagcaagcaggacatcttgaccatcttcaagcgcctccgctcggtgcccactaacaaggtgtgttttgattgtggtgccaaaaatcccagctgggcaagcataacctatggagtgttcctttgcattgattgctcagggtcccaccggtcacttggtgttcacttgagttttattcgatctacagagttggattccaactggtcatggtttcagttgcgatgcatgcaagtcggaggaaacgctagtgcatcttccttttttcatcaacatgggtgttccaccaatgacaccaatgccaagtacaacagtcgtgctgctcagctctatagggagaaaatcaaatcgctcgcctctcaagcaacacggaagcatggcactgatctgtggcttgatagttgtgtggttccacctttgtcccctccaccaaaggaggaagatttttttgcctctcacgtttctcctgaggtgagtgacacagcgtgggcatcagcaatagcagaaccatcttctttaacatcaaggcctgtggaaaccactttggaaaataatgaaggtggacaagagcaaggaccaagtgtggaaggtcttaatgtaccaacaaaggctactttagaggtatcctctatcataaaaaagaaaccaaatcaagctaaaaaaggccttggggccaaaaaaggaagtttgggagctcagaaactggcaaacacatgctttaatgaaattgaaaaacaagctcaagctgcggataaaatgaaggagcaggaagacctggccaaggtggtatctaaagaagaatcaattgtttcatcattacgattagcctataaggatcttgaaattcaaatgaagaaagacgaaaagatgaacattagtggcaaaaaaaatgttgactcagacagactcggcatgggatttggaaattgcagaagtgttatttcacattcagtgacttcagatatgcagaccatagagcaggaatcacccattatggcaaaaccaagaaaaaagtataatgatgacagtgacgattcatattttacttccagctcaaggtactttgacgagccagtggagttaaggagcagttctttctctagctgggatgacagttcagattcctattggaaaaaagagaccagcaaagatactgaaacagttctgaaaaccacaggctattcagacagacctactgctcgccgcaagccagattatgagccagttgaaaatacagatgaggcccagaagaagtttggcaatgtcaaggccatttcatcagatatgtattttggaagacaatcccaggctgattatgagaccagggcccgcctagagaggctgtcagcaagttcctccataagctcggctgatctgttcgaggagccgaggaagcagccagcagggaactacagcctgtccagtgtgctgcccaacgcccccgacatggcgcagttcaagcagggagtgagatcggttgctggaaaactctccgtctttgctaatggagtcgtgacttcaattcaggatcgctacggttcttaatactgaagtcatgatgtgtatttcctggagaaattcctctttaaatgaacaagtaaccacatctcaggcggcagtgaagtccagatagttttgcagattgttttgctactttttcatatggtatatgtttctgatttttaatatttcttttgagaaattctgagttctgatgtaggagctttcctgtgatttctgtttcacgttccttcctgtcacaccctcctttggcgtctctgtgtatatccttgctttattttcttggaacctttgatttcaacactgagggcctggagacctcggctcctcctgctcctgaaccaggaggcttcatgtgggggaggaggagaggtctccatgtgacacatgggctcagggctgccagaatcagcggatgctggatgggcctgcagaaacaacactcaccacacacacttccttcaaaagaccaaaagtgactggtgtctcgtgtgacagattgcttcatttatgtttctacatagtaaggtgactgccaaataatatttgaagtcatctgtctctttgtaaattattttatatgacctataaatttaaaaatgtttttcagtgagtgcttttaacaaacttaagcttctgccctgccaagggaattaatgttatcttgtgaaaggtgttgctgtttgaattgatgagaaatggaagatgagaactccctaagagttctcataataaatcatctcatcacaaatcaatacggtatacagagttaaagtggaatgaggtaagaagatacagctacagaaaatagttgcgtgtatgggagaacagtcattgtaattgggtagttttgttaataaatatttttaaatcttgcttttcagaaattaccgaatgtgtataaacaaataaagaaaaataatttagctgtgttttagacagcattagaatatatttgaaatttgataagccaaaaatgtggttttgaatgaatattttgtgaatctttcttaaaagctcaaatttgtagacttctaaatagaataaacacttgcagcaga

SEQ ID NO: 371512 - DNA, 2629 bp, Homo sapiens
gacggaagtgcgagtccgggccctgtatgactatgaggggcaggagcatgatgagctgagcttcaaggctgagacggggtttcaccatattatccagtctggtcttgaactcctgagctcaagtgatcctcccgcctcagcctcccaaagtgctgggatcacaggcatgagcccctgagactgcaaataaaccatgctttagagaagatctacagagttggattccaactggtcatggtttcagttgcgatgcatgcaagtcggaggaaacgctagtgcatcttccttttttcatcaacatgggtgttccaccaatgacaccaatgccaagtacaacagtcgtgctgctcagctctatagggagaaaatcaaatcgctcgcctctcaagcaacacggaagcatggcactgatctgtggcttgatagttgtgtggttccacctttgtcccctccaccaaaggaggaagatttttttgcctctcacgtttctcctgaggtgagtgacacagcgtgggcatcagcaatagcagaaccatcttctttaacatcaaggcctgtggaaaccactttggaaaataatgaaggtggacaagagcaaggaccaagtgtggaaggtcttaatgtaccaacaaaggctactttagaggtatcctctatcataaaaaagaaaccaaatcaagctaaaaaaggccttggggccaaaaaaggaagtttgggagctcagaaactggcaaacacatgctttaatgaaattgaaaaacaagctcaagctgcggataaaatgaaggagcaggaagacctggccaaggtggtatctaaagaagaatcaattgtttcatcattacgattagcctataaggatcttgaaattcaaatgaagaaagacgaaaagatgaacattagtggcaaaaaaaatgttgactcagacagactcggcatgggatttggaaattgcagaagtgttatttcacattcagtgacttcagatatgcagaccatagagcaggaatcacccattatggcaaaaccaagaaaaaagtataatgatgacagtgacgattcatattttacttccagctcaaggtactttgacgagccagtggagttaaggagcagttctttctctagctgggatgacagttcagattcctattggaaaaaagagaccagcaaagatactgaaacagttctgaaaaccacaggctattcagacagacctactgctcgccgcaagccagattatgagccagttgaaaatacagatgaggcccagaagaagtttggcaatgtcaaggccatttcatcagatatgtattttggaagacaatcccaggctgattatgagaccagggcccgcctagagaggctgtcagcaagttcctccataagctcggctgatctgttcgaggagccgaggaagcagccagcagggaactacagcctgtccagtgtgctgcccaacgcccccgacatggcgcagttcaagcagggagtgagatcggttgctggaaaactctccgtctttgctaatggagtcgtgacttcaattcaggatcgctacggttcttaatactgaagtcatgatgtgtatttcctggagaaattcctctttaaatgaacaagtaaccacatctcaggcggcagtgaagtccagatagttttgcagattgttttgctactttttcatatggtatatgtttctgatttttaatatttcttttgagaaattctgagttctgatgtaggagctttcctgtgatttctgtttcacgttccttcctgtcacaccctcctttggcgtctctgtgtatatccttgctttattttcttggaacctttgatttcaacactgagggcctggagacctcggctcctcctgctcctgaaccaggaggcttcatgtgggggaggaggagaggtctccatgtgacacatgggctcagggctgccagaatcagcggatgctggatgggcctgcagaaacaacactcaccacacacacttccttcaaaagaccaaaagtgactggtgtctcgtgtgacagattgcttcatttatgtttctacatagtaaggtgactgccaaataatatttgaagtcatctgtctctttgtaaattattttatatgacctataaatttaaaaatgtttttcagtgagtgcttttaacaaacttaagcttctgccctgccaagggaattaatgttatcttgtgaaaggtgttgctgtttgaattgatgagaaatggaagatgagaactccctaagagttctcataataaatcatctcatcacaaatcaatacggtatacagagttaaagtggaatgaggtaagaagatacagctacagaaaatagttgcgtgtatgggagaacagtcattgtaattgggtagttttgttaataaatatttttaaatcttgcttttcagaaattaccgaatgtgtataaacaaataaagaaaaataatttagctgtgttttagacagcattagaatatattgttcagcacagtaaaatatatttgaaatttgataagccaaaaatgtggttttgaatgaatattttgtgaatctttcttaaaagctcaaatttgtagacttctaaatagaataaacacttgcagcaga

SEQ ID NO: 371513 - DNA, 3260 bp, Homo sapiens
cgcggctgaagcgagggcggggagggaaagcgagcggcgcctgcgccccggcggtggacgggcccggtcgtgggcggggattggggcggagcctgaccgttacgcgcagccccgcccccgcggcctcgtcgctcctgctgaggcggtagccgcttttcgtcgactcttaccggttggctgggccagctgcgccgcggctcacagctgacgatgggggaccccagcaagcaggacatcttgaccatcttcaagcgcctccgctcggtgcccactaacaaggtgtgttttgattgtggtgccaaaaatcccagctgggcaagcataacctatggagtgttcctttgcattgattgctcagggtcccaccggtcacttggtgttcacttgagttttattcgatctacagagttggattccaactggtcatggtttcagttgcgatgcatgcaagtcggaggaaacgctagtgcatcttccttttttcatcaacatgggtgttccaccaatgacaccaatgccaagtacaacagtcgtgctgctcagctctatagggagaaaatcaaatcgctcgcctctcaagcaacacggaagcatggcactgatctgtggcttgatagttgtgtggttccacctttgtcccctccaccaaaggaggaagatttttttgcctctcacgtttctcctgaggtgagtgacacagcgtgggcatcagcaatagcagaaccatcttctttaacatcaaggcctgtggaaaccactttggaaaataatgaaggtggacaagagcaaggaccaagtgtggaaggtcttaatgtaccaacaaaggctactttagaggtatcctctatcataaaaaagaaaccaaatcaagctaaaaaaggccttggggccaaaaaaggaagtttgggagctcagaaactggcaaacacatgctttaatgaaattgaaaaacaagctcaagctgcggataaaatgaaggagcaggaagacctggccaaggtggtatctaaagaagaatcaattgtttcatcattacgattagcctataaggatcttgaaattcaaatgaagaaagacgaaaagatgaacattagtggcaaaaaaaatgttgactcagacagactcggcatgggatttggaaattgcagaagtgttatttcacattcagtgacttcagatatgcagaccatagagcaggaatcacccattatggcaaaaccaagaaaaaagtataatgatgacagtgacgattcatattttacttccagctcaaggtactttgacgagccagtggagttaaggagcagttctttctctagctgggatgacagttcagattcctattggaaaaaagagaccagcaaagatactgaaacagttctgaaaaccacaggctattcagacagacctactgctcgccgcaagccagattatgagccagttgaaaatacagatgaggcccagaagaagtttggcaatgtcaaggccatttcatcagatatgtattttggaagacaatcccaggctgattatgagaccagggcccgcctagagaggctgtcagcaagttcctccataagctcggctgatctgttcgaggagccgaggaagcagccagcagggaactacagcctgtccagtgtgctgcccaacgcccccgacatggcgcagttcaagcagggagtgagatcggttgctggaaaactctccgtctttgctaatggagtcgtgacttcaattcaggtgaaggaattgaggcacagaaggttaggtcacttctgcaagatgaccagctgaaccaaaatttcagggcttcaaacaccaaatgtgttcctttgtcttccgtttcccacttgcttcccagagggctcagcaagtagcctctggcccactgagcatcctcccgcccactttgctccctgcctcctgatcccaggactgtggccgtggatgccagaggcaggatgtgaatcctgttgggttctgaagcccacacctaccctcagccttgaagctgcagcaatggctgctctccagatgagcacaccctcggggtgcagcgtccatgtcacatgcctgacatgggctgcagtgtcaatttgggtgatgctgaatattcagggcgtgggagtcagggatcgctgctgaatggtcgtgaacttccattttggttctctcttcaggatcgctacggttcttaatactgaagtcatgatgtgtatttcctggagaaattcctctttaaatgaacaagtaaccacatctcaggcggcagtgaagtccagatagttttgcagattgttttgctactttttcatatggtatatgtttctgatttttaatatttcttttgagaaattctgagttctgatgtaggagctttcctgtgatttctgtttcacgttccttcctgtcacaccctcctttggcgtctctgtgtatatccttgctttattttcttggaacctttgatttcaacactgagggcctggagacctcggctcctcctgctcctgaaccaggaggcttcatgtgggggaggaggagaggtctccatgtgacacatgggctcagggctgccagaatcagcggatgctggatgggcctgcagaaacaacactcaccacacacacttccttcaaaagaccaaaagtgactggtgtctcgtgtgacagattgcttcatttatgtttctacatagtaaggtgactgccaaataatatttgaagtcatctgtctctttgtaaattattttatatgacctataaatttaaaaatgtttttcagtgagtgcttttaacaaacttaagcttctgccctgccaagggaattaatgttatcttgtgaaaggtgttgctgtttgaattgatgagaaatggaagatgagaactccctaagagttctcataataaatcatctcatcacaaatcaatacggtatacagagttaaagtggaatgaggtaagaagatacagctacagaaaatagttgcgtgtatgggagaacagtcattgtaattgggtagttttgttaataaatatttttaaatcttgcttttcagaaattaccgaatgtgtataaacaaataaagaaaaataatttagctgtgttttagacagcattagaatatattgttcagcacagtaaaatatatttgaaatttgataagccaaaaatgtggttttgaatgaatattttgtgaatctttcttaaaagctcaaatttgtagacttctaaatagaataaacacttgcagcaga

SEQ ID NO: 371514 - DNA, 2485 bp, Homo sapiens
tctctaaaaaaaaaaaaaaaaaaaaaaaaaaatagccagatgtggtggtgcgcacctgtgatcccaactactcaggaggctgaagtggaaggctcccttgatctgggaggtaatgccactgcactcagctaaggtgacagagcgagaccctgtctcaaaaaaaaaaaaaaagttgttgtaatatattttttaaatgctcctgaagaaagtactgagaggggcaagctcaggctctatttctcttcagtgtgctgttaaaaaaaaaaatacattttctctgagtttggagactgcgtggaaatactgaggacaccattttgacaaagttctgttaatccaaaatatgcttatcaacttgagtcttctggatgagaaactaaagtggaaaatgttatcatctcttaaataataaagtgcagtatcttagaattttaaaagacacactaaaaaagaaaaattatttctattggtcttactttttaatttttattttttggcagaggtatcctctatcataaaaaagaaaccaaatcaagctaaaaaaggccttggggccaaaaaaggaagtttgggagctcagaaactggcaaacacatgctttaatgaaattgaaaaacaagctcaagctgcggataaaatgaaggagcaggaagacctggccaaggtggtatctaaagaagaatcaattgtttcatcattacgattagcctataaggatcttgaaattcaaatgaagaaagacgaaaagatgaacattagtggcaaaaaaaatgttgactcagacagactcggcatgggatttggaaattgcagaagtgttatttcacattcagtgacttcagatatgcagaccatagagcaggaatcacccattatggcaaaaccaagaaaaaagtataatgatgacagtgacgattcatattttacttccagctcaaggtactttgacgagccagtggagttaaggagcagttctttctctagctgggatgacagttcagattcctattggaaaaaagagaccagcaaagatactgaaacagttctgaaaaccacaggctattcagacagacctactgctcgccgcaagccagattatgagccagttgaaaatacagatgaggcccagaagaagtttggcaatgtcaaggccatttcatcagatatgtattttggaagacaatcccaggctgattatgagaccagggcccgcctagagaggctgtcagcaagttcctccataagctcggctgatctgttcgaggagccgaggaagcagccagcagggaactacagcctgtccagtgtgctgcccaacgcccccgacatggcgcagttcaagcagggagtgagatcggttgctggaaaactctccgtctttgctaatggagtcgtgacttcaattcaggatcgctacggttcttaatactgaagtcatgatgtgtatttcctggagaaattcctctttaaatgaacaagtaaccacatctcaggcggcagtgaagtccagatagttttgcagattgttttgctactttttcatatggtatatgtttctgatttttaatatttcttttgagaaattctgagttctgatgtaggagctttcctgtgatttctgtttcacgttccttcctgtcacaccctcctttggcgtctctgtgtatatccttgctttattttcttggaacctttgatttcaacactgagggcctggagacctcggctcctcctgctcctgaaccaggaggcttcatgtgggggaggaggagaggtctccatgtgacacatgggctcagggctgccagaatcagcggatgctggatgggcctgcagaaacaacactcaccacacacacttccttcaaaagaccaaaagtgactggtgtctcgtgtgacagattgcttcatttatgtttctacatagtaaggtgactgccaaataatatttgaagtcatctgtctctttgtaaattattttatatgacctataaatttaaaaatgtttttcagtgagtgcttttaacaaacttaagcttctgccctgccaagggaattaatgttatcttgtgaaaggtgttgctgtttgaattgatgagaaatggaagatgagaactccctaagagttctcataataaatcatctcatcacaaatcaatacggtatacagagttaaagtggaatgaggtaagaagatacagctacagaaaatagttgcgtgtatgggagaacagtcattgtaattgggtagttttgttaataaatatttttaaatcttgcttttcagaaattaccgaatgtgtataaacaaataaagaaaaataatttagctgtgttttagacagcattagaatatattgttcagcacagtaaaatatatttgaaatttgataagccaaaaatgtggttttgaatgaatattttgtgaatctttcttaaaagctcaaatttgtagacttctaaatagaataaacacttgcagcaga

SEQ ID NO: 371515 - DNA, 1699 bp, Homo sapiens
cccgtcttaaggaatgagaaattgcagaagtgttatttcacattcagtgacttcagatatgcagaccatagagcaggaatcacccattatggcaaaaccaagaaaaaagtataatgatgacagtgacgattcatattttacttccagctcaaggtactttgacgagccagtggagttaaggagcagttctttctctagctgggatgacagttcagattcctattggaaaaaagagaccagcaaagatactgaaacagttctgaaaaccacaggctattcagacagacctactgctcgccgcaagccagattatgagccagttgaaaatacagatgaggcccagaagaagtttggcaatgtcaaggccatttcatcagatatgtattttggaagacaatcccaggctgattatgagaccagggcccgcctagagaggctgtcagcaagttcctccataagctcggctgatctgttcgaggagccgaggaagcagccagcagggaactacagcctgtccagtgtgctgcccaacgcccccgacatggcgcagttcaagcagggagtgagatcggttgctggaaaactctccgtctttgctaatggagtcgtgacttcaattcaggatcgctacggttcttaatactgaagtcatgatgtgtatttcctggagaaattcctctttaaatgaacaagtaaccacatctcaggcggcagtgaagtccagatagttttgcagattgttttgctactttttcatatggtatatgtttctgatttttaatatttcttttgagaaattctgagttctgatgtaggagctttcctgtgatttctgtttcacgttccttcctgtcacaccctcctttggcgtctctgtgtatatccttgctttattttcttggaacctttgatttcaacactgagggcctggagacctcggctcctcctgctcctgaaccaggaggcttcatgtgggggaggaggagaggtctccatgtgacacatgggctcagggctgccagaatcagcggatgctggatgggcctgcagaaacaacactcaccacacacacttccttcaaaagaccaaaagtgactggtgtctcgtgtgacagattgcttcatttatgtttctacatagtaaggtgactgccaaataatatttgaagtcatctgtctctttgtaaattattttatatgacctataaatttaaaaatgtttttcagtgagtgcttttaacaaacttaagcttctgccctgccaagggaattaatgttatcttgtgaaaggtgttgctgtttgaattgatgagaaatggaagatgagaactccctaagagttctcataataaatcatctcatcacaaatcaatacggtatacagagttaaagtggaatgaggtaagaagatacagctacagaaaatagttgcgtgtatgggagaacagtcattgtaattgggtagttttgttaataaatatttttaaatcttgcttttcagaaattaccgaatgtgtataaacaaataaagaaaaataatttagctgtgttttagacagcattagaatatattgttcagcacagtaaaatatatttgaaatttgataagccaaaaatgtggttttgaatgaatattttgtgaatctttcttaaaagctcaaatttgtagacttctaaatagaataaacacttgcagcaga

SEQ ID NO: 371516 - DNA, 2332 bp, Homo sapiens
cgcggctgaagcgagggcggggagggaaagcgagcggcgcctgcgccccggcggtggacgggcccggtcgtgggcggggattggggcggagcctgaccgttacgcgcagccccgcccccgcggcctcgtcgctcctgctgaggcggtagccgcttttcgtcgactcttaccggttggctgggccagctgcgccgcggctcacagctgacgatgggggaccccagcaagcaggacatcttgaccatcttcaagcgcctccgctcggtgcccactaacaaggtgtgttttgattgtggtgccaaaaatcccagctgggcaagcataacctatggagtgttcctttgcattgattgctcagggtcccaccggtcacttggtgttcacttgagttttattcgatctacagagttggattccaactggtcatggtttcagttgcgatgcatgcaagtcggaggaaacgctagtgcatcttccttttttcatcaacatgggtgttccaccaatgacaccaatgccaagtacaacagtcgtgctgctcagctctatagggagaaaatcaaatcgctcgcctctcaagcaacacggaagcatggcactgatctgtggcttgatagttgtgtggttccacctttgtcccctccaccaaaggaggaagatttttttgcctctcacgtttctcctgaggtgagtgacacagcgtgggcatcagcaatagcagaaccatcttctttaacatcaaggcctgtggaaaccactttggaaaataatgaaggtggacaagagcaaggaccaagtgtggaaggtcttaatgtaccaacaaaggctactttagaggtatcctctatcataaaaaagaaaccaaatcaagctaaaaaaggccttggggccaaaaaaggaagtttgggagctcagaaactggcaaacacatgctttaatgaaattgaaaaacaagctcaagctgcggataaaatgaaggagcaggaagacctggccaaggtggtatctaaagaagaatcaattgtttcatcattacgattagcctataaggatcttgaaattcaaatgaagaaagacgaaaagatgaacattagtggcaaaaaaaatgttgactcagacagactcggcatgggatttggaaattgcagaagtgttatttcacattcagtgacttcagatatgcagaccatagagcaggaatcacccattatggcaaaaccaagaaaaaagtataatgatgacagtgacgattcatattttacttccagctcaaggtactttgacgagccagtggagttaaggagcagttctttctctagctgggatgacagttcagattcctattggaaaaaagagaccagcaaagatactgaaacagttctgaaaaccacaggctattcagacagacctactgctcgccgcaagccagattatgagccagttgaaaatacagatgaggcccagaagaagtttggcaatgtcaaggccatttcatcagatatgtattttggaagacaatcccaggctgattatgagaccagggcccgcctagagaggctgtcagcaagttcctccataagctcggctgatctgttcgaggagccgaggaagcagccagcagggaactacagcctgtccagtgtgctgcccaacgcccccgacatggcgcagttcaagcagggagtgagatcggttgctggaaaactctccgtctttgctaatggagtcgtgacttcaattcaggtcagtggaatggggcagtgctcactggctatgacggtaggttcagcagtttgaaaatgagacctgcttcaatcttcaactgctggaaaattcaattatatattattggatcgatatgtttgctacactataacccagaacattatgaaaaccagaaattataattttatatttaatattttctaacggatgactctaggggaattgttagaggaattgtcatgaccattgtccagtttttttcctagattggaacagagaagtattaagaagaaaactgaaattatctgtaatgccacatcacagggataacctctgttaatattttggtatatttttagctctagatttctaaggatatttttctatacgtagattaaaaagatatacatatctatctttttaaagttaaaaagggattatattgtatagagggttttatatcttgctttttctctgtgatgctgggagcatttccttgtaatgaaaagttttcctaaaaccacattctattgagtgaaaacataaccaaggatggcgcatacttgcgcatgagatcgaggccatctgtgacgatatgagtggctcg

SEQ ID NO: 371517 - DNA, 1756 bp, Homo sapiens
tggaggtgcacccatttcggagagttccctcagccccaggactctggatgtagccgttttcatgctgtgaatagcacagtcttccctttcatgtggcactgaagttaaaatgcatagagctctttcatgtcccttaggtcagctaagcccacatcagtgtccaaataggtaacatccctattttatagatggtcatccccattttagagatggctcccttttatatccccattttacaggtgaaggaattgaggcacagaaggttaggtcacttctgcaagatgaccagctgaaccaaaatttcagggcttcaaacaccaaatgtgttcctttgtcttccgtttcccacttgcttcccagagggctcagcaagtagcctctggcccactgagcatcctcccgcccactttgctccctgcctcctgatcccaggactgtggccgtggatgccagaggcaggatgtgaatcctgttgggttctgaagcccacacctaccctcagccttgaagctgcagcaatggctgctctccagatgagcacaccctcggggtgcagcgtccatgtcacatgcctgacatgggctgcagtgtcaatttgggtgatgctgaatattcagggcgtgggagtcagggatcgctgctgaatggtcgtgaacttccattttggttctctcttcaggatcgctacggttcttaatactgaagtcatgatgtgtatttcctggagaaattcctctttaaatgaacaagtaaccacatctcaggcggcagtgaagtccagatagttttgcagattgttttgctactttttcatatggtatatgtttctgatttttaatatttcttttgagaaattctgagttctgatgtaggagctttcctgtgatttctgtttcacgttccttcctgtcacaccctcctttggcgtctctgtgtatatccttgctttattttcttggaacctttgatttcaacactgagggcctggagacctcggctcctcctgctcctgaaccaggaggcttcatgtgggggaggaggagaggtctccatgtgacacatgggctcagggctgccagaatcagcggatgctggatgggcctgcagaaacaacactcaccacacacacttccttcaaaagaccaaaagtgactggtgtctcgtgtgacagattgcttcatttatgtttctacatagtaaggtgactgccaaataatatttgaagtcatctgtctctttgtaaattattttatatgacctataaatttaaaaatgtttttcagtgagtgcttttaacaaacttaagcttctgccctgccaagggaattaatgttatcttgtgaaaggtgttgctgtttgaattgatgagaaatggaagatgagaactccctaagagttctcataataaatcatctcatcacaaatcaatacggtatacagagttaaagtggaatgaggtaagaagatacagctacagaaaatagttgcgtgtatgggagaacagtcattgtaattgggtagttttgttaataaatatttttaaatcttgcttttcagaaattaccgaatgtgtataaacaaataaagaaaaataatttagctgtgttttagacagcattagaatatattgttcagcacagtaaaatatatttgaaatttgataagccaaaaatgtggttttgaatgaatattttgtgaatctttcttaaaagctcaaatttgtagacttctaaatagaataaacacttgcagcaga

SEQ ID NO: 371518 - DNA, 983 bp, Homo sapiens
gcggccgcccgcgcctcctcggccgcctgtcgggcatgaaaaccaaattctgcaccgggggcatatgcggatccctaaacgctcgggctgttagtgtgagtgctttcctgtgatttctgtttcacgttccttcctgtcacaccctcctttggcgtctctgtgtatatccttgctttattttcttggaacctttgatttcaacactgagggcctggagacctcggctcctcctgctcctgaaccaggaggcttcatgtgggggaggaggagaggtctccatgtgacacatgggctcagggctgccagaatcagcggatgctggatgggcctgcagaaacaacactcaccacacacacttccttcaaaagaccaaaagtgactggtgtctcgtgtgacagattgcttcatttatgtttctacatagtaaggtgactgccaaataatatttgaagtcatctgtctctttgtaaattattttatatgacctataaatttaaaaatgtttttcagtgagtgcttttaacaaacttaagcttctgccctgccaagggaattaatgttatcttgtgaaaggtgttgctgtttgaattgatgagaaatggaagatgagaactccctaagagttctcataataaatcatctcatcacaaatcaatacggtatacagagttaaagtggaatgaggtaagaagatacagctacagaaaatagttgcgtgtatgggagaacagtcattgtaattgggtagttttgttaataaatatttttaaatcttgcttttcagaaattaccgaatgtgtataaacaaataaagaaaaataatttagctgtgttttagacagcattagaatatattgttcagcacagtaaaatatatttgaaatttgataagccaaaaatgtggttttgaatgaatattttgtgaatctttcttaaaagctcaaatttgtagacttctaaatagaataaacacttgcagcaga

SEQ ID NO: 371519 - DNA, 1208 bp, Homo sapiens
cgcggctgaagcgagggcggggagggaaagcgagcggcgcctgcgccccggcggtggacgggcccggtcgtgggcggggattggggcggagcctgaccgttacgcgcagccccgcccccgcggcctcgtcgctcctgctgaggcggtagccgcttttcgtcgactcttaccggttggctgggccagctgcgccgcggctcacagctgacgatgggggaccccagcaagcaggacatcttgaccatcttcaagcgcctccgctcggtgcccactaacaaggtgtgttttgattgtggtgccaaaaatcccagctgggcaagcataacctatggagtgttcctttgcattgattgctcagggtcccaccggtcacttggtgttcacttgagttttattcgatctacagagttggattccaactggtcatggtttcagttgcgatgcatgcaagtcggaggaaacgctagtgcatcttccttttttcatcaacatgggtgttccaccaatgacaccaatgccaagtacaacagtcgtgctgctcagctctatagggagaaaatcaaatcgctcgcctctcaagcaacacggaagcatggcactgatctgtggcttgatagttgtgtggttccacctttgtcccctccaccaaaggaggaagatttttttgcctctcacgtttctcctgaggtgagtgacacagcgtgggcatcagcaatagcagaaccatcttctttaacatcaaggcctgtggaaaccactttggaaaataatgaaggtggagtccttagaactgtcatgtaatactattctatggttcagtggcatgctatgaaactattaaaaattaatcccaaagtgctgggattacaggcgtgagccaccacacctggccgacccttctgtcttaacaggaagaaatattcataatagactataaagtgggggaaaaatattactgaacatggaatataataatcatttttgtaaaaaaagaaaaacataccaaaaacgttctggaaagcacatagcaaattgttaaatagagagtgaaattactgaggatttttagttctcacttgatatagtgttgaagtgtctgaacttttataatgagtatgggttacttttatcatcaaaaacaaaatttcaatttaaaaacttataaaaatagttgatacataatgattcacatttggtgactttcttac

SEQ ID NO: 371520 - DNA, 968 bp, Homo sapiens
cgcggctgaagcgagggcggggagggaaagcgagcggcgcctgcgccccggcggtggacgggcccggtcgtgggcggggattggggcggagcctgaccgttacgcgcagccccgcccccgcggcctcgtcgctcctgctgaggcggtagccgcttttcgtcgactcttaccggttggctgggccagctgcgccgcggctcacagctgacgatgggggaccccagcaagcaggacatcttgaccatcttcaagcgcctccgctcggtgcccactaacaaggtgtgttttgattgtggtgccaaaaatcccagctgggcaagcataacctatggagtgttcctttgcattgattgctcagggtcccaccggtcacttggtgttcacttgagttttattcgatctacagagttggattccaactggtcatggtttcagttgcgatgcatgcaagtcggaggaaacgctagtgcatcttccttttttcatcaacatgggtgttccaccaatgacaccaatgccaagtacaacagtcgtgctgctcagctctatagggagaaaatcaaatcgctcgcctctcaagcaacacggaagcatggcactgatgtaagtcactggaggctggattgtttcctttagatacatgttcacttcatagaaaaagtgatttttatcctgaatagtaaaacttttctacctgagttgtcttacaaggaattagtgtacagtagattcttactattgaagtagttatgttctgtaaattcatcatgagtactggattagtgaatactaaaacattgctcctaggagaaatacaggattaggttcctataagctctggtctcattttcatcaactgatcaatacataaccttatttaacatgtgtttctatttaaagacacctttttaaatatatattgatggctcatgaatattgaactcacagccaaggactataactcagcc

SEQ ID NO: 371521 - DNA, 2820 bp, Homo sapiens
cgcggctgaagcgagggcggggagggaaagcgagcggcgcctgcgccccggcggtggacgggcccggtcgtgggcggggattggggcggagcctgaccgttacgcgcagccccgcccccgcggcctcgtcgctcctgctgaggcggtagccgcttttcgtcgactcttaccggttggctgggccagctgcgccgcggctcacagctgacgatgggggaccccagcaagcaggacatcttgaccatcttcaagcgcctccgctcggtgcccactaacaaggtgtgttttgattgtggtgccaaaaatcccagctgggcaagcataacctatggagtgttcctttgcattgattgctcagggtcccaccggtcacttggtgttcacttgagttttattcgatctacagagttggattccaactggtcatggtttcagttgcgatgcatgcaagtcggaggaaacgctagtgcatcttccttttttcatcaacatgggtgttccaccaatgacaccaatgccaagtacaacagtcgtgctgctcagctctatagggagaaaatcaaatcgctcgcctctcaagcaacacggaagcatggcactgatctgtggcttgatagttgtgtggttccacctttgtcccctccaccaaaggaggaagatttttttgcctctcacgtttctcctgaggtgagtgacacagcgtgggcatcagcaatagcagaaccatcttctttaacatcaaggcctgtggaaaccactttggaaaataatgaaggtggacaagagcaaggaccaagtgtggaaggtcttaatgtaccaacaaaggctactttagaggtatcctctatcataaaaaagaaaccaaatcaagctaaaaaaggccttggggccaaaaaaggaagtttgggagctcagaaactggcaaacacatgctttaatgaaattgaaaaacaagctcaagctgcggataaaatgaaggagcaggaagacctggccaaggtggtatctaaagaagaatcaattgtttcatcattacgattagcctataaggatcttgaaattcaaatgaagaaagacgaaaagatgaacattagtggcaaaaaaaatgttgactcagacagactcggcatgggatttggaaattgcagaagtgttatttcacattcagtgacttcagatatgcagaccatagagcaggaatcacccattatggcaaaaccaagaaaaaagtataatgatgacagtgacgattcatattttacttccagctcaaggtactttgacgagccagtggagttaaggagcagttctttctctagctgggatgacagttcagattcctattggaaaaaagagaccagcaaagatactgaaacagttctgaaaaccacaggctattcagacagacctactgctcgccgcaagccagattatgagccagttgaaaatacagatgaggcccagaagaagtttggcaatgtcaaggccatttcatcagatatgtattttggaagacaatcccaggctgattatgagaccagggcccgcctagagaggctgtcagcaagttcctccataagctcggctgatctgttcgaggagccgaggaagcagccagcagggaactacagcctgtccagtgtgctgcccaacgcccccgacatggcgcagttcaagcagggagtgagatcggttgctggaaaactctccgtctttgctaatggagtcgtgacttcaattcaggatcgctacggttcttaatactgaagtcatgatgtgtatttcctggagaaattcctctttaaatgaacaagtaaccacatctcaggcggcagtgaagtccagatagttttgcagattgttttgctactttttcatatggtatatgtttctgatttttaatatttcttttgagaaattctgagttctgatgtaggagctttcctgtgatttctgtttcacgttccttcctgtcacaccctcctttggcgtctctgtgtatatccttgctttattttcttggaacctttgatttcaacactgagggcctggagacctcggctcctcctgctcctgaaccaggaggcttcatgtgggggaggaggagaggtctccatgtgacacatgggctcagggctgccagaatcagcggatgctggatgggcctgcagaaacaacactcaccacacacacttccttcaaaagaccaaaagtgactggtgtctcgtgtgacagattgcttcatttatgtttctacatagtaaggtgactgccaaataatatttgaagtcatctgtctctttgtaaattattttatatgacctataaatttaaaaatgtttttcagtgagtgcttttaacaaacttaagcttctgccctgccaagggaattaatgttatcttgtgaaaggtgttgctgtttgaattgatgagaaatggaagatgagaactccctaagagttctcataataaatcatctcatcacaaatcaatacggtatacagagttaaagtggaatgaggtaagaagatacagctacagaaaatagttgcgtgtatgggagaacagtcattgtaattgggtagttttgttaataaatatttttaaatcttgcttttcagaaattaccgaatgtgtataaacaaataaagaaaaataatttagctgtgttttagacagcattagaatatattgttcagcacagtaaaatatatttgaaatttgataagccaaaaatgtggttttgaatgaatattttgtgaatctttcttaaaagctcaaatttgtagacttctaaatagaataaacacttgcagcaga

SEQ ID NO: 371522 - DNA, 2835 bp, Homo sapiens
cgcggctgaagcgagggcggggagggaaagcgagcggcgcctgcgccccggcggtggacgggcccggtcgtgggcggggattggggcggagcctgaccgttacgcgcagccccgcccccgcggcctcgtcgctcctgctgaggcggtagccgcttttcgtcgactcttaccggttggctgggccagctgcgccgcggctcacagctgacgatgggggaccccagcaagcaggacatcttgaccatcttcaagcgcctccgctcggtgcccactaacaaggtgtgttttgattgtggtgccaaaaatcccagctgggcaagcataacctatggagtgttcctttgcattgattgctcagggtcccaccggtcacttggtgttcacttgagttttattcgatctacagagttggattccaactggtcatggtttcagttgcgatgcatgcaagtcggaggaaacgctagtgcatcttccttttttcatcaacatgggtgttccaccaatgacaccaatgccaagtacaacagtcgtgctgctcagctctatagggagaaaatcaaatcgctcgcctctcaagcaacacggaagcatggcactgatctgtggcttgatagttgtgtggttccacctttgtcccctccaccaaaggaggaagatttttttgcctctcacgtttctcctgaggtgagtgacacagcgtgggcatcagcaatagcagaaccatcttctttaacatcaaggcctgtggaaaccactttggaaaataatgaaggtggacaagagcaaggaccaagtgtggaaggtcttaatgtaccaacaaaggctactttagaggtatcctctatcataaaaaagaaaccaaatcaagctaaaaaaggccttggggccaaaaaaggaagtttgggagctcagaaactggcaaacacatgctttaatgaaattgaaaaacaagctcaagctgcggataaaatgaaggagcaggaagacctggccaaggtggtatctaaagaagaatcaattgtttcatcattacgattagcctataaggatcttgaaattcaaatgaagaaagacgaaaagatgaacattagtggcaaaaaaaatgttgactcagacagactcggcatgggatttggaaattgcagaagtgttatttcacattcagtgacttcagatatgcagaccatagagcaggaatcacccattatggcaaaaccaagaaaaaagtataatgatgacagtgacgattcatattttacttccagctcaaggtactttgacgagccagtggagttaaggagcagttctttctctagctgggatgacagttcagattcctattggaaaaaagagaccagcaaagatactgaaacagttctgaaaaccacaggctattcagacagacctactgctcgccgcaagccagattatgagccagttgaaaatacagatgaggcccagaagaagtttggcaatgtcaaggccatttcatcagatatgtattttggaagacaatcccaggctgattatgagaccagggcccgcctagagaggctgtcagcaagttcctccataagctcggctgatctgttcgaggagccgaggaagcagccagcagggaactacagcctgtccagtgtgctgcccaacgcccccgacatggcgcagttcaagcagggagtgagatcggttgctggaaaactctccgtctttgctaatggagtcgtgacttcaattcaggatcgctacggttcttaatactgaagtcatgatgtgtatttcctggagaaattcctctttaaatgaacaagtaaccacatctcaggcggcagtgaagtccagatagttttgcagattgttttgctactttttcatatggtatatgtttctgatttttaatatttcttttgagaaattctgagttctgatgtaggagctttcctgtgatttctgtttcacgttccttcctgtcacaccctcctttggcgtctctgtgtatatccttgctttattttcttggaacctttgatttcaacactgagggcctggagacctcggctcctcctgctcctgaaccaggaggcttcatgtgggggaggaggagaggtctccatgtgacacatgggctcagggctgccagaatcagcggatgctggatgggcctgcagaaacaacactcaccacacacacttccttcaaaagaccaaaagtgactggtgtctcgtgtgacagattgcttcatttatgtttctacatagtaaggtgactgccaaataatatttgaagtcatctgtctctttgtaaattattttatatgacctataaatttaaaaatgtttttcagtgagtgcttttaacaaacttaagcttctgccctgccaagggaattaatgttatcttgtgaaaggtgttgctgtttgaattgatgagaaatggaagatgagaactccctaagagttctcataataaatcatctcatcacaaatcaatacggtatacagagttaaagtggaatgaggtaagaagatacagctacagaaaatagttgcgtgtatgggagaacagtcattgtaattgggtagttttgttaataaatatttttaaatcttgcttttcagaaattaccgaatgtgtataaacaaataaagaaaaataatttagctgtgttttagacagcattagaatatattgttcagcacagtaaaatatatttgaaatttgataagccaaaaatgtggttttgaatgaatattttgtgaatctttcttaaaagctcaaaggcagaaaaaaatttgtgtcaaaatgttgaatttaatcataagtgaggaaacc

SEQ ID NO: 371523 - DNA, 2767 bp, Homo sapiens
cgcggctgaagcgagggcggggagggaaagcgagcggcgcctgcgccccggcggtggacgggcccggtcgtgggcggggattggggcggagcctgaccgttacgcgcagccccgcccccgcggcctcgtcgctcctgctgaggcggtagccgcttttcgtcgactcttaccggttggctgggccagctgcgccgcggctcacagctgacgatgggggaccccagcaagcaggacatcttgaccatcttcaagcgcctccgctcggtgcccactaacaaggtgtgttttgattgtggtgccaaaaatcccagctgggcaagcataacctatggagtgttcctttgcattgattgctcagggtcccaccggtcacttggtgttcacttgagttttattcgatctacagagttggattccaactggtcatggtttcagttgcgatgcatgcaagtcggaggaaacgctagtgcatcttccttttttcatcaacatgggtgttccaccaatgacaccaatgccaagtacaacagtcgtgctgctcagctctatagggagaaaatcaaatcgctcgcctctcaagcaacacggaagcatggcactgatctgtggcttgatagttgtgtggttccacctttgtcccctccaccaaaggaggaagatttttttgcctctcacgtttctcctgaggtgagtgacacagcgtgggcatcagcaatagcagaaccatcttctttaacatcaaggcctgtggaaaccactttggaaaataatgaaggtggacaagagcaaggaccaagtgtggaaggtcttaatgtaccaacaaaggctactttagaggtatcctctatcataaaaaagaaaccaaatcaagctaaaaaaggccttggggccaaaaaaggaagtttgggagctcagaaactggcaaacacatgctttaatgaaattgaaaaacaagctcaagctgcggataaaatgaaggagcaggaagacctggccaaggtggtatctaaagaagaatcaattgtttcatcattacgattagcctataaggatcttgaaattcaaatgaagaaagacgaaaagatgaacattagtggcaaaaaaaatgttgactcagacagactcggcatgggatttggaaattgcagaagtgttatttcacattcagtgacttcagatatgcagaccatagagcaggaatcacccattatggcaaaaccaagaaaaaagtataatgatgacagtgacgattcatattttacttccagctcaaggtactttgacgagccagtggagttaaggagcagttctttctctagctgggatgacagttcagattcctattggaaaaaagagaccagcaaagatactgaaacagttctgaaaaccacaggctattcagacagacctactgctcgccgcaagccagattatgagccagttgaaaatacagatgaggcccagaagaagtttggcaatgtcaaggccatttcatcagatatgtattttggaagacaatcccaggctgattatgagaccagggcccgcctagagaggctgtcagcaagttcctccataagctcggctgatctgttcgaggagccgaggaagcagccagcagggaactacagcctgtccagtgtgctgcccaacgcccccgacatggcgcagttcaagcagggagtgagatcggttgctggaaaactctccgtctttgctaatggagtcgtgacttcaattcaggatcgctacggttcttaatactgaagtcatgatgtgtatttcctggagaaattcctctttaaatgaacaagtaaccacatctcaggcggcagtgaagtccagatagttttgcagattgttttgctactttttcatatggtatatgtttctgatttttaatatttcttttgagaaattctgagttctgatgtaggagctttcctgtgatttctgtttcacgttccttcctgtcacaccctcctttggcgtctctgtgtatatccttgctttattttcttggaacctttgatttcaacactgagggcctggagacctcggctcctcctgctcctgaaccaggaggcttcatgtgggggaggaggagaggtctccatgtgacacatgggctcagggctgccagaatcagcggatgctggatgggcctgcagaaacaacactcaccacacacacttccttcaaaagaccaaaagtgactggtgtctcgtgtgacagattgcttcatttatgtttctacatagtaaggtgactgccaaataatatttgaagtcatctgtctctttgtaaattattttatatgacctataaatttaggaattaatgttatcttgtgaaaggtgttgctgtttgaattgatgagaaatggaagatgagaactccctaagagttctcataataaatcatctcatcacaaatcaatacggtatacagagttaaagtggaatgaggtaagaagatacagctacagaaaatagttgcgtgtatgggagaacagtcattgtaattgggtagttttgttaataaatatttttaaatcttgcttttcagaaattaccgaatgtgtataaacaaataaagaaaaataatttagctgtgttttagacagcattagaatatattgttcagcacagtaaaatatatttgaaatttgataagccaaaaatgtggttttgaatgaatattttgtgaatctttcttaaaagctcaaatttgtagacttctaaatagaataaacacttgcagcaga

SEQ ID NO: 371524 - DNA, 2784 bp, Homo sapiens
cgcggctgaagcgagggcggggagggaaagcgagcggcgcctgcgccccggcggtggacgggcccggtcgtgggcggggattggggcggagcctgaccgttacgcgcagccccgcccccgcggcctcgtcgctcctgctgaggcggtagccgcttttcgtcgactcttaccggttggctgggccagctgcgccgcggctcacagctgacgatgggggaccccagcaagcaggacatcttgaccatcttcaagcgcctccgctcggtgcccactaacaaggtgtgttttgattgtggtgccaaaaatcccagctgggcaagcataacctatggagtgttcctttgcattgattgctcagggtcccaccggtcacttggtgttcacttgagttttattcgatctacagagttggattccaactggtcatggtttcagttgcgatgcatgcaagtcggaggaaacgctagtgcatcttccttttttcatcaacatgggtgttccaccaatgacaccaatgccaagtacaacagtcgtgctgctcagctctatagggagaaaatcaaatcgctgtggcttgatagttgtgtggttccacctttgtcccctccaccaaaggaggaagatttttttgcctctcacgtttctcctgaggtgagtgacacagcgtgggcatcagcaatagcagaaccatcttctttaacatcaaggcctgtggaaaccactttggaaaataatgaaggtggacaagagcaaggaccaagtgtggaaggtcttaatgtaccaacaaaggctactttagaggtatcctctatcataaaaaagaaaccaaatcaagctaaaaaaggccttggggccaaaaaaggaagtttgggagctcagaaactggcaaacacatgctttaatgaaattgaaaaacaagctcaagctgcggataaaatgaaggagcaggaagacctggccaaggtggtatctaaagaagaatcaattgtttcatcattacgattagcctataaggatcttgaaattcaaatgaagaaagacgaaaagatgaacattagtggcaaaaaaaatgttgactcagacagactcggcatgggatttggaaattgcagaagtgttatttcacattcagtgacttcagatatgcagaccatagagcaggaatcacccattatggcaaaaccaagaaaaaagtataatgatgacagtgacgattcatattttacttccagctcaaggtactttgacgagccagtggagttaaggagcagttctttctctagctgggatgacagttcagattcctattggaaaaaagagaccagcaaagatactgaaacagttctgaaaaccacaggctattcagacagacctactgctcgccgcaagccagattatgagccagttgaaaatacagatgaggcccagaagaagtttggcaatgtcaaggccatttcatcagatatgtattttggaagacaatcccaggctgattatgagaccagggcccgcctagagaggctgtcagcaagttcctccataagctcggctgatctgttcgaggagccgaggaagcagccagcagggaactacagcctgtccagtgtgctgcccaacgcccccgacatggcgcagttcaagcagggagtgagatcggttgctggaaaactctccgtctttgctaatggagtcgtgacttcaattcaggatcgctacggttcttaatactgaagtcatgatgtgtatttcctggagaaattcctctttaaatgaacaagtaaccacatctcaggcggcagtgaagtccagatagttttgcagattgttttgctactttttcatatggtatatgtttctgatttttaatatttcttttgagaaattctgagttctgatgtaggagctttcctgtgatttctgtttcacgttccttcctgtcacaccctcctttggcgtctctgtgtatatccttgctttattttcttggaacctttgatttcaacactgagggcctggagacctcggctcctcctgctcctgaaccaggaggcttcatgtgggggaggaggagaggtctccatgtgacacatgggctcagggctgccagaatcagcggatgctggatgggcctgcagaaacaacactcaccacacacacttccttcaaaagaccaaaagtgactggtgtctcgtgtgacagattgcttcatttatgtttctacatagtaaggtgactgccaaataatatttgaagtcatctgtctctttgtaaattattttatatgacctataaatttaaaaatgtttttcagtgagtgcttttaacaaacttaagcttctgccctgccaagggaattaatgttatcttgtgaaaggtgttgctgtttgaattgatgagaaatggaagatgagaactccctaagagttctcataataaatcatctcatcacaaatcaatacggtatacagagttaaagtggaatgaggtaagaagatacagctacagaaaatagttgcgtgtatgggagaacagtcattgtaattgggtagttttgttaataaatatttttaaatcttgcttttcagaaattaccgaatgtgtataaacaaataaagaaaaataatttagctgtgttttagacagcattagaatatattgttcagcacagtaaaatatatttgaaatttgataagccaaaaatgtggttttgaatgaatattttgtgaatctttcttaaaagctcaaatttgtagacttctaaatagaataaacacttgcagcaga

SEQ ID NO: 371525 - DNA, 1657 bp, Homo sapiens
cgcggctgaagcgagggcggggagggaaagcgagcggcgcctgcgccccggcggtggacgggcccggtcgtgggcggggattggggcggagcctgaccgttacgcgcagccccgcccccgcggcctcgtcgctcctgctgaggcggtagccgcttttcgtcgactcttaccggttggctgggccagctgcgccgcggctcacagctgacgatgggggaccccagcaagcaggacatcttgaccatcttcaagcgcctccgctcggtgcccactaacaaggtgtgttttgattgtggtgccaaaaatcccagctgggcaagcataacctatggagtgttcctttgcattgattgctcagggtcccaccggtcacttggtgttcacttgagttttattcgatctacagagttggattccaactggtcatggtttcagttgcgatgcatgcaagtcggaggaaacgctagtgcatcttccttttttcatcaacatgggtgttccaccaatgacaccaatgccaagtacaacagtcgtgctgctcagctctatagggagaaaatcaaatcgctcgcctctcaagcaacacggaagcatggcactgatctgtggcttgatagttgtgtggttccacctttgtcccctccaccaaaggaggaagatttttttgcctctcacgtttctcctgaggtgagtgacacagcgtgggcatcagcaatagcagaaccatcttctttaacatcaaggcctgtggaaaccactttggaaaataatgaaggtggacaagagcaaggaccaagtgtggaaggtcttaatgtaccaacaaaggctactttagaggtatcctctatcataaaaaagaaaccaaatcaagctaaaaaaggccttggggccaaaaaaggaagtttgggagctcagaaactggcaaacacatgctttaatgaaattgaaaaacaagctcaagctgcggataaaatgaaggagcaggaagacctggccaaggtggtatctaaagaagaatcaattgtttcatcattacgattagcctataaggatcttgaaattcaaatgaagaaagacgaaaagatgaacattagtggcaaaaaaaatgttgactcagacagactcggcatgggatttggaaattgcagaagtgttatttcacattcagtgacttcagatatgcagaccatagagcaggaatcacccattatggcaaaaccaagaaaaaagtataatgatgacagtgacgattcatattttacttccagctcaaggtactttgacgagccagtggagttaaggagcagttctttctctagctgggatgacagttcagattcctattggaaaaaagagaccagcaaagatactgaaacagttctgaaaaccacaggctattcagacagacctactgctcgccgcaagccagattatgagccagttgaaaatacagatgaggcccagaagaagtttggcaatgtcaaggccatttcatcagatatgtattttggaagacaatcccaggctgattatgagaccagggcccgcctagagaggtatcctctatcataaaaaagaaaccaaatcaagctaaaacaggccttggggccaaaaaaggaagtttgggagctcagaaactggcaaaccatgcttttat

SEQ ID NO: 371526 - DNA, 2342 bp, Homo sapiens
cgcggctgaagcgagggcggggagggaaagcgagcggcgcctgcgccccggcggtggacgggcccggtcgtgggcggggattggggcggagcctgaccgttacgcgcagccccgcccccgcggcctcgtcgctcctgctgaggcggtagccgcttttcgtcgactcttaccggttggctgggccagctgcgccgcggctcacagctgacgatgggggaccccagcaagcaggacatcttgaccatcttcaagcgcctccgctcggtgcccactaacaaggtgtgttttgattgtggtgccaaaaatcccagctgggcaagcataacctatggagtgttcctttgcattgattgctcagggtcccaccggtcacttggtgttcacttgagttttattcgatctacagagttggattccaactggtcatggtttcagttgcgatgcatgcaagtcggaggaaacgctagtgcatcttccttttttcatcaacatgggtgttccaccaatgacaccaatgccaagtacaacagtcgtgctgctcagctctatagggagaaaatcaaatcgctcgcctctcaagcaacacggaagcatggcactgatctgtggcttgatagttgtgtggttccacctttgtcccctccaccaaaggaggaagatttttttgcctctcacgtttctcctgaggtgagtgacacagcgtgggcatcagcaatagcagaaccatcttctttaacatcaaggcctgtggaaaccactttggaaaataatgaaggtggacaagagcaaggaccaagtgtggaaggtcttaatgtaccaacaaaggctactttagaggtatcctctatcataaaaaagaaaccaaatcaagctaaaaaaggccttggggccaaaaaaggaagtttgggagctcagaaactggcaaacacatgctttaatgaaattgaaaaacaagctcaagctgcggataaaatgaaggagcaggaagacctggccaaggtggtatctaaagaagaatcaatgtaagtttaatttcattatattaatacattttcagggaataaaactattaactcaagattttgctttccaaatgccatgtatttttgtgtggggggggaagggagggtactgcaaaattcagttttatgaaaactgatattgcattggcatgtggattggaagggaaagagacgatgggggcagcaacactctgctgaggctgtaagggcagactggagtgacatcagtgagaagggaaagacagagatgcatggaggtgtttacacatgaaacatgcttcacattattagagttggggaaatgcaaatcaaggccacagtaagataccactgtgtactctctagggaagctataataaaaaaatcagtaacaggtgttggctaggatgtggagaaatttgaacccttgtacattgctgatggcaatgtgaaatggtgccactgttgtgaaaaacagtttggcagtccttcagaaagttaaatgtaaagtttccatgtgacccagcaaatctactcctaagtatatactcaagagaaattaaaacttacatctgtgcaaccacacacaaactcgtgcatgaatgttcatagtggcgttaatcctaatagccaaaaagtagaaataagctaaatgtctaccaactgataaatgagaaagaaaatgtggtatgtccatacaatggactattactcagccacaaaaaggaatgtagtcctgatattggccacaacatggataaaccttgaaaagtttatgctaagaaagaagccagtcataaaagatcacatgatatgattctgtctatatgcaatgtccagaataggcaaatccgtagagacagaaagcaacttactggttgccagggcctggggtgaggagagaatggagagtggctgctaatggtccaggcctgctttttggactgctgaaagtgttctggagttagtggtgatgatggcacagctttgtgaatgtgctgaaaccactgaatcatgcactttaacagggtgagttttacggtatgtgaattatatctgcataatgaaaaaagtatttataatctgaagccctgttggactctgtgactaaattctaaatacatgatggaagactatggctctggtcgtgtctccagaggttctgagcctggatcttggagagggagaaggaagagtttcagagaatgaagaaggtggaatgatcgtgtgtgtcgggggcctgcctgaagtggaggagttggaacgataatgtggagcaccttaaagtcaggctgtggttgtccacttacccaagagaaacagctccttcagcagtgctgt

SEQ ID NO: 371527 - DNA, 2230 bp, Homo sapiens
cctcgccactccagctgcgcctccggctgcagcgcacacgtctcctgcgcctcctcctccggagcgtcgctgtccgtcgggttcatccctcgcagcagtctccaggcgagagagggggccagagtgctcgcacttctcctaggggcaccatgcccaacgacgaggcattcagcaagccctctacaccgtcggaagcccctcacgcccccggggtaccgccgcagggcagagccgggggctttggcaaagcgtctggggcgctagtgggggcggccagcggctcgagcgccgggggcagcagcagaggaggcggctccggctccggggcgtcggacctgggtgccgggagcaagaagtccccgcggctgcccaagtgcgcacgctgcaggaaccacggctacgcctcgccgctcaagggccacaagcgcttctgcatgtggcgcgactgccagtgcaagaagtgcaacctgatcgccgagaggcagcgcgtgatggccgcgcaggtggccctgagaaggcagcaggcccaggaggaggaattgggtatcagccaccccatcccactgcccagtgcggccgagctgcttgtcaaaagagagaacaatggcagtaacccgtgcctcatgactgagtgcagtggcacctctcagccaccgccggccagtgtccccaccactgcagcttcagagggacgtatggtcatccaggatattcctgctgtcaccagcagagggcatgtggagaacacacctgacctggtttcagactccacctactacagcagcttctaccagccgtctctgtttccttattacaacaatctatacaactgcccgcagtactccatggccttggctgctgattctgcttctggggaggtgggaaatcccctcgggggatcccctgtgaagaacagccttcggggcctccccggaccttatgtgcctggtcagacaggaaaccagtggcagatgaagaacatggagaaccgccatgcaatgagctcccagtacaggatgcattcttactacccgcctccctcttacctgggccagagcgtgccccagttcttcacttttgaggatgctccctcttacccggaagccagggcgagcgtattctcgccgcccagcagtcaagattctggcttggtttccctctcgagcagctctcctattagtaacaagagcacaaaggcagtgcttgaatgtgagcctgcgtcggagcccagcagcttcacagtcactcccgtcatcgaggaggacgagtgagcagtgcctgctgccgatggcggttcacttggagtaacaggcttattccactttccatggggtttgttaatattttgcatggactcatactatcttaactgttgagaacgtatttggtttatattccttagagtttagtccagaggctgtaacacatttgtaatactttagggtccgtgactaccatctgcatggtttaagtgctttactcacggagtttaaataatagtgttcatttttttaatgacactggtttcatgtagttttcaagaaataaaagaattcattcaagtgaagccatttgtgtgcctctaaatgagtcatctaattagatgttacttttagttttaaaatgaaatcttaggtgccttaggggtttttttttttttttaagtattttttaaaaacctgcaaagatataaatttagccaagttacctgacgggtgagaagaaaagagcaggcaaaattagtgatttttttagaagtctgctaaatggatatattgggtgtgttgctgttggaaatagccccaccccatcctcccaatccaaaacgtaactgaaatataatcagaaacattaaagcctgtaaaaaaaaattgctgcgtttttggtaaagggtgtaatttgtaaacagtgcaatttaaagtgaccttagtgatgcagagttcctgagtggtgtttgtagaatgagtttatcatacattctttctactactggaaaaaaatggatgcagtctggactgttgtaaccttaggttgtaatctgatttggaaataagtacatctttaaaagttgctacagatttgagttcatgattttgttaaaaattgctatggagtactttgttatataacagaagccatcctgaaatgaaactagtctaaaaaaattcattgttctacttagttgcagctgtacctgaaataaaaatgttattgatgactgaaaaaaaaa

SEQ ID NO: 371528 - DNA, 1167 bp, Homo sapiens
aggggaggtgggtaagtatgaggaagagaagggagaacaaccaaaaggttatgtattctcgccgcccagcagtcaagattctggcttggtttccctctcgagcagctctcctattagtaacaagagcacaaaggcagtgcttgaatgtgagcctgcgtcggagcccagcagcttcacagtcactcccgtcatcgaggaggacgagtgagcagtgcctgctgccgatggcggttcacttggagtaacaggcttattccactttccatggggtttgttaatattttgcatggactcatactatcttaactgttgagaacgtatttggtttatattccttagagtttagtccagaggctgtaacacatttgtaatactttagggtccgtgactaccatctgcatggtttaagtgctttactcacggagtttaaataatagtgttcatttttttaatgacactggtttcatgtagttttcaagaaataaaagaattcattcaagtgaagccatttgtgtgcctctaaatgagtcatctaattagatgttacttttagttttaaaatgaaatcttaggtgccttaggggtttttttttttttttaagtattttttaaaaacctgcaaagatataaatttagccaagttacctgacgggtgagaagaaaagagcaggcaaaattagtgatttttttagaagtctgctaaatggatatattgggtgtgttgctgttggaaatagccccaccccatcctcccaatccaaaacgtaactgaaatataatcagaaacattaaagcctgtaaaaaaaaattgctgcgtttttggtaaagggtgtaatttgtaaacagtgcaatttaaagtgaccttagtgatgcagagttcctgagtggtgtttgtagaatgagtttatcatacattctttctactactggaaaaaaatggatgcagtctggactgttgtaaccttaggttgtaatctgatttggaaataagtacatctttaaaagttgctacagatttgagttcatgattttgttaaaaattgctatggagtactttgttatataacagaagccatcctgaaatgaaactagtctaaaaaaattcattgttctacttagttgcagctgtacctgaaataaaaatgttattgatgactgaaaaaaaaa

SEQ ID NO: 371529 - DNA, 1148 bp, Homo sapiens
ggagcagatggtgggggggtggggaacaaaaagacttgtttaacgccgccacgtcaagattctggcttggtttccctctcgagcagctctcctattagtaacaagagcacaaaggcagtgcttgaatgtgagcctgcgtcggagcccagcagcttcacagtcactcccgtcatcgaggaggacgagtgagcagtgcctgctgccgatggcggttcacttggagtaacaggcttattccactttccatggggtttgttaatattttgcatggactcatactatcttaactgttgagaacgtatttggtttatattccttagagtttagtccagaggctgtaacacatttgtaatactttagggtccgtgactaccatctgcatggtttaagtgctttactcacggagtttaaataatagtgttcatttttttaatgacactggtttcatgtagttttcaagaaataaaagaattcattcaagtgaagccatttgtgtgcctctaaatgagtcatctaattagatgttacttttagttttaaaatgaaatcttaggtgccttaggggtttttttttttttttaagtattttttaaaaacctgcaaagatataaatttagccaagttacctgacgggtgagaagaaaagagcaggcaaaattagtgatttttttagaagtctgctaaatggatatattgggtgtgttgctgttggaaatagccccaccccatcctcccaatccaaaacgtaactgaaatataatcagaaacattaaagcctgtaaaaaaaaattgctgcgtttttggtaaagggtgtaatttgtaaacagtgcaatttaaagtgaccttagtgatgcagagttcctgagtggtgtttgtagaatgagtttatcatacattctttctactactggaaaaaaatggatgcagtctggactgttgtaaccttaggttgtaatctgatttggaaataagtacatctttaaaagttgctacagatttgagttcatgattttgttaaaaattgctatggagtactttgttatataacagaagccatcctgaaatgaaactagtctaaaaaaattcattgttctacttagttgcagctgtacctgaaataaaaatgttattgatgactgaaaaaaaaa

SEQ ID NO: 371530 - DNA, 1722 bp, Homo sapiens
cctaaagaaaagtattaagtaaatagcagtacagatggcaaatggattgcacaatatatcctctggatccatagtgaccctgcagagataaacctgtgatggtcaaacaatgtgaaaactgctgtcagagacatgggcagggtgctcttgtttacagagaagaggtgcaaaaatcaacttgatggtagtgggaagatcaggaaatgcttcctgaaattgagtattaagaactaatagacattaggtggttgcagaataagttttgtttaggaaggacaagcagttgggtatgactggcttctaggttgtgtgttgtggagtgactggggataaaagcaggagcaagatcacaaaaggtcttctatgcttatattagggaagttggactttattctcaagctgaagggaagctgttgcatggttttaagcagtaaagtgatatgatcagagttttagaggatgccaagattgaaggcaagtctgaccagttaggagactgcttgttaaattagttcagaggagaaacagtgaaggcagtggcactgggcatgaagaagtatatgtgtgctaattttagatttcttagggaagcagaaatgacaagagttagtggtccattggacagaaatattgaaggagactggggagtctaggttgactcccagggtttaggtttgggcagtaaaatgacatgtagaacaattaactgataaacagcatacagaaagaggaaagaacttcatttcatatgtttgtttttgaggaaaagatgtttgtttttgaacttcctgattcagaggggcttgtgggacatcttggttaagatcctgtagtagttctagtagggtctagaagtcaagagatacaaccccgcctggaaggatttgggagtcttcagcatttggaattttggaagccattgtttactgcagtgcatatgagataatttaaactggtacatagataaacacttgaaaaaattttaatagataggaatttaatgtgtatgagaaacataacttgcacatctaacctttgataatcatggacattatcacttaggccaagtgagctcaataaaagggaaatattaactaaaaatatatgtgatacatggaaatggcaaaaatcacggtgaagctatgcaaacgatgcaagttcagaaagtgctgtgttaagtcatgggtgtggtggataaattcacccaaggagagagtaagagcgagaagaaaagagagttgacattgggtggcggggaatggagaagaagaacccatgaaggaaactgaggaagagcagccagacgaataggaggaaaaccaggagaagatggtctttggagtccaaatgaagagttctgaggaggaagtggtccacagcgtcaagtaagttgtaagctgaaaagtgctctttggatttagcaattaaggtagactatttagctggaagcatccaaacagtggattttaaaaatactcatctaacattaatgttaatgatagctggtatttatagcatttcccatatacctggtactcttctaagctctttacatgtattaacagattgatcaggtaggtagtattgttatccccatttgatatgcgaggaaacacagaggaagcacagagaggttaagtaacttgcccaagatcacacacccaaggaaacaagagagccaggactcaagcccagagtcttggctgcagagtccctgttctt

SEQ ID NO: 371531 - DNA, 483 bp, Homo sapiens
cctcgctaccatatggttggacgattcatcaaatgtattcgtcccagtaagcttgagatctttggtgacttttgaagggagtgaaaataccattttacatctttaatgcctttttcataattatgactttagatttctagaagctctcaatcactttgagaaagcaagaaccttgatttatcgtcttcctggagtgttaacttggcccacgagtaatgtgattattgaagagtctcagccacaaaaaataaagatgctgttagagaaatttgttgaagaatgcaagttccctccagtgccagatgccatttgttgctatcagaagtgccatggatattctaagatccagatatacataactgatccagactttaaggtaaataatgagtgtacagtgggacattaacttgcaaaatcatttcttaaaatgggctcaaaacaatctgtaattggaggcacccaagttctctggctagttagcag

SEQ ID NO: 371532 - DNA, 300 bp, Homo sapiens
atcaagttctgatgattctgtcatgcttcatttaaggagaaatgggaaagtggtttgaatgtttaagttttaacctttaaaatagtttcaggctgtcatttgtaaaatactcatatgtcttctgatctactggcaggtatccgtacttgaaaactggaaggagagtgaagtgtataagctacagatcatggagtcacaagcagaagcctttctgaagaagctggggctgattagccggtattgcagtttcgtgggtgttctcagcacgtcatttagaagataaagctaggaccatttgag

SEQ ID NO: 371533 - DNA, 9359 bp, Homo sapiens
  misc_feature (9128)..(9128): n is a, c, g, or t
  misc_feature (9192)..(9193): n is a, c, g, or t
  misc_feature (9246)..(9246): n is a, c, g, or t
  misc_feature (9253)..(9253): n is a, c, g, or t
  misc_feature (9291)..(9291): n is a, c, g, or t
  misc_feature (9327)..(9327): n is a, c, g, or t
cctaaagaaaagtattaagtaaatagcagtacagatggcaaatggattgcacaatatatcctctggatccatagtgaccctgcagagataaacctgtgatggtcaaacaatgtgaaaactgctgtcagagacatgggcagggtgctcttgtttacagagaagaggtgcaaaaatcaacttgatggtagtgggaagatcaggaaatgcttcctgaaattgagtattaagaactaatagacattaggtggttgcagaataagttttgtttaggaaggacaagcagttgggtatgactggcttctaggttgtgtgttgtggagtgactggggataaaagcaggagcaagatcacaaaaggtcttctatgcttatattagggaagttggactttattctcaagctgaagggaagctgttgcatggttttaagcagtaaagtgatatgatcagagttttagaggatgccaagattgaaggcaagtctgaccagttaggagactgcttgttaaattagttcagaggagaaacagtgaaggcagtggcactgggcatgaagaagtatatgtgtgctaattttagatttcttagggaagcagaaatgacaagagttagtggtccattggacagaaatattgaaggagactggggagtctaggttgactcccagggtttaggtttgggcagtaaaatgacatgtagaacaattaactgataaacagcatacagaaagaggaaagaacttcatttcatatgtttgtttttgaggaaaagatgtttgtttttgaacttcctgattcagaggggcttgtgggacatcttggttaagatcctgtagtagttctagtagggtctagaagtcaagagatacaaccccgcctggaaggatttgggagtcttcagcatttggaattttggaagccattgtttactgcagtgcatatgagataatttaaactggtacatagataaacacttgaaaaaattttaatagataggaatttaatgtgtatgagaaacataacttgcacatctaacctttgataatcatggacattatcacttaggccaagtgagctcaataaaagggaaatattaactaaaaatatatgtgatacatggaaatggcaaaaatcacggtgaagctatgcaaacgatgcaagttcagaaagtgctgtgttaagtcatgggtgtggtggataaattcacccaaggagagagtaagagcgagaagaaaagagagttgacattgggtggcggggaatggagaagaagaacccatgaaggaaactgaggaagagcagccagacgaataggaggaaaaccaggagaagatggtctttggagtccaaatgaagagttctgaggaggaagtggtccacagcgtcaatgtgcaccatggacaattttgctgagggagatttcactgtggcggattatgccttgttagaagattgccctcacgtggatgattgtgtctttgctgctgaatttatgagcaatgattatgttcgtgtgactcagctttactgtgatggggtgggtgtgcaatataaagattatatccaaagtgagaggaatttggaatttgacatctgcagtatatggtgtagtaaaccaatttctgtcctgcaagattattgcgatgccattaaaataaacatcttctggccacttctgtttcaacatcaaaacagttccgtaatatcacgattgcatccctgtgtggacgccaacaattcacgtgcttctgagataaatttgaagaaactacaacatcttgagttgatggaagatattgtggatttggcaaagaaagttgctaatgattcattccttattggaggcttattgagaattggttgtaaaatagaaaataaaatcttggcaatggaagaagctctgaattggataaaatatgcaggcgatgtaacaattctaactaaattaggatcaattgacaattgttggcctatgttaagtattttctttactgaatacaagtaccacataactaaaattgtaatggaagactgcaatttgcttgaagaacttaaaactcaaagttgtatggattgtatagaggaaggagaactaatgaaaatgaaaggaaatgaagagttttccaaagaaagatttgatatagctattatctattacaccagagccattgaatatagacctgaaaactaccttctttatggtaaccgagctctttgttttcttcgtactggacagtttagaaatgcactcggtgatggaaagagagccactattctgaagaacacttggccaaagggtcattatcgttattgtgatgctctttctatgctgggggaatatgactgggccctgcaagcaaacataaaagctcaaaaactctgtaaaaatgaccctgagggaatcaaggatctaattcagcagcatgtaaagttacaaaaacaaatagaagacctacaaggtcgaacagcaaataaggatccaattaaagccttttatgaaaacagggcctacacacctaggagtttatcagcacctatatttactacttcacttaactttgtggagaaggaaagagatttcagaaaaattaatcacgaaatggccaacggtggtaatcagaatctaaaggtggcggatgaggcgttgaaggtagatgattgtgactgtcatcctgaattttcaccaccatcaagtcagcctccaaaacataaaggaaaacaaaaatctcgaaacaatgaatcagaaaagttcagttctagttcaccattgactttaccagcagatttgaagaacatcttggagaaacagttttctaaatcttccagagctgcacaccaggattttgctaatataatgaaaatgctgagaagcttaattcaagatggctatatggccttattggagcagcgttgccgcagcgctgcacaggcctttacagagttgctgaacggtttagatcctcaaaaaataaagcaattgaacctggccatgattaactatgttttggtcgtctatggacttgccatttctctccttggaataggacagcctgaggaattatctgaagccgaaaaccagtttaagaggattattgaacactaccccagtgagggccttgattgcttggcctactgtggaattggaaaagtgtatttgaaaaaaaacagatttctagaagctctcaatcactttgagaaagcaagaaccttgatttatcgtcttcctggagtgttaacttggcccacgagtaatgtgattattgaagagtctcagccacaaaaaataaagatgctgttagagaaatttgttgaagaatgcaagttccctccagtgccagatgccatttgttgctatcagaagtgccatggatattctaagatccagatatacataactgatccagactttaagggttttatacgcatcagctgttgccagtactgtaaaatagaatttcacatgaattgctggaagaagttaaaaactacaacctttaatgataaaattgacaaggattttctacaaggaatatgtcttacccctgactgtgaaggtgtcatttctaagattatcatcttcagcagtggtggtgaagttaaatgtgaatttgaacacaaggtcataaaagaaaaggttcctccaagacctattctgaaacagaaatgttctagcctagagaaactaagactgaaagaagacaaaaaattgaagagaaagatccaaaaaaaagaagcaaaaaagttagcacaagaaagaatggaggaggacttaagagaaagtaatccacccaaaaatgaagagcagaaagaaactgtagacaatgttcagcgttgtcagttccttgatgacagaattctacagtgtataaagcagtatgctgacaagattaaatccggcatacagaatacagccatgcttctcaaagaattgctttcttggaaagttttgagcacagaagactatacaacctgtttttctagcagaaattttctaaatgaagcagtggactatgttattcgccacttgattcaagaaaataacagagtaaagacaagaatatttctgcatgttttgagtgagcttaaagaagtggagcccaaattagccgcctggatccaaaaacttaatagctttggcttagatgccacaggaactttcttttctcgttatggagcatctcttaaactgcttgattttagtatcatgactttcctctggaatgagaaatatggtcacaaactagactctatagaaggaaagcaacttgattatttctctgagccagcatcattgaaggaagcccgttgtttaatatggctgctagaagaacacagagacaagttcccagcattgcatagtgctttagatgaattctttgatataatggacagccgctgtactgtgttaaggaaacaagatagtggtgaagcaccgtttagttcaaccaaggtgaaaaacaaaagcaagaaaaagaagccaaaggattcaaagcctatgttagttgggtctggaacaacttcagtaacttcaaataatgagatcatcacttcaagtgaagaccatagcaatcgaaattcagattctgcaggcccatttgcagtgcctgaccatcttcggcaagatgtagaagaattcgaagctctctatgaccaacacagtaacgaatatgttgtccgcaataagaagctatgggacatgaacccaaaacaaaaatgttcaactctatatgattacttctctcagtttttggaggaacatggtcccttggacatgagtaacaagatgttctctgcagaatatgagtttttcccagaagaaactcgacagatactagaaaaagcaggaggtttaaaaccttttctcttgggatgccctcgttttgttgtgattgacaactgtattgcactgaagaaggttgcatcacggctcaagaaaaaaaggaagaagaaaaacattaaaacaaaagtagaagaaatttcaaaagcaggggagtatgtacgagttaaactacaactgaatccagctgctagggaatttaaaccagatgtaaagtctaaaccagtgtcagattcatcttcagcaccagcttttgaaaatgtgaaacccaaacctgtgtctgcaaattctcccaagccagcttgtgaagatgtgaaggccaaaccagtatccgacaattcttctagacaagtttctgaggatgggcaacccaaaggggtctcttctaattctcctaaaccaggctctgaggatgcaaattacaagcgagtctcctgtaattcccccaaaccggttcttgaggatgtgaaaccaacttattgggctcaatcccatttggtcacaggatactgtacgtatcttcctttccagagatttgatatcacccagacaccgccagcatacataaacgtgttaccaggtttgccccagtacaccagcatatatacacccttggccagcctttctcctgaatatcagctaccaagatcagtaccagtggtgccgtcttttgtagccaatgacagagcagataaaaatgctgctgcctattttgagggtcatcatttgaatgctgagaatgttgctggtcaccagattgcctctgaaacacagatccttgagggctctttgggaatatctgtaaagtcacactgcagcacaggtgatgctcatacagtcctgagtgagtctaacagaaatgatgagcactgtggaaattctaacaacaaatgtgaagtaattccagaaagcaccagtgcagtaacaaacattccacacgtgcagatggttgccatacaggtatcttggaacataatacaccaagaagtcaatactgagccatataatccttttgaggaacgacaaggggaaatttcacggattgaaaaggagcaccaagtattacaagaccaacttcaagaagtgtatgaaaattatgagcagataaaacttaagggcttagaagagaccagggacctggaagagaagttgaaaaggcacttagaagaaaacaagatctcaaagacggaattagattggttccttcaagatttggaaagagaaattaaaaaatggcaacaggaaaaaaaagaaatccaagaaagactaaaatcactgaagaagaaaattaaaaaggtttcaaatgccagtgaaatgtatacccagaaaaatgatggaaaggaaaaggaacatgaattacatctggatcagtcccttgaaatcagcaacacacttacaaatgagaaaatgaaaatagaagagtatataaagaaagggaaagaggattatgaagagagtcatcagagagctgtggctgcagaggtatccgtacttgaaaactggaaggagagtgaagtgtataagctacagatcatggagtcacaagcagaagcctttctgaagaagctggggctgattagccgtgatcctgcagcatatcctgacatggagtctgatatacgttcatgggaattgtttctttctaatgttacaaaagaaattgagaaagcaaagtctcagtttgaagaacaaattaaggcaattaaaaatggttctcggctcagtgaactttctaaagtgcagatttctgagctttcatttcctgcctgtaacacggttcatcccgagttactccctgagtcttcaggccacgatggccaagggcttgtgacttctgcaagcgacgtgactggaaaccacgcagcacttcacagggatcctagtgtgttctctgctggtgattccccaggggaggctccttctgcgctgttgccagggccaccccctggtcagcctgaagccactcagctgacagggccaaaacgggctggccaggcagctctgtcagaacgaagccctgtggctgatcggaagcagcctgttcctccaggacgtgctgcgcgttcaagccagtctccaaaaaagccgttcaatagtattattgagcacctgtcagtggtattcccatgttacaacagcactgagcttgctggttttattaaaaaagtgcgaagcaaaaacaagaactcactctcaggattgagtattgatgaaattgtccaaagagtgacagaacacattctagatgaacagaaaaagaaaaagccaaacccaggaaaggacaagaggacttatgagcccagctctgccacccccgtgaccaggtcctcccagggctcaccctcggtggttgttgcaccatcacccaaaaccaaggggcagaaagcagaagatgtccctgtgaggattgcactgggtgcaagttcctgtgaaatatgccacgaggtgttcaaatcaaaaaacgtgcgtgtgctcaaatgtgggcacaagtatcacaaagggtgctttaagcagtggcttaaagggcagagcgcttgcccggcctgccagggtcgtgatctcctgacagaagagtcaccttctggaagaggctggcccagtcagaatcaggagctgccttcctgctcttctaggtagtcacacttcactaaagtgtcatccaccagtgtgttgaatccgaagaatgacaattttctaccactggtgtaaaaaacaaacatttgaagacccttgtgcattgtgtgtcacaaagctaaatacatggaaatcgttaatatcgctgatattaagtaatttccccactctgagtgaatactttgatgattgccaacagtggctaataaaatgacggctaccacactcatgggtcactggggctgcgcagggctctttgaggtgggtggcttcttttggaaagtactatgaacgtctcgaagcagtattctagtgataagaattcttaacatagccaagcgccccacgtttgttccccacgtttgttccccttttctgtttgaaaaacctgttctggtagctccacaagagagatgatactgactttttaaattttttacaagagtctgtattcctgatatgcctatatttttcctcaaagattctgcattttaaggatgggcataagcaaactatattttaataatttatagttaatgttaaaatattggctgatttagaccaaaagattcaaatctcctctttgtgaaatcccatctgcatttgattttttattattttatgttcccccgttagattgttttaagtgtttgcttttcatcttttatagatgtaatctgattttcaaaaatcattaacactttttaattagtatcgactaagactttttccccctggaatcgaggctgtgtgtccgtcatcccagcccccggttggagcctgctctttgaactccgctgccttccttagcagcttctgtcctcttctgtgagtcagtcagcgagtgcttgggatccgcatccagccgtgctgagcacacaacaggctgtgtgtggaaatggccaccaccattctccttccccaccccaccacaaaaagagaagctgtgtctttagacaaccctgaggtatctgtgttacaatcgttctgtgtttgatatttgtgtaaagtatgcatgcagtcttgtactgtgacctaagaacaaaactgtaactgcattagaaaccatgaaaaaattagatattgttttgtgacttttagacagtggtaaatatagaaccatgaattctggtcacattccatttctctccaacatgaaggatcaaaaaatgtttttcaatgtgttctttgttccactggaaacttagagtcatgagtttatgagctgatttggtcaccttcctctgcctttgttcactgtgagttctgatgtcttagtgacttagttcttagaagctcacgccttagtttgaaacagattctccacggtggtccccaaaacactgtctgcatatccataagaattgagcgctatgggtgttaacgtgcatgaggatcagtttgcagcagcaagtacaaaaggagaagaggaacatccgttgaatgagtgtgttttgtacataacttcagatacttgtgaacatgccttatatttgtccaacaactgtcagaataaagaacattctaaaatgagaaaaaaaaaaaaaaaaaaaaaaaaaaaaaaaaaaaaaaccaacgccattgctcagctaacggccacgcttcaacctggtgatgccccggcatactttccagcatagagcgcggaataagcgcaatngcctgctctgcgatcacacaggccaacattccgtgataagactccatctcatggatagttcccnngagcgcaccgtcagcatgaaaccagctctcgaagtgcgacgatccgacaattngcgccgnaggccataaatgtacttgcataacctgactggcacggnttactggcccatatccttgggcgtgaccatcataanttccttccgtattacccgtattccctcgatgg

SEQ ID NO: 371534 - DNA, 9072 bp, Homo sapiens
ctgaactagttgccagtgatcttgaaacgtgacagtaaccaagagataaataggtgacaatgacaggaaaattagatgtagtaaaagagagtgtttgagagcagaagctatggcaactaaagactggatttgaatccttcctagcttggtgacatgagcaaattacttgatttaagtgagcattttcccatctgtacagtggagataacgataattgtgcctgctaagaagaattgctgtgaagattagtgaaataatgcatgtaaaacatttggtacagtatgtgacacatagtacaaatagtttgctaggaagattgttattattcttcacttgtgatattgtgaagttttcatacagcaaattggacatcatgagatggattgattaaataaatagatttgaacttcaaggactggtagtgttcttgctttggaaagaagaaacttggtttatcctaataatagtaggataataatggtgaagtgataggtacaagtaatagtgtttatgatgcgctggtgatgataggaaaagaaagccattatatgggcaagagctagaagtaataaaatggtgcatttttcagtgatgtttggcctatgtagctattctctgataactataaaaatccttattattgaagattcttcaggaaaaaaaaacccttagtctgaaactttagcaccaatcccccttgccccccattgaaatacgtatttttaaaacatggcttttgataatgtgagggttttttcctttttgcgatttagcagtgctgattgtgtattgcagtagttgtgagagcattagaagcagcagtcgataggaggatggaaggtctggatgccgccttggggagttaggagattggcagacttaccctgtaccactctagccctactcctttgcccaagacagaaacacactgagatggataggagaatatgagcagttgataggaaagttctcagtggagtcaggatttaggttaggccaggagattgagaatataacagtttgtgtatgatgaaatggcatatttcacagaatgcagtaaaagcaggtagggtacaagtgcagcaacaggaagatgtcttttcttcattcagcaaacacttatttgagagcttaccatgtgctaggcacatacaaagataaataagatgcccttgatgatcctctatttaaaggagacatgtaaacaggttaacttagagtagagatggtgaatatgtgaacctgaggaaaggaagaaatagattaaattatctggagagagaggaaaagtcagcagaatggggacgagaatctttcggagctcagtgttctgataggagttatttccttgggcataggttccaagtatttttctaatataccatagaagccaggaaaactttcttctgttatctcaaatgatttaattactgacttgagtttgtgttgtctccttagacttgtgcaccatggacaattttgctgagggagatttcactgtggcggattatgccttgttagaagattgccctcacgtggatgattgtgtctttgctgctgaatttatgagcaatgattatgttcgtgtgactcagctttactgtgatggggtgggtgtgcaatataaagattatatccaaagtgagaggaatttggaatttgacatctgcagtatatggtgtagtaaaccaatttctgtcctgcaagattattgcgatgccattaaaataaacatcttctggccacttctgtttcaacatcaaaacagttccgtaatatcacgattgcatccctgtgtggacgccaacaattcacgtgcttctgagataaatttgaagaaactacaacatcttgagttgatggaagatattgtggatttggcaaagaaagttgctaatgattcattccttattggaggcttattgagaattggttgtaaaatagaaaataaaatcttggcaatggaagaagctctgaattggataaaatatgcaggcgatgtaacaattctaactaaattaggatcaattgacaattgttggcctatgttaagtattttctttactgaatgaaggagaactaatgaaaatgaaaggaaatgaagagttttccaaagaaagatttgatatagctattatctattacaccagagccattgaatatagacctgaaaactaccttctttatggtaaccgagctctttgttttcttcgtactggacagtttagaaatgcactcggtgatggaaagagagccactattctgaagaacacttggccaaagggtcattatcgttattgtgatgctctttctatgctgggggaatatgactgggccctgcaagcaaacataaaagctcaaaaactctgtaaaaatgaccctgagggaatcaaggatctaattcagcagcatgtaaagttacaaaaacaaatagaagacctacaaggtcgaacagcaaataaggatccaattaaagccttttatgaaaacagggcctacacacctaggagtttatcagcacctatatttactacttcacttaactttgtggagaaggaaagagatttcagaaaaattaatcacgaaatggccaacggtggtaatcagaatctaaaggtggcggatgaggcgttgaaggtagatgattgtgactgtcatcctgaattttcaccaccatcaagtcagcctccaaaacataaaggaaaacaaaaatctcgaaacaatgaatcagaaaagttcagttctagttcaccattgactttaccagcagatttgaagaacatcttggagaaacagttttctaaatcttccagagctgcacaccaggattttgctaatataatgaaaatgctgagaagcttaattcaagatggctatatggccttattggagcagcgttgccgcagcgctgcacaggcctttacagagttgctgaacggtttagatcctcaaaaaataaagcaattgaacctggccatgattaactatgttttggtcgtctatggacttgccatttctctccttggaataggacagcctgaggaattatctgaagccgaaaaccagtttaagaggattattgaacactaccccagtgagggccttgattgcttggcctactgtggaattggaaaagtgtatttgaaaaaaaacagatttctagaagctctcaatcactttgagaaagcaagaaccttgatttatcgtcttcctggagtgttaacttggcccacgagtaatgtgattattgaagagtctcagccacaaaaaataaagatgctgttagagaaatttgttgaagaatgcaagttccctccagtgccagatgccatttgttgctatcagaagtgccatggatattctaagatccagatatacataactgatccagactttaagggttttatacgcatcagctgttgccagtactgtaaaatagaatttcacatgaattgctggaagaagttaaaaactacaacctttaatgataaaattgacaaggattttctacaaggaatatgtcttacccctgactgtgaaggtgtcatttctaagattatcatcttcagcagtggtggtgaagttaaatgtgaatttgaacacaaggtcataaaagaaaaggttcctccaagacctattctgaaacagaaatgttctagcctagagaaactaagactgaaagaagacaaaaaattgaagagaaagatccaaaaaaaagaagcaaaaaagttagcacaagaaagaatggaggaggacttaagagaaagtaatccacccaaaaatgaagagcagaaagaaactgtagacaatgttcagcgttgtcagttccttgatgacagaattctacagtgtataaagcagtatgctgacaagattaaatccggcatacagaatacagccatgcttctcaaagaattgctttcttggaaagttttgagcacagaagactatacaacctgtttttctagcagaaattttctaaatgaagcagtggactatgttattcgccacttgattcaagaaaataacagagtaaagacaagaatatttctgcatgttttgagtgagcttaaagaagtggagcccaaattagccgcctggatccaaaaacttaatagctttggcttagatgccacaggaactttcttttctcgttatggagcatctcttaaactgcttgattttagtatcatgactttcctctggaatgagaaatatggtcacaaactagactctatagaaggaaagcaacttgattatttctctgagccagcatcattgaaggaagcccgttgtttaatatggctgctagaagaacacagagacaagttcccagcattgcatagtgctttagatgaattctttgatataatggacagccgctgtactgtgttaaggaaacaagatagtggtgaagcaccgtttagttcaaccaaggtgaaaaacaaaagcaagaaaaagaagccaaaggattcaaagcctatgttagttgggtctggaacaacttcagtaacttcaaataatgagatcatcacttcaagtgaagaccatagcaatcgaaattcagattctgcaggcccatttgcagtgcctgaccatcttcggcaagatgtagaagaattcgaagctctctatgaccaacacagtaacgaatatgttgtccgcaataagaagctatgggacatgaacccaaaacaaaaatgttcaactctatatgattacttctctcagtttttggaggaacatggtcccttggacatgagtaacaagatgttctctgcagaatatgagtttttcccagaagaaactcgacagatactagaaaaagcaggaggtttaaaaccttttctcttgggatgccctcgttttgttgtgattgacaactgtattgcactgaagaaggttgcatcacggctcaagaaaaaaaggaagaagaaaaacattaaaacaaaagtagaagaaatttcaaaagcaggggagtatgtacgagttaaactacaactgaatccagctgctagggaatttaaaccagatgtaaagtctaaaccagtgtcagattcatcttcagcaccagcttttgaaaatgtgaaacccaaacctgtgtctgcaaattctcccaagccagcttgtgaagatgtgaaggccaaaccagtatccgacaattcttctagacaagtttctgaggatgggcaacccaaaggggtctcttctaattctcctaaaccaggctctgaggatgcaaattacaagcgagtctcctgtaattcccccaaaccggttcttgaggatgtgaaaccaacttattgggctcaatcccatttggtcacaggatactgtacgtatcttcctttccagagatttgatatcacccagacaccgccagcatacataaacgtgttaccaggtttgccccagtacaccagcatatatacacccttggccagcctttctcctgaatatcagctaccaagatcagtaccagtggtgccgtcttttgtagccaatgacagagcagataaaaatgctgctgcctattttgagggtcatcatttgaatgctgagaatgttgctggtcaccagattgcctctgaaacacagatccttgagggctctttgggaatatctgtaaagtcacactgcagcacaggtgatgctcatacagtcctgagtgagtctaacagaaatgatgagcactgtggaaattctaacaacaaatgtgaagtaattccagaaagcaccagtgcagtaacaaacattccacacgtgcagatggttgccatacaggtatcttggaacataatacaccaagaagtcaatactgagccatataatccttttgaggaacgacaaggggaaatttcacggattgaaaaggagcaccaagtattacaagaccaacttcaagaagtgtatgaaaattatgagcagataaaacttaagggcttagaagagaccagggacctggaagagaagttgaaaaggcacttagaagaaaacaagatctcaaagacggaattagattggttccttcaagatttggaaagagaaattaaaaaatggcaacaggaaaaaaaagaaatccaagaaagactaaaatcactgaagaagaaaattaaaaaggtttcaaatgccagtgaaatgtatacccagaaaaatgatggaaaggaaaaggaacatgaattacatctggatcagtcccttgaaatcagcaacacacttacaaatgagaaaatgaaaatagaagagtatataaagaaagggaaagaggattatgaagagagtcatcagagagctgtggctgcagaggtatccgtacttgaaaactggaaggagagtgaagtgtataagctacagatcatggagtcacaagcagaagcctttctgaagaagctggggctgattagccgtgatcctgcagcatatcctgacatggagtctgatatacgttcatgggaattgtttctttctaatgttacaaaagaaattgagaaagcaaagtctcagtttgaagaacaaattaaggcaattaaaaatggttctcggctcagtgaactttctaaagtgcagatttctgagctttcatttcctgcctgtaacacggttcatcccgagttactccctgagtcttcaggccacgatggccaagggcttgtgacttctgcaagcgacgtgactggaaaccacgcagcacttcacagggatcctagtgtgttctctgctggtgattccccaggggaggctccttctgcgctgttgccagggccaccccctggtcagcctgaagccactcagctgacagggccaaaacgggctggccaggcagctctgtcagaacgaagccctgtggctgatcggaagcagcctgttcctccaggacgtgctgcgcgttcaagccagtctccaaaaaagccgttcaatagtattattgagcacctgtcagtggtattcccatgttacaacagcactgagcttgctggttttattaaaaaagtgcgaagcaaaaacaagaactcactctcaggattgagtattgatgaaattgtccaaagagtgacagaacacattctagatgaacagaaaaagaaaaagccaaacccaggaaaggacaagaggacttatgagcccagctctgccacccccgtgaccaggtcctcccagggctcaccctcggtggttgttgcaccatcacccaaaaccaaggggcagaaagcagaagatgtccctgtgaggattgcactgggtgcaagttcctgtgaaatatgccacgaggtgttcaaatcaaaaaacgtgcgtgtgctcaaatgtgggcacaagtatcacaaagggtgctttaagcagtggcttaaagggcagagcgcttgcccggcctgccagggtcgtgatctcctgacagaagagtcaccttctggaagaggctggcccagtcagaatcaggagctgccttcctgctcttctaggtagtcacacttcactaaagtgtcatccaccagtgtgttgaatccgaagaatgacaattttctaccactggtgtaaaaaacaaacatttgaagacccttgtgcattgtgtgtcacaaagctaaatacatggaaatcgttaatatcgctgatattaagtaatttccccactctgagtgaatactttgatgattgccaacagtggctaataaaatgacggctaccacactcatgggtcactggggctgcgcagggctctttgaggtgggtggcttcttttggaaagtactatgaacgtctcgaagcagtattctagtgataagaattcttaacatagccaagcgccccacgtttgttccccacgtttgttccccttttctgtttgaaaaacctgttctggtagctccacaagagagatgatactgactttttaaattttttacaagagtctgtattcctgatatgcctatatttttcctcaaagattctgcattttaaggatgggcataagcaaactatattttaataatttatagttaatgttaaaatattggctgatttagaccaaaagattcaaatctcctctttgtgaaatcccatctgcatttgattttttattattttatgttcccccgttagattgttttaagtgtttgcttttcatcttttatagatgtaatctgattttcaaaaatcattaacactttttaattagtatcgactaagactttttccccctggaatcgaggctgtgtgtccgtcatcccagcccccggttggagcctgctctttgaactccgctgccttccttagcagcttctgtcctcttctgtgagtcagtcagcgagtgcttgggatccgcatccagccgtgctgagcacacaacaggctgtgtgtggaaatggccaccaccattctccttccccaccccaccacaaaaagagaagctgtgtctttagacaaccctgaggtatctgtgttacaatcgttctgtgtttgatatttgtgtaaagtatgcatgcagtcttgtactgtgacctaagaacaaaactgtaactgcattagaaaccatgaaaaaattagatattgttttgtgacttttagacagtggtaaatatagaaccatgaattctggtcacattccatttctctccaacatgaaggatcaaaaaatgtttttcaatgtgttctttgttccactggaaacttagagtcatgagtttatgagctgatttggtcaccttcctctgcctttgttcactgtgagttctgatgtcttagtgacttagttcttagaagctcacgccttagtttgaaacagattctccacggtggtccccaaaacactgtctgcatatccataagaattgagcgctatgggtgttaacgtgcatgaggatcagtttgcagcagcaagtacaaaaggagaagaggaacatccgttgaatgagtgtgttttgtacataacttcagatacttgtgaacatgccttatatttgtccaacaactgtcagaataaagaacattctaaaatgagaaaaaaaaaaaagattacaaaaatcaccaagctagacttcccaacaactgttctcacgaagcaataacaaacagaagggg

SEQ ID NO: 371535 - DNA, 8101 bp, Homo sapiens
  misc_feature (7870)..(7870): n is a, c, g, or t
  misc_feature (7934)..(7935): n is a, c, g, or t
  misc_feature (7988)..(7988): n is a, c, g, or t
  misc_feature (7995)..(7995): n is a, c, g, or t
  misc_feature (8033)..(8033): n is a, c, g, or t
  misc_feature (8069)..(8069): n is a, c, g, or t
cttcaacgccgccacccgctccctcccgccgtcggctgacgtggagggccggaggtggcggcggcggcggcggcggctgctgctgctgctgctgcccgcgtccgaggctcgcgggcggcgggcccggtgtgcaccatggacaattttgctgagggagatttcactgtggcggattatgccttgttagaagattgccctcacgtggatgattgtgtctttgctgctgaatttatgagcaatgattatgttcgtgtgactcagctttactgtgatggggtgggtgtgcaatataaagattatatccaaagtgagaggaatttggaatttgacatctgcagtatatggtgtagtaaaccaatttctgtcctgcaagattattgcgatgccattaaaataaacatcttctggccacttctgtttcaacatcaaaacagttccgtaatatcacgattgcatccctgtgtggacgccaacaattcacgtgcttctgagataaatttgaagaaactacaacatcttgagttgatggaagatattgtggatttggcaaagaaagttgctaatgattcattccttattggaggcttattgagaattggttgtaaaatagaaaataaaatcttggcaatggaagaagctctgaattggataaaatatgcaggcgatgtaacaattctaactaaattaggatcaattgacaattgttggcctatgttaagtattttctttactgaatacaagtaccacataactaaaattgtaatggaagactgcaatttgcttgaagaacttaaaactcaaagttgtatggattgtatagaggaaggagaactaatgaaaatgaaaggaaatgaagagttttccaaagaaagatttgatatagctattatctattacaccagagccattgaatatagacctgaaaactaccttctttatggtaaccgagctctttgttttcttcgtactggacagtttagaaatgcactcggtgatggaaagagagccactattctgaagaacacttggccaaagggtcattatcgttattgtgatgctctttctatgctgggggaatatgactgggccctgcaagcaaacataaaagctcaaaaactctgtaaaaatgaccctgagggaatcaaggatctaattcagcagcatgtaaagttacaaaaacaaatagaagacctacaaggtcgaacagcaaataaggatccaattaaagccttttatgaaaacagggcctacacacctaggagtttatcagcacctatatttactacttcacttaactttgtggagaaggaaagagatttcagaaaaattaatcacgaaatggccaacggtggtaatcagaatctaaaggtggcggatgaggcgttgaaggtagatgattgtgactgtcatcctgaattttcaccaccatcaagtcagcctccaaaacataaaggaaaacaaaaatctcgaaacaatgaatcagaaaagttcagttctagttcaccattgactttaccagcagatttgaagaacatcttggagaaacagttttctaaatcttccagagctgcacaccaggattttgctaatataatgaaaatgctgagaagcttaattcaagatggctatatggccttattggagcagcgttgccgcagcgctgcacaggcctttacagagttgctgaacggtttagatcctcaaaaaataaagcaattgaacctggccatgattaactatgttttggtcgtctatggacttgccatttctctccttggaataggacagcctgaggaattatctgaagccgaaaaccagtttaagaggattattgaacactaccccagtgagggccttgattgcttggcctactgtggaattggaaaagtgtatttgaaaaaaaacagatttctagaagctctcaatcactttgagaaagcaagaaccttgatttatcgtcttcctggagtgttaacttggcccacgagtaatgtgattattgaagagtctcagccacaaaaaataaagatgctgttagagaaatttgttgaagaatgcaagttccctccagtgccagatgccatttgttgctatcagaagtgccatggatattctaagatccagatatacataactgatccagactttaagggttttatacgcatcagctgttgccagtactgtaaaatagaatttcacatgaattgctggaagaagttaaaaactacaacctttaatgataaaattgacaaggattttctacaaggaatatgtcttacccctgactgtgaaggtgtcatttctaagattatcatcttcagcagtggtggtgaagttaaatgtgaatttgaacacaaggtcataaaagaaaaggttcctccaagacctattctgaaacagaaatgttctagcctagagaaactaagactgaaagaagacaaaaaattgaagagaaagatccaaaaaaaagaagcaaaaaagttagcacaagaaagaatggaggaggacttaagagaaagtaatccacccaaaaatgaagagcagaaagaaactgtagacaatgttcagcgttgtcagttccttgatgacagaattctacagtgtataaagcagtatgctgacaagattaaatccggcatacagaatacagccatgcttctcaaagaattgctttcttggaaagttttgagcacagaagactatacaacctgtttttctagcagaaattttctaaatgaagcagtggactatgttattcgccacttgattcaagaaaataacagagtaaagacaagaatatttctgcatgttttgagtgagcttaaagaagtggagcccaaattagccgcctggatccaaaaacttaatagctttggcttagatgccacaggaactttcttttctcgttatggagcatctcttaaactgcttgattttagtatcatgactttcctctggaatgagaaatatggtcacaaactagactctatagaaggaaagcaacttgattatttctctgagccagcatcattgaaggaagcccgttgtttaatatggctgctagaagaacacagagacaagttcccagcattgcatagtgctttagatgaattctttgatataatggacagccgctgtactgtgttaaggaaacaagatagtggtgaagcaccgtttagttcaaccaaggtgaaaaacaaaagcaagaaaaagaagccaaaggattcaaagcctatgttagttgggtctggaacaacttcagtaacttcaaataatgagatcatcacttcaagtgaagaccatagcaatcgaaattcagattctgcaggcccatttgcagtgcctgaccatcttcggcaagatgtagaagaattcgaagctctctatgaccaacacagtaacgaatatgttgtccgcaataagaagctatgggacatgaacccaaaacaaaaatgttcaactctatatgattacttctctcagtttttggaggaacatggtcccttggacatgagtaacaagatgttctctgcagaatatgagtttttcccagaagaaactcgacagatactagaaaaagcaggaggtttaaaaccttttctcttgggatgccctcgttttgttgtgattgacaactgtattgcactgaagaaggttgcatcacggctcaagaaaaaaaggaagaagaaaaacattaaaacaaaagtagaagaaatttcaaaagcaggggagtatgtacgagttaaactacaactgaatccagctgctagggaatttaaaccagatgtaaagtctaaaccagtgtcagattcatcttcagcaccagcttttgaaaatgtgaaacccaaacctgtgtctgcaaattctcccaagccagcttgtgaagatgtgaaggccaaaccagtatccgacaattcttctagacaagtttctgaggatgggcaacccaaaggggtctcttctaattctcctaaaccaggctctgaggatgcaaattacaagcgagtctcctgtaattcccccaaaccggttcttgaggatgtgaaaccaacttattgggctcaatcccatttggtcacaggatactgtacgtatcttcctttccagagatttgatatcacccagacaccgccagcatacataaacgtgttaccaggtttgccccagtacaccagcatatatacacccttggccagcctttctcctgaatatcagctaccaagatcagtaccagtggtgccgtcttttgtagccaatgacagagcagataaaaatgctgctgcctattttgagggtcatcatttgaatgctgagaatgttgctggtcaccagattgcctctgaaacacagatccttgagggctctttgggaatatctgtaaagtcacactgcagcacaggtgatgctcatacagtcctgagtgagtctaacagaaatgatgagcactgtggaaattctaacaacaaatgtgaagtaattccagaaagcaccagtgcagtaacaaacattccacacgtgcagatggttgccatacaggtatcttggaacataatacaccaagaagtcaatactgagccatataatccttttgaggaacgacaaggggaaatttcacggattgaaaaggagcaccaagtattacaagaccaacttcaagaagtgtatgaaaattatgagcagataaaacttaagggcttagaagagaccagggacctggaagagaagttgaaaaggcacttagaagaaaacaagatctcaaagacggaattagattggttccttcaagatttggaaagagaaattaaaaaatggcaacaggaaaaaaaagaaatccaagaaagactaaaatcactgaagaagaaaattaaaaaggtttcaaatgccagtgaaatgtatacccagaaaaatgatggaaaggaaaaggaacatgaattacatctggatcagtcccttgaaatcagcaacacacttacaaatgagaaaatgaaaatagaagagtatataaagaaagggaaagaggattatgaagagagtcatcagagagctgtggctgcagaggtatccgtacttgaaaactggaaggagagtgaagtgtataagctacagatcatggagtcacaagcagaagcctttctgaagaagctggggctgattagccgtgatcctgcagcatatcctgacatggagtctgatatacgttcatgggaattgtttctttctaatgttacaaaagaaattgagaaagcaaagtctcagtttgaagaacaaattaaggcaattaaaaatggttctcggctcagtgaactttctaaagtgcagatttctgagctttcatttcctgcctgtaacacggttcatcccgagttactccctgagtcttcaggccacgatggccaagggcttgtgacttctgcaagcgacgtgactggaaaccacgcagcacttcacagggatcctagtgtgttctctgctggtgattccccaggggaggctccttctgcgctgttgccagggccaccccctggtcagcctgaagccactcagctgacagggccaaaacgggctggccaggcagctctgtcagaacgaagccctgtggctgatcggaagcagcctgttcctccaggacgtgctgcgcgttcaagccagtctccaaaaaagccgttcaatagtattattgagcacctgtcagtggtattcccatgttacaacagcactgagcttgctggttttattaaaaaagtgcgaagcaaaaacaagaactcactctcaggattgagtattgatgaaattgtccaaagagtgacagaacacattctagatgaacagaaaaagaaaaagccaaacccaggaaaggacaagaggacttatgagcccagctctgccacccccgtgaccaggtcctcccagggctcaccctcggtggttgttgcaccatcacccaaaaccaaggggcagaaagcagaagatgtccctgtgaggattgcactgggtgcaagttcctgtgaaatatgccacgaggtgttcaaatcaaaaaacgtgcgtgtgctcaaatgtgggcacaagtatcacaaagggtgctttaagcagtggcttaaagggcagagcgcttgcccggcctgccagggtcgtgatctcctgacagaagagtcaccttctggaagaggctggcccagtcagaatcaggagctgccttcctgctcttctaggtagtcacacttcactaaagtgtcatccaccagtgtgttgaatccgaagaatgacaattttctaccactggtgtaaaaaacaaacatttgaagacccttgtgcattgtgtgtcacaaagctaaatacatggaaatcgttaatatcgctgatattaagtaatttccccactctgagtgaatactttgatgattgccaacagtggctaataaaatgacggctaccacactcatgggtcactggggctgcgcagggctctttgaggtgggtggcttcttttggaaagtactatgaacgtctcgaagcagtattctagtgataagaattcttaacatagccaagcgccccacgtttgttccccacgtttgttccccttttctgtttgaaaaacctgttctggtagctccacaagagagatgatactgactttttaaattttttacaagagtctgtattcctgatatgcctatatttttcctcaaagattctgcattttaaggatgggcataagcaaactatattttaataatttatagttaatgttaaaatattggctgatttagaccaaaagattcaaatctcctctttgtgaaatcccatctgcatttgattttttattattttatgttcccccgttagattgttttaagtgtttgcttttcatcttttatagatgtaatctgattttcaaaaatcattaacactttttaattagtatcgactaagactttttccccctggaatcgaggctgtgtgtccgtcatcccagcccccggttggagcctgctctttgaactccgctgccttccttagcagcttctgtcctcttctgtgagtcagtcagcgagtgcttgggatccgcatccagccgtgctgagcacacaacaggctgtgtgtggaaatggccaccaccattctccttccccaccccaccacaaaaagagaagctgtgtctttagacaaccctgaggtatctgtgttacaatcgttctgtgtttgatatttgtgtaaagtatgcatgcagtcttgtactgtgacctaagaacaaaactgtaactgcattagaaaccatgaaaaaattagatattgttttgtgacttttagacagtggtaaatatagaaccatgaattctggtcacattccatttctctccaacatgaaggatcaaaaaatgtttttcaatgtgttctttgttccactggaaacttagagtcatgagtttatgagctgatttggtcaccttcctctgcctttgttcactgtgagttctgatgtcttagtgacttagttcttagaagctcacgccttagtttgaaacagattctccacggtggtccccaaaacactgtctgcatatccataagaattgagcgctatgggtgttaacgtgcatgaggatcagtttgcagcagcaagtacaaaaggagaagaggaacatccgttgaatgagtgtgttttgtacataacttcagatacttgtgaacatgccttatatttgtccaacaactgtcagaataaagaacattctaaaatgagaaaaaaaaaaaaaaaaaaaaaaaaaaaaaaaaaaaaaaccaacgccattgctcagctaacggccacgcttcaacctggtgatgccccggcatactttccagcatagagcgcggaataagcgcaatngcctgctctgcgatcacacaggccaacattccgtgataagactccatctcatggatagttcccnngagcgcaccgtcagcatgaaaccagctctcgaagtgcgacgatccgacaattngcgccgnaggccataaatgtacttgcataacctgactggcacggnttactggcccatatccttgggcgtgaccatcataanttccttccgtattacccgtattccctcgatgg

SEQ ID NO: 371536 - DNA, 8100 bp, Homo sapiens
  misc_feature (7869)..(7869): n is a, c, g, or t
  misc_feature (7933)..(7934): n is a, c, g, or t
  misc_feature (7987)..(7987): n is a, c, g, or t
  misc_feature (7994)..(7994): n is a, c, g, or t
  misc_feature (8032)..(8032): n is a, c, g, or t
  misc_feature (8068)..(8068): n is a, c, g, or t
ccctgacatcttctccctgacaaaacgcacgtaccacaaaaacatctttactcagatagccctaaaccagaaaaccttcaatacacaatgtcaaaaatgaaaaattagcaaacctacttaccaccctgtgcaccatggacaattttgctgagggagatttcactgtggcggattatgccttgttagaagattgccctcacgtggatgattgtgtctttgctgctgaatttatgagcaatgattatgttcgtgtgactcagctttactgtgatggggtgggtgtgcaatataaagattatatccaaagtgagaggaatttggaatttgacatctgcagtatatggtgtagtaaaccaatttctgtcctgcaagattattgcgatgccattaaaataaacatcttctggccacttctgtttcaacatcaaaacagttccgtaatatcacgattgcatccctgtgtggacgccaacaattcacgtgcttctgagataaatttgaagaaactacaacatcttgagttgatggaagatattgtggatttggcaaagaaagttgctaatgattcattccttattggaggcttattgagaattggttgtaaaatagaaaataaaatcttggcaatggaagaagctctgaattggataaaatatgcaggcgatgtaacaattctaactaaattaggatcaattgacaattgttggcctatgttaagtattttctttactgaatacaagtaccacataactaaaattgtaatggaagactgcaatttgcttgaagaacttaaaactcaaagttgtatggattgtatagaggaaggagaactaatgaaaatgaaaggaaatgaagagttttccaaagaaagatttgatatagctattatctattacaccagagccattgaatatagacctgaaaactaccttctttatggtaaccgagctctttgttttcttcgtactggacagtttagaaatgcactcggtgatggaaagagagccactattctgaagaacacttggccaaagggtcattatcgttattgtgatgctctttctatgctgggggaatatgactgggccctgcaagcaaacataaaagctcaaaaactctgtaaaaatgaccctgagggaatcaaggatctaattcagcagcatgtaaagttacaaaaacaaatagaagacctacaaggtcgaacagcaaataaggatccaattaaagccttttatgaaaacagggcctacacacctaggagtttatcagcacctatatttactacttcacttaactttgtggagaaggaaagagatttcagaaaaattaatcacgaaatggccaacggtggtaatcagaatctaaaggtggcggatgaggcgttgaaggtagatgattgtgactgtcatcctgaattttcaccaccatcaagtcagcctccaaaacataaaggaaaacaaaaatctcgaaacaatgaatcagaaaagttcagttctagttcaccattgactttaccagcagatttgaagaacatcttggagaaacagttttctaaatcttccagagctgcacaccaggattttgctaatataatgaaaatgctgagaagcttaattcaagatggctatatggccttattggagcagcgttgccgcagcgctgcacaggcctttacagagttgctgaacggtttagatcctcaaaaaataaagcaattgaacctggccatgattaactatgttttggtcgtctatggacttgccatttctctccttggaataggacagcctgaggaattatctgaagccgaaaaccagtttaagaggattattgaacactaccccagtgagggccttgattgcttggcctactgtggaattggaaaagtgtatttgaaaaaaaacagatttctagaagctctcaatcactttgagaaagcaagaaccttgatttatcgtcttcctggagtgttaacttggcccacgagtaatgtgattattgaagagtctcagccacaaaaaataaagatgctgttagagaaatttgttgaagaatgcaagttccctccagtgccagatgccatttgttgctatcagaagtgccatggatattctaagatccagatatacataactgatccagactttaagggttttatacgcatcagctgttgccagtactgtaaaatagaatttcacatgaattgctggaagaagttaaaaactacaacctttaatgataaaattgacaaggattttctacaaggaatatgtcttacccctgactgtgaaggtgtcatttctaagattatcatcttcagcagtggtggtgaagttaaatgtgaatttgaacacaaggtcataaaagaaaaggttcctccaagacctattctgaaacagaaatgttctagcctagagaaactaagactgaaagaagacaaaaaattgaagagaaagatccaaaaaaaagaagcaaaaaagttagcacaagaaagaatggaggaggacttaagagaaagtaatccacccaaaaatgaagagcagaaagaaactgtagacaatgttcagcgttgtcagttccttgatgacagaattctacagtgtataaagcagtatgctgacaagattaaatccggcatacagaatacagccatgcttctcaaagaattgctttcttggaaagttttgagcacagaagactatacaacctgtttttctagcagaaattttctaaatgaagcagtggactatgttattcgccacttgattcaagaaaataacagagtaaagacaagaatatttctgcatgttttgagtgagcttaaagaagtggagcccaaattagccgcctggatccaaaaacttaatagctttggcttagatgccacaggaactttcttttctcgttatggagcatctcttaaactgcttgattttagtatcatgactttcctctggaatgagaaatatggtcacaaactagactctatagaaggaaagcaacttgattatttctctgagccagcatcattgaaggaagcccgttgtttaatatggctgctagaagaacacagagacaagttcccagcattgcatagtgctttagatgaattctttgatataatggacagccgctgtactgtgttaaggaaacaagatagtggtgaagcaccgtttagttcaaccaaggtgaaaaacaaaagcaagaaaaagaagccaaaggattcaaagcctatgttagttgggtctggaacaacttcagtaacttcaaataatgagatcatcacttcaagtgaagaccatagcaatcgaaattcagattctgcaggcccatttgcagtgcctgaccatcttcggcaagatgtagaagaattcgaagctctctatgaccaacacagtaacgaatatgttgtccgcaataagaagctatgggacatgaacccaaaacaaaaatgttcaactctatatgattacttctctcagtttttggaggaacatggtcccttggacatgagtaacaagatgttctctgcagaatatgagtttttcccagaagaaactcgacagatactagaaaaagcaggaggtttaaaaccttttctcttgggatgccctcgttttgttgtgattgacaactgtattgcactgaagaaggttgcatcacggctcaagaaaaaaaggaagaagaaaaacattaaaacaaaagtagaagaaatttcaaaagcaggggagtatgtacgagttaaactacaactgaatccagctgctagggaatttaaaccagatgtaaagtctaaaccagtgtcagattcatcttcagcaccagcttttgaaaatgtgaaacccaaacctgtgtctgcaaattctcccaagccagcttgtgaagatgtgaaggccaaaccagtatccgacaattcttctagacaagtttctgaggatgggcaacccaaaggggtctcttctaattctcctaaaccaggctctgaggatgcaaattacaagcgagtctcctgtaattcccccaaaccggttcttgaggatgtgaaaccaacttattgggctcaatcccatttggtcacaggatactgtacgtatcttcctttccagagatttgatatcacccagacaccgccagcatacataaacgtgttaccaggtttgccccagtacaccagcatatatacacccttggccagcctttctcctgaatatcagctaccaagatcagtaccagtggtgccgtcttttgtagccaatgacagagcagataaaaatgctgctgcctattttgagggtcatcatttgaatgctgagaatgttgctggtcaccagattgcctctgaaacacagatccttgagggctctttgggaatatctgtaaagtcacactgcagcacaggtgatgctcatacagtcctgagtgagtctaacagaaatgatgagcactgtggaaattctaacaacaaatgtgaagtaattccagaaagcaccagtgcagtaacaaacattccacacgtgcagatggttgccatacaggtatcttggaacataatacaccaagaagtcaatactgagccatataatccttttgaggaacgacaaggggaaatttcacggattgaaaaggagcaccaagtattacaagaccaacttcaagaagtgtatgaaaattatgagcagataaaacttaagggcttagaagagaccagggacctggaagagaagttgaaaaggcacttagaagaaaacaagatctcaaagacggaattagattggttccttcaagatttggaaagagaaattaaaaaatggcaacaggaaaaaaaagaaatccaagaaagactaaaatcactgaagaagaaaattaaaaaggtttcaaatgccagtgaaatgtatacccagaaaaatgatggaaaggaaaaggaacatgaattacatctggatcagtcccttgaaatcagcaacacacttacaaatgagaaaatgaaaatagaagagtatataaagaaagggaaagaggattatgaagagagtcatcagagagctgtggctgcagaggtatccgtacttgaaaactggaaggagagtgaagtgtataagctacagatcatggagtcacaagcagaagcctttctgaagaagctggggctgattagccgtgatcctgcagcatatcctgacatggagtctgatatacgttcatgggaattgtttctttctaatgttacaaaagaaattgagaaagcaaagtctcagtttgaagaacaaattaaggcaattaaaaatggttctcggctcagtgaactttctaaagtgcagatttctgagctttcatttcctgcctgtaacacggttcatcccgagttactccctgagtcttcaggccacgatggccaagggcttgtgacttctgcaagcgacgtgactggaaaccacgcagcacttcacagggatcctagtgtgttctctgctggtgattccccaggggaggctccttctgcgctgttgccagggccaccccctggtcagcctgaagccactcagctgacagggccaaaacgggctggccaggcagctctgtcagaacgaagccctgtggctgatcggaagcagcctgttcctccaggacgtgctgcgcgttcaagccagtctccaaaaaagccgttcaatagtattattgagcacctgtcagtggtattcccatgttacaacagcactgagcttgctggttttattaaaaaagtgcgaagcaaaaacaagaactcactctcaggattgagtattgatgaaattgtccaaagagtgacagaacacattctagatgaacagaaaaagaaaaagccaaacccaggaaaggacaagaggacttatgagcccagctctgccacccccgtgaccaggtcctcccagggctcaccctcggtggttgttgcaccatcacccaaaaccaaggggcagaaagcagaagatgtccctgtgaggattgcactgggtgcaagttcctgtgaaatatgccacgaggtgttcaaatcaaaaaacgtgcgtgtgctcaaatgtgggcacaagtatcacaaagggtgctttaagcagtggcttaaagggcagagcgcttgcccggcctgccagggtcgtgatctcctgacagaagagtcaccttctggaagaggctggcccagtcagaatcaggagctgccttcctgctcttctaggtagtcacacttcactaaagtgtcatccaccagtgtgttgaatccgaagaatgacaattttctaccactggtgtaaaaaacaaacatttgaagacccttgtgcattgtgtgtcacaaagctaaatacatggaaatcgttaatatcgctgatattaagtaatttccccactctgagtgaatactttgatgattgccaacagtggctaataaaatgacggctaccacactcatgggtcactggggctgcgcagggctctttgaggtgggtggcttcttttggaaagtactatgaacgtctcgaagcagtattctagtgataagaattcttaacatagccaagcgccccacgtttgttccccacgtttgttccccttttctgtttgaaaaacctgttctggtagctccacaagagagatgatactgactttttaaattttttacaagagtctgtattcctgatatgcctatatttttcctcaaagattctgcattttaaggatgggcataagcaaactatattttaataatttatagttaatgttaaaatattggctgatttagaccaaaagattcaaatctcctctttgtgaaatcccatctgcatttgattttttattattttatgttcccccgttagattgttttaagtgtttgcttttcatcttttatagatgtaatctgattttcaaaaatcattaacactttttaattagtatcgactaagactttttccccctggaatcgaggctgtgtgtccgtcatcccagcccccggttggagcctgctctttgaactccgctgccttccttagcagcttctgtcctcttctgtgagtcagtcagcgagtgcttgggatccgcatccagccgtgctgagcacacaacaggctgtgtgtggaaatggccaccaccattctccttccccaccccaccacaaaaagagaagctgtgtctttagacaaccctgaggtatctgtgttacaatcgttctgtgtttgatatttgtgtaaagtatgcatgcagtcttgtactgtgacctaagaacaaaactgtaactgcattagaaaccatgaaaaaattagatattgttttgtgacttttagacagtggtaaatatagaaccatgaattctggtcacattccatttctctccaacatgaaggatcaaaaaatgtttttcaatgtgttctttgttccactggaaacttagagtcatgagtttatgagctgatttggtcaccttcctctgcctttgttcactgtgagttctgatgtcttagtgacttagttcttagaagctcacgccttagtttgaaacagattctccacggtggtccccaaaacactgtctgcatatccataagaattgagcgctatgggtgttaacgtgcatgaggatcagtttgcagcagcaagtacaaaaggagaagaggaacatccgttgaatgagtgtgttttgtacataacttcagatacttgtgaacatgccttatatttgtccaacaactgtcagaataaagaacattctaaaatgagaaaaaaaaaaaaaaaaaaaaaaaaaaaaaaaaaaaaaaccaacgccattgctcagctaacggccacgcttcaacctggtgatgccccggcatactttccagcatagagcgcggaataagcgcaatngcctgctctgcgatcacacaggccaacattccgtgataagactccatctcatggatagttcccnngagcgcaccgtcagcatgaaaccagctctcgaagtgcgacgatccgacaattngcgccgnaggccataaatgtacttgcataacctgactggcacggnttactggcccatatccttgggcgtgaccatcataanttccttccgtattacccgtattccctcgatgg

SEQ ID NO: 371537 - DNA, 8831 bp, Homo sapiens
  misc_feature (8600)..(8600): n is a, c, g, or t
  misc_feature (8664)..(8665): n is a, c, g, or t
  misc_feature (8718)..(8718): n is a, c, g, or t
  misc_feature (8725)..(8725): n is a, c, g, or t
  misc_feature (8763)..(8763): n is a, c, g, or t
  misc_feature (8799)..(8799): n is a, c, g, or t
ctgaactagttgccagtgatcttgaaacgtgacagtaaccaagagataaataggtgacaatgacaggaaaattagatgtagtaaaagagagtgtttgagagcagaagctatggcaactaaagactggatttgaatccttcctagcttggtgacatgagcaaattacttgatttaagtgagcattttcccatctgtacagtggagataacgataattgtgcctgctaagaagaattgctgtgaagattagtgaaataatgcatgtaaaacatttggtacagtatgtgacacatagtacaaatagtttgctaggaagattgttattattcttcacttgtgatattgtgaagttttcatacagcaaattggacatcatgagatggattgattaaataaatagatttgaacttcaaggactggtagtgttcttgctttggaaagaagaaacttggtttatcctaataatagtaggataataatggtgaagtgataggtacaagtaatagtgtttatgatgcgctggtgatgataggaaaagaaagccattatatgggcaagagctagaagtaataaaatggtgcatttttcagtgatgtttggcctatgtagctattctctgataactataaaaatccttattattgaagattcttcaggaaaaaaaaacccttagtctgaaactttagcaccaatcccccttgccccccattgaaatacgtatttttaaaacatggcttttgataatgtgagggttttttcctttttgcgatttagcagtgctgattgtgtattgcagtagttgtgagagcattagaagcagcagtcgataggaggatggaaggtctggatgccgccttggggagttaggagattggcagacttaccctgtaccactctagccctactcctttgcccaagacagaaacacactgagatggataggagaatatgagcagttgataggaaagttctcagtggagtcaggatttaggttaggccaggagattgagaatataacagtttgtgtatgatgaaatggcatatttcacagaatgcagtaaaagcaggtagggtacaagtgcagcaacaggaagatgtcttttcttcattcagcaaacacttatttgagagcttaccatgtgctaggcacatacaaagataaataagatgcccttgatgatcctctatttaaaggagacatgtacaattcacgtgcttctgagataaatttgaagaaactacaacatcttgagttgatggaagatattgtggatttggcaaagaaagttgctaatgattcattccttattggaggcttattgagaattggttgtaaaatagaaaataaaatcttggcaatggaagaagctctgaattggataaaatatgcaggcgatgtaacaattctaactaaattaggatcaattgacaattgttggcctatgttaagtattttctttactgaatacaagtaccacataactaaaattgtaatggaagactgcaatttgcttgaagaacttaaaactcaaagttgtatggattgtatagaggaaggagaactaatgaaaatgaaaggaaatgaagagttttccaaagaaagatttgatatagctattatctattacaccagagccattgaatatagacctgaaaactaccttctttatggtaaccgagctctttgttttcttcgtactggacagtttagaaatgcactcggtgatggaaagagagccactattctgaagaacacttggccaaagggtcattatcgttattgtgatgctctttctatgctgggggaatatgactgggccctgcaagcaaacataaaagctcaaaaactctgtaaaaatgaccctgagggaatcaaggatctaattcagcagcatgtaaagttacaaaaacaaatagaagacctacaaggtcgaacagcaaataaggatccaattaaagccttttatgaaaacagggcctacacacctaggagtttatcagcacctatatttactacttcacttaactttgtggagaaggaaagagatttcagaaaaattaatcacgaaatggccaacggtggtaatcagaatctaaaggtggcggatgaggcgttgaaggtagatgattgtgactgtcatcctgaattttcaccaccatcaagtcagcctccaaaacataaaggaaaacaaaaatctcgaaacaatgaatcagaaaagttcagttctagttcaccattgactttaccagcagatttgaagaacatcttggagaaacagttttctaaatcttccagagctgcacaccaggattttgctaatataatgaaaatgctgagaagcttaattcaagatggctatatggccttattggagcagcgttgccgcagcgctgcacaggcctttacagagttgctgaacggtttagatcctcaaaaaataaagcaattgaacctggccatgattaactatgttttggtcgtctatggacttgccatttctctccttggaataggacagcctgaggaattatctgaagccgaaaaccagtttaagaggattattgaacactaccccagtgagggccttgattgcttggcctactgtggaattggaaaagtgtatttgaaaaaaaacagatttctagaagctctcaatcactttgagaaagcaagaaccttgatttatcgtcttcctggagtgttaacttggcccacgagtaatgtgattattgaagagtctcagccacaaaaaataaagatgctgttagagaaatttgttgaagaatgcaagttccctccagtgccagatgccatttgttgctatcagaagtgccatggatattctaagatccagatatacataactgatccagactttaagggttttatacgcatcagctgttgccagtactgtaaaatagaatttcacatgaattgctggaagaagttaaaaactacaacctttaatgataaaattgacaaggattttctacaaggaatatgtcttacccctgactgtgaaggtgtcatttctaagattatcatcttcagcagtggtggtgaagttaaatgtgaatttgaacacaaggtcataaaagaaaaggttcctccaagacctattctgaaacagaaatgttctagcctagagaaactaagactgaaagaagacaaaaaattgaagagaaagatccaaaaaaaagaagcaaaaaagttagcacaagaaagaatggaggaggacttaagagaaagtaatccacccaaaaatgaagagcagaaagaaactgtagacaatgttcagcgttgtcagttccttgatgacagaattctacagtgtataaagcagtatgctgacaagattaaatccggcatacagaatacagccatgcttctcaaagaattgctttcttggaaagttttgagcacagaagactatacaacctgtttttctagcagaaattttctaaatgaagcagtggactatgttattcgccacttgattcaagaaaataacagagtaaagacaagaatatttctgcatgttttgagtgagcttaaagaagtggagcccaaattagccgcctggatccaaaaacttaatagctttggcttagatgccacaggaactttcttttctcgttatggagcatctcttaaactgcttgattttagtatcatgactttcctctggaatgagaaatatggtcacaaactagactctatagaaggaaagcaacttgattatttctctgagccagcatcattgaaggaagcccgttgtttaatatggctgctagaagaacacagagacaagttcccagcattgcatagtgctttagatgaattctttgatataatggacagccgctgtactgtgttaaggaaacaagatagtggtgaagcaccgtttagttcaaccaaggtgaaaaacaaaagcaagaaaaagaagccaaaggattcaaagcctatgttagttgggtctggaacaacttcagtaacttcaaataatgagatcatcacttcaagtgaagaccatagcaatcgaaattcagattctgcaggcccatttgcagtgcctgaccatcttcggcaagatgtagaagaattcgaagctctctatgaccaacacagtaacgaatatgttgtccgcaataagaagctatgggacatgaacccaaaacaaaaatgttcaactctatatgattacttctctcagtttttggaggaacatggtcccttggacatgagtaacaagatgttctctgcagaatatgagtttttcccagaagaaactcgacagatactagaaaaagcaggaggtttaaaaccttttctcttgggatgccctcgttttgttgtgattgacaactgtattgcactgaagaaggttgcatcacggctcaagaaaaaaaggaagaagaaaaacattaaaacaaaagtagaagaaatttcaaaagcaggggagtatgtacgagttaaactacaactgaatccagctgctagggaatttaaaccagatgtaaagtctaaaccagtgtcagattcatcttcagcaccagcttttgaaaatgtgaaacccaaacctgtgtctgcaaattctcccaagccagcttgtgaagatgtgaaggccaaaccagtatccgacaattcttctagacaagtttctgaggatgggcaacccaaaggggtctcttctaattctcctaaaccaggctctgaggatgcaaattacaagcgagtctcctgtaattcccccaaaccggttcttgaggatgtgaaaccaacttattgggctcaatcccatttggtcacaggatactgtacgtatcttcctttccagagatttgatatcacccagacaccgccagcatacataaacgtgttaccaggtttgccccagtacaccagcatatatacacccttggccagcctttctcctgaatatcagctaccaagatcagtaccagtggtgccgtcttttgtagccaatgacagagcagataaaaatgctgctgcctattttgagggtcatcatttgaatgctgagaatgttgctggtcaccagattgcctctgaaacacagatccttgagggctctttgggaatatctgtaaagtcacactgcagcacaggtgatgctcatacagtcctgagtgagtctaacagaaatgatgagcactgtggaaattctaacaacaaatgtgaagtaattccagaaagcaccagtgcagtaacaaacattccacacgtgcagatggttgccatacaggtatcttggaacataatacaccaagaagtcaatactgagccatataatccttttgaggaacgacaaggggaaatttcacggattgaaaaggagcaccaagtattacaagaccaacttcaagaagtgtatgaaaattatgagcagataaaacttaagggcttagaagagaccagggacctggaagagaagttgaaaaggcacttagaagaaaacaagatctcaaagacggaattagattggttccttcaagatttggaaagagaaattaaaaaatggcaacaggaaaaaaaagaaatccaagaaagactaaaatcactgaagaagaaaattaaaaaggtttcaaatgccagtgaaatgtatacccagaaaaatgatggaaaggaaaaggaacatgaattacatctggatcagtcccttgaaatcagcaacacacttacaaatgagaaaatgaaaatagaagagtatataaagaaagggaaagaggattatgaagagagtcatcagagagctgtggctgcagaggtatccgtacttgaaaactggaaggagagtgaagtgtataagctacagatcatggagtcacaagcagaagcctttctgaagaagctggggctgattagccgtgatcctgcagcatatcctgacatggagtctgatatacgttcatgggaattgtttctttctaatgttacaaaagaaattgagaaagcaaagtctcagtttgaagaacaaattaaggcaattaaaaatggttctcggctcagtgaactttctaaagtgcagatttctgagctttcatttcctgcctgtaacacggttcatcccgagttactccctgagtcttcaggccacgatggccaagggcttgtgacttctgcaagcgacgtgactggaaaccacgcagcacttcacagggatcctagtgtgttctctgctggtgattccccaggggaggctccttctgcgctgttgccagggccaccccctggtcagcctgaagccactcagctgacagggccaaaacgggctggccaggcagctctgtcagaacgaagccctgtggctgatcggaagcagcctgttcctccaggacgtgctgcgcgttcaagccagtctccaaaaaagccgttcaatagtattattgagcacctgtcagtggtattcccatgttacaacagcactgagcttgctggttttattaaaaaagtgcgaagcaaaaacaagaactcactctcaggattgagtattgatgaaattgtccaaagagtgacagaacacattctagatgaacagaaaaagaaaaagccaaacccaggaaaggacaagaggacttatgagcccagctctgccacccccgtgaccaggtcctcccagggctcaccctcggtggttgttgcaccatcacccaaaaccaaggggcagaaagcagaagatgtccctgtgaggattgcactgggtgcaagttcctgtgaaatatgccacgaggtgttcaaatcaaaaaacgtgcgtgtgctcaaatgtgggcacaagtatcacaaagggtgctttaagcagtggcttaaagggcagagcgcttgcccggcctgccagggtcgtgatctcctgacagaagagtcaccttctggaagaggctggcccagtcagaatcaggagctgccttcctgctcttctaggtagtcacacttcactaaagtgtcatccaccagtgtgttgaatccgaagaatgacaattttctaccactggtgtaaaaaacaaacatttgaagacccttgtgcattgtgtgtcacaaagctaaatacatggaaatcgttaatatcgctgatattaagtaatttccccactctgagtgaatactttgatgattgccaacagtggctaataaaatgacggctaccacactcatgggtcactggggctgcgcagggctctttgaggtgggtggcttcttttggaaagtactatgaacgtctcgaagcagtattctagtgataagaattcttaacatagccaagcgccccacgtttgttccccacgtttgttccccttttctgtttgaaaaacctgttctggtagctccacaagagagatgatactgactttttaaattttttacaagagtctgtattcctgatatgcctatatttttcctcaaagattctgcattttaaggatgggcataagcaaactatattttaataatttatagttaatgttaaaatattggctgatttagaccaaaagattcaaatctcctctttgtgaaatcccatctgcatttgattttttattattttatgttcccccgttagattgttttaagtgtttgcttttcatcttttatagatgtaatctgattttcaaaaatcattaacactttttaattagtatcgactaagactttttccccctggaatcgaggctgtgtgtccgtcatcccagcccccggttggagcctgctctttgaactccgctgccttccttagcagcttctgtcctcttctgtgagtcagtcagcgagtgcttgggatccgcatccagccgtgctgagcacacaacaggctgtgtgtggaaatggccaccaccattctccttccccaccccaccacaaaaagagaagctgtgtctttagacaaccctgaggtatctgtgttacaatcgttctgtgtttgatatttgtgtaaagtatgcatgcagtcttgtactgtgacctaagaacaaaactgtaactgcattagaaaccatgaaaaaattagatattgttttgtgacttttagacagtggtaaatatagaaccatgaattctggtcacattccatttctctccaacatgaaggatcaaaaaatgtttttcaatgtgttctttgttccactggaaacttagagtcatgagtttatgagctgatttggtcaccttcctctgcctttgttcactgtgagttctgatgtcttagtgacttagttcttagaagctcacgccttagtttgaaacagattctccacggtggtccccaaaacactgtctgcatatccataagaattgagcgctatgggtgttaacgtgcatgaggatcagtttgcagcagcaagtacaaaaggagaagaggaacatccgttgaatgagtgtgttttgtacataacttcagatacttgtgaacatgccttatatttgtccaacaactgtcagaataaagaacattctaaaatgagaaaaaaaaaaaaaaaaaaaaaaaaaaaaaaaaaaaaaaccaacgccattgctcagctaacggccacgcttcaacctggtgatgccccggcatactttccagcatagagcgcggaataagcgcaatngcctgctctgcgatcacacaggccaacattccgtgataagactccatctcatggatagttcccnngagcgcaccgtcagcatgaaaccagctctcgaagtgcgacgatccgacaattngcgccgnaggccataaatgtacttgcataacctgactggcacggnttactggcccatatccttgggcgtgaccatcataanttccttccgtattacccgtattccctcgatgg

SEQ ID NO: 371538 - DNA, 7357 bp, Homo sapiens
  misc_feature (7126)..(7126): n is a, c, g, or t
  misc_feature (7190)..(7191): n is a, c, g, or t
  misc_feature (7244)..(7244): n is a, c, g, or t
  misc_feature (7251)..(7251): n is a, c, g, or t
  misc_feature (7289)..(7289): n is a, c, g, or t
  misc_feature (7325)..(7325): n is a, c, g, or t
cttcaacgccgccacccgctccctcccgccgtcggctgacgtggagggccggaggtggcggcggcggcggcggcggctgctgctgctgctgctgcccgcgtccgaggctcgcgggcggcgggcccgggtgagtgcacacccggcgcgctgccgggctcccggatgtgtcaccttgtcccgctgcagccgagatgccgggggagcggggccttccacaccccctccgtgggtgtgtgaaatgcactcggtgatggaaagagagccactattctgaagaacacttggccaaagggtcattatcgttattgtgatgctctttctatgctgggggaatatgactgggccctgcaagcaaacataaaagctcaaaaactctgtaaaaatgaccctgagggaatcaaggatctaattcagcagcatgtaaagttacaaaaacaaatagaagacctacaaggtcgaacagcaaataaggatccaattaaagccttttatgaaaacagggcctacacacctaggagtttatcagcacctatatttactacttcacttaactttgtggagaaggaaagagatttcagaaaaattaatcacgaaatggccaacggtggtaatcagaatctaaaggtggcggatgaggcgttgaaggtagatgattgtgactgtcatcctgaattttcaccaccatcaagtcagcctccaaaacataaaggaaaacaaaaatctcgaaacaatgaatcagaaaagttcagttctagttcaccattgactttaccagcagatttgaagaacatcttggagaaacagttttctaaatcttccagagctgcacaccaggattttgctaatataatgaaaatgctgagaagcttaattcaagatggctatatggccttattggagcagcgttgccgcagcgctgcacaggcctttacagagttgctgaacggtttagatcctcaaaaaataaagcaattgaacctggccatgattaactatgttttggtcgtctatggacttgccatttctctccttggaataggacagcctgaggaattatctgaagccgaaaaccagtttaagaggattattgaacactaccccagtgagggccttgattgcttggcctactgtggaattggaaaagtgtatttgaaaaaaaacagatttctagaagctctcaatcactttgagaaagcaagaaccttgatttatcgtcttcctggagtgttaacttggcccacgagtaatgtgattattgaagagtctcagccacaaaaaataaagatgctgttagagaaatttgttgaagaatgcaagttccctccagtgccagatgccatttgttgctatcagaagtgccatggatattctaagatccagatatacataactgatccagactttaagggttttatacgcatcagctgttgccagtactgtaaaatagaatttcacatgaattgctggaagaagttaaaaactacaacctttaatgataaaattgacaaggattttctacaaggaatatgtcttacccctgactgtgaaggtgtcatttctaagattatcatcttcagcagtggtggtgaagttaaatgtgaatttgaacacaaggtcataaaagaaaaggttcctccaagacctattctgaaacagaaatgttctagcctagagaaactaagactgaaagaagacaaaaaattgaagagaaagatccaaaaaaaagaagcaaaaaagttagcacaagaaagaatggaggaggacttaagagaaagtaatccacccaaaaatgaagagcagaaagaaactgtagacaatgttcagcgttgtcagttccttgatgacagaattctacagtgtataaagcagtatgctgacaagattaaatccggcatacagaatacagccatgcttctcaaagaattgctttcttggaaagttttgagcacagaagactatacaacctgtttttctagcagaaattttctaaatgaagcagtggactatgttattcgccacttgattcaagaaaataacagagtaaagacaagaatatttctgcatgttttgagtgagcttaaagaagtggagcccaaattagccgcctggatccaaaaacttaatagctttggcttagatgccacaggaactttcttttctcgttatggagcatctcttaaactgcttgattttagtatcatgactttcctctggaatgagaaatatggtcacaaactagactctatagaaggaaagcaacttgattatttctctgagccagcatcattgaaggaagcccgttgtttaatatggctgctagaagaacacagagacaagttcccagcattgcatagtgctttagatgaattctttgatataatggacagccgctgtactgtgttaaggaaacaagatagtggtgaagcaccgtttagttcaaccaaggtgaaaaacaaaagcaagaaaaagaagccaaaggattcaaagcctatgttagttgggtctggaacaacttcagtaacttcaaataatgagatcatcacttcaagtgaagaccatagcaatcgaaattcagattctgcaggcccatttgcagtgcctgaccatcttcggcaagatgtagaagaattcgaagctctctatgaccaacacagtaacgaatatgttgtccgcaataagaagctatgggacatgaacccaaaacaaaaatgttcaactctatatgattacttctctcagtttttggaggaacatggtcccttggacatgagtaacaagatgttctctgcagaatatgagtttttcccagaagaaactcgacagatactagaaaaagcaggaggtttaaaaccttttctcttgggatgccctcgttttgttgtgattgacaactgtattgcactgaagaaggttgcatcacggctcaagaaaaaaaggaagaagaaaaacattaaaacaaaagtagaagaaatttcaaaagcaggggagtatgtacgagttaaactacaactgaatccagctgctagggaatttaaaccagatgtaaagtctaaaccagtgtcagattcatcttcagcaccagcttttgaaaatgtgaaacccaaacctgtgtctgcaaattctcccaagccagcttgtgaagatgtgaaggccaaaccagtatccgacaattcttctagacaagtttctgaggatgggcaacccaaaggggtctcttctaattctcctaaaccaggctctgaggatgcaaattacaagcgagtctcctgtaattcccccaaaccggttcttgaggatgtgaaaccaacttattgggctcaatcccatttggtcacaggatactgtacgtatcttcctttccagagatttgatatcacccagacaccgccagcatacataaacgtgttaccaggtttgccccagtacaccagcatatatacacccttggccagcctttctcctgaatatcagctaccaagatcagtaccagtggtgccgtcttttgtagccaatgacagagcagataaaaatgctgctgcctattttgagggtcatcatttgaatgctgagaatgttgctggtcaccagattgcctctgaaacacagatccttgagggctctttgggaatatctgtaaagtcacactgcagcacaggtgatgctcatacagtcctgagtgagtctaacagaaatgatgagcactgtggaaattctaacaacaaatgtgaagtaattccagaaagcaccagtgcagtaacaaacattccacacgtgcagatggttgccatacaggtatcttggaacataatacaccaagaagtcaatactgagccatataatccttttgaggaacgacaaggggaaatttcacggattgaaaaggagcaccaagtattacaagaccaacttcaagaagtgtatgaaaattatgagcagataaaacttaagggcttagaagagaccagggacctggaagagaagttgaaaaggcacttagaagaaaacaagatctcaaagacggaattagattggttccttcaagatttggaaagagaaattaaaaaatggcaacaggaaaaaaaagaaatccaagaaagactaaaatcactgaagaagaaaattaaaaaggtttcaaatgccagtgaaatgtatacccagaaaaatgatggaaaggaaaaggaacatgaattacatctggatcagtcccttgaaatcagcaacacacttacaaatgagaaaatgaaaatagaagagtatataaagaaagggaaagaggattatgaagagagtcatcagagagctgtggctgcagaggtatccgtacttgaaaactggaaggagagtgaagtgtataagctacagatcatggagtcacaagcagaagcctttctgaagaagctggggctgattagccgtgatcctgcagcatatcctgacatggagtctgatatacgttcatgggaattgtttctttctaatgttacaaaagaaattgagaaagcaaagtctcagtttgaagaacaaattaaggcaattaaaaatggttctcggctcagtgaactttctaaagtgcagatttctgagctttcatttcctgcctgtaacacggttcatcccgagttactccctgagtcttcaggccacgatggccaagggcttgtgacttctgcaagcgacgtgactggaaaccacgcagcacttcacagggatcctagtgtgttctctgctggtgattccccaggggaggctccttctgcgctgttgccagggccaccccctggtcagcctgaagccactcagctgacagggccaaaacgggctggccaggcagctctgtcagaacgaagccctgtggctgatcggaagcagcctgttcctccaggacgtgctgcgcgttcaagccagtctccaaaaaagccgttcaatagtattattgagcacctgtcagtggtattcccatgttacaacagcactgagcttgctggttttattaaaaaagtgcgaagcaaaaacaagaactcactctcaggattgagtattgatgaaattgtccaaagagtgacagaacacattctagatgaacagaaaaagaaaaagccaaacccaggaaaggacaagaggacttatgagcccagctctgccacccccgtgaccaggtcctcccagggctcaccctcggtggttgttgcaccatcacccaaaaccaaggggcagaaagcagaagatgtccctgtgaggattgcactgggtgcaagttcctgtgaaatatgccacgaggtgttcaaatcaaaaaacgtgcgtgtgctcaaatgtgggcacaagtatcacaaagggtgctttaagcagtggcttaaagggcagagcgcttgcccggcctgccagggtcgtgatctcctgacagaagagtcaccttctggaagaggctggcccagtcagaatcaggagctgccttcctgctcttctaggtagtcacacttcactaaagtgtcatccaccagtgtgttgaatccgaagaatgacaattttctaccactggtgtaaaaaacaaacatttgaagacccttgtgcattgtgtgtcacaaagctaaatacatggaaatcgttaatatcgctgatattaagtaatttccccactctgagtgaatactttgatgattgccaacagtggctaataaaatgacggctaccacactcatgggtcactggggctgcgcagggctctttgaggtgggtggcttcttttggaaagtactatgaacgtctcgaagcagtattctagtgataagaattcttaacatagccaagcgccccacgtttgttccccacgtttgttccccttttctgtttgaaaaacctgttctggtagctccacaagagagatgatactgactttttaaattttttacaagagtctgtattcctgatatgcctatatttttcctcaaagattctgcattttaaggatgggcataagcaaactatattttaataatttatagttaatgttaaaatattggctgatttagaccaaaagattcaaatctcctctttgtgaaatcccatctgcatttgattttttattattttatgttcccccgttagattgttttaagtgtttgcttttcatcttttatagatgtaatctgattttcaaaaatcattaacactttttaattagtatcgactaagactttttccccctggaatcgaggctgtgtgtccgtcatcccagcccccggttggagcctgctctttgaactccgctgccttccttagcagcttctgtcctcttctgtgagtcagtcagcgagtgcttgggatccgcatccagccgtgctgagcacacaacaggctgtgtgtggaaatggccaccaccattctccttccccaccccaccacaaaaagagaagctgtgtctttagacaaccctgaggtatctgtgttacaatcgttctgtgtttgatatttgtgtaaagtatgcatgcagtcttgtactgtgacctaagaacaaaactgtaactgcattagaaaccatgaaaaaattagatattgttttgtgacttttagacagtggtaaatatagaaccatgaattctggtcacattccatttctctccaacatgaaggatcaaaaaatgtttttcaatgtgttctttgttccactggaaacttagagtcatgagtttatgagctgatttggtcaccttcctctgcctttgttcactgtgagttctgatgtcttagtgacttagttcttagaagctcacgccttagtttgaaacagattctccacggtggtccccaaaacactgtctgcatatccataagaattgagcgctatgggtgttaacgtgcatgaggatcagtttgcagcagcaagtacaaaaggagaagaggaacatccgttgaatgagtgtgttttgtacataacttcagatacttgtgaacatgccttatatttgtccaacaactgtcagaataaagaacattctaaaatgagaaaaaaaaaaaaaaaaaaaaaaaaaaaaaaaaaaaaaaccaacgccattgctcagctaacggccacgcttcaacctggtgatgccccggcatactttccagcatagagcgcggaataagcgcaatngcctgctctgcgatcacacaggccaacattccgtgataagactccatctcatggatagttcccnngagcgcaccgtcagcatgaaaccagctctcgaagtgcgacgatccgacaattngcgccgnaggccataaatgtacttgcataacctgactggcacggnttactggcccatatccttgggcgtgaccatcataanttccttccgtattacccgtattccctcgatgg

SEQ ID NO: 371539 - DNA, 6935 bp, Homo sapiens
  misc_feature (6704)..(6704): n is a, c, g, or t
  misc_feature (6768)..(6769): n is a, c, g, or t
  misc_feature (6822)..(6822): n is a, c, g, or t
  misc_feature (6829)..(6829): n is a, c, g, or t
  misc_feature (6867)..(6867): n is a, c, g, or t
  misc_feature (6903)..(6903): n is a, c, g, or t
ctatgtgtgtgtgtgtgtgatgacttttataggtcgaacagcaaataaggatccaattaaagccttttatgaaaacagggcctacacacctaggagtttatcagcacctatatttactacttcacttaactttgtggagaaggaaagagatttcagaaaaattaatcacgaaatggccaacggtggtaatcagaatctaaaggtggcggatgaggcgttgaaggtagatgattgtgactgtcatcctgaattttcaccaccatcaagtcagcctccaaaacataaaggaaaacaaaaatctcgaaacaatgaatcagaaaagttcagttctagttcaccattgactttaccagcagatttgaagaacatcttggagaaacagttttctaaatcttccagagctgcacaccaggattttgctaatataatgaaaatgctgagaagcttaattcaagatggctatatggccttattggagcagcgttgccgcagcgctgcacaggcctttacagagttgctgaacggtttagatcctcaaaaaataaagcaattgaacctggccatgattaactatgttttggtcgtctatggacttgccatttctctccttggaataggacagcctgaggaattatctgaagccgaaaaccagtttaagaggattattgaacactaccccagtgagggccttgattgcttggcctactgtggaattggaaaagtgtatttgaaaaaaaacagatttctagaagctctcaatcactttgagaaagcaagaaccttgatttatcgtcttcctggagtgttaacttggcccacgagtaatgtgattattgaagagtctcagccacaaaaaataaagatgctgttagagaaatttgttgaagaatgcaagttccctccagtgccagatgccatttgttgctatcagaagtgccatggatattctaagatccagatatacataactgatccagactttaagggttttatacgcatcagctgttgccagtactgtaaaatagaatttcacatgaattgctggaagaagttaaaaactacaacctttaatgataaaattgacaaggattttctacaaggaatatgtcttacccctgactgtgaaggtgtcatttctaagattatcatcttcagcagtggtggtgaagttaaatgtgaatttgaacacaaggtcataaaagaaaaggttcctccaagacctattctgaaacagaaatgttctagcctagagaaactaagactgaaagaagacaaaaaattgaagagaaagatccaaaaaaaagaagcaaaaaagttagcacaagaaagaatggaggaggacttaagagaaagtaatccacccaaaaatgaagagcagaaagaaactgtagacaatgttcagcgttgtcagttccttgatgacagaattctacagtgtataaagcagtatgctgacaagattaaatccggcatacagaatacagccatgcttctcaaagaattgctttcttggaaagttttgagcacagaagactatacaacctgtttttctagcagaaattttctaaatgaagcagtggactatgttattcgccacttgattcaagaaaataacagagtaaagacaagaatatttctgcatgttttgagtgagcttaaagaagtggagcccaaattagccgcctggatccaaaaacttaatagctttggcttagatgccacaggaactttcttttctcgttatggagcatctcttaaactgcttgattttagtatcatgactttcctctggaatgagaaatatggtcacaaactagactctatagaaggaaagcaacttgattatttctctgagccagcatcattgaaggaagcccgttgtttaatatggctgctagaagaacacagagacaagttcccagcattgcatagtgctttagatgaattctttgatataatggacagccgctgtactgtgttaaggaaacaagatagtggtgaagcaccgtttagttcaaccaaggtgaaaaacaaaagcaagaaaaagaagccaaaggattcaaagcctatgttagttgggtctggaacaacttcagtaacttcaaataatgagatcatcacttcaagtgaagaccatagcaatcgaaattcagattctgcaggcccatttgcagtgcctgaccatcttcggcaagatgtagaagaattcgaagctctctatgaccaacacagtaacgaatatgttgtccgcaataagaagctatgggacatgaacccaaaacaaaaatgttcaactctatatgattacttctctcagtttttggaggaacatggtcccttggacatgagtaacaagatgttctctgcagaatatgagtttttcccagaagaaactcgacagatactagaaaaagcaggaggtttaaaaccttttctcttgggatgccctcgttttgttgtgattgacaactgtattgcactgaagaaggttgcatcacggctcaagaaaaaaaggaagaagaaaaacattaaaacaaaagtagaagaaatttcaaaagcaggggagtatgtacgagttaaactacaactgaatccagctgctagggaatttaaaccagatgtaaagtctaaaccagtgtcagattcatcttcagcaccagcttttgaaaatgtgaaacccaaacctgtgtctgcaaattctcccaagccagcttgtgaagatgtgaaggccaaaccagtatccgacaattcttctagacaagtttctgaggatgggcaacccaaaggggtctcttctaattctcctaaaccaggctctgaggatgcaaattacaagcgagtctcctgtaattcccccaaaccggttcttgaggatgtgaaaccaacttattgggctcaatcccatttggtcacaggatactgtacgtatcttcctttccagagatttgatatcacccagacaccgccagcatacataaacgtgttaccaggtttgccccagtacaccagcatatatacacccttggccagcctttctcctgaatatcagctaccaagatcagtaccagtggtgccgtcttttgtagccaatgacagagcagataaaaatgctgctgcctattttgagggtcatcatttgaatgctgagaatgttgctggtcaccagattgcctctgaaacacagatccttgagggctctttgggaatatctgtaaagtcacactgcagcacaggtgatgctcatacagtcctgagtgagtctaacagaaatgatgagcactgtggaaattctaacaacaaatgtgaagtaattccagaaagcaccagtgcagtaacaaacattccacacgtgcagatggttgccatacaggtatcttggaacataatacaccaagaagtcaatactgagccatataatccttttgaggaacgacaaggggaaatttcacggattgaaaaggagcaccaagtattacaagaccaacttcaagaagtgtatgaaaattatgagcagataaaacttaagggcttagaagagaccagggacctggaagagaagttgaaaaggcacttagaagaaaacaagatctcaaagacggaattagattggttccttcaagatttggaaagagaaattaaaaaatggcaacaggaaaaaaaagaaatccaagaaagactaaaatcactgaagaagaaaattaaaaaggtttcaaatgccagtgaaatgtatacccagaaaaatgatggaaaggaaaaggaacatgaattacatctggatcagtcccttgaaatcagcaacacacttacaaatgagaaaatgaaaatagaagagtatataaagaaagggaaagaggattatgaagagagtcatcagagagctgtggctgcagaggtatccgtacttgaaaactggaaggagagtgaagtgtataagctacagatcatggagtcacaagcagaagcctttctgaagaagctggggctgattagccgtgatcctgcagcatatcctgacatggagtctgatatacgttcatgggaattgtttctttctaatgttacaaaagaaattgagaaagcaaagtctcagtttgaagaacaaattaaggcaattaaaaatggttctcggctcagtgaactttctaaagtgcagatttctgagctttcatttcctgcctgtaacacggttcatcccgagttactccctgagtcttcaggccacgatggccaagggcttgtgacttctgcaagcgacgtgactggaaaccacgcagcacttcacagggatcctagtgtgttctctgctggtgattccccaggggaggctccttctgcgctgttgccagggccaccccctggtcagcctgaagccactcagctgacagggccaaaacgggctggccaggcagctctgtcagaacgaagccctgtggctgatcggaagcagcctgttcctccaggacgtgctgcgcgttcaagccagtctccaaaaaagccgttcaatagtattattgagcacctgtcagtggtattcccatgttacaacagcactgagcttgctggttttattaaaaaagtgcgaagcaaaaacaagaactcactctcaggattgagtattgatgaaattgtccaaagagtgacagaacacattctagatgaacagaaaaagaaaaagccaaacccaggaaaggacaagaggacttatgagcccagctctgccacccccgtgaccaggtcctcccagggctcaccctcggtggttgttgcaccatcacccaaaaccaaggggcagaaagcagaagatgtccctgtgaggattgcactgggtgcaagttcctgtgaaatatgccacgaggtgttcaaatcaaaaaacgtgcgtgtgctcaaatgtgggcacaagtatcacaaagggtgctttaagcagtggcttaaagggcagagcgcttgcccggcctgccagggtcgtgatctcctgacagaagagtcaccttctggaagaggctggcccagtcagaatcaggagctgccttcctgctcttctaggtagtcacacttcactaaagtgtcatccaccagtgtgttgaatccgaagaatgacaattttctaccactggtgtaaaaaacaaacatttgaagacccttgtgcattgtgtgtcacaaagctaaatacatggaaatcgttaatatcgctgatattaagtaatttccccactctgagtgaatactttgatgattgccaacagtggctaataaaatgacggctaccacactcatgggtcactggggctgcgcagggctctttgaggtgggtggcttcttttggaaagtactatgaacgtctcgaagcagtattctagtgataagaattcttaacatagccaagcgccccacgtttgttccccacgtttgttccccttttctgtttgaaaaacctgttctggtagctccacaagagagatgatactgactttttaaattttttacaagagtctgtattcctgatatgcctatatttttcctcaaagattctgcattttaaggatgggcataagcaaactatattttaataatttatagttaatgttaaaatattggctgatttagaccaaaagattcaaatctcctctttgtgaaatcccatctgcatttgattttttattattttatgttcccccgttagattgttttaagtgtttgcttttcatcttttatagatgtaatctgattttcaaaaatcattaacactttttaattagtatcgactaagactttttccccctggaatcgaggctgtgtgtccgtcatcccagcccccggttggagcctgctctttgaactccgctgccttccttagcagcttctgtcctcttctgtgagtcagtcagcgagtgcttgggatccgcatccagccgtgctgagcacacaacaggctgtgtgtggaaatggccaccaccattctccttccccaccccaccacaaaaagagaagctgtgtctttagacaaccctgaggtatctgtgttacaatcgttctgtgtttgatatttgtgtaaagtatgcatgcagtcttgtactgtgacctaagaacaaaactgtaactgcattagaaaccatgaaaaaattagatattgttttgtgacttttagacagtggtaaatatagaaccatgaattctggtcacattccatttctctccaacatgaaggatcaaaaaatgtttttcaatgtgttctttgttccactggaaacttagagtcatgagtttatgagctgatttggtcaccttcctctgcctttgttcactgtgagttctgatgtcttagtgacttagttcttagaagctcacgccttagtttgaaacagattctccacggtggtccccaaaacactgtctgcatatccataagaattgagcgctatgggtgttaacgtgcatgaggatcagtttgcagcagcaagtacaaaaggagaagaggaacatccgttgaatgagtgtgttttgtacataacttcagatacttgtgaacatgccttatatttgtccaacaactgtcagaataaagaacattctaaaatgagaaaaaaaaaaaaaaaaaaaaaaaaaaaaaaaaaaaaaaccaacgccattgctcagctaacggccacgcttcaacctggtgatgccccggcatactttccagcatagagcgcggaataagcgcaatngcctgctctgcgatcacacaggccaacattccgtgataagactccatctcatggatagttcccnngagcgcaccgtcagcatgaaaccagctctcgaagtgcgacgatccgacaattngcgccgnaggccataaatgtacttgcataacctgactggcacggnttactggcccatatccttgggcgtgaccatcataanttccttccgtattacccgtattccctcgatgg

SEQ ID NO: 371540 - DNA, 6435 bp, Homo sapiens
  misc_feature (6204)..(6204): n is a, c, g, or t
  misc_feature (6268)..(6269): n is a, c, g, or t
  misc_feature (6322)..(6322): n is a, c, g, or t
  misc_feature (6329)..(6329): n is a, c, g, or t
  misc_feature (6367)..(6367): n is a, c, g, or t
  misc_feature (6403)..(6403): n is a, c, g, or t
gggcagaattatattcagatttttaactgaggcatttttattgacagcaattgaacctggccatgattaactatgttttggtcgtctatggacttgccatttctctccttggaataggacagcctgaggaattatctgaagccgaaaaccagtttaagaggattattgaacactaccccagtgagggccttgattgcttggcctactgtggaattggaaaagtgtatttgaaaaaaaacagatttctagaagctctcaatcactttgagaaagcaagaaccttgatttatcgtcttcctggagtgttaacttggcccacgagtaatgtgattattgaagagtctcagccacaaaaaataaagatgctgttagagaaatttgttgaagaatgcaagttccctccagtgccagatgccatttgttgctatcagaagtgccatggatattctaagatccagatatacataactgatccagactttaagggttttatacgcatcagctgttgccagtactgtaaaatagaatttcacatgaattgctggaagaagttaaaaactacaacctttaatgataaaattgacaaggattttctacaaggaatatgtcttacccctgactgtgaaggtgtcatttctaagattatcatcttcagcagtggtggtgaagttaaatgtgaatttgaacacaaggtcataaaagaaaaggttcctccaagacctattctgaaacagaaatgttctagcctagagaaactaagactgaaagaagacaaaaaattgaagagaaagatccaaaaaaaagaagcaaaaaagttagcacaagaaagaatggaggaggacttaagagaaagtaatccacccaaaaatgaagagcagaaagaaactgtagacaatgttcagcgttgtcagttccttgatgacagaattctacagtgtataaagcagtatgctgacaagattaaatccggcatacagaatacagccatgcttctcaaagaattgctttcttggaaagttttgagcacagaagactatacaacctgtttttctagcagaaattttctaaatgaagcagtggactatgttattcgccacttgattcaagaaaataacagagtaaagacaagaatatttctgcatgttttgagtgagcttaaagaagtggagcccaaattagccgcctggatccaaaaacttaatagctttggcttagatgccacaggaactttcttttctcgttatggagcatctcttaaactgcttgattttagtatcatgactttcctctggaatgagaaatatggtcacaaactagactctatagaaggaaagcaacttgattatttctctgagccagcatcattgaaggaagcccgttgtttaatatggctgctagaagaacacagagacaagttcccagcattgcatagtgctttagatgaattctttgatataatggacagccgctgtactgtgttaaggaaacaagatagtggtgaagcaccgtttagttcaaccaaggtgaaaaacaaaagcaagaaaaagaagccaaaggattcaaagcctatgttagttgggtctggaacaacttcagtaacttcaaataatgagatcatcacttcaagtgaagaccatagcaatcgaaattcagattctgcaggcccatttgcagtgcctgaccatcttcggcaagatgtagaagaattcgaagctctctatgaccaacacagtaacgaatatgttgtccgcaataagaagctatgggacatgaacccaaaacaaaaatgttcaactctatatgattacttctctcagtttttggaggaacatggtcccttggacatgagtaacaagatgttctctgcagaatatgagtttttcccagaagaaactcgacagatactagaaaaagcaggaggtttaaaaccttttctcttgggatgccctcgttttgttgtgattgacaactgtattgcactgaagaaggttgcatcacggctcaagaaaaaaaggaagaagaaaaacattaaaacaaaagtagaagaaatttcaaaagcaggggagtatgtacgagttaaactacaactgaatccagctgctagggaatttaaaccagatgtaaagtctaaaccagtgtcagattcatcttcagcaccagcttttgaaaatgtgaaacccaaacctgtgtctgcaaattctcccaagccagcttgtgaagatgtgaaggccaaaccagtatccgacaattcttctagacaagtttctgaggatgggcaacccaaaggggtctcttctaattctcctaaaccaggctctgaggatgcaaattacaagcgagtctcctgtaattcccccaaaccggttcttgaggatgtgaaaccaacttattgggctcaatcccatttggtcacaggatactgtacgtatcttcctttccagagatttgatatcacccagacaccgccagcatacataaacgtgttaccaggtttgccccagtacaccagcatatatacacccttggccagcctttctcctgaatatcagctaccaagatcagtaccagtggtgccgtcttttgtagccaatgacagagcagataaaaatgctgctgcctattttgagggtcatcatttgaatgctgagaatgttgctggtcaccagattgcctctgaaacacagatccttgagggctctttgggaatatctgtaaagtcacactgcagcacaggtgatgctcatacagtcctgagtgagtctaacagaaatgatgagcactgtggaaattctaacaacaaatgtgaagtaattccagaaagcaccagtgcagtaacaaacattccacacgtgcagatggttgccatacaggtatcttggaacataatacaccaagaagtcaatactgagccatataatccttttgaggaacgacaaggggaaatttcacggattgaaaaggagcaccaagtattacaagaccaacttcaagaagtgtatgaaaattatgagcagataaaacttaagggcttagaagagaccagggacctggaagagaagttgaaaaggcacttagaagaaaacaagatctcaaagacggaattagattggttccttcaagatttggaaagagaaattaaaaaatggcaacaggaaaaaaaagaaatccaagaaagactaaaatcactgaagaagaaaattaaaaaggtttcaaatgccagtgaaatgtatacccagaaaaatgatggaaaggaaaaggaacatgaattacatctggatcagtcccttgaaatcagcaacacacttacaaatgagaaaatgaaaatagaagagtatataaagaaagggaaagaggattatgaagagagtcatcagagagctgtggctgcagaggtatccgtacttgaaaactggaaggagagtgaagtgtataagctacagatcatggagtcacaagcagaagcctttctgaagaagctggggctgattagccgtgatcctgcagcatatcctgacatggagtctgatatacgttcatgggaattgtttctttctaatgttacaaaagaaattgagaaagcaaagtctcagtttgaagaacaaattaaggcaattaaaaatggttctcggctcagtgaactttctaaagtgcagatttctgagctttcatttcctgcctgtaacacggttcatcccgagttactccctgagtcttcaggccacgatggccaagggcttgtgacttctgcaagcgacgtgactggaaaccacgcagcacttcacagggatcctagtgtgttctctgctggtgattccccaggggaggctccttctgcgctgttgccagggccaccccctggtcagcctgaagccactcagctgacagggccaaaacgggctggccaggcagctctgtcagaacgaagccctgtggctgatcggaagcagcctgttcctccaggacgtgctgcgcgttcaagccagtctccaaaaaagccgttcaatagtattattgagcacctgtcagtggtattcccatgttacaacagcactgagcttgctggttttattaaaaaagtgcgaagcaaaaacaagaactcactctcaggattgagtattgatgaaattgtccaaagagtgacagaacacattctagatgaacagaaaaagaaaaagccaaacccaggaaaggacaagaggacttatgagcccagctctgccacccccgtgaccaggtcctcccagggctcaccctcggtggttgttgcaccatcacccaaaaccaaggggcagaaagcagaagatgtccctgtgaggattgcactgggtgcaagttcctgtgaaatatgccacgaggtgttcaaatcaaaaaacgtgcgtgtgctcaaatgtgggcacaagtatcacaaagggtgctttaagcagtggcttaaagggcagagcgcttgcccggcctgccagggtcgtgatctcctgacagaagagtcaccttctggaagaggctggcccagtcagaatcaggagctgccttcctgctcttctaggtagtcacacttcactaaagtgtcatccaccagtgtgttgaatccgaagaatgacaattttctaccactggtgtaaaaaacaaacatttgaagacccttgtgcattgtgtgtcacaaagctaaatacatggaaatcgttaatatcgctgatattaagtaatttccccactctgagtgaatactttgatgattgccaacagtggctaataaaatgacggctaccacactcatgggtcactggggctgcgcagggctctttgaggtgggtggcttcttttggaaagtactatgaacgtctcgaagcagtattctagtgataagaattcttaacatagccaagcgccccacgtttgttccccacgtttgttccccttttctgtttgaaaaacctgttctggtagctccacaagagagatgatactgactttttaaattttttacaagagtctgtattcctgatatgcctatatttttcctcaaagattctgcattttaaggatgggcataagcaaactatattttaataatttatagttaatgttaaaatattggctgatttagaccaaaagattcaaatctcctctttgtgaaatcccatctgcatttgattttttattattttatgttcccccgttagattgttttaagtgtttgcttttcatcttttatagatgtaatctgattttcaaaaatcattaacactttttaattagtatcgactaagactttttccccctggaatcgaggctgtgtgtccgtcatcccagcccccggttggagcctgctctttgaactccgctgccttccttagcagcttctgtcctcttctgtgagtcagtcagcgagtgcttgggatccgcatccagccgtgctgagcacacaacaggctgtgtgtggaaatggccaccaccattctccttccccaccccaccacaaaaagagaagctgtgtctttagacaaccctgaggtatctgtgttacaatcgttctgtgtttgatatttgtgtaaagtatgcatgcagtcttgtactgtgacctaagaacaaaactgtaactgcattagaaaccatgaaaaaattagatattgttttgtgacttttagacagtggtaaatatagaaccatgaattctggtcacattccatttctctccaacatgaaggatcaaaaaatgtttttcaatgtgttctttgttccactggaaacttagagtcatgagtttatgagctgatttggtcaccttcctctgcctttgttcactgtgagttctgatgtcttagtgacttagttcttagaagctcacgccttagtttgaaacagattctccacggtggtccccaaaacactgtctgcatatccataagaattgagcgctatgggtgttaacgtgcatgaggatcagtttgcagcagcaagtacaaaaggagaagaggaacatccgttgaatgagtgtgttttgtacataacttcagatacttgtgaacatgccttatatttgtccaacaactgtcagaataaagaacattctaaaatgagaaaaaaaaaaaaaaaaaaaaaaaaaaaaaaaaaaaaaaccaacgccattgctcagctaacggccacgcttcaacctggtgatgccccggcatactttccagcatagagcgcggaataagcgcaatngcctgctctgcgatcacacaggccaacattccgtgataagactccatctcatggatagttcccnngagcgcaccgtcagcatgaaaccagctctcgaagtgcgacgatccgacaattngcgccgnaggccataaatgtacttgcataacctgactggcacggnttactggcccatatccttgggcgtgaccatcataanttccttccgtattacccgtattccctcgatgg

SEQ ID NO: 371541 - DNA, 6326 bp, Homo sapiens
  misc_feature (6095)..(6095): n is a, c, g, or t
  misc_feature (6159)..(6160): n is a, c, g, or t
  misc_feature (6213)..(6213): n is a, c, g, or t
  misc_feature (6220)..(6220): n is a, c, g, or t
  misc_feature (6258)..(6258): n is a, c, g, or t
  misc_feature (6294)..(6294): n is a, c, g, or t
cctcgctaccatatggttggacgattcatcaaatgtattcgtcccagtaagcttgagatctttggtgacttttgaagggagtgaaaataccattttacatctttaatgcctttttcataattatgactttagatttctagaagctctcaatcactttgagaaagcaagaaccttgatttatcgtcttcctggagtgttaacttggcccacgagtaatgtgattattgaagagtctcagccacaaaaaataaagatgctgttagagaaatttgttgaagaatgcaagttccctccagtgccagatgccatttgttgctatcagaagtgccatggatattctaagatccagatatacataactgatccagactttaagggttttatacgcatcagctgttgccagtactgtaaaatagaatttcacatgaattgctggaagaagttaaaaactacaacctttaatgataaaattgacaaggattttctacaaggaatatgtcttacccctgactgtgaaggtgtcatttctaagattatcatcttcagcagtggtggtgaagttaaatgtgaatttgaacacaaggtcataaaagaaaaggttcctccaagacctattctgaaacagaaatgttctagcctagagaaactaagactgaaagaagacaaaaaattgaagagaaagatccaaaaaaaagaagcaaaaaagttagcacaagaaagaatggaggaggacttaagagaaagtaatccacccaaaaatgaagagcagaaagaaactgtagacaatgttcagcgttgtcagttccttgatgacagaattctacagtgtataaagcagtatgctgacaagattaaatccggcatacagaatacagccatgcttctcaaagaattgctttcttggaaagttttgagcacagaagactatacaacctgtttttctagcagaaattttctaaatgaagcagtggactatgttattcgccacttgattcaagaaaataacagagtaaagacaagaatatttctgcatgttttgagtgagcttaaagaagtggagcccaaattagccgcctggatccaaaaacttaatagctttggcttagatgccacaggaactttcttttctcgttatggagcatctcttaaactgcttgattttagtatcatgactttcctctggaatgagaaatatggtcacaaactagactctatagaaggaaagcaacttgattatttctctgagccagcatcattgaaggaagcccgttgtttaatatggctgctagaagaacacagagacaagttcccagcattgcatagtgctttagatgaattctttgatataatggacagccgctgtactgtgttaaggaaacaagatagtggtgaagcaccgtttagttcaaccaaggtgaaaaacaaaagcaagaaaaagaagccaaaggattcaaagcctatgttagttgggtctggaacaacttcagtaacttcaaataatgagatcatcacttcaagtgaagaccatagcaatcgaaattcagattctgcaggcccatttgcagtgcctgaccatcttcggcaagatgtagaagaattcgaagctctctatgaccaacacagtaacgaatatgttgtccgcaataagaagctatgggacatgaacccaaaacaaaaatgttcaactctatatgattacttctctcagtttttggaggaacatggtcccttggacatgagtaacaagatgttctctgcagaatatgagtttttcccagaagaaactcgacagatactagaaaaagcaggaggtttaaaaccttttctcttgggatgccctcgttttgttgtgattgacaactgtattgcactgaagaaggttgcatcacggctcaagaaaaaaaggaagaagaaaaacattaaaacaaaagtagaagaaatttcaaaagcaggggagtatgtacgagttaaactacaactgaatccagctgctagggaatttaaaccagatgtaaagtctaaaccagtgtcagattcatcttcagcaccagcttttgaaaatgtgaaacccaaacctgtgtctgcaaattctcccaagccagcttgtgaagatgtgaaggccaaaccagtatccgacaattcttctagacaagtttctgaggatgggcaacccaaaggggtctcttctaattctcctaaaccaggctctgaggatgcaaattacaagcgagtctcctgtaattcccccaaaccggttcttgaggatgtgaaaccaacttattgggctcaatcccatttggtcacaggatactgtacgtatcttcctttccagagatttgatatcacccagacaccgccagcatacataaacgtgttaccaggtttgccccagtacaccagcatatatacacccttggccagcctttctcctgaatatcagctaccaagatcagtaccagtggtgccgtcttttgtagccaatgacagagcagataaaaatgctgctgcctattttgagggtcatcatttgaatgctgagaatgttgctggtcaccagattgcctctgaaacacagatccttgagggctctttgggaatatctgtaaagtcacactgcagcacaggtgatgctcatacagtcctgagtgagtctaacagaaatgatgagcactgtggaaattctaacaacaaatgtgaagtaattccagaaagcaccagtgcagtaacaaacattccacacgtgcagatggttgccatacaggtatcttggaacataatacaccaagaagtcaatactgagccatataatccttttgaggaacgacaaggggaaatttcacggattgaaaaggagcaccaagtattacaagaccaacttcaagaagtgtatgaaaattatgagcagataaaacttaagggcttagaagagaccagggacctggaagagaagttgaaaaggcacttagaagaaaacaagatctcaaagacggaattagattggttccttcaagatttggaaagagaaattaaaaaatggcaacaggaaaaaaaagaaatccaagaaagactaaaatcactgaagaagaaaattaaaaaggtttcaaatgccagtgaaatgtatacccagaaaaatgatggaaaggaaaaggaacatgaattacatctggatcagtcccttgaaatcagcaacacacttacaaatgagaaaatgaaaatagaagagtatataaagaaagggaaagaggattatgaagagagtcatcagagagctgtggctgcagaggtatccgtacttgaaaactggaaggagagtgaagtgtataagctacagatcatggagtcacaagcagaagcctttctgaagaagctggggctgattagccgtgatcctgcagcatatcctgacatggagtctgatatacgttcatgggaattgtttctttctaatgttacaaaagaaattgagaaagcaaagtctcagtttgaagaacaaattaaggcaattaaaaatggttctcggctcagtgaactttctaaagtgcagatttctgagctttcatttcctgcctgtaacacggttcatcccgagttactccctgagtcttcaggccacgatggccaagggcttgtgacttctgcaagcgacgtgactggaaaccacgcagcacttcacagggatcctagtgtgttctctgctggtgattccccaggggaggctccttctgcgctgttgccagggccaccccctggtcagcctgaagccactcagctgacagggccaaaacgggctggccaggcagctctgtcagaacgaagccctgtggctgatcggaagcagcctgttcctccaggacgtgctgcgcgttcaagccagtctccaaaaaagccgttcaatagtattattgagcacctgtcagtggtattcccatgttacaacagcactgagcttgctggttttattaaaaaagtgcgaagcaaaaacaagaactcactctcaggattgagtattgatgaaattgtccaaagagtgacagaacacattctagatgaacagaaaaagaaaaagccaaacccaggaaaggacaagaggacttatgagcccagctctgccacccccgtgaccaggtcctcccagggctcaccctcggtggttgttgcaccatcacccaaaaccaaggggcagaaagcagaagatgtccctgtgaggattgcactgggtgcaagttcctgtgaaatatgccacgaggtgttcaaatcaaaaaacgtgcgtgtgctcaaatgtgggcacaagtatcacaaagggtgctttaagcagtggcttaaagggcagagcgcttgcccggcctgccagggtcgtgatctcctgacagaagagtcaccttctggaagaggctggcccagtcagaatcaggagctgccttcctgctcttctaggtagtcacacttcactaaagtgtcatccaccagtgtgttgaatccgaagaatgacaattttctaccactggtgtaaaaaacaaacatttgaagacccttgtgcattgtgtgtcacaaagctaaatacatggaaatcgttaatatcgctgatattaagtaatttccccactctgagtgaatactttgatgattgccaacagtggctaataaaatgacggctaccacactcatgggtcactggggctgcgcagggctctttgaggtgggtggcttcttttggaaagtactatgaacgtctcgaagcagtattctagtgataagaattcttaacatagccaagcgccccacgtttgttccccacgtttgttccccttttctgtttgaaaaacctgttctggtagctccacaagagagatgatactgactttttaaattttttacaagagtctgtattcctgatatgcctatatttttcctcaaagattctgcattttaaggatgggcataagcaaactatattttaataatttatagttaatgttaaaatattggctgatttagaccaaaagattcaaatctcctctttgtgaaatcccatctgcatttgattttttattattttatgttcccccgttagattgttttaagtgtttgcttttcatcttttatagatgtaatctgattttcaaaaatcattaacactttttaattagtatcgactaagactttttccccctggaatcgaggctgtgtgtccgtcatcccagcccccggttggagcctgctctttgaactccgctgccttccttagcagcttctgtcctcttctgtgagtcagtcagcgagtgcttgggatccgcatccagccgtgctgagcacacaacaggctgtgtgtggaaatggccaccaccattctccttccccaccccaccacaaaaagagaagctgtgtctttagacaaccctgaggtatctgtgttacaatcgttctgtgtttgatatttgtgtaaagtatgcatgcagtcttgtactgtgacctaagaacaaaactgtaactgcattagaaaccatgaaaaaattagatattgttttgtgacttttagacagtggtaaatatagaaccatgaattctggtcacattccatttctctccaacatgaaggatcaaaaaatgtttttcaatgtgttctttgttccactggaaacttagagtcatgagtttatgagctgatttggtcaccttcctctgcctttgttcactgtgagttctgatgtcttagtgacttagttcttagaagctcacgccttagtttgaaacagattctccacggtggtccccaaaacactgtctgcatatccataagaattgagcgctatgggtgttaacgtgcatgaggatcagtttgcagcagcaagtacaaaaggagaagaggaacatccgttgaatgagtgtgttttgtacataacttcagatacttgtgaacatgccttatatttgtccaacaactgtcagaataaagaacattctaaaatgagaaaaaaaaaaaaaaaaaaaaaaaaaaaaaaaaaaaaaaccaacgccattgctcagctaacggccacgcttcaacctggtgatgccccggcatactttccagcatagagcgcggaataagcgcaatngcctgctctgcgatcacacaggccaacattccgtgataagactccatctcatggatagttcccnngagcgcaccgtcagcatgaaaccagctctcgaagtgcgacgatccgacaattngcgccgnaggccataaatgtacttgcataacctgactggcacggnttactggcccatatccttgggcgtgaccatcataanttccttccgtattacccgtattccctcgatgg

SEQ ID NO: 371542 - DNA, 8778 bp, Homo sapiens
  misc_feature (8547)..(8547): n is a, c, g, or t
  misc_feature (8611)..(8612): n is a, c, g, or t
  misc_feature (8665)..(8665): n is a, c, g, or t
  misc_feature (8672)..(8672): n is a, c, g, or t
  misc_feature (8710)..(8710): n is a, c, g, or t
  misc_feature (8746)..(8746): n is a, c, g, or t
ctgaactagttgccagtgatcttgaaacgtgacagtaaccaagagataaataggtgacaatgacaggaaaattagatgtagtaaaagagagtgtttgagagcagaagctatggcaactaaagactggatttgaatccttcctagcttggtgacatgagcaaattacttgatttaagtgagcattttcccatctgtacagtggagataacgataattgtgcctgctaagaagaattgctgtgaagattagtgaaataatgcatgtaaaacatttggtacagtatgtgacacatagtacaaatagtttgctaggaagattgttattattcttcacttgtgatattgtgaagttttcatacagcaaattggacatcatgagatggattgattaaataaatagatttgaacttcaaggactggtagtgttcttgctttggaaagaagaaacttggtttatcctaataatagtaggataataatggtgaagtgataggtacaagtaatagtgtttatgatgcgctggtgatgataggaaaagaaagccattatatgggcaagagctagaagtaataaaatggtgcatttttcagtgatgtttggcctatgtagctattctctgataactataaaaatccttattattgaagattcttcaggaaaaaaaaacccttagtctgaaactttagcaccaatcccccttgccccccattgaaatacgtatttttaaaacatggcttttgataatgtgagggttttttcctttttgcgatttagcagtgctgattgtgtattgcagtagttgtgagagcattagaagcagcagtcgataggaggatggaaggtctggatgccgccttggggagttaggagattggcagacttaccctgtaccactctagccctactcctttgcccaagacagaaacacactgagatggataggagaatatgagcagttgataggaaagttctcagtggagtcaggatttaggttaggccaggagattgagaatataacagtttgtgtatgatgaaatggcatatttcacagaatgcagtaaaagcaggtagggtacaagtgcagcaacaggaagatgtcttttcttcattcagcaaacacttatttgagagcttaccatgtgctaggcacatacaaagataaataagatgcccttgatgatcctctatttaaaggagacatgtacaattcacgtgcttctgagataaatttgaagaaactacaacatcttgagttgatggaagatattgtggatttggcaaagaaagttgctaatgattcattccttattggaggcttattgagaattggttgtaaaatagaaaataaaatcttggcaatggaagaagctctgaattggataaaatatgcaggcgatgtaacaattctaactaaattaggatcaattgacaattgttggcctatgttaagtattttctttactgaatacaagtaccacataactaaaattgtaatggaagactgcaatttgcttgaagaacttaaaactcaaagttgtatggattgtatagaggaaggagaactaatgaaaatgaaaggaaatgaagagttttccaaagaaagatttgatatagctattatctattacaccagagccattgaatatagacctgaaaactaccttctttatggtaaccgagctctttgttttcttcgtactggacagtttagaaatgcactcggtgatggaaagagagccactattctgaagaacacttggccaaagggtcattatcgttattgtgatgctctttctatgctgggggaatatgactgggccctgcaagcaaacataaaagctcaaaaactctgtaaaaatgaccctgagggaatcaaggatctaattcagcagcatgtaaagttacaaaaacaaatagaagacctacaaggtcgaacagcaaataaggatccaattaaagccttttatgaaaacagggcctacacacctaggagtttatcagcacctatatttactacttcacttaactttgtggagaaggaaagagatttcagaaaaattaatcacgaaatggccaacggtggtaatcagaatctaaaggtggcggatgaggcgttgaaggtagatgattgtgactgtcatcctgaattttcaccaccatcaagtcagcctccaaaacataaaggaaaacaaaaatctcgaaacaatgaatcagaaaagttcagttctagttcaccattgactttaccagcagatttgaagaacatcttggagaaacagttttctaaatcttccagagctgcacaccaggattttgctaatataatgaaaatgctgagaagcttaattcaagatggctatatggccttattggagcagcgttgccgcagcgctgcacaggcctttacagagttgctgaacggtttagatcctcaaaaaataaagcaattgaacctggccatgattaactatgttttggtcgtctatggacttgccatttctctccttggaataggacagcctgaggaattatctgaagccgaaaaccagtttaagaggattattgaacactaccccagtgagggccttgattgcttggcctactgtggaattggaaaagtgtatttgaaaaaaaacagatttctagaagctctcaatcactttgagaaagcaagaaccttgatttatcgtcttcctggagtgttaacttggcccacgagtaatgtgattattgaagagtctcagccacaaaaaataaagatgctgttagagaaatttgttgaagaatgcaagttccctccagtgccagatgccatttgttgctatcagaagtgccatggatattctaagatccagatatacataactgatccagactttaagggttttatacgcatcagctgttgccagtactgtaaaatagaatttcacatgaattgctggaagaagttaaaaactacaacctttaatgataaaattgacaaggattttctacaaggaatatgtcttacccctgactgtgaaggtgtcatttctaagattatcatcttcagcagtggtggtgaagttaaatgtgaatttgaacacaaggtcataaaagaaaaggttcctccaagacctattctgaaacagaaatgttctagcctagagaaactaagactgaaagaagacaaaaaattgaagagaaagatccaaaaaaaagaagcaaaaaagttagcacaagaaagaatggaggaggacttaagagaaagtaatccacccaaaaatgaagagcagaaagaaactgtagacaatgttcagcgttgtcagttccttgatgacagaattctacagtgtataaagcagtatgctgacaagattaaatccggcatacagaatacagccatgcttctcaaagaattgctttcttggaaagttttgagcacagaagactatacaacctgtttttctagcagaaattttctaaatgaagcagtggactatgttattcgccacttgattcaagaaaataacagagtaaagacaagaatatttctgcatgttttgagtgagcttaaagaagtggagcccaaattagccgcctggatccaaaaacttaatagctttggcttagatgccacaggaactttcttttctcgttatggagcatctcttaaactgcttgattttagtatcatgactttcctctggaatgagaaatatggtcacaaactagactctatagaaggaaagcaacttgattatttctctgagccagcatcattgaaggaagcccgttgtttaatatggctgctagaagaacacagagacaagttcccagcattgcatagtgctttagatgaattctttgatataatggacagccgctgtactgtgttaaggaaacaagatagtggtgaagcaccgtttagttcaaccaaggtgaaaaacaaaagcaagaaaaagaagccaaaggattcaaagcctatgttagttgggtctggaacaacttcagtaacttcaaataatgagatcatcacttcaagtgaagaccatagcaatcgaaattcagattctgcaggcccatttgcagtgcctgaccatcttcggcaagatgtagaagaattcgaagctctctatgaccaacacagtaacgaatatgttgtccgcaataagaagctatgggacatgaacccaaaacaaaaatgttcaactctatatgattacttctctcagtttttggaggaacatggtcccttggacatgagtaacaagatgttctctgcagaatatgagtttttcccagaagaaactcgacagatactagaaaaagcaggaggtttaaaaccttttctcttgggatgccctcgttttgttgtgattgacaactgtattgcactgaagaaggttgcatcacggctcaagaaaaaaaggaagaagaaaaacattaaaacaaaagtagaagaaatttcaaaagcaggggagtatgtacgagttaaactacaactgaatccagctgctagggaatttaaaccagatgtaaagtctaaaccagtgtcagattcatcttcagcaccagcttttgaaaatgtgaaacccaaacctgtgtctgcaaattctcccaagccagcttgtgaagatgtgaaggccaaaccagtatccgacaattcttctagacaagtttctgaggatgggcaacccaaaggggtctcttctaattctcctaaaccaggctctgaggatgcaaattacaagcgagtctcctgtaattcccccaaaccggttcttgaggatgtgaaaccaacttattgggctcaatcccatttggtcacaggatactgtacgtatcttcctttccagagatttgatatcacccagacaccgccagcatacataaacgtgttaccaggtttgccccagtacaccagcatatatacacccttggccagcctttctcctgaatatcagctaccaagatcagtaccagtggtgccgtcttttgtagccaatgacagagcagattggtcaccagattgcctctgaaacacagatccttgagggctctttgggaatatctgtaaagtcacactgcagcacaggtgatgctcatacagtcctgagtgagtctaacagaaatgatgagcactgtggaaattctaacaacaaatgtgaagtaattccagaaagcaccagtgcagtaacaaacattccacacgtgcagatggttgccatacaggtatcttggaacataatacaccaagaagtcaatactgagccatataatccttttgaggaacgacaaggggaaatttcacggattgaaaaggagcaccaagtattacaagaccaacttcaagaagtgtatgaaaattatgagcagataaaacttaagggcttagaagagaccagggacctggaagagaagttgaaaaggcacttagaagaaaacaagatctcaaagacggaattagattggttccttcaagatttggaaagagaaattaaaaaatggcaacaggaaaaaaaagaaatccaagaaagactaaaatcactgaagaagaaaattaaaaaggtttcaaatgccagtgaaatgtatacccagaaaaatgatggaaaggaaaaggaacatgaattacatctggatcagtcccttgaaatcagcaacacacttacaaatgagaaaatgaaaatagaagagtatataaagaaagggaaagaggattatgaagagagtcatcagagagctgtggctgcagaggtatccgtacttgaaaactggaaggagagtgaagtgtataagctacagatcatggagtcacaagcagaagcctttctgaagaagctggggctgattagccgtgatcctgcagcatatcctgacatggagtctgatatacgttcatgggaattgtttctttctaatgttacaaaagaaattgagaaagcaaagtctcagtttgaagaacaaattaaggcaattaaaaatggttctcggctcagtgaactttctaaagtgcagatttctgagctttcatttcctgcctgtaacacggttcatcccgagttactccctgagtcttcaggccacgatggccaagggcttgtgacttctgcaagcgacgtgactggaaaccacgcagcacttcacagggatcctagtgtgttctctgctggtgattccccaggggaggctccttctgcgctgttgccagggccaccccctggtcagcctgaagccactcagctgacagggccaaaacgggctggccaggcagctctgtcagaacgaagccctgtggctgatcggaagcagcctgttcctccaggacgtgctgcgcgttcaagccagtctccaaaaaagccgttcaatagtattattgagcacctgtcagtggtattcccatgttacaacagcactgagcttgctggttttattaaaaaagtgcgaagcaaaaacaagaactcactctcaggattgagtattgatgaaattgtccaaagagtgacagaacacattctagatgaacagaaaaagaaaaagccaaacccaggaaaggacaagaggacttatgagcccagctctgccacccccgtgaccaggtcctcccagggctcaccctcggtggttgttgcaccatcacccaaaaccaaggggcagaaagcagaagatgtccctgtgaggattgcactgggtgcaagttcctgtgaaatatgccacgaggtgttcaaatcaaaaaacgtgcgtgtgctcaaatgtgggcacaagtatcacaaagggtgctttaagcagtggcttaaagggcagagcgcttgcccggcctgccagggtcgtgatctcctgacagaagagtcaccttctggaagaggctggcccagtcagaatcaggagctgccttcctgctcttctaggtagtcacacttcactaaagtgtcatccaccagtgtgttgaatccgaagaatgacaattttctaccactggtgtaaaaaacaaacatttgaagacccttgtgcattgtgtgtcacaaagctaaatacatggaaatcgttaatatcgctgatattaagtaatttccccactctgagtgaatactttgatgattgccaacagtggctaataaaatgacggctaccacactcatgggtcactggggctgcgcagggctctttgaggtgggtggcttcttttggaaagtactatgaacgtctcgaagcagtattctagtgataagaattcttaacatagccaagcgccccacgtttgttccccacgtttgttccccttttctgtttgaaaaacctgttctggtagctccacaagagagatgatactgactttttaaattttttacaagagtctgtattcctgatatgcctatatttttcctcaaagattctgcattttaaggatgggcataagcaaactatattttaataatttatagttaatgttaaaatattggctgatttagaccaaaagattcaaatctcctctttgtgaaatcccatctgcatttgattttttattattttatgttcccccgttagattgttttaagtgtttgcttttcatcttttatagatgtaatctgattttcaaaaatcattaacactttttaattagtatcgactaagactttttccccctggaatcgaggctgtgtgtccgtcatcccagcccccggttggagcctgctctttgaactccgctgccttccttagcagcttctgtcctcttctgtgagtcagtcagcgagtgcttgggatccgcatccagccgtgctgagcacacaacaggctgtgtgtggaaatggccaccaccattctccttccccaccccaccacaaaaagagaagctgtgtctttagacaaccctgaggtatctgtgttacaatcgttctgtgtttgatatttgtgtaaagtatgcatgcagtcttgtactgtgacctaagaacaaaactgtaactgcattagaaaccatgaaaaaattagatattgttttgtgacttttagacagtggtaaatatagaaccatgaattctggtcacattccatttctctccaacatgaaggatcaaaaaatgtttttcaatgtgttctttgttccactggaaacttagagtcatgagtttatgagctgatttggtcaccttcctctgcctttgttcactgtgagttctgatgtcttagtgacttagttcttagaagctcacgccttagtttgaaacagattctccacggtggtccccaaaacactgtctgcatatccataagaattgagcgctatgggtgttaacgtgcatgaggatcagtttgcagcagcaagtacaaaaggagaagaggaacatccgttgaatgagtgtgttttgtacataacttcagatacttgtgaacatgccttatatttgtccaacaactgtcagaataaagaacattctaaaatgagaaaaaaaaaaaaaaaaaaaaaaaaaaaaaaaaaaaaaaccaacgccattgctcagctaacggccacgcttcaacctggtgatgccccggcatactttccagcatagagcgcggaataagcgcaatngcctgctctgcgatcacacaggccaacattccgtgataagactccatctcatggatagttcccnngagcgcaccgtcagcatgaaaccagctctcgaagtgcgacgatccgacaattngcgccgnaggccataaatgtacttgcataacctgactggcacggnttactggcccatatccttgggcgtgaccatcataanttccttccgtattacccgtattccctcgatgg

SEQ ID NO: 371543 - DNA, 5106 bp, Homo sapiens
  misc_feature (4875)..(4875): n is a, c, g, or t
  misc_feature (4939)..(4940): n is a, c, g, or t
  misc_feature (4993)..(4993): n is a, c, g, or t
  misc_feature (5000)..(5000): n is a, c, g, or t
  misc_feature (5038)..(5038): n is a, c, g, or t
  misc_feature (5074)..(5074): n is a, c, g, or t
tgtgtcaaagccaaataaggaatagaacatggcctatgccagtagtatgaggcgttattttaaggctttagtgtactatatggaaatgtaaatatttagttttctcacaaaaccatctgtatattcctacagacagccgctgtactgtgttaaggaaacaagatagtggtgaagcaccgtttagttcaaccaaggtgaaaaacaaaagcaagaaaaagaagccaaaggattcaaagcctatgttagttgggtctggaacaacttcagtaacttcaaataatgagatcatcacttcaagtgaagaccatagcaatcgaaattcagattctgcaggcccatttgcagtgcctgaccatcttcggcaagatgtagaagaattcgaagctctctatgaccaacacagtaacgaatatgttgtccgcaataagaagctatgggacatgaacccaaaacaaaaatgttcaactctatatgattacttctctcagtttttggaggaacatggtcccttggacatgagtaacaagatgttctctgcagaatatgagtttttcccagaagaaactcgacagatactagaaaaagcaggaggtttaaaaccttttctcttgggatgccctcgttttgttgtgattgacaactgtattgcactgaagaaggttgcatcacggctcaagaaaaaaaggaagaagaaaaacattaaaacaaaagtagaagaaatttcaaaagcaggggagtatgtacgagttaaactacaactgaatccagctgctagggaatttaaaccagatgtaaagtctaaaccagtgtcagattcatcttcagcaccagcttttgaaaatgtgaaacccaaacctgtgtctgcaaattctcccaagccagcttgtgaagatgtgaaggccaaaccagtatccgacaattcttctagacaagtttctgaggatgggcaacccaaaggggtctcttctaattctcctaaaccaggctctgaggatgcaaattacaagcgagtctcctgtaattcccccaaaccggttcttgaggatgtgaaaccaacttattgggctcaatcccatttggtcacaggatactgtacgtatcttcctttccagagatttgatatcacccagacaccgccagcatacataaacgtgttaccaggtttgccccagtacaccagcatatatacacccttggccagcctttctcctgaatatcagctaccaagatcagtaccagtggtgccgtcttttgtagccaatgacagagcagataaaaatgctgctgcctattttgagggtcatcatttgaatgctgagaatgttgctggtcaccagattgcctctgaaacacagatccttgagggctctttgggaatatctgtaaagtcacactgcagcacaggtgatgctcatacagtcctgagtgagtctaacagaaatgatgagcactgtggaaattctaacaacaaatgtgaagtaattccagaaagcaccagtgcagtaacaaacattccacacgtgcagatggttgccatacaggtatcttggaacataatacaccaagaagtcaatactgagccatataatccttttgaggaacgacaaggggaaatttcacggattgaaaaggagcaccaagtattacaagaccaacttcaagaagtgtatgaaaattatgagcagataaaacttaagggcttagaagagaccagggacctggaagagaagttgaaaaggcacttagaagaaaacaagatctcaaagacggaattagattggttccttcaagatttggaaagagaaattaaaaaatggcaacaggaaaaaaaagaaatccaagaaagactaaaatcactgaagaagaaaattaaaaaggtttcaaatgccagtgaaatgtatacccagaaaaatgatggaaaggaaaaggaacatgaattacatctggatcagtcccttgaaatcagcaacacacttacaaatgagaaaatgaaaatagaagagtatataaagaaagggaaagaggattatgaagagagtcatcagagagctgtggctgcagaggtatccgtacttgaaaactggaaggagagtgaagtgtataagctacagatcatggagtcacaagcagaagcctttctgaagaagctggggctgattagccgtgatcctgcagcatatcctgacatggagtctgatatacgttcatgggaattgtttctttctaatgttacaaaagaaattgagaaagcaaagtctcagtttgaagaacaaattaaggcaattaaaaatggttctcggctcagtgaactttctaaagtgcagatttctgagctttcatttcctgcctgtaacacggttcatcccgagttactccctgagtcttcaggccacgatggccaagggcttgtgacttctgcaagcgacgtgactggaaaccacgcagcacttcacagggatcctagtgtgttctctgctggtgattccccaggggaggctccttctgcgctgttgccagggccaccccctggtcagcctgaagccactcagctgacagggccaaaacgggctggccaggcagctctgtcagaacgaagccctgtggctgatcggaagcagcctgttcctccaggacgtgctgcgcgttcaagccagtctccaaaaaagccgttcaatagtattattgagcacctgtcagtggtattcccatgttacaacagcactgagcttgctggttttattaaaaaagtgcgaagcaaaaacaagaactcactctcaggattgagtattgatgaaattgtccaaagagtgacagaacacattctagatgaacagaaaaagaaaaagccaaacccaggaaaggacaagaggacttatgagcccagctctgccacccccgtgaccaggtcctcccagggctcaccctcggtggttgttgcaccatcacccaaaaccaaggggcagaaagcagaagatgtccctgtgaggattgcactgggtgcaagttcctgtgaaatatgccacgaggtgttcaaatcaaaaaacgtgcgtgtgctcaaatgtgggcacaagtatcacaaagggtgctttaagcagtggcttaaagggcagagcgcttgcccggcctgccagggtcgtgatctcctgacagaagagtcaccttctggaagaggctggcccagtcagaatcaggagctgccttcctgctcttctaggtagtcacacttcactaaagtgtcatccaccagtgtgttgaatccgaagaatgacaattttctaccactggtgtaaaaaacaaacatttgaagacccttgtgcattgtgtgtcacaaagctaaatacatggaaatcgttaatatcgctgatattaagtaatttccccactctgagtgaatactttgatgattgccaacagtggctaataaaatgacggctaccacactcatgggtcactggggctgcgcagggctctttgaggtgggtggcttcttttggaaagtactatgaacgtctcgaagcagtattctagtgataagaattcttaacatagccaagcgccccacgtttgttccccacgtttgttccccttttctgtttgaaaaacctgttctggtagctccacaagagagatgatactgactttttaaattttttacaagagtctgtattcctgatatgcctatatttttcctcaaagattctgcattttaaggatgggcataagcaaactatattttaataatttatagttaatgttaaaatattggctgatttagaccaaaagattcaaatctcctctttgtgaaatcccatctgcatttgattttttattattttatgttcccccgttagattgttttaagtgtttgcttttcatcttttatagatgtaatctgattttcaaaaatcattaacactttttaattagtatcgactaagactttttccccctggaatcgaggctgtgtgtccgtcatcccagcccccggttggagcctgctctttgaactccgctgccttccttagcagcttctgtcctcttctgtgagtcagtcagcgagtgcttgggatccgcatccagccgtgctgagcacacaacaggctgtgtgtggaaatggccaccaccattctccttccccaccccaccacaaaaagagaagctgtgtctttagacaaccctgaggtatctgtgttacaatcgttctgtgtttgatatttgtgtaaagtatgcatgcagtcttgtactgtgacctaagaacaaaactgtaactgcattagaaaccatgaaaaaattagatattgttttgtgacttttagacagtggtaaatatagaaccatgaattctggtcacattccatttctctccaacatgaaggatcaaaaaatgtttttcaatgtgttctttgttccactggaaacttagagtcatgagtttatgagctgatttggtcaccttcctctgcctttgttcactgtgagttctgatgtcttagtgacttagttcttagaagctcacgccttagtttgaaacagattctccacggtggtccccaaaacactgtctgcatatccataagaattgagcgctatgggtgttaacgtgcatgaggatcagtttgcagcagcaagtacaaaaggagaagaggaacatccgttgaatgagtgtgttttgtacataacttcagatacttgtgaacatgccttatatttgtccaacaactgtcagaataaagaacattctaaaatgagaaaaaaaaaaaaaaaaaaaaaaaaaaaaaaaaaaaaaaccaacgccattgctcagctaacggccacgcttcaacctggtgatgccccggcatactttccagcatagagcgcggaataagcgcaatngcctgctctgcgatcacacaggccaacattccgtgataagactccatctcatggatagttcccnngagcgcaccgtcagcatgaaaccagctctcgaagtgcgacgatccgacaattngcgccgnaggccataaatgtacttgcataacctgactggcacggnttactggcccatatccttgggcgtgaccatcataanttccttccgtattacccgtattccctcgatgg

SEQ ID NO: 371544 - DNA, 8118 bp, Homo sapiens
  misc_feature (7887)..(7887): n is a, c, g, or t
  misc_feature (7951)..(7952): n is a, c, g, or t
  misc_feature (8005)..(8005): n is a, c, g, or t
  misc_feature (8012)..(8012): n is a, c, g, or t
  misc_feature (8050)..(8050): n is a, c, g, or t
  misc_feature (8086)..(8086): n is a, c, g, or t
ctgaactagttgccagtgatcttgaaacgtgacagtaaccaagagataaataggtgacaatgacaggaaaattagatgtagtaaaagagagtgtttgagagcagaagctatggcaactaaagactggatttgaatccttcctagcttggtgacatgagcaaattacttgatttaagtgagcattttcccatctgtacagtggagataacgataattgtgcctgctaagaagaattgctgtgaagattagtgaaataatgcatgtaaaacatttggtacagtatgtgacacatagtacaaatagtttgctaggaagattgttattattcttcacttgtgatattgtgaagttttcatacagcaaattggacatcatgagatggattgattaaataaatagatttgaacttcaaggactggtagtgttcttgctttggaaagaagaaacttggtttatcctaataatagtaggataataatggtgaagtgataggtacaagtaatagtgtttatgatgcgctggtgatgataggaaaagaaagccattatatgggcaagagctagaagtaataaaatggtgcatttttcagtgatgtttggcctatgtagctattctctgataactataaaaatccttattattgaagattcttcaggaaaaaaaaacccttagtctgaaactttagcaccaatcccccttgccccccattgaaatacgtatttttaaaacatggcttttgataatgtgagggttttttcctttttgcgatttagcagtgctgattgtgtattgcagtagttgtgagagcattagaagcagcagtcgataggaggatggaaggtctggatgccgccttggggagttaggagattggcagacttaccctgtaccactctagccctactcctttgcccaagacagaaacacactgagatggataggagaatatgagcagttgataggaaagttctcagtggagtcaggatttaggttaggccaggagattgagaatataacagtttgtgtatgatgaaatggcatatttcacagaatgcagtaaaagcaggtagggtacaagtgcagcaacaggaagatgtcttttcttcattcagcaaacacttatttgagagcttaccatgtgctaggcacatacaaagataaataagatgcccttgatgatcctctatttaaaggagacatgtacaattcacgtgcttctgagataaatttgaagaaactacaacatcttgagttgatggaagatattgtggatttggcaaagaaagttgctaatgattcattccttattggaggcttattgagaattggttgtaaaatagaaaataaaatcttggcaatggaagaagctctgaattggataaaatatgcaggcgatgtaacaattctaactaaattaggatcaattgacaattgttggcctatgttaagtattttctttactgaatacaagtaccacataactaaaattgtaatggaagactgcaatttgcttgaagaacttaaaactcaaagttgtatggattgtatagaggaaggagaactaatgaaaatgaaaggaaatgaagagttttccaaagaaagatttgatatagctattatctattacaccagagccattgaatatagacctgaaaactaccttctttatggtaaccgagctctttgttttcttcgtactggacagtttagaaatgcactcggtgatggaaagagagccactattctgaagaacacttggccaaagggtcattatcgttattgtgatgctctttctatgctgggggaatatgactgggccctgcaagcaaacataaaagctcaaaaactctgtaaaaatgaccctgagggaatcaaggatctaattcagcagcatgtaaagttacaaaaacaaatagaagacctacaaggtcgaacagcaaataaggatccaattaaagccttttatgaaaacagggcctacacacctaggagtttatcagcacctatatttactacttcacttaactttgtggagaaggaaagagatttcagaaaaattaatcacgaaatggccaacggtggtaatcagaatctaaaggtggcggatgaggcgttgaaggtagatgattgtgactgtcatcctgaattttcaccaccatcaagtcagcctccaaaacataaaggaaaacaaaaatctcgaaacaatgaatcagaaaagttcagttctagttcaccattgactttaccagcagatttgaagaacatcttggagaaacagttttctaaatcttccagagctgcacaccaggattttgctaatataatgaaaatgctgagaagcttaattcaagatggctatatggccttattggagcagcgttgccgcagcgctgcacaggcctttacagagttgctgaacggtttagatcctcaaaaaataaagcaattgaacctggccatgattaactatgttttggtcgtctatggacttgccatttctctccttggaataggacagcctgaggaattatctgaagccgaaaaccagtttaagaggattattgaacactaccccagtgagggccttgattgcttggcctactgtggaattggaaaagtgtatttgaaaaaaaacagatttctagaagctctcaatcactttgagaaagcaagaaccttgatttatcgtcttcctggagtgttaacttggcccacgagtaatgtgattattgaagagtctcagccacaaaaaataaagatgctgttagagaaatttgttgaagaatgcaagttccctccagtgccagatgccatttgttgctatcagaagtgccatggatattctaagatccagatatacataactgatccagactttaagggttttatacgcatcagctgttgccagtactgtaaaatagaatttcacatgaattgctggaagaagttaaaaactacaacctttaatgataaaattgacaaggattttctacaaggaatatgtcttacccctgactgtgaaggtgtcatttctaagattatcatcttcagcagtggtggtgaagttaaatgtgaatttgaacacaaggtcataaaagaaaaggttcctccaagacctattctgaaacagaaatgttctagcctagagaaactaagactgaaagaagacaaaaaattgaagagaaagatccaaaaaaaagaagcaaaaaagttagcacaagaaagaatggaggaggacttaagagaaagtaatccacccaaaaatgaagagcagaaagaaactgtagacaatgttcagcgttgtcagttccttgatgacagaattctacagtgtataaagcagtatgctgacaagattaaatccggcatacagaatacagccatgcttctcaaagaattgctttcttggaaagttttgagcacagaagactatacaacctgtttttctagcagaaattttctaaatgaagcagtggactatgttattcgccacttgattcaagaaaataacagagtaaagacaagaatatttctgcatgttttgagtgagcttaaagaagtggagcccaaattagccgcctggatccaaaaacttaatagctttggcttagatgccacaggaactttcttttctcgttatggagcatctcttaaactgcttgattttagtatcatgactttcctctggaatgagaaatatggtcacaaactagactctatagaaggaaagcaacttgattatttctctgagccagcatcattgaaggaagcccgttgtttaatatggctgctagaagaacacagagacaagttcccagcattgcatagtgctttagatgaattctttgatataatggacagccgctgtactgtgttaaggaaacaagatagtggtgaagcaccgtttagttcaaccaaggtgaaaaacaaaagcaagaaaaagaagccaaaggattcaaagcctatgttagttgggtctggaacaacttcagtaacttcaaataatgagatcatcacttcaagtgaagaccatagcaatcgaaattcagattctgcaggcccatttgcagtgcctgaccatcttcggcaagatgtagaagaattcgaagctctctatgaccaacacagtaacgaatatgttgtccgcaataagaagctatgggacatgaacccaaaacaaaaatgttcaactctatatgattacttctctcagtttttggaggaacatggtcccttggacatgagtaacaagatgttctctgcagaatatgagtttttcccagaagaaactcgacagatactagaaaaagcaggaggtttaaaaccttttctcttgggatgccctcgttttgttgtgattgacaactgtattgcactgaagaaggttgcatcacggctcaagaaaaaaaggaagaagaaaaacattaaaacaaaagtagaagaaatttcaaaagcaggggagtatgtacgagttaaactacaactgaatccagctgctagggaatttaaaccagatgtaaagtctaaaccagtgtcagattcatcttcagcaccagcttttgaaaatgtgaaacccaaacctgtgtctgcaaattctcccaagccagcttgtgaagatgtgaaggccaaaccagtatccgacaattcttctagacaagtttctgaggatgggcaacccaaaggggtctcttctaattctcctaaaccaggctctgaggatgcaaattacaagcgagtctcctgtaattcccccaaaccggttcttgaggatgtgaaaccaacttattgggctcaatcccatttggtcacaggatactgtacgtatcttcctttccagagatttgatatcacccagacaccgccagcatacataaacgtgttaccaggtttgccccagtacaccagcatatatacacccttggccagcctttctcctgaatatcagctaccaagatcagtaccagtggtgccgtcttttgtagccaatgacagagcagataaaaatgctgctgcctattttgagggtcatcatttgaatgctgagaatgttgctggtcaccagattgcctctgaaacacagatccttgagggctctttgggaatatctgtaaagtcacactgcagcacaggtgatgctcatacagtcctgagtgagtctaacagaaatgatgagcactgtggaaattctaacaacaaatgtgaagtaattccagaaagcaccagtgcagtaacaaacattccacacgtgcagatggttgccatacaggtatcttggaacataatacaccaagaagtcaatactgagccatataatccttttgaggaacgacaaggggaaatttcacggattgaaaaggagcaccaagtattacaagaccaacttcaagaagtgtatgaaaattatgagcagataaaacttaagggcttagaagagaccagggacctggaagagaagttgaaaaggcacttagaagaaaacaagatctcaaagacggaattagattggttccttcaagatttggaaagagaaattaaaaaatggcaacaggaaaaaaaagaaatccaagaaagactaaaatcactgaagaagaaaattaaaaaggtttcaaatgccagtgaaatgtatacccagaaaaatgatggaaaggaaaaggaacatgaattacatctggatcagtcccttgaaatcagcaacacacttacaaatgagaaaatgaaaatagaagagtatataaagaaagggaaagaggattatgaagagagtcatcagagagctgtggctgcagaggtatccgtacttgaaaactggaaggagagtgaagtgtataagctacagatcatggagtcacaagcagaagcctttctgaagaagctggggctgattagccgtgatcctgcagcatatcctgacatggagtctgatatacgttcatgggaattgtttctttctaatgttacaaaagaaattgagaaagcaaagtctcagtttgaagaacaaattaaggcaattaaaaatggttctcggctcagtgaactttctaaagtgcagatttctgagctttcatttcctgcctgtaacacggttcatcccgagttactccctgagtcttcaggccacgatggccaagggcttgtgacttctgcaagcgacgtgactggaaaccacgcagcacttcacagggatcctagtgtgttctctgctggtgattccccaggggaggctccttctgcgctgttgccagggccaccccctggtcagcctgaagccactcagctgacagggccaaaacgggctggccaggcagctctgtcagaacgaagccctgtggctgatcggaagcagcctgttcctccaggacgtgctgcgcgttcaagccagtctccaaaaaagccgttcaatagtattattgagcacctgtcagtggtattcccatgttacaacagcactgagcttgctggttttattaaaaaagtgcgaagcaaaaacaagaactcactctcaggattgagtattgatgaaattgtccaaagagtgacagaacacattctagatgaacagaaaaagaaaaagccaaacccaggaaaggacaagaggacttatgagcccagctctgccacccccgtgaccaggtcctcccagggctcaccctcggtggttgttgcaccatcacccaaaaccaaggggcagaaagcagaagatgtccctgtgaggattgcactgggtgcaagttcctgtgaaatatgccacgaggtgttcaaatcaaaaaacgtgcgtgtgctcaaatgtgggcacaagtatcacaaagggtgctttaagcagtggcttaaagggcagagcgcttgcccggcctgccagggtcgtgatctcctgacagaagagtcaccttctggaagaggctggcccagtcagaatcaggagctgccttcctgctcttctagtatcgactaagactttttccccctggaatcgaggctgtgtgtccgtcatcccagcccccggttggagcctgctctttgaactccgctgccttccttagcagcttctgtcctcttctgtgagtcagtcagcgagtgcttgggatccgcatccagccgtgctgagcacacaacaggctgtgtgtggaaatggccaccaccattctccttccccaccccaccacaaaaagagaagctgtgtctttagacaaccctgaggtatctgtgttacaatcgttctgtgtttgatatttgtgtaaagtatgcatgcagtcttgtactgtgacctaagaacaaaactgtaactgcattagaaaccatgaaaaaattagatattgttttgtgacttttagacagtggtaaatatagaaccatgaattctggtcacattccatttctctccaacatgaaggatcaaaaaatgtttttcaatgtgttctttgttccactggaaacttagagtcatgagtttatgagctgatttggtcaccttcctctgcctttgttcactgtgagttctgatgtcttagtgacttagttcttagaagctcacgccttagtttgaaacagattctccacggtggtccccaaaacactgtctgcatatccataagaattgagcgctatgggtgttaacgtgcatgaggatcagtttgcagcagcaagtacaaaaggagaagaggaacatccgttgaatgagtgtgttttgtacataacttcagatacttgtgaacatgccttatatttgtccaacaactgtcagaataaagaacattctaaaatgagaaaaaaaaaaaaaaaaaaaaaaaaaaaaaaaaaaaaaaccaacgccattgctcagctaacggccacgcttcaacctggtgatgccccggcatactttccagcatagagcgcggaataagcgcaatngcctgctctgcgatcacacaggccaacattccgtgataagactccatctcatggatagttcccnngagcgcaccgtcagcatgaaaccagctctcgaagtgcgacgatccgacaattngcgccgnaggccataaatgtacttgcataacctgactggcacggnttactggcccatatccttgggcgtgaccatcataanttccttccgtattacccgtattccctcgatgg

SEQ ID NO: 371545 - DNA, 3111 bp, Homo sapiens
  misc_feature (2880)..(2880): n is a, c, g, or t
  misc_feature (2944)..(2945): n is a, c, g, or t
  misc_feature (2998)..(2998): n is a, c, g, or t
  misc_feature (3005)..(3005): n is a, c, g, or t
  misc_feature (3043)..(3043): n is a, c, g, or t
  misc_feature (3079)..(3079): n is a, c, g, or t
cggcacgagtcggcacgagctcgtgccgggattatgaagagagtcatcagagagctgtggctgcagaggtatccgtacttgaaaactggaaggagagtgaagtgtataagctacagatcatggagtcacaagcagaagcctttctgaagaagctggggctgattagccgtgatcctgcagcatatcctgacatggagtctgatatacgttcatgggaattgtttctttctaatgttacaaaagaaattgagaaagcaaagtctcagtttgaagaacaaattaaggcaattaaaaatggttctcggctcagtgaactttctaaagtgcagatttctgagctttcatttcctgcctgtaacacggttcatcccgagttactccctgagtcttcaggccacgatggccaagggcttgtgacttctgcaagcgacgtgactggaaaccacgcagcacttcacagggatcctagtgtgttctctgctggtgattccccaggggaggctccttctgcgctgttgccagggccaccccctggtcagcctgaagccactcagctgacagggccaaaacgggctggccaggcagctctgtcagaacgaagccctgtggctgatcggaagcagcctgttcctccaggacgtgctgcgcgttcaagccagtctccaaaaaagccgttcaatagtattattgagcacctgtcagtggtattcccatgttacaacagcactgagcttgctggttttattaaaaaagtgcgaagcaaaaacaagaactcactctcaggattgagtattgatgaaattgtccaaagagtgacagaacacattctagatgaacagaaaaagaaaaagccaaacccaggaaaggacaagaggacttatgagcccagctctgccacccccgtgaccaggtcctcccagggctcaccctcggtggttgttgcaccatcacccaaaaccaaggggcagaaagcagaagatgtccctgtgaggattgcactgggtgcaagttcctgtgaaatatgccacgaggtgttcaaatcaaaaaacgtgcgtgtgctcaaatgtgggcacaagtatcacaaagggtgctttaagcagtggcttaaagggcagagcgcttgcccggcctgccagggtcgtgatctcctgacagaagagtcaccttctggaagaggctggcccagtcagaatcaggagctgccttcctgctcttctaggtagtcacacttcactaaagtgtcatccaccagtgtgttgaatccgaagaatgacaattttctaccactggtgtaaaaaacaaacatttgaagacccttgtgcattgtgtgtcacaaagctaaatacatggaaatcgttaatatcgctgatattaagtaatttccccactctgagtgaatactttgatgattgccaacagtggctaataaaatgacggctaccacactcatgggtcactggggctgcgcagggctctttgaggtgggtggcttcttttggaaagtactatgaacgtctcgaagcagtattctagtgataagaattcttaacatagccaagcgccccacgtttgttccccacgtttgttccccttttctgtttgaaaaacctgttctggtagctccacaagagagatgatactgactttttaaattttttacaagagtctgtattcctgatatgcctatatttttcctcaaagattctgcattttaaggatgggcataagcaaactatattttaataatttatagttaatgttaaaatattggctgatttagaccaaaagattcaaatctcctctttgtgaaatcccatctgcatttgattttttattattttatgttcccccgttagattgttttaagtgtttgcttttcatcttttatagatgtaatctgattttcaaaaatcattaacactttttaattagtatcgactaagactttttccccctggaatcgaggctgtgtgtccgtcatcccagcccccggttggagcctgctctttgaactccgctgccttccttagcagcttctgtcctcttctgtgagtcagtcagcgagtgcttgggatccgcatccagccgtgctgagcacacaacaggctgtgtgtggaaatggccaccaccattctccttccccaccccaccacaaaaagagaagctgtgtctttagacaaccctgaggtatctgtgttacaatcgttctgtgtttgatatttgtgtaaagtatgcatgcagtcttgtactgtgacctaagaacaaaactgtaactgcattagaaaccatgaaaaaattagatattgttttgtgacttttagacagtggtaaatatagaaccatgaattctggtcacattccatttctctccaacatgaaggatcaaaaaatgtttttcaatgtgttctttgttccactggaaacttagagtcatgagtttatgagctgatttggtcaccttcctctgcctttgttcactgtgagttctgatgtcttagtgacttagttcttagaagctcacgccttagtttgaaacagattctccacggtggtccccaaaacactgtctgcatatccataagaattgagcgctatgggtgttaacgtgcatgaggatcagtttgcagcagcaagtacaaaaggagaagaggaacatccgttgaatgagtgtgttttgtacataacttcagatacttgtgaacatgccttatatttgtccaacaactgtcagaataaagaacattctaaaatgagaaaaaaaaaaaaaaaaaaaaaaaaaaaaaaaaaaaaaaccaacgccattgctcagctaacggccacgcttcaacctggtgatgccccggcatactttccagcatagagcgcggaataagcgcaatngcctgctctgcgatcacacaggccaacattccgtgataagactccatctcatggatagttcccnngagcgcaccgtcagcatgaaaccagctctcgaagtgcgacgatccgacaattngcgccgnaggccataaatgtacttgcataacctgactggcacggnttactggcccatatccttgggcgtgaccatcataanttccttccgtattacccgtattccctcgatgg

SEQ ID NO: 371546 - DNA, 3179 bp, Homo sapiens
  misc_feature (2948)..(2948): n is a, c, g, or t
  misc_feature (3012)..(3013): n is a, c, g, or t
  misc_feature (3066)..(3066): n is a, c, g, or t
  misc_feature (3073)..(3073): n is a, c, g, or t
  misc_feature (3111)..(3111): n is a, c, g, or t
  misc_feature (3147)..(3147): n is a, c, g, or t
atcaagttctgatgattctgtcatgcttcatttaaggagaaatgggaaagtggtttgaatgtttaagttttaacctttaaaatagtttcaggctgtcatttgtaaaatactcatatgtcttctgatctactggcaggtatccgtacttgaaaactggaaggagagtgaagtgtataagctacagatcatggagtcacaagcagaagcctttctgaagaagctggggctgattagccgtgatcctgcagcatatcctgacatggagtctgatatacgttcatgggaattgtttctttctaatgttacaaaagaaattgagaaagcaaagtctcagtttgaagaacaaattaaggcaattaaaaatggttctcggctcagtgaactttctaaagtgcagatttctgagctttcatttcctgcctgtaacacggttcatcccgagttactccctgagtcttcaggccacgatggccaagggcttgtgacttctgcaagcgacgtgactggaaaccacgcagcacttcacagggatcctagtgtgttctctgctggtgattccccaggggaggctccttctgcgctgttgccagggccaccccctggtcagcctgaagccactcagctgacagggccaaaacgggctggccaggcagctctgtcagaacgaagccctgtggctgatcggaagcagcctgttcctccaggacgtgctgcgcgttcaagccagtctccaaaaaagccgttcaatagtattattgagcacctgtcagtggtattcccatgttacaacagcactgagcttgctggttttattaaaaaagtgcgaagcaaaaacaagaactcactctcaggattgagtattgatgaaattgtccaaagagtgacagaacacattctagatgaacagaaaaagaaaaagccaaacccaggaaaggacaagaggacttatgagcccagctctgccacccccgtgaccaggtcctcccagggctcaccctcggtggttgttgcaccatcacccaaaaccaaggggcagaaagcagaagatgtccctgtgaggattgcactgggtgcaagttcctgtgaaatatgccacgaggtgttcaaatcaaaaaacgtgcgtgtgctcaaatgtgggcacaagtatcacaaagggtgctttaagcagtggcttaaagggcagagcgcttgcccggcctgccagggtcgtgatctcctgacagaagagtcaccttctggaagaggctggcccagtcagaatcaggagctgccttcctgctcttctaggtagtcacacttcactaaagtgtcatccaccagtgtgttgaatccgaagaatgacaattttctaccactggtgtaaaaaacaaacatttgaagacccttgtgcattgtgtgtcacaaagctaaatacatggaaatcgttaatatcgctgatattaagtaatttccccactctgagtgaatactttgatgattgccaacagtggctaataaaatgacggctaccacactcatgggtcactggggctgcgcagggctctttgaggtgggtggcttcttttggaaagtactatgaacgtctcgaagcagtattctagtgataagaattcttaacatagccaagcgccccacgtttgttccccacgtttgttccccttttctgtttgaaaaacctgttctggtagctccacaagagagatgatactgactttttaaattttttacaagagtctgtattcctgatatgcctatatttttcctcaaagattctgcattttaaggatgggcataagcaaactatattttaataatttatagttaatgttaaaatattggctgatttagaccaaaagattcaaatctcctctttgtgaaatcccatctgcatttgattttttattattttatgttcccccgttagattgttttaagtgtttgcttttcatcttttatagatgtaatctgattttcaaaaatcattaacactttttaattagtatcgactaagactttttccccctggaatcgaggctgtgtgtccgtcatcccagcccccggttggagcctgctctttgaactccgctgccttccttagcagcttctgtcctcttctgtgagtcagtcagcgagtgcttgggatccgcatccagccgtgctgagcacacaacaggctgtgtgtggaaatggccaccaccattctccttccccaccccaccacaaaaagagaagctgtgtctttagacaaccctgaggtatctgtgttacaatcgttctgtgtttgatatttgtgtaaagtatgcatgcagtcttgtactgtgacctaagaacaaaactgtaactgcattagaaaccatgaaaaaattagatattgttttgtgacttttagacagtggtaaatatagaaccatgaattctggtcacattccatttctctccaacatgaaggatcaaaaaatgtttttcaatgtgttctttgttccactggaaacttagagtcatgagtttatgagctgatttggtcaccttcctctgcctttgttcactgtgagttctgatgtcttagtgacttagttcttagaagctcacgccttagtttgaaacagattctccacggtggtccccaaaacactgtctgcatatccataagaattgagcgctatgggtgttaacgtgcatgaggatcagtttgcagcagcaagtacaaaaggagaagaggaacatccgttgaatgagtgtgttttgtacataacttcagatacttgtgaacatgccttatatttgtccaacaactgtcagaataaagaacattctaaaatgagaaaaaaaaaaaaaaaaaaaaaaaaaaaaaaaaaaaaaaccaacgccattgctcagctaacggccacgcttcaacctggtgatgccccggcatactttccagcatagagcgcggaataagcgcaatngcctgctctgcgatcacacaggccaacattccgtgataagactccatctcatggatagttcccnngagcgcaccgtcagcatgaaaccagctctcgaagtgcgacgatccgacaattngcgccgnaggccataaatgtacttgcataacctgactggcacggnttactggcccatatccttgggcgtgaccatcataanttccttccgtattacccgtattccctcgatgg

SEQ ID NO: 371547 - DNA, 2087 bp, Homo sapiens
  misc_feature (1856)..(1856): n is a, c, g, or t
  misc_feature (1920)..(1921): n is a, c, g, or t
  misc_feature (1974)..(1974): n is a, c, g, or t
  misc_feature (1981)..(1981): n is a, c, g, or t
  misc_feature (2019)..(2019): n is a, c, g, or t
  misc_feature (2055)..(2055): n is a, c, g, or t
ccccccccccccccccgcccgaggaagagagcgaaggaggaaagacgggaagaaaaccgccctgtgctttaagcagtggcttaaagggcagagcgcttgcccggcctgccagggtcgtgatctcctgacagaagagtcaccttctggaagaggctggcccagtcagaatcaggagctgccttcctgctcttctaggtagtcacacttcactaaagtgtcatccaccagtgtgttgaatccgaagaatgacaattttctaccactggtgtaaaaaacaaacatttgaagacccttgtgcattgtgtgtcacaaagctaaatacatggaaatcgttaatatcgctgatattaagtaatttccccactctgagtgaatactttgatgattgccaacagtggctaataaaatgacggctaccacactcatgggtcactggggctgcgcagggctctttgaggtgggtggcttcttttggaaagtactatgaacgtctcgaagcagtattctagtgataagaattcttaacatagccaagcgccccacgtttgttccccacgtttgttccccttttctgtttgaaaaacctgttctggtagctccacaagagagatgatactgactttttaaattttttacaagagtctgtattcctgatatgcctatatttttcctcaaagattctgcattttaaggatgggcataagcaaactatattttaataatttatagttaatgttaaaatattggctgatttagaccaaaagattcaaatctcctctttgtgaaatcccatctgcatttgattttttattattttatgttcccccgttagattgttttaagtgtttgcttttcatcttttatagatgtaatctgattttcaaaaatcattaacactttttaattagtatcgactaagactttttccccctggaatcgaggctgtgtgtccgtcatcccagcccccggttggagcctgctctttgaactccgctgccttccttagcagcttctgtcctcttctgtgagtcagtcagcgagtgcttgggatccgcatccagccgtgctgagcacacaacaggctgtgtgtggaaatggccaccaccattctccttccccaccccaccacaaaaagagaagctgtgtctttagacaaccctgaggtatctgtgttacaatcgttctgtgtttgatatttgtgtaaagtatgcatgcagtcttgtactgtgacctaagaacaaaactgtaactgcattagaaaccatgaaaaaattagatattgttttgtgacttttagacagtggtaaatatagaaccatgaattctggtcacattccatttctctccaacatgaaggatcaaaaaatgtttttcaatgtgttctttgttccactggaaacttagagtcatgagtttatgagctgatttggtcaccttcctctgcctttgttcactgtgagttctgatgtcttagtgacttagttcttagaagctcacgccttagtttgaaacagattctccacggtggtccccaaaacactgtctgcatatccataagaattgagcgctatgggtgttaacgtgcatgaggatcagtttgcagcagcaagtacaaaaggagaagaggaacatccgttgaatgagtgtgttttgtacataacttcagatacttgtgaacatgccttatatttgtccaacaactgtcagaataaagaacattctaaaatgagaaaaaaaaaaaaaaaaaaaaaaaaaaaaaaaaaaaaaaccaacgccattgctcagctaacggccacgcttcaacctggtgatgccccggcatactttccagcatagagcgcggaataagcgcaatngcctgctctgcgatcacacaggccaacattccgtgataagactccatctcatggatagttcccnngagcgcaccgtcagcatgaaaccagctctcgaagtgcgacgatccgacaattngcgccgnaggccataaatgtacttgcataacctgactggcacggnttactggcccatatccttgggcgtgaccatcataanttccttccgtattacccgtattccctcgatgg

SEQ ID NO: 371548 - DNA, 6840 bp, Homo sapiens
  misc_feature (6609)..(6609): n is a, c, g, or t
  misc_feature (6673)..(6674): n is a, c, g, or t
  misc_feature (6727)..(6727): n is a, c, g, or t
  misc_feature (6734)..(6734): n is a, c, g, or t
  misc_feature (6772)..(6772): n is a, c, g, or t
  misc_feature (6808)..(6808): n is a, c, g, or t
ctgaactagttgccagtgatcttgaaacgtgacagtaaccaagagataaataggtgacaatgacaggaaaattagatgtagtaaaagagagtgtttgagagcagaagctatggcaactaaagactggatttgaatccttcctagcttggtgacatgagcaaattacttgatttaagtgagcattttcccatctgtacagtggagataacgataattgtgcctgctaagaagaattgctgtgaagattagtgaaataatgcatgtaaaacatttggtacagtatgtgacacatagtacaaatagtttgctaggaagattgttattattcttcacttgtgatattgtgaagttttcatacagcaaattggacatcatgagatggattgattaaataaatagatttgaacttcaaggactggtagtgttcttgctttggaaagaagaaacttggtttatcctaataatagtaggataataatggtgaagtgataggtacaagtaatagtgtttatgatgcgctggtgatgataggaaaagaaagccattatatgggcaagagctagaagtaataaaatggtgcatttttcagtgatgtttggcctatgtagctattctctgataactataaaaatccttattattgaagattcttcaggaaaaaaaaacccttagtctgaaactttagcaccaatcccccttgccccccattgaaatacgtatttttaaaacatggcttttgataatgtgagggttttttcctttttgcgatttagcagtgctgattgtgtattgcagtagttgtgagagcattagaagcagcagtcgataggaggatggaaggtctggatgccgccttggggagttaggagattggcagacttaccctgtaccactctagccctactcctttgcccaagacagaaacacactgagatggataggagaatatgagcagttgataggaaagttctcagtggagtcaggatttaggttaggccaggagattgagaatataacagtttgtgtatgatgaaatggcatatttcacagaatgcagtaaaagcaggtagggtacaagtgcagcaacaggaagatgtcttttcttcattcagcaaacacttatttgagagcttaccatgtgctaggcacatacaaagataaataagatgcccttgatgatcctctatttaaaggagacatgtacaattcacgtgcttctgagataaatttgaagaaactacaacatcttgagttgatggaagatattgtggatttggcaaagaaagttgctaatgattcattccttattggaggcttattgagaattggttgtaaaatagaaaataaaatcttggcaatggaagaagctctgaattggataaaatatgcaggcgatgtaacaattctaactaaattaggatcaattgacaattgttggcctatgttaagtattttctttactgaatacaagtaccacataactaaaattgtaatggaagactgcaatttgcttgaagaacttaaaactcaaagttgtatggattgtatagaggaaggagaactaatgaaaatgaaaggaaatgaagagttttccaaagaaagatttgatatagctattatctattacaccagagccattgaatatagacctgaaaactaccttctttatggtaaccgagctctttgttttcttcgtactggacagtttagaaatgcactcggtgatggaaagagagccactattctgaagaacacttggccaaagggtcattatcgttattgtgatgctctttctatgctgggggaatatgactgggccctgcaagcaaacataaaagctcaaaaactctgtaaaaatgaccctgagggaatcaaggatctaattcagcagcatgtaaagttacaaaaacaaatagaagacctacaaggtcgaacagcaaataaggatccaattaaagccttttatgaaaacagggcctacacacctaggagtttatcagcacctatatttactacttcacttaactttgtggagaaggaaagagatttcagaaaaattaatcacgaaatggccaacggtggtaatcagaatctaaaggtggcggatgaggcgttgaaggtagatgattgtgactgtcatcctgaattttcaccaccatcaagtcagcctccaaaacataaaggaaaacaaaaatctcgaaacaatgaatcagaaaagttcagttctagttcaccattgactttaccagcagatttgaagaacatcttggagaaacagttttctaaatcttccagagctgcacaccaggattttgctaatataatgaaaatgctgagaagcttaattcaagatggctatatggccttattggagcagcgttgccgcagcgctgcacaggcctttacagagttgctgaacggtttagatcctcaaaaaataaagcaattgaacctggccatgattaactatgttttggtcgtctatggacttgccatttctctccttggaataggacagcctgaggaattatctgaagccgaaaaccagtttaagaggattattgaacactaccccagtgagggccttgattgcttggcctactgtggaattggaaaagtgtatttgaaaaaaaacagatttctagaagctctcaatcactttgagaaagcaagaaccttgatttatcgtcttcctggagtgttaacttggcccacgagtaatgtgattattgaagagtctcagccacaaaaaataaagatgctgttagagaaatttgttgaagaatgcaagttccctccagtgccagatgccatttgttgctatcagaagtgccatggatattctaagatccagatatacataactgatccagactttaagggttttatacgcatcagctgttgccagtactgtaaaatagaatttcacatgaattgctggaagaagttaaaaactacaacctttaatgataaaattgacaaggattttctacaaggaatatgtcttacccctgactgtgaaggtgtcatttctaagattatcatcttcagcagtggtggtgaagttaaatgtgaatttgaacacaaggtcataaaagaaaaggttcctccaagacctattctgaaacagaaatgttctagcctagagaaactaagactgaaagaagacaaaaaattgaagagaaagatccaaaaaaaagaagcaaaaaagttagcacaagaaagaatggaggaggacttaagagaaagtaatccacccaaaaatgaagagcagaaagaaactgtagacaatgttcagcgttgtcagttccttgatgacagaattctacagtgtataaagcagtatgctgacaagattaaatccggcatacagaatacagccatgcttctcaaagaattgctttcttggaaagttttgagcacagaagactatacaacctgtttttctagcagaaattttctaaatgaagcagtggactatgttattcgccacttgattcaagaaaataacagagtaaagacaagaatatttctgcatgttttgagtgagcttaaagaagtggagcccaaattagccgcctggatccaaaaacttaatagctttggcttagatgccacaggaactttcttttctcgttatggagcatctcttaaactgcttgattttagtatcatgactttcctctggaatgagaaatatggtcacaaactagactctatagaaggaaagcaacttgattatttctctgagccagcatcattgaaggaagcccgttgtttaatatggctgctagaagaacacagagacaagttcccagcattgcatagtgctttagatgaattctttgatataatggacagccgctgtactgtgttaaggaaacaagatagtggtgaagcaccgtttagttcaaccaaggtgaaaaacaaaagcaagaaaaagaagccaaaggattcaaagcctatgttagttgggtctggaacaacttcagtaacttcaaataatgagatcatcacttcaagtgaagaccatagcaatcgaaattcagattctgcaggcccatttgcagtgcctgaccatcttcggcaagatgtagaagaattcgaagctctctatgaccaacacagtaacgaatatgttgtccgcaataagaagctatgggacatgaacccaaaacaaaaatgttcaactctatatgattacttctctcagtttttggaggaacatggtcccttggacatgagtaacaagatgttctctgcagaatatgagtttttcccagaagaaactcgacagatactagaaaaagcaggaggtttaaaaccttttctcttgggatgccctcgttttgttgtgattgacaactgtattgcactgaagaaggttgcatcacggctcaagaaaaaaaggaagaagaaaaacattaaaacaaaagtagaagaaatttcaaaagcaggggagtatgtacgagttaaactacaactgaatccagctgctagggaatttaaaccagatgtaaagtctaaaccagtgtcagattcatcttcagcaccagcttttgaaaatgtgaaacccaaacctgtgtctgcaaattctcccaagccagcttgtgaagatgtgaaggccaaaccagtatccgacaattcttctagacaagtttctgaggatgggcaacccaaaggggtctcttctaattctcctaaaccaggctctgaggatgcaaattacaagcgagtctcctgtaattcccccaaaccggttcttgaggatgtgaaaccaacttattgggctcaatcccatttggtcacaggatactgtacgtatcttcctttccagagatttgatatcacccagacaccgccagcatacataaacgtgttaccaggtttgccccagtacaccagcatatatacacccttggccagcctttctcctgaatatcagctaccaagatcagtaccagtggtgccgtcttttgtagccaatgacagagcagataaaaatgctgctgcctattttgagggtcatcatttgaatgctgagaatgttgctggtcaccagattgcctctgaaacacagatccttgagggctctttgggaatatctgtaaagtcacactgcagcacaggtgatgctcatacagtcctgagtgagtctaacagaaatgatgagcactgtggaaattctaacaacaaatgtgaagtaattccagaaagcaccagtgcagtaacaaacattccacacgtgcagatggttgccatacaggtatcttggaacataatacaccaagaagtcaatactgagccatataatccttttgaggaacgacaaggggaaatttcacggattgaaaaggagcaccaagtattacaagaccaacttcaagaagtgtatgaaaattatgagcagataaaacttaagggcttagaagagaccagggacctggaagagaagttgaaaaggcacttagaagaaaacaagatctcaaagacggaattagattggttccttcaagatttggaaagagaaattaaaaaatggcaacaggaaaaaaaagaaatccaagaaagactaaaatcactgaagaagaaaattaaaaaggtttcaaatgccagtgaaatgtatacccagaaaaatgatggaaaggaaaaggaacatgaattacatctggatcagtcccttgaaatcagcaacacacttacaaatgagaaaatgaaaatagaagagtatataaagaaagggaaagaggattatgaagagagtcatcagagagctgtggctgcagaggtatccgtacttgaaaactggaaggagagtgaagtgtataagctacagatcatggagtcacaagcagaagcctttctgaagaagctggggctgattagccgtgatcctgcagcatatcctgacatggagtctgatatacgttcatgggaattgtttctttctaatgttacaaaagaaattgagaaagcaaagtctcagtttgaagaacaaattaaggcaattaaaaatggttctcggctcagtgaactttctaaagtgcagatttctgagctttcatttcctgcctgtaacacggttcatcccgagttactccctgagtcttcaggccacgatggccaagggcttgtgacttctgcaagcgacgtgactggaaaccacgcagcacttcacagggatcctagtgtgttctctgctggtgattccccaggggaggctccttctgcgctgttgccagggccaccccctggtcagcctgaagccactcagctgacagggccaaaacgggctggccaggcagctctgtcagaacgaagccctgtggctgatcggaagcagcctgttcctccaggacgtgctgcgcgttcaagccagtctccaaaaaagccgttcaatagtattattgagcacctgtcagtggtattcccatgttacaacagtcactgagctgctggttttattaaaaaagtgcgaagcaaaaaaaaaaaaaaaaaaaaaaaaaaaaaaaaaaaaaaaaccaacgccattgctcagctaacggccacgcttcaacctggtgatgccccggcatactttccagcatagagcgcggaataagcgcaatngcctgctctgcgatcacacaggccaacattccgtgataagactccatctcatggatagttcccnngagcgcaccgtcagcatgaaaccagctctcgaagtgcgacgatccgacaattngcgccgnaggccataaatgtacttgcataacctgactggcacggnttactggcccatatccttgggcgtgaccatcataanttccttccgtattacccgtattccctcgatgg

SEQ ID NO: 371549 - DNA, 6058 bp, Homo sapiens
ctgaactagttgccagtgatcttgaaacgtgacagtaaccaagagataaataggtgacaatgacaggaaaattagatgtagtaaaagagagtgtttgagagcagaagctatggcaactaaagactggatttgaatccttcctagcttggtgacatgagcaaattacttgatttaagtgagcattttcccatctgtacagtggagataacgataattgtgcctgctaagaagaattgctgtgaagattagtgaaataatgcatgtaaaacatttggtacagtatgtgacacatagtacaaatagtttgctaggaagattgttattattcttcacttgtgatattgtgaagttttcatacagcaaattggacatcatgagatggattgattaaataaatagatttgaacttcaaggactggtagtgttcttgctttggaaagaagaaacttggtttatcctaataatagtaggataataatggtgaagtgataggtacaagtaatagtgtttatgatgcgctggtgatgataggaaaagaaagccattatatgggcaagagctagaagtaataaaatggtgcatttttcagtgatgtttggcctatgtagctattctctgataactataaaaatccttattattgaagattcttcaggaaaaaaaaacccttagtctgaaactttagcaccaatcccccttgccccccattgaaatacgtatttttaaaacatggcttttgataatgtgagggttttttcctttttgcgatttagcagtgctgattgtgtattgcagtagttgtgagagcattagaagcagcagtcgataggaggatggaaggtctggatgccgccttggggagttaggagattggcagacttaccctgtaccactctagccctactcctttgcccaagacagaaacacactgagatggataggagaatatgagcagttgataggaaagttctcagtggagtcaggatttaggttaggccaggagattgagaatataacagtttgtgtatgatgaaatggcatatttcacagaatgcagtaaaagcaggtagggtacaagtgcagcaacaggaagatgtcttttcttcattcagcaaacacttatttgagagcttaccatgtgctaggcacatacaaagataaataagatgcccttgatgatcctctatttaaaggagacatgtacaattcacgtgcttctgagataaatttgaagaaactacaacatcttgagttgatggaagatattgtggatttggcaaagaaagttgctaatgattcattccttattggaggcttattgagaattggttgtaaaatagaaaataaaatcttggcaatggaagaagctctgaattggataaaatatgcaggcgatgtaacaattctaactaaattaggatcaattgacaattgttggcctatgttaagtattttctttactgaatacaagtaccacataactaaaattgtaatggaagactgcaatttgcttgaagaacttaaaactcaaagttgtatggattgtatagaggaaggagaactaatgaaaatgaaaggaaatgaagagttttccaaagaaagatttgatatagctattatctattacaccagagccattgaatatagacctgaaaactaccttctttatggtaaccgagctctttgttttcttcgtactggacagtttagaaatgcactcggtgatggaaagagagccactattctgaagaacacttggccaaagggtcattatcgttattgtgatgctctttctatgctgggggaatatgactgggccctgcaagcaaacataaaagctcaaaaactctgtaaaaatgaccctgagggaatcaaggatctaattcagcagcatgtaaagttacaaaaacaaatagaagacctacaaggtcgaacagcaaataaggatccaattaaagccttttatgaaaacagggcctacacacctaggagtttatcagcacctatatttactacttcacttaactttgtggagaaggaaagagatttcagaaaaattaatcacgaaatggccaacggtggtaatcagaatctaaaggtggcggatgaggcgttgaaggtagatgattgtgactgtcatcctgaattttcaccaccatcaagtcagcctccaaaacataaaggaaaacaaaaatctcgaaacaatgaatcagaaaagttcagttctagttcaccattgactttaccagcagatttgaagaacatcttggagaaacagttttctaaatcttccagagctgcacaccaggattttgctaatataatgaaaatgctgagaagcttaattcaagatggctatatggccttattggagcagcgttgccgcagcgctgcacaggcctttacagagttgctgaacggtttagatcctcaaaaaataaagcaattgaacctggccatgattaactatgttttggtcgtctatggacttgccatttctctccttggaataggacagcctgaggaattatctgaagccgaaaaccagtttaagaggattattgaacactaccccagtgagggccttgattgcttggcctactgtggaattggaaaagtgtatttgaaaaaaaacagatttctagaagctctcaatcactttgagaaagcaagaaccttgatttatcgtcttcctggagtgttaacttggcccacgagtaatgtgattattgaagagtctcagccacaaaaaataaagatgctgttagagaaatttgttgaagaatgcaagttccctccagtgccagatgccatttgttgctatcagaagtgccatggatattctaagatccagatatacataactgatccagactttaagggttttatacgcatcagctgttgccagtactgtaaaatagaatttcacatgaattgctggaagaagttaaaaactacaacctttaatgataaaattgacaaggattttctacaaggaatatgtcttacccctgactgtgaaggtgtcatttctaagattatcatcttcagcagtggtggtgaagttaaatgtgaatttgaacacaaggtcataaaagaaaaggttcctccaagacctattctgaaacagaaatgttctagcctagagaaactaagactgaaagaagacaaaaaattgaagagaaagatccaaaaaaaagaagcaaaaaagttagcacaagaaagaatggaggaggacttaagagaaagtaatccacccaaaaatgaagagcagaaagaaactgtagacaatgttcagcgttgtcagttccttgatgacagaattctacagtgtataaagcagtatgctgacaagattaaatccggcatacagaatacagccatgcttctcaaagaattgctttcttggaaagttttgagcacagaagactatacaacctgtttttctagcagaaattttctaaatgaagcagtggactatgttattcgccacttgattcaagaaaataacagagtaaagacaagaatatttctgcatgttttgagtgagcttaaagaagtggagcccaaattagccgcctggatccaaaaacttaatagctttggcttagatgccacaggaactttcttttctcgttatggagcatctcttaaactgcttgattttagtatcatgactttcctctggaatgagaaatatggtcacaaactagactctatagaaggaaagcaacttgattatttctctgagccagcatcattgaaggaagcccgttgtttaatatggctgctagaagaacacagagacaagttcccagcattgcatagtgctttagatgaattctttgatataatggacagccgctgtactgtgttaaggaaacaagatagtggtgaagcaccgtttagttcaaccaaggtgaaaaacaaaagcaagaaaaagaagccaaaggattcaaagcctatgttagttgggtctggaacaacttcagtaacttcaaataatgagatcatcacttcaagtgaagaccatagcaatcgaaattcagattctgcaggcccatttgcagtgcctgaccatcttcggcaagatgtagaagaattcgaagctctctatgaccaacacagtaacgaatatgttgtccgcaataagaagctatgggacatgaacccaaaacaaaaatgttcaactctatatgattacttctctcagtttttggaggaacatggtcccttggacatgagtaacaagatgttctctgcagaatatgagtttttcccagaagaaactcgacagatactagaaaaagcaggaggtttaaaaccttttctcttgggatgccctcgttttgttgtgattgacaactgtattgcactgaagaaggttgcatcacggctcaagaaaaaaaggaagaagaaaaacattaaaacaaaagtagaagaaatttcaaaagcaggggagtatgtacgagttaaactacaactgaatccagctgctagggaatttaaaccagatgtaaagtctaaaccagtgtcagattcatcttcagcaccagcttttgaaaatgtgaaacccaaacctgtgtctgcaaattctcccaagccagcttgtgaagatgtgaaggccaaaccagtatccgacaattcttctagacaagtttctgaggatgggcaacccaaaggggtctcttctaattctcctaaaccaggctctgaggatgcaaattacaagcgagtctcctgtaattcccccaaaccggttcttgaggatgtgaaaccaacttattgggctcaatcccatttggtcacaggatactgtacgtatcttcctttccagagatttgatatcacccagacaccgccagcatacataaacgtgttaccaggtttgccccagtacaccagcatatatacacccttggccagcctttctcctgaatatcagctaccaagatcagtaccagtggtgccgtcttttgtagccaatgacagagcagataaaaatgctgctgcctattttgagggtcatcatttgaatgctgagaatgttgctggtcaccagattgcctctgaaacacagatccttgagggctctttgggaatatctgtaaagtcacactgcagcacaggtgatgctcatacagtcctgagtgagtctaacagaaatgatgagcactgtggaaattctaacaacaaatgtgaagtaattccagaaagcaccagtgcagtaacaaacattccacacgtgcagatggttgccatacaggtatcttggaacataatacaccaagaagtcaatactgagccatataatccttttgaggaacgacaaggggaaatttcacggattgaaaaggagcaccaagtattacaagaccaacttcaagaagtgtatgaaaattatgagcagataaaacttaagggcttagaagagaccagggacctggaagagaagttgaaaaggcacttagaagaaaacaagatctcaaagacggaattagattggttccttcaagatttggaaagagaaattaaaaaatggcaacaggaaaaaaaagaaatccaagaaagactaaaatcactgaagaagaaaattaaaaaggtttcaaatgccagtgaaatgtatacccagaaaaatgatggaaaggaaaaggaacatgaattacatctggatcagtcccttgaaatcagcaacacacttacaaatgagaaaatgaaaatagaagagtatataaagaaagggaaagaggattatgaagagagtcatcagagagctgtggctgcagaggtatccgtacttgaaaactggaaggagagtgaagtgtataagctacagatcatggagtcacaagcagaagcctttctgaagaagctggggctgattagccgtgatcctgcagcatatcctgacatggagtctgatatacgttcatgggaattgtttctttctaatgttacaaaagaaattgagaaagcaaagtctcagtttgaagaacaaattaaggcaattaaaaatggttctcggctcaggtggtgtggggtgccgagctcgaatgta

SEQ ID NO: 371550 - DNA, 3645 bp, Homo sapiens
ctgaactagttgccagtgatcttgaaacgtgacagtaaccaagagataaataggtgacaatgacaggaaaattagatgtagtaaaagagagtgtttgagagcagaagctatggcaactaaagactggatttgaatccttcctagcttggtgacatgagcaaattacttgatttaagtgagcattttcccatctgtacagtggagataacgataattgtgcctgctaagaagaattgctgtgaagattagtgaaataatgcatgtaaaacatttggtacagtatgtgacacatagtacaaatagtttgctaggaagattgttattattcttcacttgtgatattgtgaagttttcatacagcaaattggacatcatgagatggattgattaaataaatagatttgaacttcaaggactggtagtgttcttgctttggaaagaagaaacttggtttatcctaataatagtaggataataatggtgaagtgataggtacaagtaatagtgtttatgatgcgctggtgatgataggaaaagaaagccattatatgggcaagagctagaagtaataaaatggtgcatttttcagtgatgtttggcctatgtagctattctctgataactataaaaatccttattattgaagattcttcaggaaaaaaaaacccttagtctgaaactttagcaccaatcccccttgccccccattgaaatacgtatttttaaaacatggcttttgataatgtgagggttttttcctttttgcgatttagcagtgctgattgtgtattgcagtagttgtgagagcattagaagcagcagtcgataggaggatggaaggtctggatgccgccttggggagttaggagattggcagacttaccctgtaccactctagccctactcctttgcccaagacagaaacacactgagatggataggagaatatgagcagttgataggaaagttctcagtggagtcaggatttaggttaggccaggagattgagaatataacagtttgtgtatgatgaaatggcatatttcacagaatgcagtaaaagcaggtagggtacaagtgcagcaacaggaagatgtcttttcttcattcagcaaacacttatttgagagcttaccatgtgctaggcacatacaaagataaataagatgcccttgatgatcctctatttaaaggagacatgtacaattcacgtgcttctgagataaatttgaagaaactacaacatcttgagttgatggaagatattgtggatttggcaaagaaagttgctaatgattcattccttattggaggcttattgagaattggttgtaaaatagaaaataaaatcttggcaatggaagaagctctgaattggataaaatatgcaggcgatgtaacaattctaactaaattaggatcaattgacaattgttggcctatgttaagtattttctttactgaatacaagtaccacataactaaaattgtaatggaagactgcaatttgcttgaagaacttaaaactcaaagttgtatggattgtatagaggaaggagaactaatgaaaatgaaaggaaatgaagagttttccaaagaaagatttgatatagctattatctattacaccagagccattgaatatagacctgaaaactaccttctttatggtaaccgagctctttgttttcttcgtactggacagtttagaaatgcactcggtgatggaaagagagccactattctgaagaacacttggccaaagggtcattatcgttattgtgatgctctttctatgctgggggaatatgactgggccctgcaagcaaacataaaagctcaaaaactctgtaaaaatgaccctgagggaatcaaggatctaattcagcagcatgtaaagttacaaaaacaaatagaagacctacaaggtcgaacagcaaataaggatccaattaaagccttttatgaaaacagggcctacacacctaggagtttatcagcacctatatttactacttcacttaactttgtggagaaggaaagagatttcagaaaaattaatcacgaaatggccaacggtggtaatcagaatctaaaggtggcggatgaggcgttgaaggtagatgattgtgactgtcatcctgaattttcaccaccatcaagtcagcctccaaaacataaaggaaaacaaaaatctcgaaacaatgaatcagaaaagttcagttctagttcaccattgactttaccagcagatttgaagaacatcttggagaaacagttttctaaatcttccagagctgcacaccaggattttgctaatataatgaaaatgctgagaagcttaattcaagatggctatatggccttattggagcagcgttgccgcagcgctgcacaggcctttacagagttgctgaacggtttagatcctcaaaaaataaagcaattgaacctggccatgattaactatgttttggtcgtctatggacttgccatttctctccttggaataggacagcctgaggaattatctgaagccgaaaaccagtttaagaggattattgaacactaccccagtgagggccttgattgcttggcctactgtggaattggaaaagtgtatttgaaaaaaaacagatttctagaagctctcaatcactttgagaaagcaagaaccttgatttatcgtcttcctggagtgttaacttggcccacgagtaatgtgattattgaagagtctcagccacaaaaaataaagatgctgttagagaaatttgttgaagaatgcaagttccctccagtgccagatgccatttgttgctatcagaagtgccatggatattctaagatccagatatacataactgatccagactttaagggttttatacgcatcagctgttgccagtactgtaaaatagaatttcacatgaattgctggaagaagttaaaaactacaacctttaatgataaaattgacaaggattttctacaaggaatatgtcttacccctgactgtgaaggtgtcatttctaagattatcatcttcagcagtggtggtgaagttaaatgtgaatttgaacacaaggtcataaaagaaaaggttcctccaagacctattctgaaacagaaatgttctagcctagagaaactaagactgaaagaagacaaaaaattgaagagaaagatccaaaaaaaagaagcaaaaaagttagcacaagaaagaatggaggaggacttaagagaaagtaatccacccaaaaatgaagagcagaaagaaactgtagacaatgttcagcgttgtcagttccttgatgacagaattctacagtgtataaagcagtatgctgacaagattaaatccggcatacagaatacagccatgcttctcaaagaattgctttcttggaaagttttgagcacagaagactatacaacctgtttttctagcagaaattttctaaatgaagcagtggactatgttattcgccacttgattcaagaaaataacagagtaaagacaagaatatttctgcatgttttgagtgagcttaaagaagtggagcccaaattagccgcctggatccaaaaacttaatagctttggtatgtccctttatattccagagcaataaactttaatacg

SEQ ID NO: 371551 - DNA, 1835 bp, Homo sapiens
cttcaacgccgccacccgctccctcccgccgtcggctgacgtggagggccggaggtggcggcggcggcggcggcggctgctgctgctgctgctgcccgcgtccgaggctcgcgggcggcgggcccggtgtgcaccatggacaattttgctgagggagatttcactgtggcggattatgccttgttagaagattgccctcacgtggatgattgtgtctttgctgctgaatttatgagcaatgattatgttcgtgtgactcagctttactgtgatggggtgggtgtgcaatataaagattatatccaaagtgagaggaatttggaatttgacatctgcagtatatggtgtagtaaaccaatttctgtcctgcaagattattgcgatgccattaaaataaacatcttctggccacttctgtttcaacatcaaaacagttccgtaatatcacgattgcatccctgtgtggacgccaacaattcacgtgcttctgagataaatttgaagaaactacaacatcttgagttgatggaagatattgtggatttggcaaagaaagttgctaatgattcattccttattggaggcttattgagaattggttgtaaaatagaaaataaaatcttggcaatggaagaagctctgaattggataaaatatgcaggcgatgtaacaattctaactaaattaggatcaattgacaattgttggcctatgttaagtattttctttactgaatacaagtaccacataactaaaattgtaatggaagactgcaatttgcttgaagaacttaaaactcaaagttgtatggattgtatagaggaaggagaactaatgaaaatgaaaggaaatgaagagttttccaaagaaagatttgatatagctattatctattacaccagagccattgaatatagacctgaaaactaccttctttatggtaaccgagctctttgttttcttcgtactggacagtttagaaatgcactcggtgatggaaagagagccactattctgaagaacacttggccaaagggtcattatcgttattgtgatgctctttctatgctgggggaatatgactgggccctgcaagcaaacataaaagctcaaaaactctgtaaaaatgaccctgagggaatcaaggatctaattcagcagcatgtaaagttacaaaaacaaatagaagacctacaaggtcgaacagcaaataaggatccaattaaagccttttatgaaaacagggcctacacacctaggagtttatcagcacctatatttactacttcacttaactttgtggagaaggaaagagatttcagaaaaattaatcacgaaatggccaacggtggtaatcagaatctaaaggtggcggatgaggcgttgaaggtagatgattgtgactgtcatcctgaattttcaccaccatcaagtcagctctaaaacgtaaggcaaccacaaatctcgaaccactgactcacaaacagtgacgtctagttcacccattgagctcaacccagcagatgcgacgacatctggcagacacaggggtcgaaaatctccagagctgccacaggattgctaatataaggaacgcgcgaagctactcagaagctacctggcttctggcagaccgctgccgcagctgcacggcctccgaagtcgcacgtgacacccaaaaccaagagagccgcacgagcgcacctggcgacgccggactcccggacgacacggcatcgacgacaccgagcgccaccgcgcggggcagcgcagcccaccagtccgcacgccggacgcacaacaaccaccggggattgattgcggagcgccccccc

SEQ ID NO: 371552 - DNA, 1453 bp, Homo sapiens
cttcaacgccgccacccgctccctcccgccgtcggctgacgtggagggccggaggtggcggcggcggcggcggcggctgctgctgctgctgctgcccgcgtccgaggctcgcgggcggcgggcccggtgtgcaccatggacaattttgctgagggagatttcactgtggcggattatgccttgttagaagattgccctcacgtggatgattgtgtctttgctgctgaatttatgagcaatgattatgttcgtgtgactcagctttactgtgatggggtgggtgtgcaatataaagattatatccaaagtgagaggaatttggaatttgacatctgcagtatatggtgtagtaaaccaatttctgtcctgcaagattattgcgatgccattaaaataaacatcttctggccacttctgtttcaacatcaaaacagttccgtaatatcacgattgcatccctgtgtggacgccaacaattcacgtgcttctgagataaatttgaagaaactacaacatcttgagttgatggaagatattgtggatttggcaaagaaagttgctaatgattcattccttattggaggcttattgagaattggttgtaaaatagaaaataaaatcttggcaatggaagaagctctgaattggataaaatatgcaggcgatgtaacaattctaactaaattaggatcaattgacaattgttggcctatgttaagtattttctttactgaatacaagtaccacataactaaaattgtaatggaagactgcaatttgcttgaagaacttaaaactcaaagttgtatggattgtatagaggaaggagaactaatgaaaatgaaaggaaatgaagagttttccaaagaaagatttgatatagctattatctattacaccagagccattgaatatagacctgaaaactaccttctttatggtaaccgagctctttgttttcttcgtactggacagtttagaaatgcactcggtgatggaaagagagccactattctgaagaacacttggccaaagggtcattatcgttattgtgatgctctttctatgctgggggaatatgactgggccctgcaagcaaacataaaagctcaaaaactctgtaaaaatgaccctgagggaatcaaggatctaattcagcagcatgtaaagttacaaaaacaaatagaagacctacaaggtatttcacctaagattcttttggttacagtcttaattccctttcaaactttggagggtgggtttcttggattaacagaggaccacaaatcaatcctcagatgatttatccttattttatcatgttatcttggtcatggcacttgagtttttcatttctatctgtgtagagttacatgttatccattaagtaattataaatgatttgtactttttatttgaaacagacagcaaccaaattgttatttattcctct

SEQ ID NO: 371553 - DNA, 435 bp, Homo sapiens
tgtttaactactgaagtgatgtgtcttttcaccccatctgattataaactgagaacaggagttatctcctgtatctctctgtatctatggtagacctaaatcataatgatcactattataattgatctttaataatttaatttattatatatagaaaaatatcatcagtagcttcttttttggcttacccttttgtagttacacccacgtaccacatttctgcttctgttttcttactccaatttatattttaaaaatagttttactctcaggcttgtagatttttatgtacagattttaggaacaaatacttttgtgttcacaggtcagcctccaaaacataaaggaaaacaaaaatctcgaaacaatgaatcagaaaagttcaggtatgttttttctctaaggtatgtttttttccccttaatatactcttcc

SEQ ID NO: 371554 - DNA, 466 bp, Homo sapiens
tgttccagtttatccttatttatttataaaatatgagaattgttaaaaaaaaaaaaaagcttcaaaccaaaacctagagagcaatgtactaaagacagaagatggtcaagttgttggataactggttgcttccctcttgtcccctccccgccacccctgttattttcgcagccaaacccaggaaaggacaagaggacttatgagcccagctctgccacccccgtgaccaggtcctcccagggctcaccctcggtggttgttgcaccatcacccaaaaccaaggggcagaaagcagaagatgtccctgtgaggattgtatgtataactgtatagttttgttttttaatgaaaaacaagaagcaaacaaaatttttaatccatgatttagccccattcatttctagacctaatttatttgatcccaacattagaaactgaatttcaatgtacttgaatgtgtccagtt

SEQ ID NO: 371555 - DNA, 350 bp, Homo sapiens
gcagggatcgcgccactgccctccagcctgggcaacagagtgagacactgtctcaaaaaaaaaaaaaaagttatgctttttagatagttattgttgttatcagtggtcttcagattaattttatgtgcatttgtctttgtttctttgggttgggctgttggattaatattggcatgtaatatttcttagcagtagagaactttctgttgtcattcatcactcactctccctttcagcactgagcttgctggttttattaaaaaagtgcgaagcaaaaacaagaactcactctcaggattgagtattgatgaaattgtccaaagagtgacagaacacattctagatgaaca

SEQ ID NO: 371556 - DNA, 9349 bp, Homo sapiens
  misc_feature (9118)..(9118): n is a, c, g, or t
  misc_feature (9182)..(9183): n is a, c, g, or t
  misc_feature (9236)..(9236): n is a, c, g, or t
  misc_feature (9243)..(9243): n is a, c, g, or t
  misc_feature (9281)..(9281): n is a, c, g, or t
  misc_feature (9317)..(9317): n is a, c, g, or t
ctgaactagttgccagtgatcttgaaacgtgacagtaaccaagagataaataggtgacaatgacaggaaaattagatgtagtaaaagagagtgtttgagagcagaagctatggcaactaaagactggatttgaatccttcctagcttggtgacatgagcaaattacttgatttaagtgagcattttcccatctgtacagtggagataacgataattgtgcctgctaagaagaattgctgtgaagattagtgaaataatgcatgtaaaacatttggtacagtatgtgacacatagtacaaatagtttgctaggaagattgttattattcttcacttgtgatattgtgaagttttcatacagcaaattggacatcatgagatggattgattaaataaatagatttgaacttcaaggactggtagtgttcttgctttggaaagaagaaacttggtttatcctaataatagtaggataataatggtgaagtgataggtacaagtaatagtgtttatgatgcgctggtgatgataggaaaagaaagccattatatgggcaagagctagaagtaataaaatggtgcatttttcagtgatgtttggcctatgtagctattctctgataactataaaaatccttattattgaagattcttcaggaaaaaaaaacccttagtctgaaactttagcaccaatcccccttgccccccattgaaatacgtatttttaaaacatggcttttgataatgtgagggttttttcctttttgcgatttagcagtgctgattgtgtattgcagtagttgtgagagcattagaagcagcagtcgataggaggatggaaggtctggatgccgccttggggagttaggagattggcagacttaccctgtaccactctagccctactcctttgcccaagacagaaacacactgagatggataggagaatatgagcagttgataggaaagttctcagtggagtcaggatttaggttaggccaggagattgagaatataacagtttgtgtatgatgaaatggcatatttcacagaatgcagtaaaagcaggtagggtacaagtgcagcaacaggaagatgtcttttcttcattcagcaaacacttatttgagagcttaccatgtgctaggcacatacaaagataaataagatgcccttgatgatcctctatttaaaggagacatgtaaacaggttaacttagagtagagatggtgaatatgtgaacctgaggaaaggaagaaatagattaaattatctggagagagaggaaaagtcagcagaatggggacgagaatctttcggagctcagtgttctgataggagttatttccttgggcataggttccaagtatttttctaatataccatagaagccaggaaaactttcttctgttatctcaaatgatttaattactgacttgagtttgtgttgtctccttagacttgtgcaccatggacaattttgctgagggagatttcactgtggcggattatgccttgttagaagattgccctcacgtggatgattgtgtctttgctgctgaatttatgagcaatgattatgttcgtgtgactcagctttactgtgatggggtgggtgtgcaatataaagattatatccaaagtgagaggaatttggaatttgacatctgcagtatatggtgtagtaaaccaatttctgtcctgcaagattattgcgatgccattaaaataaacatcttctggccacttctgtttcaacatcaaaacagttccgtaatatcacgattgcatccctgtgtggacgccaacaattcacgtgcttctgagataaatttgaagaaactacaacatcttgagttgatggaagatattgtggatttggcaaagaaagttgctaatgattcattccttattggaggcttattgagaattggttgtaaaatagaaaataaaatcttggcaatggaagaagctctgaattggataaaatatgcaggcgatgtaacaattctaactaaattaggatcaattgacaattgttggcctatgttaagtattttctttactgaatgaaggagaactaatgaaaatgaaaggaaatgaagagttttccaaagaaagatttgatatagctattatctattacaccagagccattgaatatagacctgaaaactaccttctttatggtaaccgagctctttgttttcttcgtactggacagtttagaaatgcactcggtgatggaaagagagccactattctgaagaacacttggccaaagggtcattatcgttattgtgatgctctttctatgctgggggaatatgactgggccctgcaagcaaacataaaagctcaaaaactctgtaaaaatgaccctgagggaatcaaggatctaattcagcagcatgtaaagttacaaaaacaaatagaagacctacaaggtcgaacagcaaataaggatccaattaaagccttttatgaaaacagggcctacacacctaggagtttatcagcacctatatttactacttcacttaactttgtggagaaggaaagagatttcagaaaaattaatcacgaaatggccaacggtggtaatcagaatctaaaggtggcggatgaggcgttgaaggtagatgattgtgactgtcatcctgaattttcaccaccatcaagtcagcctccaaaacataaaggaaaacaaaaatctcgaaacaatgaatcagaaaagttcagttctagttcaccattgactttaccagcagatttgaagaacatcttggagaaacagttttctaaatcttccagagctgcacaccaggattttgctaatataatgaaaatgctgagaagcttaattcaagatggctatatggccttattggagcagcgttgccgcagcgctgcacaggcctttacagagttgctgaacggtttagatcctcaaaaaataaagcaattgaacctggccatgattaactatgttttggtcgtctatggacttgccatttctctccttggaataggacagcctgaggaattatctgaagccgaaaaccagtttaagaggattattgaacactaccccagtgagggccttgattgcttggcctactgtggaattggaaaagtgtatttgaaaaaaaacagatttctagaagctctcaatcactttgagaaagcaagaaccttgatttatcgtcttcctggagtgttaacttggcccacgagtaatgtgattattgaagagtctcagccacaaaaaataaagatgctgttagagaaatttgttgaagaatgcaagttccctccagtgccagatgccatttgttgctatcagaagtgccatggatattctaagatccagatatacataactgatccagactttaagggttttatacgcatcagctgttgccagtactgtaaaatagaatttcacatgaattgctggaagaagttaaaaactacaacctttaatgataaaattgacaaggattttctacaaggaatatgtcttacccctgactgtgaaggtgtcatttctaagattatcatcttcagcagtggtggtgaagttaaatgtgaatttgaacacaaggtcataaaagaaaaggttcctccaagacctattctgaaacagaaatgttctagcctagagaaactaagactgaaagaagacaaaaaattgaagagaaagatccaaaaaaaagaagcaaaaaagttagcacaagaaagaatggaggaggacttaagagaaagtaatccacccaaaaatgaagagcagaaagaaactgtagacaatgttcagcgttgtcagttccttgatgacagaattctacagtgtataaagcagtatgctgacaagattaaatccggcatacagaatacagccatgcttctcaaagaattgctttcttggaaagttttgagcacagaagactatacaacctgtttttctagcagaaattttctaaatgaagcagtggactatgttattcgccacttgattcaagaaaataacagagtaaagacaagaatatttctgcatgttttgagtgagcttaaagaagtggagcccaaattagccgcctggatccaaaaacttaatagctttggcttagatgccacaggaactttcttttctcgttatggagcatctcttaaactgcttgattttagtatcatgactttcctctggaatgagaaatatggtcacaaactagactctatagaaggaaagcaacttgattatttctctgagccagcatcattgaaggaagcccgttgtttaatatggctgctagaagaacacagagacaagttcccagcattgcatagtgctttagatgaattctttgatataatggacagccgctgtactgtgttaaggaaacaagatagtggtgaagcaccgtttagttcaaccaaggtgaaaaacaaaagcaagaaaaagaagccaaaggattcaaagcctatgttagttgggtctggaacaacttcagtaacttcaaataatgagatcatcacttcaagtgaagaccatagcaatcgaaattcagattctgcaggcccatttgcagtgcctgaccatcttcggcaagatgtagaagaattcgaagctctctatgaccaacacagtaacgaatatgttgtccgcaataagaagctatgggacatgaacccaaaacaaaaatgttcaactctatatgattacttctctcagtttttggaggaacatggtcccttggacatgagtaacaagatgttctctgcagaatatgagtttttcccagaagaaactcgacagatactagaaaaagcaggaggtttaaaaccttttctcttgggatgccctcgttttgttgtgattgacaactgtattgcactgaagaaggttgcatcacggctcaagaaaaaaaggaagaagaaaaacattaaaacaaaagtagaagaaatttcaaaagcaggggagtatgtacgagttaaactacaactgaatccagctgctagggaatttaaaccagatgtaaagtctaaaccagtgtcagattcatcttcagcaccagcttttgaaaatgtgaaacccaaacctgtgtctgcaaattctcccaagccagcttgtgaagatgtgaaggccaaaccagtatccgacaattcttctagacaagtttctgaggatgggcaacccaaaggggtctcttctaattctcctaaaccaggctctgaggatgcaaattacaagcgagtctcctgtaattcccccaaaccggttcttgaggatgtgaaaccaacttattgggctcaatcccatttggtcacaggatactgtacgtatcttcctttccagagatttgatatcacccagacaccgccagcatacataaacgtgttaccaggtttgccccagtacaccagcatatatacacccttggccagcctttctcctgaatatcagctaccaagatcagtaccagtggtgccgtcttttgtagccaatgacagagcagataaaaatgctgctgcctattttgagggtcatcatttgaatgctgagaatgttgctggtcaccagattgcctctgaaacacagatccttgagggctctttgggaatatctgtaaagtcacactgcagcacaggtgatgctcatacagtcctgagtgagtctaacagaaatgatgagcactgtggaaattctaacaacaaatgtgaagtaattccagaaagcaccagtgcagtaacaaacattccacacgtgcagatggttgccatacaggtatcttggaacataatacaccaagaagtcaatactgagccatataatccttttgaggaacgacaaggggaaatttcacggattgaaaaggagcaccaagtattacaagaccaacttcaagaagtgtatgaaaattatgagcagataaaacttaagggcttagaagagaccagggacctggaagagaagttgaaaaggcacttagaagaaaacaagatctcaaagacggaattagattggttccttcaagatttggaaagagaaattaaaaaatggcaacaggaaaaaaaagaaatccaagaaagactaaaatcactgaagaagaaaattaaaaaggtttcaaatgccagtgaaatgtatacccagaaaaatgatggaaaggaaaaggaacatgaattacatctggatcagtcccttgaaatcagcaacacacttacaaatgagaaaatgaaaatagaagagtatataaagaaagggaaagaggattatgaagagagtcatcagagagctgtggctgcagaggtatccgtacttgaaaactggaaggagagtgaagtgtataagctacagatcatggagtcacaagcagaagcctttctgaagaagctggggctgattagccgtgatcctgcagcatatcctgacatggagtctgatatacgttcatgggaattgtttctttctaatgttacaaaagaaattgagaaagcaaagtctcagtttgaagaacaaattaaggcaattaaaaatggttctcggctcagtgaactttctaaagtgcagatttctgagctttcatttcctgcctgtaacacggttcatcccgagttactccctgagtcttcaggccacgatggccaagggcttgtgacttctgcaagcgacgtgactggaaaccacgcagcacttcacagggatcctagtgtgttctctgctggtgattccccaggggaggctccttctgcgctgttgccagggccaccccctggtcagcctgaagccactcagctgacagggccaaaacgggctggccaggcagctctgtcagaacgaagccctgtggctgatcggaagcagcctgttcctccaggacgtgctgcgcgttcaagccagtctccaaaaaagccgttcaatagtattattgagcacctgtcagtggtattcccatgttacaacagcactgagcttgctggttttattaaaaaagtgcgaagcaaaaacaagaactcactctcaggattgagtattgatgaaattgtccaaagagtgacagaacacattctagatgaacagaaaaagaaaaagccaaacccaggaaaggacaagaggacttatgagcccagctctgccacccccgtgaccaggtcctcccagggctcaccctcggtggttgttgcaccatcacccaaaaccaaggggcagaaagcagaagatgtccctgtgaggattgcactgggtgcaagttcctgtgaaatatgccacgaggtgttcaaatcaaaaaacgtgcgtgtgctcaaatgtgggcacaagtatcacaaagggtgctttaagcagtggcttaaagggcagagcgcttgcccggcctgccagggtcgtgatctcctgacagaagagtcaccttctggaagaggctggcccagtcagaatcaggagctgccttcctgctcttctaggtagtcacacttcactaaagtgtcatccaccagtgtgttgaatccgaagaatgacaattttctaccactggtgtaaaaaacaaacatttgaagacccttgtgcattgtgtgtcacaaagctaaatacatggaaatcgttaatatcgctgatattaagtaatttccccactctgagtgaatactttgatgattgccaacagtggctaataaaatgacggctaccacactcatgggtcactggggctgcgcagggctctttgaggtgggtggcttcttttggaaagtactatgaacgtctcgaagcagtattctagtgataagaattcttaacatagccaagcgccccacgtttgttccccacgtttgttccccttttctgtttgaaaaacctgttctggtagctccacaagagagatgatactgactttttaaattttttacaagagtctgtattcctgatatgcctatatttttcctcaaagattctgcattttaaggatgggcataagcaaactatattttaataatttatagttaatgttaaaatattggctgatttagaccaaaagattcaaatctcctctttgtgaaatcccatctgcatttgattttttattattttatgttcccccgttagattgttttaagtgtttgcttttcatcttttatagatgtaatctgattttcaaaaatcattaacactttttaattagtatcgactaagactttttccccctggaatcgaggctgtgtgtccgtcatcccagcccccggttggagcctgctctttgaactccgctgccttccttagcagcttctgtcctcttctgtgagtcagtcagcgagtgcttgggatccgcatccagccgtgctgagcacacaacaggctgtgtgtggaaatggccaccaccattctccttccccaccccaccacaaaaagagaagctgtgtctttagacaaccctgaggtatctgtgttacaatcgttctgtgtttgatatttgtgtaaagtatgcatgcagtcttgtactgtgacctaagaacaaaactgtaactgcattagaaaccatgaaaaaattagatattgttttgtgacttttagacagtggtaaatatagaaccatgaattctggtcacattccatttctctccaacatgaaggatcaaaaaatgtttttcaatgtgttctttgttccactggaaacttagagtcatgagtttatgagctgatttggtcaccttcctctgcctttgttcactgtgagttctgatgtcttagtgacttagttcttagaagctcacgccttagtttgaaacagattctccacggtggtccccaaaacactgtctgcatatccataagaattgagcgctatgggtgttaacgtgcatgaggatcagtttgcagcagcaagtacaaaaggagaagaggaacatccgttgaatgagtgtgttttgtacataacttcagatacttgtgaacatgccttatatttgtccaacaactgtcagaataaagaacattctaaaatgagaaaaaaaaaaaaaaaaaaaaaaaaaaaaaaaaaaaaaaccaacgccattgctcagctaacggccacgcttcaacctggtgatgccccggcatactttccagcatagagcgcggaataagcgcaatngcctgctctgcgatcacacaggccaacattccgtgataagactccatctcatggatagttcccnngagcgcaccgtcagcatgaaaccagctctcgaagtgcgacgatccgacaattngcgccgnaggccataaatgtacttgcataacctgactggcacggnttactggcccatatccttgggcgtgaccatcataanttccttccgtattacccgtattccctcgatgg

SEQ ID NO: 371557 - DNA, 9435 bp, Homo sapiens
  misc_feature (9204)..(9204): n is a, c, g, or t
  misc_feature (9268)..(9269): n is a, c, g, or t
  misc_feature (9322)..(9322): n is a, c, g, or t
  misc_feature (9329)..(9329): n is a, c, g, or t
  misc_feature (9367)..(9367): n is a, c, g, or t
  misc_feature (9403)..(9403): n is a, c, g, or t
ctgaactagttgccagtgatcttgaaacgtgacagtaaccaagagataaataggtgacaatgacaggaaaattagatgtagtaaaagagagtgtttgagagcagaagctatggcaactaaagactggatttgaatccttcctagcttggtgacatgagcaaattacttgatttaagtgagcattttcccatctgtacagtggagataacgataattgtgcctgctaagaagaattgctgtgaagattagtgaaataatgcatgtaaaacatttggtacagtatgtgacacatagtacaaatagtttgctaggaagattgttattattcttcacttgtgatattgtgaagttttcatacagcaaattggacatcatgagatggattgattaaataaatagatttgaacttcaaggactggtagtgttcttgctttggaaagaagaaacttggtttatcctaataatagtaggataataatggtgaagtgataggtacaagtaatagtgtttatgatgcgctggtgatgataggaaaagaaagccattatatgggcaagagctagaagtaataaaatggtgcatttttcagtgatgtttggcctatgtagctattctctgataactataaaaatccttattattgaagattcttcaggaaaaaaaaacccttagtctgaaactttagcaccaatcccccttgccccccattgaaatacgtatttttaaaacatggcttttgataatgtgagggttttttcctttttgcgatttagcagtgctgattgtgtattgcagtagttgtgagagcattagaagcagcagtcgataggaggatggaaggtctggatgccgccttggggagttaggagattggcagacttaccctgtaccactctagccctactcctttgcccaagacagaaacacactgagatggataggagaatatgagcagttgataggaaagttctcagtggagtcaggatttaggttaggccaggagattgagaatataacagtttgtgtatgatgaaatggcatatttcacagaatgcagtaaaagcaggtagggtacaagtgcagcaacaggaagatgtcttttcttcattcagcaaacacttatttgagagcttaccatgtgctaggcacatacaaagataaataagatgcccttgatgatcctctatttaaaggagacatgtaaacaggttaacttagagtagagatggtgaatatgtgaacctgaggaaaggaagaaatagattaaattatctggagagagaggaaaagtcagcagaatggggacgagaatctttcggagctcagtgttctgataggagttatttccttgggcataggttccaagtatttttctaatataccatagaagccaggaaaactttcttctgttatctcaaatgatttaattactgacttgagtttgtgttgtctccttagacttgtgcaccatggacaattttgctgagggagatttcactgtggcggattatgccttgttagaagattgccctcacgtggatgattgtgtctttgctgctgaatttatgagcaatgattatgttcgtgtgactcagctttactgtgatggggtgggtgtgcaatataaagattatatccaaagtgagaggaatttggaatttgacatctgcagtatatggtgtagtaaaccaatttctgtcctgcaagattattgcgatgccattaaaataaacatcttctggccacttctgtttcaacatcaaaacagttccgtaatatcacgattgcatccctgtgtggacgccaacaattcacgtgcttctgagataaatttgaagaaactacaacatcttgagttgatggaagatattgtggatttggcaaagaaagttgctaatgattcattccttattggaggcttattgagaattggttgtaaaatagaaaataaaatcttggcaatggaagaagctctgaattggataaaatatgcaggcgatgtaacaattctaactaaattaggatcaattgacaattgttggcctatgttaagtattttctttactgaatacaagtaccacataactaaaattgtaatggaagactgcaatttgcttgaagaacttaaaactcaaagttgtatggattgtatagaggaaggagaactaatgaaaatgaaaggaaatgaagagttttccaaagaaagatttgatatagctattatctattacaccagagccattgaatatagacctgaaaactaccttctttatggtaaccgagctctttgttttcttcgtactggacagtttagaaatgcactcggtgatggaaagagagccactattctgaagaacacttggccaaagggtcattatcgttattgtgatgctctttctatgctgggggaatatgactgggccctgcaagcaaacataaaagctcaaaaactctgtaaaaatgaccctgagggaatcaaggatctaattcagcagcatgtaaagttacaaaaacaaatagaagacctacaaggtcgaacagcaaataaggatccaattaaagccttttatgaaaacagggcctacacacctaggagtttatcagcacctatatttactacttcacttaactttgtggagaaggaaagagatttcagaaaaattaatcacgaaatggccaacggtggtaatcagaatctaaaggtggcggatgaggcgttgaaggtagatgattgtgactgtcatcctgaattttcaccaccatcaagtcagcctccaaaacataaaggaaaacaaaaatctcgaaacaatgaatcagaaaagttcagttctagttcaccattgactttaccagcagatttgaagaacatcttggagaaacagttttctaaatcttccagagctgcacaccaggattttgctaatataatgaaaatgctgagaagcttaattcaagatggctatatggccttattggagcagcgttgccgcagcgctgcacaggcctttacagagttgctgaacggtttagatcctcaaaaaataaagcaattgaacctggccatgattaactatgttttggtcgtctatggacttgccatttctctccttggaataggacagcctgaggaattatctgaagccgaaaaccagtttaagaggattattgaacactaccccagtgagggccttgattgcttggcctactgtggaattggaaaagtgtatttgaaaaaaaacagatttctagaagctctcaatcactttgagaaagcaagaaccttgatttatcgtcttcctggagtgttaacttggcccacgagtaatgtgattattgaagagtctcagccacaaaaaataaagatgctgttagagaaatttgttgaagaatgcaagttccctccagtgccagatgccatttgttgctatcagaagtgccatggatattctaagatccagatatacataactgatccagactttaagggttttatacgcatcagctgttgccagtactgtaaaatagaatttcacatgaattgctggaagaagttaaaaactacaacctttaatgataaaattgacaaggattttctacaaggaatatgtcttacccctgactgtgaaggtgtcatttctaagattatcatcttcagcagtggtggtgaagttaaatgtgaatttgaacacaaggtcataaaagaaaaggttcctccaagacctattctgaaacagaaatgttctagcctagagaaactaagactgaaagaagacaaaaaattgaagagaaagatccaaaaaaaagaagcaaaaaagttagcacaagaaagaatggaggaggacttaagagaaagtaatccacccaaaaatgaagagcagaaagaaactgtagacaatgttcagcgttgtcagttccttgatgacagaattctacagtgtataaagcagtatgctgacaagattaaatccggcatacagaatacagccatgcttctcaaagaattgctttcttggaaagttttgagcacagaagactatacaacctgtttttctagcagaaattttctaaatgaagcagtggactatgttattcgccacttgattcaagaaaataacagagtaaagacaagaatatttctgcatgttttgagtgagcttaaagaagtggagcccaaattagccgcctggatccaaaaacttaatagctttggcttagatgccacaggaactttcttttctcgttatggagcatctcttaaactgcttgattttagtatcatgactttcctctggaatgagaaatatggtcacaaactagactctatagaaggaaagcaacttgattatttctctgagccagcatcattgaaggaagcccgttgtttaatatggctgctagaagaacacagagacaagttcccagcattgcatagtgctttagatgaattctttgatataatggacagccgctgtactgtgttaaggaaacaagatagtggtgaagcaccgtttagttcaaccaaggtgaaaaacaaaagcaagaaaaagaagccaaaggattcaaagcctatgttagttgggtctggaacaacttcagtaacttcaaataatgagatcatcacttcaagtgaagaccatagcaatcgaaattcagattctgcaggcccatttgcagtgcctgaccatcttcggcaagatgtagaagaattcgaagctctctatgaccaacacagtaacgaatatgttgtccgcaataagaagctatgggacatgaacccaaaacaaaaatgttcaactctatatgattacttctctcagtttttggaggaacatggtcccttggacatgagtaacaagatgttctctgcagaatatgagtttttcccagaagaaactcgacagatactagaaaaagcaggaggtttaaaaccttttctcttgggatgccctcgttttgttgtgattgacaactgtattgcactgaagaaggttgcatcacggctcaagaaaaaaaggaagaagaaaaacattaaaacaaaagtagaagaaatttcaaaagcaggggagtatgtacgagttaaactacaactgaatccagctgctagggaatttaaaccagatgtaaagtctaaaccagtgtcagattcatcttcagcaccagcttttgaaaatgtgaaacccaaacctgtgtctgcaaattctcccaagccagcttgtgaagatgtgaaggccaaaccagtatccgacaattcttctagacaagtttctgaggatgggcaacccaaaggggtctcttctaattctcctaaaccaggctctgaggatgcaaattacaagcgagtctcctgtaattcccccaaaccggttcttgaggatgtgaaaccaacttattgggctcaatcccatttggtcacaggatactgtacgtatcttcctttccagagatttgatatcacccagacaccgccagcatacataaacgtgttaccaggtttgccccagtacaccagcatatatacacccttggccagcctttctcctgaatatcagctaccaagatcagtaccagtggtgccgtcttttgtagccaatgacagagcagataaaaatgctgctgcctattttgagggtcatcatttgaatgctgagaatgttgctggtcaccagattgcctctgaaacacagatccttgagggctctttgggaatatctgtaaagtcacactgcagcacaggtgatgctcatacagtcctgagtgagtctaacagaaatgatgagcactgtggaaattctaacaacaaatgtgaagtaattccagaaagcaccagtgcagtaacaaacattccacacgtgcagatggttgccatacaggtatcttggaacataatacaccaagaagtcaatactgagccatataatccttttgaggaacgacaaggggaaatttcacggattgaaaaggagcaccaagtattacaagaccaacttcaagaagtgtatgaaaattatgagcagataaaacttaagggcttagaagagaccagggacctggaagagaagttgaaaaggcacttagaagaaaacaagatctcaaagacggaattagattggttccttcaagatttggaaagagaaattaaaaaatggcaacaggaaaaaaaagaaatccaagaaagactaaaatcactgaagaagaaaattaaaaaggtttcaaatgccagtgaaatgtatacccagaaaaatgatggaaaggaaaaggaacatgaattacatctggatcagtcccttgaaatcagcaacacacttacaaatgagaaaatgaaaatagaagagtatataaagaaagggaaagaggattatgaagagagtcatcagagagctgtggctgcagaggtatccgtacttgaaaactggaaggagagtgaagtgtataagctacagatcatggagtcacaagcagaagcctttctgaagaagctggggctgattagccgtgatcctgcagcatatcctgacatggagtctgatatacgttcatgggaattgtttctttctaatgttacaaaagaaattgagaaagcaaagtctcagtttgaagaacaaattaaggcaattaaaaatggttctcggctcagtgaactttctaaagtgcagatttctgagctttcatttcctgcctgtaacacggttcatcccgagttactccctgagtcttcaggccacgatggccaagggcttgtgacttctgcaagcgacgtgactggaaaccacgcagcacttcacagggatcctagtgtgttctctgctggtgattccccaggggaggctccttctgcgctgttgccagggccaccccctggtcagcctgaagccactcagctgacagggccaaaacgggctggccaggcagctctgtcagaacgaagccctgtggctgatcggaagcagcctgttcctccaggacgtgctgcgcgttcaagccagtctccaaaaaagccgttcaatagtattattgagcacctgtcagtggtattcccatgttacaacagcactgagcttgctggttttattaaaaaagtgcgaagcaaaaacaagaactcactctcaggattgagtattgatgaaattgtccaaagagtgacagaacacattctagatgaacagaaaaagaaaaagccaaacccaggaaaggacaagaggacttatgagcccagctctgccacccccgtgaccaggtcctcccagggctcaccctcggtggttgttgcaccatcacccaaaaccaaggggcagaaagcagaagatgtccctgtgaggattgcactgggtgcaagttcctgtgaaatatgccacgaggtgttcaaatcaaaaaacgtgcgtgtgctcaaatgtgggcacaagtatcacaaagggtgctttaagcagtggcttaaagggcagagcgcttgcccggcctgccagggtcgtgatctcctgacagaagagtcaccttctggaagaggctggcccagtcagaatcaggagctgccttcctgctcttctaggtagtcacacttcactaaagtgtcatccaccagtgtgttgaatccgaagaatgacaattttctaccactggtgtaaaaaacaaacatttgaagacccttgtgcattgtgtgtcacaaagctaaatacatggaaatcgttaatatcgctgatattaagtaatttccccactctgagtgaatactttgatgattgccaacagtggctaataaaatgacggctaccacactcatgggtcactggggctgcgcagggctctttgaggtgggtggcttcttttggaaagtactatgaacgtctcgaagcagtattctagtgataagaattcttaacatagccaagcgccccacgtttgttccccacgtttgttccccttttctgtttgaaaaacctgttctggtagctccacaagagagatgatactgactttttaaattttttacaagagtctgtattcctgatatgcctatatttttcctcaaagattctgcattttaaggatgggcataagcaaactatattttaataatttatagttaatgttaaaatattggctgatttagaccaaaagattcaaatctcctctttgtgaaatcccatctgcatttgattttttattattttatgttcccccgttagattgttttaagtgtttgcttttcatcttttatagatgtaatctgattttcaaaaatcattaacactttttaattagtatcgactaagactttttccccctggaatcgaggctgtgtgtccgtcatcccagcccccggttggagcctgctctttgaactccgctgccttccttagcagcttctgtcctcttctgtgagtcagtcagcgagtgcttgggatccgcatccagccgtgctgagcacacaacaggctgtgtgtggaaatggccaccaccattctccttccccaccccaccacaaaaagagaagctgtgtctttagacaaccctgaggtatctgtgttacaatcgttctgtgtttgatatttgtgtaaagtatgcatgcagtcttgtactgtgacctaagaacaaaactgtaactgcattagaaaccatgaaaaaattagatattgttttgtgacttttagacagtggtaaatatagaaccatgaattctggtcacattccatttctctccaacatgaaggatcaaaaaatgtttttcaatgtgttctttgttccactggaaacttagagtcatgagtttatgagctgatttggtcaccttcctctgcctttgttcactgtgagttctgatgtcttagtgacttagttcttagaagctcacgccttagtttgaaacagattctccacggtggtccccaaaacactgtctgcatatccataagaattgagcgctatgggtgttaacgtgcatgaggatcagtttgcagcagcaagtacaaaaggagaagaggaacatccgttgaatgagtgtgttttgtacataacttcagatacttgtgaacatgccttatatttgtccaacaactgtcagaataaagaacattctaaaatgagaaaaaaaaaaaaaaaaaaaaaaaaaaaaaaaaaaaaaaccaacgccattgctcagctaacggccacgcttcaacctggtgatgccccggcatactttccagcatagagcgcggaataagcgcaatngcctgctctgcgatcacacaggccaacattccgtgataagactccatctcatggatagttcccnngagcgcaccgtcagcatgaaaccagctctcgaagtgcgacgatccgacaattngcgccgnaggccataaatgtacttgcataacctgactggcacggnttactggcccatatccttgggcgtgaccatcataanttccttccgtattacccgtattccctcgatgg

SEQ ID NO: 371558 - DNA, 9046 bp, Homo sapiens
ctgaactagttgccagtgatcttgaaacgtgacagtaaccaagagataaataggtgacaatgacaggaaaattagatgtagtaaaagagagtgtttgagagcagaagctatggcaactaaagactggatttgaatccttcctagcttggtgacatgagcaaattacttgatttaagtgagcattttcccatctgtacagtggagataacgataattgtgcctgctaagaagaattgctgtgaagattagtgaaataatgcatgtaaaacatttggtacagtatgtgacacatagtacaaatagtttgctaggaagattgttattattcttcacttgtgatattgtgaagttttcatacagcaaattggacatcatgagatggattgattaaataaatagatttgaacttcaaggactggtagtgttcttgctttggaaagaagaaacttggtttatcctaataatagtaggataataatggtgaagtgataggtacaagtaatagtgtttatgatgcgctggtgatgataggaaaagaaagccattatatgggcaagagctagaagtaataaaatggtgcatttttcagtgatgtttggcctatgtagctattctctgataactataaaaatccttattattgaagattcttcaggaaaaaaaaacccttagtctgaaactttagcaccaatcccccttgccccccattgaaatacgtatttttaaaacatggcttttgataatgtgagggttttttcctttttgcgatttagcagtgctgattgtgtattgcagtagttgtgagagcattagaagcagcagtcgataggaggatggaaggtctggatgccgccttggggagttaggagattggcagacttaccctgtaccactctagccctactcctttgcccaagacagaaacacactgagatggataggagaatatgagcagttgataggaaagttctcagtggagtcaggatttaggttaggccaggagattgagaatataacagtttgtgtatgatgaaatggcatatttcacagaatgcagtaaaagcaggtagggtacaagtgcagcaacaggaagatgtcttttcttcattcagcaaacacttatttgagagcttaccatgtgctaggcacatacaaagataaataagatgcccttgatgatcctctatttaaaggagacatgtaaacaggttaacttagagtagagatggtgaatatgtgaacctgaggaaaggaagaaatagattaaattatctggagagagaggaaaagtcagcagaatggggacgagaatctttcggagctcagtgttctgataggagttatttccttgggcataggttccaagtatttttctaatataccatagaagccaggaaaactttcttctgttatctcaaatgatttaattactgacttgagtttgtgttgtctccttagacttgtgcaccatggacaattttgctgagggagatttcactgtggcggattatgccttgttagaagattgccctcacgtggatgattgtgtctttgctgctgaatttatgagcaatgattatgttcgtgtgactcagctttactgtgatggggtgggtgtgcaatataaagattatatccaaagtgagaggaatttggaatttgacatctgcagtatatggtgtagtaaaccaatttctgtcctgcaagattattgcgatgccattaaaataaacatcttctggccacttctgtttcaacatcaaaacagttccgtaatatcacgattgcatccctgtgtggacgccaacaattcacgtgcttctgagataaatttgaagaaactacaacatcttgagttgatggaagatattgtggatttggcaaagaaagttgctaatgattcattccttattggaggcttattgagaattggttgtaaaatagaaaataaaatcttggcaatggaagaagctctgaattggataaaatatgcaggcgatgtaacaattctaactaaattaggatcaattgacaattgttggcctatgttaagtattttctttactgaatgaaggagaactaatgaaaatgaaaggaaatgaagagttttccaaagaaagatttgatatagctattatctattacaccagagccattgaatatagacctgaaaactaccttctttatggtaaccgagctctttgttttcttcgtactggacagtttagaaatgcactcggtgatggaaagagagccactattctgaagaacacttggccaaagggtcattatcgttattgtgatgctctttctatgctgggggaatatgactgggccctgcaagcaaacataaaagctcaaaaactctgtaaaaatgaccctgagggaatcaaggatctaattcagcagcatgtaaagttacaaaaacaaatagaagacctacaaggtcgaacagcaaataaggatccaattaaagccttttatgaaaacagggcctacacacctaggagtttatcagcacctatatttactacttcacttaactttgtggagaaggaaagagatttcagaaaaattaatcacgaaatggccaacggtggtaatcagaatctaaaggtggcggatgaggcgttgaaggtagatgattgtgactgtcatcctgaattttcaccaccatcaagtcagcctccaaaacataaaggaaaacaaaaatctcgaaacaatgaatcagaaaagttcagttctagttcaccattgactttaccagcagatttgaagaacatcttggagaaacagttttctaaatcttccagagctgcacaccaggattttgctaatataatgaaaatgctgagaagcttaattcaagatggctatatggccttattggagcagcgttgccgcagcgctgcacaggcctttacagagttgctgaacggtttagatcctcaaaaaataaagcaattgaacctggccatgattaactatgttttggtcgtctatggacttgccatttctctccttggaataggacagcctgaggaattatctgaagccgaaaaccagtttaagaggattattgaacactaccccagtgagggccttgattgcttggcctactgtggaattggaaaagtgtatttgaaaaaaaacagatttctagaagctctcaatcactttgagaaagcaagaaccttgatttatcgtcttcctggagtgttaacttggcccacgagtaatgtgattattgaagagtctcagccacaaaaaataaagatgctgttagagaaatttgttgaagaatgcaagttccctccagtgccagatgccatttgttgctatcagaagtgccatggatattctaagatccagatatacataactgatccagactttaagggttttatacgcatcagctgttgccagtactgtaaaatagaatttcacatgaattgctggaagaagttaaaaactacaacctttaatgataaaattgacaaggattttctacaaggaatatgtcttacccctgactgtgaaggtgtcatttctaagattatcatcttcagcagtggtggtgaagttaaatgtgaatttgaacacaaggtcataaaagaaaaggttcctccaagacctattctgaaacagaaatgttctagcctagagaaactaagactgaaagaagacaaaaaattgaagagaaagatccaaaaaaaagaagcaaaaaagttagcacaagaaagaatggaggaggacttaagagaaagtaatccacccaaaaatgaagagcagaaagaaactgtagacaatgttcagcgttgtcagttccttgatgacagaattctacagtgtataaagcagtatgctgacaagattaaatccggcatacagaatacagccatgcttctcaaagaattgctttcttggaaagttttgagcacagaagactatacaacctgtttttctagcagaaattttctaaatgaagcagtggactatgttattcgccacttgattcaagaaaataacagagtaaagacaagaatatttctgcatgttttgagtgagcttaaagaagtggagcccaaattagccgcctggatccaaaaacttaatagctttggcttagatgccacaggaactttcttttctcgttatggagcatctcttaaactgcttgattttagtatcatgactttcctctggaatgagaaatatggtcacaaactagactctatagaaggaaagcaacttgattatttctctgagccagcatcattgaaggaagcccgttgtttaatatggctgctagaagaacacagagacaagttcccagcattgcatagtgctttagatgaattctttgatataatggacagccgctgtactgtgttaaggaaacaagatagtggtgaagcaccgtttagttcaaccaaggtgaaaaacaaaagcaagaaaaagaagccaaaggattcaaagcctatgttagttgggtctggaacaacttcagtaacttcaaataatgagatcatcacttcaagtgaagaccatagcaatcgaaattcagattctgcaggcccatttgcagtgcctgaccatcttcggcaagatgtagaagaattcgaagctctctatgaccaacacagtaacgaatatgttgtccgcaataagaagctatgggacatgaacccaaaacaaaaatgttcaactctatatgattacttctctcagtttttggaggaacatggtcccttggacatgagtaacaagatgttctctgcagaatatgagtttttcccagaagaaactcgacagatactagaaaaagcaggaggtttaaaaccttttctcttgggatgccctcgttttgttgtgattgacaactgtattgcactgaagaaggttgcatcacggctcaagaaaaaaaggaagaagaaaaacattaaaacaaaagtagaagaaatttcaaaagcaggggagtatgtacgagttaaactacaactgaatccagctgctagggaatttaaaccagatgtaaagtctaaaccagtgtcagattcatcttcagcaccagcttttgaaaatgtgaaacccaaacctgtgtctgcaaattctcccaagccagcttgtgaagatgtgaaggccaaaccagtatccgacaattcttctagacaagtttctgaggatgggcaacccaaaggggtctcttctaattctcctaaaccaggctctgaggatgcaaattacaagcgagtctcctgtaattcccccaaaccggttcttgaggatgtgaaaccaacttattgggctcaatcccatttggtcacaggatactgtacgtatcttcctttccagagatttgatatcacccagacaccgccagcatacataaacgtgttaccaggtttgccccagtacaccagcatatatacacccttggccagcctttctcctgaatatcagctaccaagatcagtaccagtggtgccgtcttttgtagccaatgacagagcagataaaaatgctgctgcctattttgagggtcatcatttgaatgctgagaatgttgctggtcaccagattgcctctgaaacacagatccttgagggctctttgggaatatctgtaaagtcacactgcagcacaggtgatgctcatacagtcctgagtgagtctaacagaaatgatgagcactgtggaaattctaacaacaaatgtgaagtaattccagaaagcaccagtgcagtaacaaacattccacacgtgcagatggttgccatacaggtatcttggaacataatacaccaagaagtcaatactgagccatataatccttttgaggaacgacaaggggaaatttcacggattgaaaaggagcaccaagtattacaagaccaacttcaagaagtgtatgaaaattatgagcagataaaacttaagggcttagaagagaccagggacctggaagagaagttgaaaaggcacttagaagaaaacaagatctcaaagacggaattagattggttccttcaagatttggaaagagaaattaaaaaatggcaacaggaaaaaaaagaaatccaagaaagactaaaatcactgaagaagaaaattaaaaaggtttcaaatgccagtgaaatgtatacccagaaaaatgatggaaaggaaaaggaacatgaattacatctggatcagtcccttgaaatcagcaacacacttacaaatgagaaaatgaaaatagaagagtatataaagaaagggaaagaggattatgaagagagtcatcagagagctgtggctgcagaggtatccgtacttgaaaactggaaggagagtgaagtgtataagctacagatcatggagtcacaagcagaagcctttctgaagaagctggggctgattagccgtgatcctgcagcatatcctgacatggagtctgatatacgttcatgggaattgtttctttctaatgttacaaaagaaattgagaaagcaaagtctcagtttgaagaacaaattaaggcaattaaaaatggttctcggctcagtgaactttctaaagtgcagatttctgagctttcatttcctgcctgtaacacggttcatcccgagttactccctgagtcttcaggccacgatggccaagggcttgtgacttctgcaagcgacgtgactggaaaccacgcagcacttcacagggatcctagtgtgttctctgctggtgattccccaggggaggctccttctgcgctgttgccagggccaccccctggtcagcctgaagccactcagctgacagggccaaaacgggctggccaggcagctctgtcagaacgaagccctgtggctgatcggaagcagcctgttcctccaggacgtgctgcgcgttcaagccagtctccaaaaaagccgttcaatagtattattgagcacctgtcagtggtattcccatgttacaacagcactgagcttgctggttttattaaaaaagtgcgaagcaaaaacaagaactcactctcaggattgagtattgatgaaattgtccaaagagtgacagaacacattctagatgaacagaaaaagaaaaagccaaacccaggaaaggacaagaggacttatgagcccagctctgccacccccgtgaccaggtcctcccagggctcaccctcggtggttgttgcaccatcacccaaaaccaaggggcagaaagcagaagatgtccctgtgaggattgcactgggtgcaagttcctgtgaaatatgccacgaggtgttcaaatcaaaaaacgtgcgtgtgctcaaatgtgggcacaagtatcacaaagggtgctttaagcagtggcttaaagggcagagcgcttgcccggcctgccagggtcgtgatctcctgacagaagagtcaccttctggaagaggctggcccagtcagaatcaggagctgccttcctgctcttctaggtagtcacacttcactaaagtgtcatccaccagtgtgttgaatccgaagaatgacaattttctaccactggtgtaaaaaacaaacatttgaagacccttgtgcattgtgtgtcacaaagctaaatacatggaaatcgttaatatcgctgatattaagtaatttccccactctgagtgaatactttgatgattgccaacagtggctaataaaatgacggctaccacactcatgggtcactggggctgcgcagggctctttgaggtgggtggcttcttttggaaagtactatgaacgtctcgaagcagtattctagtgataagaattcttaacatagccaagcgccccacgtttgttccccacgtttgttccccttttctgtttgaaaaacctgttctggtagctccacaagagagatgatactgactttttaaattttttacaagagtctgtattcctgatatgcctatatttttcctcaaagattctgcattttaaggatgggcataagcaaactatattttaataatttatagttaatgttaaaatattggctgatttagaccaaaagattcaaatctcctctttgtgaaatcccatctgcatttgattttttattattttatgttcccccgttagattgttttaagtgtttgcttttcatcttttatagatgtaatctgattttcaaaaatcattaacactttttaattagtatcgactaagactttttccccctggaatcgaggctgtgtgtccgtcatcccagcccccggttggagcctgctctttgaactccgctgccttccttagcagcttctgtcctcttctgtgagtcagtcagcgagtgcttgggatccgcatccagccgtgctgagcacacaacaggctgtgtgtggaaatggccaccaccattctccttccccaccccaccacaaaaagagaagctgtgtctttagacaaccctgaggtatctgtgttacaatcgttctgtgtttgatatttgtgtaaagtatgcatgcagtcttgtactgtgacctaagaacaaaactgtaactgcattagaaaccatgaaaaaattagatattgttttgtgacttttagacagtggtaaatatagaaccatgaattctggtcacattccatttctctccaacatgaaggatcaaaaaatgtttttcaatgtgttctttgttccactggaaacttagagtcatgagtttatgagctgatttggtcaccttcctctgcctttgttcactgtgagttctgatgtcttagtgacttagttcttagaagctcacgccttagtttgaaacagattctccacggtggtccccaaaacactgtctgcatatccataagaattgagcgctatgggtgttaacgtgcatgaggatcagtttgcagcagcaagtacaaaaggagaagaggaacatccgttgaatgagtgtgttttgtacataacttcagatacttgtgaacatgccttatatttgtccaacaactgtcagaataaagaacattctaaaatgagaaaaaaacaattataaaattctctttaatcaataaaaaccaacgccattgttat

SEQ ID NO: 371559 - DNA, 7773 bp, Homo sapiens
  misc_feature (205)..(205): n is a, c, g, or t
  misc_feature (231)..(231): n is a, c, g, or t
  misc_feature (7542)..(7542): n is a, c, g, or t
  misc_feature (7606)..(7607): n is a, c, g, or t
  misc_feature (7660)..(7660): n is a, c, g, or t
  misc_feature (7667)..(7667): n is a, c, g, or t
  misc_feature (7705)..(7705): n is a, c, g, or t
  misc_feature (7741)..(7741): n is a, c, g, or t
tacatttggaaagtcttactgacatgcagaaatagtacagaaaaacatacaaataggaatgttattggctgggcatggtggctcacacctgtaatcccagcactttgggaggccaaggcgggtggatcacaaggtcaggagatcgagaccatcgtggctaacatggtgaaaccctgtgcctactaaaaattcaaaaaattagccnggtgtactggcatgtgctgtaatccnagctacttgggaggctgaggcaggagaatcacttgaacccgggagcaaaggttgcagtgagccaagatcacgccactgcactccagcctgggcgacagagcgagactctgtctcaaaaaaaacaaaagaatgctatgcataggtacaatgtcgaaatgtgcaagaaatacttcagaaatattaaaagtagttattcctgggtagttgtgattgtgactctgggtgactttttccctttgttttatttttctgtattttccaaatttcctataatggacatatattatatggattttttttaattaaaattatcttttgactagataatatacatggaaaattcacaaagtacacatatgcaagatataatacttttactataaaagagtgaaaatttttaaatacttgtttttccttttagaaatgcactcggtgatggaaagagagccactattctgaagaacacttggccaaagggtcattatcgttattgtgatgctctttctatgctgggggaatatgactgggccctgcaagcaaacataaaagctcaaaaactctgtaaaaatgaccctgagggaatcaaggatctaattcagcagcatgtaaagttacaaaaacaaatagaagacctacaaggtcgaacagcaaataaggatccaattaaagccttttatgaaaacagggcctacacacctaggagtttatcagcacctatatttactacttcacttaactttgtggagaaggaaagagatttcagaaaaattaatcacgaaatggccaacggtggtaatcagaatctaaaggtggcggatgaggcgttgaaggtagatgattgtgactgtcatcctgaattttcaccaccatcaagtcagcctccaaaacataaaggaaaacaaaaatctcgaaacaatgaatcagaaaagttcagttctagttcaccattgactttaccagcagatttgaagaacatcttggagaaacagttttctaaatcttccagagctgcacaccaggattttgctaatataatgaaaatgctgagaagcttaattcaagatggctatatggccttattggagcagcgttgccgcagcgctgcacaggcctttacagagttgctgaacggtttagatcctcaaaaaataaagcaattgaacctggccatgattaactatgttttggtcgtctatggacttgccatttctctccttggaataggacagcctgaggaattatctgaagccgaaaaccagtttaagaggattattgaacactaccccagtgagggccttgattgcttggcctactgtggaattggaaaagtgtatttgaaaaaaaacagatttctagaagctctcaatcactttgagaaagcaagaaccttgatttatcgtcttcctggagtgttaacttggcccacgagtaatgtgattattgaagagtctcagccacaaaaaataaagatgctgttagagaaatttgttgaagaatgcaagttccctccagtgccagatgccatttgttgctatcagaagtgccatggatattctaagatccagatatacataactgatccagactttaagggttttatacgcatcagctgttgccagtactgtaaaatagaatttcacatgaattgctggaagaagttaaaaactacaacctttaatgataaaattgacaaggattttctacaaggaatatgtcttacccctgactgtgaaggtgtcatttctaagattatcatcttcagcagtggtggtgaagttaaatgtgaatttgaacacaaggtcataaaagaaaaggttcctccaagacctattctgaaacagaaatgttctagcctagagaaactaagactgaaagaagacaaaaaattgaagagaaagatccaaaaaaaagaagcaaaaaagttagcacaagaaagaatggaggaggacttaagagaaagtaatccacccaaaaatgaagagcagaaagaaactgtagacaatgttcagcgttgtcagttccttgatgacagaattctacagtgtataaagcagtatgctgacaagattaaatccggcatacagaatacagccatgcttctcaaagaattgctttcttggaaagttttgagcacagaagactatacaacctgtttttctagcagaaattttctaaatgaagcagtggactatgttattcgccacttgattcaagaaaataacagagtaaagacaagaatatttctgcatgttttgagtgagcttaaagaagtggagcccaaattagccgcctggatccaaaaacttaatagctttggcttagatgccacaggaactttcttttctcgttatggagcatctcttaaactgcttgattttagtatcatgactttcctctggaatgagaaatatggtcacaaactagactctatagaaggaaagcaacttgattatttctctgagccagcatcattgaaggaagcccgttgtttaatatggctgctagaagaacacagagacaagttcccagcattgcatagtgctttagatgaattctttgatataatggacagccgctgtactgtgttaaggaaacaagatagtggtgaagcaccgtttagttcaaccaaggtgaaaaacaaaagcaagaaaaagaagccaaaggattcaaagcctatgttagttgggtctggaacaacttcagtaacttcaaataatgagatcatcacttcaagtgaagaccatagcaatcgaaattcagattctgcaggcccatttgcagtgcctgaccatcttcggcaagatgtagaagaattcgaagctctctatgaccaacacagtaacgaatatgttgtccgcaataagaagctatgggacatgaacccaaaacaaaaatgttcaactctatatgattacttctctcagtttttggaggaacatggtcccttggacatgagtaacaagatgttctctgcagaatatgagtttttcccagaagaaactcgacagatactagaaaaagcaggaggtttaaaaccttttctcttgggatgccctcgttttgttgtgattgacaactgtattgcactgaagaaggttgcatcacggctcaagaaaaaaaggaagaagaaaaacattaaaacaaaagtagaagaaatttcaaaagcaggggagtatgtacgagttaaactacaactgaatccagctgctagggaatttaaaccagatgtaaagtctaaaccagtgtcagattcatcttcagcaccagcttttgaaaatgtgaaacccaaacctgtgtctgcaaattctcccaagccagcttgtgaagatgtgaaggccaaaccagtatccgacaattcttctagacaagtttctgaggatgggcaacccaaaggggtctcttctaattctcctaaaccaggctctgaggatgcaaattacaagcgagtctcctgtaattcccccaaaccggttcttgaggatgtgaaaccaacttattgggctcaatcccatttggtcacaggatactgtacgtatcttcctttccagagatttgatatcacccagacaccgccagcatacataaacgtgttaccaggtttgccccagtacaccagcatatatacacccttggccagcctttctcctgaatatcagctaccaagatcagtaccagtggtgccgtcttttgtagccaatgacagagcagataaaaatgctgctgcctattttgagggtcatcatttgaatgctgagaatgttgctggtcaccagattgcctctgaaacacagatccttgagggctctttgggaatatctgtaaagtcacactgcagcacaggtgatgctcatacagtcctgagtgagtctaacagaaatgatgagcactgtggaaattctaacaacaaatgtgaagtaattccagaaagcaccagtgcagtaacaaacattccacacgtgcagatggttgccatacaggtatcttggaacataatacaccaagaagtcaatactgagccatataatccttttgaggaacgacaaggggaaatttcacggattgaaaaggagcaccaagtattacaagaccaacttcaagaagtgtatgaaaattatgagcagataaaacttaagggcttagaagagaccagggacctggaagagaagttgaaaaggcacttagaagaaaacaagatctcaaagacggaattagattggttccttcaagatttggaaagagaaattaaaaaatggcaacaggaaaaaaaagaaatccaagaaagactaaaatcactgaagaagaaaattaaaaaggtttcaaatgccagtgaaatgtatacccagaaaaatgatggaaaggaaaaggaacatgaattacatctggatcagtcccttgaaatcagcaacacacttacaaatgagaaaatgaaaatagaagagtatataaagaaagggaaagaggattatgaagagagtcatcagagagctgtggctgcagaggtatccgtacttgaaaactggaaggagagtgaagtgtataagctacagatcatggagtcacaagcagaagcctttctgaagaagctggggctgattagccgtgatcctgcagcatatcctgacatggagtctgatatacgttcatgggaattgtttctttctaatgttacaaaagaaattgagaaagcaaagtctcagtttgaagaacaaattaaggcaattaaaaatggttctcggctcagtgaactttctaaagtgcagatttctgagctttcatttcctgcctgtaacacggttcatcccgagttactccctgagtcttcaggccacgatggccaagggcttgtgacttctgcaagcgacgtgactggaaaccacgcagcacttcacagggatcctagtgtgttctctgctggtgattccccaggggaggctccttctgcgctgttgccagggccaccccctggtcagcctgaagccactcagctgacagggccaaaacgggctggccaggcagctctgtcagaacgaagccctgtggctgatcggaagcagcctgttcctccaggacgtgctgcgcgttcaagccagtctccaaaaaagccgttcaatagtattattgagcacctgtcagtggtattcccatgttacaacagcactgagcttgctggttttattaaaaaagtgcgaagcaaaaacaagaactcactctcaggattgagtattgatgaaattgtccaaagagtgacagaacacattctagatgaacagaaaaagaaaaagccaaacccaggaaaggacaagaggacttatgagcccagctctgccacccccgtgaccaggtcctcccagggctcaccctcggtggttgttgcaccatcacccaaaaccaaggggcagaaagcagaagatgtccctgtgaggattgcactgggtgcaagttcctgtgaaatatgccacgaggtgttcaaatcaaaaaacgtgcgtgtgctcaaatgtgggcacaagtatcacaaagggtgctttaagcagtggcttaaagggcagagcgcttgcccggcctgccagggtcgtgatctcctgacagaagagtcaccttctggaagaggctggcccagtcagaatcaggagctgccttcctgctcttctaggtagtcacacttcactaaagtgtcatccaccagtgtgttgaatccgaagaatgacaattttctaccactggtgtaaaaaacaaacatttgaagacccttgtgcattgtgtgtcacaaagctaaatacatggaaatcgttaatatcgctgatattaagtaatttccccactctgagtgaatactttgatgattgccaacagtggctaataaaatgacggctaccacactcatgggtcactggggctgcgcagggctctttgaggtgggtggcttcttttggaaagtactatgaacgtctcgaagcagtattctagtgataagaattcttaacatagccaagcgccccacgtttgttccccacgtttgttccccttttctgtttgaaaaacctgttctggtagctccacaagagagatgatactgactttttaaattttttacaagagtctgtattcctgatatgcctatatttttcctcaaagattctgcattttaaggatgggcataagcaaactatattttaataatttatagttaatgttaaaatattggctgatttagaccaaaagattcaaatctcctctttgtgaaatcccatctgcatttgattttttattattttatgttcccccgttagattgttttaagtgtttgcttttcatcttttatagatgtaatctgattttcaaaaatcattaacactttttaattagtatcgactaagactttttccccctggaatcgaggctgtgtgtccgtcatcccagcccccggttggagcctgctctttgaactccgctgccttccttagcagcttctgtcctcttctgtgagtcagtcagcgagtgcttgggatccgcatccagccgtgctgagcacacaacaggctgtgtgtggaaatggccaccaccattctccttccccaccccaccacaaaaagagaagctgtgtctttagacaaccctgaggtatctgtgttacaatcgttctgtgtttgatatttgtgtaaagtatgcatgcagtcttgtactgtgacctaagaacaaaactgtaactgcattagaaaccatgaaaaaattagatattgttttgtgacttttagacagtggtaaatatagaaccatgaattctggtcacattccatttctctccaacatgaaggatcaaaaaatgtttttcaatgtgttctttgttccactggaaacttagagtcatgagtttatgagctgatttggtcaccttcctctgcctttgttcactgtgagttctgatgtcttagtgacttagttcttagaagctcacgccttagtttgaaacagattctccacggtggtccccaaaacactgtctgcatatccataagaattgagcgctatgggtgttaacgtgcatgaggatcagtttgcagcagcaagtacaaaaggagaagaggaacatccgttgaatgagtgtgttttgtacataacttcagatacttgtgaacatgccttatatttgtccaacaactgtcagaataaagaacattctaaaatgagaaaaaaaaaaaaaaaaaaaaaaaaaaaaaaaaaaaaaaccaacgccattgctcagctaacggccacgcttcaacctggtgatgccccggcatactttccagcatagagcgcggaataagcgcaatngcctgctctgcgatcacacaggccaacattccgtgataagactccatctcatggatagttcccnngagcgcaccgtcagcatgaaaccagctctcgaagtgcgacgatccgacaattngcgccgnaggccataaatgtacttgcataacctgactggcacggnttactggcccatatccttgggcgtgaccatcataanttccttccgtattacccgtattccctcgatgg

SEQ ID NO: 371560 - DNA, 8729 bp, Homo sapiens
  misc_feature (8498)..(8498): n is a, c, g, or t
  misc_feature (8562)..(8563): n is a, c, g, or t
  misc_feature (8616)..(8616): n is a, c, g, or t
  misc_feature (8623)..(8623): n is a, c, g, or t
  misc_feature (8661)..(8661): n is a, c, g, or t
  misc_feature (8697)..(8697): n is a, c, g, or t
ctgaactagttgccagtgatcttgaaacgtgacagtaaccaagagataaataggtgacaatgacaggaaaattagatgtagtaaaagagagtgtttgagagcagaagctatggcaactaaagactggatttgaatccttcctagcttggtgacatgagcaaattacttgatttaagtgagcattttcccatctgtacagtggagataacgataattgtgcctgctaagaagaattgctgtgaagattagtgaaataatgcatgtaaaacatttggtacagtatgtgacacatagtacaaatagtttgctaggaagattgttattattcttcacttgtgatattgtgaagttttcatacagcaaattggacatcatgagatggattgattaaataaatagatttgaacttcaaggactggtagtgttcttgctttggaaagaagaaacttggtttatcctaataatagtaggataataatggtgaagtgataggtacaagtaatagtgtttatgatgcgctggtgatgataggaaaagaaagccattatatgggcaagagctagaagtaataaaatggtgcatttttcagtgatgtttggcctatgtagctattctctgataactataaaaatccttattattgaagattcttcaggaaaaaaaaacccttagtctgaaactttagcaccaatcccccttgccccccattgaaatacgtatttttaaaacatggcttttgataatgtgagggttttttcctttttgcgatttagcagtgctgattgtgtattgcagtagttgtgagagcattagaagcagcagtcgataggaggatggaaggtctggatgccgccttggggagttaggagattggcagacttaccctgtaccactctagccctactcctttgcccaagacagaaacacactgagatggataggagaatatgagcagttgataggaaagttctcagtggagtcaggatttaggttaggccaggagattgagaatataacagtttgtgtatgatgaaatggcatatttcacagaatgcagtaaaagcaggtagggtacaagtgcagcaacaggaagatgtcttttcttcattcagcaaacacttatttgagagcttaccatgtgctaggcacatacaaagataaataagatgcccttgatgatcctctatttaaaggagacatgtacaattcacgtgcttctgagataaatttgaagaaactacaacatcttgagttgatggaagatattgtggatttggcaaagaaagttgctaatgattcattccttattggaggcttattgagaattggttgtaaaatagaaaataaaatcttggcaatggaagaagctctgaattggataaaatatgcaggcgatgtaacaattctaactaaattaggatcaattgacaattgttggcctatgttaagtattttctttactgaatacaagtaccacataactaaaattgtaatggaagactgcaatttgcttgaagaacttaaaactcaaagttgtatggattgtatagaggaaggagaactaatgaaaatgaaaggaaatgaagagttttccaaagaaagatttgatatagctattatctattacaccagagccattgaatatagacctgaaaactaccttctttatggtaaccgagctctttgttttcttcgtactggacagtttagaaatgcactcggtgatggaaagagagccactattctgaagaacacttggccaaagggtcattatcgttattgtgatgctctttctatgctgggggaatatgactgggccctgcaagcaaacataaaagctcaaaaactctgtaaaaatgaccctgagggaatcaaggatctaattcagcagcatgtaaagttacaaaaacaaatagaagacctacaaggtcgaacagcaaataaggatccaattaaagccttttatgaaaacagggcctacacacctaggagtttatcagcacctatatttactacttcacttaactttgtggagaaggaaagagatttcagaaaaattaatcacgaaatggccaacggtggtaatcagaatctaaaggtggcggatgaggcgttgaaggtagatgattgtgactgtcatcctgaattttcaccaccatcaagtcagcctccaaaacataaaggaaaacaaaaatctcgaaacaatgaatcagaaaagttcagttctagttcaccattgactttaccagcagatttgaagaacatcttggagaaacagttttctaaatcttccagagctgcacaccaggattttgctaatataatgaaaatgctgagaagcttaattcaagatggctatatggccttattggagcagcgttgccgcagcgctgcacaggcctttacagagttgctgaacggtttagatcctcaaaaaataaagcaattgaacctggccatgattaactatgttttggtcgtctatggacttgccatttctctccttggaataggacagcctgaggaattatctgaagccgaaaaccagtttaagaggattattgaacactaccccagtgagggccttgattgcttggcctactgtggaattggaaaagtgtatttgaaaaaaaacagatttctagaagctctcaatcactttgagaaagcaagaaccttgatttatcgtcttcctggagtgttaacttggcccacgagtaatgtgattattgaagagtctcagccacaaaaaataaagatgctgttagagaaatttgttgaagaatgcaagttccctccagtgccagatgccatttgttgctatcagaagtgccatggatattctaagatccagatatacataactgatccagactttaaggattttctacaaggaatatgtcttacccctgactgtgaaggtgtcatttctaagattatcatcttcagcagtggtggtgaagttaaatgtgaatttgaacacaaggtcataaaagaaaaggttcctccaagacctattctgaaacagaaatgttctagcctagagaaactaagactgaaagaagacaaaaaattgaagagaaagatccaaaaaaaagaagcaaaaaagttagcacaagaaagaatggaggaggacttaagagaaagtaatccacccaaaaatgaagagcagaaagaaactgtagacaatgttcagcgttgtcagttccttgatgacagaattctacagtgtataaagcagtatgctgacaagattaaatccggcatacagaatacagccatgcttctcaaagaattgctttcttggaaagttttgagcacagaagactatacaacctgtttttctagcagaaattttctaaatgaagcagtggactatgttattcgccacttgattcaagaaaataacagagtaaagacaagaatatttctgcatgttttgagtgagcttaaagaagtggagcccaaattagccgcctggatccaaaaacttaatagctttggcttagatgccacaggaactttcttttctcgttatggagcatctcttaaactgcttgattttagtatcatgactttcctctggaatgagaaatatggtcacaaactagactctatagaaggaaagcaacttgattatttctctgagccagcatcattgaaggaagcccgttgtttaatatggctgctagaagaacacagagacaagttcccagcattgcatagtgctttagatgaattctttgatataatggacagccgctgtactgtgttaaggaaacaagatagtggtgaagcaccgtttagttcaaccaaggtgaaaaacaaaagcaagaaaaagaagccaaaggattcaaagcctatgttagttgggtctggaacaacttcagtaacttcaaataatgagatcatcacttcaagtgaagaccatagcaatcgaaattcagattctgcaggcccatttgcagtgcctgaccatcttcggcaagatgtagaagaattcgaagctctctatgaccaacacagtaacgaatatgttgtccgcaataagaagctatgggacatgaacccaaaacaaaaatgttcaactctatatgattacttctctcagtttttggaggaacatggtcccttggacatgagtaacaagatgttctctgcagaatatgagtttttcccagaagaaactcgacagatactagaaaaagcaggaggtttaaaaccttttctcttgggatgccctcgttttgttgtgattgacaactgtattgcactgaagaaggttgcatcacggctcaagaaaaaaaggaagaagaaaaacattaaaacaaaagtagaagaaatttcaaaagcaggggagtatgtacgagttaaactacaactgaatccagctgctagggaatttaaaccagatgtaaagtctaaaccagtgtcagattcatcttcagcaccagcttttgaaaatgtgaaacccaaacctgtgtctgcaaattctcccaagccagcttgtgaagatgtgaaggccaaaccagtatccgacaattcttctagacaagtttctgaggatgggcaacccaaaggggtctcttctaattctcctaaaccaggctctgaggatgcaaattacaagcgagtctcctgtaattcccccaaaccggttcttgaggatgtgaaaccaacttattgggctcaatcccatttggtcacaggatactgtacgtatcttcctttccagagatttgatatcacccagacaccgccagcatacataaacgtgttaccaggtttgccccagtacaccagcatatatacacccttggccagcctttctcctgaatatcagctaccaagatcagtaccagtggtgccgtcttttgtagccaatgacagagcagataaaaatgctgctgcctattttgagggtcatcatttgaatgctgagaatgttgctggtcaccagattgcctctgaaacacagatccttgagggctctttgggaatatctgtaaagtcacactgcagcacaggtgatgctcatacagtcctgagtgagtctaacagaaatgatgagcactgtggaaattctaacaacaaatgtgaagtaattccagaaagcaccagtgcagtaacaaacattccacacgtgcagatggttgccatacaggtatcttggaacataatacaccaagaagtcaatactgagccatataatccttttgaggaacgacaaggggaaatttcacggattgaaaaggagcaccaagtattacaagaccaacttcaagaagtgtatgaaaattatgagcagataaaacttaagggcttagaagagaccagggacctggaagagaagttgaaaaggcacttagaagaaaacaagatctcaaagacggaattagattggttccttcaagatttggaaagagaaattaaaaaatggcaacaggaaaaaaaagaaatccaagaaagactaaaatcactgaagaagaaaattaaaaaggtttcaaatgccagtgaaatgtatacccagaaaaatgatggaaaggaaaaggaacatgaattacatctggatcagtcccttgaaatcagcaacacacttacaaatgagaaaatgaaaatagaagagtatataaagaaagggaaagaggattatgaagagagtcatcagagagctgtggctgcagaggtatccgtacttgaaaactggaaggagagtgaagtgtataagctacagatcatggagtcacaagcagaagcctttctgaagaagctggggctgattagccgtgatcctgcagcatatcctgacatggagtctgatatacgttcatgggaattgtttctttctaatgttacaaaagaaattgagaaagcaaagtctcagtttgaagaacaaattaaggcaattaaaaatggttctcggctcagtgaactttctaaagtgcagatttctgagctttcatttcctgcctgtaacacggttcatcccgagttactccctgagtcttcaggccacgatggccaagggcttgtgacttctgcaagcgacgtgactggaaaccacgcagcacttcacagggatcctagtgtgttctctgctggtgattccccaggggaggctccttctgcgctgttgccagggccaccccctggtcagcctgaagccactcagctgacagggccaaaacgggctggccaggcagctctgtcagaacgaagccctgtggctgatcggaagcagcctgttcctccaggacgtgctgcgcgttcaagccagtctccaaaaaagccgttcaatagtattattgagcacctgtcagtggtattcccatgttacaacagcactgagcttgctggttttattaaaaaagtgcgaagcaaaaacaagaactcactctcaggattgagtattgatgaaattgtccaaagagtgacagaacacattctagatgaacagaaaaagaaaaagccaaacccaggaaaggacaagaggacttatgagcccagctctgccacccccgtgaccaggtcctcccagggctcaccctcggtggttgttgcaccatcacccaaaaccaaggggcagaaagcagaagatgtccctgtgaggattgcactgggtgcaagttcctgtgaaatatgccacgaggtgttcaaatcaaaaaacgtgcgtgtgctcaaatgtgggcacaagtatcacaaagggtgctttaagcagtggcttaaagggcagagcgcttgcccggcctgccagggtcgtgatctcctgacagaagagtcaccttctggaagaggctggcccagtcagaatcaggagctgccttcctgctcttctaggtagtcacacttcactaaagtgtcatccaccagtgtgttgaatccgaagaatgacaattttctaccactggtgtaaaaaacaaacatttgaagacccttgtgcattgtgtgtcacaaagctaaatacatggaaatcgttaatatcgctgatattaagtaatttccccactctgagtgaatactttgatgattgccaacagtggctaataaaatgacggctaccacactcatgggtcactggggctgcgcagggctctttgaggtgggtggcttcttttggaaagtactatgaacgtctcgaagcagtattctagtgataagaattcttaacatagccaagcgccccacgtttgttccccacgtttgttccccttttctgtttgaaaaacctgttctggtagctccacaagagagatgatactgactttttaaattttttacaagagtctgtattcctgatatgcctatatttttcctcaaagattctgcattttaaggatgggcataagcaaactatattttaataatttatagttaatgttaaaatattggctgatttagaccaaaagattcaaatctcctctttgtgaaatcccatctgcatttgattttttattattttatgttcccccgttagattgttttaagtgtttgcttttcatcttttatagatgtaatctgattttcaaaaatcattaacactttttaattagtatcgactaagactttttccccctggaatcgaggctgtgtgtccgtcatcccagcccccggttggagcctgctctttgaactccgctgccttccttagcagcttctgtcctcttctgtgagtcagtcagcgagtgcttgggatccgcatccagccgtgctgagcacacaacaggctgtgtgtggaaatggccaccaccattctccttccccaccccaccacaaaaagagaagctgtgtctttagacaaccctgaggtatctgtgttacaatcgttctgtgtttgatatttgtgtaaagtatgcatgcagtcttgtactgtgacctaagaacaaaactgtaactgcattagaaaccatgaaaaaattagatattgttttgtgacttttagacagtggtaaatatagaaccatgaattctggtcacattccatttctctccaacatgaaggatcaaaaaatgtttttcaatgtgttctttgttccactggaaacttagagtcatgagtttatgagctgatttggtcaccttcctctgcctttgttcactgtgagttctgatgtcttagtgacttagttcttagaagctcacgccttagtttgaaacagattctccacggtggtccccaaaacactgtctgcatatccataagaattgagcgctatgggtgttaacgtgcatgaggatcagtttgcagcagcaagtacaaaaggagaagaggaacatccgttgaatgagtgtgttttgtacataacttcagatacttgtgaacatgccttatatttgtccaacaactgtcagaataaagaacattctaaaatgagaaaaaaaaaaaaaaaaaaaaaaaaaaaaaaaaaaaaaaccaacgccattgctcagctaacggccacgcttcaacctggtgatgccccggcatactttccagcatagagcgcggaataagcgcaatngcctgctctgcgatcacacaggccaacattccgtgataagactccatctcatggatagttcccnngagcgcaccgtcagcatgaaaccagctctcgaagtgcgacgatccgacaattngcgccgnaggccataaatgtacttgcataacctgactggcacggnttactggcccatatccttgggcgtgaccatcataanttccttccgtattacccgtattccctcgatgg

SEQ ID NO: 371561 - DNA, 8766 bp, Homo sapiens
  misc_feature (8535)..(8535): n is a, c, g, or t
  misc_feature (8599)..(8600): n is a, c, g, or t
  misc_feature (8653)..(8653): n is a, c, g, or t
  misc_feature (8660)..(8660): n is a, c, g, or t
  misc_feature (8698)..(8698): n is a, c, g, or t
  misc_feature (8734)..(8734): n is a, c, g, or t
ctgaactagttgccagtgatcttgaaacgtgacagtaaccaagagataaataggtgacaatgacaggaaaattagatgtagtaaaagagagtgtttgagagcagaagctatggcaactaaagactggatttgaatccttcctagcttggtgacatgagcaaattacttgatttaagtgagcattttcccatctgtacagtggagataacgataattgtgcctgctaagaagaattgctgtgaagattagtgaaataatgcatgtaaaacatttggtacagtatgtgacacatagtacaaatagtttgctaggaagattgttattattcttcacttgtgatattgtgaagttttcatacagcaaattggacatcatgagatggattgattaaataaatagatttgaacttcaaggactggtagtgttcttgctttggaaagaagaaacttggtttatcctaataatagtaggataataatggtgaagtgataggtacaagtaatagtgtttatgatgcgctggtgatgataggaaaagaaagccattatatgggcaagagctagaagtaataaaatggtgcatttttcagtgatgtttggcctatgtagctattctctgataactataaaaatccttattattgaagattcttcaggaaaaaaaaacccttagtctgaaactttagcaccaatcccccttgccccccattgaaatacgtatttttaaaacatggcttttgataatgtgagggttttttcctttttgcgatttagcagtgctgattgtgtattgcagtagttgtgagagcattagaagcagcagtcgataggaggatggaaggtctggatgccgccttggggagttaggagattggcagacttaccctgtaccactctagccctactcctttgcccaagacagaaacacactgagatggataggagaatatgagcagttgataggaaagttctcagtggagtcaggatttaggttaggccaggagattgagaatataacagtttgtgtatgatgaaatggcatatttcacagaatgcagtaaaagcaggtagggtacaagtgcagcaacaggaagatgtcttttcttcattcagcaaacacttatttgagagcttaccatgtgctaggcacatacaaagataaataagatgcccttgatgatcctctatttaaaggagacatgtacaattcacgtgcttctgagataaatttgaagaaactacaacatcttgagttgatggaagatattgtggatttggcaaagaaagttgctaatgattcattccttattggaggcttattgagaattggttgtaaaatagaaaataaaatcttggcaatggaagaagctctgaattggataaaatatgcaggcgatgtaacaattctaactaaattaggatcaattgacaattgttggcctatgttaagtattttctttactgaatacaagtaccacataactaaaattgtaatggaagactgcaatttgcttgaagaacttaaaactcaaagttgtatggattgtatagaggaaggagaactaatgaaaatgaaaggaaatgaagagttttccaaagaaagatttgatatagctattatctattacaccagagccattgaatatagacctgaaaactaccttctttatggtaaccgagctctttgttttcttcgtactggacagtttagaaatgcactcggtgatggaaagagagccactattctgaagaacacttggccaaagggtcattatcgttattgtgatgctctttctatgctgggggaatatgactgggccctgcaagcaaacataaaagctcaaaaactctgtaaaaatgaccctgagggaatcaaggatctaattcagcagcatgtaaagttacaaaaacaaatagaagacctacaaggtcgaacagcaaataaggatccaattaaagccttttatgaaaacagggcctacacacctaggagtttatcagcacctatatttactacttcacttaactttgtggagaaggaaagagatttcagaaaaattaatcacgaaatggccaacggtggtaatcagaatctaaaggtggcggatgaggcgttgaaggtagatgattgtgactgtcatcctgaattttcaccaccatcaagtcagcctccaaaacataaaggaaaacaaaaatctcgaaacaatgaatcagaaaagttcagttctagttcaccattgactttaccagcagatttgaagaacatcttggagaaacagttttctaaatcttccagagctgcacaccaggattttgctaatataatgaaaatgctgagaagcttaattcaagatggctatatggccttattggagcagcgttgccgcagcgctgcacaggcctttacagagttgctgaacggtttagatcctcaaaaaataaagcaattgaacctggccatgattaactatgttttggtcgtctatggacttgccatttctctccttggaataggacagcctgaggaattatctgaagccgaaaaccagtttaagaggattattgaacactaccccagtgagggccttgattgcttggcctactgtggaattggaaaagtgtatttgaaaaaaaacagatttctagaagctctcaatcactttgagaaagcaagaaccttgatttatcgtcttcctggagtgttaacttggcccacgagtaatgtgattattgaagagtctcagccacaaaaaataaagatgctgttagagaaatttgttgaagaatgcaagttccctccagtgccagatgccatttgttgctatcagaagtgccatggatattctaagatccagatatacataactgatccagactttaagggttttatacgcatcagctgttgccagtactgtaaaatagaatttcacatgaattgctggaagaagttaaaaactacaacctttaatgataaaattgacaaggattttctacaaggaatatgtcttacccctgactgtgaaggtgtcatttctaagattatcatcttcagcagtggtggtgaagttaaatgtgaacctagagaaactaagactgaaagaagacaaaaaattgaagagaaagatccaaaaaaaagaagcaaaaaagttagcacaagaaagaatggaggaggacttaagagaaagtaatccacccaaaaatgaagagcagaaagaaactgtagacaatgttcagcgttgtcagttccttgatgacagaattctacagtgtataaagcagtatgctgacaagattaaatccggcatacagaatacagccatgcttctcaaagaattgctttcttggaaagttttgagcacagaagactatacaacctgtttttctagcagaaattttctaaatgaagcagtggactatgttattcgccacttgattcaagaaaataacagagtaaagacaagaatatttctgcatgttttgagtgagcttaaagaagtggagcccaaattagccgcctggatccaaaaacttaatagctttggcttagatgccacaggaactttcttttctcgttatggagcatctcttaaactgcttgattttagtatcatgactttcctctggaatgagaaatatggtcacaaactagactctatagaaggaaagcaacttgattatttctctgagccagcatcattgaaggaagcccgttgtttaatatggctgctagaagaacacagagacaagttcccagcattgcatagtgctttagatgaattctttgatataatggacagccgctgtactgtgttaaggaaacaagatagtggtgaagcaccgtttagttcaaccaaggtgaaaaacaaaagcaagaaaaagaagccaaaggattcaaagcctatgttagttgggtctggaacaacttcagtaacttcaaataatgagatcatcacttcaagtgaagaccatagcaatcgaaattcagattctgcaggcccatttgcagtgcctgaccatcttcggcaagatgtagaagaattcgaagctctctatgaccaacacagtaacgaatatgttgtccgcaataagaagctatgggacatgaacccaaaacaaaaatgttcaactctatatgattacttctctcagtttttggaggaacatggtcccttggacatgagtaacaagatgttctctgcagaatatgagtttttcccagaagaaactcgacagatactagaaaaagcaggaggtttaaaaccttttctcttgggatgccctcgttttgttgtgattgacaactgtattgcactgaagaaggttgcatcacggctcaagaaaaaaaggaagaagaaaaacattaaaacaaaagtagaagaaatttcaaaagcaggggagtatgtacgagttaaactacaactgaatccagctgctagggaatttaaaccagatgtaaagtctaaaccagtgtcagattcatcttcagcaccagcttttgaaaatgtgaaacccaaacctgtgtctgcaaattctcccaagccagcttgtgaagatgtgaaggccaaaccagtatccgacaattcttctagacaagtttctgaggatgggcaacccaaaggggtctcttctaattctcctaaaccaggctctgaggatgcaaattacaagcgagtctcctgtaattcccccaaaccggttcttgaggatgtgaaaccaacttattgggctcaatcccatttggtcacaggatactgtacgtatcttcctttccagagatttgatatcacccagacaccgccagcatacataaacgtgttaccaggtttgccccagtacaccagcatatatacacccttggccagcctttctcctgaatatcagctaccaagatcagtaccagtggtgccgtcttttgtagccaatgacagagcagataaaaatgctgctgcctattttgagggtcatcatttgaatgctgagaatgttgctggtcaccagattgcctctgaaacacagatccttgagggctctttgggaatatctgtaaagtcacactgcagcacaggtgatgctcatacagtcctgagtgagtctaacagaaatgatgagcactgtggaaattctaacaacaaatgtgaagtaattccagaaagcaccagtgcagtaacaaacattccacacgtgcagatggttgccatacaggtatcttggaacataatacaccaagaagtcaatactgagccatataatccttttgaggaacgacaaggggaaatttcacggattgaaaaggagcaccaagtattacaagaccaacttcaagaagtgtatgaaaattatgagcagataaaacttaagggcttagaagagaccagggacctggaagagaagttgaaaaggcacttagaagaaaacaagatctcaaagacggaattagattggttccttcaagatttggaaagagaaattaaaaaatggcaacaggaaaaaaaagaaatccaagaaagactaaaatcactgaagaagaaaattaaaaaggtttcaaatgccagtgaaatgtatacccagaaaaatgatggaaaggaaaaggaacatgaattacatctggatcagtcccttgaaatcagcaacacacttacaaatgagaaaatgaaaatagaagagtatataaagaaagggaaagaggattatgaagagagtcatcagagagctgtggctgcagaggtatccgtacttgaaaactggaaggagagtgaagtgtataagctacagatcatggagtcacaagcagaagcctttctgaagaagctggggctgattagccgtgatcctgcagcatatcctgacatggagtctgatatacgttcatgggaattgtttctttctaatgttacaaaagaaattgagaaagcaaagtctcagtttgaagaacaaattaaggcaattaaaaatggttctcggctcagtgaactttctaaagtgcagatttctgagctttcatttcctgcctgtaacacggttcatcccgagttactccctgagtcttcaggccacgatggccaagggcttgtgacttctgcaagcgacgtgactggaaaccacgcagcacttcacagggatcctagtgtgttctctgctggtgattccccaggggaggctccttctgcgctgttgccagggccaccccctggtcagcctgaagccactcagctgacagggccaaaacgggctggccaggcagctctgtcagaacgaagccctgtggctgatcggaagcagcctgttcctccaggacgtgctgcgcgttcaagccagtctccaaaaaagccgttcaatagtattattgagcacctgtcagtggtattcccatgttacaacagcactgagcttgctggttttattaaaaaagtgcgaagcaaaaacaagaactcactctcaggattgagtattgatgaaattgtccaaagagtgacagaacacattctagatgaacagaaaaagaaaaagccaaacccaggaaaggacaagaggacttatgagcccagctctgccacccccgtgaccaggtcctcccagggctcaccctcggtggttgttgcaccatcacccaaaaccaaggggcagaaagcagaagatgtccctgtgaggattgcactgggtgcaagttcctgtgaaatatgccacgaggtgttcaaatcaaaaaacgtgcgtgtgctcaaatgtgggcacaagtatcacaaagggtgctttaagcagtggcttaaagggcagagcgcttgcccggcctgccagggtcgtgatctcctgacagaagagtcaccttctggaagaggctggcccagtcagaatcaggagctgccttcctgctcttctaggtagtcacacttcactaaagtgtcatccaccagtgtgttgaatccgaagaatgacaattttctaccactggtgtaaaaaacaaacatttgaagacccttgtgcattgtgtgtcacaaagctaaatacatggaaatcgttaatatcgctgatattaagtaatttccccactctgagtgaatactttgatgattgccaacagtggctaataaaatgacggctaccacactcatgggtcactggggctgcgcagggctctttgaggtgggtggcttcttttggaaagtactatgaacgtctcgaagcagtattctagtgataagaattcttaacatagccaagcgccccacgtttgttccccacgtttgttccccttttctgtttgaaaaacctgttctggtagctccacaagagagatgatactgactttttaaattttttacaagagtctgtattcctgatatgcctatatttttcctcaaagattctgcattttaaggatgggcataagcaaactatattttaataatttatagttaatgttaaaatattggctgatttagaccaaaagattcaaatctcctctttgtgaaatcccatctgcatttgattttttattattttatgttcccccgttagattgttttaagtgtttgcttttcatcttttatagatgtaatctgattttcaaaaatcattaacactttttaattagtatcgactaagactttttccccctggaatcgaggctgtgtgtccgtcatcccagcccccggttggagcctgctctttgaactccgctgccttccttagcagcttctgtcctcttctgtgagtcagtcagcgagtgcttgggatccgcatccagccgtgctgagcacacaacaggctgtgtgtggaaatggccaccaccattctccttccccaccccaccacaaaaagagaagctgtgtctttagacaaccctgaggtatctgtgttacaatcgttctgtgtttgatatttgtgtaaagtatgcatgcagtcttgtactgtgacctaagaacaaaactgtaactgcattagaaaccatgaaaaaattagatattgttttgtgacttttagacagtggtaaatatagaaccatgaattctggtcacattccatttctctccaacatgaaggatcaaaaaatgtttttcaatgtgttctttgttccactggaaacttagagtcatgagtttatgagctgatttggtcaccttcctctgcctttgttcactgtgagttctgatgtcttagtgacttagttcttagaagctcacgccttagtttgaaacagattctccacggtggtccccaaaacactgtctgcatatccataagaattgagcgctatgggtgttaacgtgcatgaggatcagtttgcagcagcaagtacaaaaggagaagaggaacatccgttgaatgagtgtgttttgtacataacttcagatacttgtgaacatgccttatatttgtccaacaactgtcagaataaagaacattctaaaatgagaaaaaaaaaaaaaaaaaaaaaaaaaaaaaaaaaaaaaaccaacgccattgctcagctaacggccacgcttcaacctggtgatgccccggcatactttccagcatagagcgcggaataagcgcaatngcctgctctgcgatcacacaggccaacattccgtgataagactccatctcatggatagttcccnngagcgcaccgtcagcatgaaaccagctctcgaagtgcgacgatccgacaattngcgccgnaggccataaatgtacttgcataacctgactggcacggnttactggcccatatccttgggcgtgaccatcataanttccttccgtattacccgtattccctcgatgg

SEQ ID NO: 371562 - DNA, 8885 bp, Homo sapiens
  misc_feature (8654)..(8654): n is a, c, g, or t
  misc_feature (8718)..(8719): n is a, c, g, or t
  misc_feature (8772)..(8772): n is a, c, g, or t
  misc_feature (8779)..(8779): n is a, c, g, or t
  misc_feature (8817)..(8817): n is a, c, g, or t
  misc_feature (8853)..(8853): n is a, c, g, or t
ctgaactagttgccagtgatcttgaaacgtgacagtaaccaagagataaataggtgacaatgacaggaaaattagatgtagtaaaagagagtgtttgagagcagaagctatggcaactaaagactggatttgaatccttcctagcttggtgacatgagcaaattacttgatttaagtgagcattttcccatctgtacagtggagataacgataattgtgcctgctaagaagaattgctgtgaagattagtgaaataatgcatgtaaaacatttggtacagtatgtgacacatagtacaaatagtttgctaggaagattgttattattcttcacttgtgatattgtgaagttttcatacagcaaattggacatcatgagatggattgattaaataaatagatttgaacttcaaggactggtagtgttcttgctttggaaagaagaaacttggtttatcctaataatagtaggataataatggtgaagtgataggtacaagtaatagtgtttatgatgcgctggtgatgataggaaaagaaagccattatatgggcaagagctagaagtaataaaatggtgcatttttcagtgatgtttggcctatgtagctattctctgataactataaaaatccttattattgaagattcttcaggaaaaaaaaacccttagtctgaaactttagcaccaatcccccttgccccccattgaaatacgtatttttaaaacatggcttttgataatgtgagggttttttcctttttgcgatttagcagtgctgattgtgtattgcagtagttgtgagagcattagaagcagcagtcgataggaggatggaaggtctggatgccgccttggggagttaggagattggcagacttaccctgtaccactctagccctactcctttgcccaagacagaaacacactgagatggataggagaatatgagcagttgataggaaagttctcagtggagtcaggatttaggttaggccaggagattgagaatataacagtttgtgtatgatgaaatggcatatttcacagaatgcagtaaaagcaggtagggtacaagtgcagcaacaggaagatgtcttttcttcattcagcaaacacttatttgagagcttaccatgtgctaggcacatacaaagataaataagatgcccttgatgatcctctatttaaaggagacatgtacaattcacgtgcttctgagataaatttgaagaaactacaacatcttgagttgatggaagatattgtggatttggcaaagaaagttgctaatgattcattccttattggaggcttattgagaattggttgtaaaatagaaaataaaatcttggcaatggaagaagctctgaattggataaaatatgcaggcgatgtaacaattctaactaaattaggatcaattgacaattgttggcctatgttaagtattttctttactgaatacaagtaccacataactaaaattgtaatggaagactgcaatttgcttgaagaacttaaaactcaaagttgtatggattgtatagaggaaggagaactaatgaaaatgaaaggaaatgaagagttttccaaagaaagatttgatatagctattatctattacaccagagccattgaatatagacctgaaaactaccttctttatggtaaccgagctctttgttttcttcgtactggacagtttagaaatgcactcggtgatggaaagagagccactattctgaagaacacttggccaaagggtcattatcgttattgtgatgctctttctatgctgggggaatatgactgggccctgcaagcaaacataaaagctcaaaaactctgtaaaaatgaccctgagggaatcaaggatctaattcagcagcatgtaaagttacaaaaacaaatagaagacctacaaggtcgaacagcaaataaggatccaattaaagccttttatgaaaacagggcctacacacctaggagtttatcagcacctatatttactacttcacttaactttgtggagaaggaaagagatttcagaaaaattaatcacgaaatggccaacggtggtaatcagaatctaaaggtggcggatgaggcgttgaaggtagatgattgtgactgtcatcctgaattttcaccaccatcaagtcagcctccaaaacataaaggaaaacaaaaatctcgaaacaatgaatcagaaaagttcagttctagttcaccattgactttaccagcagatttgaagaacatcttggagaaacagttttctaaatcttccagagctgcacaccaggattttgctaatataatgaaaatgctgagaagcttaattcaagatggctatatggccttattggagcagcgttgccgcagcgctgcacaggcctttacagagttgctgaacggtttagatcctcaaaaaataaagcaattgaacctggccatgattaactatgttttggtcgtctatggacttgccatttctctccttggaataggacagcctgaggaattatctgaagccgaaaaccagtttaagaggattattgaacactaccccagtgagggccttgattgcttggcctactgtggaattggaaaagtgtatttgaaaaaaaacagatttctagaagctctcaatcactttgagaaagcaagaaccttgatttatcgtcttcctggagtgttaacttggcccacgagtaatgtgattattgaagagtctcagccacaaaaaataaagatgctgttagagaaatttgttgaagaatgcaagttccctccagtgccagatgccatttgttgctatcagaagtgccatggatattctaagatccagatatacataactgatccagactttaagggttttatacgcatcagctgttgccagtactgtaaaatagaatttcacatgaattgctggaagaagttaaaaactacaacctttaatgataaaattgacaaggattttctacaaggaatatgtcttacccctgactgtgaaggtgtcatttctaagattatcatcttcagcagtggtggtgaagttaaatgtgaatttgaacacaaggtcataaaagaaaaggttcctccaagacctattctgaaacagaaatgttctagcctagagaaactaagactgaaagaagacaaaaaattgaagagaaagatccaaaaaaaagaagcaaaaaagttagcacaagaaagaatggaggaggacttaagagaaagtaatccacccaaaaatgaagagcagaaagaaactgtagacaatgttcagcgttgtcagttccttgatgacagaattctacagtgtataaagcagtatgctgacaagattaaatccggcatacagaatacagccatgcttctcaaagaattgctttcttggaaagttttgagcacagaagactatacaacctgtttttctagcagaaattttctaaatgaagcagtggactatgttattcgccacttgattcaagaaaataacagagtaaagacaagaatatttctgcatgttttgagtgagcttaaagaagtggagcccaaattagccgcctggatccaaaaacttaatagctttggcttagatgccacaggaactttcttttctcgttatggagcatctcttaaactgcttgattttagtatcatgactttcctctggaatgagaaatatggtcacaaactagactctatagaaggaaagcaacttgattatttctctgagccagcatcattgaaggaagcccgttgtttaatatggctgctagaagaacacagagacaagttcccagcattgcatagtgctttagatgaattctttgatataatggatattttcacagcatcatgggaaagattgcatgttacactgacagaatctattaacagccgctgtactgtgttaaggaaacaagatagtggtgaagcaccgtttagttcaaccaaggtgaaaaacaaaagcaagaaaaagaagccaaaggattcaaagcctatgttagttgggtctggaacaacttcagtaacttcaaataatgagatcatcacttcaagtgaagaccatagcaatcgaaattcagattctgcaggcccatttgcagtgcctgaccatcttcggcaagatgtagaagaattcgaagctctctatgaccaacacagtaacgaatatgttgtccgcaataagaagctatgggacatgaacccaaaacaaaaatgttcaactctatatgattacttctctcagtttttggaggaacatggtcccttggacatgagtaacaagatgttctctgcagaatatgagtttttcccagaagaaactcgacagatactagaaaaagcaggaggtttaaaaccttttctcttgggatgccctcgttttgttgtgattgacaactgtattgcactgaagaaggttgcatcacggctcaagaaaaaaaggaagaagaaaaacattaaaacaaaagtagaagaaatttcaaaagcaggggagtatgtacgagttaaactacaactgaatccagctgctagggaatttaaaccagatgtaaagtctaaaccagtgtcagattcatcttcagcaccagcttttgaaaatgtgaaacccaaacctgtgtctgcaaattctcccaagccagcttgtgaagatgtgaaggccaaaccagtatccgacaattcttctagacaagtttctgaggatgggcaacccaaaggggtctcttctaattctcctaaaccaggctctgaggatgcaaattacaagcgagtctcctgtaattcccccaaaccggttcttgaggatgtgaaaccaacttattgggctcaatcccatttggtcacaggatactgtacgtatcttcctttccagagatttgatatcacccagacaccgccagcatacataaacgtgttaccaggtttgccccagtacaccagcatatatacacccttggccagcctttctcctgaatatcagctaccaagatcagtaccagtggtgccgtcttttgtagccaatgacagagcagataaaaatgctgctgcctattttgagggtcatcatttgaatgctgagaatgttgctggtcaccagattgcctctgaaacacagatccttgagggctctttgggaatatctgtaaagtcacactgcagcacaggtgatgctcatacagtcctgagtgagtctaacagaaatgatgagcactgtggaaattctaacaacaaatgtgaagtaattccagaaagcaccagtgcagtaacaaacattccacacgtgcagatggttgccatacaggtatcttggaacataatacaccaagaagtcaatactgagccatataatccttttgaggaacgacaaggggaaatttcacggattgaaaaggagcaccaagtattacaagaccaacttcaagaagtgtatgaaaattatgagcagataaaacttaagggcttagaagagaccagggacctggaagagaagttgaaaaggcacttagaagaaaacaagatctcaaagacggaattagattggttccttcaagatttggaaagagaaattaaaaaatggcaacaggaaaaaaaagaaatccaagaaagactaaaatcactgaagaagaaaattaaaaaggtttcaaatgccagtgaaatgtatacccagaaaaatgatggaaaggaaaaggaacatgaattacatctggatcagtcccttgaaatcagcaacacacttacaaatgagaaaatgaaaatagaagagtatataaagaaagggaaagaggattatgaagagagtcatcagagagctgtggctgcagaggtatccgtacttgaaaactggaaggagagtgaagtgtataagctacagatcatggagtcacaagcagaagcctttctgaagaagctggggctgattagccgtgatcctgcagcatatcctgacatggagtctgatatacgttcatgggaattgtttctttctaatgttacaaaagaaattgagaaagcaaagtctcagtttgaagaacaaattaaggcaattaaaaatggttctcggctcagtgaactttctaaagtgcagatttctgagctttcatttcctgcctgtaacacggttcatcccgagttactccctgagtcttcaggccacgatggccaagggcttgtgacttctgcaagcgacgtgactggaaaccacgcagcacttcacagggatcctagtgtgttctctgctggtgattccccaggggaggctccttctgcgctgttgccagggccaccccctggtcagcctgaagccactcagctgacagggccaaaacgggctggccaggcagctctgtcagaacgaagccctgtggctgatcggaagcagcctgttcctccaggacgtgctgcgcgttcaagccagtctccaaaaaagccgttcaatagtattattgagcacctgtcagtggtattcccatgttacaacagcactgagcttgctggttttattaaaaaagtgcgaagcaaaaacaagaactcactctcaggattgagtattgatgaaattgtccaaagagtgacagaacacattctagatgaacagaaaaagaaaaagccaaacccaggaaaggacaagaggacttatgagcccagctctgccacccccgtgaccaggtcctcccagggctcaccctcggtggttgttgcaccatcacccaaaaccaaggggcagaaagcagaagatgtccctgtgaggattgcactgggtgcaagttcctgtgaaatatgccacgaggtgttcaaatcaaaaaacgtgcgtgtgctcaaatgtgggcacaagtatcacaaagggtgctttaagcagtggcttaaagggcagagcgcttgcccggcctgccagggtcgtgatctcctgacagaagagtcaccttctggaagaggctggcccagtcagaatcaggagctgccttcctgctcttctaggtagtcacacttcactaaagtgtcatccaccagtgtgttgaatccgaagaatgacaattttctaccactggtgtaaaaaacaaacatttgaagacccttgtgcattgtgtgtcacaaagctaaatacatggaaatcgttaatatcgctgatattaagtaatttccccactctgagtgaatactttgatgattgccaacagtggctaataaaatgacggctaccacactcatgggtcactggggctgcgcagggctctttgaggtgggtggcttcttttggaaagtactatgaacgtctcgaagcagtattctagtgataagaattcttaacatagccaagcgccccacgtttgttccccacgtttgttccccttttctgtttgaaaaacctgttctggtagctccacaagagagatgatactgactttttaaattttttacaagagtctgtattcctgatatgcctatatttttcctcaaagattctgcattttaaggatgggcataagcaaactatattttaataatttatagttaatgttaaaatattggctgatttagaccaaaagattcaaatctcctctttgtgaaatcccatctgcatttgattttttattattttatgttcccccgttagattgttttaagtgtttgcttttcatcttttatagatgtaatctgattttcaaaaatcattaacactttttaattagtatcgactaagactttttccccctggaatcgaggctgtgtgtccgtcatcccagcccccggttggagcctgctctttgaactccgctgccttccttagcagcttctgtcctcttctgtgagtcagtcagcgagtgcttgggatccgcatccagccgtgctgagcacacaacaggctgtgtgtggaaatggccaccaccattctccttccccaccccaccacaaaaagagaagctgtgtctttagacaaccctgaggtatctgtgttacaatcgttctgtgtttgatatttgtgtaaagtatgcatgcagtcttgtactgtgacctaagaacaaaactgtaactgcattagaaaccatgaaaaaattagatattgttttgtgacttttagacagtggtaaatatagaaccatgaattctggtcacattccatttctctccaacatgaaggatcaaaaaatgtttttcaatgtgttctttgttccactggaaacttagagtcatgagtttatgagctgatttggtcaccttcctctgcctttgttcactgtgagttctgatgtcttagtgacttagttcttagaagctcacgccttagtttgaaacagattctccacggtggtccccaaaacactgtctgcatatccataagaattgagcgctatgggtgttaacgtgcatgaggatcagtttgcagcagcaagtacaaaaggagaagaggaacatccgttgaatgagtgtgttttgtacataacttcagatacttgtgaacatgccttatatttgtccaacaactgtcagaataaagaacattctaaaatgagaaaaaaaaaaaaaaaaaaaaaaaaaaaaaaaaaaaaaaccaacgccattgctcagctaacggccacgcttcaacctggtgatgccccggcatactttccagcatagagcgcggaataagcgcaatngcctgctctgcgatcacacaggccaacattccgtgataagactccatctcatggatagttcccnngagcgcaccgtcagcatgaaaccagctctcgaagtgcgacgatccgacaattngcgccgnaggccataaatgtacttgcataacctgactggcacggnttactggcccatatccttgggcgtgaccatcataanttccttccgtattacccgtattccctcgatgg

SEQ ID NO: 371563 - DNA, 7248 bp, Homo sapiens
  misc_feature (7017)..(7017): n is a, c, g, or t
  misc_feature (7081)..(7082): n is a, c, g, or t
  misc_feature (7135)..(7135): n is a, c, g, or t
  misc_feature (7142)..(7142): n is a, c, g, or t
  misc_feature (7180)..(7180): n is a, c, g, or t
  misc_feature (7216)..(7216): n is a, c, g, or t
cttcaacgccgccacccgctccctcccgccgtcggctgacgtggagggccggaggtggcggcggcggcggcggcggctgctgctgctgctgctgcccgcgtccgaggctcgcgggcggcgggcccggaaatgcactcggtgatggaaagagagccactattctgaagaacacttggccaaagggtcattatcgttattgtgatgctctttctatgctgggggaatatgactgggccctgcaagcaaacataaaagctcaaaaactctgtaaaaatgaccctgagggaatcaaggatctaattcagcagcatgtaaagttacaaaaacaaatagaagacctacaaggtcgaacagcaaataaggatccaattaaagccttttatgaaaacagggcctacacacctaggagtttatcagcacctatatttactacttcacttaactttgtggagaaggaaagagatttcagaaaaattaatcacgaaatggccaacggtggtaatcagaatctaaaggtggcggatgaggcgttgaaggtagatgattgtgactgtcatcctgaattttcaccaccatcaagtcagcctccaaaacataaaggaaaacaaaaatctcgaaacaatgaatcagaaaagttcagttctagttcaccattgactttaccagcagatttgaagaacatcttggagaaacagttttctaaatcttccagagctgcacaccaggattttgctaatataatgaaaatgctgagaagcttaattcaagatggctatatggccttattggagcagcgttgccgcagcgctgcacaggcctttacagagttgctgaacggtttagatcctcaaaaaataaagcaattgaacctggccatgattaactatgttttggtcgtctatggacttgccatttctctccttggaataggacagcctgaggaattatctgaagccgaaaaccagtttaagaggattattgaacactaccccagtgagggccttgattgcttggcctactgtggaattggaaaagtgtatttgaaaaaaaacagatttctagaagctctcaatcactttgagaaagcaagaaccttgatttatcgtcttcctggagtgttaacttggcccacgagtaatgtgattattgaagagtctcagccacaaaaaataaagatgctgttagagaaatttgttgaagaatgcaagttccctccagtgccagatgccatttgttgctatcagaagtgccatggatattctaagatccagatatacataactgatccagactttaagggttttatacgcatcagctgttgccagtactgtaaaatagaatttcacatgaattgctggaagaagttaaaaactacaacctttaatgataaaattgacaaggattttctacaaggaatatgtcttacccctgactgtgaaggtgtcatttctaagattatcatcttcagcagtggtggtgaagttaaatgtgaatttgaacacaaggtcataaaagaaaaggttcctccaagacctattctgaaacagaaatgttctagcctagagaaactaagactgaaagaagacaaaaaattgaagagaaagatccaaaaaaaagaagcaaaaaagttagcacaagaaagaatggaggaggacttaagagaaagtaatccacccaaaaatgaagagcagaaagaaactgtagacaatgttcagcgttgtcagttccttgatgacagaattctacagtgtataaagcagtatgctgacaagattaaatccggcatacagaatacagccatgcttctcaaagaattgctttcttggaaagttttgagcacagaagactatacaacctgtttttctagcagaaattttctaaatgaagcagtggactatgttattcgccacttgattcaagaaaataacagagtaaagacaagaatatttctgcatgttttgagtgagcttaaagaagtggagcccaaattagccgcctggatccaaaaacttaatagctttggcttagatgccacaggaactttcttttctcgttatggagcatctcttaaactgcttgattttagtatcatgactttcctctggaatgagaaatatggtcacaaactagactctatagaaggaaagcaacttgattatttctctgagccagcatcattgaaggaagcccgttgtttaatatggctgctagaagaacacagagacaagttcccagcattgcatagtgctttagatgaattctttgatataatggacagccgctgtactgtgttaaggaaacaagatagtggtgaagcaccgtttagttcaaccaaggtgaaaaacaaaagcaagaaaaagaagccaaaggattcaaagcctatgttagttgggtctggaacaacttcagtaacttcaaataatgagatcatcacttcaagtgaagaccatagcaatcgaaattcagattctgcaggcccatttgcagtgcctgaccatcttcggcaagatgtagaagaattcgaagctctctatgaccaacacagtaacgaatatgttgtccgcaataagaagctatgggacatgaacccaaaacaaaaatgttcaactctatatgattacttctctcagtttttggaggaacatggtcccttggacatgagtaacaagatgttctctgcagaatatgagtttttcccagaagaaactcgacagatactagaaaaagcaggaggtttaaaaccttttctcttgggatgccctcgttttgttgtgattgacaactgtattgcactgaagaaggttgcatcacggctcaagaaaaaaaggaagaagaaaaacattaaaacaaaagtagaagaaatttcaaaagcaggggagtatgtacgagttaaactacaactgaatccagctgctagggaatttaaaccagatgtaaagtctaaaccagtgtcagattcatcttcagcaccagcttttgaaaatgtgaaacccaaacctgtgtctgcaaattctcccaagccagcttgtgaagatgtgaaggccaaaccagtatccgacaattcttctagacaagtttctgaggatgggcaacccaaaggggtctcttctaattctcctaaaccaggctctgaggatgcaaattacaagcgagtctcctgtaattcccccaaaccggttcttgaggatgtgaaaccaacttattgggctcaatcccatttggtcacaggatactgtacgtatcttcctttccagagatttgatatcacccagacaccgccagcatacataaacgtgttaccaggtttgccccagtacaccagcatatatacacccttggccagcctttctcctgaatatcagctaccaagatcagtaccagtggtgccgtcttttgtagccaatgacagagcagataaaaatgctgctgcctattttgagggtcatcatttgaatgctgagaatgttgctggtcaccagattgcctctgaaacacagatccttgagggctctttgggaatatctgtaaagtcacactgcagcacaggtgatgctcatacagtcctgagtgagtctaacagaaatgatgagcactgtggaaattctaacaacaaatgtgaagtaattccagaaagcaccagtgcagtaacaaacattccacacgtgcagatggttgccatacaggtatcttggaacataatacaccaagaagtcaatactgagccatataatccttttgaggaacgacaaggggaaatttcacggattgaaaaggagcaccaagtattacaagaccaacttcaagaagtgtatgaaaattatgagcagataaaacttaagggcttagaagagaccagggacctggaagagaagttgaaaaggcacttagaagaaaacaagatctcaaagacggaattagattggttccttcaagatttggaaagagaaattaaaaaatggcaacaggaaaaaaaagaaatccaagaaagactaaaatcactgaagaagaaaattaaaaaggtttcaaatgccagtgaaatgtatacccagaaaaatgatggaaaggaaaaggaacatgaattacatctggatcagtcccttgaaatcagcaacacacttacaaatgagaaaatgaaaatagaagagtatataaagaaagggaaagaggattatgaagagagtcatcagagagctgtggctgcagaggtatccgtacttgaaaactggaaggagagtgaagtgtataagctacagatcatggagtcacaagcagaagcctttctgaagaagctggggctgattagccgtgatcctgcagcatatcctgacatggagtctgatatacgttcatgggaattgtttctttctaatgttacaaaagaaattgagaaagcaaagtctcagtttgaagaacaaattaaggcaattaaaaatggttctcggctcagtgaactttctaaagtgcagatttctgagctttcatttcctgcctgtaacacggttcatcccgagttactccctgagtcttcaggccacgatggccaagggcttgtgacttctgcaagcgacgtgactggaaaccacgcagcacttcacagggatcctagtgtgttctctgctggtgattccccaggggaggctccttctgcgctgttgccagggccaccccctggtcagcctgaagccactcagctgacagggccaaaacgggctggccaggcagctctgtcagaacgaagccctgtggctgatcggaagcagcctgttcctccaggacgtgctgcgcgttcaagccagtctccaaaaaagccgttcaatagtattattgagcacctgtcagtggtattcccatgttacaacagcactgagcttgctggttttattaaaaaagtgcgaagcaaaaacaagaactcactctcaggattgagtattgatgaaattgtccaaagagtgacagaacacattctagatgaacagaaaaagaaaaagccaaacccaggaaaggacaagaggacttatgagcccagctctgccacccccgtgaccaggtcctcccagggctcaccctcggtggttgttgcaccatcacccaaaaccaaggggcagaaagcagaagatgtccctgtgaggattgcactgggtgcaagttcctgtgaaatatgccacgaggtgttcaaatcaaaaaacgtgcgtgtgctcaaatgtgggcacaagtatcacaaagggtgctttaagcagtggcttaaagggcagagcgcttgcccggcctgccagggtcgtgatctcctgacagaagagtcaccttctggaagaggctggcccagtcagaatcaggagctgccttcctgctcttctaggtagtcacacttcactaaagtgtcatccaccagtgtgttgaatccgaagaatgacaattttctaccactggtgtaaaaaacaaacatttgaagacccttgtgcattgtgtgtcacaaagctaaatacatggaaatcgttaatatcgctgatattaagtaatttccccactctgagtgaatactttgatgattgccaacagtggctaataaaatgacggctaccacactcatgggtcactggggctgcgcagggctctttgaggtgggtggcttcttttggaaagtactatgaacgtctcgaagcagtattctagtgataagaattcttaacatagccaagcgccccacgtttgttccccacgtttgttccccttttctgtttgaaaaacctgttctggtagctccacaagagagatgatactgactttttaaattttttacaagagtctgtattcctgatatgcctatatttttcctcaaagattctgcattttaaggatgggcataagcaaactatattttaataatttatagttaatgttaaaatattggctgatttagaccaaaagattcaaatctcctctttgtgaaatcccatctgcatttgattttttattattttatgttcccccgttagattgttttaagtgtttgcttttcatcttttatagatgtaatctgattttcaaaaatcattaacactttttaattagtatcgactaagactttttccccctggaatcgaggctgtgtgtccgtcatcccagcccccggttggagcctgctctttgaactccgctgccttccttagcagcttctgtcctcttctgtgagtcagtcagcgagtgcttgggatccgcatccagccgtgctgagcacacaacaggctgtgtgtggaaatggccaccaccattctccttccccaccccaccacaaaaagagaagctgtgtctttagacaaccctgaggtatctgtgttacaatcgttctgtgtttgatatttgtgtaaagtatgcatgcagtcttgtactgtgacctaagaacaaaactgtaactgcattagaaaccatgaaaaaattagatattgttttgtgacttttagacagtggtaaatatagaaccatgaattctggtcacattccatttctctccaacatgaaggatcaaaaaatgtttttcaatgtgttctttgttccactggaaacttagagtcatgagtttatgagctgatttggtcaccttcctctgcctttgttcactgtgagttctgatgtcttagtgacttagttcttagaagctcacgccttagtttgaaacagattctccacggtggtccccaaaacactgtctgcatatccataagaattgagcgctatgggtgttaacgtgcatgaggatcagtttgcagcagcaagtacaaaaggagaagaggaacatccgttgaatgagtgtgttttgtacataacttcagatacttgtgaacatgccttatatttgtccaacaactgtcagaataaagaacattctaaaatgagaaaaaaaaaaaaaaaaaaaaaaaaaaaaaaaaaaaaaaccaacgccattgctcagctaacggccacgcttcaacctggtgatgccccggcatactttccagcatagagcgcggaataagcgcaatngcctgctctgcgatcacacaggccaacattccgtgataagactccatctcatggatagttcccnngagcgcaccgtcagcatgaaaccagctctcgaagtgcgacgatccgacaattngcgccgnaggccataaatgtacttgcataacctgactggcacggnttactggcccatatccttgggcgtgaccatcataanttccttccgtattacccgtattccctcgatgg

SEQ ID NO: 371564 - DNA, 7354 bp, Homo sapiens
  misc_feature (7123)..(7123): n is a, c, g, or t
  misc_feature (7187)..(7188): n is a, c, g, or t
  misc_feature (7241)..(7241): n is a, c, g, or t
  misc_feature (7248)..(7248): n is a, c, g, or t
  misc_feature (7286)..(7286): n is a, c, g, or t
  misc_feature (7322)..(7322): n is a, c, g, or t
cttcaacgccgccacccgctccctcccgccgtcggctgacgtggagggccggaggtggcggcggcggcggcggcggctgctgctgctgctgctgcccgcgtccgaggctcgcgggcggcgggcccggaaatgcactcggtgatggaaagagagccactattctgaagaacacttggccaaagccaggagctgcacttagagataacaatgaaaagctgagtgaaggggagacggctggatggaagatctagcctgagcacatcccccatctgtctgcactcttcggagggtcattatcgttattgtgatgctctttctatgctgggggaatatgactgggccctgcaagcaaacataaaagctcaaaaactctgtaaaaatgaccctgagggaatcaaggatctaattcagcagcatgtaaagttacaaaaacaaatagaagacctacaaggtcgaacagcaaataaggatccaattaaagccttttatgaaaacagggcctacacacctaggagtttatcagcacctatatttactacttcacttaactttgtggagaaggaaagagatttcagaaaaattaatcacgaaatggccaacggtggtaatcagaatctaaaggtggcggatgaggcgttgaaggtagatgattgtgactgtcatcctgaattttcaccaccatcaagtcagcctccaaaacataaaggaaaacaaaaatctcgaaacaatgaatcagaaaagttcagttctagttcaccattgactttaccagcagatttgaagaacatcttggagaaacagttttctaaatcttccagagctgcacaccaggattttgctaatataatgaaaatgctgagaagcttaattcaagatggctatatggccttattggagcagcgttgccgcagcgctgcacaggcctttacagagttgctgaacggtttagatcctcaaaaaataaagcaattgaacctggccatgattaactatgttttggtcgtctatggacttgccatttctctccttggaataggacagcctgaggaattatctgaagccgaaaaccagtttaagaggattattgaacactaccccagtgagggccttgattgcttggcctactgtggaattggaaaagtgtatttgaaaaaaaacagatttctagaagctctcaatcactttgagaaagcaagaaccttgatttatcgtcttcctggagtgttaacttggcccacgagtaatgtgattattgaagagtctcagccacaaaaaataaagatgctgttagagaaatttgttgaagaatgcaagttccctccagtgccagatgccatttgttgctatcagaagtgccatggatattctaagatccagatatacataactgatccagactttaagggttttatacgcatcagctgttgccagtactgtaaaatagaatttcacatgaattgctggaagaagttaaaaactacaacctttaatgataaaattgacaaggattttctacaaggaatatgtcttacccctgactgtgaaggtgtcatttctaagattatcatcttcagcagtggtggtgaagttaaatgtgaatttgaacacaaggtcataaaagaaaaggttcctccaagacctattctgaaacagaaatgttctagcctagagaaactaagactgaaagaagacaaaaaattgaagagaaagatccaaaaaaaagaagcaaaaaagttagcacaagaaagaatggaggaggacttaagagaaagtaatccacccaaaaatgaagagcagaaagaaactgtagacaatgttcagcgttgtcagttccttgatgacagaattctacagtgtataaagcagtatgctgacaagattaaatccggcatacagaatacagccatgcttctcaaagaattgctttcttggaaagttttgagcacagaagactatacaacctgtttttctagcagaaattttctaaatgaagcagtggactatgttattcgccacttgattcaagaaaataacagagtaaagacaagaatatttctgcatgttttgagtgagcttaaagaagtggagcccaaattagccgcctggatccaaaaacttaatagctttggcttagatgccacaggaactttcttttctcgttatggagcatctcttaaactgcttgattttagtatcatgactttcctctggaatgagaaatatggtcacaaactagactctatagaaggaaagcaacttgattatttctctgagccagcatcattgaaggaagcccgttgtttaatatggctgctagaagaacacagagacaagttcccagcattgcatagtgctttagatgaattctttgatataatggacagccgctgtactgtgttaaggaaacaagatagtggtgaagcaccgtttagttcaaccaaggtgaaaaacaaaagcaagaaaaagaagccaaaggattcaaagcctatgttagttgggtctggaacaacttcagtaacttcaaataatgagatcatcacttcaagtgaagaccatagcaatcgaaattcagattctgcaggcccatttgcagtgcctgaccatcttcggcaagatgtagaagaattcgaagctctctatgaccaacacagtaacgaatatgttgtccgcaataagaagctatgggacatgaacccaaaacaaaaatgttcaactctatatgattacttctctcagtttttggaggaacatggtcccttggacatgagtaacaagatgttctctgcagaatatgagtttttcccagaagaaactcgacagatactagaaaaagcaggaggtttaaaaccttttctcttgggatgccctcgttttgttgtgattgacaactgtattgcactgaagaaggttgcatcacggctcaagaaaaaaaggaagaagaaaaacattaaaacaaaagtagaagaaatttcaaaagcaggggagtatgtacgagttaaactacaactgaatccagctgctagggaatttaaaccagatgtaaagtctaaaccagtgtcagattcatcttcagcaccagcttttgaaaatgtgaaacccaaacctgtgtctgcaaattctcccaagccagcttgtgaagatgtgaaggccaaaccagtatccgacaattcttctagacaagtttctgaggatgggcaacccaaaggggtctcttctaattctcctaaaccaggctctgaggatgcaaattacaagcgagtctcctgtaattcccccaaaccggttcttgaggatgtgaaaccaacttattgggctcaatcccatttggtcacaggatactgtacgtatcttcctttccagagatttgatatcacccagacaccgccagcatacataaacgtgttaccaggtttgccccagtacaccagcatatatacacccttggccagcctttctcctgaatatcagctaccaagatcagtaccagtggtgccgtcttttgtagccaatgacagagcagataaaaatgctgctgcctattttgagggtcatcatttgaatgctgagaatgttgctggtcaccagattgcctctgaaacacagatccttgagggctctttgggaatatctgtaaagtcacactgcagcacaggtgatgctcatacagtcctgagtgagtctaacagaaatgatgagcactgtggaaattctaacaacaaatgtgaagtaattccagaaagcaccagtgcagtaacaaacattccacacgtgcagatggttgccatacaggtatcttggaacataatacaccaagaagtcaatactgagccatataatccttttgaggaacgacaaggggaaatttcacggattgaaaaggagcaccaagtattacaagaccaacttcaagaagtgtatgaaaattatgagcagataaaacttaagggcttagaagagaccagggacctggaagagaagttgaaaaggcacttagaagaaaacaagatctcaaagacggaattagattggttccttcaagatttggaaagagaaattaaaaaatggcaacaggaaaaaaaagaaatccaagaaagactaaaatcactgaagaagaaaattaaaaaggtttcaaatgccagtgaaatgtatacccagaaaaatgatggaaaggaaaaggaacatgaattacatctggatcagtcccttgaaatcagcaacacacttacaaatgagaaaatgaaaatagaagagtatataaagaaagggaaagaggattatgaagagagtcatcagagagctgtggctgcagaggtatccgtacttgaaaactggaaggagagtgaagtgtataagctacagatcatggagtcacaagcagaagcctttctgaagaagctggggctgattagccgtgatcctgcagcatatcctgacatggagtctgatatacgttcatgggaattgtttctttctaatgttacaaaagaaattgagaaagcaaagtctcagtttgaagaacaaattaaggcaattaaaaatggttctcggctcagtgaactttctaaagtgcagatttctgagctttcatttcctgcctgtaacacggttcatcccgagttactccctgagtcttcaggccacgatggccaagggcttgtgacttctgcaagcgacgtgactggaaaccacgcagcacttcacagggatcctagtgtgttctctgctggtgattccccaggggaggctccttctgcgctgttgccagggccaccccctggtcagcctgaagccactcagctgacagggccaaaacgggctggccaggcagctctgtcagaacgaagccctgtggctgatcggaagcagcctgttcctccaggacgtgctgcgcgttcaagccagtctccaaaaaagccgttcaatagtattattgagcacctgtcagtggtattcccatgttacaacagcactgagcttgctggttttattaaaaaagtgcgaagcaaaaacaagaactcactctcaggattgagtattgatgaaattgtccaaagagtgacagaacacattctagatgaacagaaaaagaaaaagccaaacccaggaaaggacaagaggacttatgagcccagctctgccacccccgtgaccaggtcctcccagggctcaccctcggtggttgttgcaccatcacccaaaaccaaggggcagaaagcagaagatgtccctgtgaggattgcactgggtgcaagttcctgtgaaatatgccacgaggtgttcaaatcaaaaaacgtgcgtgtgctcaaatgtgggcacaagtatcacaaagggtgctttaagcagtggcttaaagggcagagcgcttgcccggcctgccagggtcgtgatctcctgacagaagagtcaccttctggaagaggctggcccagtcagaatcaggagctgccttcctgctcttctaggtagtcacacttcactaaagtgtcatccaccagtgtgttgaatccgaagaatgacaattttctaccactggtgtaaaaaacaaacatttgaagacccttgtgcattgtgtgtcacaaagctaaatacatggaaatcgttaatatcgctgatattaagtaatttccccactctgagtgaatactttgatgattgccaacagtggctaataaaatgacggctaccacactcatgggtcactggggctgcgcagggctctttgaggtgggtggcttcttttggaaagtactatgaacgtctcgaagcagtattctagtgataagaattcttaacatagccaagcgccccacgtttgttccccacgtttgttccccttttctgtttgaaaaacctgttctggtagctccacaagagagatgatactgactttttaaattttttacaagagtctgtattcctgatatgcctatatttttcctcaaagattctgcattttaaggatgggcataagcaaactatattttaataatttatagttaatgttaaaatattggctgatttagaccaaaagattcaaatctcctctttgtgaaatcccatctgcatttgattttttattattttatgttcccccgttagattgttttaagtgtttgcttttcatcttttatagatgtaatctgattttcaaaaatcattaacactttttaattagtatcgactaagactttttccccctggaatcgaggctgtgtgtccgtcatcccagcccccggttggagcctgctctttgaactccgctgccttccttagcagcttctgtcctcttctgtgagtcagtcagcgagtgcttgggatccgcatccagccgtgctgagcacacaacaggctgtgtgtggaaatggccaccaccattctccttccccaccccaccacaaaaagagaagctgtgtctttagacaaccctgaggtatctgtgttacaatcgttctgtgtttgatatttgtgtaaagtatgcatgcagtcttgtactgtgacctaagaacaaaactgtaactgcattagaaaccatgaaaaaattagatattgttttgtgacttttagacagtggtaaatatagaaccatgaattctggtcacattccatttctctccaacatgaaggatcaaaaaatgtttttcaatgtgttctttgttccactggaaacttagagtcatgagtttatgagctgatttggtcaccttcctctgcctttgttcactgtgagttctgatgtcttagtgacttagttcttagaagctcacgccttagtttgaaacagattctccacggtggtccccaaaacactgtctgcatatccataagaattgagcgctatgggtgttaacgtgcatgaggatcagtttgcagcagcaagtacaaaaggagaagaggaacatccgttgaatgagtgtgttttgtacataacttcagatacttgtgaacatgccttatatttgtccaacaactgtcagaataaagaacattctaaaatgagaaaaaaaaaaaaaaaaaaaaaaaaaaaaaaaaaaaaaaccaacgccattgctcagctaacggccacgcttcaacctggtgatgccccggcatactttccagcatagagcgcggaataagcgcaatngcctgctctgcgatcacacaggccaacattccgtgataagactccatctcatggatagttcccnngagcgcaccgtcagcatgaaaccagctctcgaagtgcgacgatccgacaattngcgccgnaggccataaatgtacttgcataacctgactggcacggnttactggcccatatccttgggcgtgaccatcataanttccttccgtattacccgtattccctcgatgg

SEQ ID NO: 371565 - DNA, 6783 bp, Homo sapiens
  misc_feature (6552)..(6552): n is a, c, g, or t
  misc_feature (6616)..(6617): n is a, c, g, or t
  misc_feature (6670)..(6670): n is a, c, g, or t
  misc_feature (6677)..(6677): n is a, c, g, or t
  misc_feature (6715)..(6715): n is a, c, g, or t
  misc_feature (6751)..(6751): n is a, c, g, or t
tttattcataatagccaaaaactttgaaataatccaaatgaccatccacagtagatacatacattatgatataatcgtgtaatgaaataagccactgtgcctggccctattttttctttatatgagtagaacttttattttaaaatgatttttaaaaatgctttttttcttttagttctagttcaccattgactttaccagcagatttgaagaacatcttggagaaacagttttctaaatcttccagagctgcacaccaggattttgctaatataatgaaaatgctgagaagcttaattcaagatggctatatggccttattggagcagcgttgccgcagcgctgcacaggcctttacagagttgctgaacggtttagatcctcaaaaaataaagcaattgaacctggccatgattaactatgttttggtcgtctatggacttgccatttctctccttggaataggacagcctgaggaattatctgaagccgaaaaccagtttaagaggattattgaacactaccccagtgagggccttgattgcttggcctactgtggaattggaaaagtgtatttgaaaaaaaacagatttctagaagctctcaatcactttgagaaagcaagaaccttgatttatcgtcttcctggagtgttaacttggcccacgagtaatgtgattattgaagagtctcagccacaaaaaataaagatgctgttagagaaatttgttgaagaatgcaagttccctccagtgccagatgccatttgttgctatcagaagtgccatggatattctaagatccagatatacataactgatccagactttaagggttttatacgcatcagctgttgccagtactgtaaaatagaatttcacatgaattgctggaagaagttaaaaactacaacctttaatgataaaattgacaaggattttctacaaggaatatgtcttacccctgactgtgaaggtgtcatttctaagattatcatcttcagcagtggtggtgaagttaaatgtgaatttgaacacaaggtcataaaagaaaaggttcctccaagacctattctgaaacagaaatgttctagcctagagaaactaagactgaaagaagacaaaaaattgaagagaaagatccaaaaaaaagaagcaaaaaagttagcacaagaaagaatggaggaggacttaagagaaagtaatccacccaaaaatgaagagcagaaagaaactgtagacaatgttcagcgttgtcagttccttgatgacagaattctacagtgtataaagcagtatgctgacaagattaaatccggcatacagaatacagccatgcttctcaaagaattgctttcttggaaagttttgagcacagaagactatacaacctgtttttctagcagaaattttctaaatgaagcagtggactatgttattcgccacttgattcaagaaaataacagagtaaagacaagaatatttctgcatgttttgagtgagcttaaagaagtggagcccaaattagccgcctggatccaaaaacttaatagctttggcttagatgccacaggaactttcttttctcgttatggagcatctcttaaactgcttgattttagtatcatgactttcctctggaatgagaaatatggtcacaaactagactctatagaaggaaagcaacttgattatttctctgagccagcatcattgaaggaagcccgttgtttaatatggctgctagaagaacacagagacaagttcccagcattgcatagtgctttagatgaattctttgatataatggacagccgctgtactgtgttaaggaaacaagatagtggtgaagcaccgtttagttcaaccaaggtgaaaaacaaaagcaagaaaaagaagccaaaggattcaaagcctatgttagttgggtctggaacaacttcagtaacttcaaataatgagatcatcacttcaagtgaagaccatagcaatcgaaattcagattctgcaggcccatttgcagtgcctgaccatcttcggcaagatgtagaagaattcgaagctctctatgaccaacacagtaacgaatatgttgtccgcaataagaagctatgggacatgaacccaaaacaaaaatgttcaactctatatgattacttctctcagtttttggaggaacatggtcccttggacatgagtaacaagatgttctctgcagaatatgagtttttcccagaagaaactcgacagatactagaaaaagcaggaggtttaaaaccttttctcttgggatgccctcgttttgttgtgattgacaactgtattgcactgaagaaggttgcatcacggctcaagaaaaaaaggaagaagaaaaacattaaaacaaaagtagaagaaatttcaaaagcaggggagtatgtacgagttaaactacaactgaatccagctgctagggaatttaaaccagatgtaaagtctaaaccagtgtcagattcatcttcagcaccagcttttgaaaatgtgaaacccaaacctgtgtctgcaaattctcccaagccagcttgtgaagatgtgaaggccaaaccagtatccgacaattcttctagacaagtttctgaggatgggcaacccaaaggggtctcttctaattctcctaaaccaggctctgaggatgcaaattacaagcgagtctcctgtaattcccccaaaccggttcttgaggatgtgaaaccaacttattgggctcaatcccatttggtcacaggatactgtacgtatcttcctttccagagatttgatatcacccagacaccgccagcatacataaacgtgttaccaggtttgccccagtacaccagcatatatacacccttggccagcctttctcctgaatatcagctaccaagatcagtaccagtggtgccgtcttttgtagccaatgacagagcagataaaaatgctgctgcctattttgagggtcatcatttgaatgctgagaatgttgctggtcaccagattgcctctgaaacacagatccttgagggctctttgggaatatctgtaaagtcacactgcagcacaggtgatgctcatacagtcctgagtgagtctaacagaaatgatgagcactgtggaaattctaacaacaaatgtgaagtaattccagaaagcaccagtgcagtaacaaacattccacacgtgcagatggttgccatacaggtatcttggaacataatacaccaagaagtcaatactgagccatataatccttttgaggaacgacaaggggaaatttcacggattgaaaaggagcaccaagtattacaagaccaacttcaagaagtgtatgaaaattatgagcagataaaacttaagggcttagaagagaccagggacctggaagagaagttgaaaaggcacttagaagaaaacaagatctcaaagacggaattagattggttccttcaagatttggaaagagaaattaaaaaatggcaacaggaaaaaaaagaaatccaagaaagactaaaatcactgaagaagaaaattaaaaaggtttcaaatgccagtgaaatgtatacccagaaaaatgatggaaaggaaaaggaacatgaattacatctggatcagtcccttgaaatcagcaacacacttacaaatgagaaaatgaaaatagaagagtatataaagaaagggaaagaggattatgaagagagtcatcagagagctgtggctgcagaggtatccgtacttgaaaactggaaggagagtgaagtgtataagctacagatcatggagtcacaagcagaagcctttctgaagaagctggggctgattagccgtgatcctgcagcatatcctgacatggagtctgatatacgttcatgggaattgtttctttctaatgttacaaaagaaattgagaaagcaaagtctcagtttgaagaacaaattaaggcaattaaaaatggttctcggctcagtgaactttctaaagtgcagatttctgagctttcatttcctgcctgtaacacggttcatcccgagttactccctgagtcttcaggccacgatggccaagggcttgtgacttctgcaagcgacgtgactggaaaccacgcagcacttcacagggatcctagtgtgttctctgctggtgattccccaggggaggctccttctgcgctgttgccagggccaccccctggtcagcctgaagccactcagctgacagggccaaaacgggctggccaggcagctctgtcagaacgaagccctgtggctgatcggaagcagcctgttcctccaggacgtgctgcgcgttcaagccagtctccaaaaaagccgttcaatagtattattgagcacctgtcagtggtattcccatgttacaacagcactgagcttgctggttttattaaaaaagtgcgaagcaaaaacaagaactcactctcaggattgagtattgatgaaattgtccaaagagtgacagaacacattctagatgaacagaaaaagaaaaagccaaacccaggaaaggacaagaggacttatgagcccagctctgccacccccgtgaccaggtcctcccagggctcaccctcggtggttgttgcaccatcacccaaaaccaaggggcagaaagcagaagatgtccctgtgaggattgcactgggtgcaagttcctgtgaaatatgccacgaggtgttcaaatcaaaaaacgtgcgtgtgctcaaatgtgggcacaagtatcacaaagggtgctttaagcagtggcttaaagggcagagcgcttgcccggcctgccagggtcgtgatctcctgacagaagagtcaccttctggaagaggctggcccagtcagaatcaggagctgccttcctgctcttctaggtagtcacacttcactaaagtgtcatccaccagtgtgttgaatccgaagaatgacaattttctaccactggtgtaaaaaacaaacatttgaagacccttgtgcattgtgtgtcacaaagctaaatacatggaaatcgttaatatcgctgatattaagtaatttccccactctgagtgaatactttgatgattgccaacagtggctaataaaatgacggctaccacactcatgggtcactggggctgcgcagggctctttgaggtgggtggcttcttttggaaagtactatgaacgtctcgaagcagtattctagtgataagaattcttaacatagccaagcgccccacgtttgttccccacgtttgttccccttttctgtttgaaaaacctgttctggtagctccacaagagagatgatactgactttttaaattttttacaagagtctgtattcctgatatgcctatatttttcctcaaagattctgcattttaaggatgggcataagcaaactatattttaataatttatagttaatgttaaaatattggctgatttagaccaaaagattcaaatctcctctttgtgaaatcccatctgcatttgattttttattattttatgttcccccgttagattgttttaagtgtttgcttttcatcttttatagatgtaatctgattttcaaaaatcattaacactttttaattagtatcgactaagactttttccccctggaatcgaggctgtgtgtccgtcatcccagcccccggttggagcctgctctttgaactccgctgccttccttagcagcttctgtcctcttctgtgagtcagtcagcgagtgcttgggatccgcatccagccgtgctgagcacacaacaggctgtgtgtggaaatggccaccaccattctccttccccaccccaccacaaaaagagaagctgtgtctttagacaaccctgaggtatctgtgttacaatcgttctgtgtttgatatttgtgtaaagtatgcatgcagtcttgtactgtgacctaagaacaaaactgtaactgcattagaaaccatgaaaaaattagatattgttttgtgacttttagacagtggtaaatatagaaccatgaattctggtcacattccatttctctccaacatgaaggatcaaaaaatgtttttcaatgtgttctttgttccactggaaacttagagtcatgagtttatgagctgatttggtcaccttcctctgcctttgttcactgtgagttctgatgtcttagtgacttagttcttagaagctcacgccttagtttgaaacagattctccacggtggtccccaaaacactgtctgcatatccataagaattgagcgctatgggtgttaacgtgcatgaggatcagtttgcagcagcaagtacaaaaggagaagaggaacatccgttgaatgagtgtgttttgtacataacttcagatacttgtgaacatgccttatatttgtccaacaactgtcagaataaagaacattctaaaatgagaaaaaaaaaaaaaaaaaaaaaaaaaaaaaaaaaaaaaaccaacgccattgctcagctaacggccacgcttcaacctggtgatgccccggcatactttccagcatagagcgcggaataagcgcaatngcctgctctgcgatcacacaggccaacattccgtgataagactccatctcatggatagttcccnngagcgcaccgtcagcatgaaaccagctctcgaagtgcgacgatccgacaattngcgccgnaggccataaatgtacttgcataacctgactggcacggnttactggcccatatccttgggcgtgaccatcataanttccttccgtattacccgtattccctcgatgg

SEQ ID NO: 371566 - DNA, 6155 bp, Homo sapiens
  misc_feature (5924)..(5924): n is a, c, g, or t
  misc_feature (5988)..(5989): n is a, c, g, or t
  misc_feature (6042)..(6042): n is a, c, g, or t
  misc_feature (6049)..(6049): n is a, c, g, or t
  misc_feature (6087)..(6087): n is a, c, g, or t
  misc_feature (6123)..(6123): n is a, c, g, or t
tgtgaccaagaaaaagcaaaagaaaagatgaacagaattatttgttggagagaattcattgtaaccagatcaaccaaattatagtgttgtgggttattattgagatgtgaaaattatattttactatgggacctttcttagaaatgagagtttacatgaattattttgcagagtaatttgtactatttctgtttaccctatgaagtaacttagatacatgaaagtgacatctatacaatctgtagactgcatccttagacatcacctaatcattgaggtttttgttttcatgaaacaagtacccttattttgacaatactgacagtttcttacattgaatggaagatgtaggccgggctctgattaaaaaaggaaaacttctaatatattgcttggaagatggtttctacgatagtcaaaggaaaacagttcattgagttgtcactaattgtaaatgtttatcagcctagagaaactaagactgaaagaagacaaaaaattgaagagaaagatccaaaaaaaagaagcaaaaaagttagcacaagaaagaatggaggaggacttaagagaaagtaatccacccaaaaatgaagagcagaaagaaactgtagacaatgttcagcgttgtcagttccttgatgacagaattctacagtgtataaagcagtatgctgacaagattaaatccggcatacagaatacagccatgcttctcaaagaattgctttcttggaaagttttgagcacagaagactatacaacctgtttttctagcagaaattttctaaatgaagcagtggactatgttattcgccacttgattcaagaaaataacagagtaaagacaagaatatttctgcatgttttgagtgagcttaaagaagtggagcccaaattagccgcctggatccaaaaacttaatagctttggcttagatgccacaggaactttcttttctcgttatggagcatctcttaaactgcttgattttagtatcatgactttcctctggaatgagaaatatggtcacaaactagactctatagaaggaaagcaacttgattatttctctgagccagcatcattgaaggaagcccgttgtttaatatggctgctagaagaacacagagacaagttcccagcattgcatagtgctttagatgaattctttgatataatggacagccgctgtactgtgttaaggaaacaagatagtggtgaagcaccgtttagttcaaccaaggtgaaaaacaaaagcaagaaaaagaagccaaaggattcaaagcctatgttagttgggtctggaacaacttcagtaacttcaaataatgagatcatcacttcaagtgaagaccatagcaatcgaaattcagattctgcaggcccatttgcagtgcctgaccatcttcggcaagatgtagaagaattcgaagctctctatgaccaacacagtaacgaatatgttgtccgcaataagaagctatgggacatgaacccaaaacaaaaatgttcaactctatatgattacttctctcagtttttggaggaacatggtcccttggacatgagtaacaagatgttctctgcagaatatgagtttttcccagaagaaactcgacagatactagaaaaagcaggaggtttaaaaccttttctcttgggatgccctcgttttgttgtgattgacaactgtattgcactgaagaaggttgcatcacggctcaagaaaaaaaggaagaagaaaaacattaaaacaaaagtagaagaaatttcaaaagcaggggagtatgtacgagttaaactacaactgaatccagctgctagggaatttaaaccagatgtaaagtctaaaccagtgtcagattcatcttcagcaccagcttttgaaaatgtgaaacccaaacctgtgtctgcaaattctcccaagccagcttgtgaagatgtgaaggccaaaccagtatccgacaattcttctagacaagtttctgaggatgggcaacccaaaggggtctcttctaattctcctaaaccaggctctgaggatgcaaattacaagcgagtctcctgtaattcccccaaaccggttcttgaggatgtgaaaccaacttattgggctcaatcccatttggtcacaggatactgtacgtatcttcctttccagagatttgatatcacccagacaccgccagcatacataaacgtgttaccaggtttgccccagtacaccagcatatatacacccttggccagcctttctcctgaatatcagctaccaagatcagtaccagtggtgccgtcttttgtagccaatgacagagcagataaaaatgctgctgcctattttgagggtcatcatttgaatgctgagaatgttgctggtcaccagattgcctctgaaacacagatccttgagggctctttgggaatatctgtaaagtcacactgcagcacaggtgatgctcatacagtcctgagtgagtctaacagaaatgatgagcactgtggaaattctaacaacaaatgtgaagtaattccagaaagcaccagtgcagtaacaaacattccacacgtgcagatggttgccatacaggtatcttggaacataatacaccaagaagtcaatactgagccatataatccttttgaggaacgacaaggggaaatttcacggattgaaaaggagcaccaagtattacaagaccaacttcaagaagtgtatgaaaattatgagcagataaaacttaagggcttagaagagaccagggacctggaagagaagttgaaaaggcacttagaagaaaacaagatctcaaagacggaattagattggttccttcaagatttggaaagagaaattaaaaaatggcaacaggaaaaaaaagaaatccaagaaagactaaaatcactgaagaagaaaattaaaaaggtttcaaatgccagtgaaatgtatacccagaaaaatgatggaaaggaaaaggaacatgaattacatctggatcagtcccttgaaatcagcaacacacttacaaatgagaaaatgaaaatagaagagtatataaagaaagggaaagaggattatgaagagagtcatcagagagctgtggctgcagaggtatccgtacttgaaaactggaaggagagtgaagtgtataagctacagatcatggagtcacaagcagaagcctttctgaagaagctggggctgattagccgtgatcctgcagcatatcctgacatggagtctgatatacgttcatgggaattgtttctttctaatgttacaaaagaaattgagaaagcaaagtctcagtttgaagaacaaattaaggcaattaaaaatggttctcggctcagtgaactttctaaagtgcagatttctgagctttcatttcctgcctgtaacacggttcatcccgagttactccctgagtcttcaggccacgatggccaagggcttgtgacttctgcaagcgacgtgactggaaaccacgcagcacttcacagggatcctagtgtgttctctgctggtgattccccaggggaggctccttctgcgctgttgccagggccaccccctggtcagcctgaagccactcagctgacagggccaaaacgggctggccaggcagctctgtcagaacgaagccctgtggctgatcggaagcagcctgttcctccaggacgtgctgcgcgttcaagccagtctccaaaaaagccgttcaatagtattattgagcacctgtcagtggtattcccatgttacaacagcactgagcttgctggttttattaaaaaagtgcgaagcaaaaacaagaactcactctcaggattgagtattgatgaaattgtccaaagagtgacagaacacattctagatgaacagaaaaagaaaaagccaaacccaggaaaggacaagaggacttatgagcccagctctgccacccccgtgaccaggtcctcccagggctcaccctcggtggttgttgcaccatcacccaaaaccaaggggcagaaagcagaagatgtccctgtgaggattgcactgggtgcaagttcctgtgaaatatgccacgaggtgttcaaatcaaaaaacgtgcgtgtgctcaaatgtgggcacaagtatcacaaagggtgctttaagcagtggcttaaagggcagagcgcttgcccggcctgccagggtcgtgatctcctgacagaagagtcaccttctggaagaggctggcccagtcagaatcaggagctgccttcctgctcttctaggtagtcacacttcactaaagtgtcatccaccagtgtgttgaatccgaagaatgacaattttctaccactggtgtaaaaaacaaacatttgaagacccttgtgcattgtgtgtcacaaagctaaatacatggaaatcgttaatatcgctgatattaagtaatttccccactctgagtgaatactttgatgattgccaacagtggctaataaaatgacggctaccacactcatgggtcactggggctgcgcagggctctttgaggtgggtggcttcttttggaaagtactatgaacgtctcgaagcagtattctagtgataagaattcttaacatagccaagcgccccacgtttgttccccacgtttgttccccttttctgtttgaaaaacctgttctggtagctccacaagagagatgatactgactttttaaattttttacaagagtctgtattcctgatatgcctatatttttcctcaaagattctgcattttaaggatgggcataagcaaactatattttaataatttatagttaatgttaaaatattggctgatttagaccaaaagattcaaatctcctctttgtgaaatcccatctgcatttgattttttattattttatgttcccccgttagattgttttaagtgtttgcttttcatcttttatagatgtaatctgattttcaaaaatcattaacactttttaattagtatcgactaagactttttccccctggaatcgaggctgtgtgtccgtcatcccagcccccggttggagcctgctctttgaactccgctgccttccttagcagcttctgtcctcttctgtgagtcagtcagcgagtgcttgggatccgcatccagccgtgctgagcacacaacaggctgtgtgtggaaatggccaccaccattctccttccccaccccaccacaaaaagagaagctgtgtctttagacaaccctgaggtatctgtgttacaatcgttctgtgtttgatatttgtgtaaagtatgcatgcagtcttgtactgtgacctaagaacaaaactgtaactgcattagaaaccatgaaaaaattagatattgttttgtgacttttagacagtggtaaatatagaaccatgaattctggtcacattccatttctctccaacatgaaggatcaaaaaatgtttttcaatgtgttctttgttccactggaaacttagagtcatgagtttatgagctgatttggtcaccttcctctgcctttgttcactgtgagttctgatgtcttagtgacttagttcttagaagctcacgccttagtttgaaacagattctccacggtggtccccaaaacactgtctgcatatccataagaattgagcgctatgggtgttaacgtgcatgaggatcagtttgcagcagcaagtacaaaaggagaagaggaacatccgttgaatgagtgtgttttgtacataacttcagatacttgtgaacatgccttatatttgtccaacaactgtcagaataaagaacattctaaaatgagaaaaaaaaaaaaaaaaaaaaaaaaaaaaaaaaaaaaaaccaacgccattgctcagctaacggccacgcttcaacctggtgatgccccggcatactttccagcatagagcgcggaataagcgcaatngcctgctctgcgatcacacaggccaacattccgtgataagactccatctcatggatagttcccnngagcgcaccgtcagcatgaaaccagctctcgaagtgcgacgatccgacaattngcgccgnaggccataaatgtacttgcataacctgactggcacggnttactggcccatatccttgggcgtgaccatcataanttccttccgtattacccgtattccctcgatgg

SEQ ID NO: 371567 - DNA, 8818 bp, Homo sapiens
  misc_feature (8587)..(8587): n is a, c, g, or t
  misc_feature (8651)..(8652): n is a, c, g, or t
  misc_feature (8705)..(8705): n is a, c, g, or t
  misc_feature (8712)..(8712): n is a, c, g, or t
  misc_feature (8750)..(8750): n is a, c, g, or t
  misc_feature (8786)..(8786): n is a, c, g, or t
ctgaactagttgccagtgatcttgaaacgtgacagtaaccaagagataaataggtgacaatgacaggaaaattagatgtagtaaaagagagtgtttgagagcagaagctatggcaactaaagactggatttgaatccttcctagcttggtgacatgagcaaattacttgatttaagtgagcattttcccatctgtacagtggagataacgataattgtgcctgctaagaagaattgctgtgaagattagtgaaataatgcatgtaaaacatttggtacagtatgtgacacatagtacaaatagtttgctaggaagattgttattattcttcacttgtgatattgtgaagttttcatacagcaaattggacatcatgagatggattgattaaataaatagatttgaacttcaaggactggtagtgttcttgctttggaaagaagaaacttggtttatcctaataatagtaggataataatggtgaagtgataggtacaagtaatagtgtttatgatgcgctggtgatgataggaaaagaaagccattatatgggcaagagctagaagtaataaaatggtgcatttttcagtgatgtttggcctatgtagctattctctgataactataaaaatccttattattgaagattcttcaggaaaaaaaaacccttagtctgaaactttagcaccaatcccccttgccccccattgaaatacgtatttttaaaacatggcttttgataatgtgagggttttttcctttttgcgatttagcagtgctgattgtgtattgcagtagttgtgagagcattagaagcagcagtcgataggaggatggaaggtctggatgccgccttggggagttaggagattggcagacttaccctgtaccactctagccctactcctttgcccaagacagaaacacactgagatggataggagaatatgagcagttgataggaaagttctcagtggagtcaggatttaggttaggccaggagattgagaatataacagtttgtgtatgatgaaatggcatatttcacagaatgcagtaaaagcaggtagggtacaagtgcagcaacaggaagatgtcttttcttcattcagcaaacacttatttgagagcttaccatgtgctaggcacatacaaagataaataagatgcccttgatgatcctctatttaaaggagacatgtacaattcacgtgcttctgagataaatttgaagaaactacaacatcttgagttgatggaagatattgtggatttggcaaagaaagttgctaatgattcattccttattggaggcttattgagaattggttgtaaaatagaaaataaaatcttggcaatggaagaagctctgaattggataaaatatgcaggcgatgtaacaattctaactaaattaggatcaattgacaattgttggcctatgttaagtattttctttactgaatacaagtaccacataactaaaattgtaatggaagactgcaatttgcttgaagaacttaaaactcaaagttgtatggattgtatagaggaaggagaactaatgaaaatgaaaggaaatgaagagttttccaaagaaagatttgatatagctattatctattacaccagagccattgaatatagacctgaaaactaccttctttatggtaaccgagctctttgttttcttcgtactggacagtttagaaatgcactcggtgatggaaagagagccactattctgaagaacacttggccaaagggtcattatcgttattgtgatgctctttctatgctgggggaatatgactgggccctgcaagcaaacataaaagctcaaaaactctgtaaaaatgaccctgagggaatcaaggatctaattcagcagcatgtaaagttacaaaaacaaatagaagacctacaaggtcgaacagcaaataaggatccaattaaagccttttatgaaaacagggcctacacacctaggagtttatcagcacctatatttactacttcacttaactttgtggagaaggaaagagatttcagaaaaattaatcacgaaatggccaacggtggtaatcagaatctaaaggtggcggatgaggcgttgaaggtagatgattgtgactgtcatcctgaattttcaccaccatcaagtcagcctccaaaacataaaggaaaacaaaaatctcgaaacaatgaatcagaaaagttcagttctagttcaccattgactttaccagcagatttgaagaacatcttggagaaacagttttctaaatcttccagagctgcacaccaggattttgctaatataatgaaaatgctgagaagcttaattcaagatggctatatggccttattggagcagcgttgccgcagcgctgcacaggcctttacagagttgctgaacggtttagatcctcaaaaaataaagcaattgaacctggccatgattaactatgttttggtcgtctatggacttgccatttctctccttggaataggacagcctgaggaattatctgaagccgaaaaccagtttaagaggattattgaacactaccccagtgagggccttgattgcttggcctactgtggaattggaaaagtgtatttgaaaaaaaacagatttctagaagctctcaatcactttgagaaagcaagaaccttgatttatcgtcttcctggagtgttaacttggcccacgagtaatgtgattattgaagagtctcagccacaaaaaataaagatgctgttagagaaatttgttgaagaatgcaagttccctccagtgccagatgccatttgttgctatcagaagtgccatggatattctaagatccagatatacataactgatccagactttaagggttttatacgcatcagctgttgccagtactgtaaaatagaatttcacatgaattgctggaagaagttaaaaactacaacctttaatgataaaattgacaaggattttctacaaggaatatgtcttacccctgactgtgaaggtgtcatttctaagattatcatcttcagcagtggtggtgaagttaaatgtgaatttgaacacaaggtcataaaagaaaaggttcctccaagacctattctgaaacagaaatgttctagcctagagaaactaagactgaaagaagacaaaaaattgaagagaaagatccaaaaaaaagaagcaaaaaagttagcacaagaaagaatggaggaggacttaagagaaagtaatccacccaaaaatgaagagcagaaagaaactgtagacaatgttcagcgttgtcagttccttgatgacagaattctacagtgtataaagcagtatgctgacaagattaaatccggcatacagaatacagccatgcttctcaaagaattgctttcttggaaagttttgagcacagaagactatacaacctgtttttctagcagaaattttctaaatgaagcagtggactatgttattcgccacttgattcaagaaaataacagagtaaagacaagaatatttctgcatgttttgagtgagcttaaagaagtggagcccaaattagccgcctggatccaaaaacttaatagctttggcttagatgccacaggaactttcttttctcgttatggagcatctcttaaactgcttgattttagtatcatgactttcctctggaatgagaaatatggtcacaaactagactctatagaaggaaagcaacttgattatttctctgagccagcatcattgaaggaagcccgttgtttaatatggctgctagaagaacacagagacaagttcccagcattgcatagtgctttagatgaattctttgatataatggacagccgctgtactgtgttaaggaaacaagatagtggtgaagcaccgtttagttcaaccaaggtgaaaaacaaaagcaagaaaaagaagccaaaggattcaaagcctatgttagttgggtctggaacaacttcagtaacttcaaataatgagatcatcacttcaagtgaagaccatagcaatcgaaattcagattctgcaggcccatttgcagtgcctgaccatcttcggcaagatgtagaagaattcgaagctctctatgaccaacacagtaacgaatatgttgtccgcaataagaagctatgggacatgaacccaaaacaaaaatgttcaactctatatgattacttctctcagtttttggaggaacatggtcccttggacatgagtaacaagatgttctctgcagaatatgagtttttcccagaagaaactcgacagatactagaaaaagcaggaggtttaaaaccttttctcttgggatgccctcgttttgttgtgattgacaactgtattgcactgaagaaggttgcatcacggctcaagaaaaaaaggaagaagaaaaacattaaaacaaaagtagaagaaatttcaaaagcaggggagtatgtacgagttaaactacaactgaatccagctgctagggaatttaaaccagatgtaaagtctaaaccagtgtcagattcatcttcagcaccagcttttgaaaatgtgaaacccaaacctgtgtctgcaaattctcccaagccagcttgtgaagatgtgaaggccaaaccagtatccgacaattcttctagacaagtttctgaggatgggcaacccaaaggggtctcttctaattctcctaaaccaggctctgaggatgcaaattacaagcgagtctcctgtaattcccccaaaccggttcttgaggatgtgaaaccaacttattgggctcaatcccatttggtcacaggatactgtacgtatcttcctttccagagatttgatatcacccagacaccgccagcatacataaacgtgttaccaggtttgccccagtacaccagcatatatacacccttggccagcctttctcctgaatatcagctaccaagatcagtaccagtggtgccgtcttttgtagccaatgacagagcagataaaaatgctgctgcctattttgagggtcatcatttgaatgctgagaatgttgctggtcaccagattgcctctgaaacacagatccttgagggctctttgggaatatctgtaaagtcacactgcagcacaggtgatgctcatacagtcctgagtgagtctaacagaaatgatgagcactgtggaaattctaacaacaaatgtgaagtaattccagaaagcaccagtgcagtaacaaacattccacacgtgcagatggttgccatacaggtatcttggaacataatacaccaagaagtcaatactgagccatataatccttttgaggaacgacaaggggaaatttcacggattgaaaaggagcaccaagtattacaagaccaacttcaagaagtgtatgaaaattatgagcagataaaacttaagggcttagaagagaccagggacctggaagagaagttgaaaaggcacttagaagaaaacaagatctcaaagacggaattagattggttccttcaagatttggaaagagaaattaaaaaatggcaacaggaaaaaaaagaaatccaagaaagactaaaatcactgaagaagaaaattaaaaaggtttcaaatgccagtgaaatgtatacccagaaaaatgatggaaaggaaaaggaacatgaattacatctggatcagtcccttgaaatcagcaacacacttacaaatgagaaaatgaaaatagaagagtatataaagaaagggaaagaggattatgaagagagtcatcagagagctgtggctgcagaggtatccgtacttgaaaactggaaggagagtgaagtgtataagctacagatcatggagtcacaagcagaagcctttctgaagaagctggggctgattagccgtgatcctgcagcatatcctgacatggagtctgatatacgttcatgggaattgtttctttctaatgttacaaaagaaattgagaaagcaaagtctcagtttgaagaacaaattaaggcaattaaaaatggttctcggctcagtgaactttctaaagtgcagatttctgagctttcatttcctgcctgtaacacggttcatcccgagttactccctgagtcttcaggccacgatggccaagggcttgtgacttctgcaagcgacgtgactggaaaccacgcagcacttcacagggatcctagtgtgttctctgctggtgattccccaggggaggctccttctgcgctgttgccagggccaccccctggtcagcctgaagccactcagctgacagggccaaaacgggctggccaggcagctctgtcagaacgaagccctgtggctgatcggaagcagcctgttcctccaggacgtgctgcgcgttcaagccagtctccaaaaaagccgttcaatagtattattgagcacctgtcagtggtattcccatgttacaacagcactgagcttgctggttttattaaaaaagtgcgaagcaaaaacaagaactcactctcaggattgagtattgatgaaattgtccaaagagtgacagaacacattctagatgaacagaaaaagaaaaagccaaacccaggaaaggacaagaggacttatgagcccagctctgccacccccgtgaccaggtcctcccagggctcaccctcggtggttgttgcaccatcacccaaaaccaaggggcagaaagcagaagatgtccctgtgaggattgcactgggtgcaagttcctgtgaaatatgccacgaggtgttcaaatcaaaaaacgtgcgtgtgctcaaatgtgggcacaagtatcacaaagggtgctttaagcagtggcttaaagggcagagcgcttgcccggcctgccagggtcgtgatctcctgacagaagagtcaccttctggaagaggctggcccagtcagaatcaggagctgccttcctgctcttctaggtagtcacacttcactaaagtgtcatccaccagtgtgttgaatccgaagaatgacaattttctaccactggtgtaaaaaacaaacatttgaagacccttgtgcattgtgtgtcacaaagctaaatacatggaaatcgttaatatcgctgatattaagtaatttccccactctgagtgaatactttgatgattgccaacagtggctaataaaatgacggctaccacactcatgggtcactggggctgcgcagggctctttgaggtgggtggcttcttttggaaagtactatgaacgtctcgaagcagtattctagtgataagaattcttaacatagccaagcgccccacgtttgttccccttttctgtttgaaaaacctgttctggtagctccacaagagagatgatactgactttttaaattttttacaagagtctgtattcctgatatgcctatatttttcctcaaagattctgcattttaaggatgggcataagcaaactatattttaataatttatagttaatgttaaaatattggctgatttagaccaaaagattcaaatctcctctttgtgaaatcccatctgcatttgattttttattattttatgttcccccgttagattgttttaagtgtttgcttttcatcttttatagatgtaatctgattttcaaaaatcattaacactttttaattagtatcgactaagactttttccccctggaatcgaggctgtgtgtccgtcatcccagcccccggttggagcctgctctttgaactccgctgccttccttagcagcttctgtcctcttctgtgagtcagtcagcgagtgcttgggatccgcatccagccgtgctgagcacacaacaggctgtgtgtggaaatggccaccaccattctccttccccaccccaccacaaaaagagaagctgtgtctttagacaaccctgaggtatctgtgttacaatcgttctgtgtttgatatttgtgtaaagtatgcatgcagtcttgtactgtgacctaagaacaaaactgtaactgcattagaaaccatgaaaaaattagatattgttttgtgacttttagacagtggtaaatatagaaccatgaattctggtcacattccatttctctccaacatgaaggatcaaaaaatgtttttcaatgtgttctttgttccactggaaacttagagtcatgagtttatgagctgatttggtcaccttcctctgcctttgttcactgtgagttctgatgtcttagtgacttagttcttagaagctcacgccttagtttgaaacagattctccacggtggtccccaaaacactgtctgcatatccataagaattgagcgctatgggtgttaacgtgcatgaggatcagtttgcagcagcaagtacaaaaggagaagaggaacatccgttgaatgagtgtgttttgtacataacttcagatacttgtgaacatgccttatatttgtccaacaactgtcagaataaagaacattctaaaatgagaaaaaaaaaaaaaaaaaaaaaaaaaaaaaaaaaaaaaaccaacgccattgctcagctaacggccacgcttcaacctggtgatgccccggcatactttccagcatagagcgcggaataagcgcaatngcctgctctgcgatcacacaggccaacattccgtgataagactccatctcatggatagttcccnngagcgcaccgtcagcatgaaaccagctctcgaagtgcgacgatccgacaattngcgccgnaggccataaatgtacttgcataacctgactggcacggnttactggcccatatccttgggcgtgaccatcataanttccttccgtattacccgtattccctcgatgg

SEQ ID NO: 371568 - DNA, 8630 bp, Homo sapiens
ctgaactagttgccagtgatcttgaaacgtgacagtaaccaagagataaataggtgacaatgacaggaaaattagatgtagtaaaagagagtgtttgagagcagaagctatggcaactaaagactggatttgaatccttcctagcttggtgacatgagcaaattacttgatttaagtgagcattttcccatctgtacagtggagataacgataattgtgcctgctaagaagaattgctgtgaagattagtgaaataatgcatgtaaaacatttggtacagtatgtgacacatagtacaaatagtttgctaggaagattgttattattcttcacttgtgatattgtgaagttttcatacagcaaattggacatcatgagatggattgattaaataaatagatttgaacttcaaggactggtagtgttcttgctttggaaagaagaaacttggtttatcctaataatagtaggataataatggtgaagtgataggtacaagtaatagtgtttatgatgcgctggtgatgataggaaaagaaagccattatatgggcaagagctagaagtaataaaatggtgcatttttcagtgatgtttggcctatgtagctattctctgataactataaaaatccttattattgaagattcttcaggaaaaaaaaacccttagtctgaaactttagcaccaatcccccttgccccccattgaaatacgtatttttaaaacatggcttttgataatgtgagggttttttcctttttgcgatttagcagtgctgattgtgtattgcagtagttgtgagagcattagaagcagcagtcgataggaggatggaaggtctggatgccgccttggggagttaggagattggcagacttaccctgtaccactctagccctactcctttgcccaagacagaaacacactgagatggataggagaatatgagcagttgataggaaagttctcagtggagtcaggatttaggttaggccaggagattgagaatataacagtttgtgtatgatgaaatggcatatttcacagaatgcagtaaaagcaggtagggtacaagtgcagcaacaggaagatgtcttttcttcattcagcaaacacttatttgagagcttaccatgtgctaggcacatacaaagataaataagatgcccttgatgatcctctatttaaaggagacatgtacaattcacgtgcttctgagataaatttgaagaaactacaacatcttgagttgatggaagatattgtggatttggcaaagaaagttgctaatgattcattccttattggaggcttattgagaattggttgtaaaatagaaaataaaatcttggcaatggaagaagctctgaattggataaaatatgcaggcgatgtaacaattctaactaaattaggatcaattgacaattgttggcctatgttaagtattttctttactgaatacaagtaccacataactaaaattgtaatggaagactgcaatttgcttgaagaacttaaaactcaaagttgtatggattgtatagaggaaggagaactaatgaaaatgaaaggaaatgaagagttttccaaagaaagatttgatatagctattatctattacaccagagccattgaatatagacctgaaaactaccttctttatggtaaccgagctctttgttttcttcgtactggacagtttagaaatgcactcggtgatggaaagagagccactattctgaagaacacttggccaaagggtcattatcgttattgtgatgctctttctatgctgggggaatatgactgggccctgcaagcaaacataaaagctcaaaaactctgtaaaaatgaccctgagggaatcaaggatctaattcagcagcatgtaaagttacaaaaacaaatagaagacctacaaggtcgaacagcaaataaggatccaattaaagccttttatgaaaacagggcctacacacctaggagtttatcagcacctatatttactacttcacttaactttgtggagaaggaaagagatttcagaaaaattaatcacgaaatggccaacggtggtaatcagaatctaaaggtggcggatgaggcgttgaaggtagatgattgtgactgtcatcctgaattttcaccaccatcaagtcagcctccaaaacataaaggaaaacaaaaatctcgaaacaatgaatcagaaaagttcagttctagttcaccattgactttaccagcagatttgaagaacatcttggagaaacagttttctaaatcttccagagctgcacaccaggattttgctaatataatgaaaatgctgagaagcttaattcaagatggctatatggccttattggagcagcgttgccgcagcgctgcacaggcctttacagagttgctgaacggtttagatcctcaaaaaataaagcaattgaacctggccatgattaactatgttttggtcgtctatggacttgccatttctctccttggaataggacagcctgaggaattatctgaagccgaaaaccagtttaagaggattattgaacactaccccagtgagggccttgattgcttggcctactgtggaattggaaaagtgtatttgaaaaaaaacagatttctagaagctctcaatcactttgagaaagcaagaaccttgatttatcgtcttcctggagtgttaacttggcccacgagtaatgtgattattgaagagtctcagccacaaaaaataaagatgctgttagagaaatttgttgaagaatgcaagttccctccagtgccagatgccatttgttgctatcagaagtgccatggatattctaagatccagatatacataactgatccagactttaagggttttatacgcatcagctgttgccagtactgtaaaatagaatttcacatgaattgctggaagaagttaaaaactacaacctttaatgataaaattgacaaggattttctacaaggaatatgtcttacccctgactgtgaaggtgtcatttctaagattatcatcttcagcagtggtggtgaagttaaatgtgaatttgaacacaaggtcataaaagaaaaggttcctccaagacctattctgaaacagaaatgttctagcctagagaaactaagactgaaagaagacaaaaaattgaagagaaagatccaaaaaaaagaagcaaaaaagttagcacaagaaagaatggaggaggacttaagagaaagtaatccacccaaaaatgaagagcagaaagaaactgtagacaatgttcagcgttgtcagttccttgatgacagaattctacagtgtataaagcagtatgctgacaagattaaatccggcatacagaatacagccatgcttctcaaagaattgctttcttggaaagttttgagcacagaagactatacaacctgtttttctagcagaaattttctaaatgaagcagtggactatgttattcgccacttgattcaagaaaataacagagtaaagacaagaatatttctgcatgttttgagtgagcttaaagaagtggagcccaaattagccgcctggatccaaaaacttaatagctttggcttagatgccacaggaactttcttttctcgttatggagcatctcttaaactgcttgattttagtatcatgactttcctctggaatgagaaatatggtcacaaactagactctatagaaggaaagcaacttgattatttctctgagccagcatcattgaaggaagcccgttgtttaatatggctgctagaagaacacagagacaagttcccagcattgcatagtgctttagatgaattctttgatataatggacagccgctgtactgtgttaaggaaacaagatagtggtgaagcaccgtttagttcaaccaaggtgaaaaacaaaagcaagaaaaagaagccaaaggattcaaagcctatgttagttgggtctggaacaacttcagtaacttcaaataatgagatcatcacttcaagtgaagaccatagcaatcgaaattcagattctgcaggcccatttgcagtgcctgaccatcttcggcaagatgtagaagaattcgaagctctctatgaccaacacagtaacgaatatgttgtccgcaataagaagctatgggacatgaacccaaaacaaaaatgttcaactctatatgattacttctctcagtttttggaggaacatggtcccttggacatgagtaacaagatgttctctgcagaatatgagtttttcccagaagaaactcgacagatactagaaaaagcaggaggtttaaaaccttttctcttgggatgccctcgttttgttgtgattgacaactgtattgcactgaagaaggttgcatcacggctcaagaaaaaaaggaagaagaaaaacattaaaacaaaagtagaagaaatttcaaaagcaggggagtatgtacgagttaaactacaactgaatccagctgctagggaatttaaaccagatgtaaagtctaaaccagtgtcagattcatcttcagcaccagcttttgaaaatgtgaaacccaaacctgtgtctgcaaattctcccaagccagcttgtgaagatgtgaaggccaaaccagtatccgacaattcttctagacaagtttctgaggatgggcaacccaaaggggtctcttctaattctcctaaaccaggctctgaggatgcaaattacaagcgagtctcctgtaattcccccaaaccggttcttgaggatgtgaaaccaacttattgggctcaatcccatttggtcacaggatactgtacgtatcttcctttccagagatttgatatcacccagacaccgccagcatacataaacgtgttaccaggtttgccccagtacaccagcatatatacacccttggccagcctttctcctgaatatcagctaccaagatcagtaccagtggtgccgtcttttgtagccaatgacagagcagataaaaatgctgctgcctattttgagggtcatcatttgaatgctgagaatgttgctggtcaccagattgcctctgaaacacagatccttgagggctctttgggaatatctgtaaagtcacactgcagcacaggtgatgctcatacagtcctgagtgagtctaacagaaatgatgagcactgtggaaattctaacaacaaatgtgaagtaattccagaaagcaccagtgcagtaacaaacattccacacgtgcagatggttgccatacaggtatcttggaacataatacaccaagaagtcaatactgagccatataatccttttgaggaacgacaaggggaaatttcacggattgaaaaggagcaccaagtattacaagaccaacttcaagaagtgtatgaaaattatgagcagataaaacttaagggcttagaagagaccagggacctggaagagaagttgaaaaggcacttagaagaaaacaagatctcaaagacggaattagattggttccttcaagatttggaaagagaaattaaaaaatggcaacaggaaaaaaaagaaatccaagaaagactaaaatcactgaagaagaaaattaaaaaggtttcaaatgccagtgaaatgtatacccagaaaaatgatggaaaggaaaaggaacatgaattacatctggatcagtcccttgaaatcagcaacacacttacaaatgagaaaatgaaaatagaagagtatataaagaaagggaaagaggattatgaagagagtcatcagagagctgtggctgcagaggtatccgtacttgaaaactggaaggagagtgaagtgtataagctacagatcatggagtcacaagcagaagcctttctgaagaagctggggctgattagccgtgatcctgcagcatatcctgacatggagtctgatatacgttcatgggaattgtttctttctaatgttacaaaagaaattgagaaagcaaagtctcagtttgaagaacaaattaaggcaattaaaaatggttctcggctcagtgaactttctaaagtgcagatttctgagctttcatttcctgcctgtaacacggttcatcccgagttactccctgagtcttcaggccacgatggccaagggcttgtgacttctgcaagcgacgtgactggaaaccacgcagcacttcacagggatcctagtgtgttctctgctggtgattccccaggggaggctccttctgcgctgttgccagggccaccccctggtcagcctgaagccactcagctgacagggccaaaacgggctggccaggcagctctgtcagaacgaagccctgtggctgatcggaagcagcctgttcctccaggacgtgctgcgcgttcaagccagtctccaaaaaagccgttcaatagtattattgagcacctgtcagtggtattcccatgttacaacagcactgagcttgctggttttattaaaaaagtgcgaagcaaaaacaagaactcactctcaggattgagtattgatgaaattgtccaaagagtgacagaacacattctagatgaacagaaaaagaaaaagccaaacccaggaaaggacaagaggacttatgagcccagctctgccacccccgtgaccaggtcctcccagggctcaccctcggtggttgttgcaccatcacccaaaaccaaggggcagaaagcagaagatgtccctgtgaggattgcactgggtgcaagttcctgtgaaatatgccacgaggtgttcaaatcaaaaaacgtgcgtgtgctcaaatgtgggcacaagtatcacaaagggtgctttaagcagtggcttaaagggcagagcgcttgcccggcctgccagggtcgtgatctcctgacagaagagtcaccttctggaagaggctggcccagtcagaatcaggagctgccttcctgctcttctaggtagtcacacttcactaaagtgtcatccaccagtgtgttgaatccgaagaatgacaattttctaccactggtgtaaaaaacaaacatttgaagacccttgtgcattgtgtgtcacaaagctaaatacatggaaatcgttaatatcgctgatattaagtaatttccccactctgagtgaatactttgatgattgccaacagtggctaataaaatgacggctaccacactcatgggtcactggggctgcgcagggctctttgaggtgggtggcttcttttggaaagtactatgaacgtctcgaagcagtattctagtgataagaattcttaacatagccaagcgccccacgtttgttccccacgtttgttccccttttctgtttgaaaaacctgttctggtagctccacaagagagatgatactgactttttaaattttttacaagagtctgtattcctgatatgcctatatttttcctcaaagattctgcattttaaggatgggcataagcaaactatattttaataatttatagttaatgttaaaatattggctgatttagaccaaaagattcaaatctcctctttgtgaaatcccatctgcatttgattttttattattttatgttcccccgttagattgttttaagtgtttgcttttcatcttttatagatgtaatctgattttcaaaaatcattaacactttttaattagtatcgactaagactttttccccctggaatcgaggctgtgtgtccgtcatcccagcccccggttggagcctgctctttgaactccgctgccttccttagcagcttctgtcctcttctgtgagtcagtcagcgagtgcttgggatccgcatccagccgtgctgagcacacaacaggctgtgtgtggaaatggccaccaccattctccttccccaccccaccacaaaaagagaagctgtgtctttagacaaccctgaggtatctgtgttacaatcgttctgtgtttgatatttgtgtaaagtatgcatgcagtcttgtactgtgacctaagaacaaaactgtaactgcattagaaaccatgaaaaaattagatattgttttgtgacttttagacagtggtaaatatagaaccatgaattctggtcacattccatttctctccaacatgaaggatcaaaaaatgtttttcaatgtgttctttgttccactggaaacttagagtcatgagtttatgagctgatttggtcaccttcctctgcctttgttcactgtgagttctgatgtcttagtgacttagttcttagaagctcacgccttagtttgaaacagattctccacggtggtccccaaaacactgtctgcatatccataagaattgagcgctatgggtgttaacgtgcatgaggatcagtttgcagcagcaagtacaaaaggagaagaggaacatccgttgaatgagtgtgttttgtacataacttcagatacttgtgaacatgccttatatttgtccaacaactgtcagtaagacctcttcctggaacaacaacacaaaaaaaagcgcgggcaagaaaccctgaggcacttcgctcactttggaaagccaagagagtaaaaaggcgacaagggacaatcggttgagacccgggggaggaccacaaacaagaaaatagtgcggtggtcataataaaaaatatgacacaa

SEQ ID NO: 371569 - DNA, 8514 bp, Homo sapiens
ctgaactagttgccagtgatcttgaaacgtgacagtaaccaagagataaataggtgacaatgacaggaaaattagatgtagtaaaagagagtgtttgagagcagaagctatggcaactaaagactggatttgaatccttcctagcttggtgacatgagcaaattacttgatttaagtgagcattttcccatctgtacagtggagataacgataattgtgcctgctaagaagaattgctgtgaagattagtgaaataatgcatgtaaaacatttggtacagtatgtgacacatagtacaaatagtttgctaggaagattgttattattcttcacttgtgatattgtgaagttttcatacagcaaattggacatcatgagatggattgattaaataaatagatttgaacttcaaggactggtagtgttcttgctttggaaagaagaaacttggtttatcctaataatagtaggataataatggtgaagtgataggtacaagtaatagtgtttatgatgcgctggtgatgataggaaaagaaagccattatatgggcaagagctagaagtaataaaatggtgcatttttcagtgatgtttggcctatgtagctattctctgataactataaaaatccttattattgaagattcttcaggaaaaaaaaacccttagtctgaaactttagcaccaatcccccttgccccccattgaaatacgtatttttaaaacatggcttttgataatgtgagggttttttcctttttgcgatttagcagtgctgattgtgtattgcagtagttgtgagagcattagaagcagcagtcgataggaggatggaaggtctggatgccgccttggggagttaggagattggcagacttaccctgtaccactctagccctactcctttgcccaagacagaaacacactgagatggataggagaatatgagcagttgataggaaagttctcagtggagtcaggatttaggttaggccaggagattgagaatataacagtttgtgtatgatgaaatggcatatttcacagaatgcagtaaaagcaggtagggtacaagtgcagcaacaggaagatgtcttttcttcattcagcaaacacttatttgagagcttaccatgtgctaggcacatacaaagataaataagatgcccttgatgatcctctatttaaaggagacatgtacaattcacgtgcttctgagataaatttgaagaaactacaacatcttgagttgatggaagatattgtggatttggcaaagaaagttgctaatgattcattccttattggaggcttattgagaattggttgtaaaatagaaaataaaatcttggcaatggaagaagctctgaattggataaaatatgcaggcgatgtaacaattctaactaaattaggatcaattgacaattgttggcctatgttaagtattttctttactgaatacaagtaccacataactaaaattgtaatggaagactgcaatttgcttgaagaacttaaaactcaaagttgtatggattgtatagaggaaggagaactaatgaaaatgaaaggaaatgaagagttttccaaagaaagatttgatatagctattatctattacaccagagccattgaatatagacctgaaaactaccttctttatggtaaccgagctctttgttttcttcgtactggacagtttagaaatgcactcggtgatggaaagagagccactattctgaagaacacttggccaaagggtcattatcgttattgtgatgctctttctatgctgggggaatatgactgggccctgcaagcaaacataaaagctcaaaaactctgtaaaaatgaccctgagggaatcaaggatctaattcagcagcatgtaaagttacaaaaacaaatagaagacctacaaggtcgaacagcaaataaggatccaattaaagccttttatgaaaacagggcctacacacctaggagtttatcagcacctatatttactacttcacttaactttgtggagaaggaaagagatttcagaaaaattaatcacgaaatggccaacggtggtaatcagaatctaaaggtggcggatgaggcgttgaaggtagatgattgtgactgtcatcctgaattttcaccaccatcaagtcagcctccaaaacataaaggaaaacaaaaatctcgaaacaatgaatcagaaaagttcagttctagttcaccattgactttaccagcagatttgaagaacatcttggagaaacagttttctaaatcttccagagctgcacaccaggattttgctaatataatgaaaatgctgagaagcttaattcaagatggctatatggccttattggagcagcgttgccgcagcgctgcacaggcctttacagagttgctgaacggtttagatcctcaaaaaataaagcaattgaacctggccatgattaactatgttttggtcgtctatggacttgccatttctctccttggaataggacagcctgaggaattatctgaagccgaaaaccagtttaagaggattattgaacactaccccagtgagggccttgattgcttggcctactgtggaattggaaaagtgtatttgaaaaaaaacagatttctagaagctctcaatcactttgagaaagcaagaaccttgatttatcgtcttcctggagtgttaacttggcccacgagtaatgtgattattgaagagtctcagccacaaaaaataaagatgctgttagagaaatttgttgaagaatgcaagttccctccagtgccagatgccatttgttgctatcagaagtgccatggatattctaagatccagatatacataactgatccagactttaagggttttatacgcatcagctgttgccagtactgtaaaatagaatttcacatgaattgctggaagaagttaaaaactacaacctttaatgataaaattgacaaggattttctacaaggaatatgtcttacccctgactgtgaaggtgtcatttctaagattatcatcttcagcagtggtggtgaagttaaatgtgaatttgaacacaaggtcataaaagaaaaggttcctccaagacctattctgaaacagaaatgttctagcctagagaaactaagactgaaagaagacaaaaaattgaagagaaagatccaaaaaaaagaagcaaaaaagttagcacaagaaagaatggaggaggacttaagagaaagtaatccacccaaaaatgaagagcagaaagaaactgtagacaatgttcagcgttgtcagttccttgatgacagaattctacagtgtataaagcagtatgctgacaagattaaatccggcatacagaatacagccatgcttctcaaagaattgctttcttggaaagttttgagcacagaagactatacaacctgtttttctagcagaaattttctaaatgaagcagtggactatgttattcgccacttgattcaagaaaataacagagtaaagacaagaatatttctgcatgttttgagtgagcttaaagaagtggagcccaaattagccgcctggatccaaaaacttaatagctttggcttagatgccacaggaactttcttttctcgttatggagcatctcttaaactgcttgattttagtatcatgactttcctctggaatgagaaatatggtcacaaactagactctatagaaggaaagcaacttgattatttctctgagccagcatcattgaaggaagcccgttgtttaatatggctgctagaagaacacagagacaagttcccagcattgcatagtgctttagatgaattctttgatataatggacagccgctgtactgtgttaaggaaacaagatagtggtgaagcaccgtttagttcaaccaaggtgaaaaacaaaagcaagaaaaagaagccaaaggattcaaagcctatgttagttgggtctggaacaacttcagtaacttcaaataatgagatcatcacttcaagtgaagaccatagcaatcgaaattcagattctgcaggcccatttgcagtgcctgaccatcttcggcaagatgtagaagaattcgaagctctctatgaccaacacagtaacgaatatgttgtccgcaataagaagctatgggacatgaacccaaaacaaaaatgttcaactctatatgattacttctctcagtttttggaggaacatggtcccttggacatgagtaacaagatgttctctgcagaatatgagtttttcccagaagaaactcgacagatactagaaaaagcaggaggtttaaaaccttttctcttgggatgccctcgttttgttgtgattgacaactgtattgcactgaagaaggttgcatcacggctcaagaaaaaaaggaagaagaaaaacattaaaacaaaagtagaagaaatttcaaaagcaggggagtatgtacgagttaaactacaactgaatccagctgctagggaatttaaaccagatgtaaagtctaaaccagtgtcagattcatcttcagcaccagcttttgaaaatgtgaaacccaaacctgtgtctgcaaattctcccaagccagcttgtgaagatgtgaaggccaaaccagtatccgacaattcttctagacaagtttctgaggatgggcaacccaaaggggtctcttctaattctcctaaaccaggctctgaggatgcaaattacaagcgagtctcctgtaattcccccaaaccggttcttgaggatgtgaaaccaacttattgggctcaatcccatttggtcacaggatactgtacgtatcttcctttccagagatttgatatcacccagacaccgccagcatacataaacgtgttaccaggtttgccccagtacaccagcatatatacacccttggccagcctttctcctgaatatcagctaccaagatcagtaccagtggtgccgtcttttgtagccaatgacagagcagataaaaatgctgctgcctattttgagggtcatcatttgaatgctgagaatgttgctggtcaccagattgcctctgaaacacagatccttgagggctctttgggaatatctgtaaagtcacactgcagcacaggtgatgctcatacagtcctgagtgagtctaacagaaatgatgagcactgtggaaattctaacaacaaatgtgaagtaattccagaaagcaccagtgcagtaacaaacattccacacgtgcagatggttgccatacaggtatcttggaacataatacaccaagaagtcaatactgagccatataatccttttgaggaacgacaaggggaaatttcacggattgaaaaggagcaccaagtattacaagaccaacttcaagaagtgtatgaaaattatgagcagataaaacttaagggcttagaagagaccagggacctggaagagaagttgaaaaggcacttagaagaaaacaagatctcaaagacggaattagattggttccttcaagatttggaaagagaaattaaaaaatggcaacaggaaaaaaaagaaatccaagaaagactaaaatcactgaagaagaaaattaaaaaggtttcaaatgccagtgaaatgtatacccagaaaaatgatggaaaggaaaaggaacatgaattacatctggatcagtcccttgaaatcagcaacacacttacaaatgagaaaatgaaaatagaagagtatataaagaaagggaaagaggattatgaagagagtcatcagagagctgtggctgcagaggtatccgtacttgaaaactggaaggagagtgaagtgtataagctacagatcatggagtcacaagcagaagcctttctgaagaagctggggctgattagccgtgatcctgcagcatatcctgacatggagtctgatatacgttcatgggaattgtttctttctaatgttacaaaagaaattgagaaagcaaagtctcagtttgaagaacaaattaaggcaattaaaaatggttctcggctcagtgaactttctaaagtgcagatttctgagctttcatttcctgcctgtaacacggttcatcccgagttactccctgagtcttcaggccacgatggccaagggcttgtgacttctgcaagcgacgtgactggaaaccacgcagcacttcacagggatcctagtgtgttctctgctggtgattccccaggggaggctccttctgcgctgttgccagggccaccccctggtcagcctgaagccactcagctgacagggccaaaacgggctggccaggcagctctgtcagaacgaagccctgtggctgatcggaagcagcctgttcctccaggacgtgctgcgcgttcaagccagtctccaaaaaagccgttcaatagtattattgagcacctgtcagtggtattcccatgttacaacagcactgagcttgctggttttattaaaaaagtgcgaagcaaaaacaagaactcactctcaggattgagtattgatgaaattgtccaaagagtgacagaacacattctagatgaacagaaaaagaaaaagccaaacccaggaaaggacaagaggacttatgagcccagctctgccacccccgtgaccaggtcctcccagggctcaccctcggtggttgttgcaccatcacccaaaaccaaggggcagaaagcagaagatgtccctgtgaggattgcactgggtgcaagttcctgtgaaatatgccacgaggtgttcaaatcaaaaaacgtgcgtgtgctcaaatgtgggcacaagtatcacaaagggtgctttaagcagtggcttaaagggcagagcgcttgcccggcctgccagggtcgtgatctcctgacagaagagtcaccttctggaagaggctggcccagtcagaatcaggagctgccttcctgctcttctaggtagtcacacttcactaaagtgtcatccaccagtgtgttgaatccgaagaatgacaattttctaccactggtgtaaaaaacaaacatttgaagacccttgtgcattgtgtgtcacaaagctaaatacatggaaatcgttaatatcgctgatattaagtaatttccccactctgagtgaatactttgatgattgccaacagtggctaataaaatgacggctaccacactcatgggtcactggggctgcgcagggctctttgaggtgggtggcttcttttggaaagtactatgaacgtctcgaagcagtattctagtgataagaattcttaacatagccaagcgccccacgtttgttccccacgtttgttccccttttctgtttgaaaaacctgttctggtagctccacaagagagatgatactgactttttaaattttttacaagagtctgtattcctgatatgcctatatttttcctcaaagattctgcattttaaggatgggcataagcaaactatattttaataatttatagttaatgttaaaatattggctgatttagaccaaaagattcaaatctcctctttgtgaaatcccatctgcatttgattttttattattttatgttcccccgttagattgttttaagtgtttgcttttcatcttttatagatgtaatctgattttcaaaaatcattaacactttttaattagtatcgactaagactttttccccctggaatcgaggctgtgtgtccgtcatcccagcccccggttggagcctgctctttgaactccgctgccttccttagcagcttctgtcctcttctgtgagtcagtcagcgagtgcttgggatccgcatccagccgtgctgagcacacaacaggctgtgtgtggaaatggccaccaccattctccttccccaccccaccacaaaaagagaagctgtgtctttagacaaccctgaggtatctgtgttacaatcgttctgtgtttgatatttgtgtaaagtatgcatgcagtcttgtactgtgacctaagaacaaaactgtaactgcattagaaaccatgaaaaaattagatattgttttgtgacttttagacagtggtaaatatagaaccatgaattctggtcacattccatttctctccaacatgaaggatcaaaaaatgtttttcaatgtgttctttgttccactggaaacttagagtcatgagtttatgagctgatttggtcaccttcctctgcctttgttcactgtgagttctgatgtcttagtgacttagttcttagaagctcacgccttagtttgaaacagattctccacggtggtccccaaaacactgtctgcatatccataagaattgagcgctatgggtgttaacgtgcatgaggatcagtttgcagcagcaagtacaaaaggagaagaggaacatccgttgaatgagtgtgttttgtacataacttcagatacttgtgaacatgccttatatttgtccaacaactgtcagtgtgggctatcggaagagttcttaaatggtctccctccagctcatgttgcccatattctaatg

SEQ ID NO: 371570 - DNA, 3742 bp, Homo sapiens
  misc_feature (3511)..(3511): n is a, c, g, or t
  misc_feature (3575)..(3576): n is a, c, g, or t
  misc_feature (3629)..(3629): n is a, c, g, or t
  misc_feature (3636)..(3636): n is a, c, g, or t
  misc_feature (3674)..(3674): n is a, c, g, or t
  misc_feature (3710)..(3710): n is a, c, g, or t
aatgaccagcaagaggattacatttatatttataaaagcaaacaaaaactattggccttgccaactaaaacatgcatacactccctgtagattagagaatcatttaggctggagagtaagtgtgaacacttctgggcacgtcggagtggttcttcggggtgtcttactgtaatcaggtacacgtagcgggtaggatgtggctgtctggtgtgacttggtgtcccaggcttggctggggggcatagtctgccacagggcgccagcttgggagtgtgttccactgaacttaggtcattgtttaagctatggcaccgtcacaattctagcctttcagtctcttttgttaaaaagtatattttgccatttatttaagtactttctaaatgtttttagatctcaaagacggaattagattggttccttcaagatttggaaagagaaattaaaaaatggcaacaggaaaaaaaagaaatccaagaaagactaaaatcactgaagaagaaaattaaaaaggtttcaaatgccagtgaaatgtatacccagaaaaatgatggaaaggaaaaggaacatgaattacatctggatcagtcccttgaaatcagcaacacacttacaaatgagaaaatgaaaatagaagagtatataaagaaagggaaagaggattatgaagagagtcatcagagagctgtggctgcagaggtatccgtacttgaaaactggaaggagagtgaagtgtataagctacagatcatggagtcacaagcagaagcctttctgaagaagctggggctgattagccgtgatcctgcagcatatcctgacatggagtctgatatacgttcatgggaattgtttctttctaatgttacaaaagaaattgagaaagcaaagtctcagtttgaagaacaaattaaggcaattaaaaatggttctcggctcagtgaactttctaaagtgcagatttctgagctttcatttcctgcctgtaacacggttcatcccgagttactccctgagtcttcaggccacgatggccaagggcttgtgacttctgcaagcgacgtgactggaaaccacgcagcacttcacagggatcctagtgtgttctctgctggtgattccccaggggaggctccttctgcgctgttgccagggccaccccctggtcagcctgaagccactcagctgacagggccaaaacgggctggccaggcagctctgtcagaacgaagccctgtggctgatcggaagcagcctgttcctccaggacgtgctgcgcgttcaagccagtctccaaaaaagccgttcaatagtattattgagcacctgtcagtggtattcccatgttacaacagcactgagcttgctggttttattaaaaaagtgcgaagcaaaaacaagaactcactctcaggattgagtattgatgaaattgtccaaagagtgacagaacacattctagatgaacagaaaaagaaaaagccaaacccaggaaaggacaagaggacttatgagcccagctctgccacccccgtgaccaggtcctcccagggctcaccctcggtggttgttgcaccatcacccaaaaccaaggggcagaaagcagaagatgtccctgtgaggattgcactgggtgcaagttcctgtgaaatatgccacgaggtgttcaaatcaaaaaacgtgcgtgtgctcaaatgtgggcacaagtatcacaaagggtgctttaagcagtggcttaaagggcagagcgcttgcccggcctgccagggtcgtgatctcctgacagaagagtcaccttctggaagaggctggcccagtcagaatcaggagctgccttcctgctcttctaggtagtcacacttcactaaagtgtcatccaccagtgtgttgaatccgaagaatgacaattttctaccactggtgtaaaaaacaaacatttgaagacccttgtgcattgtgtgtcacaaagctaaatacatggaaatcgttaatatcgctgatattaagtaatttccccactctgagtgaatactttgatgattgccaacagtggctaataaaatgacggctaccacactcatgggtcactggggctgcgcagggctctttgaggtgggtggcttcttttggaaagtactatgaacgtctcgaagcagtattctagtgataagaattcttaacatagccaagcgccccacgtttgttccccacgtttgttccccttttctgtttgaaaaacctgttctggtagctccacaagagagatgatactgactttttaaattttttacaagagtctgtattcctgatatgcctatatttttcctcaaagattctgcattttaaggatgggcataagcaaactatattttaataatttatagttaatgttaaaatattggctgatttagaccaaaagattcaaatctcctctttgtgaaatcccatctgcatttgattttttattattttatgttcccccgttagattgttttaagtgtttgcttttcatcttttatagatgtaatctgattttcaaaaatcattaacactttttaattagtatcgactaagactttttccccctggaatcgaggctgtgtgtccgtcatcccagcccccggttggagcctgctctttgaactccgctgccttccttagcagcttctgtcctcttctgtgagtcagtcagcgagtgcttgggatccgcatccagccgtgctgagcacacaacaggctgtgtgtggaaatggccaccaccattctccttccccaccccaccacaaaaagagaagctgtgtctttagacaaccctgaggtatctgtgttacaatcgttctgtgtttgatatttgtgtaaagtatgcatgcagtcttgtactgtgacctaagaacaaaactgtaactgcattagaaaccatgaaaaaattagatattgttttgtgacttttagacagtggtaaatatagaaccatgaattctggtcacattccatttctctccaacatgaaggatcaaaaaatgtttttcaatgtgttctttgttccactggaaacttagagtcatgagtttatgagctgatttggtcaccttcctctgcctttgttcactgtgagttctgatgtcttagtgacttagttcttagaagctcacgccttagtttgaaacagattctccacggtggtccccaaaacactgtctgcatatccataagaattgagcgctatgggtgttaacgtgcatgaggatcagtttgcagcagcaagtacaaaaggagaagaggaacatccgttgaatgagtgtgttttgtacataacttcagatacttgtgaacatgccttatatttgtccaacaactgtcagaataaagaacattctaaaatgagaaaaaaaaaaaaaaaaaaaaaaaaaaaaaaaaaaaaaaccaacgccattgctcagctaacggccacgcttcaacctggtgatgccccggcatactttccagcatagagcgcggaataagcgcaatngcctgctctgcgatcacacaggccaacattccgtgataagactccatctcatggatagttcccnngagcgcaccgtcagcatgaaaccagctctcgaagtgcgacgatccgacaattngcgccgnaggccataaatgtacttgcataacctgactggcacggnttactggcccatatccttgggcgtgaccatcataanttccttccgtattacccgtattccctcgatgg

SEQ ID NO: 371571 - DNA, 3037 bp, Homo sapiens
  misc_feature (2806)..(2806): n is a, c, g, or t
  misc_feature (2870)..(2871): n is a, c, g, or t
  misc_feature (2924)..(2924): n is a, c, g, or t
  misc_feature (2931)..(2931): n is a, c, g, or t
  misc_feature (2969)..(2969): n is a, c, g, or t
  misc_feature (3005)..(3005): n is a, c, g, or t
ggagtgtagtggcgtgatctcggctcactgcaagctctgcctcccgagttcacgccattctcctgccttagcctcctgagtagctgagactacagtgatcctgcagcatatcctgacatggagtctgatatacgttcatgggaattgtttctttctaatgttacaaaagaaattgagaaagcaaagtctcagtttgaagaacaaattaaggcaattaaaaatggttctcggctcagtgaactttctaaagtgcagatttctgagctttcatttcctgcctgtaacacggttcatcccgagttactccctgagtcttcaggccacgatggccaagggcttgtgacttctgcaagcgacgtgactggaaaccacgcagcacttcacagggatcctagtgtgttctctgctggtgattccccaggggaggctccttctgcgctgttgccagggccaccccctggtcagcctgaagccactcagctgacagggccaaaacgggctggccaggcagctctgtcagaacgaagccctgtggctgatcggaagcagcctgttcctccaggacgtgctgcgcgttcaagccagtctccaaaaaagccgttcaatagtattattgagcacctgtcagtggtattcccatgttacaacagcactgagcttgctggttttattaaaaaagtgcgaagcaaaaacaagaactcactctcaggattgagtattgatgaaattgtccaaagagtgacagaacacattctagatgaacagaaaaagaaaaagccaaacccaggaaaggacaagaggacttatgagcccagctctgccacccccgtgaccaggtcctcccagggctcaccctcggtggttgttgcaccatcacccaaaaccaaggggcagaaagcagaagatgtccctgtgaggattgcactgggtgcaagttcctgtgaaatatgccacgaggtgttcaaatcaaaaaacgtgcgtgtgctcaaatgtgggcacaagtatcacaaagggtgctttaagcagtggcttaaagggcagagcgcttgcccggcctgccagggtcgtgatctcctgacagaagagtcaccttctggaagaggctggcccagtcagaatcaggagctgccttcctgctcttctaggtagtcacacttcactaaagtgtcatccaccagtgtgttgaatccgaagaatgacaattttctaccactggtgtaaaaaacaaacatttgaagacccttgtgcattgtgtgtcacaaagctaaatacatggaaatcgttaatatcgctgatattaagtaatttccccactctgagtgaatactttgatgattgccaacagtggctaataaaatgacggctaccacactcatgggtcactggggctgcgcagggctctttgaggtgggtggcttcttttggaaagtactatgaacgtctcgaagcagtattctagtgataagaattcttaacatagccaagcgccccacgtttgttccccacgtttgttccccttttctgtttgaaaaacctgttctggtagctccacaagagagatgatactgactttttaaattttttacaagagtctgtattcctgatatgcctatatttttcctcaaagattctgcattttaaggatgggcataagcaaactatattttaataatttatagttaatgttaaaatattggctgatttagaccaaaagattcaaatctcctctttgtgaaatcccatctgcatttgattttttattattttatgttcccccgttagattgttttaagtgtttgcttttcatcttttatagatgtaatctgattttcaaaaatcattaacactttttaattagtatcgactaagactttttccccctggaatcgaggctgtgtgtccgtcatcccagcccccggttggagcctgctctttgaactccgctgccttccttagcagcttctgtcctcttctgtgagtcagtcagcgagtgcttgggatccgcatccagccgtgctgagcacacaacaggctgtgtgtggaaatggccaccaccattctccttccccaccccaccacaaaaagagaagctgtgtctttagacaaccctgaggtatctgtgttacaatcgttctgtgtttgatatttgtgtaaagtatgcatgcagtcttgtactgtgacctaagaacaaaactgtaactgcattagaaaccatgaaaaaattagatattgttttgtgacttttagacagtggtaaatatagaaccatgaattctggtcacattccatttctctccaacatgaaggatcaaaaaatgtttttcaatgtgttctttgttccactggaaacttagagtcatgagtttatgagctgatttggtcaccttcctctgcctttgttcactgtgagttctgatgtcttagtgacttagttcttagaagctcacgccttagtttgaaacagattctccacggtggtccccaaaacactgtctgcatatccataagaattgagcgctatgggtgttaacgtgcatgaggatcagtttgcagcagcaagtacaaaaggagaagaggaacatccgttgaatgagtgtgttttgtacataacttcagatacttgtgaacatgccttatatttgtccaacaactgtcagaataaagaacattctaaaatgagaaaaaaaaaaaaaaaaaaaaaaaaaaaaaaaaaaaaaaccaacgccattgctcagctaacggccacgcttcaacctggtgatgccccggcatactttccagcatagagcgcggaataagcgcaatngcctgctctgcgatcacacaggccaacattccgtgataagactccatctcatggatagttcccnngagcgcaccgtcagcatgaaaccagctctcgaagtgcgacgatccgacaattngcgccgnaggccataaatgtacttgcataacctgactggcacggnttactggcccatatccttgggcgtgaccatcataanttccttccgtattacccgtattccctcgatgg

SEQ ID NO: 371572 - DNA, 3047 bp, Homo sapiens
  misc_feature (2816)..(2816): n is a, c, g, or t
  misc_feature (2880)..(2881): n is a, c, g, or t
  misc_feature (2934)..(2934): n is a, c, g, or t
  misc_feature (2941)..(2941): n is a, c, g, or t
  misc_feature (2979)..(2979): n is a, c, g, or t
  misc_feature (3015)..(3015): n is a, c, g, or t
cgcgttaccccagtgcctgtgttcaagtcacccctattttactccataatggccccaaagcatgggagtaatgatgctggtcaatcagatatgccatagagaagcaatatattgcttcctttaagtgaaaagctgaaagttctcaacccaataaggaaagagaaaagatcgtatcctgaggttgctaagatctatggtcagaacaaatctacccatgatattgtgaagaaggaaaaagaaattcatgtgccatgctgctcaggagaccaggccccatgtgtccacgtgggagttgagggttcatcccgagttactccctgagtcttcaggccacgatggccaagggcttgtgacttctgcaagcgacgtgactggaaaccacgcagcacttcacagggatcctagtgtgttctctgctggtgattccccaggggaggctccttctgcgctgttgccagggccaccccctggtcagcctgaagccactcagctgacagggccaaaacgggctggccaggcagctctgtcagaacgaagccctgtggctgatcggaagcagcctgttcctccaggacgtgctgcgcgttcaagccagtctccaaaaaagccgttcaatagtattattgagcacctgtcagtggtattcccatgttacaacagcactgagcttgctggttttattaaaaaagtgcgaagcaaaaacaagaactcactctcaggattgagtattgatgaaattgtccaaagagtgacagaacacattctagatgaacagaaaaagaaaaagccaaacccaggaaaggacaagaggacttatgagcccagctctgccacccccgtgaccaggtcctcccagggctcaccctcggtggttgttgcaccatcacccaaaaccaaggggcagaaagcagaagatgtccctgtgaggattgcactgggtgcaagttcctgtgaaatatgccacgaggtgttcaaatcaaaaaacgtgcgtgtgctcaaatgtgggcacaagtatcacaaagggtgctttaagcagtggcttaaagggcagagcgcttgcccggcctgccagggtcgtgatctcctgacagaagagtcaccttctggaagaggctggcccagtcagaatcaggagctgccttcctgctcttctaggtagtcacacttcactaaagtgtcatccaccagtgtgttgaatccgaagaatgacaattttctaccactggtgtaaaaaacaaacatttgaagacccttgtgcattgtgtgtcacaaagctaaatacatggaaatcgttaatatcgctgatattaagtaatttccccactctgagtgaatactttgatgattgccaacagtggctaataaaatgacggctaccacactcatgggtcactggggctgcgcagggctctttgaggtgggtggcttcttttggaaagtactatgaacgtctcgaagcagtattctagtgataagaattcttaacatagccaagcgccccacgtttgttccccacgtttgttccccttttctgtttgaaaaacctgttctggtagctccacaagagagatgatactgactttttaaattttttacaagagtctgtattcctgatatgcctatatttttcctcaaagattctgcattttaaggatgggcataagcaaactatattttaataatttatagttaatgttaaaatattggctgatttagaccaaaagattcaaatctcctctttgtgaaatcccatctgcatttgattttttattattttatgttcccccgttagattgttttaagtgtttgcttttcatcttttatagatgtaatctgattttcaaaaatcattaacactttttaattagtatcgactaagactttttccccctggaatcgaggctgtgtgtccgtcatcccagcccccggttggagcctgctctttgaactccgctgccttccttagcagcttctgtcctcttctgtgagtcagtcagcgagtgcttgggatccgcatccagccgtgctgagcacacaacaggctgtgtgtggaaatggccaccaccattctccttccccaccccaccacaaaaagagaagctgtgtctttagacaaccctgaggtatctgtgttacaatcgttctgtgtttgatatttgtgtaaagtatgcatgcagtcttgtactgtgacctaagaacaaaactgtaactgcattagaaaccatgaaaaaattagatattgttttgtgacttttagacagtggtaaatatagaaccatgaattctggtcacattccatttctctccaacatgaaggatcaaaaaatgtttttcaatgtgttctttgttccactggaaacttagagtcatgagtttatgagctgatttggtcaccttcctctgcctttgttcactgtgagttctgatgtcttagtgacttagttcttagaagctcacgccttagtttgaaacagattctccacggtggtccccaaaacactgtctgcatatccataagaattgagcgctatgggtgttaacgtgcatgaggatcagtttgcagcagcaagtacaaaaggagaagaggaacatccgttgaatgagtgtgttttgtacataacttcagatacttgtgaacatgccttatatttgtccaacaactgtcagaataaagaacattctaaaatgagaaaaaaaaaaaaaaaaaaaaaaaaaaaaaaaaaaaaaaccaacgccattgctcagctaacggccacgcttcaacctggtgatgccccggcatactttccagcatagagcgcggaataagcgcaatngcctgctctgcgatcacacaggccaacattccgtgataagactccatctcatggatagttcccnngagcgcaccgtcagcatgaaaccagctctcgaagtgcgacgatccgacaattngcgccgnaggccataaatgtacttgcataacctgactggcacggnttactggcccatatccttgggcgtgaccatcataanttccttccgtattacccgtattccctcgatgg

SEQ ID NO: 371573 - DNA, 5919 bp, Homo sapiens
ctgaactagttgccagtgatcttgaaacgtgacagtaaccaagagataaataggtgacaatgacaggaaaattagatgtagtaaaagagagtgtttgagagcagaagctatggcaactaaagactggatttgaatccttcctagcttggtgacatgagcaaattacttgatttaagtgagcattttcccatctgtacagtggagataacgataattgtgcctgctaagaagaattgctgtgaagattagtgaaataatgcatgtaaaacatttggtacagtatgtgacacatagtacaaatagtttgctaggaagattgttattattcttcacttgtgatattgtgaagttttcatacagcaaattggacatcatgagatggattgattaaataaatagatttgaacttcaaggactggtagtgttcttgctttggaaagaagaaacttggtttatcctaataatagtaggataataatggtgaagtgataggtacaagtaatagtgtttatgatgcgctggtgatgataggaaaagaaagccattatatgggcaagagctagaagtaataaaatggtgcatttttcagtgatgtttggcctatgtagctattctctgataactataaaaatccttattattgaagattcttcaggaaaaaaaaacccttagtctgaaactttagcaccaatcccccttgccccccattgaaatacgtatttttaaaacatggcttttgataatgtgagggttttttcctttttgcgatttagcagtgctgattgtgtattgcagtagttgtgagagcattagaagcagcagtcgataggaggatggaaggtctggatgccgccttggggagttaggagattggcagacttaccctgtaccactctagccctactcctttgcccaagacagaaacacactgagatggataggagaatatgagcagttgataggaaagttctcagtggagtcaggatttaggttaggccaggagattgagaatataacagtttgtgtatgatgaaatggcatatttcacagaatgcagtaaaagcaggtagggtacaagtgcagcaacaggaagatgtcttttcttcattcagcaaacacttatttgagagcttaccatgtgctaggcacatacaaagataaataagatgcccttgatgatcctctatttaaaggagacatgtacaattcacgtgcttctgagataaatttgaagaaactacaacatcttgagttgatggaagatattgtggatttggcaaagaaagttgctaatgattcattccttattggaggcttattgagaattggttgtaaaatagaaaataaaatcttggcaatggaagaagctctgaattggataaaatatgcaggcgatgtaacaattctaactaaattaggatcaattgacaattgttggcctatgttaagtattttctttactgaatacaagtaccacataactaaaattgtaatggaagactgcaatttgcttgaagaacttaaaactcaaagttgtatggattgtatagaggaaggagaactaatgaaaatgaaaggaaatgaagagttttccaaagaaagatttgatatagctattatctattacaccagagccattgaatatagacctgaaaactaccttctttatggtaaccgagctctttgttttcttcgtactggacagtttagaaatgcactcggtgatggaaagagagccactattctgaagaacacttggccaaagggtcattatcgttattgtgatgctctttctatgctgggggaatatgactgggccctgcaagcaaacataaaagctcaaaaactctgtaaaaatgaccctgagggaatcaaggatctaattcagcagcatgtaaagttacaaaaacaaatagaagacctacaaggtcgaacagcaaataaggatccaattaaagccttttatgaaaacagggcctacacacctaggagtttatcagcacctatatttactacttcacttaactttgtggagaaggaaagagatttcagaaaaattaatcacgaaatggccaacggtggtaatcagaatctaaaggtggcggatgaggcgttgaaggtagatgattgtgactgtcatcctgaattttcaccaccatcaagtcagcctccaaaacataaaggaaaacaaaaatctcgaaacaatgaatcagaaaagttcagttctagttcaccattgactttaccagcagatttgaagaacatcttggagaaacagttttctaaatcttccagagctgcacaccaggattttgctaatataatgaaaatgctgagaagcttaattcaagatggctatatggccttattggagcagcgttgccgcagcgctgcacaggcctttacagagttgctgaacggtttagatcctcaaaaaataaagcaattgaacctggccatgattaactatgttttggtcgtctatggacttgccatttctctccttggaataggacagcctgaggaattatctgaagccgaaaaccagtttaagaggattattgaacactaccccagtgagggccttgattgcttggcctactgtggaattggaaaagtgtatttgaaaaaaaacagatttctagaagctctcaatcactttgagaaagcaagaaccttgatttatcgtcttcctggagtgttaacttggcccacgagtaatgtgattattgaagagtctcagccacaaaaaataaagatgctgttagagaaatttgttgaagaatgcaagttccctccagtgccagatgccatttgttgctatcagaagtgccatggatattctaagatccagatatacataactgatccagactttaagggttttatacgcatcagctgttgccagtactgtaaaatagaatttcacatgaattgctggaagaagttaaaaactacaacctttaatgataaaattgacaaggattttctacaaggaatatgtcttacccctgactgtgaaggtgtcatttctaagattatcatcttcagcagtggtggtgaagttaaatgtgaatttgaacacaaggtcataaaagaaaaggttcctccaagacctattctgaaacagaaatgttctagcctagagaaactaagactgaaagaagacaaaaaattgaagagaaagatccaaaaaaaagaagcaaaaaagttagcacaagaaagaatggaggaggacttaagagaaagtaatccacccaaaaatgaagagcagaaagaaactgtagacaatgttcagcgttgtcagttccttgatgacagaattctacagtgtataaagcagtatgctgacaagattaaatccggcatacagaatacagccatgcttctcaaagaattgctttcttggaaagttttgagcacagaagactatacaacctgtttttctagcagaaattttctaaatgaagcagtggactatgttattcgccacttgattcaagaaaataacagagtaaagacaagaatatttctgcatgttttgagtgagcttaaagaagtggagcccaaattagccgcctggatccaaaaacttaatagctttggcttagatgccacaggaactttcttttctcgttatggagcatctcttaaactgcttgattttagtatcatgactttcctctggaatgagaaatatggtcacaaactagactctatagaaggaaagcaacttgattatttctctgagccagcatcattgaaggaagcccgttgtttaatatggctgctagaagaacacagagacaagttcccagcattgcatagtgctttagatgaattctttgatataatggacagccgctgtactgtgttaaggaaacaagatagtggtgaagcaccgtttagttcaaccaaggtgaaaaacaaaagcaagaaaaagaagccaaaggattcaaagcctatgttagttgggtctggaacaacttcagtaacttcaaataatgagatcatcacttcaagtgaagaccatagcaatcgaaattcagattctgcaggcccatttgcagtgcctgaccatcttcggcaagatgtagaagaattcgaagctctctatgaccaacacagtaacgaatatgttgtccgcaataagaagctatgggacatgaacccaaaacaaaaatgttcaactctatatgattacttctctcagtttttggaggaacatggtcccttggacatgagtaacaagatgttctctgcagaatatgagtttttcccagaagaaactcgacagatactagaaaaagcaggaggtttaaaaccttttctcttgggatgccctcgttttgttgtgattgacaactgtattgcactgaagaaggttgcatcacggctcaagaaaaaaaggaagaagaaaaacattaaaacaaaagtagaagaaatttcaaaagcaggggagtatgtacgagttaaactacaactgaatccagctgctagggaatttaaaccagatgtaaagtctaaaccagtgtcagattcatcttcagcaccagcttttgaaaatgtgaaacccaaacctgtgtctgcaaattctcccaagccagcttgtgaagatgtgaaggccaaaccagtatccgacaattcttctagacaagtttctgaggatgggcaacccaaaggggtctcttctaattctcctaaaccaggctctgaggatgcaaattacaagcgagtctcctgtaattcccccaaaccggttcttgaggatgtgaaaccaacttattgggctcaatcccatttggtcacaggatactgtacgtatcttcctttccagagatttgatatcacccagacaccgccagcatacataaacgtgttaccaggtttgccccagtacaccagcatatatacacccttggccagcctttctcctgaatatcagctaccaagatcagtaccagtggtgccgtcttttgtagccaatgacagagcagataaaaatgctgctgcctattttgagggtcatcatttgaatgctgagaatgttgctggtcaccagattgcctctgaaacacagatccttgagggctctttgggaatatctgtaaagtcacactgcagcacaggtgatgctcatacagtcctgagtgagtctaacagaaatgatgagcactgtggaaattctaacaacaaatgtgaagtaattccagaaagcaccagtgcagtaacaaacattccacacgtgcagatggttgccatacaggtatcttggaacataatacaccaagaagtcaatactgagccatataatccttttgaggaacgacaaggggaaatttcacggattgaaaaggagcaccaagtattacaagaccaacttcaagaagtgtatgaaaattatgagcagataaaacttaagggcttagaagagaccagggacctggaagagaagttgaaaaggcacttagaagaaaacaagatctcaaagacggaattagattggttccttcaagatttggaaagagaaattaaaaaatggcaacaggaaaaaaaagaaatccaagaaagactaaaatcactgaagaagaaaattaaaaaggtttcaaatgccagtgaaatgtatacccagaaaaatgatggaaaggaaaaggaacatgaattacatctggatcagtcccttgaaatcaggcaaattaagcttaaatttatttttaatatattttaatacttttaatgccaggagtacaagcacagtagactttgaaatatattgttgcttgtctatttcttttaaataattatgtttctgttttctttatttctatttctgttgcattttaaaaattaatttataaatatattctttgaatatttaaatatttttattttacaagatttctgcatttatttcccatt

SEQ ID NO: 371574 - DNA, 3394 bp, Homo sapiens
ctgaactagttgccagtgatcttgaaacgtgacagtaaccaagagataaataggtgacaatgacaggaaaattagatgtagtaaaagagagtgtttgagagcagaagctatggcaactaaagactggatttgaatccttcctagcttggtgacatgagcaaattacttgatttaagtgagcattttcccatctgtacagtggagataacgataattgtgcctgctaagaagaattgctgtgaagattagtgaaataatgcatgtaaaacatttggtacagtatgtgacacatagtacaaatagtttgctaggaagattgttattattcttcacttgtgatattgtgaagttttcatacagcaaattggacatcatgagatggattgattaaataaatagatttgaacttcaaggactggtagtgttcttgctttggaaagaagaaacttggtttatcctaataatagtaggataataatggtgaagtgataggtacaagtaatagtgtttatgatgcgctggtgatgataggaaaagaaagccattatatgggcaagagctagaagtaataaaatggtgcatttttcagtgatgtttggcctatgtagctattctctgataactataaaaatccttattattgaagattcttcaggaaaaaaaaacccttagtctgaaactttagcaccaatcccccttgccccccattgaaatacgtatttttaaaacatggcttttgataatgtgagggttttttcctttttgcgatttagcagtgctgattgtgtattgcagtagttgtgagagcattagaagcagcagtcgataggaggatggaaggtctggatgccgccttggggagttaggagattggcagacttaccctgtaccactctagccctactcctttgcccaagacagaaacacactgagatggataggagaatatgagcagttgataggaaagttctcagtggagtcaggatttaggttaggccaggagattgagaatataacagtttgtgtatgatgaaatggcatatttcacagaatgcagtaaaagcaggtagggtacaagtgcagcaacaggaagatgtcttttcttcattcagcaaacacttatttgagagcttaccatgtgctaggcacatacaaagataaataagatgcccttgatgatcctctatttaaaggagacatgtacaattcacgtgcttctgagataaatttgaagaaactacaacatcttgagttgatggaagatattgtggatttggcaaagaaagttgctaatgattcattccttattggaggcttattgagaattggttgtaaaatagaaaataaaatcttggcaatggaagaagctctgaattggataaaatatgcaggcgatgtaacaattctaactaaattaggatcaattgacaattgttggcctatgttaagtattttctttactgaatacaagtaccacataactaaaattgtaatggaagactgcaatttgcttgaagaacttaaaactcaaagttgtatggattgtatagaggaaggagaactaatgaaaatgaaaggaaatgaagagttttccaaagaaagatttgatatagctattatctattacaccagagccattgaatatagacctgaaaactaccttctttatggtaaccgagctctttgttttcttcgtactggacagtttagaaatgcactcggtgatggaaagagagccactattctgaagaacacttggccaaagggtcattatcgttattgtgatgctctttctatgctgggggaatatgactgggccctgcaagcaaacataaaagctcaaaaactctgtaaaaatgaccctgagggaatcaaggatctaattcagcagcatgtaaagttacaaaaacaaatagaagacctacaaggtcgaacagcaaataaggatccaattaaagccttttatgaaaacagggcctacacacctaggagtttatcagcacctatatttactacttcacttaactttgtggagaaggaaagagatttcagaaaaattaatcacgaaatggccaacggtggtaatcagaatctaaaggtggcggatgaggcgttgaaggtagatgattgtgactgtcatcctgaattttcaccaccatcaagtcagcctccaaaacataaaggaaaacaaaaatctcgaaacaatgaatcagaaaagttcagttctagttcaccattgactttaccagcagatttgaagaacatcttggagaaacagttttctaaatcttccagagctgcacaccaggattttgctaatataatgaaaatgctgagaagcttaattcaagatggctatatggccttattggagcagcgttgccgcagcgctgcacaggcctttacagagttgctgaacggtttagatcctcaaaaaataaagcaattgaacctggccatgattaactatgttttggtcgtctatggacttgccatttctctccttggaataggacagcctgaggaattatctgaagccgaaaaccagtttaagaggattattgaacactaccccagtgagggccttgattgcttggcctactgtggaattggaaaagtgtatttgaaaaaaaacagatttctagaagctctcaatcactttgagaaagcaagaaccttgatttatcgtcttcctggagtgttaacttggcccacgagtaatgtgattattgaagagtctcagccacaaaaaataaagatgctgttagagaaatttgttgaagaatgcaagttccctccagtgccagatgccatttgttgctatcagaagtgccatggatattctaagatccagatatacataactgatccagactttaaggattttctacaaggaatatgtcttacccctgactgtgaaggtgtcatttctaagattatcatcttcagcagtggtggtgaagttaaatgtgaatttgaacacaaggtcataaaagaaaaggttcctccaagacctattctgaaacagaaatgttctagcctagagaaactaagactgaaagaagacaaaaaattgaagagaaagatccaaaaaaaagaagcaaaaaagttagcacaagaaagaatggaggaggacttaagagaaagtaatccacccaaaaatgaagagcagaaagaaactgtagacaatgttcagcgttgtcagttccttgatgacagaattctacagtgtataaagcagtatgctgacaagattaaatccggcatacagaatacagccatgcttctcaaagaattgctttcttggaagttggccagagactatcaccgtttctaggcgaattcttatggcgggctgtttgcctgttcgaattcggtgacgatttgcgggggc

SEQ ID NO: 371575 - DNA, 1436 bp, Homo sapiens
cttcaacgccgccacccgctccctcccgccgtcggctgacgtggagggccggaggtggcggcggcggcggcggcggctgctgctgctgctgctgcccgcgtccgaggctcgcgggcggcgggcccggtgtgcaccatggacaattttgctgagggagatttcactgtggcggattatgccttgttagaagattgccctcacgtggatgattgtgtctttgctgctgaatttatgagcaatgattatgttcgtgtgactcagctttactgtgatggggtgggtgtgcaatataaagattatatccaaagtgagaggaatttggaatttgacatctgcagtatatggtgtagtaaaccaatttctgtcctgcaagattattgcgatgccattaaaataaacatcttctggccacttctgtttcaacatcaaaacagttccgtaatatcacgattgcatccctgtgtggacgccaacaattcacgtgcttctgagataaatttgaagaaactacaacatcttgagttgatggaagatattgtggatttggcaaagaaagttgctaatgattcattccttattggaggcttattgagaattggttgtaaaatagaaaataaaatcttggcaatggaagaagctctgaattggataaaatatgcaggcgatgtaacaattctaactaaattaggatcaattgacaattgttggcctatgttaagtattttctttactgaatacaagtaccacataactaaaattgtaatggaagactgcaatttgcttgaagaacttaaaactcaaagttgtatggattgtatagaggaaggagaactaatgaaaatgaaaggaaatgaagagttttccaaagaaagatttgatatagctattatctattacaccagagccattgaatatagacctgaaaactaccttctttatggtaaccgagctctttgttttcttcgtactggacagtttagaacacattctcatggtagaaaatttggaaaatacaagagtttaaaaagaagaaaataaaaatcaccagtaatccaaccaccttggagaataccgctgtattaacgttatgcagcttttagatggcttaagccgtggataaaccgaggctatctagactagaggaatggatgggcttgacacagtcttccatcaataccactgtcctcaacgggttctgacaagaaatgagctgcacatgtctttaggttattgctactggctaggtccagaattgcatttattttgtgctgtttgaaggtgaatttgtatgctttcaagatcagatgaataggttggcaacttggctagcctcttgtgaaaattgaggtgcctgtctgaaatattgcctggcagaaggttttccactttccacttctgagagctgagaggcacaccagggtgtttctgctctcttt

SEQ ID NO: 371576 - DNA, 963 bp, Homo sapiens
cttcaacgccgccacccgctccctcccgccgtcggctgacgtggagggccggaggtggcggcggcggcggcggcggctgctgctgctgctgctgcccgcgtccgaggctcgcgggcggcgggcccggtgtgcaccatggacaattttgctgagggagatttcactgtggcggattatgccttgttagaagattgccctcacgtggatgattgtgtctttgctgctgaatttatgagcaatgattatgttcgtgtgactcagctttactgtgatggggtgggtgtgcaatataaagattatatccaaagtgagaggaatttggaatttgacatctgcagtatatggtgtagtaaaccaatttctgtcctgcaagattattgcgatgccattaaaataaacatcttctggccacttctgtttcaacatcaaaacagttccgtaatatcacgattgcatccctgtgtggacgccaacaattcacgtgcttctgagataaatttgaagaaactacaacatcttgagttgatggaagatattgtggatttggcaaagaaagttgctaatgattcattccttattggaggcttattgagaattggttgtaaaatagaaaataaaatcttggcaatggaagaagctctgaattggataaaatatgcaggcgatgtaacaattctaactaaattaggatcaattgacaattgttggcctatgttaagtattttctttactgaatacaagtaccacataactaaaattgtaatggaagactgcaatttgcttgaagaacttaaaactcaaagttgtatggattgtatagaggaaggagaactaatgaaaatgaaaggaaatgaagagttttccaaagaaagatttgatatagctattatctattacaccagagccattgaatataggtaagagcaaatagaacaaaagagatgctttttctatggcacatca

SEQ ID NO: 371577 - DNA, 823 bp, Homo sapiens
gcttcccccaacgcaacatctaggttcttaggaaacttcatttgttgtgaaaatcggaaatgaaaagacagttggtgacaaactcctttctccatcacctccttattggacagaaacgacccaggaatgcgcctcgcaagccaaagaagaagaagaggaagaggaaagaagaagaagaggaagaggaagaagaagaagaagaagaagaagaagaagaagaagaagaagaagaagaagaagaagaagaaaagaagaagaagaagaagaggaagaagaagaagaatgcagcagtaggttgtttacagattggtcacgagtcttggcaagaaagtctgaagacgggaccagctgcacatgttttaccctaagagcttgctatataaaggatactttctggaaggctggttggtgtgaggattcagtcttgcagccactcgagacatcacttctgttcgagaaaccaggagctctaagagaatgtataatgagaacttctatgtgtggagagttaaacaagaagctgtctcatcccagggaagatgaagagaaaatggcggatctgggcttgaagtgcacacagtgttggaaaaggccccacctaaggctctaggaccagcagtccctgagaagtagctgtgtgtaggattaagacaagctgactgcggagagctgtgacattgggcattcaagcatgaagcattgttggcccagagagggtgcacaagcattctccctcagagaaccatggtgttccagagccagagagagatggagagcttccacaatccttgtgaagatctgttatcctaacaccaatatatcc

SEQ ID NO: 371578 - DNA, 2228 bp, Homo sapiens
aagggaggaggcgccgagctgaccgggcgacgccgcgggaggttctggaaacgccgggagctgcgagtgtccagctgcggagacccgtgataattcgttaactaattcaacaaacgggacccttctgtgtgccagaaaccgcaagcagttgctaacccagtgggacaggcggattggaagagcgggaaggtcctggcccagagcagtgtgacacttccctctgtgaccatgaaactctgggtgtctgcattgctgatggcctggtttggtgtcctgagctgtgtgcaggccgaattcttcacctctattgggcacatgactgacctgatttatgcagagaaagagctggtgcagtctctgaaagagtacatccttgtggaggaagccaagctttccaagattaagagctgggccaacaaaatggaagccttgactagcaagtcagctgctgatgctgagggctacctggctcaccctgtgaatgcctacaaactggtgaagcggctaaacacagactggcctgcgctggaggaccttgtcctgcaggactcagctgcaggttttatcgccaacctctctgtgcagcggcagttcttccccactgatgaggacgagataggagctgccaaagccctgatgagacttcaggacacatacaggctggacccaggcacaatttccagaggggaacttccaggaaccaagtaccaggcaatgctgagtgtggatgactgctttgggatgggccgctcggcctacaatgaaggggactattatcatacggtgttgtggatggagcaggtgctaaagcagcttgatgccggggaggaggccaccacaaccaagtcacaggtgctggactacctcagctatgctgtcttccagttgggtgatctgcaccgtgccctggagctcacccgccgcctgctctcccttgacccaagccacgaacgagctggagggaatctgcggtactttgagcagttattggaggaagagagagaaaaaacgttaacaaatcagacagaagctgagctagcaaccccagaaggcatctatgagaggcctgtggactacctgcctgagagggatgtttacgagagcctctgtcgtggggagggtgtcaaactgacaccccgtagacagaagaggcttttctgtaggtaccaccatggcaacagggccccacagctgctcattgcccccttcaaagaggaggacgagtgggacagcccgcacatcgtcaggtactacgatgtcatgtctgatgaggaaatcgagaggatcaaggagatcgcaaaacctaaacttgcacgagccaccgttcgtgatcccaagacaggagtcctcactgtcgccagctaccgggtttccaaaagctcctggctagaggaagatgatgaccctgttgtggcccgagtaaatcgtcggatgcagcatatcacagggttaacagtaaagactgcagaattgttacaggttgcaaattatggagtgggaggacagtatgaaccgcacttcgacttctctaggcgaccttttgacagcggcctcaaaacagaggggaataggttagcgacgtttcttaactacatgagtgatgtagaagctggtggtgccaccgtcttccctgatctgggggctgcaatttggcctaagaagggtacagctgtgttctggtacaacctcttgcggagcggggaaggtgactaccgaacaagacatgctgcctgccctgtgcttgtgggctgcaagtgggtctccaataagtggttccatgaacgaggacaggagttcttgagaccttgtggatcaacagaagttgactgacatccttttctgtccttccccttcctggtccttcagcccatgtcaacgtgacagacacctttgtatgttcctttgtatgttcctatcaggctgatttttggagaaatgaatgtttgtctggagcagagggagaccatactagggcgactcctgtgtgactgaagtcccagcccttccattcagcctgtgccatccctggccccaaggctaggatcaaagtggctgcagcagagttagctgtctagcgcctagcaaggtgcctttgtacctcaggtgttttaggtgtgagatgtttcagtgaaccaaagttctgataccttgtttacatgtttgtttttatggcatttctatctattgtggctttaccaaaaaataaaatgtccctaccagaagcctta

SEQ ID NO: 371579 - DNA, 3517 bp, Homo sapiens
aagggaggaggcgccgagctgaccgggcgacgccgcgggaggttctggaaacgccgggagctgcgagtgtccagacatccttgtggaaccagcgttgtttttccttggcagctgcggagacccgtgataattcgttaactaattcaacaaacgggacccttctgtgtgccagaaaccgcaagcagttgctaacccagtgggacaggcggattggaagagcgggaaggtcctggcccagagcagtgtggtgagcgctgtgctggaagggaatgcgggcagtgggtacttggtagagcactgactgcctccggccagaggacttcccggaggaggtgacccatgagctggagtggtcagaggaaggctggcaaaagggcatcgtggacagaggaacagcctatgtgagtgggagcagagaccttggccaatgccattccttatggccttgtagtggaagcaaggtgatggggaaggaacactgtaggggatagctgtccacggacgctgtctacaagaccctggagtgagataacgtgcctggtactgtgccctgcatgtgtaagatgcccagttgaccttcgcagcaggagcctggatcagggcacttcctgcctcaggtattgctggacagcccagacacttccctctgtgaccatgaaactctgggtgtctgcattgctgatggcctggtttggtgtcctgagctgtgtgcaggccgaattcttcacctctattgggcacatgactgacctgatttatgcagagaaagagctggtgcagtctctgaaagagtacatccttgtggaggaagccaagctttccaagattaagagctgggccaacaaaatggaagccttgactagcaagtcagctgctgatgctgagggctacctggctcaccctgtgaatgcctacaaactggtgaagcggctaaacacagactggcctgcgctggaggaccttgtcctgcaggactcagctgcaggttttatcgccaacctctctgtgcagcggcagttcttccccactgatgaggacgagataggagctgccaaagccctgatgagacttcaggacacatacaggctggacccaggcacaatttccagaggggaacttccaggaaccaagtaccaggcaatgctgagtgtggatgactgctttgggatgggccgctcggcctacaatgaaggggactattatcatacggtgttgtggatggagcaggtgctaaagcagcttgatgccggggaggaggccaccacaaccaagtcacaggtgctggactacctcagctatgctgtcttccagttgggtgatctgcaccgtgccctggagctcacccgccgcctgctctcccttgacccaagccacgaacgagctggagggaatctgcggtactttgagcagttattggaggaagagagagaaaaaacgttaacaaatcagacagaagctgagctagcaaccccagaaggcatctatgagaggcctgtggactacctgcctgagagggatgtttacgagagcctctgtcgtggggagggtgtcaaactgacaccccgtagacagaagaggcttttctgtaggtaccaccatggcaacagggccccacagctgctcattgcccccttcaaagaggaggacgagtgggacagcccgcacatcgtcaggtactacgatgtcatgtctgatgaggaaatcgagaggatcaaggagatcgcaaaacctaaacttgcacgagccaccgttcgtgatcccaagacaggagtcctcactgtcgccagctaccgggtttccaaaagctcctggctagaggaagatgatgaccctgttgtggcccgagtaaatcgtcggatgcagcatatcacagggttaacagtaaagactgcagaattgttacaggttgcaaattatggagtgggaggacagtatgaaccgcacttcgacttctctaggaatgatgagcgagatactttcaagcatttagggacggggaatcgtgtggctactttcttaaactacatgagtgatgtagaagctggtggtgccaccgtcttccctgatctgggggctgcaatttggcctaagaagggtacagctgtgttctggtacaacctcttgcggagcggggaaggtgactaccgaacaagacatgctgcctgccctgtgcttgtgggctgcaagtgggtctccaataagtggttccatgaacgaggacaggagttcttgagaccttgtggatcaacagaagttgactgacatccttttctgtccttccccttcctggtccttcagcccatgtcaacgtgacagacacctttgtatgttcctttgtatgttcctatcaggctgatttttggagaaatgaatgtttgtctggagcagagggagaccatactagggcgactcctgtgtgactgaagtcccagcccttccattcagcctgtgccatccctggccccaaggctaggatcaaagtggctgcagcagagttagctgtctagcgcctagcaaggtgcctttgtacctcaggtgttttaggtgtgagatgtttcagtgaaccaaagttctgataccttgtttacatgtttgtttttatggcatttctatctattgtggctttaccaaaaaataaaatgtccctaccagaagccttaaagagccttacttggagtatttttaagactggaagcttttaccaggttcatcatttcctatgcatcaccttcatgcaggcagagtctggataatgaatgctttagcagcaaaaaagcatcttgggtcttggatttcagacctggtttcaacacttgtgttccctctaagtgtcagtgtccttttctggaaagtagggtaaatagtttctctttgtctcccagagaacatagcacatgtgttcatgattgtaatgctgttataatgtgtacttcatttttaaattttgagataagaattgttcatgatacacagatgtatacttaaaaaaatatgaaggtgagcaggagcacctgtgtcaacaccaagttagaaaagagaacgttttcaagtcagtacctcaggagccccttgggaacccctcctagatcacatctccttcactgcccccagcactttggagataaatcattgtctcatgatgtgtggtactcattcctttgcttgtctttatagttttaccatctatgattagatccctaaataagtagttattctgttttccctgattttgaacttttactaatagaatgagagtaaatatttttgggtatgtggcttcttttgttcaacattgttttaagattcatccgtgttgcttgtgtagctgtaatttgttttaatctttatagtacattcagttttgttaatgcttattgtaggactgtaccataatacaggcagcatgctgctgataaacactggaattgatttcagtctttgtatattgtgaataatgctgtgataaacatttttatacatgattcctggtgcacatataaacacatatttctgtagg

SEQ ID NO: 371580 - DNA, 2054 bp, Homo sapiens
gcctcgtgccgaatcggcacgagggcgagtgtccagacacttccctctgtgaccatgaaactctgggtgtctgcattgctgatggcctggtttggtgtcctgagctgtgtgcaggccgaattcttcacctctattgggcacatgactgacctgatttatgcagagaaagagctggtgcagtctctgaaagagtacatccttgtggaggaagccaagctttccaagattaagagctgggccaacaaaatggaagccttgactagcaagtcagctgctgatgctgagggctacctggctcaccctgtgaatgcctacaaactggtgaagcggctaaacacagactggcctgcgctggaggaccttgtcctgcaggactcagctgcaggttttatcgccaacctctctgtgcagcggcagttcttccccactgatgaggacgagataggagctgccaaagccctgatgagacttcaggacacatacaggctggacccaggcacaatttccagaggggaacttccaggaaccaagtaccaggcaatgctgagtgtggatgactgctttgggatgggccgctcggcctacaatgaaggggactattatcatacggtgttgtggatggagcaggtgctaaagcagcttgatgccggggaggaggccaccacaaccaagtcacaggtgctggactacctcagctatgctgtcttccagttgggtgatctgcaccgtgccctggagctcacccgccgcctgctctcccttgacccaagccacgaacgagctggagggaatctgcggtactttgagcagttattggaggaagagagagaaaaaacgttaacaaatcagacagaagctgagctagcaaccccagaaggcatctatgagaggcctgtggactacctgcctgagagggatgtttacgagagcctctgtcgtggggagggtgtcaaactgacaccccgtagacagaagaggcttttctgtaggtaccaccatggcaacagggccccacagctgctcattgcccccttcaaagaggaggacgagtgggacagcccgcacatcgtcaggtactacgatgtcatgtctgatgaggaaatcgagaggatcaaggagatcgcaaaacctaaacttgcacgagccaccgttcgtgatcccaagacaggagtcctcactgtcgccagctaccgggtttccaaaagctcctggctagaggaagatgatgaccctgttgtggcccgagtaaatcgtcggatgcagcatatcacagggttaacagtaaagactgcagaattgttacaggttgcaaattatggagtgggaggacagtatgaaccgcacttcgacttctctaggcgaccttttgacagcggcctcaaaacagaggggaataggttagcgacgtttcttaactacatgagtgatgtagaagctggtggtgccaccgtcttccctgatctgggggctgcaatttggcctaagaagggtacagctgtgttctggtacaacctcttgcggagcggggaaggtgactaccgaacaagacatgctgcctgccctgtgcttgtgggctgcaagtgggtctccaataagtggttccatgaacgaggacaggagttcttgagaccttgtggatcaacagaagttgactgacatccttttctgtccttccccttcctggtccttcagcccatgtcaacgtgacagacacctttgtatgttcctttgtatgttcctatcaggctgatttttggagaaatgaatgtttgtctggagcagagggagaccatactagggcgactcctgtgtgactgaagtcccagcccttccattcagcctgtgccatccctggccccaaggctaggatcaaagtggctgcagcagagttagctgtctagcgcctagcaaggtgcctttgtacctcaggtgttttaggtgtgagatgtttcagtgaaccaaagttctgataccttgtttacatgtttgtttttatggcatttctatctattgtggctttaccaaaaaataaaatgtccctaccagaagcctta

SEQ ID NO: 371581 - DNA, 2382 bp, Homo sapiens
aagggaggaggcgccgagctgaccgggcgacgccgcgggaggttctggaaacgccgggagctgcgagtgtccagctgcggagacccgtgataattcgttaactaattcaacaaacgggacccttctgtgtgccagaaaccgcaagcagttgctaacccagtgggacaggcggattggaagagcgggaaggtcctggcccagagcagtgtggtgagcgctgtgctggaagggaatgcgggcagtgggtacttggtagagcactgactgcctccggccagaggacttcccggaggaggtgacccatgagctggagtggtcagaggaaggctggcaaaagggcatcgtggacagaggaacagcctatacacttccctctgtgaccatgaaactctgggtgtctgcattgctgatggcctggtttggtgtcctgagctgtgtgcaggccgaattcttcacctctattgggcacatgactgacctgatttatgcagagaaagagctggtgcagtctctgaaagagtacatccttgtggaggaagccaagctttccaagattaagagctgggccaacaaaatggaagccttgactagcaagtcagctgctgatgctgagggctacctggctcaccctgtgaatgcctacaaactggtgaagcggctaaacacagactggcctgcgctggaggaccttgtcctgcaggactcagctgcaggttttatcgccaacctctctgtgcagcggcagttcttccccactgatgaggacgagataggagctgccaaagccctgatgagacttcaggacacatacaggctggacccaggcacaatttccagaggggaacttccaggaaccaagtaccaggcaatgctgagtgtggatgactgctttgggatgggccgctcggcctacaatgaaggggactattatcatacggtgttgtggatggagcaggtgctaaagcagcttgatgccggggaggaggccaccacaaccaagtcacaggtgctggactacctcagctatgctgtcttccagttgggtgatctgcaccgtgccctggagctcacccgccgcctgctctcccttgacccaagccacgaacgagctggagggaatctgcggtactttgagcagttattggaggaagagagagaaaaaacgttaacaaatcagacagaagctgagctagcaaccccagaaggcatctatgagaggcctgtggactacctgcctgagagggatgtttacgagagcctctgtcgtggggagggtgtcaaactgacaccccgtagacagaagaggcttttctgtaggtaccaccatggcaacagggccccacagctgctcattgcccccttcaaagaggaggacgagtgggacagcccgcacatcgtcaggtactacgatgtcatgtctgatgaggaaatcgagaggatcaaggagatcgcaaaacctaaacttgcacgagccaccgttcgtgatcccaagacaggagtcctcactgtcgccagctaccgggtttccaaaagctcctggctagaggaagatgatgaccctgttgtggcccgagtaaatcgtcggatgcagcatatcacagggttaacagtaaagactgcagaattgttacaggttgcaaattatggagtgggaggacagtatgaaccgcacttcgacttctctaggcgaccttttgacagcggcctcaaaacagaggggaataggttagcgacgtttcttaactacatgagtgatgtagaagctggtggtgccaccgtcttccctgatctgggggctgcaatttggcctaagaagggtacagctgtgttctggtacaacctcttgcggagcggggaaggtgactaccgaacaagacatgctgcctgccctgtgcttgtgggctgcaagtgggtctccaataagtggttccatgaacgaggacaggagttcttgagaccttgtggatcaacagaagttgactgacatccttttctgtccttccccttcctggtccttcagcccatgtcaacgtgacagacacctttgtatgttcctttgtatgttcctatcaggctgatttttggagaaatgaatgtttgtctggagcagagggagaccatactagggcgactcctgtgtgactgaagtcccagcccttccattcagcctgtgccatccctggccccaaggctaggatcaaagtggctgcagcagagttagctgtctagcgcctagcaaggtgcctttgtacctcaggtgttttaggtgtgagatgtttcagtgaaccaaagttctgataccttgtttacatgtttgtttttatggcatttctatctattgtggctttaccaaaaaataaaatgtccctaccagaagcctta

SEQ ID NO: 371582 - DNA, 2155 bp, Homo sapiens
gcttcccccaacgcaacatctaggttcttaggaaacttcatttgttgtgaaaatcggaaatgaaaagacagttggtgacaaactcctttctccatcacctccttattggacagaaacgacccaggaatgcgcctcgcacacttccctctgtgaccatgaaactctgggtgtctgcattgctgatggcctggtttggtgtcctgagctgtgtgcaggccgaattcttcacctctattgggcacatgactgacctgatttatgcagagaaagagctggtgcagtctctgaaagagtacatccttgtggaggaagccaagctttccaagattaagagctgggccaacaaaatggaagccttgactagcaagtcagctgctgatgctgagggctacctggctcaccctgtgaatgcctacaaactggtgaagcggctaaacacagactggcctgcgctggaggaccttgtcctgcaggactcagctgcaggttttatcgccaacctctctgtgcagcggcagttcttccccactgatgaggacgagataggagctgccaaagccctgatgagacttcaggacacatacaggctggacccaggcacaatttccagaggggaacttccaggaaccaagtaccaggcaatgctgagtgtggatgactgctttgggatgggccgctcggcctacaatgaaggggactattatcatacggtgttgtggatggagcaggtgctaaagcagcttgatgccggggaggaggccaccacaaccaagtcacaggtgctggactacctcagctatgctgtcttccagttgggtgatctgcaccgtgccctggagctcacccgccgcctgctctcccttgacccaagccacgaacgagctggagggaatctgcggtactttgagcagttattggaggaagagagagaaaaaacgttaacaaatcagacagaagctgagctagcaaccccagaaggcatctatgagaggcctgtggactacctgcctgagagggatgtttacgagagcctctgtcgtggggagggtgtcaaactgacaccccgtagacagaagaggcttttctgtaggtaccaccatggcaacagggccccacagctgctcattgcccccttcaaagaggaggacgagtgggacagcccgcacatcgtcaggtactacgatgtcatgtctgatgaggaaatcgagaggatcaaggagatcgcaaaacctaaacttgcacgagccaccgttcgtgatcccaagacaggagtcctcactgtcgccagctaccgggtttccaaaagctcctggctagaggaagatgatgaccctgttgtggcccgagtaaatcgtcggatgcagcatatcacagggttaacagtaaagactgcagaattgttacaggttgcaaattatggagtgggaggacagtatgaaccgcacttcgacttctctaggcgaccttttgacagcggcctcaaaacagaggggaataggttagcgacgtttcttaactacatgagtgatgtagaagctggtggtgccaccgtcttccctgatctgggggctgcaatttggcctaagaagggtacagctgtgttctggtacaacctcttgcggagcggggaaggtgactaccgaacaagacatgctgcctgccctgtgcttgtgggctgcaagtgggtctccaataagtggttccatgaacgaggacaggagttcttgagaccttgtggatcaacagaagttgactgacatccttttctgtccttccccttcctggtccttcagcccatgtcaacgtgacagacacctttgtatgttcctttgtatgttcctatcaggctgatttttggagaaatgaatgtttgtctggagcagagggagaccatactagggcgactcctgtgtgactgaagtcccagcccttccattcagcctgtgccatccctggccccaaggctaggatcaaagtggctgcagcagagttagctgtctagcgcctagcaaggtgcctttgtacctcaggtgttttaggtgtgagatgtttcagtgaaccaaagttctgataccttgtttacatgtttgtttttatggcatttctatctattgtggctttaccaaaaaataaaatgtccctaccagaagcctta

SEQ ID NO: 371583 - DNA, 1524 bp, Homo sapiens
ggtgcaccttgcgttttgctggtcgctctcgaggaccccggactgcacgcgcaacaatgaaggggactattatcatacggtgttgtggatggagcaggtgctaaagcagcttgatgccggggaggaggccaccacaaccaagtcacaggtgctggactacctcagctatgctgtcttccagttgggtgatctgcaccgtgccctggagctcacccgccgcctgctctcccttgacccaagccacgaacgagctggagggaatctgcggtactttgagcagttattggaggaagagagagaaaaaacgttaacaaatcagacagaagctgagctagcaaccccagaaggcatctatgagaggcctgtggactacctgcctgagagggatgtttacgagagcctctgtcgtggggagggtgtcaaactgacaccccgtagacagaagaggcttttctgtaggtaccaccatggcaacagggccccacagctgctcattgcccccttcaaagaggaggacgagtgggacagcccgcacatcgtcaggtactacgatgtcatgtctgatgaggaaatcgagaggatcaaggagatcgcaaaacctaaacttgcacgagccaccgttcgtgatcccaagacaggagtcctcactgtcgccagctaccgggtttccaaaagctcctggctagaggaagatgatgaccctgttgtggcccgagtaaatcgtcggatgcagcatatcacagggttaacagtaaagactgcagaattgttacaggttgcaaattatggagtgggaggacagtatgaaccgcacttcgacttctctaggcgaccttttgacagcggcctcaaaacagaggggaataggttagcgacgtttcttaactacatgagtgatgtagaagctggtggtgccaccgtcttccctgatctgggggctgcaatttggcctaagaagggtacagctgtgttctggtacaacctcttgcggagcggggaaggtgactaccgaacaagacatgctgcctgccctgtgcttgtgggctgcaagtgggtctccaataagtggttccatgaacgaggacaggagttcttgagaccttgtggatcaacagaagttgactgacatccttttctgtccttccccttcctggtccttcagcccatgtcaacgtgacagacacctttgtatgttcctttgtatgttcctatcaggctgatttttggagaaatgaatgtttgtctggagcagagggagaccatactagggcgactcctgtgtgactgaagtcccagcccttccattcagcctgtgccatccctggccccaaggctaggatcaaagtggctgcagcagagttagctgtctagcgcctagcaaggtgcctttgtacctcaggtgttttaggtgtgagatgtttcagtgaaccaaagttctgataccttgtttacatgtttgtttttatggcatttctatctattgtggctttaccaaaaaataaaatgtccctaccagaagcctta

SEQ ID NO: 371584 - DNA, 885 bp, Homo sapiens
cggatgtgggtctcctgtgggcctcaactcttgaacactcatgacatggagactgttctaatgaatcacactggttaagtaggcatgggaagagcctttcttggctaaagggctggccatggagcagacaccaagtagtgtcactcatgctgagaggagggcaatctatataccttgtcatgtcctttgtggctcaattgctctgagagccttgggtaggagggtcaagctctatgtcttatatttccagatgagtgatgtagaagctggtggtgccaccgtcttccctgatctgggggctgcaatttggcctaagaagggtacagctgtgttctggtacaacctcttgcggagcggggaaggtgactaccgaacaagacatgctgcctgccctgtgcttgtgggctgcaagtgggtctccaataagtggttccatgaacgaggacaggagttcttgagaccttgtggatcaacagaagttgactgacatccttttctgtccttccccttcctggtccttcagcccatgtcaacgtgacagacacctttgtatgttcctttgtatgttcctatcaggctgatttttggagaaatgaatgtttgtctggagcagagggagaccatactagggcgactcctgtgtgactgaagtcccagcccttccattcagcctgtgccatccctggccccaaggctaggatcaaagtggctgcagcagagttagctgtctagcgcctagcaaggtgcctttgtacctcaggtgttttaggtgtgagatgtttcagtgaaccaaagttctgataccttgtttacatgtttgtttttatggcatttctatctattgtggctttaccaaaaaataaaatgtccctaccagaagcctta

SEQ ID NO: 371585 - DNA, 507 bp, Homo sapiens
ggccgctcggcctacaatgaaggggactattatcatacggtgttgtggatggagcaggtgctaaagcagcttgatgccggggaggaggccaccacaaccaagtcacaggtgctggactacctcagctatgctgtcttccagttgggtgatctgcaccgtgccctggagctcacccgccgcctgctctcccttggtaaggagattctaggggaaggtaagatgggaatggagagtggcagaggaactgcactgtgctggcatctgcctgacccctctcctgggactgagtcagtttaccctgtcacttggccagtgactaatgccttactgactttaggaccagtccagcttcttactagctccttacccacctcaatcctggccttaggtttgcgcagtcgctgatagatacgctcaggcctgtggcacttgtgggcctttttaataaggactctgttatggtgtatctgtcaccatgcaggactacacagggtggaacctttacta

SEQ ID NO: 371586 - DNA, 2092 bp, Homo sapiens
aagggaggaggcgccgagctgaccgggcgacgccgcgggaggttctggaaacgccgggagctgcgagtgtccagacacttccctctgtgaccatgaaactctgggtgtctgcattgctgatggcctggtttggtgtcctgagctgtgtgcaggccgaattcttcacctctattgggcacatgactgacctgatttatgcagagaaagagctggtgcagtctctgaaagagtacatccttgtggaggaagccaagctttccaagattaagagctgggccaacaaaatggaagccttgactagcaagtcagctgctgatgctgagggctacctggctcaccctgtgaatgcctacaaactggtgaagcggctaaacacagactggcctgcgctggaggaccttgtcctgcaggactcagctgcaggttttatcgccaacctctctgtgcagcggcagttcttccccactgatgaggacgagataggagctgccaaagccctgatgagacttcaggacacatacaggctggacccaggcacaatttccagaggggaacttccaggaaccaagtaccaggcaatgctgagtgtggatgactgctttgggatgggccgctcggcctacaatgaaggggactattatcatacggtgttgtggatggagcaggtgctaaagcagcttgatgccggggaggaggccaccacaaccaagtcacaggtgctggactacctcagctatgctgtcttccagttgggtgatctgcaccgtgccctggagctcacccgccgcctgctctcccttgacccaagccacgaacgagctggagggaatctgcggtactttgagcagttattggaggaagagagagaaaaaacgttaacaaatcagacagaagctgagctagcaaccccagaaggcatctatgagaggcctgtggactacctgcctgagagggatgtttacgagagcctctgtcgtggggagggtgtcaaactgacaccccgtagacagaagaggcttttctgtaggtaccaccatggcaacagggccccacagctgctcattgcccccttcaaagaggaggacgagtgggacagcccgcacatcgtcaggtactacgatgtcatgtctgatgaggaaatcgagaggatcaaggagatcgcaaaacctaaacttgcacgagccaccgttcgtgatcccaagacaggagtcctcactgtcgccagctaccgggtttccaaaagctcctggctagaggaagatgatgaccctgttgtggcccgagtaaatcgtcggatgcagcatatcacagggttaacagtaaagactgcagaattgttacaggttgcaaattatggagtgggaggacagtatgaaccgcacttcgacttctctaggcgaccttttgacagcggcctcaaaacagaggggaataggttagcgacgtttcttaactacatgagtgatgtagaagctggtggtgccaccgtcttccctgatctgggggctgcaatttggcctaagaagggtacagctgtgttctggtacaacctcttgcggagcggggaaggtgactaccgaacaagacatgctgcctgccctgtgcttgtgggctgcaagtgggtctccaataagtggttccatgaacgaggacaggagttcttgagaccttgtggatcaacagaagttgactgacatccttttctgtccttccccttcctggtccttcagcccatgtcaacgtgacagacacctttgtatgttcctttgtatgttcctatcaggctgatttttggagaaatgaatgtttgtctggagcagagggagaccatactagggcgactcctgtgtgactgaagtcccagcccttccattcagcctgtgccatccctggccccaaggctaggatcaaagtggctgcagcagagttagctgtctagcgcctagcaaggtgcctttgtacctcaggtgttttaggtgtgagatgtttcagtgaaccaaagttctgataccttgtttacatgtttgtttttatggcatttctatctattgtggctttaccaaaaaataaaatgtccctaccagaagcctta

SEQ ID NO: 371587 - DNA, 2949 bp, Homo sapiens
aagggaggaggcgccgagctgaccgggcgacgccgcgggaggttctggaaacgccgggagctgcgagtgtccagacacttccctctgtgaccatgaaactctgggtgtctgcattgctgatggcctggtttggtgtcctgagctgtgtgcaggccgaattcttcacctctattgggcacatgactgacctgatttatgcagagaaagagctggtgcagtctctgaaagagtacatccttgtggaggaagccaagctttccaagattaagagctgggccaacaaaatggaagccttgactagcaagtcagctgctgatgctgagggctacctggctcaccctgtgaatgcctacaaactggtgaagcggctaaacacagactggcctgcgctggaggaccttgtcctgcaggactcagctgcaggttttatcgccaacctctctgtgcagcggcagttcttccccactgatgaggacgagataggagctgccaaagccctgatgagacttcaggacacatacaggctggacccaggcacaatttccagaggggaacttccaggaaccaagtaccaggcaatgctgagtgtggatgactgctttgggatgggccgctcggcctacaatgaaggggactattatcatacggtgttgtggatggagcaggtgctaaagcagcttgatgccggggaggaggccaccacaaccaagtcacaggtgctggactacctcagctatgctgtcttccagttgggtgatctgcaccgtgccctggagctcacccgccgcctgctctcccttgacccaagccacgaacgagctggagggaatctgcggtactttgagcagttattggaggaagagagagaaaaaacgttaacaaatcagacagaagctgagctagcaaccccagaaggcatctatgagaggcctgtggactacctgcctgagagggatgtttacgagagcctctgtcgtggggagggtgtcaaactgacaccccgtagacagaagaggcttttctgtaggtaccaccatggcaacagggccccacagctgctcattgcccccttcaaagaggaggacgagtgggacagcccgcacatcgtcaggtactacgatgtcatgtctgatgaggaaatcgagaggatcaaggagatcgcaaaacctaaacttgcacgagccaccgttcgtgatcccaagacaggagtcctcactgtcgccagctaccgggtttccaaaagctcctggctagaggaagatgatgaccctgttgtggcccgagtaaatcgtcggatgcagcatatcacagggttaacagtaaagactgcagaattgttacaggttgcaaattatggagtgggaggacagtatgaaccgcacttcgacttctctaggcgaccttttgacagcggcctcaaaacagaggggaataggttagcgacgtttcttaactacatgagtgatgtagaagctggtggtgccaccgtcttccctgatctgggggctgcaatttggcctaagaagggtacagctgtgttctggtacaacctcttgcggagcggggaaggtgactaccgaacaagacatgctgcctgccctgtgcttgtgggctgcaagtgggtctccaataagtggttccatgaacgaggacaggagttcttgagaccttgtggatcaacagaagttgactgacatccttttctgtccttccccttcctggtccttcagcccatgtcaacgtgacagacacctttgtatgttcctttgtatgttcctatcaggctgatttttggagaaatgaatgtttgtctggagcagagggagaccatactagggcgactcctgtgtgactgaagtcccagcccttccattcagcctgtgccatccctggccccaaggctaggatcaaagtggctgcagcagagttagctgtctagcgcctagcaaggtgcctttgtacctcaggtgttttaggtgtgagatgtttcagtgaaccaaagttctgataccttgtttacatgtttgtttttatggcatttctatctattgtggctttaccaaaaaataaaatgtccctaccagaagccttaaagagccttacttggagtatttttaagactggaagcttttaccaggttcatcatttcctatgcatcaccttcatgcaggcagagtctggataatgaatgctttagcagcaaaaaagcatcttgggtcttggatttcagacctggtttcaacacttgtgttccctctaagtgtcagtgtccttttctggaaagtagggtaaatagtttctctttgtctcccagagaacatagcacatgtgttcatgattgtaatgctgttataatgtgtacttcatttttaaattttgagataagaattgttcatgatacacagatgtatacttaaaaaaatatgaaggtgagcaggagcacctgtgtcaacaccaagttagaaaagagaacgttttcaagtcagtacctcaggagccccttgggaacccctcctagatcacatctccttcactgcccccagcactttggagataaatcattgtctcatgatgtgtggtactcattcctttgcttgtctttatagttttaccatctatgattagatccctaaataagtagttattctgttttccctgattttgaacttttactaatagaatgagagtaaatatttttgggtatgtggcttcttttgttcaacattgttttaagattcatccgtgttgcttgtgtagctgtaatttgttttaatctttatagtacattcagttttgttaatgcttattgtaggactgtaccataatacaggcagcatgctgctgataaacactggaattgatttcagtctttgtatattgtgaataatgctgtgataaacatttttatacatgattcctggtgcacatataaacacatatttctgtagg

SEQ ID NO: 371588 - DNA, 2668 bp, Homo sapiens
aagggaggaggcgccgagctgaccgggcgacgccgcgggaggttctggaaacgccgggagctgcgagtgtccagacatccttgtggaaccagcgttgtttttccttggcagctgcggagacccgtgataattcgttaactaattcaacaaacgggacccttctgtgtgccagaaaccgcaagcagttgctaacccagtgggacaggcggattggaagagcgggaaggtcctggcccagagcagtgtgacacttccctctgtgaccatgaaactctgggtgtctgcattgctgatggcctggtttggtgtcctgagctgtgtgcaggccgaattcttcacctctattgggcacatgactgacctgatttatgcagagaaagagctggtgcagtctctgaaagagtacatccttgtggaggaagccaagctttccaagattaagaggtgtcctaagtccccaaccatccttagttggccttccttcccttctgcccctcaaggaacaaggaagccatccagggtgcctataagaggaaacctttgagagggtgatgtggggctggcctggttacttcatgccagtgcttgagaggagctaagtacatgggctaaggagtcactgtttattttctatttaagaccttttcccttacattgggggtcccagctgttatctagattaaggggctagaagtatctgtggggagttactgtattcatttttcattgcctcttgatgaaaagggccccagaacctggcaccagggaattctcactaggaaaattgtcacaggtcaagacctatgtgggtggacgcattagtcttccttttcctctggttccacagctgggccaacaaaatggaagccttgactagcaagtcagctgctgatgctgagggctacctggctcaccctgtgaatgcctacaaactggtgaagcggctaaacacagactggcctgcgctggaggaccttgtcctgcaggactcagctgcaggttttatcgccaacctctctgtgcagcggcagttcttccccactgatgaggacgagataggagctgccaaagccctgatgagacttcaggacacatacaggctggacccaggcacaatttccagaggggaacttccaggaaccaagtaccaggcaatgctgagtgtggatgactgctttgggatgggccgctcggcctacaatgaaggggactattatcatacggtgttgtggatggagcaggtgctaaagcagcttgatgccggggaggaggccaccacaaccaagtcacaggtgctggactacctcagctatgctgtcttccagttgggtgatctgcaccgtgccctggagctcacccgccgcctgctctcccttgacccaagccacgaacgagctggagggaatctgcggtactttgagcagttattggaggaagagagagaaaaaacgttaacaaatcagacagaagctgagctagcaaccccagaaggcatctatgagaggcctgtggactacctgcctgagagggatgtttacgagagcctctgtcgtggggagggtgtcaaactgacaccccgtagacagaagaggcttttctgtaggtaccaccatggcaacagggccccacagctgctcattgcccccttcaaagaggaggacgagtgggacagcccgcacatcgtcaggtactacgatgtcatgtctgatgaggaaatcgagaggatcaaggagatcgcaaaacctaaacttgcacgagccaccgttcgtgatcccaagacaggagtcctcactgtcgccagctaccgggtttccaaaagctcctggctagaggaagatgatgaccctgttgtggcccgagtaaatcgtcggatgcagcatatcacagggttaacagtaaagactgcagaattgttacaggttgcaaattatggagtgggaggacagtatgaaccgcacttcgacttctctaggcgaccttttgacagcggcctcaaaacagaggggaataggttagcgacgtttcttaactacatgagtgatgtagaagctggtggtgccaccgtcttccctgatctgggggctgcaatttggcctaagaagggtacagctgtgttctggtacaacctcttgcggagcggggaaggtgactaccgaacaagacatgctgcctgccctgtgcttgtgggctgcaagtgggtctccaataagtggttccatgaacgaggacaggagttcttgagaccttgtggatcaacagaagttgactgacatccttttctgtccttccccttcctggtccttcagcccatgtcaacgtgacagacacctttgtatgttcctttgtatgttcctatcaggctgatttttggagaaatgaatgtttgtctggagcagagggagaccatactagggcgactcctgtgtgactgaagtcccagcccttccattcagcctgtgccatccctggccccaaggctaggatcaaagtggctgcagcagagttagctgtctagcgcctagcaaggtgcctttgtacctcaggtgttttaggtgtgagatgtttcagtgaaccaaagttctgataccttgtttacatgtttgtttttatggcatttctatctattgtggctttaccaaaaaataaaatgtccctaccagaagcctta

SEQ ID NO: 371589 - DNA, 2196 bp, Homo sapiens
tctagagagggggtctcgctatgttgcccagtggtcacgagtcttggcaagaaagtctgaagacgggaccagctgcacatgttttaccctaagagcttgctatataaaggatactttctggaaggctggttggtgtgaggattcagtcttgcagccactcgagacatcacttctgttcacacttccctctgtgaccatgaaactctgggtgtctgcattgctgatggcctggtttggtgtcctgagctgtgtgcaggccgaattcttcacctctattgggcacatgactgacctgatttatgcagagaaagagctggtgcagtctctgaaagagtacatccttgtggaggaagccaagctttccaagattaagagctgggccaacaaaatggaagccttgactagcaagtcagctgctgatgctgagggctacctggctcaccctgtgaatgcctacaaactggtgaagcggctaaacacagactggcctgcgctggaggaccttgtcctgcaggactcagctgcaggttttatcgccaacctctctgtgcagcggcagttcttccccactgatgaggacgagataggagctgccaaagccctgatgagacttcaggacacatacaggctggacccaggcacaatttccagaggggaacttccaggaaccaagtaccaggcaatgctgagtgtggatgactgctttgggatgggccgctcggcctacaatgaaggggactattatcatacggtgttgtggatggagcaggtgctaaagcagcttgatgccggggaggaggccaccacaaccaagtcacaggtgctggactacctcagctatgctgtcttccagttgggtgatctgcaccgtgccctggagctcacccgccgcctgctctcccttgacccaagccacgaacgagctggagggaatctgcggtactttgagcagttattggaggaagagagagaaaaaacgttaacaaatcagacagaagctgagctagcaaccccagaaggcatctatgagaggcctgtggactacctgcctgagagggatgtttacgagagcctctgtcgtggggagggtgtcaaactgacaccccgtagacagaagaggcttttctgtaggtaccaccatggcaacagggccccacagctgctcattgcccccttcaaagaggaggacgagtgggacagcccgcacatcgtcaggtactacgatgtcatgtctgatgaggaaatcgagaggatcaaggagatcgcaaaacctaaacttgcacgagccaccgttcgtgatcccaagacaggagtcctcactgtcgccagctaccgggtttccaaaagctcctggctagaggaagatgatgaccctgttgtggcccgagtaaatcgtcggatgcagcatatcacagggttaacagtaaagactgcagaattgttacaggttgcaaattatggagtgggaggacagtatgaaccgcacttcgacttctctaggcgaccttttgacagcggcctcaaaacagaggggaataggttagcgacgtttcttaactacatgagtgatgtagaagctggtggtgccaccgtcttccctgatctgggggctgcaatttggcctaagaagggtacagctgtgttctggtacaacctcttgcggagcggggaaggtgactaccgaacaagacatgctgcctgccctgtgcttgtgggctgcaagtgggtctccaataagtggttccatgaacgaggacaggagttcttgagaccttgtggatcaacagaagttgactgacatccttttctgtccttccccttcctggtccttcagcccatgtcaacgtgacagacacctttgtatgttcctttgtatgttcctatcaggctgatttttggagaaatgaatgtttgtctggagcagagggagaccatactagggcgactcctgtgtgactgaagtcccagcccttccattcagcctgtgccatccctggccccaaggctaggatcaaagtggctgcagcagagttagctgtctagcgcctagcaaggtgcctttgtacctcaggtgttttaggtgtgagatgtttcagtgaaccaaagttctgataccttgtttacatgtttgtttttatggcatttctatctattgtggctttaccaaaaaataaaatgtccctaccagaagcctta

SEQ ID NO: 371590 - DNA, 1425 bp, Homo sapiens
gttaatcactgctgttccccgtgggggtgtgtctagtctaagcgttttgacctgcattgctgcgtgcttgatgcttgtcccttttgactcgtggtgatttagagggtgaactcactagccaaccgtggactagtacccaagccacgaacgagctggagggaatctgcggtactttgagcagttattggaggaagagagagaaaaaacgttaacaaatcagacagaagctgagctagcaaccccagaaggcatctatgagaggcctgtggactacctgcctgagagggatgtttacgagagcctctgtcgtggggagggtgtcaaactgacaccccgtagacagaagaggcttttctgtaggtaccaccatggcaacagggccccacagctgctcattgcccccttcaaagaggaggacgagtgggacagcccgcacatcgtcaggtactacgatgtcatgtctgatgaggaaatcgagaggatcaaggagatcgcaaaacctaaacttgcacgagccaccgttcgtgatcccaagacaggagtcctcactgtcgccagctaccgggtttccaaaagctcctggctagaggaagatgatgaccctgttgtggcccgagtaaatcgtcggatgcagcatatcacagggttaacagtaaagactgcagaattgttacaggttgcaaattatggagtgggaggacagtatgaaccgcacttcgacttctctaggcgaccttttgacagcggcctcaaaacagaggggaataggttagcgacgtttcttaactacatgagtgatgtagaagctggtggtgccaccgtcttccctgatctgggggctgcaatttggcctaagaagggtacagctgtgttctggtacaacctcttgcggagcggggaaggtgactaccgaacaagacatgctgcctgccctgtgcttgtgggctgcaagtgggtctccaataagtggttccatgaacgaggacaggagttcttgagaccttgtggatcaacagaagttgactgacatccttttctgtccttccccttcctggtccttcagcccatgtcaacgtgacagacacctttgtatgttcctttgtatgttcctatcaggctgatttttggagaaatgaatgtttgtctggagcagagggagaccatactagggcgactcctgtgtgactgaagtcccagcccttccattcagcctgtgccatccctggccccaaggctaggatcaaagtggctgcagcagagttagctgtctagcgcctagcaaggtgcctttgtacctcaggtgttttaggtgtgagatgtttcagtgaaccaaagttctgataccttgtttacatgtttgtttttatggcatttctatctattgtggctttaccaaaaaataaaatgtccctaccagaagcctta

SEQ ID NO: 371591 - DNA, 1528 bp, Homo sapiens
  misc_feature (1516)..(1516): n is a, c, g, or t
  misc_feature (1528)..(1528): n is a, c, g, or t
aagggaggaggcgccgagctgaccgggcgacgccgcgggaggttctggaaacgccgggagctgcgagtgtccagacacttccctctgtgaccatgaaactctgggtgtctgcattgctgatggcctggtttggtgtcctgagctgtgtgcaggccgaattcttcacctctattgggcacatgactgacctgatttatgcagagaaagagctggtgcagtctctgaaagagtacatccttgtggaggaagccaagctttccaagattaagagctgggccaacaaaatggaagccttgactagcaagtcagctgctgatgctgagggctacctggctcaccctgtgaatgcctacaaactggtgaagcggctaaacacagactggcctgcgctggaggaccttgtcctgcaggactcagctgcaggttttatcgccaacctctctgtgcagcggcagttcttccccactgatgaggacgagataggagctgccaaagccctgatgagacttcaggacacatacaggctggacccaggcacaatttccagaggggaacttccaggaaccaagtaccaggcaatgctgagtgtggatgactgctttgggatgggccgctcggcctacaatgaaggggactattatcatacggtgttgtggatggagcaggtgctaaagcagcttgatgccggggaggaggccaccacaaccaagtcacaggtgctggactacctcagctatgctgtcttccagttgggtgatctgcaccgtgccctggagctcacccgccgcctgctctcccttgacccaagccacgaacgagctggagggaatctgcggtactttgagcagttattggaggaagagagagaaaaaacgttaacaaatcagacagaagctgagctagcaaccccagaaggcatctatgagaggcctgtggactacctgcctgagagggatgtttacgagagcctctgtcgtggggagggtgtcaaactgacaccccgtagacagaagaggcttttctgtaggtaccaccatggcaacagggccccacagctgctcattgcccccttcaaagaggaggacgagtgggacagcccgcacatcgtcaggtactacgatgtcatgtctgatgaggaaatcgagaggatcaaggagatcgcaaaacctaaacttgcacgagccaccgttcgtgatcccaagacaggagtcctcactgtcgccagctaccgggtttccaaaagctcctggctagaggaagatgatgaccctgttgtggcccgagtaaatcgtcggatgcagcatatcacagggttaacagtaaagactgcagaattgttacaggttgcaaattatggagtgggaggacagtatgaaccgcacttcgacttctctaggcgaccttttgacagcggcctcaaaacagaggggaataggttagcgacgtttcttaactacatgagtgatgtagaagctggtggtgccaccgtcttccctgaagtgtcaacgtggggatnctctagagcggn

SEQ ID NO: 371592 - DNA, 2498 bp, Homo sapiens
cgtgacgcatttcctgtttgttgttggagaaaggagagaaaggaaagcgcgaggagccgccgccaccaccagcgcagcagtcctggagctgtgaggagattcgggccgtcaccctgcctcccctgcgtcccgccaccggccgcttctgtcctcggacccattccaacaatctcgtaaaacatggtggattactatgaagttctaggcgtgcagagacatgcctcacccgaggatattaaaaaggcatatcggaaactggcactgaagtggcatccagataaaaatcctgagaataaagaagaagcagagagaaaattcaagcaagtagcggaggcatatgaagtgctgtcggatgctaagaaacgggacatctatgacaaatatggcaaagaaggattaaatggtggaggaggaggtggaagtcattttgacagtccatttgaatttggcttcacattccgtaacccagatgatgtcttcagggaattttttggtggaagggacccattttcatttgacttctttgaagacccttttgaggacttctttgggaatcgaaggggtccccgaggaagcagaagccgagggacggggtcgtttttctctgcgttcagtggatttccgtcttttggaagtggattttcttcttttgatacaggatttacttcatttgggtcactaggtcacgggggcctcacttcattctcttccacgtcatttggtggtagtggcatgggcaacttcaaatcgatatcaacttcaactaaaatggttaatggcagaaaaatcactacaaagagaattgtcgagaacggtcaagaaagagtagaagttgaagaagatggccagttaaagtccttaacaataaatggtgtggccgacgacgatgccctcgctgaggagcgcatgcggagaggccagaacgccctgccagcccagcctgccggcctccgcccgccgaagccgccccggcctgcctcgctgctgagacacgcgcctcactgtctctctgaggaggagggcgagcaggaccgacctcgggcacccgggccctgggaccccctcgcgtccgcagcaggattgaaagaaggtggcaagaggaagaagcagaagcagagagaggagtcgaagaagaagaagtcgaccaaaggcaatcactagaccggacttgaggcacgcggtgcacccccagacgctggcgctccaccgtgctcggcatgcggtcgtgcacacgcgctaggtagcagcgtcggtcaggactgtctcgaggccacactcgctcggcaggattatgcgatcacggatcagtcagagcagggtcaggagacggggctgacggcacgggtggcggggacagacgtttgggacttggccgcgactctctgcttctctccagctctcaatctgctgcattttcctctagtgcttccggatcctcttcattcttttcggctactcaaccactccgcatgctgctggaatatttctggctttagaagtacaggagggcgcagatggctaactgagtaacattcatgaaatgaggctttctgtggcggcgtagtgtttggaattagaaggtaattcagtagagtgtaacttagagaatattgcaagtgacacattgaatcctgcccgtcagggcaccttttcctcagagcaatccggccacacgaatagaaggctgtcgtgaatcacatcagatgtaaaatcattccttctgtttactcttttaattttcatcctttgcaggtagtgcaaattcaacttcaaatatggtgtaggttttgctagattccatatttttttcttggatttttgctaattatttttagcaaaaaatttttgctcagtggcaccctccctagtgtccatgggttagggccatgctggggaaaacgggccggtatttacacacgcgcaaaacacccagagacggcacaaggaggttgaactcatgtttcagttcgcgaacattgactccttacgaaagtcacttcattctaactagatgcgcccacttccggtcattatttcgtttgcatgatgtattgcttcttcacgttttgtttttattgagcacggagtagaattccagggctgccttgacttcttccctgcatgctccctcccagtgactttccttccctttcacatgaggatctgccgttcatgttgctttctcctttgtcctcttggacttgagggcattgtgaaaagctttgctgtgatttaaaaatgccagcaattttaatctagcagtgttgaagctgggaattttttggcgcaatccatgtagcagtgacccaggcttgggagccagaaacaagtgtgacctgggattttatttaacacaactgttgccaaagagttggctttgtttatttggttttggcggggagaggagtggtatttgatgctttctgtggacaatgtaaccctaaacacatcatgtattttaaatgccacctacataaataaaacataagcatattgaa

SEQ ID NO: 371593 - DNA, 455 bp, Homo sapiens
actagttctagatcgcgagcggcgcccttttggggggtttttaaaattgttgtaaatctctgtatgcactttgcttttttattaaacgtactccaaggtgagtcttgactctttagtgtaggacaagattgtacactaacaccagcatggacctgcttttcattgtgtctgaaatgtgagccacgtagtgtcggcctgctgtgaagttaacattgccaggacgattcttctacagaaataatttcaatttttttcagtatttagtagtgaaagatattaatacattaatggtaatacatttctggtttaatataaattaaggatgttttctagttgtgcatgaatgctggcaacttagtaagttttgacaattgtttaaatatgtaatgttaagcttaggtttaaaaaagtaaagctggtaaactgggtctttgtcatttgctttaaaaaaaaaa

SEQ ID NO: 371594 - DNA, 307 bp, Homo sapiens
gccctggcgccgtcttcatgctcttggccatgacgattcttctacagaaataatttcaatttttttcagtatttagtagtgaaagatattaatacattaatggtaatacatttctggtttaatataaattaaggatgttttctagttgtgcatgaatgctggcaacttagtaagttttgacaattgtttaaatatgtaatgttaagcttaggtttaaaaaagtaaagctggtaaactgggtctttgtcatttgctttaaaaaaaaaaaaaaagaaaataaatgcgaatgtgttggtgcattcttcct

SEQ ID NO: 371595 - DNA, 1701 bp, Homo sapiens
cgctgtgcggagatgccacccagctccaccgcaggaccgcggagcgagaggcggcagacgcgctccgggggccgccggtcaagaggaagatgaagggcgcgacgacttcgcggtttccagaatgggctccttctggcccaacaataagtgccatttggaatcttctcggccttctctgtgccttccgcgcgtctgggctccccggagagaaaggaaagcgcgaggagccgccgccaccaccagcgcagcagtcctggagctgtgaggagattcgggccgtcaccctgcctcccctgcgtcccgccaccggccgcttctgtcctcggacccattccaacaatctcgtaaaacatggtggattactatgaagttctaggcgtgcagagacatgcctcacccgaggatattaaaaaggcatatcggaaactggcactgaagtggcatccagataaaaatcctgagaataaagaagaagcagagagaaaattcaagcaagtagcggaggcatatgaagtgctgtcggatgctaagaaacgggacatctatgacaaatatggcaaagaaggattaaatggtggaggaggaggtggaagtcattttgacagtccatttgaatttggcttcacattccgtaacccagatgatgtcttcagggaattttttggtggaagggacccattttcatttgacttctttgaagacccttttgaggacttctttgggaatcgaaggggtccccgaggaagcagaagccgagggacggggtcgtttttctctgcgttcagtggatttccgtcttttggaagtggattttcttcttttgatacaggatttacttcatttgggtcactaggtcacgggggcctcacttcattctcttccacgtcatttggtggtagtggcatgggcaacttcaaatcgatatcaacttcaactaaaatggttaatggcagaaaaatcactacaaagagaattgtcgagaacggtcaagaaagagtagaagttgaagaagatggccagttaaagtccttaacaataaatggtaaggagcagctgctgcgcttggataacaagtaattcaacgcacgcacttaacagaaatgttaaactataacaagcaccatttgaggattaacaggaacatttttttgaagatttcaaacgaactcgactttcagtataattgtacctaaagtatttataaacagctcatcggagcctctatttgtcatagacttttgagttgattgttgggaccacataataggaccattttttttttgtctttaaaattgttgtaaatctctgtatgcactttgcttttttattaaacgtactccaaggtgagtcttgactctttagtgtaggacaagattgtacactaacaccagcatggacctgcttttcattgtgtctgaaatgtgagccacgtagtgtcggcctgctgtgaagttaacattgccaggacgattcttctacagaaataatttcaatttttttcagtatttagtagtgaaagatattaatacattaatggtaatacatttctggtttaatataaattaaggatgttttctagttgtgcatgaatgctggcaacttagtaagttttgacaattgtttaaatatgtaatgttaagcttaggtttaaaaaagtaaagctggtaaactgggtctttgtcatttgctttaaaaaaaaaa

SEQ ID NO: 371596 - DNA, 1537 bp, Homo sapiens
aggatccttaattaaattaatcccttcctccgggagaaaggagagaaaggaaagcgcgaggagccgccgccaccaccagcgcagcagtcctggagctgtgaggagattcgggccgtcaccctgcctcccctgcgtcccgccaccggccgcttctgtcctcggacccattccaacaatctcgtaaaacatggtggattactatgaagttctaggcgtgcagagacatgcctcacccgaggatattaaaaaggcatatcggaaactggcactgaagtggcatccagataaaaatcctgagaataaagaagaagcagagagaaaattcaagcaagtagcggaggcatatgaagtgctgtcggatgctaagaaacgggacatctatgacaaatatggcaaagaaggattaaatggtggaggaggaggtggaagtcattttgacagtccatttgaatttggcttcacattccgtaacccagatgatgtcttcagggaattttttggtggaagggacccattttcatttgacttctttgaagacccttttgaggacttctttgggaatcgaaggggtccccgaggaagcagaagccgagggacggggtcgtttttctctgcgttcagtggatttccgtcttttggaagtggattttcttcttttgatacaggatttacttcatttgggtcactaggtcacgggggcctcacttcattctcttccacgtcatttggtggtagtggcatgggcaacttcaaatcgatatcaacttcaactaaaatggttaatggcagaaaaatcactacaaagagaattgtcgagaacggtcaagaaagagtagaagttgaagaagatggccagttaaagtccttaacaataaatggtaaggagcagctgctgcgcttggataacaagtaattcaacgcacgcacttaacagaaatgttaaactataacaagcaccatttgaggattaacaggaacatttttttgaagatttcaaacgaactcgactttcagtataattgtacctaaagtatttataaacagctcatcggagcctctatttgtcatagacttttgagttgattgttgggaccacataataggaccattttttttttgtctttaaaattgttgtaaatctctgtatgcactttgcttttttattaaacgtactccaaggtgagtcttgactctttagtgtaggacaagattgtacactaacaccagcatggacctgcttttcattgtgtctgaaatgtgagccacgtagtgtcggcctgctgtgaagttaacattgccaggacgattcttctacagaaataatttcaatttttttcagtatttagtagtgaaagatattaatacattaatggtaatacatttctggtttaatataaattaaggatgttttctagttgtgcatgaatgctggcaacttagtaagttttgacaattgtttaaatatgtaatgttaagcttaggtttaaaaaagtaaagctggtaaactgggtctttgtcatttgctttaaaaaaaaaa

SEQ ID NO: 371597 - DNA, 1534 bp, Homo sapiens
tggcggccgctcgcgatctagaactagtcggagaaaggagagaaaggaaagcgcgaggagccgccgccaccaccagcgcagcagtcctggagctgtgaggagattcgggccgtcaccctgcctcccctgcgtcccgccaccggccgcttctgtcctcggacccattccaacaatctcgtaaaacatggtggattactatgaagttctaggcgtgcagagacatgcctcacccgaggatattaaaaaggcatatcggaaactggcactgaagtggcatccagataaaaatcctgagaataaagaagaagcagagagaaaattcaagcaagtagcggaggcatatgaagtgctgtcggatgctaagaaacgggacatctatgacaaatatggcaaagaaggattaaatggtggaggaggaggtggaagtcattttgacagtccatttgaatttggcttcacattccgtaacccagatgatgtcttcagggaattttttggtggaagggacccattttcatttgacttctttgaagacccttttgaggacttctttgggaatcgaaggggtccccgaggaagcagaagccgagggacggggtcgtttttctctgcgttcagtggatttccgtcttttggaagtggattttcttcttttgatacaggatttacttcatttgggtcactaggtcacgggggcctcacttcattctcttccacgtcatttggtggtagtggcatgggcaacttcaaatcgatatcaacttcaactaaaatggttaatggcagaaaaatcactacaaagagaattgtcgagaacggtcaagaaagagtagaagttgaagaagatggccagttaaagtccttaacaataaatggtaaggagcagctgctgcgcttggataacaagtaattcaacgcacgcacttaacagaaatgttaaactataacaagcaccatttgaggattaacaggaacatttttttgaagatttcaaacgaactcgactttcagtataattgtacctaaagtatttataaacagctcatcggagcctctatttgtcatagacttttgagttgattgttgggaccacataataggaccattttttttttgtctttaaaattgttgtaaatctctgtatgcactttgcttttttattaaacgtactccaaggtgagtcttgactctttagtgtaggacaagattgtacactaacaccagcatggacctgcttttcattgtgtctgaaatgtgagccacgtagtgtcggcctgctgtgaagttaacattgccaggacgattcttctacagaaataatttcaatttttttcagtatttagtagtgaaagatattaatacattaatggtaatacatttctggtttaatataaattaaggatgttttctagttgtgcatgaatgctggcaacttagtaagttttgacaattgtttaaatatgtaatgttaagcttaggtttaaaaaagtaaagctggtaaactgggtctttgtcatttgctttaaaaaaaaaa

SEQ ID NO: 371598 - DNA, 1621 bp, Homo sapiens
cgtgacgcatttcctgtttgttgttggagaaaggagagaaaggaaagcgcgaggagccgccgccaccaccagcgcagcagtcctggagctgtgaggagattcgggccgtcaccctgcctcccctgcgtcccgccaccggccgcttctgtcctcggacccattccaacaatctcgtaaaacatggtggattactatgaagttctaggcgtgcagagacatgcctcacccgaggatattaaaaaggcatatcggaaactggcactgaagtggcatccagataaaaatcctgagaataaagaagaagcagagagaaaattcaagcaagtagcggaggcatatgaagtgctgtcggatgctaagaaacgggacatctatgacaaatatggcaaagaaggattaaatggtggaggaggaggtggaagtcattttgacagtccatttgaatttggcttcacattccgtaacccagatgatgtcttcagggaattttttggtggaagggacccattttcatttgacttctttgaagacccttttgaggacttctttgggaatcgaaggggtccccgaggaagcagaagccgagggacggggtcgtttttctctgcgttcagtggatttccgtcttttggaagtggattttcttcttttgatacaggatttacttcatttgggtcactaggtcacgggggcctcacttcattctcttccacgtcatttggtggtagtggcatgggcaacttcaaatcgatatcaacttcaactaaaatggttaatggcagaaaaatcactacaaagagaattgtcgagaacggtcaagaaagagtagaagttgaagaagatggccagttaaagtccttaacaataaatggtaaggagcagctgctgcgcttggataacaagtaattcaacgcacgcacttaacagaaatgttaaactataacaagcaccatttgaggattaacaggaacatttttttgaagatttcaaacgaactcgactttcagtataattgtacctaaagtatttataaacagctcatcggagcctctatttgtcatagacttttgagttgattgttgggaccacataataggaccattttttttttgtctttaaaattgttgtaaatctctgtatgcactttgcttttttattaaacgtactccaaggtgagtcttgactctttagtgtaggacaagattgtacactaacaccagcatggacctgcttttcattgtgtctgaaatgtgagccacgtagtgtcggcctgctgtgaagttaacattgccaggacgattcttctacagaaataatttcaatttttttcagtatttagtagtgaaagatattaatacattaatggtaatacatttctggtttaatataaattaaggatgttttctagttgtgcatgaatgctggcaacttagtaagttttgacaattgtttaaatatgtaatgttaagcttaggtttaaaaaagtaaagctggtaaactgggtctttgtcatttgctttaaaaaaaaaacactggccgcgtttaacaacgtggactggaaaacttgcgtaccaatttaacgcttgaaaaattccccttcccactgcgcggccgcacgtct

SEQ ID NO: 371599 - DNA, 1492 bp, Homo sapiens
cgtgacgcatttcctgtttgttgttggagaaaggagagaaaggaaagcgcgaggagccgccgccaccaccagcgcagcagtcctggagctgtgaggagattcgggccgtcaccctgcctcccctgcgtcccgccaccggccgcttctgtcctcggacccattccaacaatctcgtaaaacatggtggattactatgaagttctaggcgtgcagagacatgcctcacccgaggatattaaaaaggcatatcggaaactggcactgaagtggcatccagataaaaatcctgagaataaagaagaagcagagagaaaattcaagcaagtagcggaggcatatgaagtgctgtcggatgctaagaaacgggacatctatgacaaatatggcaaagaaggattaaatggtggaggaggaggtggaagtcattttgacagtccatttgaatttggcttcacattccgtaacccagatgatgtcttcagggaattttttggtggaagggacccattttcatttgacttctttgaagacccttttgaggacttctttgggaatcgaaggggtccccgaggaagcagaagccgagggacggggtcgtttttctctgcgttcagtggatttccgtcttttggaagtggattttcttcttttgatacaggatttacttcatttgggtcactaggtcacgggggcctcacttcattctcttccacgtcatttggtggtagtggcatgggcaacttcaaatcgatatcaacttcaactaaaatggttaatggcagaaaaatcactacaaagagaagatggccagttaaagtccttaacaataaatggtaaggagcagctgctgcgcttggataacaagtaattcaacgcacgcacttaacagaaatgttaaactataacaagcaccatttgaggattaacaggaacatttttttgaagatttcaaacgaactcgactttcagtataattgtacctaaagtatttataaacagctcatcggagcctctatttgtcatagacttttgagttgattgttgggaccacataataggaccattttttttttgtctttaaaattgttgtaaatctctgtatgcactttgcttttttattaaacgtactccaaggtgagtcttgactctttagtgtaggacaagattgtacactaacaccagcatggacctgcttttcattgtgtctgaaatgtgagccacgtagtgtcggcctgctgtgaagttaacattgccaggacgattcttctacagaaataatttcaatttttttcagtatttagtagtgaaagatattaatacattaatggtaatacatttctggtttaatataaattaaggatgttttctagttgtgcatgaatgctggcaacttagtaagttttgacaattgtttaaatatgtaatgttaagcttaggtttaaaaaagtaaagctggtaaactgggtctttgtcatttgctttaaaaaaaaaa

SEQ ID NO: 371600 - DNA, 2366 bp, Homo sapiens
cgtgacgcatttcctgtttgttgttggagaaaggagagaaaggaaagcgcgaggagccgccgccaccaccagcgcagcagtcctggagctgtgaggagattcgggccgtcaccctgcctcccctgcgtcccgccaccggccgcttctgtcctcggacccattccaacaatctcgtaaaacatggtggattactatgaagttctaggcgtgcagagacatgcctcacccgaggatattaaaaaggcatatcggaaactggcactgaagtggcatccagataaaaatcctgagaataaagaagaagcagagagaaaattcaagcaagtagcggaggcatatgaagtgctgtcggatgctaagaaacgggacatctatgacaaatatggcaaagaaggattaaatggtggaggaggaggtggaagtcattttgacagtccatttgaatttggcttcacattccgtaacccagatgatgtcttcagggaattttttggtggaagggacccattttcatttgacttctttggatttacttcatttgggtcactaggtcacgggggcctcacttcattctcttccacgtcatttggtggtagtggcatgggcaacttcaaatcgatatcaacttcaactaaaatggttaatggcagaaaaatcactacaaagagaattgtcgagaacggtcaagaaagagtagaagttgaagaagatggccagttaaagtccttaacaataaatggtgtggccgacgacgatgccctcgctgaggagcgcatgcggagaggccagaacgccctgccagcccagcctgccggcctccgcccgccgaagccgccccggcctgcctcgctgctgagacacgcgcctcactgtctctctgaggaggagggcgagcaggaccgacctcgggcacccgggccctgggaccccctcgcgtccgcagcaggattgaaagaaggtggcaagaggaagaagcagaagcagagagaggagtcgaagaagaagaagtcgaccaaaggcaatcactagaccggacttgaggcacgcggtgcacccccagacgctggcgctccaccgtgctcggcatgcggtcgtgcacacgcgctaggtagcagcgtcggtcaggactgtctcgaggccacactcgctcggcaggattatgcgatcacggatcagtcagagcagggtcaggagacggggctgacggcacgggtggcggggacagacgtttgggacttggccgcgactctctgcttctctccagctctcaatctgctgcattttcctctagtgcttccggatcctcttcattcttttcggctactcaaccactccgcatgctgctggaatatttctggctttagaagtacaggagggcgcagatggctaactgagtaacattcatgaaatgaggctttctgtggcggcgtagtgtttggaattagaaggtaattcagtagagtgtaacttagagaatattgcaagtgacacattgaatcctgcccgtcagggcaccttttcctcagagcaatccggccacacgaatagaaggctgtcgtgaatcacatcagatgtaaaatcattccttctgtttactcttttaattttcatcctttgcaggtagtgcaaattcaacttcaaatatggtgtaggttttgctagattccatatttttttcttggatttttgctaattatttttagcaaaaaatttttgctcagtggcaccctccctagtgtccatgggttagggccatgctggggaaaacgggccggtatttacacacgcgcaaaacacccagagacggcacaaggaggttgaactcatgtttcagttcgcgaacattgactccttacgaaagtcacttcattctaactagatgcgcccacttccggtcattatttcgtttgcatgatgtattgcttcttcacgttttgtttttattgagcacggagtagaattccagggctgccttgacttcttccctgcatgctccctcccagtgactttccttccctttcacatgaggatctgccgttcatgttgctttctcctttgtcctcttggacttgagggcattgtgaaaagctttgctgtgatttaaaaatgccagcaattttaatctagcagtgttgaagctgggaattttttggcgcaatccatgtagcagtgacccaggcttgggagccagaaacaagtgtgacctgggattttatttaacacaactgttgccaaagagttggctttgtttatttggttttggcggggagaggagtggtatttgatgctttctgtggacaatgtaaccctaaacacatcatgtattttaaatgccacctacataaataaaacataagcatattgaa

SEQ ID NO: 371601 - DNA, 1027 bp, Homo sapiens
  misc_feature (1027)..(1027): n is a, c, g, or t
cgtgacgcatttcctgtttgttgttggagaaaggagagaaaggaaagcgcgaggagccgccgccaccaccagcgcagcagtcctggagctgtgaggagattcgggccgtcaccctgcctcccctgcgtcccgccaccggccgcttctgtcctcggacccattccaacaatctcgtaaaacatggtggattactatgaagttctaggcgtgcagagacatgcctcacccgaggatattaaaaaggcatatcggaaactggcactgaagtggcatccagataaaaatcctgagaataaagaagaagcagagagaaaattcaagcaagtagcggaggcatatgaagtgctgtcggatgctaagaaacgggacatctatgacaaatatggcaaagaaggattaaatggtggaggaggaggtggaagtcattttgacagtccatttgaatttggcttcacattccgtaacccagatgatgtcttcagggaattttttggtggaagggacccattttcatttgacttctttgaagacccttttgaggacttctttgggaatcgaaggggtccccgaggaagcagaagccgagggacggggtcgtttttctctgcgttcagtggatttccgtcttttggaagtggattttcttcttttgatacaggatttacttcatttgggtcactaggtcacgggggcctcacttcattctcttccacgtcatttggtggtagtggcatgggcaacttcaaatcgatatcaacttcaactaaaatggttaatggcagaaaaatcactacaaagagaattgtcgagaacggtcaagaaagagtagaagttgaagaagatggccagttaaagtccttaacaataaatggtgtggccgacgacgatgccctcgctgaggagcgcatcggtagaaggacagaagaccgcacaggccaagtggacggagatcgagagacagaacaagacaggaaacacatcgtgagaccagcgcagcacggggtccgcagacgaggggcgcaaacan

SEQ ID NO: 371602 - DNA, 1462 bp, Homo sapiens
gagcttgggtgaagaaactgaacaccacctgcaactcgaggagggaaagagaagagtagttgtgtctacagataatacaggggagaaacgtggagctcctgcctgccgcaggcacgaagaagcataatcactctcatatctggggaccgggagactggcgtgctcatcgtttaagtgcatttgctgtaatcactgctgccatcagcagaaacagagctcaagaaagaaccatgtttacatccgtccttcatcaaccctcacaggacagggcagtgttcgggttgaagtcctgtgttctgatcggtgattctcgtggtgaccaagcgaggaagaaggcccgctcttccaacaccatggcttctcttctggggcacacgaggctctcaggatttacacactggggaagctgctgctccatggctgctatatgtatgtagtcactgagcagcctgctgacgaagacccttttgaggacttctttgggaatcgaaggggtccccgaggaagcagaagccgagggacggggtcgtttttctctgcgttcagtggatttccgtcttttggaagtggattttcttcttttgatacaggatttacttcatttgggtcactaggtcacgggggcctcacttcattctcttccacgtcatttggtggtagtggcatgggcaacttcaaatcgatatcaacttcaactaaaatggttaatggcagaaaaatcactacaaagagaattgtcgagaacggtcaagaaagagtagaagttgaagaagatggccagttaaagtccttaacaataaatggtaaggagcagctgctgcgcttggataacaagtaattcaacgcacgcacttaacagaaatgttaaactataacaagcaccatttgaggattaacaggaacatttttttgaagatttcaaacgaactcgactttcagtataattgtacctaaagtatttataaacagctcatcggagcctctatttgtcatagacttttgagttgattgttgggaccacataataggaccattttttttttgtctttaaaattgttgtaaatctctgtatgcactttgcttttttattaaacgtactccaaggtgagtcttgactctttagtgtaggacaagattgtacactaacaccagcatggacctgcttttcattgtgtctgaaatgtgagccacgtagtgtcggcctgctgtgaagttaacattgccaggacgattcttctacagaaataatttcaatttttttcagtatttagtagtgaaagatattaatacattaatggtaatacatttctggtttaatataaattaaggatgttttctagttgtgcatgaatgctggcaacttagtaagttttgacaattgtttaaatatgtaatgttaagcttaggtttaaaaaagtaaagctggtaaactgggtctttgtcatttgctttaaaaaaaaaa

SEQ ID NO: 371603 - DNA, 1130 bp, Homo sapiens
taaaacctcttaagttttttgttcctgaatatgttacaaacatctattttctcttactgtagctatcacatgaggaaaaaaacttgaaaaaaagacttcatagtgtgtgtttatgtttgattttagaagacccttttgaggacttctttgggaatcgaaggggtccccgaggaagcagaagccgagggacggggtcgtttttctctgcgttcagtggatttccgtcttttggaagtggattttcttcttttgatacaggatttacttcatttgggtcactaggtcacgggggcctcacttcattctcttccacgtcatttggtggtagtggcatgggcaacttcaaatcgatatcaacttcaactaaaatggttaatggcagaaaaatcactacaaagagaattgtcgagaacggtcaagaaagagtagaagttgaagaagatggccagttaaagtccttaacaataaatggtaaggagcagctgctgcgcttggataacaagtaattcaacgcacgcacttaacagaaatgttaaactataacaagcaccatttgaggattaacaggaacatttttttgaagatttcaaacgaactcgactttcagtataattgtacctaaagtatttataaacagctcatcggagcctctatttgtcatagacttttgagttgattgttgggaccacataataggaccattttttttttgtctttaaaattgttgtaaatctctgtatgcactttgcttttttattaaacgtactccaaggtgagtcttgactctttagtgtaggacaagattgtacactaacaccagcatggacctgcttttcattgtgtctgaaatgtgagccacgtagtgtcggcctgctgtgaagttaacattgccaggacgattcttctacagaaataatttcaatttttttcagtatttagtagtgaaagatattaatacattaatggtaatacatttctggtttaatataaattaaggatgttttctagttgtgcatgaatgctggcaacttagtaagttttgacaattgtttaaatatgtaatgttaagcttaggtttaaaaaagtaaagctggtaaactgggtctttgtcatttgctttaaaaaaaaaa

SEQ ID NO: 371604 - DNA, 1901 bp, Homo sapiens
aggatccttaattaaattaatcccttcctccgggagaaaggagagaaaggaaagcgcgaggagccgccgccaccaccagcgcagcagtcctggagctgtgaggagattcgggccgtcaccctgcctcccctgcgtcccgccaccggccgcttctgtcctcgttcaactaaaatggttaatggcagaaaaatcactacaaagagaattgtcgagaacggtcaagaaagagtagaagttgaagaagatggccagttaaagtccttaacaataaatggtgtggccgacgacgatgccctcgctgaggagcgcatgcggagaggccagaacgccctgccagcccagcctgccggcctccgcccgccgaagccgccccggcctgcctcgctgctgagacacgcgcctcactgtctctctgaggaggagggcgagcaggaccgacctcgggcacccgggccctgggaccccctcgcgtccgcagcaggattgaaagaaggtggcaagaggaagaagcagaagcagagagaggagtcgaagaagaagaagtcgaccaaaggcaatcactagaccggacttgaggcacgcggtgcacccccagacgctggcgctccaccgtgctcggcatgcggtcgtgcacacgcgctaggtagcagcgtcggtcaggactgtctcgaggccacactcgctcggcaggattatgcgatcacggatcagtcagagcagggtcaggagacggggctgacggcacgggtggcggggacagacgtttgggacttggccgcgactctctgcttctctccagctctcaatctgctgcattttcctctagtgcttccggatcctcttcattcttttcggctactcaaccactccgcatgctgctggaatatttctggctttagaagtacaggagggcgcagatggctaactgagtaacattcatgaaatgaggctttctgtggcggcgtagtgtttggaattagaaggtaattcagtagagtgtaacttagagaatattgcaagtgacacattgaatcctgcccgtcagggcaccttttcctcagagcaatccggccacacgaatagaaggctgtcgtgaatcacatcagatgtaaaatcattccttctgtttactcttttaattttcatcctttgcaggtagtgcaaattcaacttcaaatatggtgtaggttttgctagattccatatttttttcttggatttttgctaattatttttagcaaaaaatttttgctcagtggcaccctccctagtgtccatgggttagggccatgctggggaaaacgggccggtatttacacacgcgcaaaacacccagagacggcacaaggaggttgaactcatgtttcagttcgcgaacattgactccttacgaaagtcacttcattctaactagatgcgcccacttccggtcattatttcgtttgcatgatgtattgcttcttcacgttttgtttttattgagcacggagtagaattccagggctgccttgacttcttccctgcatgctccctcccagtgactttccttccctttcacatgaggatctgccgttcatgttgctttctcctttgtcctcttggacttgagggcattgtgaaaagctttgctgtgatttaaaaatgccagcaattttaatctagcagtgttgaagctgggaattttttggcgcaatccatgtagcagtgacccaggcttgggagccagaaacaagtgtgacctgggattttatttaacacaactgttgccaaagagttggctttgtttatttggttttggcggggagaggagtggtatttgatgctttctgtggacaatgtaaccctaaacacatcatgtattttaaatgccacctacataaataaaacataagcatattgaa

SEQ ID NO: 371605 - DNA, 1021 bp, Homo sapiens
cagctgaggccttgatagttgcgtcgtttattactcctcggttctatgccttaacattaaatattctgctactgaactttcaaactcttgtctttgcattactagttgacatatttctttaagcatttttcttttctgttttcctgtaggatttacttcatttgggtcactaggtcacgggggcctcacttcattctcttccacgtcatttggtggtagtggcatgggcaacttcaaatcgatatcaacttcaactaaaatggttaatggcagaaaaatcactacaaagagaattgtcgagaacggtcaagaaagagtagaagttgaagaagatggccagttaaagtccttaacaataaatggtaaggagcagctgctgcgcttggataacaagtaattcaacgcacgcacttaacagaaatgttaaactataacaagcaccatttgaggattaacaggaacatttttttgaagatttcaaacgaactcgactttcagtataattgtacctaaagtatttataaacagctcatcggagcctctatttgtcatagacttttgagttgattgttgggaccacataataggaccattttttttttgtctttaaaattgttgtaaatctctgtatgcactttgcttttttattaaacgtactccaaggtgagtcttgactctttagtgtaggacaagattgtacactaacaccagcatggacctgcttttcattgtgtctgaaatgtgagccacgtagtgtcggcctgctgtgaagttaacattgccaggacgattcttctacagaaataatttcaatttttttcagtatttagtagtgaaagatattaatacattaatggtaatacatttctggtttaatataaattaaggatgttttctagttgtgcatgaatgctggcaacttagtaagttttgacaattgtttaaatatgtaatgttaagcttaggtttaaaaaagtaaagctggtaaactgggtctttgtcatttgctttaaaaaaaaaa

SEQ ID NO: 371606 - DNA, 1623 bp, Homo sapiens
aggatccttaattaaattaatcccttcctccgggagaaaggagagaaaggaaagcgcgaggagccgccgccaccaccagcgcagcagtcctggagctgtgaggagattcgggccgtcaccctgcctcccctgcgtcccgccaccggccgcttctgtcctcgctcgggcacccgggccctgggaccccctcgcgtccgcagcaggattgaaagaaggtggcaagaggaagaagcagaagcagagagaggagtcgaagaagaagaagtcgaccaaaggcaatcactagaccggacttgaggcacgcggtgcacccccagacgctggcgctccaccgtgctcggcatgcggtcgtgcacacgcgctaggtagcagcgtcggtcaggactgtctcgaggccacactcgctcggcaggattatgcgatcacggatcagtcagagcagggtcaggagacggggctgacggcacgggtggcggggacagacgtttgggacttggccgcgactctctgcttctctccagctctcaatctgctgcattttcctctagtgcttccggatcctcttcattcttttcggctactcaaccactccgcatgctgctggaatatttctggctttagaagtacaggagggcgcagatggctaactgagtaacattcatgaaatgaggctttctgtggcggcgtagtgtttggaattagaaggtaattcagtagagtgtaacttagagaatattgcaagtgacacattgaatcctgcccgtcagggcaccttttcctcagagcaatccggccacacgaatagaaggctgtcgtgaatcacatcagatgtaaaatcattccttctgtttactcttttaattttcatcctttgcaggtagtgcaaattcaacttcaaatatggtgtaggttttgctagattccatatttttttcttggatttttgctaattatttttagcaaaaaatttttgctcagtggcaccctccctagtgtccatgggttagggccatgctggggaaaacgggccggtatttacacacgcgcaaaacacccagagacggcacaaggaggttgaactcatgtttcagttcgcgaacattgactccttacgaaagtcacttcattctaactagatgcgcccacttccggtcattatttcgtttgcatgatgtattgcttcttcacgttttgtttttattgagcacggagtagaattccagggctgccttgacttcttccctgcatgctccctcccagtgactttccttccctttcacatgaggatctgccgttcatgttgctttctcctttgtcctcttggacttgagggcattgtgaaaagctttgctgtgatttaaaaatgccagcaattttaatctagcagtgttgaagctgggaattttttggcgcaatccatgtagcagtgacccaggcttgggagccagaaacaagtgtgacctgggattttatttaacacaactgttgccaaagagttggctttgtttatttggttttggcggggagaggagtggtatttgatgctttctgtggacaatgtaaccctaaacacatcatgtattttaaatgccacctacataaataaaacataagcatattgaa

SEQ ID NO: 371607 - DNA, 1463 bp, Homo sapiens
aggatccttaattaaattaatcccttcctccgggagaaaggagagaaaggaaagcgcgaggagccgccgccaccaccagcgcagcagtcctggagctgtgaggagattcgggccgtcaccctgcctcccctgcgtcccgccaccggccgcttctgtcctcggacccattccaacaatctcgtaaaacatggtggattactatgaagttctaggcgtgcagagacatgcctcacccgaggatattaaaaaggcgattatgcgatcacggatcagtcagagcagggtcaggagacggggctgacggcacgggtggcggggacagacgtttgggacttggccgcgactctctgcttctctccagctctcaatctgctgcattttcctctagtgcttccggatcctcttcattcttttcggctactcaaccactccgcatgctgctggaatatttctggctttagaagtacaggagggcgcagatggctaactgagtaacattcatgaaatgaggctttctgtggcggcgtagtgtttggaattagaaggtaattcagtagagtgtaacttagagaatattgcaagtgacacattgaatcctgcccgtcagggcaccttttcctcagagcaatccggccacacgaatagaaggctgtcgtgaatcacatcagatgtaaaatcattccttctgtttactcttttaattttcatcctttgcaggtagtgcaaattcaacttcaaatatggtgtaggttttgctagattccatatttttttcttggatttttgctaattatttttagcaaaaaatttttgctcagtggcaccctccctagtgtccatgggttagggccatgctggggaaaacgggccggtatttacacacgcgcaaaacacccagagacggcacaaggaggttgaactcatgtttcagttcgcgaacattgactccttacgaaagtcacttcattctaactagatgcgcccacttccggtcattatttcgtttgcatgatgtattgcttcttcacgttttgtttttattgagcacggagtagaattccagggctgccttgacttcttccctgcatgctccctcccagtgactttccttccctttcacatgaggatctgccgttcatgttgctttctcctttgtcctcttggacttgagggcattgtgaaaagctttgctgtgatttaaaaatgccagcaattttaatctagcagtgttgaagctgggaattttttggcgcaatccatgtagcagtgacccaggcttgggagccagaaacaagtgtgacctgggattttatttaacacaactgttgccaaagagttggctttgtttatttggttttggcggggagaggagtggtatttgatgctttctgtggacaatgtaaccctaaacacatcatgtattttaaatgccacctacataaataaaacataagcatattgaa

SEQ ID NO: 371608 - DNA, 278 bp, Homo sapiens
ggccttttgcatggtgcagttcttcagtgtgtctcaaatggggattcaaagaggttgttcttacaccttattatgggctggctggcttgaagagagcccctttctgagggaggaaggacagtcagtggcctcaagcattttcagggaaactgaagctgagcaggcgatttccgattaggggaccgggagactggcgtgctcatcgtttaagtgcatttgctgtaatcactgctgccatcagcagaaacagagctcaagaaagaaccatgtttacatcc

SEQ ID NO: 371609 - DNA, 496 bp, Homo sapiens
tacagtgttttacaagccgtgtttccttaggattgaaagaaggtggcaagaggaagaagcagaagcagagagaggagtcgaagaagaagaagtcgaccaaaggcaatcactagaccggacttgaggcacgcggtgcacccccagacgctggcgctccaccgtgctcggcatgcggtcgtgcacacgcgctaggtagcagcgtcggtcaggactgtctcgaggccacactcgctcggcaggattatgcgatcacggatcagtcagagcagggtcaggagacggggctgacggcacgggtggcggggacagacgtttgggacttggccgcgactctctgcttctctccagctctcaatctgctgcattttcctctagtgcttccggatcctcttcattcttttcggctactcaaccactccgcatgctgctggaatatttctggctttagaagtacaggagggcgcagatggctaactgagtaacattcatgaaatga

SEQ ID NO: 371610 - DNA, 1530 bp, Homo sapiens
cgtgacgcatttcctgtttgttgttggagaaaggagagaaaggaaagcgcgaggagccgccgccaccaccagcgcagcagtcctggagctgtgaggagattcgggccgtcaccctgcctcccctgcgtcccgccaccggccgcttctgtcctcggacccattccaacaatctcgtaaaacatggtggattactatgaagttctaggcgtgcagagacatgcctcacccgaggatattaaaaaggcatatcggaaactggcactgaagtggcatccagataaaaatcctgagaataaagaagaagcagagagaaaattcaagcaagtagcggaggcatatgaagtgctgtcggatgctaagaaacgggacatctatgacaaatatggcaaagaaggattaaatggtggaggaggaggtggaagtcattttgacagtccatttgaatttggcttcacattccgtaacccagatgatgtcttcagggaattttttggtggaagggacccattttcatttgacttctttgaagacccttttgaggacttctttgggaatcgaaggggtccccgaggaagcagaagccgagggacggggtcgtttttctctgcgttcagtggatttccgtcttttggaagtggattttcttcttttgatacaggatttacttcatttgggtcactaggtcacgggggcctcacttcattctcttccacgtcatttggtggtagtggcatgggcaacttcaaatcgatatcaacttcaactaaaatggttaatggcagaaaaatcactacaaagagaattgtcgagaacggtcaagaaagagtagaagttgaagaagatggccagttaaagtccttaacaataaatggtaaggagcagctgctgcgcttggataacaagtaattcaacgcacgcacttaacagaaatgttaaactataacaagcaccatttgaggattaacaggaacatttttttgaagatttcaaacgaactcgactttcagtataattgtacctaaagtatttataaacagctcatcggagcctctatttgtcatagacttttgagttgattgttgggaccacataataggaccattttttttttgtctttaaaattgttgtaaatctctgtatgcactttgcttttttattaaacgtactccaaggtgagtcttgactctttagtgtaggacaagattgtacactaacaccagcatggacctgcttttcattgtgtctgaaatgtgagccacgtagtgtcggcctgctgtgaagttaacattgccaggacgattcttctacagaaataatttcaatttttttcagtatttagtagtgaaagatattaatacattaatggtaatacatttctggtttaatataaattaaggatgttttctagttgtgcatgaatgctggcaacttagtaagttttgacaattgtttaaatatgtaatgttaagcttaggtttaaaaaagtaaagctggtaaactgggtctttgtcatttgctttaaaaaaaaaa

SEQ ID NO: 371611 - DNA, 3033 bp, Homo sapiens
cgtgacgcatttcctgtttgttgttggagaaaggagagaaaggaaagcgcgaggagccgccgccaccaccagcgcagcagtcctggagctgtgaggagattcgggccgtcaccctgcctcccctgcgtcccgccaccggccgcttctgtcctcggacccattccaacaatctcgtaaaacatggtggattactatgaagttctaggcgtgcagagacatgcctcacccgaggatattaaaaaggcatatcggaaactggcactgaagtggcatccagataaaaatcctgagaataaagaagaagcagagagaaaattcaagcaagtagcggaggcatatgaagtgctgtcggatgctaagaaacgggacatctatgacaaatatggcaaagaaggattaaatggtggaggaggaggtggaagtcattttgacagtccatttgaatttggcttcacattccgtaacccagatgatgtcttcagggaattttttggtggaagggacccattttcatttgacttctttgaagacccttttgaggacttctttgggaatcgaaggggtccccgaggaagcagaagccgagggacggggtcgtttttctctgcgttcagtggatttccgtcttttggaagtggattttcttcttttgatacaggatttacttcatttgggtcactaggtcacgggggcctcacttcattctcttccacgtcatttggtggtagtggcatgggcaacttcaaatcgatatcaacttcaactaaaatggttaatggcagaaaaatcactacaaagagaggtactgtggtattctgcattttatatttttagtaagcaggcgtaacgtttcactggtgccatgttgcacgtctcccagagtgtgaagtagaggttgttgtatgctaaatctggcgccatgaaaatcttttgctctccaaattcattaattaaagccttttctcttaaattttacttaactgttgaattattagagggaatctttaatgtaatacagtgtaataagtttctgcagcattgttaaaatggtaaaatggaaaatcattaatagtaaagcctttactgttttatagcctctgcatgtatttagcatccgcctgtacggtatttgagacacaatttattttgtcaggttaattctattttaggaaaggaagatgtgttgttgacaggttggcttcagccatgtttttacagcctgaaaattacttatattcatggtgtatttcagtaatgtccttaaacaacttagttatccctcacacatgcattttctttaccagaaaggtttttaaatgaatttttttcctacagaattgtcgagaacggtcaagaaagagtagaagttgaagaagatggccagttaaagtccttaacaataaatggtgtggccgacgacgatgccctcgctgaggagcgcatgcggagaggccagaacgccctgccagcccagcctgccggcctccgcccgccgaagccgccccggcctgcctcgctgctgagacacgcgcctcactgtctctctgaggaggagggcgagcaggaccgacctcgggcacccgggccctgggaccccctcgcgtccgcagcaggattgaaagaaggtggcaagaggaagaagcagaagcagagagaggagtcgaagaagaagaagtcgaccaaaggcaatcactagaccggacttgaggcacgcggtgcacccccagacgctggcgctccaccgtgctcggcatgcggtcgtgcacacgcgctaggtagcagcgtcggtcaggactgtctcgaggccacactcgctcggcaggattatgcgatcacggatcagtcagagcagggtcaggagacggggctgacggcacgggtggcggggacagacgtttgggacttggccgcgactctctgcttctctccagctctcaatctgctgcattttcctctagtgcttccggatcctcttcattcttttcggctactcaaccactccgcatgctgctggaatatttctggctttagaagtacaggagggcgcagatggctaactgagtaacattcatgaaatgaggctttctgtggcggcgtagtgtttggaattagaaggtaattcagtagagtgtaacttagagaatattgcaagtgacacattgaatcctgcccgtcagggcaccttttcctcagagcaatccggccacacgaatagaaggctgtcgtgaatcacatcagatgtaaaatcattccttctgtttactcttttaattttcatcctttgcaggtagtgcaaattcaacttcaaatatggtgtaggttttgctagattccatatttttttcttggatttttgctaattatttttagcaaaaaatttttgctcagtggcaccctccctagtgtccatgggttagggccatgctggggaaaacgggccggtatttacacacgcgcaaaacacccagagacggcacaaggaggttgaactcatgtttcagttcgcgaacattgactccttacgaaagtcacttcattctaactagatgcgcccacttccggtcattatttcgtttgcatgatgtattgcttcttcacgttttgtttttattgagcacggagtagaattccagggctgccttgacttcttccctgcatgctccctcccagtgactttccttccctttcacatgaggatctgccgttcatgttgctttctcctttgtcctcttggacttgagggcattgtgaaaagctttgctgtgatttaaaaatgccagcaattttaatctagcagtgttgaagctgggaattttttggcgcaatccatgtagcagtgacccaggcttgggagccagaaacaagtgtgacctgggattttatttaacacaactgttgccaaagagttggctttgtttatttggttttggcggggagaggagtggtatttgatgctttctgtggacaatgtaaccctaaacacatcatgtattttaaatgccacctacataaataaaacataagcatattgaa

SEQ ID NO: 371612 - DNA, 1473 bp, Homo sapiens
aggatccttaattaaattaatcccttcctccgggagaaaggagagaaaggaaagcgcgaggagccgccgccaccaccagcgcagcagtcctggagctgacccattccaacaatctcgtaaaacatggtggattactatgaagttctaggcgtgcagagacatgcctcacccgaggatattaaaaaggcatatcggaaactggcactgaagtggcatccagataaaaatcctgagaataaagaagaagcagagagaaaattcaagcaagtagcggaggcatatgaagtgctgtcggatgctaagaaacgggacatctatgacaaatatggcaaagaaggattaaatggtggaggaggaggtggaagtcattttgacagtccatttgaatttggcttcacattccgtaacccagatgatgtcttcagggaattttttggtggaagggacccattttcatttgacttctttgaagacccttttgaggacttctttgggaatcgaaggggtccccgaggaagcagaagccgagggacggggtcgtttttctctgcgttcagtggatttccgtcttttggaagtggattttcttcttttgatacaggatttacttcatttgggtcactaggtcacgggggcctcacttcattctcttccacgtcatttggtggtagtggcatgggcaacttcaaatcgatatcaacttcaactaaaatggttaatggcagaaaaatcactacaaagagaattgtcgagaacggtcaagaaagagtagaagttgaagaagatggccagttaaagtccttaacaataaatggtaaggagcagctgctgcgcttggataacaagtaattcaacgcacgcacttaacagaaatgttaaactataacaagcaccatttgaggattaacaggaacatttttttgaagatttcaaacgaactcgactttcagtataattgtacctaaagtatttataaacagctcatcggagcctctatttgtcatagacttttgagttgattgttgggaccacataataggaccattttttttttgtctttaaaattgttgtaaatctctgtatgcactttgcttttttattaaacgtactccaaggtgagtcttgactctttagtgtaggacaagattgtacactaacaccagcatggacctgcttttcattgtgtctgaaatgtgagccacgtagtgtcggcctgctgtgaagttaacattgccaggacgattcttctacagaaataatttcaatttttttcagtatttagtagtgaaagatattaatacattaatggtaatacatttctggtttaatataaattaaggatgttttctagttgtgcatgaatgctggcaacttagtaagttttgacaattgtttaaatatgtaatgttaagcttaggtttaaaaaagtaaagctggtaaactgggtctttgtcatttgctttaaaaaaaaaa

SEQ ID NO: 371613 - DNA, 1646 bp, Homo sapiens
cgtgacgcatttcctgtttgttgttggagaaaggagagaaaggaaagcgcgaggagccgccgccaccaccagcgcagcagtcctggagctgtgaggagattcgggccgtcaccctgcctcccctgcgtcccgccaccggccgcttctgtcctcggacccattccaacaatctcgtaaaacatggtggattactatgaagttctaggcgtgcagagacatgcctcacccgaggatattaaaaaggcatatcggaaactggcactgaagtggcatccagataaaaatcctgagaataaagaagaagcagagagaaaattcaagcaagtagcggaggcatatgaagtgctgtcggatgctaagaaacgggacatctatgacaaatatggcaaagaaggattaaatggtggaggaggaggtggaagtcattttgacagtccatttgaatttggcttcacattccgtaacccagatgatgtcttcagggaattttttggtggaagggacccattttcatttgacttctttggacagggcagtgttcgggttgaagtcctgtgttctgatcggtgattctcgtggtgaccaagcgaggaagaaggcccgctcttccaacaccatggcttctcttctggggcacacgagaagacccttttgaggacttctttgggaatcgaaggggtccccgaggaagcagaagccgagggacggggtcgtttttctctgcgttcagtggatttccgtcttttggaagtggattttcttcttttgatacaggatttacttcatttgggtcactaggtcacgggggcctcacttcattctcttccacgtcatttggtggtagtggcatgggcaacttcaaatcgatatcaacttcaactaaaatggttaatggcagaaaaatcactacaaagagaattgtcgagaacggtcaagaaagagtagaagttgaagaagatggccagttaaagtccttaacaataaatggtaaggagcagctgctgcgcttggataacaagtaattcaacgcacgcacttaacagaaatgttaaactataacaagcaccatttgaggattaacaggaacatttttttgaagatttcaaacgaactcgactttcagtataattgtacctaaagtatttataaacagctcatcggagcctctatttgtcatagacttttgagttgattgttgggaccacataataggaccattttttttttgtctttaaaattgttgtaaatctctgtatgcactttgcttttttattaaacgtactccaaggtgagtcttgactctttagtgtaggacaagattgtacactaacaccagcatggacctgcttttcattgtgtctgaaatgtgagccacgtagtgtcggcctgctgtgaagttaacattgccaggacgattcttctacagaaataatttcaatttttttcagtatttagtagtgaaagatattaatacattaatggtaatacatttctggtttaatataaattaaggatgttttctagttgtgcatgaatgctggcaacttagtaagttttgacaattgtttaaatatgtaatgttaagcttaggtttaaaaaagtaaagctggtaaactgggtctttgtcatttgctttaaaaaaaaaa

SEQ ID NO: 371614 - DNA, 1485 bp, Homo sapiens
cgtgacgcatttcctgtttgttgttggagaaaggagagaaaggaaagcgcgaggagccgccgccaccaccagcgcagcagtcctggagctgtgaggagattcgggccgtcaccctgcctcccctgcgtcccgccaccggccgcttctgtcctcggacccattccaacaatctcgtaaaacatggtggattactatgaagttctaggcgtgcagagacatgcctcacccgaggatattaaaaaggcatatcggaaactggcactgaagtggcatccagataaaaatcctgagaataaagaagaagcagagactaagaaacgggacatctatgacaaatatggcaaagaaggattaaatggtggaggaggaggtggaagtcattttgacagtccatttgaatttggcttcacattccgtaacccagatgatgtcttcagggaattttttggtggaagggacccattttcatttgacttctttgaagacccttttgaggacttctttgggaatcgaaggggtccccgaggaagcagaagccgagggacggggtcgtttttctctgcgttcagtggatttccgtcttttggaagtggattttcttcttttgatacaggatttacttcatttgggtcactaggtcacgggggcctcacttcattctcttccacgtcatttggtggtagtggcatgggcaacttcaaatcgatatcaacttcaactaaaatggttaatggcagaaaaatcactacaaagagaattgtcgagaacggtcaagaaagagtagaagttgaagaagatggccagttaaagtccttaacaataaatggtaaggagcagctgctgcgcttggataacaagtaattcaacgcacgcacttaacagaaatgttaaactataacaagcaccatttgaggattaacaggaacatttttttgaagatttcaaacgaactcgactttcagtataattgtacctaaagtatttataaacagctcatcggagcctctatttgtcatagacttttgagttgattgttgggaccacataataggaccattttttttttgtctttaaaattgttgtaaatctctgtatgcactttgcttttttattaaacgtactccaaggtgagtcttgactctttagtgtaggacaagattgtacactaacaccagcatggacctgcttttcattgtgtctgaaatgtgagccacgtagtgtcggcctgctgtgaagttaacattgccaggacgattcttctacagaaataatttcaatttttttcagtatttagtagtgaaagatattaatacattaatggtaatacatttctggtttaatataaattaaggatgttttctagttgtgcatgaatgctggcaacttagtaagttttgacaattgtttaaatatgtaatgttaagcttaggtttaaaaaagtaaagctggtaaactgggtctttgtcatttgctttaaaaaaaaaa

SEQ ID NO: 371615 - DNA, 2114 bp, Homo sapiens
gagcttgggtgaagaaactgaacaccacctgcaactcgaggagggaaagagaagagtagttgtgtctacagataatacaggggagaaacgtggagctcctgcctgccgcaggcacgaagaagcataatcactctcatatctgaagacccttttgaggacttctttgggaatcgaaggggtccccgaggaagcagaagccgagggacggggtcgtttttctctgcgttcagtggatttccgtcttttggaagtggattttcttcttttgatacaggatttacttcatttgggtcactaggtcacgggggcctcacttcattctcttccacgtcatttggtggtagtggcatgggcaacttcaaatcgatatcaacttcaactaaaatggttaatggcagaaaaatcactacaaagagaattgtcgagaacggtcaagaaagagtagaagttgaagaagatggccagttaaagtccttaacaataaatggtgtggccgacgacgatgccctcgctgaggagcgcatgcggagaggccagaacgccctgccagcccagcctgccggcctccgcccgccgaagccgccccggcctgcctcgctgctgagacacgcgcctcactgtctctctgaggaggagggcgagcaggaccgacctcgggcacccgggccctgggaccccctcgcgtccgcagcaggattgaaagaaggtggcaagaggaagaagcagaagcagagagaggagtcgaagaagaagaagtcgaccaaaggcaatcactagaccggacttgaggcacgcggtgcacccccagacgctggcgctccaccgtgctcggcatgcggtcgtgcacacgcgctaggtagcagcgtcggtcaggactgtctcgaggccacactcgctcggcaggattatgcgatcacggatcagtcagagcagggtcaggagacggggctgacggcacgggtggcggggacagacgtttgggacttggccgcgactctctgcttctctccagctctcaatctgctgcattttcctctagtgcttccggatcctcttcattcttttcggctactcaaccactccgcatgctgctggaatatttctggctttagaagtacaggagggcgcagatggctaactgagtaacattcatgaaatgaggctttctgtggcggcgtagtgtttggaattagaaggtaattcagtagagtgtaacttagagaatattgcaagtgacacattgaatcctgcccgtcagggcaccttttcctcagagcaatccggccacacgaatagaaggctgtcgtgaatcacatcagatgtaaaatcattccttctgtttactcttttaattttcatcctttgcaggtagtgcaaattcaacttcaaatatggtgtaggttttgctagattccatatttttttcttggatttttgctaattatttttagcaaaaaatttttgctcagtggcaccctccctagtgtccatgggttagggccatgctggggaaaacgggccggtatttacacacgcgcaaaacacccagagacggcacaaggaggttgaactcatgtttcagttcgcgaacattgactccttacgaaagtcacttcattctaactagatgcgcccacttccggtcattatttcgtttgcatgatgtattgcttcttcacgttttgtttttattgagcacggagtagaattccagggctgccttgacttcttccctgcatgctccctcccagtgactttccttccctttcacatgaggatctgccgttcatgttgctttctcctttgtcctcttggacttgagggcattgtgaaaagctttgctgtgatttaaaaatgccagcaattttaatctagcagtgttgaagctgggaattttttggcgcaatccatgtagcagtgacccaggcttgggagccagaaacaagtgtgacctgggattttatttaacacaactgttgccaaagagttggctttgtttatttggttttggcggggagaggagtggtatttgatgctttctgtggacaatgtaaccctaaacacatcatgtattttaaatgccacctacataaataaaacataagcatattgaa

SEQ ID NO: 371616 - DNA, 562 bp, Homo sapiens
cgtgacgcatttcctgtttgttgttggagaaaggagagaaaggaaagcgcgaggagccgccgccaccaccagcgcagcagtcctggagctgtgaggagattcgggccgtcaccctgcctcccctgcgtcccgccaccggccgcttctgtcctcggacccattccaacaatctcgtaaaacatggtggattactatgaagttctaggcgtgcagagacatgcctcacccgaggatattaaaaaggcatatcggaaactggcactgaagtggcatccagataaaaatcctgagaataaagaagaagcagagagaaaattcaagcaagtagcggaggcatatgaagtgctgtcggatgctaagaaacgggacatctatgacaaatatggcaaagaaggattaaatggtggaggaggaggtggaagtcattaagcctgtccatacgaatccgtctgctcatggaggaggccggatgatctcctcagggaatagatgggcggcagggaccgattgacatagctccagttgggagaccctattgaaggctatgctggggaatatgtgg

SEQ ID NO: 371617 - DNA, 1078 bp, Homo sapiens
gggaggaggactgcgggctgcgcctgggcaggggatgagcttgtgtcgcgggcggcagggggaagggagtcggagagctcctgcggtccagccggatgactgatgaggttgaaagcacttccgctgcggcccccgcaggaagttcccaggaggaagttgcgaccctttctaagccatcccactggcctggactctgctgggattattttgaccccccagggcagagtgtagccatctgactggctttctctctcggcaggagacggggcgcacgcctgcaggttttgggatttgagattgacgcggtgaactctgtccagttttcaaaccacacaggctatgcccactggaagggccaagtgctgaattcagatgagctccaggagttgtacgaaggcctgaggctgaacaacatgaataaatatgactacgtgctcacaggttatacgagggacaagtcgttcctggccatggtggtggacattgtgcaggagctgaagcagcagaaccccaggctggtgtacgtgtgtgatccagtcttgggtgacaagtgggacggcgaaggctcgatgagcaagaccccatctcaaaaaacaaaagaaaaatctagaaaccacttaacccatgagctgtgtagtaacagcagcagctgcagcccacagacctggacgtcggatcaagtggatggagaacaaatccactgtgaccagtccagaagcctagaatttagaggcggaaggaacccaaaggtgatcctgcctgtgggtttttaactcagccattcagcgcccaggcgatttcagtatctgccttctttgtcgttgtgtctagggtgtctgtttgcttgctgtatattcactgagcacagcgggcttctccactggcacagggcacgcctgggcctgtgccctccctgccccgctgggtcagtggttgaagtcaggatatctgtcactgggcatctaactgggtggggcgggctggtgtgctcagcgtctgtctgtccactttctcccatgcttgttctctggaaggttccctgtcctgcgcccagcctgcaggaccccagcttgcagct

SEQ ID NO: 371618 - DNA, 1974 bp, Homo sapiens
  misc_feature (4)..(4): n is a, c, g, or t
  misc_feature (6)..(8): n is a, c, g, or t
ggcncnnngcggaactcgcgggttcggagccgcccgctgaggtcagaaggaggcgtctgcgctgatcgggtccgccgcgcgccagagccagagtcgcagccgaggggagccggggccggagcccgagcccgagccgagccggagcccgagcgagcggcggagaccgtgcccccgcctcggccccgcgccgccgcggccaggcccggcatggaggaggagtgccgggtgctctccatacagagccacgtcatccgcggctacgtgggcaaccgggcggccacgttcccgctgcaggttttgggatttgagattgacgcggtgaactctgtccagttttcaaaccacacaggctatgcccactggaagggccaagtgctgaattcagatgagctccaggagttgtacgaaggcctgaggctgaacaacatgaataaatatgactacgtgctcacaggttatacgagggacaagtcgttcctggccatggtggtggacattgtgcaggagctgaagcagcagaaccccaggctggtgtacgtgtgtgatccagtcttgggtgacaagtgggacggcgaaggctcgatgtacgtcccggaggacctccttcccgtctacaaagaaaaagtggtgccgcttgcagacattatcacgcccaaccagtttgaggccgagttactgagtggccggaagatccacagccaggaggaagccttgcgggtgatggacatgctgcactctatgggccccgacaccgtggtcatcaccagctccgacctgccctccccgcagggcagcaactacctgattgtgctggggagtcagaggaggaggaatcccgctggctccgtggtgatggaacgcatccggatggacattcgcaaagtggacgccgtctttgtgggcactggggacctgtttgctgccatgctcctggcgtggacacacaagcaccccaataacctcaaggtggcctgtgagaagaccgtgtctaccttgcaccacgttctgcagaggaccatccagtgtgcaaaagcccaggccggggaaggagtgaggcccagccccatgcagctggagctgcggatggtgcagagcaaaagggacatcgaggacccagagatcgtcgtccaggccacggtgctgtgagggccccgccgcttgcccgtgacacgcagcgcgttggtgtctccgtgtttgtccctgtgaaaacatgtaacgtctgccttagagccatgaccgaaacttgatatttttttctttcaaaaaaaaaaaaaaaaaaaaaaaaaaaaaaaaaaacaaaaaaaaaaaaaaaaaaaaaaaaaaaaaaaaaaaaaaaaaaaaaacaacaaaaagagagggggcgcgcgcgcgccgccccaatatccccccgcggggggcgccacacccacttatccccccaccccaagttgtttgtatagaacaaggagggggcccccccatacgcggcagcctctattatatatatacaacgccagcgcggcccggcgcgcggctactaataacaaacaccgacggtcacggtggagagaaccaaccaacccaccgcacacagcgcgactcaactctccccgtgcgaggcaggaaggcacccccccccattaccccgcgcgcgaggcgcggcagcacacacaccaacgcagcggagacgaacaaccccccccctcccgccgccgcacctccatccaacacagcccacccccaccgacgcgcgcccactccatcataacaccccacctgccaccgccagcgcgcccaccgcggacggcgggacgaccacaccaccaccccgccgcacacaattacacccccgcgcgccgcgcgcgccgaccagacgacagatcgtcgccgcacgcccccccccgacgggcccacccgcccatccccgtaccacaacctatctcttctctccaccggcgcgggcgcaccccccaccccccaaacacgcaccacccc

SEQ ID NO: 371619 - DNA, 1339 bp, Homo sapiens
gggaggaggactgcgggctgcgcctgggcaggggatgagcttgtgtcgcgggcggcagggggaagggagtcggagagctcctgcggtccagccggatgactgatgaggttgaaagcacttccgctgcggcccccgcaggaagttcccaggaggaagttgcgaccctttctaagccatcccactggcctggactctgctgggattattttgaccccccagggcagagtgtagccatctgactggctttctctctcggcaggagacggggcgcacgcctgcaggttttgggatttgagattgacgcggtgaactctgtccagttttcaaaccacacaggctatgcccactggaagggccaagtgctgaattcagatgagctccaggagttgtacgaaggcctgaggctgaacaacatgaataaatatgactacgtgctcacaggttatacgagggacaagtcgttcctggccatggtggtggacattgtgcaggagctgaagcagcagaaccccaggctggtgtacgtgtgtgatccagtcttgggtgacaagtgggacggcgaaggctcgatgtacgtcccggaggacctccttcccgtctacaaagaaaaagtggtgccgcttgcagacattatcacgcccaaccagtttgaggccgagttactgagtggccggaagatccacagccaggaggaagccttgcgggtgatggacatgctgcactctatgggccccgacaccgtggtcatcaccagctccgacctgccctccccgcagggcagcaactacctgattgtgctggggagtcagaggaggaggaatcccgctggctccgtggtgatggaacgcatccggatggacattcgcaaagtggacgccgtctttgtgggcactggggacctgtttgctgccatgctcctggcgtggacacacaagcaccccaataacctcaaggtggcctgtgagaagaccgtgtctaccttgcaccacgttctgcagaggaccatccagtgtgcaaaagcccaggccggggaaggagtgaggcccagccccatgcagctggagctgcggatggtgcagagcaaaagggacatcgaggacccagagatcgtcgtccaggccacggtgctgtgagggccccgccgcttgcccgtgacacgcagcgcgttggtgtctccgtgtttgtccctgtgaaaacatgtaacgtctgccttagagccatgaccgaaacttgatatttttttctttcatgagtgtccggcatctgctggtcttcattgtgaaacgtgccagtcgtgctttgtgaaaaataacaaagtggtcacagaaaaattgtgatc

SEQ ID NO: 371620 - DNA, 1104 bp, Homo sapiens
agcgggcgttccatgtgggcagccgttgggacctgccaagcactgcgcctagtgatctccttcgggtttgagccagtccatggggaggagccgtccaccaggctatgcccactggaagggccaagtgctgaattcagatgagctccaggagttgtacgaaggcctgaggctgaacaacatgaataaatatgactacgtgctcacaggttatacgagggacaagtcgttcctggccatggtggtggacattgtgcaggagctgaagcagcagaaccccaggctggtgtacgtgtgtgatccagtcttgggtgacaagtgggacggcgaaggctcgatgtacgtcccggaggacctccttcccgtctacaaagaaaaagtggtgccgcttgcagacattatcacgcccaaccagtttgaggccgagttactgagtggccggaagatccacagccaggaggaagccttgcgggtgatggacatgctgcactctatgggccccgacaccgtggtcatcaccagctccgacctgccctccccgcagggcagcaactacctgattgtgctggggagtcagaggaggaggaatcccgctggctccgtggtgatggaacgcatccggatggacattcgcaaagtggacgccgtctttgtgggcactggggacctgtttgctgccatgctcctggcgtggacacacaagcaccccaataacctcaaggtggcctgtgagaagaccgtgtctaccttgcaccacgttctgcagaggaccatccagtgtgcaaaagcccaggccggggaaggagtgaggcccagccccatgcagctggagctgcggatggtgcagagcaaaagggacatcgaggacccagagatcgtcgtccaggccacggtgctgtgagggccccgccgcttgcccgtgacacgcagcgcgttggtgtctccgtgtttgtccctgtgaaaacatgtaacgtctgccttagagccatgaccgaaacttgatatttttttctttcatgagtgtccggcatctgctggtcttcattgtgaaacgtgccagtcgtgctttgtgaaaaataacaaagtggtcacagaaaaattgtgatc

SEQ ID NO: 371621 - DNA, 1527 bp, Homo sapiens
gccaggctcagggtacacctattgccagggagctcccactgattccttgtgagtgtagcacagatttgttgcgactggaccatctgcacgtctgggcttcagagctgttctccccagctgttttctgccaggtcctgtcagaggcagccaccctccctgggcagagcatcagtttcacattcttggtacctcctggtggtgcctgggagggagccactgctgtacagagatgccaattccagaggcatggtccggcacagagcgctggcttccagctgaaggacatgtgtaacagcaggagatacctttctctggggtcccaggctcccgtcctggaccttggcaccccgccccccgtgcattgtcgtcttctgagtctggctttgtctggcacatgaagttggatgggtagactctggaagcgtccagaccagcttgcgatgctgatgaataagctgattttgatggggttttgggatttgagattgacgcggtgaactctgtccagttttcaaaccacacaggctatgcccactggaagggccaagtgctgaattcagatgagctccaggagttgtacgaaggcctgaggctgaacaacatgaataaatatgactacgtgctcacaggttatacgagggacaagtcgttcctggccatggtggtggacattgtgcaggagctgaagcagcagaaccccaggctggtgtacgtgtgtgatccagtcttgggtgacaagtgggacggcgaaggctcgatgtacgtcccggaggacctccttcccgtctacaaagaaaaagtggtgccgcttgcagacattatcacgcccaaccagtttgaggccgagttactgagtggccggaagatccacagccaggaggaagccttgcgggtgatggacatgctgcactctatgggccccgacaccgtggtcatcaccagctccgacctgccctccccgcagggcagcaactacctgattgtgctggggagtcagaggaggaggaatcccgctggctccgtggtgatggaacgcatccggatggacattcgcaaagtggacgccgtctttgtgggcactggggacctgtttgctgccatgctcctggcgtggacacacaagcaccccaataacctcaaggtggcctgtgagaagaccgtgtctaccttgcaccacgttctgcagaggaccatccagtgtgcaaaagcccaggccggggaaggagtgaggcccagccccatgcagctggagctgcggatggtgcagagcaaaagggacatcgaggacccagagatcgtcgtccaggccacggtgctgtgagggccccgccgcttgcccgtgacacgcagcgcgttggtgtctccgtgtttgtccctgtgaaaacatgtaacgtctgccttagagccatgaccgaaacttgatatttttttctttcatgagtgtccggcatctgctggtcttcattgtgaaacgtgccagtcgtgctttgtgaaaaataacaaagtggtcacagaaaaattgtgatc

SEQ ID NO: 371622 - DNA, 1120 bp, Homo sapiens
cggtacagatccctttcatccatcgcggctaccgtgggcaacgcggcacgttcccgctgcaggttttgggatttgagattgacgcggtgaactctgtccagttttcaaaccacacaggctatgcccactggaagggccaagtgctgaattcagatgagctccaggagttgtacgaaggcctgaggctgaacaacatgaataaatatgactacgtgctcacaggttatacgagggacaagtcgttcctggccatggtggtggacattgtgcaggagctgaagcagcagaaccccaggctggtgtacgtgtgtgatccagtcttgggtgacaagtgggacggcgaaggctcgatgtacgtcccggaggacctccttcccgtctacaaagaaaaagtggtgccgcttgcagacattatcacgcccaaccagtttgaggccgagttactgagtggccggaagatccacagccaggaggaagccttgcgggtgatggacatgctgcactctatgggccccgacaccgtggtcatcaccagctccgacctgccctccccgcagggcagcaactacctgattgtgctggggagtcagaggaggaggaatcccgctggctccgtggtgatggaacgcatccggatggacattcgcaaagtggacgccgtctttgtgggcactggggacctgtttgctgccatgctcctggcgtggacacacaagcaccccaataacctcaaggtggcctgtgagaagaccgtgtctaccttgcaccacgttctgcagaggaccatccagtgtgcaaaagcccaggccggggaaggagtgaggcccagccccatgcagctggagctgcggatggtgcagagcaaaagggacatcgaggacccagagatcgtcgtccaggccacggtgctgtgagggccccgccgcttgcccgtgacacgcagcgcgttggtgtctccgtgtttgtccctgtgaaaacatgtaacgtctgccttagagccatgaccgaaacttgatatttttttctttcatgagtgtccggcatctgctggtcttcattgtgaaacgtgccagtcgtgctttgtgaaaaataacaaagtggtcacagaaaaattgtgatc

SEQ ID NO: 371623 - DNA, 1028 bp, Homo sapiens
gggggagcaacgcagccgtgagccggctatgcccactggaagggccaagtgctgaattcagatgagctccaggagttgtacgaaggcctgaggctgaacaacatgaataaatatgactacgtgctcacaggttatacgagggacaagtcgttcctggccatggtggtggacattgtgcaggagctgaagcagcagaaccccaggctggtgtacgtgtgtgatccagtcttgggtgacaagtgggacggcgaaggctcgatgtacgtcccggaggacctccttcccgtctacaaagaaaaagtggtgccgcttgcagacattatcacgcccaaccagtttgaggccgagttactgagtggccggaagatccacagccaggaggaagccttgcgggtgatggacatgctgcactctatgggccccgacaccgtggtcatcaccagctccgacctgccctccccgcagggcagcaactacctgattgtgctggggagtcagaggaggaggaatcccgctggctccgtggtgatggaacgcatccggatggacattcgcaaagtggacgccgtctttgtgggcactggggacctgtttgctgccatgctcctggcgtggacacacaagcaccccaataacctcaaggtggcctgtgagaagaccgtgtctaccttgcaccacgttctgcagaggaccatccagtgtgcaaaagcccaggccggggaaggagtgaggcccagccccatgcagctggagctgcggatggtgcagagcaaaagggacatcgaggacccagagatcgtcgtccaggccacggtgctgtgagggccccgccgcttgcccgtgacacgcagcgcgttggtgtctccgtgtttgtccctgtgaaaacatgtaacgtctgccttagagccatgaccgaaacttgatatttttttctttcatgagtgtccggcatctgctggtcttcattgtgaaacgtgccagtcgtgctttgtgaaaaataacaaagtggtcacagaaaaattgtgatc

SEQ ID NO: 371624 - DNA, 2483 bp, Homo sapiens
tcaatcctccagcctcagcctcccaaagtgctgcgatcacaggtgtgagccactgtgcctggccatatgactcagtttttaataatgactctacgtaaaactgacctgcactattgcatctggcaatcgcgtggcccaatccatcttcaaagccagcaacagtcgttgagtccttcttttaacttccaatctctgatttttccttctgcccttcagcctgagaaaactctgcttttgaagggctcatgtcattcaattaaactctcctggataagaagatcctcatgggagagagatctcatcacactgacaggtttcacccacactcagggggttgcccgagggtgagcggggtccctgaaggtcattcttagaattctgccacggaagagccccataggccatgatagggacagggtttactgtaaaacaaggtgattcacatacacagaccagtaatgctgttcctaaaggggcccaagctgatcccatcagtcagcagggctgctcacagggcacttggcctgtctttgttgaaggcgattcctgtgaaggcagtggaggagctccgggtgggaggtgagtgttgtggagagcccagcagcccgctgggctgaaccttggaccaagaaccagtctgtccttggctcccttgtgggtggggaaagatgaggtgtatcagcagggtccagtccagaaacagaaaccagagcaacaatcgtagaggccgttgttcagccaggtattgagaaaatagagaaggcaaaaagggaacactggtgtcgtggaggagacccctgccagcattggctccacacagctgaccctgggataagagaattgttggactctttagaacctggagctgggaaggcaggtgtctgccagctggcgggtgctgggagtctgtgggggcatgcgatgaggaattctgctggtggagggaaagccacaaagtggattccgctgctgctatgggaagggacggtcactaccgctgcccctgtggggagaagagccccgggggaagaagagcactgctgacagaagcccattctcttcgcaggcttcagtttcacattcttggtacctcctggtggtgcctgggagggagccactgctgtacagagatgccaattccagaggcatggtccggcacagagcgctggcttccagctgaaggacatgtgtaacagcaggagatacctttctctggggtcccaggctcccgtcctggaccttggcaccccgccccccgtgcattgtcgtcttctgagtctggctttgtctggcacatgaagttggatgggtagactctggaagcgtccagaccagcttgcgatgctgatgaataagctgattttgatggggttttgggatttgagattgacgcggtgaactctgtccagttttcaaaccacacaggctatgcccactggaagggccaagtgctgaattcagatgagctccaggagttgtacgaaggcctgaggctgaacaacatgaataaatatgactacgtgctcacagttgatcgtggtgagtctcctgttttctgagggtgacctggattctccccctaaaggttatacgagggacaagtcgttcctggccatggtggtggacattgtgcaggagctgaagcagcagaaccccaggctggtgtacgtgtgtgatccagtcttgggtgacaagtgggacggcgaaggctcgatgtacgtcccggaggacctccttcccgtctacaaagaaaaagtggtgccgcttgcagacattatcacgcccaaccagtttgaggccgagttactgagtggccggaagatccacagccaggaggaagccttgcgggtgatggacatgctgcactctatgggccccgacaccgtggtcatcaccagctccgacctgccctccccgcagggcagcaactacctgattgtgctggggagtcagaggaggaggaatcccgctggctccgtggtgatggaacgcatccggatggacattcgcaaagtggacgccgtctttgtgggcactggggacctgtttgctgccatgctcctggcgtggacacacaagcaccccaataacctcaaggtggcctgtgagaagaccgtgtctaccttgcaccacgttctgcagaggaccatccagtgtgcaaaagcccaggccggggaaggagtgaggcccagccccatgcagctggagctgcggatggtgcagagcaaaagggacatcgaggacccagagatcgtcgtccaggccacggtgctgtgagggccccgccgcttgcccgtgacacgcagcgcgttggtgtctccgtgtttgtccctgtgaaaacatgtaacgtctgccttagagccatgaccgaaacttgatatttttttctttcatgagtgtccggcatctgctggtcttcattgtgaaacgtgccagtcgtgctttgtgaaaaataacaaagtggtcacagaaaaattgtgatc

SEQ ID NO: 371625 - DNA, 807 bp, Homo sapiens
gtatgtatcgtctgagttcagaggatccaagatgcaaaagtacgtcccggaggacctccttcccgtctacaaagaaaaagtggtgccgcttgcagacattatcacgcccaaccagtttgaggccgagttactgagtggccggaagatccacagccaggaggaagccttgcgggtgatggacatgctgcactctatgggccccgacaccgtggtcatcaccagctccgacctgccctccccgcagggcagcaactacctgattgtgctggggagtcagaggaggaggaatcccgctggctccgtggtgatggaacgcatccggatggacattcgcaaagtggacgccgtctttgtgggcactggggacctgtttgctgccatgctcctggcgtggacacacaagcaccccaataacctcaaggtggcctgtgagaagaccgtgtctaccttgcaccacgttctgcagaggaccatccagtgtgcaaaagcccaggccggggaaggagtgaggcccagccccatgcagctggagctgcggatggtgcagagcaaaagggacatcgaggacccagagatcgtcgtccaggccacggtgctgtgagggccccgccgcttgcccgtgacacgcagcgcgttggtgtctccgtgtttgtccctgtgaaaacatgtaacgtctgccttagagccatgaccgaaacttgatatttttttctttcatgagtgtccggcatctgctggtcttcattgtgaaacgtgccagtcgtgctttgtgaaaaataacaaagtggtcacagaaaaattgtgatc

SEQ ID NO: 371626 - DNA, 1274 bp, Homo sapiens
  misc_feature (4)..(4): n is a, c, g, or t
  misc_feature (6)..(8): n is a, c, g, or t
ggcncnnngcggaactcgcgggttcggagccgcccgctgaggtcagaaggaggcgtctgcgctgatcgggtccgccgcgcgccagagccagagtcgcagccgaggggagccggggccggagcccgagcccgagccgagccggagcccgagcgagcggcggagaccgtgcccccgcctcggccccgcgccgccgcggccaggcccggcatggaggaggagtgccgggtgctctccatacagagccacgtcatccgcggctacgtgggcaaccgggcggccacgttcccgctgcaggttttgggatttgagattgacgcggtgaactctgtccagttttcaaaccacacaggctatgcccactggaagggccaagtgctgaattcagatgagctccaggagttgtacgaaggcctgaggctgaacaacatgaataaatatgactacgtgctcacaggttatacgagggacaagtcgttcctggccatggtggtggacattgtgcaggagctgaagcagcagaaccccaggctggtgtacgtgtgtgatccagtcttgggtgacaagtgggacggcgaaggctcgatgtacgtcccggaggacctccttcccgtctacaaagaaaaagtggtgccgcttgcagacattatcacgcccaaccagtttgaggccgagttactgagtggccggaagatccacagccaggaggaagccttgcggaactacctgattgtgctggggagtcagaggaggaggaatcccgctggctccgtggtgatggaacgcatccggatggacattcgcaaagtggacgccgtctttgtgggcactggggacctgtttgctgccatgctcctggcgtggacacacaagcaccccaataacctcaaggtggcctgtgagaagaccgtgtctaccttgcaccacgttctgcagaggaccatccagtgtgcaaaagcccaggccggggaaggagtgaggcccagccccatgcagctggagctgcggatggtgcagagcaaaagggacatcgaggacccagagatcgtcgtccaggccacggtgctgtgagggccccgccgcttgcccgtgacacgcagcgcgttggtgtctccgtgtttgtccctgtgaaaacatgtaacgtctgccttagagccatgaccgaaacttgatatttttttctttcatgagtgtccggcatctgctggtcttcattgtgaaacgtgccagtcgtgctttgtgaaaaataacaaagtggtcacagaaaaattgtgatc

SEQ ID NO: 371627 - DNA, 2256 bp, Homo sapiens
  misc_feature (4)..(4): n is a, c, g, or t
  misc_feature (6)..(8): n is a, c, g, or t
ggcncnnngcggaactcgcgggttcggagccgcccgctgaggtcagaaggaggcgtctgcgctgatcgggtccgccgcgcgccagagccagagtcgcagccgaggggagccggggccggagcccgagcccgagccgagccggagcccgagcgagcggcggagaccgtgcccccgcctcggccccgcgccgccgcggccaggcccggcatggaggaggagtgccgggtgctctccatacagagccacgtcatccgcggctacgtgggcaaccgggcggccacgttcccgctgcaggttttgggatttgagattgacgcggtgaactctgtccagttttcaaaccacacagagacaaggtcggtctctgtcgcccaggctggcgtgaagtggcgcaaccagctcactgcagccttgacctcctgggctgaagcaatctttctgcctccacctcccgagtggctgggactatagttgtgcaccagcacgcccacctcctgcccagggttgttactggggtggtcacgtgggcagcttctgcctgggatgggccacaaagccagactcccggcagggacacgggtgttccacacaagctgcgttgttggttccctgacgcccttcaggctggggggtgggaaagccgatcccccaagtgcctgcagagcccacctggcgcaggcctcgccgcctcgaggctgctgctcgcacttctgccccttcccccggccaggcccccgttccttgaggccgtaccacaaggtgcgttcatttttccacaccgtgagctgggcttggcagagcctccaccttgtggccagtattcccagtggcccctttgagaggatttcctggagctccctgtctgagcttcccggactgagggcactgggaaggagcctgcggagctggaggtcagcgggtggacgggttgcgctgtcctggctttcggagtgtagagccagaggggatgggacaggtgccctgctgctgggcttggtggtccctgctgcagggaaggggcagctggtgtgaacacaaggagctgcggggctggagaaggccagggccaggagcctgccgacggacaccagcgaggggccaggccgggccaggagcctgccgacggacaccagcgaggggccaggccgggccagactccctggccggctgggatctgacaggagcgccaggctccttgggccgcccgaggaaccgcttgtttgcctgtgctttttcatctgtaaatggaatgagttggacacaagatccaagcgccctcccctgttggagaaggttcttgtgggctctgggcccatcccacatcccacagtgggcaggaggccaccaagaggtgcaagaccatgccctctgtttcgataggaagctgggcctcagaggggcctggggcctgtgtctgagacccggccaagtgctggacgtctccccttcctcatggctgttatggctgaattacgtccccccaaattctcatgttgcagccttaaccccagcacctcagtgtgggactgggtttggagatggagcccctacagaggtcagcaggttaaaagaggccatcagggctctgggtgggccctgatccaagctgcttggtgtccttgtaagaagaagagatgaggacacagacacacacagagggacagccccatgaggaaacagggaggcaatgccgtctgcaagcccagggcagaggcctcaggaaccagccctggtgacacctggaccttggacccccgtgcccaggacagtaggagaattggagccgcctggctgcagtccttcccgatggcaccctgtattagtccgttctcacactgctaattgttgggaaaagggcttgtggaatgcctgtataaactggccatgaaaatatgggacaataagttgtggaaagccacaagaggcctctgaggaggaaagcctcctaattgccatcatgttcgcatgctcagggcgagacctgctgtcttatctgtaaacaccgtgttcaaggagaaagacattccttcgaagcactggactgtggacagacacacgagctcctggttaagcccgctcccaccagctcctgtccgataagttaaagatacgctgtttgagcacaaaggagattcattgaaaccgctattgctgtagattacgcctgtgacgcactgcctccctttcactgtttcgccctgaatatctgcttctcagatctaagtgactgtactcaataaatagcgtggagaccag

SEQ ID NO: 371628 - DNA, 1186 bp, Homo sapiens
  misc_feature (4)..(4): n is a, c, g, or t
  misc_feature (6)..(8): n is a, c, g, or t
ggcncnnngcggaactcgcgggttcggagccgcccgctgaggtcagaaggaggcgtctgcgctgatcgggtccgccgcgcgccagagccagagtcgcagccgaggggagccggggccggagcccgagcccgagccgagccggagcccgagcgagcggcggagaccgtgcccccgcctcggccccgcgccgccgcggccaggcccggcatggaggaggagtgccgggtgctctccatacagagccacgtcatccgcggctacgtgggcaaccgggcggccacgttcccgctgcaggttttgggatttgagattgacgcggtgaactctgtccagttttcaaaccacacaggctatgcccactggaagggccaagtgctgaattcagatgagctccaggagttgtacgaaggcctgaggctgaacaacatgaataaatatgactacgtgctcacaggttatacgagggacaagtcgttcctggccatggtggtggacattgtgcaggagctgaagcagcagaaccccaggctggtgtacgtgtgtgatccagtcttgggtgacaagtgggacggcgaaggctcgatgtacgtcccggaggacctccttcccgtctacaaagaaaaagtggtgccgcttgcagacattatcacgcccaaccagtttgaggccgagttactgagtggccggaagatccacagccaggaggaagccttgcggtggacgccgtctttgtgggcactggggacctgtttgctgccatgctcctggcgtggacacacaagcaccccaataacctcaaggtggcctgtgagaagaccgtgtctaccttgcaccacgttctgcagaggaccatccagtgtgcaaaagcccaggccggggaaggagtgaggcccagccccatgcagctggagctgcggatggtgcagagcaaaagggacatcgaggacccagagatcgtcgtccaggccacggtgctgtgagggccccgccgcttgcccgtgacacgcagcgcgttggtgtctccgtgtttgtccctgtgaaaacatgtaacgtctgccttagagccatgaccgaaacttgatatttttttctttcatgagtgtccggcatctgctggtcttcattgtgaaacgtgccagtcgtgctttgtgaaaaataacaaagtggtcacagaaaaattgtgatc

SEQ ID NO: 371629 - DNA, 1564 bp, Homo sapiens
  misc_feature (4)..(4): n is a, c, g, or t
  misc_feature (6)..(8): n is a, c, g, or t
ggcncnnngcggaactcgcgggttcggagccgcccgctgaggtcagaaggaggcgtctgcgctgatcgggtccgccgcgcgccagagccagagtcgcagccgaggggagccggggccggagcccgagcccgagccgagccggagcccgagcgagcggcggagaccgtgcccccgcctcggccccgcgccgccgcggccaggcccggcatggaggaggagtgccgggtgctctccatacagagccacgtcatccgcggctacgtgggcaaccgggcggccacgttcccgctgcaggttttgggatttgagattgacgcggtgaactctgtccagttttcaaaccacacaggctatgcccactggaagggccaagtgctgaattcagatgagctccaggagttgtacgaaggcctgaggctgaacaacatgaataaatatgactacgtgctcacaggttatacgagggacaagtcgttcctggccatggtggtggacattgtgcaggagctgaagcagcagaaccccaggctggtgtacgtgtgtgatccagtcttgggtgacaagtgggacggcgaaggctcgatgtacgtcccggaggacctccttcccgtctacaaagaaaaagtggtgccgcttgcagacattatcacgcccaaccagtttgaggccgagttactgagtggccggaagatccacagccaggaggaagccttgcggccaggccacggtgctgtgagggccccgccgcttgcccgtgacacgcagcgcgttggtgtctccgtgtttgtccctgtgaaaacatgtaacgtctgccttagagccatgaccgaaacttgatatttttttctttcaaaaaaaaaaaaaaaaaaaaaaaaaaaaaaaaaaacaaaaaaaaaaaaaaaaaaaaaaaaaaaaaaaaaaaaaaaaaaaaaacaacaaaaagagagggggcgcgcgcgcgccgccccaatatccccccgcggggggcgccacacccacttatccccccaccccaagttgtttgtatagaacaaggagggggcccccccatacgcggcagcctctattatatatatacaacgccagcgcggcccggcgcgcggctactaataacaaacaccgacggtcacggtggagagaaccaaccaacccaccgcacacagcgcgactcaactctccccgtgcgaggcaggaaggcacccccccccattaccccgcgcgcgaggcgcggcagcacacacaccaacgcagcggagacgaacaaccccccccctcccgccgccgcacctccatccaacacagcccacccccaccgacgcgcgcccactccatcataacaccccacctgccaccgccagcgcgcccaccgcggacggcgggacgaccacaccaccaccccgccgcacacaattacacccccgcgcgccgcgcgcgccgaccagacgacagatcgtcgccgcacgcccccccccgacgggcccacccgcccatccccgtaccacaacctatctcttctctccaccggcgcgggcgcaccccccaccccccaaacacgcaccacccc

SEQ ID NO: 371630 - DNA, 454 bp, Homo sapiens
cagagcaggtagctgggaccgggcatctgctcagccctccgggctctccgtggtgggcagtccgcagcgtggcctgtgagaagaccgtgtctaccttgcaccacgttctgcagaggaccatccagtgtgcaaaagcccaggccggggaaggagtgaggcccagccccatgcagctggagctgcggatggtgcagagcaaaagggacatcgaggacccagagatcgtcgtccaggccacggtgctgtgagggccccgccgcttgcccgtgacacgcagcgcgttggtgtctccgtgtttgtccctgtgaaaacatgtaacgtctgccttagagccatgaccgaaacttgatatttttttctttcatgagtgtccggcatctgctggtcttcattgtgaaacgtgccagtcgtgctttgtgaaaaataacaaagtggtcacagaaaaattgtgatc

SEQ ID NO: 371631 - DNA, 3332 bp, Homo sapiens
tcaatcctccagcctcagcctcccaaagtgctgcgatcacaggtgtgagccactgtgcctggccatatgactcagtttttaataatgactctacgtaaaactgacctgcactattgcatctggcaatcgcgtggcccaatccatcttcaaagccagcaacagtcgttgagtccttcttttaacttccaatctctgatttttccttctgcccttcagcctgagaaaactctgcttttgaagggctcatgtcattcaattaaactctcctggataagaagatcctcatgggagagagatctcatcacactgacaggtttcacccacactcagggggttgcccgagggtgagcggggtccctgaaggtcattcttagaattctgccacggaagagccccataggccatgatagggacagggtttactgtaaaacaaggtgattcacatacacagaccagtaatgctgttcctaaaggggcccaagctgatcccatcagtcagcagggctgctcacagggcacttggcctgtctttgttgaaggcgattcctgtgaaggcagtggaggagctccgggtgggaggtgagtgttgtggagagcccagcagcccgctgggctgaaccttggaccaagaaccagtctgtccttggctcccttgtgggtggggaaagatgaggtgtatcagcagggtccagtccagaaacagaaaccagagcaacaatcgtagaggccgttgttcagccaggtattgagaaaatagagaaggcaaaaagggaacactggtgtcgtggaggagacccctgccagcattggctccacacagctgaccctgggataagagaattgttggactctttagaacctggagctgggaaggcaggtgtctgccagctggcgggtgctgggagtctgtgggggcatgcgatgaggaattctgctggtggagggaaagccacaaagtggattccgctgctgctatgggaagggacggtcactaccgctgcccctgtggggagaagagccccgggggaagaagagcactgctgacagaagcccattctcttcgcaggcttcagtttcacattcttggtacctcctggtggtgcctgggagggagccactgctgtacagagatgccaattccagaggcatggtccggcacagagcgctggcttccagctgaaggacatgtgtaacagcaggagatacctttctctggggtcccaggctcccgtcctggaccttggcaccccgccccccgtgcattgtcgtcttctgagtctggctttgtctggcacatgaagttggatgggtagactctggaagcgtccagaccagcttgcgatgctgatgaataagctgattttgatggggttttgggatttgagattgacgcggtgaactctgtccagttttcaaaccacacagagacaaggtcggtctctgtcgcccaggctggcgtgaagtggcgcaaccagctcactgcagccttgacctcctgggctgaagcaatctttctgcctccacctcccgagtggctgggactatagttgtgcaccagcacgcccacctcctgcccagggttgttactggggtggtcacgtgggcagcttctgcctgggatgggccacaaagccagactcccggcagggacacgggtgttccacacaagctgcgttgttggttccctgacgcccttcaggctggggggtgggaaagccgatcccccaagtgcctgcagagcccacctggcgcaggcctcgccgcctcgaggctgctgctcgcacttctgccccttcccccggccaggcccccgttccttgaggccgtaccacaaggtgcgttcatttttccacaccgtgagctgggcttggcagagcctccaccttgtggccagtattcccagtggcccctttgagaggatttcctggagctccctgtctgagcttcccggactgagggcactgggaaggagcctgcggagctggaggtcagcgggtggacgggttgcgctgtcctggctttcggagtgtagagccagaggggatgggacaggtgccctgctgctgggcttggtggtccctgctgcagggaaggggcagctggtgtgaacacaaggagctgcggggctggagaaggccagggccaggagcctgccgacggacaccagcgaggggccaggccgggccaggagcctgccgacggacaccagcgaggggccaggccgggccagactccctggccggctgggatctgacaggagcgccaggctccttgggccgcccgaggaaccgcttgtttgcctgtgctttttcatctgtaaatggaatgagttggacacaagatccaagcgccctcccctgttggagaaggttcttgtgggctctgggcccatcccacatcccacagtgggcaggaggccaccaagaggtgcaagaccatgccctctgtttcgataggaagctgggcctcagaggggcctggggcctgtgtctgagacccggccaagtgctggacgtctccccttcctcatggctgttatggctgaattacgtccccccaaattctcatgttgcagccttaaccccagcacctcagtgtgggactgggtttggagatggagcccctacagaggtcagcaggttaaaagaggccatcagggctctgggtgggccctgatccaagctgcttggtgtccttgtaagaagaagagatgaggacacagacacacacagagggacagccccatgaggaaacagggaggcaatgccgtctgcaagcccagggcagaggcctcaggaaccagccctggtgacacctggaccttggacccccgtgcccaggacagtaggagaattggagccgcctggctgcagtccttcccgatggcaccctgtattagtccgttctcacactgctaattgttgggaaaagggcttgtggaatgcctgtataaactggccatgaaaatatgggacaataagttgtggaaagccacaagaggcctctgaggaggaaagcctcctaattgccatcatgttcgcatgctcagggcgagacctgctgtcttatctgtaaacaccgtgttcaaggagaaagacattccttcgaagcactggactgtggacagacacacgagctcctggttaagcccgctcccaccagctcctgtccgataagttaaagatacgctgtttgagcacaaaggagattcattgaaaccgctattgctgtagattacgcctgtgacgcactgcctccctttcactgtttcgccctgaatatctgcttctcagatctaagtgactgtactcaataaatagcgtggagaccag

SEQ ID NO: 371632 - DNA, 1880 bp, Homo sapiens
tcaatcctccagcctcagcctcccaaagtgctgcgatcacaggtgtgagccactgtgcctggccatatgactcagtttttaataatgactctacgtaaaactgacctgcactattgcatctggcaatcgcgtggcccaatccatcttcaaagccagcaacagtcgttgagtccttcttttaacttccaatctctgatttttccttctgcccttcagcctgagaaaactctgcttttgaagggctcatgtcattcaattaaactctcctggataagaagatcctcatgggagagagatctcatcacactgacaggtttcacccacactcagggggttgcccgagggtgagcggggtccctgaaggtcattcttagaattctgccacggaagagccccataggccatgatagggacagggtttactgtaaaacaaggtgattcacatacacagaccagtaatgctgttcctaaaggggcccaagctgatcccatcagtcagcagggctgctcacagggcacttggcctgtctttgttgaaggcgattcctgtgaaggcagtggaggagctccgggtgggaggtgagtgttgtggagagcccagcagcccgctgggctgaaccttggaccaagaaccagtctgtccttggctcccttgtgggtggggaaagatgaggtgtatcagcagggtccagtccagaaacagaaaccagagcaacaatcgtagaggccgttgttcagccaggtattgagaaaatagagaaggcaaaaagggaacactggtgtcgtggaggagacccctgccagcattggctccacacagctgaccctgggataagagaattgttggactctttagaacctggagctgggaaggcaggtgtctgccagctggcgggtgctgggagtctgtgggggcatgcgatgaggaattctgctggtggagggaaagccacaaagtggattccgctgctgctatgggaagggacggtcactaccgctgcccctgtggggagaagagccccgggggaagaagagcactgctgacagaagcccattctcttcgcaggcttcagtttcacattcttggtacctcctggtggtgcctgggagggagccactgctgtacagagatgccaattccagaggcatggtccggcacagagcgctggcttccagctgaaggacatgtgtaacagcaggagatacctttctctggggtcccaggctcccgtcctggaccttggcaccccgccccccgtgcattgtcgtcttctgagtctggctttgtctggcacatgaagttggatgggtagactctggaagcgtccagaccagcttgcgatgctgatgaataagctgattttgatggggttttgggatttgagattgacgcggtgaactctgtccagttttcaaaccacacaggctatgcccactggaagggccaagtgctgaattcagatgagctccaggagttgtacgaaggcctgaggctgaacaacatgaataaatatgactacgtgctcacagttgatcgtggtgagtctcctgttttctgagggtgacctggattctccccctaaaggttatacgagggacaagtcgttcctggccatggtggtggacattgtgcaggagctgaagcagcagaaccccaggctggtgtacgtgtgtgatccagtcttgggtgacaagtgggacggcgaaggctcgatggtgagtagtttcacgtgtgtgatttaaaagtgtggtgagtggagctattcctgtccagccagaagacaggcccacatctctaagtgtctaactcggtgggactcctctgtccaggggtaaaaagacaaaccttgttaggaaggagaaagggaaccgacatattt

SEQ ID NO: 371633 - DNA, 761 bp, Homo sapiens
  misc_feature (4)..(4): n is a, c, g, or t
  misc_feature (6)..(8): n is a, c, g, or t
ggcncnnngcggaactcgcgggttcggagccgcccgctgaggtcagaaggaggcgtctgcgctgatcgggtccgccgcgcgccagagccagagtcgcagccgaggggagccggggccggagcccgagcccgagccgagccggagcccgagcgagcggcggagaccgtgcccccgcctcggccccgcgccgccgcggccaggcccggcatggaggaggagtgccgggtgctctccatacagagccacgtcatccgcggctacgtgggcaaccgggcggccacgttcccgctgcaggttttgggatttgagattgacgcggtgaactctgtccagttttcaaaccacacaggctatgcccactggaagggccaagtgctgaattcagatgagctccaggagttgtacgaaggcctgaggctgaacaacatgaataaatatgactacgtgctcacaggttatacgagggacaagtcgttcctggccatggtggtggacattgtgcaggagctgaagcagcagaaccccaggctggtgtacgtgtgtgatccagtcttgggtgacaagtgggacggcgaaggctcgatgtacgtcccggaggacctccttcccgtctacaaagaaaaagtggctgccttagagccatgaccgaaacttgatatttttttctttcatgagtgtccggcatctgctggtcttcattgtgaaacgtgccagtcgtgctttgtgaaaaataacaaagtggtcacagaaaaattgtgatc

SEQ ID NO: 371634 - DNA, 740 bp, Homo sapiens
  misc_feature (4)..(4): n is a, c, g, or t
  misc_feature (6)..(8): n is a, c, g, or t
ggcncnnngcggaactcgcgggttcggagccgcccgctgaggtcagaaggaggcgtctgcgctgatcgggtccgccgcgcgccagagccagagtcgcagccgaggggagccggggccggagcccgagcccgagccgagccggagcccgagcgagcggcggagaccgtgcccccgcctcggccccgcgccgccgcggccaggcccggcatggaggaggagtgccgggtgctctccatacagagccacgtcatccgcggctacgtgggcaaccgggcggccacgttcccgctgcaggttttgggatttgagattgacgcggtgaactctgtccagttttcaaaccacacaggctatgcccactggaagggccaagtgctgaattcagatgagctccaggagttgtacgaaggcctgaggctgaacaacatgaataaatatgactacgtgctcacaggttatacgagggacaagtcgttcctggccatggtggtggacattgtgcaggagctgaagcagcagaaccccaggctggtgtacgtgtgtgatccagtcttgggtgacaagtgggacggcgaaggctcgatgtacgtcccagaggacctcctttccggtctacaaaggaccaggtacctggagtgagccgggattccacaggccagggagggaagcccttgtcggttggatggacatggctggactgctatgggcccccgacacccgtggtcatccaggttcgcccg

SEQ ID NO: 371635 - DNA, 814 bp, Homo sapiens
cacttgagcccaggaggtggaggctgcagtgagctgagatcgcaccgctacactcactccacagagcaagaccccatctcaaaaaacaaaagaaaaatctagaaaccacttaacccatgagctgtgtagtaacagcagcagctgcagcccacagacctggacgtcggatcaagtggatggagaacaaatccactgtgaccagtccagaagcctagaatttagaggcggaaggaacccaaaggtgatcctgcctgtgggtttttaactcagccattcagcgcccaggcgatttcagtatctgccttctttgtcgttgtgtctagggtgtctgtttgcttgctgtatattcactgagcacagcgggcttctccactggcacagggcacgcctgggcctgtgccctccctgccccgctgggtcagtggttgaagtcaggatatctgtcactgggcatctaactgggtggggcgggctggtgtgctcagcgtctgtctgtccactttctcccatgcttgttctctggaaggttccctgtcctgcgcccagcctgcaggaccccagcttgcagctccctgccttcccttcatggtgctccctggtgtgggctctgctgaccctcggcagacacttgcgtttggatcacgaagagttggggccactgtccagttcagtgcggctacgggatctggcccctcgattttgatcacatttgttttcctgaacaagagtggcctaaacacgagctcctgtctcagatgagcggtcaccccgtatctcccctttccgtgaggttaaaggggtgtgttggccctcc

SEQ ID NO: 371636 - DNA, 1352 bp, Homo sapiens
  misc_feature (4)..(4): n is a, c, g, or t
  misc_feature (6)..(8): n is a, c, g, or t
ggcncnnngcggaactcgcgggttcggagccgcccgctgaggtcagaaggaggcgtctgcgctgatcgggtccgccgcgcgccagagccagagtcgcagccgaggggagccggggccggagcccgagcccgagccgagccggagcccgagcgagcggcggagaccgtgcccccgcctcggccccgcgccgccgcggccaggcccggcatggaggaggagtgccgggtgctctccatacagagccacgtcatccgcggctacgtgggcaaccgggcggccacgttcccgctgcaggttttgggatttgagattgacgcggtgaactctgtccagttttcaaaccacacaggctatgcccactggaagggccaagtgctgaattcagatgagctccaggagttgtacgaaggcctgaggctgaacaacatgaataaatatgactacgtgctcacaggttatacgagggacaagtcgttcctggccatggtggtggacattgtgcaggagctgaagcagcagaaccccaggctggtgtacgtgtgtgatccagtcttgggtgacaagtgggacggcgaaggctcgatgtacgtcccggaggacctccttcccgtctacaaagaaaaagtggtgccgcttgcagacattatcacgcccaaccagtttgaggccgagttactgagtggccggaagatccacagccaggaggaagccttgcgggtgatggacatgctgcactctatgggccccgacaccgtggtcatcaccagctccgacctgccctccccgcagggcagcaactacctgattgtgctggggagtcagaggaggaggaatcccgctggctccgtggtgatggaacgcatccggatggacattcgcaaagtggacgccgtctttgtgggcactggggacctgtttgctgccatgctcctggcgtggacacacaagcaccccaataacctcaaggtggcctgtgagaagaccgtgtctaccttgcaccacgttctgcagaggaccatccagtgtgcaaaagcccaggccggggaaggagtgaggcccagccccatgcagctggagctgcggatggtgcagagcaaaagggacatcgaggacccagagatcgtcgtccaggccacggtgctgtgagggccccgccgcttgcccgtgacacgcagcgcgttggtgtctccgtgtttgtccctgtgaaaacatgtaacgtctgccttagagccatgaccgaaacttgatatttttttctttcatgagtgtccggcatctgctggtcttcattgtgaaacgtgccagtcgtgctttgtgaaaaataacaaagtggtcacagaaaaattgtgatc

SEQ ID NO: 371637 - DNA, 1198 bp, Homo sapiens
agcgggcgttccatgtgggcagccgttgggacctgccaagcactgcgcctagtgatctccttcgggtttgagccagtccatggggaggagccgtccaccaggcagcctcagggagagtgggcgggtgtcaagggaagcccacggccccagctggcccccttgtgtctgagcccccatggcttcctctgcctctaggctatgcccactggaagggccaagtgctgaattcagatgagctccaggagttgtacgaaggcctgaggctgaacaacatgaataaatatgactacgtgctcacaggttatacgagggacaagtcgttcctggccatggtggtggacattgtgcaggagctgaagcagcagaaccccaggctggtgtacgtgtgtgatccagtcttgggtgacaagtgggacggcgaaggctcgatgtacgtcccggaggacctccttcccgtctacaaagaaaaagtggtgccgcttgcagacattatcacgcccaaccagtttgaggccgagttactgagtggccggaagatccacagccaggaggaagccttgcgggtgatggacatgctgcactctatgggccccgacaccgtggtcatcaccagctccgacctgccctccccgcagggcagcaactacctgattgtgctggggagtcagaggaggaggaatcccgctggctccgtggtgatggaacgcatccggatggacattcgcaaagtggacgccgtctttgtgggcactggggacctgtttgctgccatgctcctggcgtggacacacaagcaccccaataacctcaaggtggcctgtgagaagaccgtgtctaccttgcaccacgttctgcagaggaccatccagtgtgcaaaagcccaggccggggaaggagtgaggcccagccccatgcagctggagctgcggatggtgcagagcaaaagggacatcgaggacccagagatcgtcgtccaggccacggtgctgtgagggccccgccgcttgcccgtgacacgcagcgcgttggtgtctccgtgtttgtccctgtgaaaacatgtaacgtctgccttagagccatgaccgaaacttgatatttttttctttcatgagtgtccggcatctgctggtcttcattgtgaaacgtgccagtcgtgctttgtgaaaaataacaaagtggtcacagaaaaattgtgatc

SEQ ID NO: 371638 - DNA, 2428 bp, Homo sapiens
tcaatcctccagcctcagcctcccaaagtgctgcgatcacaggtgtgagccactgtgcctggccatatgactcagtttttaataatgactctacgtaaaactgacctgcactattgcatctggcaatcgcgtggcccaatccatcttcaaagccagcaacagtcgttgagtccttcttttaacttccaatctctgatttttccttctgcccttcagcctgagaaaactctgcttttgaagggctcatgtcattcaattaaactctcctggataagaagatcctcatgggagagagatctcatcacactgacaggtttcacccacactcagggggttgcccgagggtgagcggggtccctgaaggtcattcttagaattctgccacggaagagccccataggccatgatagggacagggtttactgtaaaacaaggtgattcacatacacagaccagtaatgctgttcctaaaggggcccaagctgatcccatcagtcagcagggctgctcacagggcacttggcctgtctttgttgaaggcgattcctgtgaaggcagtggaggagctccgggtgggaggtgagtgttgtggagagcccagcagcccgctgggctgaaccttggaccaagaaccagtctgtccttggctcccttgtgggtggggaaagatgaggtgtatcagcagggtccagtccagaaacagaaaccagagcaacaatcgtagaggccgttgttcagccaggtattgagaaaatagagaaggcaaaaagggaacactggtgtcgtggaggagacccctgccagcattggctccacacagctgaccctgggataagagaattgttggactctttagaacctggagctgggaaggcaggtgtctgccagctggcgggtgctgggagtctgtgggggcatgcgatgaggaattctgctggtggagggaaagccacaaagtggattccgctgctgctatgggaagggacggtcactaccgctgcccctgtggggagaagagccccgggggaagaagagcactgctgacagaagcccattctcttcgcaggcttcagtttcacattcttggtacctcctggtggtgcctgggagggagccactgctgtacagagatgccaattccagaggcatggtccggcacagagcgctggcttccagctgaaggacatgtgtaacagcaggagatacctttctctggggtcccaggctcccgtcctggaccttggcaccccgccccccgtgcattgtcgtcttctgagtctggctttgtctggcacatgaagttggatgggtagactctggaagcgtccagaccagcttgcgatgctgatgaataagctgattttgatggggttttgggatttgagattgacgcggtgaactctgtccagttttcaaaccacacaggctatgcccactggaagggccaagtgctgaattcagatgagctccaggagttgtacgaaggcctgaggctgaacaacatgaataaatatgactacgtgctcacaggttatacgagggacaagtcgttcctggccatggtggtggacattgtgcaggagctgaagcagcagaaccccaggctggtgtacgtgtgtgatccagtcttgggtgacaagtgggacggcgaaggctcgatgtacgtcccggaggacctccttcccgtctacaaagaaaaagtggtgccgcttgcagacattatcacgcccaaccagtttgaggccgagttactgagtggccggaagatccacagccaggaggaagccttgcgggtgatggacatgctgcactctatgggccccgacaccgtggtcatcaccagctccgacctgccctccccgcagggcagcaactacctgattgtgctggggagtcagaggaggaggaatcccgctggctccgtggtgatggaacgcatccggatggacattcgcaaagtggacgccgtctttgtgggcactggggacctgtttgctgccatgctcctggcgtggacacacaagcaccccaataacctcaaggtggcctgtgagaagaccgtgtctaccttgcaccacgttctgcagaggaccatccagtgtgcaaaagcccaggccggggaaggagtgaggcccagccccatgcagctggagctgcggatggtgcagagcaaaagggacatcgaggacccagagatcgtcgtccaggccacggtgctgtgagggccccgccgcttgcccgtgacacgcagcgcgttggtgtctccgtgtttgtccctgtgaaaacatgtaacgtctgccttagagccatgaccgaaacttgatatttttttctttcatgagtgtccggcatctgctggtcttcattgtgaaacgtgccagtcgtgctttgtgaaaaataacaaagtggtcacagaaaaattgtgatc

SEQ ID NO: 371639 - DNA, 1574 bp, Homo sapiens
gccaggctcagggtacacctattgccagggagctcccactgattccttgtgagtgtagcacagatttgttgcgactggaccatctgcacgtctgggcttcagagctgttctccccagctgttttctgccaggtcctgtcagaggcagccaccctccctgggcagagcaaaaccttgagcctgtgtttggattttgtttctgggcctaagcctaagtcagtttcacattcttggtacctcctggtggtgcctgggagggagccactgctgtacagagatgccaattccagaggcatggtccggcacagagcgctggcttccagctgaaggacatgtgtaacagcaggagatacctttctctggggtcccaggctcccgtcctggaccttggcaccccgccccccgtgcattgtcgtcttctgagtctggctttgtctggcacatgaagttggatgggtagactctggaagcgtccagaccagcttgcgatgctgatgaataagctgattttgatggggttttgggatttgagattgacgcggtgaactctgtccagttttcaaaccacacaggctatgcccactggaagggccaagtgctgaattcagatgagctccaggagttgtacgaaggcctgaggctgaacaacatgaataaatatgactacgtgctcacaggttatacgagggacaagtcgttcctggccatggtggtggacattgtgcaggagctgaagcagcagaaccccaggctggtgtacgtgtgtgatccagtcttgggtgacaagtgggacggcgaaggctcgatgtacgtcccggaggacctccttcccgtctacaaagaaaaagtggtgccgcttgcagacattatcacgcccaaccagtttgaggccgagttactgagtggccggaagatccacagccaggaggaagccttgcgggtgatggacatgctgcactctatgggccccgacaccgtggtcatcaccagctccgacctgccctccccgcagggcagcaactacctgattgtgctggggagtcagaggaggaggaatcccgctggctccgtggtgatggaacgcatccggatggacattcgcaaagtggacgccgtctttgtgggcactggggacctgtttgctgccatgctcctggcgtggacacacaagcaccccaataacctcaaggtggcctgtgagaagaccgtgtctaccttgcaccacgttctgcagaggaccatccagtgtgcaaaagcccaggccggggaaggagtgaggcccagccccatgcagctggagctgcggatggtgcagagcaaaagggacatcgaggacccagagatcgtcgtccaggccacggtgctgtgagggccccgccgcttgcccgtgacacgcagcgcgttggtgtctccgtgtttgtccctgtgaaaacatgtaacgtctgccttagagccatgaccgaaacttgatatttttttctttcatgagtgtccggcatctgctggtcttcattgtgaaacgtgccagtcgtgctttgtgaaaaataacaaagtggtcacagaaaaattgtgatc

SEQ ID NO: 371640 - DNA, 1268 bp, Homo sapiens
  misc_feature (4)..(4): n is a, c, g, or t
  misc_feature (6)..(8): n is a, c, g, or t
ggcncnnngcggaactcgcgggttcggagccgcccgctgaggtcagaaggaggcgtctgcgctgatcgggtccgccgcgcgccagagccagagtcgcagccgaggggagccggggccggagcccgagcccgagccgagccggagcccgagcgagcggcggagaccgtgcccccgcctcggccccgcgccgccgcggccaggcccggcatggaggaggagtgccgggtgctctccatacagagccacgtcatccgcggctacgtgggcaaccgggcggccacgttcccgctgcaggttttgggatttgagattgacgcggtgaactctgtccagttttcaaaccacacaggctatgcccactggaagggccaagtgctgaattcagatgagctccaggagttgtacgaaggcctgaggctgaacaacatgaataaatatgactacgtgctcacagtgtgtgatccagtcttgggtgacaagtgggacggcgaaggctcgatgtacgtcccggaggacctccttcccgtctacaaagaaaaagtggtgccgcttgcagacattatcacgcccaaccagtttgaggccgagttactgagtggccggaagatccacagccaggaggaagccttgcgggtgatggacatgctgcactctatgggccccgacaccgtggtcatcaccagctccgacctgccctccccgcagggcagcaactacctgattgtgctggggagtcagaggaggaggaatcccgctggctccgtggtgatggaacgcatccggatggacattcgcaaagtggacgccgtctttgtgggcactggggacctgtttgctgccatgctcctggcgtggacacacaagcaccccaataacctcaaggtggcctgtgagaagaccgtgtctaccttgcaccacgttctgcagaggaccatccagtgtgcaaaagcccaggccggggaaggagtgaggcccagccccatgcagctggagctgcggatggtgcagagcaaaagggacatcgaggacccagagatcgtcgtccaggccacggtgctgtgagggccccgccgcttgcccgtgacacgcagcgcgttggtgtctccgtgtttgtccctgtgaaaacatgtaacgtctgccttagagccatgaccgaaacttgatatttttttctttcatgagtgtccggcatctgctggtcttcattgtgaaacgtgccagtcgtgctttgtgaaaaataacaaagtggtcacagaaaaattgtgatc

SEQ ID NO: 371641 - DNA, 1407 bp, Homo sapiens
  misc_feature (4)..(4): n is a, c, g, or t
  misc_feature (6)..(8): n is a, c, g, or t
ggcncnnngcggaactcgcgggttcggagccgcccgctgaggtcagaaggaggcgtctgcgctgatcgggtccgccgcgcgccagagccagagtcgcagccgaggggagccggggccggagcccgagcccgagccgagccggagcccgagcgagcggcggagaccgtgcccccgcctcggccccgcgccgccgcggccaggcccggcatggaggaggagtgccgggtgctctccatacagagccacgtcatccgcggctacgtgggcaaccgggcggccacgttcccgctgcaggttttgggatttgagattgacgcggtgaactctgtccagttttcaaaccacacaggctatgcccactggaagggccaagtgctgaattcagatgagctccaggagttgtacgaaggcctgaggctgaacaacatgaataaatatgactacgtgctcacagttgatcgtggtgagtctcctgttttctgagggtgacctggattctccccctaaaggttatacgagggacaagtcgttcctggccatggtggtggacattgtgcaggagctgaagcagcagaaccccaggctggtgtacgtgtgtgatccagtcttgggtgacaagtgggacggcgaaggctcgatgtacgtcccggaggacctccttcccgtctacaaagaaaaagtggtgccgcttgcagacattatcacgcccaaccagtttgaggccgagttactgagtggccggaagatccacagccaggaggaagccttgcgggtgatggacatgctgcactctatgggccccgacaccgtggtcatcaccagctccgacctgccctccccgcagggcagcaactacctgattgtgctggggagtcagaggaggaggaatcccgctggctccgtggtgatggaacgcatccggatggacattcgcaaagtggacgccgtctttgtgggcactggggacctgtttgctgccatgctcctggcgtggacacacaagcaccccaataacctcaaggtggcctgtgagaagaccgtgtctaccttgcaccacgttctgcagaggaccatccagtgtgcaaaagcccaggccggggaaggagtgaggcccagccccatgcagctggagctgcggatggtgcagagcaaaagggacatcgaggacccagagatcgtcgtccaggccacggtgctgtgagggccccgccgcttgcccgtgacacgcagcgcgttggtgtctccgtgtttgtccctgtgaaaacatgtaacgtctgccttagagccatgaccgaaacttgatatttttttctttcatgagtgtccggcatctgctggtcttcattgtgaaacgtgccagtcgtgctttgtgaaaaataacaaagtggtcacagaaaaattgtgatc

SEQ ID NO: 371642 - DNA, 1117 bp, Homo sapiens
agcgggcgttccatgtgggcagccgttgggacctgccaagcactgcgcctagtgatctccttcgggtttgagccagtccatggggaggagccgtccaccaggcagcctcagggagagtgggcgggtgtcaagggaagcccacggccccagctggcccccttgtgtctgagcccccatggcttcctctgcctctaggctatgcccactggaagggccaagtgctgaattcagatgagctccaggagttgtacgaaggcctgaggctgaacaacatgaataaatatgactacgtgctcacaggttatacgagggacaagtcgttcctggccatggtggtggacattgtgcaggagctgaagcagcagaaccccaggctggtgtacgtgtgtgatccagtcttgggtgacaagtgggacggcgaaggctcgatgtacgtcccggaggacctccttcccgtctacaaagaaaaagtggtgccgcttgcagacattatcacgcccaaccagtttgaggccgacgtggtcatcaccagctccgacctgccctccccgcagggcagcaactacctgattgtgctggggagtcagaggaggaggaatcccgctggctccgtggtgatggaacgcatccggatggacattcgcaaagtggacgccgtctttgtgggcactggggacctgtttgctgccatgctcctggcgtggacacacaagcaccccaataacctcaaggtggcctgtgagaagaccgtgtctaccttgcaccacgttctgcagaggaccatccagtgtgcaaaagcccaggccggggaaggagtgaggcccagccccatgcagctggagctgcggatggtgcagagcaaaagggacatcgaggacccagagatcgtcgtccaggccacggtgctgtgagggccccgccgcttgcccgtgacacgcagcgcgttggtgtctccgtgtttgtccctgtgaaaacatgtaacgtctgccttagagccatgaccgaaacttgatatttttttctttcatgagtgtccggcatctgctggtcttcattgtgaaacgtgccagtcgtgctttgtgaaaaataacaaagtggtcacagaaaaattgtgatc

SEQ ID NO: 371643 - DNA, 2405 bp, Homo sapiens
tcaatcctccagcctcagcctcccaaagtgctgcgatcacaggtgtgagccactgtgcctggccatatgactcagtttttaataatgactctacgtaaaactgacctgcactattgcatctggcaatcgcgtggcccaatccatcttcaaagccagcaacagtcgttgagtccttcttttaacttccaatctctgatttttccttctgcccttcagcctgagaaaactctgcttttgaagggctcatgtcattcaattaaactctcctggataagaagatcctcatgggagagagatctcatcacactgacaggtttcacccacactcagggggttgcccgagggtgagcggggtccctgaaggtcattcttagaattctgccacggaagagccccataggccatgatagggacagggtttactgtaaaacaaggtgattcacatacacagaccagtaatgctgttcctaaaggggcccaagctgatcccatcagtcagcagggctgctcacagggcacttggcctgtctttgttgaaggcgattcctgtgaaggcagtggaggagctccgggtgggaggtgagtgttgtggagagcccagcagcccgctgggctgaaccttggaccaagaaccagtctgtccttggctcccttgtgggtggggaaagatgaggtgtatcagcagggtccagtccagaaacagaaaccagagcaacaatcgtagaggccgttgttcagccaggtattgagaaaatagagaaggcaaaaagggaacactggtgtcgtggaggagacccctgccagcattggctccacacagctgaccctgggataagagaattgttggactctttagaacctggagctgggaaggcaggtgtctgccagctggcgggtgctgggagtctgtgggggcatgcgatgaggaattctgctggtggagggaaagccacaaagtggattccgctgctgctatgggaagggacggtcactaccgctgcccctgtggggagaagagccccgggggaagaagagcactgctgacagaagcccattctcttcgcaggcttcagtttcacattcttggtacctcctggtggtgcctgggagggagccactgctgtacagagatgccaattccagaggcatggtccggcacagagcgctggcttccagctgaaggacatgtgtaacagcaggagatacctttctctggggtcccaggctcccgtcctggaccttggcaccccgccccccgtgcattgtcgtcttctgagtctggctttgtctggcacatgaagttggatgggtagactctggaagcgtccagaccagcttgcgatgctgatgaataagctgattttgatggggttttgggatttgagattgacgcggtgaactctgtccagttttcaaaccacacaggctatgcccactggaagggccaagtgctgaattcagatgagctccaggagttgtacgaaggcctgaggctgaacaacatgaataaatatgactacgtgctcacagttgatcgtggtgagtctcctgttttctgagggtgacctggattctccccctaaaggttatacgagggacaagtcgttcctggccatggtggtggacattgtgcaggagctgaagcagcagaaccccaggctggtgtacgtgtgtgatccagtcttgggtgacaagtgggacggcgaaggctcgatgtacgtcccggaggacctccttcccgtctacaaagaaaaagtggtgccgcttgcagacattatcacgcccaaccagtttgaggccgagttactgagtggccggaagatccacagccaggaggaagccttgcggaactacctgattgtgctggggagtcagaggaggaggaatcccgctggctccgtggtgatggaacgcatccggatggacattcgcaaagtggacgccgtctttgtgggcactggggacctgtttgctgccatgctcctggcgtggacacacaagcaccccaataacctcaaggtggcctgtgagaagaccgtgtctaccttgcaccacgttctgcagaggaccatccagtgtgcaaaagcccaggccggggaaggagtgaggcccagccccatgcagctggagctgcggatggtgcagagcaaaagggacatcgaggacccagagatcgtcgtccaggccacggtgctgtgagggccccgccgcttgcccgtgacacgcagcgcgttggtgtctccgtgtttgtccctgtgaaaacatgtaacgtctgccttagagccatgaccgaaacttgatatttttttctttcatgagtgtccggcatctgctggtcttcattgtgaaacgtgccagtcgtgctttgtgaaaaataacaaagtggtcacagaaaaattgtgatc

SEQ ID NO: 371644 - DNA, 593 bp, Homo sapiens
gcgcgcgtaggattaccttgcgccccccggagtatgggctatagtcggaccacgcgtcgcatgaggaggaggaatcccgctggctccgtggtgatggaacgcatccggatggacattcgcaaagtggacgccgtctttgtgggcactggggacctgtttgctgccatgctcctggcgtggacacacaagcaccccaataacctcaaggtggcctgtgagaagaccgtgtctaccttgcaccacgttctgcagaggaccatccagtgtgcaaaagcccaggccggggaaggagtgaggcccagccccatgcagctggagctgcggatggtgcagagcaaaagggacatcgaggacccagagatcgtcgtccaggccacggtgctgtgagggccccgccgcttgcccgtgacacgcagcgcgttggtgtctccgtgtttgtccctgtgaaaacatgtaacgtctgccttagagccatgaccgaaacttgatatttttttctttcatgagtgtccggcatctgctggtcttcattgtgaaacgtgccagtcgtgctttgtgaaaaataacaaagtggtcacagaaaaattgtgatc

SEQ ID NO: 371645 - DNA, 899 bp, Homo sapiens
  misc_feature (4)..(4): n is a, c, g, or t
  misc_feature (6)..(8): n is a, c, g, or t
ggcncnnngcggaactcgcgggttcggagccgcccgctgaggtcagaaggaggcgtctgcgctgatcgggtccgccgcgcgccagagccagagtcgcagccgaggggagccggggccggagcccgagcccgagccgagccggagcccgagcgagcggcggagaccgtgcccccgcctcggccccgcgccgccgcggccaggcccggcatggaggaggagtgccgggtgctctccatacagagccacgtcatccgcggctacgtgggcaaccgggcggccacgttcccgctgcaggttttgggatttgagattgacgcggtgaactctgtccagttttcaaaccacacaggctatgcccactggaagggccaagtgctgaattcagatgagctccaggagttgtacgaaggcctgaggctgaacaacatgaataaatatgactacgtgctcacaggttatacgagggacaagtcgttcctggcgtggacacacaagcaccccaataacctcaaggtggcctgtgagaagaccgtgtctaccttgcaccacgttctgcagaggaccatccagtgtgcaaaagcccaggccggggaaggagtgaggcccagccccatgcagctggagctgcggatggtgcagagcaaaagggacatcgaggacccagagatcgtcgtccaggccacggtgctgtgagggccccgccgcttgcccgtgacacgcagcgcgttggtgtctccgtgtttgtccctgtgaaaacatgtaacgtctgccttagagccatgaccgaaacttgatatttttttctttcatgagtgtccggcatctgctggtcttcattgtgaaacgtgccagtcgtgctttgtgaaaaataacaaagtggtcacagaaaaattgtgatc

SEQ ID NO: 371646 - DNA, 2222 bp, Homo sapiens
tcaatcctccagcctcagcctcccaaagtgctgcgatcacaggtgtgagccactgtgcctggccatatgactcagtttttaataatgactctacgtaaaactgacctgcactattgcatctggcaatcgcgtggcccaatccatcttcaaagccagcaacagtcgttgagtccttcttttaacttccaatctctgatttttccttctgcccttcagcctgagaaaactctgcttttgaagggctcatgtcattcaattaaactctcctggataagaagatcctcatgggagagagatctcatcacactgacaggtttcacccacactcagggggttgcccgagggtgagcggggtccctgaaggtcattcttagaattctgccacggaagagccccataggccatgatagggacagggtttactgtaaaacaaggtgattcacatacacagaccagtaatgctgttcctaaaggggcccaagctgatcccatcagtcagcagggctgctcacagggcacttggcctgtctttgttgaaggcgattcctgtgaaggcagtggaggagctccgggtgggaggtgagtgttgtggagagcccagcagcccgctgggctgaaccttggaccaagaaccagtctgtccttggctcccttgtgggtggggaaagatgaggtgtatcagcagggtccagtccagaaacagaaaccagagcaacaatcgtagaggccgttgttcagccaggtattgagaaaatagagaaggcaaaaagggaacactggtgtcgtggaggagacccctgccagcattggctccacacagctgaccctgggataagagaattgttggactctttagaacctggagctgggaaggcaggtgtctgccagctggcgggtgctgggagtctgtgggggcatgcgatgaggaattctgctggtggagggaaagccacaaagtggattccgctgctgctatgggaagggacggtcactaccgctgcccctgtggggagaagagccccgggggaagaagagcactgctgacagaagcccattctcttcgcaggcttcagtttcacattcttggtacctcctggtggtgcctgggagggagccactgctgtacagagatgccaattccagaggcatggtccggcacagagcgctggcttccagctgaaggacatgtgtaacagcaggagatacctttctctggggtcccaggctcccgtcctggaccttggcaccccgccccccgtgcattgtcgtcttctgagtctggctttgtctggcacatgaagttggatgggtagactctggaagcgtccagaccagcttgcgatgctgatgaataagctgattttgatggggttttgggatttgagattgacgcggtgaactctgtccagttttcaaaccacacaggctatgcccactggaagggccaagtgctgaattcagatgagctccaggagttgtacgaaggcctgaggctgaacaacatgaataaatatgactacgtgctcacagttgatcgtggtgagtctcctgttttctgagggtgacctggattctccccctaaaggttatacgagggacaagtcgttcctggccatggtggtggacattgtgcaggagctgaagcagcagaaccccaggctggtgtacgtgtgtgatccagtcttgggtgacaagtgggacggcgaaggctcgatgagcaagaccccatctcaaaaaacaaaagaaaaatctagaaaccacttaacccatgagctgtgtagtaacagcagcagctgcagcccacagacctggacgtcggatcaagtggatggagaacaaatccactgtgaccagtccagaagcctagaatttagaggcggaaggaacccaaaggtgatcctgcctgtgggtttttaactcagccattcagcgcccaggcgatttcagtatctgccttctttgtcgttgtgtctagggtgtctgtttgcttgctgtatattcactgagcacagcgggcttctccactggcacagggcacgcctgggcctgtgccctccctgccccgctgggtcagtggttgaagtcaggatatctgtcactgggcatctaactgggtggggcgggctggtgtgctcagcgtctgtctgtccactttctcccatgcttgttctctggaaggttccctgtcctgcgcccagcctgcaggaccccagcttgcagct

SEQ ID NO: 371647 - DNA, 1432 bp, Homo sapiens
  misc_feature (4)..(4): n is a, c, g, or t
  misc_feature (6)..(8): n is a, c, g, or t
ggcncnnngcggaactcgcgggttcggagccgcccgctgaggtcagaaggaggcgtctgcgctgatcgggtccgccgcgcgccagagccagagtcgcagccgaggggagccggggccggagcccgagcccgagccgagccggagcccgagcgagcggcggagaccgtgcccccgcctcggccccgcgccgccgcggccaggcccggcatggaggaggagtgccgggtgctctccatacagagccacgtcatccgcggctacgtgggcaaccgggcggccacgttcccgctgcaggttttgggatttgagattgacgcggtgaactctgtccagttttcaaaccacacaggctatgcccactggaagggccaagtgctgaattcagatgagctccaggagttgtacgtgtgtgatccagtcttgggtgacaagtgggacggcgaaggctcgatgtacgtcccggaggacctccttcccgtctacaaagaaaaagtggtgccgcttgcagacattatcacgcccaaccagtttgaggccgagttactgagtggccggaagatccacagccaggaggaagccttgcggccaggccacggtgctgtgagggccccgccgcttgcccgtgacacgcagcgcgttggtgtctccgtgtttgtccctgtgaaaacatgtaacgtctgccttagagccatgaccgaaacttgatatttttttctttcaaaaaaaaaaaaaaaaaaaaaaaaaaaaaaaaaaacaaaaaaaaaaaaaaaaaaaaaaaaaaaaaaaaaaaaaaaaaaaaaacaacaaaaagagagggggcgcgcgcgcgccgccccaatatccccccgcggggggcgccacacccacttatccccccaccccaagttgtttgtatagaacaaggagggggcccccccatacgcggcagcctctattatatatatacaacgccagcgcggcccggcgcgcggctactaataacaaacaccgacggtcacggtggagagaaccaaccaacccaccgcacacagcgcgactcaactctccccgtgcgaggcaggaaggcacccccccccattaccccgcgcgcgaggcgcggcagcacacacaccaacgcagcggagacgaacaaccccccccctcccgccgccgcacctccatccaacacagcccacccccaccgacgcgcgcccactccatcataacaccccacctgccaccgccagcgcgcccaccgcggacggcgggacgaccacaccaccaccccgccgcacacaattacacccccgcgcgccgcgcgcgccgaccagacgacagatcgtcgccgcacgcccccccccgacgggcccacccgcccatccccgtaccacaacctatctcttctctccaccggcgcgggcgcaccccccaccccccaaacacgcaccacccc

SEQ ID NO: 371648 - DNA, 457 bp, Homo sapiens
ctctggggtcccaggctcccgtcctggaccttggcaccccgccccccgtgcattgtcgtcttctgagtctggctttgtctggcacatgaagttggatgggtagactctggaagcgtccagaccagcttgcgatgctgatgaataagctgattttgatggggtgtgtgaaacggagatgccagcccaggggctcagcttgctcgtgctctcatttaaaagcagaaaatagcgacttcattctcggatacgtttgccagccccaaaggattaattatctacacacccagaagcagtggagcagaatattttggcaggattttcaggatttgtgtcatcgttgcttaatatctgtttcttcacagtcggttagaattttaaaggatttgaaatactgcaagctatctgtgtatagaggctgtggattcgggctggtacatttgcaaagtgcccattttat

SEQ ID NO: 371649 - DNA, 514 bp, Homo sapiens
aaaatgttttgtgggccatttcagtgctcctcactccctcatagccaccagcctcatcagaaagatgccccgagagcacaggaagccccccaagcatgtgccccacccaccttctctaacaaggtaataaatatttccacagccagtcccaagctgctcccaagcctgtaggtcaccaggttggaagggcaggccacttctacctgttacatgccctgacacctcttatggatcaatcaggacattttttctcaatgacatgacctcagatgctgttactcagccacaaattgacccatgaggtgaaacctatttttatccatgtattaagtagtttttaataatccatactacacttgcttacagaaaggctaaagacacaaacaaaactattcaaacaccagcatcaaagaggcaaggatgggagttaaagggggaattctgttgtgcggaaggcccacaggaaggttgaggggggcctgtagcaaatgagcaaaaacttcactctcagctt

SEQ ID NO: 371650 - DNA, 1135 bp, Homo sapiens
aggttgtgctagtgcaatttttcttagtttcatggatttgatccctgatcagaccaattacctgtgatccaaggctagcaatcttaaatacaaacaatactaagattggattatcgaaagcctttgcactacagtaagaacaatgcaaatagaactttctgattatagtccatcaatggcattgaccaccgaaaagtacttgcatgtcatctttgtattgccaaacaataccttgattttgaagtctgtaatctttgataatagttaaacacttttcttggcatgaattgagacattcagttcattcactatacatgtgttttggtccagtctttgctttacttatgtctctgtggcgtcaggcaaatcaggtaacttcttacttacacccttgattgtaaaacagattatacttgtcttgcctactgacctagtgtggcaatttggggaaacatcttggtgctgaattaggttctaggctcaggcactaaacatgatttaaaacttgatcatttgaactagaagccaagtacaaccttcaagacaactctgtataaggtcataggtataatcactattttacagatgaggaaacgagattgactacaaatttggttttgaaaataaatcacatgctcaacagaagcagttttggccaggcacggtggctcgcacctataatcccagcaccttgggaaaccaaagcaggaacatcgcttgagcccaggagttggaggccagtttgggcaacatagtgagaccccatctctacaaagaaaaaaaaaaaagaatcagcaagacgtggtggacacctcctgtagtctcagctacttgggaggctgaggcagaaggattgcttgagcctgggagttcaaggtgcagtgagctgtgatcatgccagtgcactttggcctaggcaacggagcaagaccttgtctcaaaaaattattaaataataaatcaggcacaactttaacaacacttattgagtccttagcatgtgctatactgtgtgccaaattatttgcttttaatgtgctgtgaaatatctgtgcagtagatactaaaattctgttttattaacctaaaccacaaagaggttaattaacttgcccaaagccacacagctcgtaag

SEQ ID NO: 371651 - DNA, 766 bp, Homo sapiens
  misc_feature (41)..(41): n is a, c, g, or t
gacccacgcgtccgcggacgcgtgggtcgacccacgcgtcngaataatagctcttcaagtctgcaataaaaaatggcctccaacaaaactacattgcaaaaaatgggaaaaaaacagaatggaaagagtaaaaaagttgaagaggcagagcctgaagaatttgtcgtggaaaaagtactagatcgacgtgtagtgaatgggaaagtggaatatttcctgaagtggaagggatttacagatgctgacaatacttgggaacctgaagaaaatttagattgtccagaattgattgaagcgtttcttaactctcagaaagctggcaaagaaaaagatggtacaaaaagaaaatctttatctgacagtgaatctgatgacagcaaatcaaagaagaaaagagatgctgctgacaaaccaagaggatttgccagaggtcttgatcctgaaagaataattggtgccacagacagcagtggagaattgatgtttctcatgaaatggaaagattcagatgaggcagacttggtgctggcgaaagaggcaaatatgaagtgtcctcaaattgtaattgctttttatgaagagagactaacttggcattcttgtccagaagatgaagctcaatacttaattaatggtaaacatggcttttaataaaactatgttttttattaaaaatggtgcttaaatttgagttacaatggggaaaatacttactctaaatgattcagtttatattttttgtttaaaagtgcgtgaactctttttt

SEQ ID NO: 371652 - DNA, 579 bp, Homo sapiens
atcattctcacccaggcagtgtgactccagagcttgtgacattgatgtaaaactctgacaggaataaaggatttattgatatcattggttctcaaactttttttggtctcagggcctctttatactctaaaaaaattattgaggatccccagagagcttttgtttatatgggttataattatcaatactaacagtagaaattaaaacaaatttctaaaatgacttttctaaaaaagctgagaagagtagcattttacatttttacagatattcaacatgtgtcttaaggcaattttacttaaacacatttgattgctgtggcggatcattttggtggaggtatatgaagacaatccaaagtcacaaatagatgaaaaaagggggccttacacaaccccctcccaaaaaggactctggaatccccagtgaatccgtagaccacattttgagagccactggtttatattaagtactttctagcgcagggggtccaatcttttggcagccctgggccacattaggagaattgtcgagggctacacataaaatagacttaataccaaccatagctgatgagct

SEQ ID NO: 371653 - DNA, 1318 bp, Homo sapiens
atcattctcacccaggcagtgtgactccagagcttgtgacattgatgtaaaactctgacaggaataaaggatttattgatatcattggttctcaaactttttttggtctcagggcctctttatactctaaaaaaattattgaggatccccagagagcttttgtttatatgggttataattatcaatactaacagtagaaattaaaacaaatttctaaaatgacttttctaaaaaagctgagaagagtagcattttacatttttacagatattcaacatgtgtcttaaggcaattttacttaaacacatttgattgctgtggcggatcattttggtggaggtatatgaagacaatccaaagtcacaaatagatgaaaaaagggggccttacacaaccccctcccaaaaaggactctggaatccccagtgaatccgtagaccacattttgagagccactggtttatattaagtactttctagcgcagggggtccaatcttttggcagccctgggccacattaggagaattgtcgagggctacacataaaatagacttaataccaaccatagctgatgagctaaaaaaaaaaaaaaaaaaaatcgcaagaaagtttcaatgttttaagaaagtttacaaatttgtgttgggcctccaaagccatcctgggccacaggttacacaagtttgttctaacatttactatcatttagaatgattacagatagttggtatgagttttaacatttttaatatttcttaccgtttgtgttttgtttatgcttttaaaatgtgtcagtaattcagactaattcctggaagtcatttgaaatatattaactttcaagactttattattaccagaaataaagaggttagtttttctgtatgcccacacaactctgactttggtgtcattgaacgcagtaattttcttgactttttattctgaatgttttcagaaattttaagtattctacgttgagtatcaaactcaggtttttctgcttgtaaagttaatggaaatcagatgtttttaattaccaaatatgggttcttgctctagtcatttccatctcactattggaatgtttttatttaaaatacgccatgaaaacaatttaatactctgagtttgctgtatgaaaaaatgtcttctaaacagggctgacaaaccaagaggatttgccagaggtcttgatcctgaaagaataattggtgccacagacagcagtggagaattgatgtttctcatgaaatggtgagtatgcagagattgttacatttgaaagtaagagtagctttttttttttaatttgtg

SEQ ID NO: 371654 - DNA, 2844 bp, Homo sapiens
tgagaactgccgctgctcgagaaacaactctgcgaggagcacctccgcacgggacccggcgctgctgctactgccgctagagccgctgccgccgcttttctagaaccttcccccccactaacgcgtcttccgctacgtcaggccgtcgcgtaaacgccctatccgccgccaatggcgggaaggctctacgccccaccttacgccaaatgcgtactcctcccacccttgcggccagagacagtacccgacgttacttccgtaaatgcgctcaatgaattgcggaaggctagagtcctgctagttactacctcttggaatagggtcccgccccctgccttggcgcaaggcaggtgagaaacggtcgcgcagtttgaaattaacgccgacgggaggggcttaatccgcagcctggagatccagccccctcaacccgggaggtggtccctgcagttacgccaatgataacccccgccagaaaaatcttagtagccttccctttttgttttccgtgccccaactcggcggattgactcggccccttccggaaacacccgaatcaacttctagtcaaattattgttcacgccgcaatgacccacccctggcccgcgtctgtggaactgacccctggtgtacaggagagttcgctgctgaaagtggtcccaaaggggtactagtttttaagctcccaactccccctcccccagcgtctggaggattccacaccctcgcaccgcaggggcgaggaagtgggcggagtccggttttggcgccagccgctgaggctgccaagcagaaaagccaccgctgaggagactccggtcactgtcctcgccccgcctcccccttccctccccttggggaccaccgggcgccacgccgcgaacggtaagtgccgcggtcgtcggcgcctccgccctccccctagggccccaattcccagcgggcgcgcgcccgctgccccgcccttcgtggccgcccggcgtgggcggtgccacccctccccccggcggccccgcgcgcagctcccggctccctcccccttcggatgtggcttgagctgtaggcgcggagggccggagacgctgcagacccgcgacccggagcagctcggaggcggtgaataatagctcttcaagtctgcaataaaaaatggcctccaacaaaactacattgcaaaaaatgggaaaaaaacagaatggaaagagtaaaaaagttgaagaggcagagcctgaagaatttgtcgtggaaaaagtactagatcgacgtgtagtgaatgggaaagtggaatatttcctgaagtggaagggatttacagatgctgacaatacttgggaacctgaagaaaatttagattgtccagaattgattgaagcgtttcttaactctcagaaagctggcaaagaaaaagatggtacaaaaagaaaatctttatctgacagtgaatctgatgacagcaaatcaaagaagaaaagagatgctgctgacaaaccaagaggatttgccagaggtcttgatcctgaaagaataattggtgccacagacagcagtggagaattgatgtttctcatgaaatggaaagattcagatgaggcagacttggtgctggcgaaagaggcaaatatgaagtgtcctcaaattgtaattgctttttatgaagagagactaacttggcattcttgtccagaagatgaagctcaataattgttcacattgttcttttatatatatttatatatatatataaaaattgggtcttagattttgatttactagtgtgacaaaataactacatcctaatgaaaatcaagtttgatatgtttgttttgaaagtagcgttggaagagttgttgggggttttttgcatccatagcactggttactttgaacaaataaataaaagctttctgtagttgcttcctttatcagaaaagaacatttgataccatggtatatcatttcctcttcattaaagaacagcttttctaaatgttgggggaaatgtccatagtcattactcagtcaaaacttgtgttctcatgagcctaaggaccattctagatttattacgtgttttgtgtgtgtgtgtgtgtgtgtgtgtgtgtgtatccataaaatgcatatgtaaatttttttttgtttttaagcattcacccaaacaaaaaaatcacaggtaaacccatgtttctgagatgccattattccaagcaaaataagagataatcccttcaagttaaattgaaaattttcctgaaaccatacatttcaagtgaaataagtaattctagataggacaatttaaattggataattttaaagtgtctataattgcagtggtttatttgcaaaattcctaaaaggaaaaattttatcactgccatcacagcaggtttcctcatccagatgaggaaactagacaaatgctagtgtgttttaactagctaaacaaaactaagttaaatgaacatttaaaagtttccctagcgggccattccttagcaaaatgttggaatccctgttgctacattgactaaaaggtcatgatgaatggaatatgtaagacttggctcatagaaacctaatcagatggttagaggtgttggcagtttaggacctgctgtcataaatgtgtgaacaaccttttgtaacctaacctattgacctgcatgttttttctttaccccaattcattacatggaggctcaatcttgagtttgctttactggttcagcaaaagccaggaagaacaactttgtagtaatcaaaatgttatccaactgtatattgtttactttattgtaaatactggtgaacagtggttaataaatagttttatattccttta

SEQ ID NO: 371655 - DNA, 2141 bp, Homo sapiens
  misc_feature (56)..(58): n is a, c, g, or t
gggatttcctccgggctacaggcgacagagctgagccaagcgtttactgggcacgnnngctcagattccaaatgaaaatgtttgagagcgctgactctacagccacaagatctggccaggatctctgggctgaaatttgttcctgtctgccaaatcctgaacaagaagatggtgccaacaatgcattctcagactcctttgtggattcttgccctgaaggtgaaggccagagggaggtggctgactttgctgtccagccagctgtaaagccttgggctcccttgcaggattcagaagtgtatttagcatctctagccattttattttaaaaatatttcctgaggatgtggcttgagctgtaggcgcggagggccggagacgctgcagacccgcgacccggagcagctcggaggcggtgaataatagctcttcaagtctgcaataaaaaatggcctccaacaaaactacattgcaaaaaatgggaaaaaaacagaatggaaagagtaaaaaagttgaagaggcagagcctgaagaatttgtcgtggaaaaagtactagatcgacgtgtagtgaatgggaaagtggaatatttcctgaagtggaagggatttacagatgctgacaatacttgggaacctgaagaaaatttagattgtccagaattgattgaagcgtttcttaactctcagaaagctggcaaagaaaaagatggtacaaaaagaaaatctttatctgacagtgaatctgatgacagcaaatcaaagaagaaaagagatgctgctgacaaaccaagaggatttgccagaggtcttgatcctgaaagaataattggtgccacagacagcagtggagaattgatgtttctcatgaaatggaaagattcagatgaggcagacttggtgctggcgaaagaggcaaatatgaagtgtcctcaaattgtaattgctttttatgaagagagactaacttggcattcttgtccagaagatgaagctcaataattgttcacattgttcttttatatatatttatatatatatataaaaattgggtcttagattttgatttactagtgtgacaaaataactacatcctaatgaaaatcaagtttgatatgtttgttttgaaagtagcgttggaagagttgttgggggttttttgcatccatagcactggttactttgaacaaataaataaaagctttctgtagttgcttcctttatcagaaaagaacatttgataccatggtatatcatttcctcttcattaaagaacagcttttctaaatgttgggggaaatgtccatagtcattactcagtcaaaacttgtgttctcatgagcctaaggaccattctagatttattacgtgttttgtgtgtgtgtgtgtgtgtgtgtgtgtgtgtatccataaaatgcatatgtaaatttttttttgtttttaagcattcacccaaacaaaaaaatcacaggtaaacccatgtttctgagatgccattattccaagcaaaataagagataatcccttcaagttaaattgaaaattttcctgaaaccatacatttcaagtgaaataagtaattctagataggacaatttaaattggataattttaaagtgtctataattgcagtggtttatttgcaaaattcctaaaaggaaaaattttatcactgccatcacagcaggtttcctcatccagatgaggaaactagacaaatgctagtgtgttttaactagctaaacaaaactaagttaaatgaacatttaaaagtttccctagcgggccattccttagcaaaatgttggaatccctgttgctacattgactaaaaggtcatgatgaatggaatatgtaagacttggctcatagaaacctaatcagatggttagaggtgttggcagtttaggacctgctgtcataaatgtgtgaacaaccttttgtaacctaacctattgacctgcatgttttttctttaccccaattcattacatggaggctcaatcttgagtttgctttactggttcagcaaaagccaggaagaacaactttgtagtaatcaaaatgttatccaactgtatattgtttactttattgtaaatactggtgaacagtggttaataaatagttttatattccttta

SEQ ID NO: 371656 - DNA, 1843 bp, Homo sapiens
  misc_feature (41)..(41): n is a, c, g, or t
gacccacgcgtccgcggacgcgtgggtcgacccacgcgtcngaaggatgtggcttgagctgtaggcgcggagggccggagacgctgcagacccgcgacccggagcagctcggaggcggtgaataatagctcttcaagtctgcaataaaaaatggcctccaacaaaactacattgcaaaaaatgggaaaaaaacagaatggaaagagtaaaaaagttgaagaggcagagcctgaagaatttgtcgtggaaaaagtactagatcgacgtgtagtgaatgggaaagtggaatatttcctgaagtggaagggatttacagatgctgacaatacttgggaacctgaagaaaatttagattgtccagaattgattgaagcgtttcttaactctcagaaagctggcaaagaaaaagatggtacaaaaagaaaatctttatctgacagtgaatctgatgacagcaaatcaaagaagaaaagagatgctgctgacaaaccaagaggatttgccagaggtcttgatcctgaaagaataattggtgccacagacagcagtggagaattgatgtttctcatgaaatggaaagattcagatgaggcagacttggtgctggcgaaagaggcaaatatgaagtgtcctcaaattgtaattgctttttatgaagagagactaacttggcattcttgtccagaagatgaagctcaataattgttcacattgttcttttatatatatttatatatatatataaaaattgggtcttagattttgatttactagtgtgacaaaataactacatcctaatgaaaatcaagtttgatatgtttgttttgaaagtagcgttggaagagttgttgggggttttttgcatccatagcactggttactttgaacaaataaataaaagctttctgtagttgcttcctttatcagaaaagaacatttgataccatggtatatcatttcctcttcattaaagaacagcttttctaaatgttgggggaaatgtccatagtcattactcagtcaaaacttgtgttctcatgagcctaaggaccattctagatttattacgtgttttgtgtgtgtgtgtgtgtgtgtgtgtgtgtgtatccataaaatgcatatgtaaatttttttttgtttttaagcattcacccaaacaaaaaaatcacaggtaaacccatgtttctgagatgccattattccaagcaaaataagagataatcccttcaagttaaattgaaaattttcctgaaaccatacatttcaagtgaaataagtaattctagataggacaatttaaattggataattttaaagtgtctataattgcagtggtttatttgcaaaattcctaaaaggaaaaattttatcactgccatcacagcaggtttcctcatccagatgaggaaactagacaaatgctagtgtgttttaactagctaaacaaaactaagttaaatgaacatttaaaagtttccctagcgggccattccttagcaaaatgttggaatccctgttgctacattgactaaaaggtcatgatgaatggaatatgtaagacttggctcatagaaacctaatcagatggttagaggtgttggcagtttaggacctgctgtcataaatgtgtgaacaaccttttgtaacctaacctattgacctgcatgttttttctttaccccaattcattacatggaggctcaatcttgagtttgctttactggttcagcaaaagccaggaagaacaactttgtagtaatcaaaatgttatccaactgtatattgtttactttattgtaaatactggtgaacagtggttaataaatagttttatattccttta

SEQ ID NO: 371657 - DNA, 2816 bp, Homo sapiens
tgagaactgccgctgctcgagaaacaactctgcgaggagcacctccgcacgggacccggcgctgctgctactgccgctagagccgctgccgccgcttttctagaaccttcccccccactaacgcgtcttccgctacgtcaggccgtcgcgtaaacgccctatccgccgccaatggcgggaaggctctacgccccaccttacgccaaatgcgtactcctcccacccttgcggccagagacagtacccgacgttacttccgtaaatgcgctcaatgaattgcggaaggctagagtcctgctagttactacctcttggaatagggtcccgccccctgccttggcgcaaggcaggtgagaaacggtcgcgcagtttgaaattaacgccgacgggaggggcttaatccgcagcctggagatccagccccctcaacccgggaggtggtccctgcagttacgccaatgataacccccgccagaaaaatcttagtagccttccctttttgttttccgtgccccaactcggcggattgactcggccccttccggaaacacccgaatcaacttctagtcaaattattgttcacgccgcaatgacccacccctggcccgcgtctgtggaactgacccctggtgtacaggagagttcgctgctgaaagtggtcccaaaggggtactagtttttaagctcccaactccccctcccccagcgtctggaggattccacaccctcgcaccgcaggggcgaggaagtgggcggagtccggttttggcgccagccgctgaggctgccaagcagaaaagccaccgctgaggagactccggtcactgtcctcgccccgcctcccccttccctccccttggggaccaccgggcgccacgccgcgaacggtaagtgccgcggtcgtcggcgcctccgccctccccctagggccccaattcccagcgggcgcgcgcccgctgccccgcccttcgtggccgcccggcgtgggcggtgccacccctccccccggcggccccgcgcgcagctcccggctccctcccccttcggatgtggcttgagctgtaggcgcggagggccggagacgctgcagacccgcgacccggagcagctcggaggcggtgaataatagctcttcaagtctgcaataaaaaatggcctccaacaaaactacattgcaaaaaatgggaaaaaaacagaatggaaagagtaaaaaagttgaagaggcagagcctgaagaatttgtcgtggaaaaagtactagatcgacgtgtagtgaatgggaaagtggaatatttcctgaagtggaagggatttacagatgctgacaatacttgggaacctgaagaaaatttagattgtccagaattgattgaagcgtttcttaactctcagaaagctggcaaagaaaaagatggtacaaaaagaaaatctttatctgacagtgaatctgatgacagcaaatcaaagaagaaaagagatgctgctgacaaaccaagaggatttgccagaggtcttgatcctgaaagaataattggtgccacagacagcagtggagaattgatgtttctcatgaaatggaaagattcagatgaggcagacttggtgctggcgaaagaggcaaatatgaagtgtcctcaaattgtaattgctttttatgaagagagactaacttggcattcttgtccagaagatgaagctcaataattgttcacattgttcttttatatatatttatatatatatataaaaattgggtcttagattttgatttactagtgtgacaaaataactacatcctaatgaaaatcaagtttgatatgtttgttttgaaagtagcgttggaagagttgttgggggttttttgcatccatagcactggttactttgaacaaataaataaaagctttctgtagttgcttcctttatcagaaaagaacatttgataccatggtatatcatttcctcttcattaaagaacagcttttctaaatgttgggggaaatgtccatagtcattactcagtcaaaacttgtgttctcatgagcctaaggaccattctagatttattacgtgttttgtgtgtgtgtgtgtgtgtgtgtgtgtgtgtatccataaaatgcatatgtaaatttttttttgtttttaagcattcacccaaacaaaaaaatcacaggtaaacccatgtttctgagatgccattattccaagcaaaataagagataatcccttcaagttaaattgaaaattttcctgaaaccatacattacaatttaaattggataattttaaagtgtctataattgcagtggtttatttgcaaaattcctaaaaggaaaaattttatcactgccatcacagcaggtttcctcatccagatgaggaaactagacaaatgctagtgtgttttaactagctaaacaaaactaagttaaatgaacatttaaaagtttccctagcgggccattccttagcaaaatgttggaatccctgttgctacattgactaaaaggtcatgatgaatggaatatgtaagacttggctcatagaaacctaatcagatggttagaggtgttggcagtttaggacctgctgtcataaatgtgtgaacaaccttttgtaacctaacctattgacctgcatgttttttctttaccccaattcattacatggaggctcaatcttgagtttgctttactggttcagcaaaagccaggaagaacaactttgtagtaatcaaaatgttatccaactgtatattgtttactttattgtaaatactggtgaacagtggttaataaatagttttatattccttta

SEQ ID NO: 371658 - DNA, 3225 bp, Homo sapiens
  misc_feature (2863)..(2863): n is a, c, g, or t
  misc_feature (2870)..(2870): n is a, c, g, or t
  misc_feature (2879)..(2879): n is a, c, g, or t
  misc_feature (2881)..(2881): n is a, c, g, or t
  misc_feature (2893)..(2894): n is a, c, g, or t
  misc_feature (2896)..(2896): n is a, c, g, or t
  misc_feature (2899)..(2899): n is a, c, g, or t
  misc_feature (2922)..(2922): n is a, c, g, or t
tgagaactgccgctgctcgagaaacaactctgcgaggagcacctccgcacgggacccggcgctgctgctactgccgctagagccgctgccgccgcttttctagaaccttcccccccactaacgcgtcttccgctacgtcaggccgtcgcgtaaacgccctatccgccgccaatggcgggaaggctctacgccccaccttacgccaaatgcgtactcctcccacccttgcggccagagacagtacccgacgttacttccgtaaatgcgctcaatgaattgcggaaggctagagtcctgctagttactacctcttggaatagggtcccgccccctgccttggcgcaaggcaggtgagaaacggtcgcgcagtttgaaattaacgccgacgggaggggcttaatccgcagcctggagatccagccccctcaacccgggaggtggtccctgcagttacgccaatgataacccccgccagaaaaatcttagtagccttccctttttgttttccgtgccccaactcggcggattgactcggccccttccggaaacacccgaatcaacttctagtcaaattattgttcacgccgcaatgacccacccctggcccgcgtctgtggaactgacccctggtgtacaggagagttcgctgctgaaagtggtcccaaaggggtactagtttttaagctcccaactccccctcccccagcgtctggaggattccacaccctcgcaccgcaggggcgaggaagtgggcggagtccggttttggcgccagccgctgaggctgccaagcagaaaagccaccgctgaggagactccggtcactgtcctcgccccgcctcccccttccctccccttggggaccaccgggcgccacgccgcgaacggtaagtgccgcggtcgtcggcgcctccgccctccccctagggccccaattcccagcgggcgcgcgcccgctgccccgcccttcgtggccgcccggcgtgggcggtgccacccctccccccggcggccccgcgcgcagctcccggctccctcccccttcggatgtggcttgagctgtaggcgcggagggccggagacgctgcagacccgcgacccggagcagctcggaggcggtgaataatagctcttcaagtctgcaataaaaaatggcctccaacaaaactacattgcaaaaaatgggaaaaaaacagaatggaaagagtaaaaaagttgaagaggcagagcctgaagaatttgtcgtggaaaaagtactagatcgacgtgtagtgaatgggaaagtggaatatttcctgaagtggaagggatttacagatgctgacaatacttgggaacctgaagaaaatttagattgtccagaattgattgaagcgtttcttaactctcagaaagctggcaaagaaaaagatggtacaaaaagaaaatctttatctgacagtgaatctgatgacagcaaatcaaagaagaaaagagatgctgctgacaaaccaagaggatttgccagaggtcttgatcctgaaagaataattggtgccacagacagcagtggagaattgatgtttctcatgaaatggaaagattcagatgaggcagacttggtgctggcgaaagaggcaaatatgaagtgtcctcaaattgtaattgctttttatgaagagagactaacttggcattcttgtccagaagatgaagctcaataattgttcacattgttcttttatatatatttatatatatatataaaaattgggtcttagattttgatttactagtgtgacaaaataactacatcctaatgaaaatcaagtttgatatgtttgttttgaaagtagcgttggaagagttgttgggggttttttgcatccatagcactggttactttgaacaaataaataaaagctttctgtagttgcttcctttatcagaaaagaacatttgataccatggtatatcatttcctcttcattaaagaacagcttttctaaatgttgggggaaatgtccatagtcattactcagtcaaaacttgtgttctcatgagcctaaggaccattctagatttattacgtgttttgtgtgtgtgtgtgtgtgtgtgtgtgtgtgtatccataaaatgcatatgtaaatttttttttgtttttaagcattcacccaaacaaaaaaatcacaggtaaacccatgtttctgagatgccattattccaagcaaaataagagataatcccttcaagttaaattgaaaattttcctgaaaccatacatttcaagtgaaataagtaattctagataggacaatttaaattggataattttaaagtgtctataattgcagtggtttatttgcaaaattcctaaaaggaaaaattttatcactgccatcacagcaggtttcctcatccagatgaggaaactagacaaatgctagtgtgttttaactagctaaacaaaactaagttaaatgaacatttaaaagtttccctagcgggccattccttagcaaaatgttggaatccctgttgctacattgactaaaaggtcatgatgaatggaatatgtaagacttggctcatagaaacctaatcagatggttagaggtgttggcagtttaggacctgctgtcataaatgtgtgaacaaccttttgtaacctaacctattgacctgcatgttttttctttaccccaattcattacatggaggctcaatcttgagtttgctttactggttcagcaaaagccaggaagaacaactttgtagtaatcaaaatgttatccaactgtatattgtttactttattgtaaatactggtgaacagtggttaataaatagttttatattcctttaaaaaaaaaaaaaaaaaaanaaaaaanaaaaaaaananaaaaaaaaaaannanaanaaaaaaaaaaaaagaaaaaaaanaaagatgaaaaacaaaatgaaagaggggggcgagccgcacacgaaaattcccgggaggaggccgtccgaataaggaaaaataccagcgagtagtacacgtggaagaggaggcggccaccacacaagagaggagcgcgaagcgaataaaaagagacgacagcggcaggagcgagcaagccatcacgatcccgcagcgcagagagcaggaacaaacgagcgacagggagggaaccatgtgggagggcgaggacacactcagaaagcggggggggacaaaaaagtggggacaaagcacccccgcgc

SEQ ID NO: 371659 - DNA, 2422 bp, Homo sapiens
cgccgcgggggtaggcgcgtgcggtgtggcgcagtgcccttgagcccccgtgccgcggcctttgtttctccccgcggatgcgctgaccacgaggcccgcgctcccgggtgggggcgggcacccgcgcttaggcacgtctggacgccgggcttcagcggcgggggtcgggagcgggtgtttgcaagaggtgattcttttttcaaagtgtcacgaaacggggttgaagcatcttaagttttttccttttgttatttaattaccgattggaaagagggagggtttctgagcagaaaccaagttgggattgcagaacagagaagattcacagtgctttaccgttgtgagttgtttgggtaatcgtgcctggttttaaaccgaaaggattgtcctttaaaaatggaacatggactttattataaatgggacttagattggaaaagacattggtcccctattttaagccatgtgaagctgttttaggtaccaggatccccagtaaagtctttctagactcacatggttaggacacgtacttaagtacatcataagcaatgtaggtaggagcgcagatctactctggatttgtattcacgtttgaaatgtgcgctctctacttgggggttggaatccaaacagaatttgtatttagttaccttttttgtgtcatgcaaacttaccttaactgtcatgcatttttctagtaatagctcttcaagtctgcaataaaaaatggcctccaacaaaactacattgcaaaaaatgggaaaaaaacagaatggaaagagtaaaaaagttgaagaggcagagcctgaagaatttgtcgtggaaaaagtactagatcgacgtgtagtgaatgggaaagtggaatatttcctgaagtggaagggatttacagatgctgacaatacttgggaacctgaagaaaatttagattgtccagaattgattgaagcgtttcttaactctcagaaagctggcaaagaaaaagatggtacaaaaagaaaatctttatctgacagtgaatctgatgacagcaaatcaaagaagaaaagagatgctgctgacaaaccaagaggatttgccagaggtcttgatcctgaaagaataattggtgccacagacagcagtggagaattgatgtttctcatgaaatggaaagattcagatgaggcagacttggtgctggcgaaagaggcaaatatgaagtgtcctcaaattgtaattgctttttatgaagagagactaacttggcattcttgtccagaagatgaagctcaataattgttcacattgttcttttatatatatttatatatatatataaaaattgggtcttagattttgatttactagtgtgacaaaataactacatcctaatgaaaatcaagtttgatatgtttgttttgaaagtagcgttggaagagttgttgggggttttttgcatccatagcactggttactttgaacaaataaataaaagctttctgtagttgcttcctttatcagaaaagaacatttgataccatggtatatcatttcctcttcattaaagaacagcttttctaaatgttgggggaaatgtccatagtcattactcagtcaaaacttgtgttctcatgagcctaaggaccattctagatttattacgtgttttgtgtgtgtgtgtgtgtgtgtgtgtgtgtgtatccataaaatgcatatgtaaatttttttttgtttttaagcattcacccaaacaaaaaaatcacaggtaaacccatgtttctgagatgccattattccaagcaaaataagagataatcccttcaagttaaattgaaaattttcctgaaaccatacatttcaagtgaaataagtaattctagataggacaatttaaattggataattttaaagtgtctataattgcagtggtttatttgcaaaattcctaaaaggaaaaattttatcactgccatcacagcaggtttcctcatccagatgaggaaactagacaaatgctagtgtgttttaactagctaaacaaaactaagttaaatgaacatttaaaagtttccctagcgggccattccttagcaaaatgttggaatccctgttgctacattgactaaaaggtcatgatgaatggaatatgtaagacttggctcatagaaacctaatcagatggttagaggtgttggcagtttaggacctgctgtcataaatgtgtgaacaaccttttgtaacctaacctattgacctgcatgttttttctttaccccaattcattacatggaggctcaatcttgagtttgctttactggttcagcaaaagccaggaagaacaactttgtagtaatcaaaatgttatccaactgtatattgtttactttattgtaaatactggtgaacagtggttaataaatagttttatattccttta

SEQ ID NO: 371660 - DNA, 2608 bp, Homo sapiens
tgagaactgccgctgctcgagaaacaactctgcgaggagcacctccgcacgggacccggcgctgctgctactgccgctagagccgctgccgccgcttttctagaaccttcccccccactaacgcgtcttccgctacgtcaggccgtcgcgtaaacgccctatccgccgccaatggcgggaaggctctacgccccaccttacgccaaatgcgtactcctcccacccttgcggccagagacagtacccgacgttacttccgtaaatgcgctcaatgaattgcggaaggctagagtcctgctagttactacctcttggaatagggtcccgccccctgccttggcgcaaggcaggtgagaaacggtcgcgcagtttgaaattaacgccgacgggaggggcttaatccgcagcctggagatccagccccctcaacccgggaggtggtccctgcagttacgccaatgataacccccgccagaaaaatcttagtagccttccctttttgttttccgtgccccaactcggcggattgactcggccccttccggaaacacccgaatcaacttctagtcaaattattgttcacgccgcaatgacccacccctggcccgcgtctgtggaactgacccctggtgtacaggagagttcgctgctgaaagtggtcccaaaggggtactagtttttaagctcccaactccccctcccccagcgtctggaggattccacaccctcgcaccgcaggggcgaggaagtgggcggagtccggttttggcgccagccgctgaggctgccaagcagaaaagccaccgctgaggagactccggtcactgtcctcgccccgcctcccccttccctccccttggggaccaccgggcgccacgccgcgaacgtaatagctcttcaagtctgcaataaaaaatggcctccaacaaaactacattgcaaaaaatgggaaaaaaacagaatggaaagagtaaaaaagttgaagaggcagagcctgaagaatttgtcgtggaaaaagtactagatcgacgtgtagtgaatgggaaagtggaatatttcctgaagtggaagggatttacagatgctgacaatacttgggaacctgaagaaaatttagattgtccagaattgattgaagcgtttcttaactctcagaaagctggcaaagaaaaagatggtacaaaaagaaaatctttatctgacagtgaatctgatgacagcaaatcaaagaagaaaagagatgctgctgacaaaccaagaggatttgccagaggtcttgatcctgaaagaataattggtgccacagacagcagtggagaattgatgtttctcatgaaatggaaagattcagatgaggcagacttggtgctggcgaaagaggcaaatatgaagtgtcctcaaattgtaattgctttttatgaagagagactaacttggcattcttgtccagaagatgaagctcaataattgttcacattgttcttttatatatatttatatatatatataaaaattgggtcttagattttgatttactagtgtgacaaaataactacatcctaatgaaaatcaagtttgatatgtttgttttgaaagtagcgttggaagagttgttgggggttttttgcatccatagcactggttactttgaacaaataaataaaagctttctgtagttgcttcctttatcagaaaagaacatttgataccatggtatatcatttcctcttcattaaagaacagcttttctaaatgttgggggaaatgtccatagtcattactcagtcaaaacttgtgttctcatgagcctaaggaccattctagatttattacgtgttttgtgtgtgtgtgtgtgtgtgtgtgtgtgtgtatccataaaatgcatatgtaaatttttttttgtttttaagcattcacccaaacaaaaaaatcacaggtaaacccatgtttctgagatgccattattccaagcaaaataagagataatcccttcaagttaaattgaaaattttcctgaaaccatacatttcaagtgaaataagtaattctagataggacaatttaaattggataattttaaagtgtctataattgcagtggtttatttgcaaaattcctaaaaggaaaaattttatcactgccatcacagcaggtttcctcatccagatgaggaaactagacaaatgctagtgtgttttaactagctaaacaaaactaagttaaatgaacatttaaaagtttccctagcgggccattccttagcaaaatgttggaatccctgttgctacattgactaaaaggtcatgatgaatggaatatgtaagacttggctcatagaaacctaatcagatggttagaggtgttggcagtttaggacctgctgtcataaatgtgtgaacaaccttttgtaacctaacctattgacctgcatgttttttctttaccccaattcattacatggaggctcaatcttgagtttgctttactggttcagcaaaagccaggaagaacaactttgtagtaatcaaaatgttatccaactgtatattgtttactttattgtaaatactggtgaacagtggttaataaatagttttatattccttta

SEQ ID NO: 371661 - DNA, 3031 bp, Homo sapiens
tgagaactgccgctgctcgagaaacaactctgcgaggagcacctccgcacgggacccggcgctgctgctactgccgctagagccgctgccgccgcttttctagaaccttcccccccactaacgcgtcttccgctacgtcaggccgtcgcgtaaacgccctatccgccgccaatggcgggaaggctctacgccccaccttacgccaaatgcgtactcctcccacccttgcggccagagacagtacccgacgttacttccgtaaatgcgctcaatgaattgcggaaggctagagtcctgctagttactacctcttggaatagggtcccgccccctgccttggcgcaaggcaggtgagaaacggtcgcgcagtttgaaattaacgccgacgggaggggcttaatccgcagcctggagatccagccccctcaacccgggaggtggtccctgcagttacgccaatgataacccccgccagaaaaatcttagtagccttccctttttgttttccgtgccccaactcggcggattgactcggccccttccggaaacacccgaatcaacttctagtcaaattattgttcacgccgcaatgacccacccctggcccgcgtctgtggaactgacccctggtgtacaggagagttcgctgctgaaagtggtcccaaaggggtactagtttttaagctcccaactccccctcccccagcgtctggaggattccacaccctcgcaccgcaggggcgaggaagtgggcggagtccggttttggcgccagccgctgaggctgccaagcagaaaagccaccgctgaggagactccggtcactgtcctcgccccgcctcccccttccctccccttggggaccaccgggcgccacgccgcgaacggtaagtgccgcggtcgtcggcgcctccgccctccccctagggccccaattcccagcgggcgcgcgcccgctgccccgcccttcgtggccgcccggcgtgggcggtgccacccctccccccggcggccccgcgcgcagctcccggctccctcccccttcggatgtggcttgagctgtaggcgcggagggccggagacgctgcagacccgcgacccggagcagctcggaggcggtgaagtcggtggctttccttctctctagctctcgctcgctggtggtgcttcagatgccacacgcgtcccgggggcccggttctccgctcccctcccctccccttctcgccggaccccgcgccgggagctgcgggaaggagtggagggtcgggcggtggcctcgcggctggcctggcgcgcggccagcgccgtaatagctcttcaagtctgcaataaaaaatggcctccaacaaaactacattgcaaaaaatgggaaaaaaacagaatggaaagagtaaaaaagttgaagaggcagagcctgaagaatttgtcgtggaaaaagtactagatcgacgtgtagtgaatgggaaagtggaatatttcctgaagtggaagggatttacagatgctgacaatacttgggaacctgaagaaaatttagattgtccagaattgattgaagcgtttcttaactctcagaaagctggcaaagaaaaagatggtacaaaaagaaaatctttatctgacagtgaatctgatgacagcaaatcaaagaagaaaagagatgctgctgacaaaccaagaggatttgccagaggtcttgatcctgaaagaataattggtgccacagacagcagtggagaattgatgtttctcatgaaatggaaagattcagatgaggcagacttggtgctggcgaaagaggcaaatatgaagtgtcctcaaattgtaattgctttttatgaagagagactaacttggcattcttgtccagaagatgaagctcaataattgttcacattgttcttttatatatatttatatatatatataaaaattgggtcttagattttgatttactagtgtgacaaaataactacatcctaatgaaaatcaagtttgatatgtttgttttgaaagtagcgttggaagagttgttgggggttttttgcatccatagcactggttactttgaacaaataaataaaagctttctgtagttgcttcctttatcagaaaagaacatttgataccatggtatatcatttcctcttcattaaagaacagcttttctaaatgttgggggaaatgtccatagtcattactcagtcaaaacttgtgttctcatgagcctaaggaccattctagatttattacgtgttttgtgtgtgtgtgtgtgtgtgtgtgtgtgtgtatccataaaatgcatatgtaaatttttttttgtttttaagcattcacccaaacaaaaaaatcacaggtaaacccatgtttctgagatgccattattccaagcaaaataagagataatcccttcaagttaaattgaaaattttcctgaaaccatacatttcaagtgaaataagtaattctagataggacaatttaaattggataattttaaagtgtctataattgcagtggtttatttgcaaaattcctaaaaggaaaaattttatcactgccatcacagcaggtttcctcatccagatgaggaaactagacaaatgctagtgtgttttaactagctaaacaaaactaagttaaatgaacatttaaaagtttccctagcgggccattccttagcaaaatgttggaatccctgttgctacattgactaaaaggtcatgatgaatggaatatgtaagacttggctcatagaaacctaatcagatggttagaggtgttggcagtttaggacctgctgtcataaatgtgtgaacaaccttttgtaacctaacctattgacctgcatgttttttctttaccccaattcattacatggaggctcaatcttgagtttgctttactggttcagcaaaagccaggaagaacaactttgtagtaatcaaaatgttatccaactgtatattgtttactttattgtaaatactggtgaacagtggttaataaatagttttatattccttta

SEQ ID NO: 371662 - DNA, 2368 bp, Homo sapiens
cgccgcgggggtaggcgcgtgcggtgtggcgcagtgcccttgagcccccgtgccgcggcctttgtttctccccgcggatgcgctgaccacgaggcccgcgctcccgggtgggggcgggcacccgcgcttaggcacgtctggacgccgggcttcagcggcgggggtcgggagcgggtgtttgcaagaggtgattcttttttcaaagtgtcacgaaacggggttgaagcatcttaagttttttccttttgttatttaattaccgattggaaagagggagggtttctgagcagaaaccaagttgggattgcagaacagagaagattcacagtgctttaccgttgtgagttgtttgggtaatcgtgcctggttttaaaccgaaaggattgtcctttaaaaatggaacatggactttattataaatgggacttagattggtccccagtaaagtctttctagactcacatggttaggacacgtacttaagtacatcataagcaatgtaggtaggagcgcagatctactctggatttgtattcacgtttgaaatgtgcgctctctacttgggggttggaatccaaacagaatttgtatttagttaccttttttgtgtcatgcaaacttaccttaactgtcatgcatttttctagtaatagctcttcaagtctgcaataaaaaatggcctccaacaaaactacattgcaaaaaatgggaaaaaaacagaatggaaagagtaaaaaagttgaagaggcagagcctgaagaatttgtcgtggaaaaagtactagatcgacgtgtagtgaatgggaaagtggaatatttcctgaagtggaagggatttacagatgctgacaatacttgggaacctgaagaaaatttagattgtccagaattgattgaagcgtttcttaactctcagaaagctggcaaagaaaaagatggtacaaaaagaaaatctttatctgacagtgaatctgatgacagcaaatcaaagaagaaaagagatgctgctgacaaaccaagaggatttgccagaggtcttgatcctgaaagaataattggtgccacagacagcagtggagaattgatgtttctcatgaaatggaaagattcagatgaggcagacttggtgctggcgaaagaggcaaatatgaagtgtcctcaaattgtaattgctttttatgaagagagactaacttggcattcttgtccagaagatgaagctcaataattgttcacattgttcttttatatatatttatatatatatataaaaattgggtcttagattttgatttactagtgtgacaaaataactacatcctaatgaaaatcaagtttgatatgtttgttttgaaagtagcgttggaagagttgttgggggttttttgcatccatagcactggttactttgaacaaataaataaaagctttctgtagttgcttcctttatcagaaaagaacatttgataccatggtatatcatttcctcttcattaaagaacagcttttctaaatgttgggggaaatgtccatagtcattactcagtcaaaacttgtgttctcatgagcctaaggaccattctagatttattacgtgttttgtgtgtgtgtgtgtgtgtgtgtgtgtgtgtatccataaaatgcatatgtaaatttttttttgtttttaagcattcacccaaacaaaaaaatcacaggtaaacccatgtttctgagatgccattattccaagcaaaataagagataatcccttcaagttaaattgaaaattttcctgaaaccatacatttcaagtgaaataagtaattctagataggacaatttaaattggataattttaaagtgtctataattgcagtggtttatttgcaaaattcctaaaaggaaaaattttatcactgccatcacagcaggtttcctcatccagatgaggaaactagacaaatgctagtgtgttttaactagctaaacaaaactaagttaaatgaacatttaaaagtttccctagcgggccattccttagcaaaatgttggaatccctgttgctacattgactaaaaggtcatgatgaatggaatatgtaagacttggctcatagaaacctaatcagatggttagaggtgttggcagtttaggacctgctgtcataaatgtgtgaacaaccttttgtaacctaacctattgacctgcatgttttttctttaccccaattcattacatggaggctcaatcttgagtttgctttactggttcagcaaaagccaggaagaacaactttgtagtaatcaaaatgttatccaactgtatattgtttactttattgtaaatactggtgaacagtggttaataaatagttttatattccttta

SEQ ID NO: 371663 - DNA, 1765 bp, Homo sapiens
  misc_feature (41)..(41): n is a, c, g, or t
gacccacgcgtccgcggacgcgtgggtcgacccacgcgtcngaataatagctcttcaagtctgcaataaaaaatggcctccaacaaaactacattgcaaaaaatgggaaaaaaacagaatggaaagagtaaaaaagttgaagaggcagagcctgaagaatttgtcgtggaaaaagtactagatcgacgtgtagtgaatgggaaagtggaatatttcctgaagtggaagggatttacagatgctgacaatacttgggaacctgaagaaaatttagattgtccagaattgattgaagcgtttcttaactctcagaaagctggcaaagaaaaagatggtacaaaaagaaaatctttatctgacagtgaatctgatgacagcaaatcaaagaagaaaagagatgctgctgacaaaccaagaggatttgccagaggtcttgatcctgaaagaataattggtgccacagacagcagtggagaattgatgtttctcatgaaatggaaagattcagatgaggcagacttggtgctggcgaaagaggcaaatatgaagtgtcctcaaattgtaattgctttttatgaagagagactaacttggcattcttgtccagaagatgaagctcaataattgttcacattgttcttttatatatatttatatatatatataaaaattgggtcttagattttgatttactagtgtgacaaaataactacatcctaatgaaaatcaagtttgatatgtttgttttgaaagtagcgttggaagagttgttgggggttttttgcatccatagcactggttactttgaacaaataaataaaagctttctgtagttgcttcctttatcagaaaagaacatttgataccatggtatatcatttcctcttcattaaagaacagcttttctaaatgttgggggaaatgtccatagtcattactcagtcaaaacttgtgttctcatgagcctaaggaccattctagatttattacgtgttttgtgtgtgtgtgtgtgtgtgtgtgtgtgtgtatccataaaatgcatatgtaaatttttttttgtttttaagcattcacccaaacaaaaaaatcacaggtaaacccatgtttctgagatgccattattccaagcaaaataagagataatcccttcaagttaaattgaaaattttcctgaaaccatacatttcaagtgaaataagtaattctagataggacaatttaaattggataattttaaagtgtctataattgcagtggtttatttgcaaaattcctaaaaggaaaaattttatcactgccatcacagcaggtttcctcatccagatgaggaaactagacaaatgctagtgtgttttaactagctaaacaaaactaagttaaatgaacatttaaaagtttccctagcgggccattccttagcaaaatgttggaatccctgttgctacattgactaaaaggtcatgatgaatggaatatgtaagacttggctcatagaaacctaatcagatggttagaggtgttggcagtttaggacctgctgtcataaatgtgtgaacaaccttttgtaacctaacctattgacctgcatgttttttctttaccccaattcattacatggaggctcaatcttgagtttgctttactggttcagcaaaagccaggaagaacaactttgtagtaatcaaaatgttatccaactgtatattgtttactttattgtaaatactggtgaacagtggttaataaatagttttatattccttta

SEQ ID NO: 371664 - DNA, 2792 bp, Homo sapiens
tgagaactgccgctgctcgagaaacaactctgcgaggagcacctccgcacgggacccggcgctgctgctactgccgctagagccgctgccgccgcttttctagaaccttcccccccactaacgcgtcttccgctacgtcaggccgtcgcgtaaacgccctatccgccgccaatggcgggaaggctctacgccccaccttacgccaaatgcgtactcctcccacccttgcggccagagacagtacccgacgttacttccgtaaatgcgctcaatgaattgcggaaggctagagtcctgctagttactacctcttggaatagggtcccgccccctgccttggcgcaaggcaggtgagaaacggtcgcgcagtttgaaattaacgccgacgggaggggcttaatccgcagcctggagatccagccccctcaacccgggaggtggtccctgcagttacgccaatgataacccccgccagaaaaatcttagtagccttccctttttgttttccgtgccccaactcggcggattgactcggccccttccggaaacacccgaatcaacttctagtcaaattattgttcacgccgcaatgacccacccctggcccgcgtctgtggaactgacccctggtgtacaggagagttcgctgctgaaagtggtcccaaaggggtactagtttttaagctcccaactccccctcccccagcgtctggaggattccacaccctcgcaccgcaggggcgaggaagtgggcggagtccggttttggcgccagccgctgaggctgccaagcagaaaagccaccgctgaggagactccggtcactgtcctcgccccgcctcccccttccctccccttggggaccaccgggcgccacgccgcgaacggtaagtgccgcggtcgtcggcgcctccgccctccccctagggccccaattcccagcgggcgcgcgcccgctgccccgcccttcgtggccgcccggcgtgggcggtgccacccctccccccggcggccccgcgcgcagctcccggctccctcccccttcggatgtggcttgagctgtaggcgcggagggccggagacgctgcagacccgcgacccggagcagctcggaggcggtgaacaaaaaatgggaaaaaaacagaatggaaagagtaaaaaagttgaagaggcagagcctgaagaatttgtcgtggaaaaagtactagatcgacgtgtagtgaatgggaaagtggaatatttcctgaagtggaagggatttacagatgctgacaatacttgggaacctgaagaaaatttagattgtccagaattgattgaagcgtttcttaactctcagaaagctggcaaagaaaaagatggtacaaaaagaaaatctttatctgacagtgaatctgatgacagcaaatcaaagaagaaaagagatgctgctgacaaaccaagaggatttgccagaggtcttgatcctgaaagaataattggtgccacagacagcagtggagaattgatgtttctcatgaaatggaaagattcagatgaggcagacttggtgctggcgaaagaggcaaatatgaagtgtcctcaaattgtaattgctttttatgaagagagactaacttggcattcttgtccagaagatgaagctcaataattgttcacattgttcttttatatatatttatatatatatataaaaattgggtcttagattttgatttactagtgtgacaaaataactacatcctaatgaaaatcaagtttgatatgtttgttttgaaagtagcgttggaagagttgttgggggttttttgcatccatagcactggttactttgaacaaataaataaaagctttctgtagttgcttcctttatcagaaaagaacatttgataccatggtatatcatttcctcttcattaaagaacagcttttctaaatgttgggggaaatgtccatagtcattactcagtcaaaacttgtgttctcatgagcctaaggaccattctagatttattacgtgttttgtgtgtgtgtgtgtgtgtgtgtgtgtgtgtatccataaaatgcatatgtaaatttttttttgtttttaagcattcacccaaacaaaaaaatcacaggtaaacccatgtttctgagatgccattattccaagcaaaataagagataatcccttcaagttaaattgaaaattttcctgaaaccatacatttcaagtgaaataagtaattctagataggacaatttaaattggataattttaaagtgtctataattgcagtggtttatttgcaaaattcctaaaaggaaaaattttatcactgccatcacagcaggtttcctcatccagatgaggaaactagacaaatgctagtgtgttttaactagctaaacaaaactaagttaaatgaacatttaaaagtttccctagcgggccattccttagcaaaatgttggaatccctgttgctacattgactaaaaggtcatgatgaatggaatatgtaagacttggctcatagaaacctaatcagatggttagaggtgttggcagtttaggacctgctgtcataaatgtgtgaacaaccttttgtaacctaacctattgacctgcatgttttttctttaccccaattcattacatggaggctcaatcttgagtttgctttactggttcagcaaaagccaggaagaacaactttgtagtaatcaaaatgttatccaactgtatattgtttactttattgtaaatactggtgaacagtggttaataaatagttttatattccttta

SEQ ID NO: 371665 - DNA, 1805 bp, Homo sapiens
gactgaagaccagcaatccggaggagcgcggaggcggtgagtaatagactcttgagagtttagcaagtaatacataatggagcatccgatggataaatcgtactaatgtggcaatagagaaatgggcaacacaaatcaagaaatggacaagagtaaaaaagtaggcagatgagggcagcagactgcaaggaatagtgagtccgtgagagtcaagtactggatcgatgagtagtggaattggagaagaaatggaatattccctgtaaggggaagggatgttgctgacaatacttgggaacctgaagaaaatttagattgtccagaattgattgaagcgtttcttaactctcagaaagctggcaaagaaaaagatggtacaaaaagaaaatctttatctgacagtgaatctgatgacagcaaatcaaagaagaaaagagatgctgctgacaaaccaagaggatttgccagaggtcttgatcctgaaagaataattggtgccacagacagcagtggagaattgatgtttctcatgaaatggaaagattcagatgaggcagacttggtgctggcgaaagaggcaaatatgaagtgtcctcaaattgtaattgctttttatgaagagagactaacttggcattcttgtccagaagatgaagctcaataattgttcacattgttcttttatatatatttatatatatatataaaaattgggtcttagattttgatttactagtgtgacaaaataactacatcctaatgaaaatcaagtttgatatgtttgttttgaaagtagcgttggaagagttgttgggggttttttgcatccatagcactggttactttgaacaaataaataaaagctttctgtagttgcttcctttatcagaaaagaacatttgataccatggtatatcatttcctcttcattaaagaacagcttttctaaatgttgggggaaatgtccatagtcattactcagtcaaaacttgtgttctcatgagcctaaggaccattctagatttattacgtgttttgtgtgtgtgtgtgtgtgtgtgtgtgtgtgtatccataaaatgcatatgtaaatttttttttgtttttaagcattcacccaaacaaaaaaatcacaggtaaacccatgtttctgagatgccattattccaagcaaaataagagataatcccttcaagttaaattgaaaattttcctgaaaccatacatttcaagtgaaataagtaattctagataggacaatttaaattggataattttaaagtgtctataattgcagtggtttatttgcaaaattcctaaaaggaaaaattttatcactgccatcacagcaggtttcctcatccagatgaggaaactagacaaatgctagtgtgttttaactagctaaacaaaactaagttaaatgaacatttaaaagtttccctagcgggccattccttagcaaaatgttggaatccctgttgctacattgactaaaaggtcatgatgaatggaatatgtaagacttggctcatagaaacctaatcagatggttagaggtgttggcagtttaggacctgctgtcataaatgtgtgaacaaccttttgtaacctaacctattgacctgcatgttttttctttaccccaattcattacatggaggctcaatcttgagtttgctttactggttcagcaaaagccaggaagaacaactttgtagtaatcaaaatgttatccaactgtatattgtttactttattgtaaatactggtgaacagtggttaataaatagttttatattccttta

SEQ ID NO: 371666 - DNA, 2771 bp, Homo sapiens
tgagaactgccgctgctcgagaaacaactctgcgaggagcacctccgcacgggacccggcgctgctgctactgccgctagagccgctgccgccgcttttctagaaccttcccccccactaacgcgtcttccgctacgtcaggccgtcgcgtaaacgccctatccgccgccaatggcgggaaggctctacgccccaccttacgccaaatgcgtactcctcccacccttgcggccagagacagtacccgacgttacttccgtaaatgcgctcaatgaattgcggaaggctagagtcctgctagttactacctcttggaatagggtcccgccccctgccttggcgcaaggcaggtgagaaacggtcgcgcagtttgaaattaacgccgacgggaggggcttaatccgcagcctggagatccagccccctcaacccgggaggtggtccctgcagttacgccaatgataacccccgccagaaaaatcttagtagccttccctttttgttttccgtgccccaactcggcggattgactcggccccttccggaaacacccgaatcaacttctagtcaaattattgttcacgccgcaatgacccacccctggcccgcgtctgtggaactgacccctggtgtacaggagagttcgctgctgaaagtggtcccaaaggggtactagtttttaagctcccaactccccctcccccagcgtctggaggattccacaccctcgcaccgcaggggcgaggaagtgggcggagtccggttttggcgccagccgctgaggctgccaagcagaaaagccaccgctgaggagactccggtcactgtcctcgccccgcctcccccttccctccccttggggaccaccgggcgccacgccgcgaacggtaagtgccgcggtcgtcggcgcctccgccctccccctagggccccaattcccagcgggcgcgcgcccgctgccccgcccttcgtggccgcccggcgtgggcggtgccacccctccccccggcggccccgcgcgcagctcccggctccctcccccttcggatgtggcttgagctgtaggcgcggagggccggagacgctgcagacccgcgacccggagcagctcggaggcggtgaataatagctcttcaagtctgcaataaaaaatggcctccaacaaaactacattgcaaaaaatgggaaaaaaacagaatggaaagagtaaaaaagttgaagaggcagagcctgaagaatttgtcgtggaaaaagtactagatcgacgtgtagtgaatgggaaagtggaatatttcctgaagtggaagggatttacagaaaagctggcaaagaaaaagatggtacaaaaagaaaatctttatctgacagtgaatctgatgacagcaaatcaaagaagaaaagagatgctgctgacaaaccaagaggatttgccagaggtcttgatcctgaaagaataattggtgccacagacagcagtggagaattgatgtttctcatgaaatggaaagattcagatgaggcagacttggtgctggcgaaagaggcaaatatgaagtgtcctcaaattgtaattgctttttatgaagagagactaacttggcattcttgtccagaagatgaagctcaataattgttcacattgttcttttatatatatttatatatatatataaaaattgggtcttagattttgatttactagtgtgacaaaataactacatcctaatgaaaatcaagtttgatatgtttgttttgaaagtagcgttggaagagttgttgggggttttttgcatccatagcactggttactttgaacaaataaataaaagctttctgtagttgcttcctttatcagaaaagaacatttgataccatggtatatcatttcctcttcattaaagaacagcttttctaaatgttgggggaaatgtccatagtcattactcagtcaaaacttgtgttctcatgagcctaaggaccattctagatttattacgtgttttgtgtgtgtgtgtgtgtgtgtgtgtgtgtgtatccataaaatgcatatgtaaatttttttttgtttttaagcattcacccaaacaaaaaaatcacaggtaaacccatgtttctgagatgccattattccaagcaaaataagagataatcccttcaagttaaattgaaaattttcctgaaaccatacatttcaagtgaaataagtaattctagataggacaatttaaattggataattttaaagtgtctataattgcagtggtttatttgcaaaattcctaaaaggaaaaattttatcactgccatcacagcaggtttcctcatccagatgaggaaactagacaaatgctagtgtgttttaactagctaaacaaaactaagttaaatgaacatttaaaagtttccctagcgggccattccttagcaaaatgttggaatccctgttgctacattgactaaaaggtcatgatgaatggaatatgtaagacttggctcatagaaacctaatcagatggttagaggtgttggcagtttaggacctgctgtcataaatgtgtgaacaaccttttgtaacctaacctattgacctgcatgttttttctttaccccaattcattacatggaggctcaatcttgagtttgctttactggttcagcaaaagccaggaagaacaactttgtagtaatcaaaatgttatccaactgtatattgtttactttattgtaaatactggtgaacagtggttaataaatagttttatattccttta

SEQ ID NO: 371667 - DNA, 2172 bp, Homo sapiens
tgagaactgccgctgctcgagaaacaactctgcgaggagcacctccgcacgggacccggcgctgctgctactgccgctagagccgctgccgccgcttttctagaaccttcccccccactaacgcgtcttccgctacgtcaggccgtcgcgtaaacgccctatccgccgccaatggcgggaaggctctacgccccaccttacgccaaatgcgtactcctcccacccttgcggccagagacagtacccgacgttacttccgtaaatgcgctcaatgaattgcggaaggctagagtcctgctagttactacctcttggaatagggtcccgccccctgccttggcgcaaggcaggtgagaaacggtcgcgcagtttgaaattaacgccgacgggaggggcttaatccgcagcctggagatccagccccctcaacccgggaggtggtccctgcagttacgccaatgataacccccgccagaaaaatcttagtagccttccctttttgttttccgtgccccaactcggcggattgactcggccccttccggaaacacccgaatcaacttctagtcaaattattgttcacgccgcaatgacccacccctggcccgcgtctgtggaactgacccctggtgtacaggagagttcgctgctgaaagtggtcccaaaggggtactagtttttaagctcccaactccccctcccccagcgtctggaggattccacaccctcgcaccgcaggggcgaggaagtgggcggagtccggttttggcgccagccgctgaggctgccaagcagaaaagccaccgctgaggagactccggtcactgtcctcgccccgcctcccccttccctccccttggggaccaccgggcgccacgccgcgaacggtaagtgccgcggtcgtcggcgcctccgccctccccctagggccccaattcccagcgggcgcgcgcccgctgccccgcccttcgtggccgcccggcgtgggcggtgccacccctccccccggcggccccgcgcgcagctcccggctccctcccccttcggatgtggcttgagctgtaggcgcggagggccggagacgctgcagacccgcgacccggagcagctcggaggcggtgaataatagctcttcaagtctgcaataaaaaatggcctccaacaaaactacattgcaaaaaatgggaaaaaaacagaatggaaagagtaaaaaagttgaagaggcagagcctgaagaatttgtcgtggaaaaagtactagatcgacgtgtagtgaatgggaaagtggaatatttcctgaagtggaagggatttacagatgctgacaatacttgggaacctgaagaaaatttagattgtccagaattgattgaagcgtttcttaactctcagaaagctggcaaagaaaaagatggtacaaaaagaaaatctttatctgacagtgaatctgatgacagcaaatcaaagaagaaaagagatgctgctgacaaaccaagaggatttgccagaggtcttgatcctgaaagaataattggtgccacagacagcagtggagaattgatgtttctcatgaaatggaaagattcagatgaggcagacttggtgctggcgaaagaggcaaatatgaagtgtcctcaaattgtaattgctttttatgaagagagactaacttggcattcttgtccagaagatgaagctcaataattgttcacattgttcttttatatatatttatatatatatataaaaattgggtcttagattttgatttactagtgtgacaaaataactacatcctaatgaaaatcaagtttgatatgtttgttttgaaagtagcgttggaagagttgttgggggttttttgcatccatagcactggttactttgaacaaataaataaaagctttctgtagttgcttcctttatcagaaaagaacatttgataccatggtatatcatttcctcttcattaaagaacagcttttctaaatgttgggggaaatgtccatagtcattactcagtcaaaacttgtgttctcatgagcctaaggaccattctagatttattacgtgttttgtgtgtgtgtgtgtgtgcctcctagacccgtgacctgagatgtgtgacttatagatcataaaatggaagtgtctgccaaacacagcaaacacacac

SEQ ID NO: 371668 - DNA, 2526 bp, Homo sapiens
atcattctcacccaggcagtgtgactccagagcttgtgacattgatgtaaaactctgacaggaataaaggatttattgatatcattggttctcaaactttttttggtctcagggcctctttatactctaaaaaaattattgaggatccccagagagcttttgtttatatgggttataattatcaatactaacagtagaaattaaaacaaatttctaaaatgacttttctaaaaaagctgagaagagtagcattttacatttttacagatattcaacatgtgtcttaaggcaattttacttaaacacatttgattgctgtggcggatcattttggtggaggtatatgaagacaatccaaagtcacaaatagatgaaaaaagggggccttacacaaccccctcccaaaaaggactctggaatccccagtgaatccgtagaccacattttgagagccactggtttatattaagtactttctagcgcagggggtccaatcttttggcagccctgggccacattaggagaattgtcgagggctacacataaaatagacttaataccaaccatagctgatgagctaaaaaaaaaaaaaaaaaaaatcgcaagaaagtttcaatgttttaagaaagtttacaaatttgtgttgggcctccaaagccatcctgggccacaggttacacaagtttgttctaacatttactatcatttagaatgattacagatagttggtatgagttttaacatttttaatatttcttaccgtttgtgttttgtttatgcttttaaaatgtgtcagtaattcagactaattcctggaagtcatttgaaatatattaactttcaagactttattattaccagaaataaagaggttagtttttctgtatgcccacacaactctgactttggtgtcattgaacgcagtaattttcttgactttttattctgaatgttttcagaaattttaagtattctacgttgagtatcaaactcaggtttttctgcttgtaaagttaatggaaatcagatgtttttaattaccaaatatgggttcttgctctagtcatttccatctcactattggaatgtttttatttaaaatacgccatgaaaacaatttaatactctgagtttgctgtatgaaaaaatgtcttctaaacagggctgacaaaccaagaggatttgccagaggtcttgatcctgaaagaataattggtgccacagacagcagtggagaattgatgtttctcatgaaatggaaagattcagatgaggcagacttggtgctggcgaaagaggcaaatatgaagtgtcctcaaattgtaattgctttttatgaagagagactaacttggcattcttgtccagaagatgaagctcaataattgttcacattgttcttttatatatatttatatatatatataaaaattgggtcttagattttgatttactagtgtgacaaaataactacatcctaatgaaaatcaagtttgatatgtttgttttgaaagtagcgttggaagagttgttgggggttttttgcatccatagcactggttactttgaacaaataaataaaagctttctgtagttgcttcctttatcagaaaagaacatttgataccatggtatatcatttcctcttcattaaagaacagcttttctaaatgttgggggaaatgtccatagtcattactcagtcaaaacttgtgttctcatgagcctaaggaccattctagatttattacgtgttttgtgtgtgtgtgtgtgtgtgtgtgtgtgtgtatccataaaatgcatatgtaaatttttttttgtttttaagcattcacccaaacaaaaaaatcacaggtaaacccatgtttctgagatgccattattccaagcaaaataagagataatcccttcaagttaaattgaaaattttcctgaaaccatacatttcaagtgaaataagtaattctagataggacaatttaaattggataattttaaagtgtctataattgcagtggtttatttgcaaaattcctaaaaggaaaaattttatcactgccatcacagcaggtttcctcatccagatgaggaaactagacaaatgctagtgtgttttaactagctaaacaaaactaagttaaatgaacatttaaaagtttccctagcgggccattccttagcaaaatgttggaatccctgttgctacattgactaaaaggtcatgatgaatggaatatgtaagacttggctcatagaaacctaatcagatggttagaggtgttggcagtttaggacctgctgtcataaatgtgtgaacaaccttttgtaacctaacctattgacctgcatgttttttctttaccccaattcattacatggaggctcaatcttgagtttgctttactggttcagcaaaagccaggaagaacaactttgtagtaatcaaaatgttatccaactgtatattgtttactttattgtaaatactggtgaacagtggttaataaatagttttatattccttta

SEQ ID NO: 371669 - DNA, 1822 bp, Homo sapiens
ggatgctgccacgcgtcacgcgaggtcatcgcagatgggtgaataatagctttcaaggatctcgcgatatcaagtaggtgctcaactaatagtgacattgcaaggaggaagtgggtgccggtaacggaatggactgagtaaaattcggttgtggaggtcagcaggcctgaacaatgggtcggtggaacgaagtactagatcgagtctattgcattgggacacgtggaatatgtcctgaagtggaagcggataacagatgctgacaataattgggaactgtgaagaagatgtagattgtccacaattgaattgagatgcgtttcttaatgtctcagtaaagctgtggtaatatgaagatagatgtgttgctaagaagatatagtctttagtctgagcagttgaatctgattgagcagccatgtcaatataatgaacatgagatgctggttgaccaatatggctgacaaaccaagaggatttgccagaggtcttgatcctgaaagaataattggtgccacagacagcagtggagaattgatgtttctcatgaaatggaaagattcagatgaggcagacttggtgctggcgaaagaggcaaatatgaagtgtcctcaaattgtaattgctttttatgaagagagactaacttggcattcttgtccagaagatgaagctcaataattgttcacattgttcttttatatatatttatatatatatataaaaattgggtcttagattttgatttactagtgtgacaaaataactacatcctaatgaaaatcaagtttgatatgtttgttttgaaagtagcgttggaagagttgttgggggttttttgcatccatagcactggttactttgaacaaataaataaaagctttctgtagttgcttcctttatcagaaaagaacatttgataccatggtatatcatttcctcttcattaaagaacagcttttctaaatgttgggggaaatgtccatagtcattactcagtcaaaacttgtgttctcatgagcctaaggaccattctagatttattacgtgttttgtgtgtgtgtgtgtgtgtgtgtgtgtgtgtatccataaaatgcatatgtaaatttttttttgtttttaagcattcacccaaacaaaaaaatcacaggtaaacccatgtttctgagatgccattattccaagcaaaataagagataatcccttcaagttaaattgaaaattttcctgaaaccatacatttcaagtgaaataagtaattctagataggacaatttaaattggataattttaaagtgtctataattgcagtggtttatttgcaaaattcctaaaaggaaaaattttatcactgccatcacagcaggtttcctcatccagatgaggaaactagacaaatgctagtgtgttttaactagctaaacaaaactaagttaaatgaacatttaaaagtttccctagcgggccattccttagcaaaatgttggaatccctgttgctacattgactaaaaggtcatgatgaatggaatatgtaagacttggctcatagaaacctaatcagatggttagaggtgttggcagtttaggacctgctgtcataaatgtgtgaacaaccttttgtaacctaacctattgacctgcatgttttttctttaccccaattcattacatggaggctcaatcttgagtttgctttactggttcagcaaaagccaggaagaacaactttgtagtaatcaaaatgttatccaactgtatattgtttactttattgtaaatactggtgaacagtggttaataaatagttttatattccttta

SEQ ID NO: 371670 - DNA, 1987 bp, Homo sapiens
tgagaactgccgctgctcgagaaacaactctgcgaggagcacctccgcacgggacccggcgctgctgctactgccgctagagccgctgccgccgcttttctagaaccttcccccccactaacgcgtcttccgctacgtcaggccgtcgcgtaaacgccctatccgccgccaatggcgggaaggctctacgccccaccttacgccaaatgcgtactcctcccacccttgcggccagagacagtacccgacgttacttccgtaaatgcgctcaatgaattgcggaaggctagagtcctgctagttactacctcttggaatagggtcccgccccctgccttggcgcaaggcaggtgagaaacggtcgcgcagtttgaaattaacgccgacgggaggggcttaatccgcagcctggagatccagccccctcaacccgggaggtggtccctgcagttacgccaatgataacccccgccagaaaaatcttagtagccttccctttttgttttccgtgccccaactcggcggattgactcggccccttccggaaacacccgaatcaacttctagtcaaattattgttcacgccgcaatgacccacccctggcccgcgtctgtggaactgacccctggtgtacaggagagttcgctgctgaaagtggtcccaaaggggtactagtttttaagctcccaactccccctcccccagcgtctggaggattccacaccctcgcaccgcaggggcgaggaagtgggcggagtccggttttggcgccagccgctgaggctgccaagcagaaaagccaccgctgaggagactccggtcactgtcctcgccccgcctcccccttccctccccttggggaccaccgggcgccacgccgcgaacggtaagtgccgcggtcgtcggcgcctccgccctccccctagggccccaattcccagcgggcgcgcgcccgctgccccgcccttcgtggccgcccggcgtgggcggtgccacccctccccccggcggccccgcgcgcagctcccggctccctcccccttcggatgtggcttgagctgtaggcgcggagggccggagacgctgcagacccgcgacccggagcagctcggaggcggtgaataatagctcttcaagtctgcaataaaaaatggcctccaacaaaactacattgcaaaaaatgggaaaaaaacagaatggaaagagtaaaaaagttgaagaggcagagcctgaagaatttgtcgtggaaaaagtactagatcgacgtgtagtgaatgggaaagtggaatatttcctgaagtggaagggatttacagatgctgacaatacttgggaacctgaagaaaatttagattgtccagaattgattgaagcgtttcttaactctcagaaagctggcaaagaaaaagatggtacaaaaagaaaatctttatctgacagtgaatctgatgacagcaaatcaaagaagaaaagagatgctgctgacaaaccaagaggatttgccagaggtcttgatcctgaaagaataattggtgccacagacagcagtggagaattgatgtttctcatgaaatggaaagattcagatgaggcagacttggtgctggcgaaagaggcaaatatgaagtgtcctcaaattgtaattgctttttatgaagagagactaacttggcattcttgtccagaagatgaagctcaataattgttcacattgttcttttatatatatttatatatatatataaaaattgggtcttagattttgatttactagtgtgacaaaataactacatcctaatgaaaatcaagtttgatatgtttgttttgaaagtagcgttggaagagttgttgggggttttttgcatccatagcactggttactttgaacaaataaataaaagctttctgtagttgcttcctttatcagaaaagaacatttgataccatggtatatcatttcctcttcattaaagaacagcttttcta

SEQ ID NO: 371671 - DNA, 2877 bp, Homo sapiens
tgagaactgccgctgctcgagaaacaactctgcgaggagcacctccgcacgggacccggcgctgctgctactgccgctagagccgctgccgccgcttttctagaaccttcccccccactaacgcgtcttccgctacgtcaggccgtcgcgtaaacgccctatccgccgccaatggcgggaaggctctacgccccaccttacgccaaatgcgtactcctcccacccttgcggccagagacagtacccgacgttacttccgtaaatgcgctcaatgaattgcggaaggctagagtcctgctagttactacctcttggaatagggtcccgccccctgccttggcgcaaggcaggtgagaaacggtcgcgcagtttgaaattaacgccgacgggaggggcttaatccgcagcctggagatccagccccctcaacccgggaggtggtccctgcagttacgccaatgataacccccgccagaaaaatcttagtagccttccctttttgttttccgtgccccaactcggcggattgactcggccccttccggaaacacccgaatcaacttctagtcaaattattgttcacgccgcaatgacccacccctggcccgcgtctgtggaactgacccctggtgtacaggagagttcgctgctgaaagtggtcccaaaggggtactagtttttaagctcccaactccccctcccccagcgtctggaggattccacaccctcgcaccgcaggggcgaggaagtgggcggagtccggttttggcgccagccgctgaggctgccaagcagaaaagccaccgctgaggagactccggtcactgtcctcgccccgcctcccccttccctccccttggggaccaccgggcgccacgccgcgaacgtaatagctcttcaagtctgcaataaaaaatggcctccaacaaaactacattgcaaaaaatgggaaaaaaacagaatggaaagagtaaaaaagttgaagaggcagagcctgaagaatttgtcgtggaaaaagtactagatcgacgtgtagtgaatgggaaagtggaatatttcctgaagtggaagggatttacagatgctgacaatacttgggaacctgaagaaaatttagattgtccagaattgattgaagcgtttcttaactctcagaaagctggcaaagaaaaagatggtacaaaaagaaaatctttatctgacagtgaatctgatgacagcaaatcaaagaagaaaagagatgctgctgacaaaccaagaggatttgccagaggtcttgatcctgaaagaataattggtgccacagacagcagtggagaattgatgtttctcatgaaatggaaagattcagatgaggcagacttggtgctggcgaaagaggcaaatatgaagtgtcctcaaattgtaattgctttttatgaagagagactaacttggcattcttgtccagaagatgaagctcaataattgttcacattgttcttttatatatatttatatatatatataaaaattgggtcttagattttgatttactagtgtgacaaaataactacatcctaatgaaaatcaagtttgatatgtttgttttgaaagtagcgttggaagagttgttgggggttttttgcatccatagcactggttactttgaacaaataaataaaagctttctgtagttgcttcctttatcagaaaagaacatttgataccatggtatatcatttcctcttcattaaagaacagcttttctaaatgttgggggaaatgtccatagtcattactcagtcaaaacttgtgttctcatgagcctaaggaccattctagatttattacgtgttttgtgtgtgtgtgtgtgtgtgtgtgtgtgtgtatccataaaatgcatatgtaaatttttttttgtttttaagcattcacccaaacaaaaaaatcacaggtaaacccatgtttctgagatgccattattccaagcaaaataagagataatcccttcaagttaaattgaaaattttcctgaaaccatacatttcaagtgaaataagtaattctagataggacaatttaaattggataattttaaagtgtctataattgcagtggtttatttgcaaaattcctaaaaggaaaaattttatcactgccatcacagcaggtttcctcatccagatgaggaaactagacaaatgctagtgtgttttaactagctaaacaaaactaagttaaatgaacatttaaaagtttccctagcgggccattccttagcaaaatgttggaatccctgttgctacattgactaaaaggtcatgatgaatggaatatgtaagacttggctcatagaaacctaatcagatggttagaggtgttggcagtttaggacctgctgtcataaatgtgtgaacaaccttttgtaacctaacctattgacctgcatgttttttctttaccccaattcattacatggaggctcaatcttgagtttgctttactggttcagcaaaagccaggaagaacaactttgtagtaatcaaaatgttatccaactgtatattgtttactttattgtaaatactggtgaacagtggttaataaatagttttatattcctttatgccaattattagacttttttctttatttgatatgcctttacagtagaaatagaaatgcccacactcattggattatctttgtttataagttagatgataccagtaaggcattacagtacatatcctagatcttttgagcttacgagttttaaacttgaatatgtatttccacaggaatgtttccacagttgggaaataaaagtttcatgtgatgcctagggtcaattgtctcattaaaatgaggttttaaattctggtttgttgtaac

SEQ ID NO: 371672 - DNA, 1491 bp, Homo sapiens
gaggatgattctggttacttttactagtagtgttttaaagcaagggtcagcaaactgtggcctgttttgaaaatgaagtttattagaacatagcaacaagtaacataactctcctggagcacttcaataccttttgtttggactattatttcttaaatgaatggctgtcggttgacatgaacaacttcgacttgtaactgaatttttctttttcttaaaacaggaaagattcagatgaggcagacttggtgctggcgaaagaggcaaatatgaagtgtcctcaaattgtaattgctttttatgaagagagactaacttggcattcttgtccagaagatgaagctcaataattgttcacattgttcttttatatatatttatatatatatataaaaattgggtcttagattttgatttactagtgtgacaaaataactacatcctaatgaaaatcaagtttgatatgtttgttttgaaagtagcgttggaagagttgttgggggttttttgcatccatagcactggttactttgaacaaataaataaaagctttctgtagttgcttcctttatcagaaaagaacatttgataccatggtatatcatttcctcttcattaaagaacagcttttctaaatgttgggggaaatgtccatagtcattactcagtcaaaacttgtgttctcatgagcctaaggaccattctagatttattacgtgttttgtgtgtgtgtgtgtgtgtgtgtgtgtgtgtatccataaaatgcatatgtaaatttttttttgtttttaagcattcacccaaacaaaaaaatcacaggtaaacccatgtttctgagatgccattattccaagcaaaataagagataatcccttcaagttaaattgaaaattttcctgaaaccatacatttcaagtgaaataagtaattctagataggacaatttaaattggataattttaaagtgtctataattgcagtggtttatttgcaaaattcctaaaaggaaaaattttatcactgccatcacagcaggtttcctcatccagatgaggaaactagacaaatgctagtgtgttttaactagctaaacaaaactaagttaaatgaacatttaaaagtttccctagcgggccattccttagcaaaatgttggaatccctgttgctacattgactaaaaggtcatgatgaatggaatatgtaagacttggctcatagaaacctaatcagatggttagaggtgttggcagtttaggacctgctgtcataaatgtgtgaacaaccttttgtaacctaacctattgacctgcatgttttttctttaccccaattcattacatggaggctcaatcttgagtttgctttactggttcagcaaaagccaggaagaacaactttgtagtaatcaaaatgttatccaactgtatattgtttactttattgtaaatactggtgaacagtggttaataaatagttttatattccttta

SEQ ID NO: 371673 - DNA, 847 bp, Homo sapiens
gtagtagaagctgtgctgcagacagtgtctctctacctgactgcagctctactgtgcatcgcccatatatactggttttgtgtgtgtgtgtgtgtgtgtgtgtgtgtgtatccataaaatgcatatgtaaatttttttttgtttttaagcattcacccaaacaaaaaaatcacaggtaaacccatgtttctgagatgccattattccaagcaaaataagagataatcccttcaagttaaattgaaaattttcctgaaaccatacatttcaagtgaaataagtaattctagataggacaatttaaattggataattttaaagtgtctataattgcagtggtttatttgcaaaattcctaaaaggaaaaattttatcactgccatcacagcaggtttcctcatccagatgaggaaactagacaaatgctagtgtgttttaactagctaaacaaaactaagttaaatgaacatttaaaagtttccctagcgggccattccttagcaaaatgttggaatccctgttgctacattgactaaaaggtcatgatgaatggaatatgtaagacttggctcatagaaacctaatcagatggttagaggtgttggcagtttaggacctgctgtcataaatgtgtgaacaaccttttgtaacctaacctattgacctgcatgttttttctttaccccaattcattacatggaggctcaatcttgagtttgctttactggttcagcaaaagccaggaagaacaactttgtagtaatcaaaatgttatccaactgtatattgtttactttattgtaaatactggtgaacagtggttaataaatagttttatattccttta

SEQ ID NO: 371674 - DNA, 1492 bp, Homo sapiens
cgccgcgggggtaggcgcgtgcggtgtggcgcagtgcccttgagcccccgtgccgcggcctttgtttctccccgcggatgcgctgaccacgaggcccgcgctcccgggtgggggcgggcacccgcgcttaggcacgtctggacgccgggcttcagcggcgggggtcgggagcgggtgtttgcaagaggtgattcttttttcaaagtgtcacgaaacggggttgaagcatcttaagttttttccttttgttatttaattaccgattggaaagagggagggtttctgagcagaaaccaagttgggattgcagaacagagaagattcacagtgctttaccgttgtgagttgtttgggtaatcgtgcctggttttaaaccgaaaggattgtcctttaaaaatggaacatggactttattataaatgggacttagattggaaaagacattggtcccctattttaagccatgtgaagctgttttaggtaccaggatccccagtaaagtctttctagactcacatggttaggacacgtacttaagtacatcataagcaatgtaggtaggagcgcagatctactctggatttgtattcacgtttgaaatgtgcgctctctacttgggggttggaatccaaacagaatttgtatttagttaccttttttgtgtcatgcaaacttaccttaactgtcatgcatttttctagtaatagctcttcaagtctgcaataaaaaatggcctccaacaaaactacattgcaaaaaatgggaaaaaaacagaatggaaagagtaaaaaagttgaagaggcagagcctgaagaatttgtcgtggaaaaagtactagatcgacgtgtagtgaatgggaaagtggaatatttcctgaagtggaagggatttacagaaaagctggcaaagaaaaagatggtacaaaaagaaaatctttatctgacagtgaatctgatgacagcaaatcaaagaagaaaagagatgctgctgacaaaccaagaggatttgccagaggtcttgatcctgaaagaataattggtgccacagacagcagtggagaattgatgtttctcatgaaatggaaagattcagatgaggcagacttggtgctggcgaaagaggcaaatatgaagtgtcctcaaattgtaattgctttttatgaagagagactaacttggcattcttgtccagaagatgaagctcaataattgttcacattgttcttttatatatatttatatatatatataaaaattgggtcttagattttgatttactagtgtgacaaaataactacatcctaatgaaaatcaagtttgatatgtttgttttgaaagtagcgttggaagagttgttgggggttttttgcatccatagcactggttactttgaacaaataaataaaagctttctgtagttgcttcctttatcagaaaagaacatttgataccatggtatatcatttcctcttcattaaagaacagcttttcta

SEQ ID NO: 371675 - DNA, 1328 bp, Homo sapiens
  misc_feature (56)..(58): n is a, c, g, or t
gggatttcctccgggctacaggcgacagagctgagccaagcgtttactgggcacgnnngctcagattccaaatgaaaatgtttgagagcgctgactctacagccacaagatctggccaggatctctgggctgaaatttgttcctgtctgccaaatcctgaacaagaagatggtgccaacaatgcattctcagactcctttgtggattcttgccctgaaggtgaaggccagagggaggtggctgactttgctgtccagccagctgtaaagccttgggctcccttgcaggattcagaagtgtatttagcatctctagccattttattttaaaaatatttcctgaggatgtggcttgagctgtaggcgcggagggccggagacgctgcagacccgcgacccggagcagctcggaggcggtgaataatagctcttcaagtctgcaataaaaaatggcctccaacaaaactacattgcaaaaaatgggaaaaaaacagaatggaaagagtaaaaaagttgaagaggcagagcctgaagaatttgtcgtggaaaaagtactagatcgacgtgtagtgaatgggaaagtggaatatttcctgaagtggaagggatttacagatgctgacaatacttgggaacctgaagaaaatttagattgtccagaattgattgaagcgtttcttaactctcagaaagctggcaaagaaaaagatggtacaaaaagaaaatctttatctgacagtgaatctgatgacagcaaatcaaagaagaaaagagatgctatgaggaaacgagattgactacaaatttggttttgaaaataaatcacatgctcaacagaagcagttttggccaggcacggtggctcgcacctataatcccagcaccttgggaaaccaaagcaggaacatcgcttgagcccaggagttggaggccagtttgggcaacatagtgagaccccatctctacaaagaaaaaaaaaaaagaatcagcaagacgtggtggacacctcctgtagtctcagctacttgggaggctgaggcagaaggattgcttgagcctgggagttcaaggtgcagtgagctgtgatcatgccagtgcactttggcctaggcaacggagcaagaccttgtctcaaaaaattattaaataataaatcaggcacaactttaacaacacttattgagtccttagcatgtgctatactgtgtgccaaattatttgcttttaatgtgctgtgaaatatctgtgcagtagatactaaaattctgttttattaacctaaaccacaaagaggttaattaacttgcccaaagccacacagctcgtaag

SEQ ID NO: 371676 - DNA, 2019 bp, Homo sapiens
tgagaactgccgctgctcgagaaacaactctgcgaggagcacctccgcacgggacccggcgctgctgctactgccgctagagccgctgccgccgcttttctagaaccttcccccccactaacgcgtcttccgctacgtcaggccgtcgcgtaaacgccctatccgccgccaatggcgggaaggctctacgccccaccttacgccaaatgcgtactcctcccacccttgcggccagagacagtacccgacgttacttccgtaaatgcgctcaatgaattgcggaaggctagagtcctgctagttactacctcttggaatagggtcccgccccctgccttggcgcaaggcaggtgagaaacggtcgcgcagtttgaaattaacgccgacgggaggggcttaatccgcagcctggagatccagccccctcaacccgggaggtggtccctgcagttacgccaatgataacccccgccagaaaaatcttagtagccttccctttttgttttccgtgccccaactcggcggattgactcggccccttccggaaacacccgaatcaacttctagtcaaattattgttcacgccgcaatgacccacccctggcccgcgtctgtggaactgacccctggtgtacaggagagttcgctgctgaaagtggtcccaaaggggtactagtttttaagctcccaactccccctcccccagcgtctggaggattccacaccctcgcaccgcaggggcgaggaagtgggcggagtccggttttggcgccagccgctgaggctgccaagcagaaaagccaccgctgaggagactccggtcactgtcctcgccccgcctcccccttccctccccttggggaccaccgggcgccacgccgcgaacggtaagtgccgcggtcgtcggcgcctccgccctccccctagggccccaattcccagcgggcgcgcgcccgctgccccgcccttcgtggccgcccggcgtgggcggtgccacccctccccccggcggccccgcgcgcagctcccggctccctcccccttcggatgtggcttgagctgtaggcgcggagggccggagacgctgcagacccgcgacccggagcagctcggaggcggtgaagtcggtggctttccttctctctagctctcgctcgctggtggtgcttcagatgccacacgcgtcccgggggcccggttctccgctcccctcccctccccttctcgccggaccccgcgccgggagctgcgggaaggagtggagggtcgggcggtggcctcgcggctggcctggcgcgcggccagcgccggtagttagtggggggactgctctgccctcgagggggtagggagctgtggcgacggttgccccatttcgagacaaagcgcatttccccctcgagggcagagcaggcgatccaggaaaacgggcgcatggccgagcggaaggacgagggagagggagcagataggacccaaccggaacagaaccggagcagatggaccacgagaggatgacagaaagggagacgagggaaggggcaaacggacagggagaagaaccacagaagaccaggtgacacaacagagaaacaacgaaaaaaggatagacagacagcgaggagacatagagacaccagagcaagaaagcatgagcagacaaagggaacacagtaagcacgacgaaaaccaacgaagtgcaagggaacagcacgaagaaagagaagtacacacgacagcagcgcggatcacgtgaaaacgatgacgtgaacaaaccaccgaaagggaccccccgaggcaatcgacaccccccggaagaggggagagagcgctcagcaggtggcgaaccaaccgatggcggacaaggaaagcgagaaatgccctaggaacaaagagccgaggagagacgaaatagaacagcaacaagacgaagagaagagctacgaagagagcacaacggaaccagcagagagaagggacaaaaagaaacagcgaagacacaacaaacacacagaagaa

SEQ ID NO: 371677 - DNA, 1615 bp, Homo sapiens
tgagaactgccgctgctcgagaaacaactctgcgaggagcacctccgcacgggacccggcgctgctgctactgccgctagagccgctgccgccgcttttctagaaccttcccccccactaacgcgtcttccgctacgtcaggccgtcgcgtaaacgccctatccgccgccaatggcgggaaggctctacgccccaccttacgccaaatgcgtactcctcccacccttgcggccagagacagtacccgacgttacttccgtaaatgcgctcaatgaattgcggaaggctagagtcctgctagttactacctcttggaatagggtcccgccccctgccttggcgcaaggcaggtgagaaacggtcgcgcagtttgaaattaacgccgacgggaggggcttaatccgcagcctggagatccagccccctcaacccgggaggtggtccctgcagttacgccaatgataacccccgccagaaaaatcttagtagccttccctttttgttttccgtgccccaactcggcggattgactcggccccttccggaaacacccgaatcaacttctagtcaaattattgttcacgccgcaatgacccacccctggcccgcgtctgtggaactgacccctggtgtacaggagagttcgctgctgaaagtggtcccaaaggggtactagtttttaagctcccaactccccctcccccagcgtctggaggattccacaccctcgcaccgcaggggcgaggaagtgggcggagtccggttttggcgccagccgctgaggctgccaagcagaaaagccaccgctgaggagactccggtcactgtcctcgccccgcctcccccttccctccccttggggaccaccgggcgccacgccgcgaacggtaagtgccgcggtcgtcggcgcctccgccctccccctagggccccaattcccagcgggcgcgcgcccgctgccccgcccttcgtggccgcccggcgtgggcggtgccacccctccccccggcggccccgcgcgcagctcccggctccctcccccttcggatgtggcttgagctgtaggcgcggagggccggagacgctgcagacccgcgacccggagcagctcggaggcggtgaataatagctcttcaagtctgcaataaaaaatggcctccaacaaaactacattgcaacaaacatgcaaaaacaagaaaaaaaaaaaacaacaaaacaaaacacagtgtgtggtgggcgcggcgcggggccctcggagaaagagtttttggagacaccaattggggtgggggcggggggcgccccaagatgagggttagaggtgaaacagtgtggccaaagagggtggttccctgagaggagagaaccccgggggacgaggacaaagaggcgggagggaattttcccaccccaaattaaaaaaccccggggggggaccacggagggagtttgtgagaaaaaaactctccagagagggggggagatacaaggaggggacacaataaaggggggccctttataacacaggagggagtcccacaaagaagaagaccccgaatatatcacaaaatttaacacaccccgaacctctgggggacaacacaacaacacacac

SEQ ID NO: 371678 - DNA, 416 bp, Homo sapiens
aggctgaggcatgagaactgcttgaacctggggaggcggaggttgcagtgagctgagatcacgccactgcactccagcctgggcgacaagagtgtgagaccctgtctcaaaaaaaaagactggaaaaaaataactgtttccagatagtgtttttttattgtattattttggtggtgggttgtaagtttgaactaaatgaacaagataaagcattcttttattttattgtctgttgacttttaatctttccagaaggtgtctgccctgggatatagaagtaaaaatttatgtcgaatgtgataataatataagcaattgagccttgaaaatgtgctcaaaattcaagaggaatatttcttaatttctcttttgttttattttagcaaaaaatgggaaaaaaacagaatggaaagagt

SEQ ID NO: 371679 - DNA, 2823 bp, Homo sapiens
tgagaactgccgctgctcgagaaacaactctgcgaggagcacctccgcacgggacccggcgctgctgctactgccgctagagccgctgccgccgcttttctagaaccttcccccccactaacgcgtcttccgctacgtcaggccgtcgcgtaaacgccctatccgccgccaatggcgggaaggctctacgccccaccttacgccaaatgcgtactcctcccacccttgcggccagagacagtacccgacgttacttccgtaaatgcgctcaatgaattgcggaaggctagagtcctgctagttactacctcttggaatagggtcccgccccctgccttggcgcaaggcaggtgagaaacggtcgcgcagtttgaaattaacgccgacgggaggggcttaatccgcagcctggagatccagccccctcaacccgggaggtggtccctgcagttacgccaatgataacccccgccagaaaaatcttagtagccttccctttttgttttccgtgccccaactcggcggattgactcggccccttccggaaacacccgaatcaacttctagtcaaattattgttcacgccgcaatgacccacccctggcccgcgtctgtggaactgacccctggtgtacaggagagttcgctgctgaaagtggtcccaaaggggtactagtttttaagctcccaactccccctcccccagcgtctggaggattccacaccctcgcaccgcaggggcgaggaagtgggcggagtccggttttggcgccagccgctgaggctgccaagcagaaaagccaccgctgaggagactccggtcactgtcctcgccccgcctcccccttccctccccttggggaccaccgggcgccacgccgcgaacggtaagtgccgcggtcgtcggcgcctccgccctccccctagggccccaattcccagcgggcgcgcgcccgctgccccgcccttcgtggccgcccggcgtgggcggtgccacccctccccccggcggccccgcgcgcagctcccggctccctcccccttcggatgtggcttgagctgtaggcgcggagggccggagacgctgcagacccgcgacccggagcagctcggaggcggtgaataatagctcttcaagtctgcaataaaaaatggcctccaacaaaactacattgcaaaaaatgggaaaaaaacagaatggaaagagtaaaaaagttgaagaggcagagcctgaagaatttgtcgtggaaaaagtactagatcgacgtgtagtgaatgggaaagtggaatatttcctgaagtggaagggatttacagatgctgacaatacttgggaacctgaagaaaatttagattgtccagaattgattgaagcgtttcttaactctcagaaagctggcaaagaaaaagatggtacaaaaagaaaatctttatctgacagtgaatctgatgacagcaaatcaaagaagaaaagagatgctgctgacaaaccaagaggatttgccagaggtcttgatcctgaaagaataattggtgccacagacagcagtggagaattgatgtttctcatgaaatggaaagattcagatgaggcagacttggtgctggcgaaagaggcaaatatgaagtgtcctcaaattgtaattgctttttatgaagagagactaacttggcattcttgtccagaagatgaagctcaataattgttcacattgttcttttatatatatttatatatatatataaaaattgggtcttagattttgatttactagtgtgacaaaataactacatcctaatgaaaatcaagtttgatatgtttgttttgaaagtagcgttggaagagttgttgggggttttttgcatccatagcactggttactttgaacaaataaataaaagctttctgtagttgcttcctttatcagaaaagaacatttgataccatggtatatcatttcctcttcattaaagaacagcttttctaaatgttgggggaaatgtccatagtcattactcagtcaaaacttgtgttctcatgagcctaaggaccattctagatttattacgtgtgtgtgtgtgtgtatccataaaatgcatatgtaaatttttttttgtttttaagcattcacccaaacaaaaaaatcacaggtaaacccatgtttctgagatgccattattccaagcaaaataagagataatcccttcaagttaaattgaaaattttcctgaaaccatacatttcaagtgaaataagtaattctagataggacaatttaaattggataattttaaagtgtctataattgcagtggtttatttgcaaaattcctaaaaggaaaaattttatcactgccatcacagcaggtttcctcatccagatgaggaaactagacaaatgctagtgtgttttaactagctaaacaaaactaagttaaatgaacatttaaaagtttccctagcgggccattccttagcaaaatgttggaatccctgttgctacattgactaaaaggtcatgatgaatggaatatgtaagacttggctcatagaaacctaatcagatggttagaggtgttggcagtttaggacctgctgtcataaatgtgtgaacaaccttttgtaacctaacctattgacctgcatgttttttctttaccccaattcattacatggaggctcaatcttgagtttgctttactggttcagcaaaagccaggaagaacaactttgtagtaatcaaaatgttatccaactgtatattgtttactttattgtaaatactggtgaacagtggttaataaatagttttatattccttta

SEQ ID NO: 371680 - DNA, 3262 bp, Homo sapiens
  misc_feature (2863)..(2863): n is a, c, g, or t
  misc_feature (2870)..(2870): n is a, c, g, or t
  misc_feature (2879)..(2879): n is a, c, g, or t
  misc_feature (2881)..(2881): n is a, c, g, or t
  misc_feature (2893)..(2894): n is a, c, g, or t
  misc_feature (2896)..(2896): n is a, c, g, or t
  misc_feature (2899)..(2899): n is a, c, g, or t
  misc_feature (2922)..(2922): n is a, c, g, or t
  misc_feature (3262)..(3262): n is a, c, g, or t
tgagaactgccgctgctcgagaaacaactctgcgaggagcacctccgcacgggacccggcgctgctgctactgccgctagagccgctgccgccgcttttctagaaccttcccccccactaacgcgtcttccgctacgtcaggccgtcgcgtaaacgccctatccgccgccaatggcgggaaggctctacgccccaccttacgccaaatgcgtactcctcccacccttgcggccagagacagtacccgacgttacttccgtaaatgcgctcaatgaattgcggaaggctagagtcctgctagttactacctcttggaatagggtcccgccccctgccttggcgcaaggcaggtgagaaacggtcgcgcagtttgaaattaacgccgacgggaggggcttaatccgcagcctggagatccagccccctcaacccgggaggtggtccctgcagttacgccaatgataacccccgccagaaaaatcttagtagccttccctttttgttttccgtgccccaactcggcggattgactcggccccttccggaaacacccgaatcaacttctagtcaaattattgttcacgccgcaatgacccacccctggcccgcgtctgtggaactgacccctggtgtacaggagagttcgctgctgaaagtggtcccaaaggggtactagtttttaagctcccaactccccctcccccagcgtctggaggattccacaccctcgcaccgcaggggcgaggaagtgggcggagtccggttttggcgccagccgctgaggctgccaagcagaaaagccaccgctgaggagactccggtcactgtcctcgccccgcctcccccttccctccccttggggaccaccgggcgccacgccgcgaacggtaagtgccgcggtcgtcggcgcctccgccctccccctagggccccaattcccagcgggcgcgcgcccgctgccccgcccttcgtggccgcccggcgtgggcggtgccacccctccccccggcggccccgcgcgcagctcccggctccctcccccttcggatgtggcttgagctgtaggcgcggagggccggagacgctgcagacccgcgacccggagcagctcggaggcggtgaataatagctcttcaagtctgcaataaaaaatggcctccaacaaaactacattgcaaaaaatgggaaaaaaacagaatggaaagagtaaaaaagttgaagaggcagagcctgaagaatttgtcgtggaaaaagtactagatcgacgtgtagtgaatgggaaagtggaatatttcctgaagtggaagggatttacagatgctgacaatacttgggaacctgaagaaaatttagattgtccagaattgattgaagcgtttcttaactctcagaaagctggcaaagaaaaagatggtacaaaaagaaaatctttatctgacagtgaatctgatgacagcaaatcaaagaagaaaagagatgctgctgacaaaccaagaggatttgccagaggtcttgatcctgaaagaataattggtgccacagacagcagtggagaattgatgtttctcatgaaatggaaagattcagatgaggcagacttggtgctggcgaaagaggcaaatatgaagtgtcctcaaattgtaattgctttttatgaagagagactaacttggcattcttgtccagaagatgaagctcaataattgttcacattgttcttttatatatatttatatatatatataaaaattgggtcttagattttgatttactagtgtgacaaaataactacatcctaatgaaaatcaagtttgatatgtttgttttgaaagtagcgttggaagagttgttgggggttttttgcatccatagcactggttactttgaacaaataaataaaagctttctgtagttgcttcctttatcagaaaagaacatttgataccatggtatatcatttcctcttcattaaagaacagcttttctaaatgttgggggaaatgtccatagtcattactcagtcaaaacttgtgttctcatgagcctaaggaccattctagatttattacgtgttttgtgtgtgtgtgtgtgtgtgtgtgtgtgtgtatccataaaatgcatatgtaaatttttttttgtttttaagcattcacccaaacaaaaaaatcacaggtaaacccatgtttctgagatgccattattccaagcaaaataagagataatcccttcaagttaaattgaaaattttcctgaaaccatacatttcaagtgaaataagtaattctagataggacaatttaaattggataattttaaagtgtctataattgcagtggtttatttgcaaaattcctaaaaggaaaaattttatcactgccatcacagcaggtttcctcatccagatgaggaaactagacaaatgctagtgtgttttaactagctaaacaaaactaagttaaatgaacatttaaaagtttccctagcgggccattccttagcaaaatgttggaatccctgttgctacattgactaaaaggtcatgatgaatggaatatgtaagacttggctcatagaaacctaatcagatggttagaggtgttggcagtttaggacctgctgtcataaatgtgtgaacaaccttttgtaacctaacctattgacctgcatgttttttctttaccccaattcattacatggaggctcaatcttgagtttgctttactggttcagcaaaagccaggaagaacaactttgtagtaatcaaaatgttatccaactgtatattgtttactttattgtaaatactggtgaacagtggttaataaatagttttatattcctttaaaaaaaaaaaaaaaaaaanaaaaaanaaaaaaaananaaaaaaaaaaannanaanaaaaaaaaaaaaagaaaaaaaanaaaaagaggtggggggggggggaaaaaccgcgggggggaaacctttttaaagggcaaagaggggaaaaaaaaaagggggggggggaaaaacagaggggggaagacacaacgtatgtgcgtttagggaggagacccttcttgtgcgggagaagggaccccacgagaataagggaggacaaaagtggtgttgttgggaccttttcttgtcgtgttttgtcttgttaataatgacacgtatgcatagataaagtgagagaagcgggaaaaggtttgaggatgatggtagagataaaacaagcagaggaagaaggagaaatactgagtgactacacttaagacn

SEQ ID NO: 371681 - DNA, 3113 bp, Homo sapiens
tgagaactgccgctgctcgagaaacaactctgcgaggagcacctccgcacgggacccggcgctgctgctactgccgctagagccgctgccgccgcttttctagaaccttcccccccactaacgcgtcttccgctacgtcaggccgtcgcgtaaacgccctatccgccgccaatggcgggaaggctctacgccccaccttacgccaaatgcgtactcctcccacccttgcggccagagacagtacccgacgttacttccgtaaatgcgctcaatgaattgcggaaggctagagtcctgctagttactacctcttggaatagggtcccgccccctgccttggcgcaaggcaggtgagaaacggtcgcgcagtttgaaattaacgccgacgggaggggcttaatccgcagcctggagatccagccccctcaacccgggaggtggtccctgcagttacgccaatgataacccccgccagaaaaatcttagtagccttccctttttgttttccgtgccccaactcggcggattgactcggccccttccggaaacacccgaatcaacttctagtcaaattattgttcacgccgcaatgacccacccctggcccgcgtctgtggaactgacccctggtgtacaggagagttcgctgctgaaagtggtcccaaaggggtactagtttttaagctcccaactccccctcccccagcgtctggaggattccacaccctcgcaccgcaggggcgaggaagtgggcggagtccggttttggcgccagccgctgaggctgccaagcagaaaagccaccgctgaggagactccggtcactgtcctcgccccgcctcccccttccctccccttggggaccaccgggcgccacgccgcgaacggtaagtgccgcggtcgtcggcgcctccgccctccccctagggccccaattcccagcgggcgcgcgcccgctgccccgcccttcgtggccgcccggcgtgggcggtgccacccctccccccggcggccccgcgcgcagctcccggctccctcccccttcggatgtggcttgagctgtaggcgcggagggccggagacgctgcagacccgcgacccggagcagctcggaggcggtgaataatagctcttcaagtctgcaataaaaaatggcctccaacaaaactacattgcaaaaaatgggaaaaaaacagaatggaaagagtaaaaaagttgaagaggcagagcctgaagaatttgtcgtggaaaaagtactagatcgacgtgtagtgaatgggaaagtggaatatttcctgaagtggaagggatttacagatgctgacaatacttgggaacctgaagaaaatttagattgtccagaattgattgaagcgtttcttaactctcagaaagctggcaaagaaaaagatggtacaaaaagaaaatctttatctgacagtgaatctgatgacagcaaatcaaagaagaaaagagatgctgctgacaaaccaagaggatttgccagaggtcttgatcctgaaagaataattggtgccacagacagcagtggagaattgatgtttctcatgaaatggaaagattcagatgaggcagacttggtgctggcgaaagaggcaaatatgaagtgtcctcaaattgtaattgctttttatgaagagagactaacttggcattcttgtccagaagatgaagctcaataattgttcacattgttcttttatatatatttatatatatatataaaaattgggtcttagattttgatttactagtgtgacaaaataactacatcctaatgaaaatcaagtttgatatgtttgttttgaaagtagcgttggaagagttgttgggggttttttgcatccatagcactggttactttgaacaaataaataaaagctttctgtagttgcttcctttatcagaaaagaacatttgataccatggtatatcatttcctcttcattaaagaacagcttttctaaatgttgggggaaatgtccatagtcattactcagtcaaaacttgtgttctcatgagcctaaggaccattctagatttattacgtgttttgtgtgtgtgtgtgtgtgtgtgtgtgtgtgtatccataaaatgcatatgtaaatttttttttgtttttaagcattcacccaaacaaaaaaatcacaggtaaacccatgtttctgagatgccattattccaagcaaaataagagataatcccttcaagttaaattgaaaattttcctgaaaccatacatttcaagtgaaataagtaattctagataggacaatttaaattggataattttaaagtgtctataattgcagtggtttatttgcaaaattcctaaaaggaaaaattttatcactgccatcacagcaggtttcctcatccagatgaggaaactagacaaatgctagtgtgttttaactagctaaacaaaactaagttaaatgaacatttaaaagtttccctagcgggccattccttagcaaaatgttggaatccctgttgctacattgactaaaaggtcatgatgaatggaatatgtaagacttggctcatagaaacctaatcagatggttagaggtgttggcagtttaggacctgctgtcataaatgtgtgaacaaccttttgtaacctaacctattgacctgcatgttttttctttaccccaattcattacatggaggctcaatcttgagtttgctttactggttcagcaaaagccaggaagaacaactttgtagtaatcaaaatgttatccaactgtatattgtttactttattgtaaatactggtgaacagtggttaataaatagttttatattcctttatgccaattattagacttttttctttatttgatatgcctttacagtagaaatagaaatgcccacactcattggattatctttgtttataagttagatgataccagtaaggcattacagtacatatcctagatcttttgagcttacgagttttaaacttgaatatgtatttccacaggaatgtttccacagttgggaaataaaagtttcatgtgatgcctagggtcaattgtctcattaaaatgaggttttaaattctggtttgttgtaac

SEQ ID NO: 371682 - DNA, 1946 bp, Homo sapiens
gtttttatgaggatttatcaacagagttatttaaggaggaatcctgtgttgttatcaggaactaaaaggataaggctaacaatttggaaagagcaactactctttcttaaatcaatctacaattcacagataggaagaggtcaatgacctaggagtaacaatcaactcaagattcattttcattatgttattcatgaacacccggagcagctcggaggcggtgaataatagctcttcaagtctgcaataaaaaatggcctccaacaaaactacattgcaaaaaatgggaaaaaaacagaatggaaagagtaaaaaagttgaagaggcagagcctgaagaatttgtcgtggaaaaagtactagatcgacgtgtagtgaatgggaaagtggaatatttcctgaagtggaagggatttacagatgctgacaatacttgggaacctgaagaaaatttagattgtccagaattgattgaagcgtttcttaactctcagaaagctggcaaagaaaaagatggtacaaaaagaaaatctttatctgacagtgaatctgatgacagcaaatcaaagaagaaaagagatgctgctgacaaaccaagaggatttgccagaggtcttgatcctgaaagaataattggtgccacagacagcagtggagaattgatgtttctcatgaaatggaaagattcagatgaggcagacttggtgctggcgaaagaggcaaatatgaagtgtcctcaaattgtaattgctttttatgaagagagactaacttggcattcttgtccagaagatgaagctcaataattgttcacattgttcttttatatatatttatatatatatataaaaattgggtcttagattttgatttactagtgtgacaaaataactacatcctaatgaaaatcaagtttgatatgtttgttttgaaagtagcgttggaagagttgttgggggttttttgcatccatagcactggttactttgaacaaataaataaaagctttctgtagttgcttcctttatcagaaaagaacatttgataccatggtatatcatttcctcttcattaaagaacagcttttctaaatgttgggggaaatgtccatagtcattactcagtcaaaacttgtgttctcatgagcctaaggaccattctagatttattacgtgttttgtgtgtgtgtgtgtgtgtgtgtgtgtgtgtatccataaaatgcatatgtaaatttttttttgtttttaagcattcacccaaacaaaaaaatcacaggtaaacccatgtttctgagatgccattattccaagcaaaataagagataatcccttcaagttaaattgaaaattttcctgaaaccatacatttcaagtgaaataagtaattctagataggacaatttaaattggataattttaaagtgtctataattgcagtggtttatttgcaaaattcctaaaaggaaaaattttatcactgccatcacagcaggtttcctcatccagatgaggaaactagacaaatgctagtgtgttttaactagctaaacaaaactaagttaaatgaacatttaaaagtttccctagcgggccattccttagcaaaatgttggaatccctgttgctacattgactaaaaggtcatgatgaatggaatatgtaagacttggctcatagaaacctaatcagatggttagaggtgttggcagtttaggacctgctgtcataaatgtgtgaacaaccttttgtaacctaacctattgacctgcatgttttttctttaccccaattcattacatggaggctcaatcttgagtttgctttactggttcagcaaaagccaggaagaacaactttgtagtaatcaaaatgttatccaactgtatattgtttactttattgtaaatactggtgaacagtggttaataaatagttttatattccttta

SEQ ID NO: 371683 - DNA, 2505 bp, Homo sapiens
tgagaactgccgctgctcgagaaacaactctgcgaggagcacctccgcacgggacccggcgctgctgctactgccgctagagccgctgccgccgcttttctagaaccttcccccccactaacgcgtcttccgctacgtcaggccgtcgcgtaaacgccctatccgccgccaatggcgggaaggctctacgccccaccttacgccaaatgcgtactcctcccacccttgcggccagagacagtacccgacgttacttccgtaaatgcgctcaatgaattgcggaaggctagagtcctgctagttactacctcttggaatagggtcccgccccctgccttggcgcaaggcaggtgagaaacggtcgcgcagtttgaaattaacgccgacgggaggggcttaatccgcagcctggagatccagccccctcaacccgggaggtggtccctgcagttacgccaatgataacccccgccagaaaaatcttagtagccttccctttttgttttccgtgccccaactcggcggattgactcggccccttccggaaacacccgaatcaacttctagtcaaattattgttcacgccgcaatgacccacccctggcccgcgtctgtggaactgacccctggtgtacaggagagttcgctgctgaaagtggtcccaaaggggtactagtttttaagctcccaactccccctcccccagcgtctggaggattccacaccctcgccccgcctcccccttccctccccttggggaccaccgggcgccacgccgcgaacgtaatagctcttcaagtctgcaataaaaaatggcctccaacaaaactacattgcaaaaaatgggaaaaaaacagaatggaaagagtaaaaaagttgaagaggcagagcctgaagaatttgtcgtggaaaaagtactagatcgacgtgtagtgaatgggaaagtggaatatttcctgaagtggaagggatttacagatgctgacaatacttgggaacctgaagaaaatttagattgtccagaattgattgaagcgtttcttaactctcagaaagctggcaaagaaaaagatggtacaaaaagaaaatctttatctgacagtgaatctgatgacagcaaatcaaagaagaaaagagatgctgctgacaaaccaagaggatttgccagaggtcttgatcctgaaagaataattggtgccacagacagcagtggagaattgatgtttctcatgaaatggaaagattcagatgaggcagacttggtgctggcgaaagaggcaaatatgaagtgtcctcaaattgtaattgctttttatgaagagagactaacttggcattcttgtccagaagatgaagctcaataattgttcacattgttcttttatatatatttatatatatatataaaaattgggtcttagattttgatttactagtgtgacaaaataactacatcctaatgaaaatcaagtttgatatgtttgttttgaaagtagcgttggaagagttgttgggggttttttgcatccatagcactggttactttgaacaaataaataaaagctttctgtagttgcttcctttatcagaaaagaacatttgataccatggtatatcatttcctcttcattaaagaacagcttttctaaatgttgggggaaatgtccatagtcattactcagtcaaaacttgtgttctcatgagcctaaggaccattctagatttattacgtgttttgtgtgtgtgtgtgtgtgtgtgtgtgtgtgtatccataaaatgcatatgtaaatttttttttgtttttaagcattcacccaaacaaaaaaatcacaggtaaacccatgtttctgagatgccattattccaagcaaaataagagataatcccttcaagttaaattgaaaattttcctgaaaccatacatttcaagtgaaataagtaattctagataggacaatttaaattggataattttaaagtgtctataattgcagtggtttatttgcaaaattcctaaaaggaaaaattttatcactgccatcacagcaggtttcctcatccagatgaggaaactagacaaatgctagtgtgttttaactagctaaacaaaactaagttaaatgaacatttaaaagtttccctagcgggccattccttagcaaaatgttggaatccctgttgctacattgactaaaaggtcatgatgaatggaatatgtaagacttggctcatagaaacctaatcagatggttagaggtgttggcagtttaggacctgctgtcataaatgtgtgaacaaccttttgtaacctaacctattgacctgcatgttttttctttaccccaattcattacatggaggctcaatcttgagtttgctttactggttcagcaaaagccaggaagaacaactttgtagtaatcaaaatgttatccaactgtatattgtttactttattgtaaatactggtgaacagtggttaataaatagttttatattccttta

SEQ ID NO: 371684 - DNA, 2061 bp, Homo sapiens
cgccgcgggggtaggcgcgtgcggtgtggcgcagtgcccttgagcccccgtgccgcggcctttgtttctccccgcggatgcgctgaccacgaggcccgcgctcccgggtgggggcgggcacccgcgcttaggcacgtctggacgccgggcttcagcggcgggggtcgggagcgggtgtttgcaagaggtgattcttttttcaaagtgtcacgaaacggggttgaagcatcttaagttttttccttttgttatttaattaccgattggaaagagggagggtttctgagcagaaaccaagttgggattgcagaacagagaagattcacagtgctttaccgtttaatagctcttcaagtctgcaataaaaaatggcctccaacaaaactacattgcaaaaaatgggaaaaaaacagaatggaaagagtaaaaaagttgaagaggcagagcctgaagaatttgtcgtggaaaaagtactagatcgacgtgtagtgaatgggaaagtggaatatttcctgaagtggaagggatttacagatgctgacaatacttgggaacctgaagaaaatttagattgtccagaattgattgaagcgtttcttaactctcagaaagctggcaaagaaaaagatggtacaaaaagaaaatctttatctgacagtgaatctgatgacagcaaatcaaagaagaaaagagatgctgctgacaaaccaagaggatttgccagaggtcttgatcctgaaagaataattggtgccacagacagcagtggagaattgatgtttctcatgaaatggaaagattcagatgaggcagacttggtgctggcgaaagaggcaaatatgaagtgtcctcaaattgtaattgctttttatgaagagagactaacttggcattcttgtccagaagatgaagctcaataattgttcacattgttcttttatatatatttatatatatatataaaaattgggtcttagattttgatttactagtgtgacaaaataactacatcctaatgaaaatcaagtttgatatgtttgttttgaaagtagcgttggaagagttgttgggggttttttgcatccatagcactggttactttgaacaaataaataaaagctttctgtagttgcttcctttatcagaaaagaacatttgataccatggtatatcatttcctcttcattaaagaacagcttttctaaatgttgggggaaatgtccatagtcattactcagtcaaaacttgtgttctcatgagcctaaggaccattctagatttattacgtgttttgtgtgtgtgtgtgtgtgtgtgtgtgtgtgtatccataaaatgcatatgtaaatttttttttgtttttaagcattcacccaaacaaaaaaatcacaggtaaacccatgtttctgagatgccattattccaagcaaaataagagataatcccttcaagttaaattgaaaattttcctgaaaccatacatttcaagtgaaataagtaattctagataggacaatttaaattggataattttaaagtgtctataattgcagtggtttatttgcaaaattcctaaaaggaaaaattttatcactgccatcacagcaggtttcctcatccagatgaggaaactagacaaatgctagtgtgttttaactagctaaacaaaactaagttaaatgaacatttaaaagtttccctagcgggccattccttagcaaaatgttggaatccctgttgctacattgactaaaaggtcatgatgaatggaatatgtaagacttggctcatagaaacctaatcagatggttagaggtgttggcagtttaggacctgctgtcataaatgtgtgaacaaccttttgtaacctaacctattgacctgcatgttttttctttaccccaattcattacatggaggctcaatcttgagtttgctttactggttcagcaaaagccaggaagaacaactttgtagtaatcaaaatgttatccaactgtatattgtttactttattgtaaatactggtgaacagtggttaataaatagttttatattccttta

SEQ ID NO: 371685 - DNA, 2397 bp, Homo sapiens
tgagaactgccgctgctcgagaaacaactctgcgaggagcacctccgcacgggacccggcgctgctgctactgccgctagagccgctgccgccgcttttctagaaccttcccccccactaacgcgtcttccgctacgtcaggccgtcgcgtaaacgccctatccgccgccaatggcgggaaggctctacgccccaccttacgccaaatgcgtactcctcccacccttgcggccagagacagtacccgacgttacttccgtaaatgcgctcaatgaattgcggaaggctagagtcctgctagttactacctcttggaatagggtcccgccccctgccttggcgcaaggcaggtgagaaacggtcgcgcagtttgaaattaacgccgacgggaggggcttaatccgcagcctggagatccagccccctcaacccgggaggtggtccctgcagttacgccaatgataacccccgccagaaaaatcttagtagccttccctttttgttttccgtgccccaactcggcggattgactcggccccttccggaaacacccgaatcaacttctagtcaaattattgttcacgccgcaatgacccacccctggcccgcgtctgtggaactgacccctggtgtacaggagagttcgctgctgaaagtggtcccaaaggggtactagtttttaagctcccaactccccctcccccagcgtctggaggattccacaccctcgcaccgcaggggcgaggaagtgggcggagtccggttttggcgccagccgctgaggctgccaagcagaaaagccaccgctgaggagactccggtcactgtcctcgccccgcctcccccttccctccccttggggaccaccgggcgccacgccgcgaacggtaagtgccgcggtcgtcggcgcctccgccctccccctagggccccaattcccagcgggcgcgcgcccgctgccccgcccttcgtggccgcccggcgtgggcggtgccacccctccccccggcggccccgcgcgcagctcccggctccctcccccttcggatgtggcttgagctgtaggcgcggagggccggagacgctgcagacccgcgacccggagcagctcggaggcggtgaataatagctcttcaagtctgcaataaaaaatggcctccaacaaaactacattgcaaaaaatgggaaaaaaacagaatggaaagagtaaaaaagttgaagaggcagagcctgaagaatttgtcgtggaaaaagtactagatcgacgtgtagtgaatgggaaagtggaatatttcctgaagtggaagggatttacagatgctgacaatacttgggaacctgaagaaaatttagattgtccagaattgattgaagcgtttcttaactctcagaaagctggcaaagaaaaagatggtacaaaaagaaaatctttatctgacagtgaatctgatgacagcaaatcaaagaagaaaagagatgctgctgacaaaccaagaggatttgccagaggtcttgatcctgaaagaataattggtgccacagacagcagtggagaattgatgtttctcatgaaatggaaagattcagatgaggcagacttggtgctggcgaaagaggcaaatatgaagtgtcctcaaattgtaattgctttttatgaagagagactaacttggcattcttgtccagaagatgaagctcaataattgttcacattgttcttttatatatatttatatatatatataaaaattgggtcttagattttgatttactagtgtgacaaaataactacatcctaatgaaaatcaagtttgatatgtttgttttgaaagtagcgttggaagagttgttgggggttttttgcatccatagcactggttactttgaacaaataaataaaagctttctgtagttgcttcctttatcagaaaagaacatttgataccatggtatatcatttcctcttcattaaagaacagcttttctaaatgttgggggaaatgtccatagtcattactcagtcaaaacttgtgttctcatgagcctaaggaccattctagatttattacgtgttttgtgtgtgtgtgtgtgtgtgtgtgtgtgtgtatccataaaatgcatatgtaaatttttttttgtttttaagcattcacccaaacaaaaaaatcacaggtaaacccatgtttctgagatgccattattccaagcaaaataagagataatcccttcaagttaaattgaaaattttcctgaaaccatacatttcaagtgaaataagtaattctagataggaccatttaacgttcgcatactccagagggtcttcatcatcgcggggttaattggccagatcctaaagcggaaaaattatccgcgcgcccagggttcccaccaaag

SEQ ID NO: 371686 - DNA, 1929 bp, Homo sapiens
tgagaactgccgctgctcgagaaacaactctgcgaggagcacctccgcacgggacccggcgctgctgctactgccgctagagccgctgccgccgcttttctagaaccttcccccccactaacgcgtcttccgctacgtcaggccgtcgcgtaaacgccctatccgccgccaatggcgggaaggctctacgccccaccttacgccaaatgcgtactcctcccacccttgcggccagagacagtacccgacgttacttccgtaaatgcgctcaatgaattgcggaaggctagagtcctgctagttactacctcttggaatagggtcccgccccctgccttggcgcaaggcaggtgagaaacggtcgcgcagtttgaaattaacgccgacgggaggggcttaatccgcagcctggagatccagccccctcaacccgggaggtggtccctgcagttacgccaatgataacccccgccagaaaaatcttagtagccttccctttttgttttccgtgccccaactcggcggattgactcggccccttccggaaacacccgaatcaacttctagtcaaattattgttcacgccgcaatgacccacccctggcccgcgtctgtggaactgacccctggtgtacaggagagttcgctgctgaaagtggtcccaaaggggtactagtttttaagctcccaactccccctcccccagcgtctggaggattccacaccctcgcaccgcaggggcgaggaagtgggcggagtccggttttggcgccagccgctgaggctgccaagcagaaaagccaccgctgaggagactccggtcactgtcctcgccccgcctcccccttccctccccttggggaccaccgggcgccacgccgcgaacggtaagtgccgcggtcgtcggcgcctccgccctccccctagggccccaattcccagcgggcgcgcgcccgctgccccgcccttcgtggccgcccggcgtgggcggtgccacccctccccccggcggccccgcgcgcagctcccggctccctcccccttcggatgtggcttgagctgtaggcgcggagggccggagacgctgcagacccgcgacccggagcagctcggaggcggtgaataatagctcttcaagtctgcaataaaaaatggcctccaacaaaactacattgcaaaaaatgggaaaaaaacagaatggaaagagtaaaaaagttgaagaggcagagcctgaagaatttgtcgtggaaaaagtactagatcgacgtgtagtgaatgggaaagtggaatatttcctgaagtggaagggatttacagatgctgacaatacttgggaacctgaagaaaatttagattgtccagaattgattgaagcgtttcttaactctcagaaagctggcaaagaaaaagatggtacaaaaagaaaatctttatctgacagtgaatctgatgacagcaaatcaaagaagaaaagagatgctgctgacaaaccaagaggatttgccagaggtcttgatcctgaaagaataattggtgccacagacagcagtggagaattgatgtttctcatgaaatggaaagattcagatgaggcagacttggtgctggcgaaagaggcaaatatgaagtgtcctcaaattgtaattgctttttatgaagagagactaacttggcattcttgtccagaagatgaagctcaataattgttcacattgttcttttatatatatttatatatatatataaaaattgggtcttagattttgatttactagtgtgacaaaataactacatcctaatgaaaatcaagtttgatatgtttgttttgaaagtagcgttggaagagttgttgggggttttttgcatccatagcactggttactttgaacaaataaataaaagctttctgtagttgcttcctttatcaga

SEQ ID NO: 371687 - DNA, 2378 bp, Homo sapiens
cgccgcgggggtaggcgcgtgcggtgtggcgcagtgcccttgagcccccgtgccgcggcctttgtttctccccgcggatgcgctgaccacgaggcccgcgctcccgggtgggggcgggcacccgcgcttaggcacgtctggacgccgggcttcagcggcgggggtcgggagcgggtgtttgcaagaggtgattcttttttcaaagtgtcacgaaacggggttgaagcatcttaagttttttccttttgttatttaattaccgattggaaagagggagggtttctgagcagaaaccaagttgggattgcagaacagagaagattcacagtgctttaccgttgtgagttgtttgggtaatcgtgcctggttttaaaccgaaaggattgtcctttaaaaatggaacatggactttattataaatgggacttagattggaaaagacattggtcccctattttaagccatgtgaagctgttttaggtaccaggatccccagtaaagtctttctagactcacatggttaggacacgtacttaagtacatcataagcaatgtaggtaggagcgcagatctactctggatttgtattcacgtttgaaatgtgcgctctctacttgggggttggaatccaaacagaatttgtatttagttaccttttttgtgtcatgcaaacttaccttaactgtcatgcatttttctagtaatagctcttcaagtctgcaataaaaaatggcctccaacaaaactacattgcaaaaaatgggaaaaaaacagaatggaaagagtaaaaaagttgaagaggcagagcctgaagaatttgtcgtggaaaaagtactagatcgacgtgtagtgaatgggaaagtggaatatttcctgaagtggaagggatttacagatgctgacaatacttgggaacctgaagaaaatttagattgtccagaattgattgaagcgtttcttaactctcagaaagctggcaaagaaaaagatggtacaaaaagaaaatctttatctgacagtgaatctgatgacagcaaatcaaagaagaaaagagatgctaataattggtgccacagacagcagtggagaattgatgtttctcatgaaatggaaagattcagatgaggcagacttggtgctggcgaaagaggcaaatatgaagtgtcctcaaattgtaattgctttttatgaagagagactaacttggcattcttgtccagaagatgaagctcaataattgttcacattgttcttttatatatatttatatatatatataaaaattgggtcttagattttgatttactagtgtgacaaaataactacatcctaatgaaaatcaagtttgatatgtttgttttgaaagtagcgttggaagagttgttgggggttttttgcatccatagcactggttactttgaacaaataaataaaagctttctgtagttgcttcctttatcagaaaagaacatttgataccatggtatatcatttcctcttcattaaagaacagcttttctaaatgttgggggaaatgtccatagtcattactcagtcaaaacttgtgttctcatgagcctaaggaccattctagatttattacgtgttttgtgtgtgtgtgtgtgtgtgtgtgtgtgtgtatccataaaatgcatatgtaaatttttttttgtttttaagcattcacccaaacaaaaaaatcacaggtaaacccatgtttctgagatgccattattccaagcaaaataagagataatcccttcaagttaaattgaaaattttcctgaaaccatacatttcaagtgaaataagtaattctagataggacaatttaaattggataattttaaagtgtctataattgcagtggtttatttgcaaaattcctaaaaggaaaaattttatcactgccatcacagcaggtttcctcatccagatgaggaaactagacaaatgctagtgtgttttaactagctaaacaaaactaagttaaatgaacatttaaaagtttccctagcgggccattccttagcaaaatgttggaatccctgttgctacattgactaaaaggtcatgatgaatggaatatgtaagacttggctcatagaaacctaatcagatggttagaggtgttggcagtttaggacctgctgtcataaatgtgtgaacaaccttttgtaacctaacctattgacctgcatgttttttctttaccccaattcattacatggaggctcaatcttgagtttgctttactggttcagcaaaagccaggaagaacaactttgtagtaatcaaaatgttatccaactgtatattgtttactttattgtaaatactggtgaacagtggttaataaatagttttatattccttta

SEQ ID NO: 371688 - DNA, 1348 bp, Homo sapiens
  misc_feature (56)..(58): n is a, c, g, or t
gggatttcctccgggctacaggcgacagagctgagccaagcgtttactgggcacgnnngctcagattccaaatgaaaatgtttgagagcgctgactctacagccacaagatctggccaggatctctgggctgaaatttgttcctgtctgccaaatcctgaacaagaagatggtgccaacaatgcattctcagactcctttgtggattcttgccctgaaggtgaaggccagagggaggtggctgactttgctgtccagccagctgtaaagccttgggctcccttgcaggattcagaagtgtatttagcatctctagccattttattttaaaaatatttcctgaggatgtggcttgagctgtaggcgcggagggccggagacgctgcagacccgcgacccggagcagctcggaggcggtgaataatagctcttcaagtctgcaataaaaaatggcctccaacaaaactacattgcaaaaaatgggaaaaaaacagaatggaaagagtaaaaaagttgaagaggcagagcctgaagaatttgtcgtggaaaaagtactagatcgacgtgtagtgaatgggaaagtggaatatttcctgaagtggaagggatttacagatgctgacaatacttgggaacctgaagaaaatttagattgtccagaattgattgaagcgtttcttaactctcagaaagctggcaaagaaaaagatggtacaaaaagaaaatctttatctgacagtgaatctgatgacagcaaatcaaagaagaaaagagatgctgtataatcactattttacagatgaggaaacgagattgactacaaatttggttttgaaaataaatcacatgctcaacagaagcagttttggccaggcacggtggctcgcacctataatcccagcaccttgggaaaccaaagcaggaacatcgcttgagcccaggagttggaggccagtttgggcaacatagtgagaccccatctctacaaagaaaaaaaaaaaagaatcagcaagacgtggtggacacctcctgtagtctcagctacttgggaggctgaggcagaaggattgcttgagcctgggagttcaaggtgcagtgagctgtgatcatgccagtgcactttggcctaggcaacggagcaagaccttgtctcaaaaaattattaaataataaatcaggcacaactttaacaacacttattgagtccttagcatgtgctatactgtgtgccaaattatttgcttttaatgtgctgtgaaatatctgtgcagtagatactaaaattctgttttattaacctaaaccacaaagaggttaattaacttgcccaaagccacacagctcgtaag

SEQ ID NO: 371689 - DNA, 1000 bp, Homo sapiens
  misc_feature (56)..(58): n is a, c, g, or t
gggatttcctccgggctacaggcgacagagctgagccaagcgtttactgggcacgnnngctcagattccaaatgaaaatgtttgagagcgctgactctacagccacaagatctggccaggatctctgggctgaaatttgttcctgtctgccaaatcctgaacaagaagatggtgccaacaatgcattctcagactcctttgtggattcttgccctgaaggtgaaggccagagggaggtggctgactttgctgtccagccagctgtaaagccttgggctcccttgcaggattcagaagtgtatttagcatctctagccattttattttaaaaatatttcctgaggatgtggcttgagctgtaggcgcggagggccggagacgctgcagacccgcgacccggagcagctcggaggcggtgaataatagctcttcaagtctgcaataaaaaatggcctccaacaaaactacattgcaaaaaatgggaaaaaaacagaatggaaagagtaaaaaagttgaagaggcagagcctgaagaatttgtcgtggaaaaagtactagatcgacgtgtagtgaatgggaaagtggaatatttcctgaagtggaagggatttacagatgctgacaatacttgggaacctgaagaaaatttagattgtccagaattgattgaagcgtttcttaactctcagaaagctggcaaagaaaaagatggtacaaacaaagctgcccaggacctagtgctggcagccggctcatggtccacatgcggatctgcagtaggggtcagctgggggccctcaaccagcaccctgttcctaagcacgtccagatgtatcctcatatccatgtcccttttggcagcttcctggtcaacctgaacctacccttctgcacagcctcgggtggctgctgagggcaatgagtgagctggggccacgggtcagcaggcaggcagggaaggggctcaggaggctcagtctggttgtccggcggctaagtct

SEQ ID NO: 371690 - DNA, 787 bp, Homo sapiens
cgccgcgggggtaggcgcgtgcggtgtggcgcagtgcccttgagcccccgtgccgcggcctttgtttctccccgcggatgcgctgaccacgaggcccgcgctcccgggtgggggcgggcacccgcgcttaggcacgtctggacgccgggcttcagcggcgggggtcgggagcgggtgtttgcaagaggtgattcttttttcaaagtgtcacgaaacggggttgaagcatcttaagttttttccttttgttatttaattaccgattggaaagagggagggtttctgagcagaaaccaagttgggattgcagaacagagaagattcacagtgctttaccgttgtgagttgtttgggtaatcgtgcctggttttaaaccgaaaggattgtcctttaaaaatggaacatggactttattataaatgggacttagattggaaaagacattggtcccctattttaagccatgtgaagctgttttaggtaccaggatccccagtaaagtctttctagactcacatggttaggacacgtacttaagtacatcataagcaatgtaggtaggagcgcagatctactctggatttgtattcacgtttgaaatgtgcgctctctacttgggggttggaatccaaacagaatttgtatttagttgctccctccccaccacgcgccctctctctctctctctcccacgctcccagtcactcccccctcaccgggggagcgcagcagtgggggcggcggcggggggagaagggtaggggcggcaggggacggaggcggccgc

SEQ ID NO: 371691 - DNA, 287 bp, Homo sapiens
tcttttttttttaaactgcaaatttgctacaaggaacgtatattgtatctgcaaatggggaaaatgacagttatttttaaataagcttattacgtattagattaaatcagctgcctgagatgtgtacacagacaccattcagctctactgggcttaaaccacttcttcatttcatgggaggagtgactcaaaataaagtaacgggcaaaattgacacttctgaattcagctgctaatcctctgattgaacaccagccgtattcttccctgggcctggggcacataca

SEQ ID NO: 371692 - DNA, 346 bp, Homo sapiens
aaccttgggggcctcgtcagtcttgggctgccccatgccctgcacagcccgcctgaggtttgaggaaggggcagttggctaggcccagactggagaaagccaccccaccatggctcttctgcaagaacccccggccagccacaagcctaagccccctccttaaaagctcctcctctgaccttagctgtgcatcaagggagaaaagaaagctccaggccgggtgcggtggctcacacctgcaatcccagcactttgggagaccaaggctggcagatcattaggtcaggagttcgagaccagcctggccagcaaggtgaaaccccatctctactaaaattacaaaaaa

SEQ ID NO: 371693 - DNA, 3851 bp, Homo sapiens
gtcgacgagagagagagagagagagaactagtctcggggggccaaagggaaagaagaagaacggaaggaacagagggggcaaagccaacaaccccccgtatttgccccccgaggctgaagatggaaacattgaatataaattgaagctggtgaatccatcccagtaccgctttgagcacctggtgacacaaatgaagtggcggctccaggagggacgtggtgaggccgtctaccagattggggtagaggacaatgggctgctggtggggctggctgaggaggaaatgcgagcttcgctcaagaccctgcaccggatggcagagaaggttggggcagacataaccgttcttcgagagcgagaagtggattatgatagcgacatgccccggaagatcaccgaggtgctagtacgaaaggtccctgacaaccaacagttcctagacctccgtgtggccgtcctggggaatgtggactctgggaagtcaactctgcttggagtcctgacccagggagagctggacaatgggcggggccgggctcggctcaaccttttccgccacctgcatgagattcagtctggccgaacctccagcatcagcttcgagatcctgggctttaacagcaagggagaggtggtgaattacagcgactcacggacagcagaagagatctgtgagagcagctccaagatgatcaccttcatcgacctggcaggccaccataagtacctacacaccaccatctttggcctcacatcatactgccccgactgcgccctgctcctcgtcagtgccaacactgggattgctggcaccacaagggaacatctggggctggccctggccctgaaagtgcccttcttcatcgtggtcagcaagatcgacctatgtgccaagaccacagtggagaggacagtacgccagctggagcgggtcctcaagcagcctggctgccacaaggtccccatgctggtcacctctgaggatgatgccgtcactgctgcccagcagtttgctcagtcacccaatgtcacccccatcttcacattgtccagtgtgtctggagagagtctggacctcctcaaagtctttctgaatattctgccgccactcaccaacagcaaagagcaggaggaactcatgcagcagctgacggagttccaggtggatgaaatctacacagtaccagaggtggggactgttgttggaggaacactttccagtgggatttgccgtgagggggaccagctggtggtgggccccacggatgatggctgcttcctggagctgagagtatgcagcatccagcgcaaccgctctgcctgtcgtgtgctgcgagctggtcaggctgctacactggcgcttggggactttgaccgtgcactgcttcgcaagggcatggtgatggtgagcccggagatgaatcctaccatctgctcggtgtttgaggcagagatagtcttactgttccatgccaccaccttccgacgaggattccaggtgacagtacacgtgggcaacgtacgtcagacggcagtggtggaaaagatccatgccaaggacaaactgcggacaggcgagaaggcagtggtacgtttccgcttcctgaaacacccagagtacctgaaggtgggcgccaaactgctgttccgggagggtgtcaccaagggcatcggccatgtcactgatgtacaagccattacagcaggagaagcccaggccaacatgggcttctgaacccttcaggcagggacagttctattgctgtccctacaatatataaggtgacttctggccatgctgccctgccattggcggctctgtgtgttaataggctagggagagaggggtgctgtctgccacttgctccctgccaactttctggagaggtgccaaacttggtgtggccaggaaagggcagtcctgagggagaagacaggattcagggcagtgctccgaagctgtgtgctcacctggttggctcatcaaacctggcaaccctgtggcctgtctgccggagctgactggatccactcatcaattcttcgtccccactactaagactgggcatgttttgctggtgtggtctctgcacttcaggaatggtcacaacagggggtagccctcaaaagcactcctttttctatacctcttctcaaggccatgtaagttgcccatctctacctggctgtggacaaaaggttatctgctcttggccatctggtggtggtggcggcccagagtctgaagaaatggcacagggacagtgaatggtagtgttgccaccctgtgctgaggcctgaggcctcttcctcagctttatctccctttccttcactcaagggccatttccccagtccctatctcccccatcccctcccggcttataggccccacaggtgctatttgttgtgctggcccaggcgtggggctaccaagcaaaggcttggcatataccaaaggccagctgcatgcccatcagtctggtctttttcctctgcggtcatgttggctttcatgctggatcaaatgttttactttcccagactggtggcatctgagttccccatcctaccactctcaccccactttcctgccccacctaaaccctcgttttagtaatttgtagtgactgttcccttccctctgttgcagggaaccaggaggaaagggaaagatgttgccatatttcctactctttaggcatggactctcctttccctttgttagtgtcctgggttcccatggactcagggatttgttggctaaggtttctctgtgcatatatatatatatacatatgtatatatatttaaatacacatatatattgtacagaataaaaatgttttattgaatacactgtgcttatgcgttacgtacaggctcagcttccttccagggctagatacctcttcaggattagagacaagtgaaaccccaacactgctgagccctgaatgtggaaagagcccagctggtatctcgttcaccattgtttttctctcctccacataggttcagagttccagtattgtaaccaagtattgtggcctattttccgtagttcaagtgagcagaatactgaggcctttcacgtgaaataggtagctaccctgtatttgaagagttggccacttgctagtggtcagaatagtaaggagcccacttctgtgccctggcagagatacagtgccagctacttaaagaagagtagaatttagagacaaaaggtaatctggtcccatatttttcaagtttacatagcctaaattactcttggaacaatgagggccacttgaccaaaccttagtccctgctcctgtttccatgttcatactacttgattttgacattttatgggtaaataggggccaaagtcaactgtaaatagaaactgcattttgaggagaccctggaaaagaaatatgtgacccaaagtcctatgtggcattctgcctctagagtattaaagtgatagcttccctaccactcaggctgttttataaaatgtaactggtttaacttgctactaacaagcctgtagttgaacaacttcctcctgtattaggggctaagctgtttacttcctctctatagctgctgatagagatgaaagctttgtccacaatttacttatcttttgcctgtattgtaaagaaaattttggaaaatcacatttcagtacttaataagacatctccaggaactagtgagcctctctgcaacattaatggaacatttagggggataaaaagtatataaggcagactcccaaggagtttatacatgtttatgatcccaattgtggtaatcagatctaaaattcttcactatatacattcatccaatg

SEQ ID NO: 371694 - DNA, 5191 bp, Homo sapiens
cctgcctcaggtttatttgtacaaatagcacaggaggaccccagccccatgcagatggtagcccaggggcgggggtggggggtcgcaccagtccttctgtcctcatgttggcagagatatctactctgaagcctttgtaggggcctgggtacgtttgggagcctgagctggaactgaagctggggctgcagcctgggccttggtttgatccttggccttggccttggcctttggccggcacagcctgagccccttggcaatacgggcacgattcggggtgggcaatgtaggcaagtcgatcgagcttgcggctgacaccctttgggatcttgggcttaacctccttgggctttacgagggccttgatagcctcggcacgtgcactcatggccttggcattgttggcctgcatcttctttaggccctttttgttgtgcttcttggcaaagcgcatgttcctcaggaacttggggtccacccccttaagagattcgtatctttgtgatcggggtttcttgataccatttctgtgccattttcgggactggttgtgtgtggtgtggttcttggacttggccatgtctgcaccataagccgcggctcccgaagcgacatgccccggaagatcaccgaggtgctagtacgaaaggtccctgacaaccaacagttcctagacctccgtgtggccgtcctggggaatgtggactctgggaagtcaactctgcttggagtcctgacccagggagagctggacaatgggcggggccgggctcggctcaaccttttccgccacctgcatgagattcagtctggccgaacctccagcatcagcttcgagatcctgggctttaacagcaagggagaggtgcatgggatcaatgggacccaatggggccagactctgaggatgggatggtagtagtgaaggacataggatgggggtagagtgtggagactttttgaaatagtatagatgaatgccctgaggggactgtgaacaagctctgcccctcttaggaaatcaatggggaatcaactaaattaaataaaaaatggggtcaagattaagaggcagggtcacccagggaatggtttaggtcctggcaactctgaaggggttggaagggctggcaggaggcactgagggccctgggccctgggccaggtggtgaattacagcgactcacggacagcagaagagatctgtgagagcagctccaagatgatcaccttcatcgacctggcaggccaccataagtacctacacaccaccatctttggcctcacatcatactgccccgactgcgccctgctcctcgtcagtgccaacactgggattgctggcaccacaagggaacatctggggctggccctggccctgaaagtgcccttcttcatcgtggtcagcaagatcgacctatgtgccaagaccacagtggagaggacagtacgccagctggagcgggtcctcaagcagcctggctgccacaaggtccccatgctggtcacctctgaggatgatgccgtcactgctgcccagcagtttgctcagtcacccaatgtcacccccatcttcacattgtccagtgtgtctggagagagtctggacctcctcaaagtctttctgaatattctgccgccactcaccaacagcaaagagcaggaggaactcatgcagcagctgacggagttccaggtggatgaaatctacacagtaccagaggtggggactgttgttggaggaacactttccagattaggctttcactatcagaagagctggagaacggtagtctgttggctttggagggaagaaacagtattgctgcctattggggaatctccaggcccctgagagagaagtgtgggtcttgagctccaggaagaaaactagagtgtattcaactgacttcatctcacacagggaaatgagagacgtcacttaagactcttctttctttctttctttcttttttttgagacagagtctcgctctgttgcccaggctggattgcagtggagcgatcttggctcactgcaacctctgcctcctgggttccagcaattctcctgcctcagccttgagtagctggaattacaggcgcctaccaccatgcccggctaatttttgtatttttagtagagatggggtcgtcaccatattggccaggctggtcttgaattcctgacctcaagtgatccacctgcctcagcctccccaagtgctaggattacaggtgtgagccaacgcggctggcctaagactctgcaaagcagagaatgaaacccaaggggataacttgctccttcagtgattaggtgtcggtgttgttaaaccagcaagtgtctctctgtccaccatcactgctggccttttatgaaattagtcttctgattctgaactctggcagtgagccctgttacatccaagtcagaatttagggttcttccccacttgagggactcaaccctagaagggaaggaatgctctgggtgatcctaatagagaagtaggtatggggaccttggctgacactgtgccacctgccctctgggctgcagtgggatttgccgtgagggggaccagctggtggtgggccccacggatgatggctgcttcctggagctgagagtatgcagcatccagcgcaaccgctctgcctgtcgtgtgctgcgagctggtcaggctgctacactggcgcttggggactttgaccgtgcactgcttcgcaagggcatggtgatggtgagcccggagatgaatcctaccatctgctcggtgtttgaggcagagatagtcttactgttccatgccaccaccttccgacgaggattccaggtgacagtacacgtgggcaacgtacgtcagacggcagtggtggaaaagatccatgccaaggacaaactgcggacaggcgagaaggcagtggtacgtttccgcttcctgaaacacccagagtacctgaaggtgggcgccaaactgctgttccgggagggtgtcaccaagggcatcggccatgtcactgatgtacaagccattacagcaggagaagcccaggccaacatgggcttctgaacccttcaggcagggacagttctattgctgtccctacaatatataaggtgacttctggccatgctgccctgccattggcggctctgtgtgttaataggctagggagagaggggtgctgtctgccacttgctccctgccaactttctggagaggtgccaaacttggtgtggccaggaaagggcagtcctgagggagaagacaggattcagggcagtgctccgaagctgtgtgctcacctggttggctcatcaaacctggcaaccctgtggcctgtctgccggagctgactggatccactcatcaattcttcgtccccactactaagactgggcatgttttgctggtgtggtctctgcacttcaggaatggtcacaacagggggtagccctcaaaagcactcctttttctatacctcttctcaaggccatgtaagttgcccatctctacctggctgtggacaaaaggttatctgctcttggccatctggtggtggtggcggcccagagtctgaagaaatggcacagggacagtgaatggtagtgttgccaccctgtgctgaggcctgaggcctcttcctcagctttatctccctttccttcactcaagggccatttccccagtccctatctcccccatcccctcccggcttataggccccacaggtgctatttgttgtgctggcccaggcgtggggctaccaagcaaaggcttggcatataccaaaggccagctgcatgcccatcagtctggtctttttcctctgcggtcatgttggctttcatgctggatcaaatgttttactttcccagactggtggcatctgagttccccatcctaccactctcaccccactttcctgccccacctaaaccctcgttttagtaatttgtagtgactgttcccttccctctgttgcagggaaccaggaggaaagggaaagatgttgccatatttcctactctttaggcatggactctcctttccctttgttagtgtcctgggttcccatggactcagggatttgttggctaaggtttctctgtgcatatatatatatatacatatgtatatatatttaaatacacatatatattgtacagaataaaaatgttttattgaatacactgtgcttatgcgttacgtacaggctcagcttccttccagggctagatacctcttcaggattagagacaagtgaaaccccaacactgctgagccctgaatgtggaaagagcccagctggtatctcgttcaccattgtttttctctcctccacataggttcagagttccagtattgtaaccaagtattgtggcctattttccgtagttcaagtgagcagaatactgaggcctttcacgtgaaataggtagctaccctgtatttgaagagttggccacttgctagtggtcagaatagtaaggagcccacttctgtgccctggcagagatacagtgccagctacttaaagaagagtagaatttagagacaaaaggtaatctggtcccatatttttcaagtttacatagcctaaattactcttggaacaatgagggccacttgaccaaaccttagtccctgctcctgtttccatgttcatactacttgattttgacattttatgggtaaataggggccaaagtcaactgtaaatagaaactgcattttgaggagaccctggaaaagaaatatgtgacccaaagtcctatgtggcattctgcctctagagtattaaagtgatagcttccctaccactcaggctgttttataaaatgtaactggtttaacttgctactaacaagcctgtagttgaacaacttcctcctgtattaggggctaagctgtttacttcctctctatagctgctgatagagatgaaagctttgtccacaatttacttatcttttgcctgtattgtaaagaaaattttggaaaatcacatttcagtacttaataagacatctccaggaactagtgagcctctctgcaacattaatggaacatttagggggataaaaagtatataaggcagactcccaaggagtttatacatgtttatgatcccaattgtggtaatcagatctaaaattcttcactatatacattcatccaatg

SEQ ID NO: 371695 - DNA, 4628 bp, Homo sapiens
cccagggaggaggggcacgggaggagaacacctctttcaggtcccgggaccccagggaggaagggcagagactggactctcaggctgaagatggaaacattgaatataaattgaagctggtgaatccatcccagtaccgctttgagcacctggtgacacaaatgaagtggcggctccaggagggacgtggtgaggccgtctaccagattggggtagaggacaatgggctgctggtggggctggctgaggaggaaatgcgagcttcgctcaagaccctgcaccggatggcagagaaggttggggcagacataaccgttcttcgagagcgagaagtggattatgatagcgacatgccccggaagatcaccgaggtgctagtacgaaaggtccctgacaaccaacagttcctagacctccgtgtggccgtcctggggaatgtggactctgggaagtcaactctgcttggagtcctgacccagggagagctggacaatgggcggggccgggctcggctcaaccttttccgccacctgcatgagattcagtctggccgaacctccagcatcagcttcgagatcctgggctttaacagcaagggagaggtggtgaattacagcgactcacggacagcagaagagatctgtgagagcagctccaagatgatcaccttcatcgacctggcaggccaccataagtacctacacaccaccatctttggcctcacatcatactgccccgactgcgccctgctcctcgtcagtgccaacactgggattgctggcaccacaagggaacatctggggctggccctggccctgaaagtgcccttcttcatcgtggtcagcaagatcgacctatgtgccaagaccacagtggagaggacagtacgccagctggagcgggtcctcaagcagcctggctgccacaaggtccccatgctggtcacctctgaggatgatgccgtcactgctgcccagcagtttgctcagtcacccaatgtcacccccatcttcacattgtccagtgtgtctggagagagtctggacctcctcaaagtctttctgaatattctgccgccactcaccaacagcaaagagcaggaggaactcatgcagcagctgacggagttccaggtggatgaaatctacacagtaccagaggtggggactgttgttggaggaacactttccagattaggctttcactatcagaagagctggagaacggtagtctgttggctttggagggaagaaacagtattgctgcctattggggaatctccaggcccctgagagagaagtgtgggtcttgagctccaggaagaaaactagagtgtattcaactgacttcatctcacacagggaaatgagagacgtcacttaagactcttctttctttctttctttcttttttttgagacagagtctcgctctgttgcccaggctggattgcagtggagcgatcttggctcactgcaacctctgcctcctgggttccagcaattctcctgcctcagccttgagtagctggaattacaggcgcctaccaccatgcccggctaatttttgtatttttagtagagatggggtcgtcaccatattggccaggctggtcttgaattcctgacctcaagtgatccacctgcctcagcctccccaagtgctaggattacaggtgtgagccaacgcggctggcctaagactctgcaaagcagagaatgaaacccaaggggataacttgctccttcagtgattaggtgtcggtgttgttaaaccagcaagtgtctctctgtccaccatcactgctggccttttatgaaattagtcttctgattctgaactctggcagtgagccctgttacatccaagtcagaatttagggttcttccccacttgagggactcaaccctagaagggaaggaatgctctgggtgatcctaatagagaagtaggtatggggaccttggctgacactgtgccacctgccctctgggctgcagtgggatttgccgtgagggggaccagctggtggtgggccccacggatgatggctgcttcctggagctgagagtatgcagcatccagcgcaaccgctctgcctgtcgtgtgctgcgagctggtcaggctgctacactggcgcttggggactttgaccgtgcactgcttcgcaagggcatggtgatggtgagcccggagatgaatcctaccatctgctcggtgtttgaggcagagatagtcttactgttccatgccaccaccttccgacgaggattccaggtgacagtacacgtgggcaacgtacgtcagacggcagtggtggaaaagatccatgccaaggacaaactgcggacaggcgagaaggcagtggtacgtttccgcttcctgaaacacccagagtacctgaaggtgggcgccaaactgctgttccgggagggtgtcaccaagggcatcggccatgtcactgatgtacaagccattacagcaggagaagcccaggccaacatgggcttctgaacccttcaggcagggacagttctattgctgtccctacaatatataaggtgacttctggccatgctgccctgccattggcggctctgtgtgttaataggctagggagagaggggtgctgtctgccacttgctccctgccaactttctggagaggtgccaaacttggtgtggccaggaaagggcagtcctgagggagaagacaggattcagggcagtgctccgaagctgtgtgctcacctggttggctcatcaaacctggcaaccctgtggcctgtctgccggagctgactggatccactcatcaattcttcgtccccactactaagactgggcatgttttgctggtgtggtctctgcacttcaggaatggtcacaacagggggtagccctcaaaagcactcctttttctatacctcttctcaaggccatgtaagttgcccatctctacctggctgtggacaaaaggttatctgctcttggccatctggtggtggtggcggcccagagtctgaagaaatggcacagggacagtgaatggtagtgttgccaccctgtgctgaggcctgaggcctcttcctcagctttatctccctttccttcactcaagggccatttccccagtccctatctcccccatcccctcccggcttataggccccacaggtgctatttgttgtgctggcccaggcgtggggctaccaagcaaaggcttggcatataccaaaggccagctgcatgcccatcagtctggtctttttcctctgcggtcatgttggctttcatgctggatcaaatgttttactttcccagactggtggcatctgagttccccatcctaccactctcaccccactttcctgccccacctaaaccctcgttttagtaatttgtagtgactgttcccttccctctgttgcagggaaccaggaggaaagggaaagatgttgccatatttcctactctttaggcatggactctcctttccctttgttagtgtcctgggttcccatggactcagggatttgttggctaaggtttctctgtgcatatatatatatatacatatgtatatatatttaaatacacatatatattgtacagaataaaaatgttttattgaatacactgtgcttatgcgttacgtacaggctcagcttccttccagggctagatacctcttcaggattagagacaagtgaaaccccaacactgctgagccctgaatgtggaaagagcccagctggtatctcgttcaccattgtttttctctcctccacataggttcagagttccagtattgtaaccaagtattgtggcctattttccgtagttcaagtgagcagaatactgaggcctttcacgtgaaataggtagctaccctgtatttgaagagttggccacttgctagtggtcagaatagtaaggagcccacttctgtgccctggcagagatacagtgccagctacttaaagaagagtagaatttagagacaaaaggtaatctggtcccatatttttcaagtttacatagcctaaattactcttggaacaatgagggccacttgaccaaaccttagtccctgctcctgtttccatgttcatactacttgattttgacattttatgggtaaataggggccaaagtcaactgtaaatagaaactgcattttgaggagaccctggaaaagaaatatgtgacccaaagtcctatgtggcattctgcctctagagtattaaagtgatagcttccctaccactcaggctgttttataaaatgtaactggtttaacttgctactaacaagcctgtagttgaacaacttcctcctgtattaggggctaagctgtttacttcctctctatagctgctgatagagatgaaagctttgtccacaatttacttatcttttgcctgtattgtaaagaaaattttggaaaatcacatttcagtacttaataagacatctccaggaactagtgagcctctctgcaacattaatggaacatttagggggataaaaagtatataaggcagactcccaaggagtttatacatgtttatgatcccaattgtggtaatcagatctaaaattcttcactatatacattcatccaatg

SEQ ID NO: 371696 - DNA, 5107 bp, Homo sapiens
cagtggcagtaagggcggcggcgacggcggcggcggtcgggggaggggccgggcggggggctggcggcagcggcggatggactcgcgggtatcggagctgttcggcggctgctgccggcccggagggggcccggccgtgggcggaaccctcaaggctaggggggccggcagcagcagcggctgcggggggccaaagggaaagaagaagaacggaaggaacagagggggcaaagccaacaaccccccgtatttgccccccgaggctgaagatggaaacattgaatataaattgaagctggtgaatccatcccagtaccgctttgagcacctggtgacacaaatgaagtggcggctccaggagggacgtggtgaggccgtctaccagattggggtagaggacaatgggctgctggtggggctggctgaggaggaaatgcgagcttcgctcaagaccctgcaccggatggcagagaaggttggggcagacataaccgttcttcgagagcgagaagtggattatgatagcgacatgccccggaagatcaccgaggtgctagtacgaaaggtccctgacaaccaacagttcctagacctccgtgtggccgtcctggggaatgtggactctgggaagtcaactctgcttggagtcctgacccagggagagctggacaatgggcggggccgggctcggctcaaccttttccgccacctgcatgagattcagtctggccgaacctccagcatcagcttcgagatcctgggctttaacagcaagggagaggtgcatgggatcaatgggacccaatggggccagactctgaggatgggatggtagtagtgaaggacataggatgggggtagagtgtggagactttttgaaatagtatagatgaatgccctgaggggactgtgaacaagctctgcccctcttaggaaatcaatggggaatcaactaaattaaataaaaaatggggtcaagattaagaggcagggtcacccagggaatggtttaggtcctggcaactctgaaggggttggaagggctggcaggaggcactgagggccctgggccctgggccaggtggtgaattacagcgactcacggacagcagaagagatctgtgagagcagctccaagatgatcaccttcatcgacctggcaggccaccataagtacctacacaccaccatctttggcctcacatcatactgccccgactgcgccctgctcctcgtcagtgccaacactgggattgctggcaccacaagggaacatctggggctggccctggccctgaaagtgcccttcttcatcgtggtcagcaagatcgacctatgtgccaagaccacagtggagaggacagtacgccagctggagcgggtcctcaagcagcctggctgccacaaggtccccatgctggtcacctctgaggatgatgccgtcactgctgcccagcagtttgctcagtcacccaatgtcacccccatcttcacattgtccagtgtgtctggagagagtctggacctcctcaaagtctttctgaatattctgccgccactcaccaacagcaaagagcaggaggaactcatgcagcagctgacggagttccaggtggatgaaatctacacagtaccagaggtggggactgttgttggaggaacactttccagattaggctttcactatcagaagagctggagaacggtagtctgttggctttggagggaagaaacagtattgctgcctattggggaatctccaggcccctgagagagaagtgtgggtcttgagctccaggaagaaaactagagtgtattcaactgacttcatctcacacagggaaatgagagacgtcacttaagactcttctttctttctttctttcttttttttgagacagagtctcgctctgttgcccaggctggattgcagtggagcgatcttggctcactgcaacctctgcctcctgggttccagcaattctcctgcctcagccttgagtagctggaattacaggcgcctaccaccatgcccggctaatttttgtatttttagtagagatggggtcgtcaccatattggccaggctggtcttgaattcctgacctcaagtgatccacctgcctcagcctccccaagtgctaggattacaggtgtgagccaacgcggctggcctaagactctgcaaagcagagaatgaaacccaaggggataacttgctccttcagtgattaggtgtcggtgttgttaaaccagcaagtgtctctctgtccaccatcactgctggccttttatgaaattagtcttctgattctgaactctggcagtgagccctgttacatccaagtcagaatttagggttcttccccacttgagggactcaaccctagaagggaaggaatgctctgggtgatcctaatagagaagtaggtatggggaccttggctgacactgtgccacctgccctctgggctgcagtgggatttgccgtgagggggaccagctggtggtgggccccacggatgatggctgcttcctggagctgagagtatgcagcatccagcgcaaccgctctgcctgtcgtgtgctgcgagctggtcaggctgctacactggcgcttggggactttgaccgtgcactgcttcgcaagggcatggtgatggtgagcccggagatgaatcctaccatctgctcggtgtttgaggcagagatagtcttactgttccatgccaccaccttccgacgaggattccaggtgacagtacacgtgggcaacgtacgtcagacggcagtggtggaaaagatccatgccaaggacaaactgcggacaggcgagaaggcagtggtacgtttccgcttcctgaaacacccagagtacctgaaggtgggcgccaaactgctgttccgggagggtgtcaccaagggcatcggccatgtcactgatgtacaagccattacagcaggagaagcccaggccaacatgggcttctgaacccttcaggcagggacagttctattgctgtccctacaatatataaggtgacttctggccatgctgccctgccattggcggctctgtgtgttaataggctagggagagaggggtgctgtctgccacttgctccctgccaactttctggagaggtgccaaacttggtgtggccaggaaagggcagtcctgagggagaagacaggattcagggcagtgctccgaagctgtgtgctcacctggttggctcatcaaacctggcaaccctgtggcctgtctgccggagctgactggatccactcatcaattcttcgtccccactactaagactgggcatgttttgctggtgtggtctctgcacttcaggaatggtcacaacagggggtagccctcaaaagcactcctttttctatacctcttctcaaggccatgtaagttgcccatctctacctggctgtggacaaaaggttatctgctcttggccatctggtggtggtggcggcccagagtctgaagaaatggcacagggacagtgaatggtagtgttgccaccctgtgctgaggcctgaggcctcttcctcagctttatctccctttccttcactcaagggccatttccccagtccctatctcccccatcccctcccggcttataggccccacaggtgctatttgttgtgctggcccaggcgtggggctaccaagcaaaggcttggcatataccaaaggccagctgcatgcccatcagtctggtctttttcctctgcggtcatgttggctttcatgctggatcaaatgttttactttcccagactggtggcatctgagttccccatcctaccactctcaccccactttcctgccccacctaaaccctcgttttagtaatttgtagtgactgttcccttccctctgttgcagggaaccaggaggaaagggaaagatgttgccatatttcctactctttaggcatggactctcctttccctttgttagtgtcctgggttcccatggactcagggatttgttggctaaggtttctctgtgcatatatatatatatacatatgtatatatatttaaatacacatatatattgtacagaataaaaatgttttattgaatacactgtgcttatgcgttacgtacaggctcagcttccttccagggctagatacctcttcaggattagagacaagtgaaaccccaacactgctgagccctgaatgtggaaagagcccagctggtatctcgttcaccattgtttttctctcctccacataggttcagagttccagtattgtaaccaagtattgtggcctattttccgtagttcaagtgagcagaatactgaggcctttcacgtgaaataggtagctaccctgtatttgaagagttggccacttgctagtggtcagaatagtaaggagcccacttctgtgccctggcagagatacagtgccagctacttaaagaagagtagaatttagagacaaaaggtaatctggtcccatatttttcaagtttacatagcctaaattactcttggaacaatgagggccacttgaccaaaccttagtccctgctcctgtttccatgttcatactacttgattttgacattttatgggtaaataggggccaaagtcaactgtaaatagaaactgcattttgaggagaccctggaaaagaaatatgtgacccaaagtcctatgtggcattctgcctctagagtattaaagtgatagcttccctaccactcaggctgttttataaaatgtaactggtttaacttgctactaacaagcctgtagttgaacaacttcctcctgtattaggggctaagctgtttacttcctctctatagctgctgatagagatgaaagctttgtccacaatttacttatcttttgcctgtattgtaaagaaaattttggaaaatcacatttcagtacttaataagacatctccaggaactagtgagcctctctgcaacattaatggaacatttagggggataaaaagtatataaggcagactcccaaggagtttatacatgtttatgatcccaattgtggtaatcagatctaaaattcttcactatatacattcatccaatg

SEQ ID NO: 371697 - DNA, 4783 bp, Homo sapiens
cagtggcagtaagggcggcggcgacggcggcggcggtcgggggaggggccgggcggggggctggcggcagcggcggatggactcgcgggtatcggagctgttcggcggctgctgccggcccggagggggcccggccgtgggcggaaccctcaaggctaggggggccggcagcagcagcggctgcggggggccaaagggaaagaagaagaacggaaggaacagagggggcaaagccaacaaccccccgtatttgccccccgaggctgaagatggaaacattgaatataaataccgctttgagcacctggtgacacaaatgaagtggcggctccaggagggacgtggtgaggccgtctaccagattggggtagaggacaatgggctgctggtggggctggctgaggaggaaatgcgagcttcgctcaagaccctgcaccggatggcagagaaggttggggcagacataaccgttcttcgagagcgagaagtggattatgatagcgacatgccccggaagatcaccgaggtgctagtacgaaaggtccctgacaaccaacagttcctagacctccgtgtggccgtcctggggaatgtggactctgggaagtcaactctgcttggagtcctgacccagggagagctggacaatgggcggggccgggctcggctcaaccttttccgccacctgcatgagattcagtctggccgaacctccagcatcagcttcgagatcctgggctttaacagcaagggagaggtggtgaattacagcgactcacggacagcagaagagatctgtgagagcagctccaagatgatcaccttcatcgacctggcaggccaccataagtacctacacaccaccatctttggcctcacatcatactgccccgactgcgccctgctcctcgtcagtgccaacactgggattgctggcaccacaagggaacatctggggctggccctggccctgaaagtgcccttcttcatcgtggtcagcaagatcgacctatgtgccaagaccacagtggagaggacagtacgccagctggagcgggtcctcaagcagcctggctgccacaaggtccccatgctggtcacctctgaggatgatgccgtcactgctgcccagcagtttgctcagtcacccaatgtcacccccatcttcacattgtccagtgtgtctggagagagtctggacctcctcaaagtctttctgaatattctgccgccactcaccaacagcaaagagcaggaggaactcatgcagcagctgacggagttccaggtggatgaaatctacacagtaccagaggtggggactgttgttggaggaacactttccagattaggctttcactatcagaagagctggagaacggtagtctgttggctttggagggaagaaacagtattgctgcctattggggaatctccaggcccctgagagagaagtgtgggtcttgagctccaggaagaaaactagagtgtattcaactgacttcatctcacacagggaaatgagagacgtcacttaagactcttctttctttctttctttcttttttttgagacagagtctcgctctgttgcccaggctggattgcagtggagcgatcttggctcactgcaacctctgcctcctgggttccagcaattctcctgcctcagccttgagtagctggaattacaggcgcctaccaccatgcccggctaatttttgtatttttagtagagatggggtcgtcaccatattggccaggctggtcttgaattcctgacctcaagtgatccacctgcctcagcctccccaagtgctaggattacaggtgtgagccaacgcggctggcctaagactctgcaaagcagagaatgaaacccaaggggataacttgctccttcagtgattaggtgtcggtgttgttaaaccagcaagtgtctctctgtccaccatcactgctggccttttatgaaattagtcttctgattctgaactctggcagtgagccctgttacatccaagtcagaatttagggttcttccccacttgagggactcaaccctagaagggaaggaatgctctgggtgatcctaatagagaagtaggtatggggaccttggctgacactgtgccacctgccctctgggctgcagtgggatttgccgtgagggggaccagctggtggtgggccccacggatgatggctgcttcctggagctgagagtatgcagcatccagcgcaaccgctctgcctgtcgtgtgctgcgagctggtcaggctgctacactggcgcttggggactttgaccgtgcactgcttcgcaagggcatggtgatggtgagcccggagatgaatcctaccatctgctcggtgtttgaggcagagatagtcttactgttccatgccaccaccttccgacgaggattccaggtgacagtacacgtgggcaacgtacgtcagacggcagtggtggaaaagatccatgccaaggacaaactgcggacaggcgagaaggcagtggtacgtttccgcttcctgaaacacccagagtacctgaaggtgggcgccaaactgctgttccgggagggtgtcaccaagggcatcggccatgtcactgatgtacaagccattacagcaggagaagcccaggccaacatgggcttctgaacccttcaggcagggacagttctattgctgtccctacaatatataaggtgacttctggccatgctgccctgccattggcggctctgtgtgttaataggctagggagagaggggtgctgtctgccacttgctccctgccaactttctggagaggtgccaaacttggtgtggccaggaaagggcagtcctgagggagaagacaggattcagggcagtgctccgaagctgtgtgctcacctggttggctcatcaaacctggcaaccctgtggcctgtctgccggagctgactggatccactcatcaattcttcgtccccactactaagactgggcatgttttgctggtgtggtctctgcacttcaggaatggtcacaacagggggtagccctcaaaagcactcctttttctatacctcttctcaaggccatgtaagttgcccatctctacctggctgtggacaaaaggttatctgctcttggccatctggtggtggtggcggcccagagtctgaagaaatggcacagggacagtgaatggtagtgttgccaccctgtgctgaggcctgaggcctcttcctcagctttatctccctttccttcactcaagggccatttccccagtccctatctcccccatcccctcccggcttataggccccacaggtgctatttgttgtgctggcccaggcgtggggctaccaagcaaaggcttggcatataccaaaggccagctgcatgcccatcagtctggtctttttcctctgcggtcatgttggctttcatgctggatcaaatgttttactttcccagactggtggcatctgagttccccatcctaccactctcaccccactttcctgccccacctaaaccctcgttttagtaatttgtagtgactgttcccttccctctgttgcagggaaccaggaggaaagggaaagatgttgccatatttcctactctttaggcatggactctcctttccctttgttagtgtcctgggttcccatggactcagggatttgttggctaaggtttctctgtgcatatatatatatatacatatgtatatatatttaaatacacatatatattgtacagaataaaaatgttttattgaatacactgtgcttatgcgttacgtacaggctcagcttccttccagggctagatacctcttcaggattagagacaagtgaaaccccaacactgctgagccctgaatgtggaaagagcccagctggtatctcgttcaccattgtttttctctcctccacataggttcagagttccagtattgtaaccaagtattgtggcctattttccgtagttcaagtgagcagaatactgaggcctttcacgtgaaataggtagctaccctgtatttgaagagttggccacttgctagtggtcagaatagtaaggagcccacttctgtgccctggcagagatacagtgccagctacttaaagaagagtagaatttagagacaaaaggtaatctggtcccatatttttcaagtttacatagcctaaattactcttggaacaatgagggccacttgaccaaaccttagtccctgctcctgtttccatgttcatactacttgattttgacattttatgggtaaataggggccaaagtcaactgtaaatagaaactgcattttgaggagaccctggaaaagaaatatgtgacccaaagtcctatgtggcattctgcctctagagtattaaagtgatagcttccctaccactcaggctgttttataaaatgtaactggtttaacttgctactaacaagcctgtagttgaacaacttcctcctgtattaggggctaagctgtttacttcctctctatagctgctgatagagatgaaagctttgtccacaatttacttatcttttgcctgtattgtaaagaaaattttggaaaatcacatttcagtacttaataagacatctccaggaactagtgagcctctctgcaacattaatggaacatttagggggataaaaagtatataaggcagactcccaaggagtttatacatgtttatgatcccaattgtggtaatcagatctaaaattcttcactatatacattcatccaatg

SEQ ID NO: 371698 - DNA, 3025 bp, Homo sapiens
ccgcatcactcacccatcattaagatcccccacggctgcctgccctaagccctctcactgtcacaaatcgactattccaaacccattgagagacatacccactgtacggtcccaaaaacctggctgccacaaggtccccatgctggtcacctctgaggatgatgccgtcactgctgcccagcagtttgctcagtcacccaatgtcacccccatcttcacattgtccagtgtgtctggagagagtctggacctcctcaaagtctttctgaatattctgccgccactcaccaacagcaaagagcaggaggaactcatgcagcagctgacggagttccaggtggatgaaatctacacagtaccagaggtggggactgttgttggaggaacactttccagtgggatttgccgtgagggggaccagctggtggtgggccccacggatgatggctgcttcctggagctgagagtatgcagcatccagcgcaaccgctctgcctgtcgtgtgctgcgagctggtcaggctgctacactggcgcttggggactttgaccgtgcactgcttcgcaagggcatggtgatggtgagcccggagatgaatcctaccatctgctcggtgtttgaggcagagatagtcttactgttccatgccaccaccttccgacgaggattccaggtgacagtacacgtgggcaacgtacgtcagacggcagtggtggaaaagatccatgccaaggacaaactgcggacaggcgagaaggcagtggtacgtttccgcttcctgaaacacccagagtacctgaaggtgggcgccaaactgctgttccgggagggtgtcaccaagggcatcggccatgtcactgatgtacaagccattacagcaggagaagcccaggccaacatgggcttctgaacccttcaggcagggacagttctattgctgtccctacaatatataaggtgacttctggccatgctgccctgccattggcggctctgtgtgttaataggctagggagagaggggtgctgtctgccacttgctccctgccaactttctggagaggtgccaaacttggtgtggccaggaaagggcagtcctgagggagaagacaggattcagggcagtgctccgaagctgtgtgctcacctggttggctcatcaaacctggcaaccctgtggcctgtctgccggagctgactggatccactcatcaattcttcgtccccactactaagactgggcatgttttgctggtgtggtctctgcacttcaggaatggtcacaacagggggtagccctcaaaagcactcctttttctatacctcttctcaaggccatgtaagttgcccatctctacctggctgtggacaaaaggttatctgctcttggccatctggtggtggtggcggcccagagtctgaagaaatggcacagggacagtgaatggtagtgttgccaccctgtgctgaggcctgaggcctcttcctcagctttatctccctttccttcactcaagggccatttccccagtccctatctcccccatcccctcccggcttataggccccacaggtgctatttgttgtgctggcccaggcgtggggctaccaagcaaaggcttggcatataccaaaggccagctgcatgcccatcagtctggtctttttcctctgcggtcatgttggctttcatgctggatcaaatgttttactttcccagactggtggcatctgagttccccatcctaccactctcaccccactttcctgccccacctaaaccctcgttttagtaatttgtagtgactgttcccttccctctgttgcagggaaccaggaggaaagggaaagatgttgccatatttcctactctttaggcatggactctcctttccctttgttagtgtcctgggttcccatggactcagggatttgttggctaaggtttctctgtgcatatatatatatatacatatgtatatatatttaaatacacatatatattgtacagaataaaaatgttttattgaatacactgtgcttatgcgttacgtacaggctcagcttccttccagggctagatacctcttcaggattagagacaagtgaaaccccaacactgctgagccctgaatgtggaaagagcccagctggtatctcgttcaccattgtttttctctcctccacataggttcagagttccagtattgtaaccaagtattgtggcctattttccgtagttcaagtgagcagaatactgaggcctttcacgtgaaataggtagctaccctgtatttgaagagttggccacttgctagtggtcagaatagtaaggagcccacttctgtgccctggcagagatacagtgccagctacttaaagaagagtagaatttagagacaaaaggtaatctggtcccatatttttcaagtttacatagcctaaattactcttggaacaatgagggccacttgaccaaaccttagtccctgctcctgtttccatgttcatactacttgattttgacattttatgggtaaataggggccaaagtcaactgtaaatagaaactgcattttgaggagaccctggaaaagaaatatgtgacccaaagtcctatgtggcattctgcctctagagtattaaagtgatagcttccctaccactcaggctgttttataaaatgtaactggtttaacttgctactaacaagcctgtagttgaacaacttcctcctgtattaggggctaagctgtttacttcctctctatagctgctgatagagatgaaagctttgtccacaatttacttatcttttgcctgtattgtaaagaaaattttggaaaatcacatttcagtacttaataagacatctccaggaactagtgagcctctctgcaacattaatggaacatttagggggataaaaagtatataaggcagactcccaaggagtttatacatgtttatgatcccaattgtggtaatcagatctaaaattcttcactatatacattcatccaatg

SEQ ID NO: 371699 - DNA, 2445 bp, Homo sapiens
gagagtgcaagagattgaagagttcaactctgaccaagatgttgatgttggatacgagaattctctgctccccacctctaagttgcccgccaatcgaatcgataggtgggcaacgtacgtcagacggcagtggtggaaaagatccatgccaaggacaaactgcggacaggcgagaaggcagtggtacgtttccgcttcctgaaacacccagagtacctgaaggtgggcgccaaactgctgttccgggagggtgtcaccaagggcatcggccatgtcactgatgtacaagccattacagcaggagaagcccaggccaacatgggcttctgaacccttcaggcagggacagttctattgctgtccctacaatatataaggtgacttctggccatgctgccctgccattggcggctctgtgtgttaataggctagggagagaggggtgctgtctgccacttgctccctgccaactttctggagaggtgccaaacttggtgtggccaggaaagggcagtcctgagggagaagacaggattcagggcagtgctccgaagctgtgtgctcacctggttggctcatcaaacctggcaaccctgtggcctgtctgccggagctgactggatccactcatcaattcttcgtccccactactaagactgggcatgttttgctggtgtggtctctgcacttcaggaatggtcacaacagggggtagccctcaaaagcactcctttttctatacctcttctcaaggccatgtaagttgcccatctctacctggctgtggacaaaaggttatctgctcttggccatctggtggtggtggcggcccagagtctgaagaaatggcacagggacagtgaatggtagtgttgccaccctgtgctgaggcctgaggcctcttcctcagctttatctccctttccttcactcaagggccatttccccagtccctatctcccccatcccctcccggcttataggccccacaggtgctatttgttgtgctggcccaggcgtggggctaccaagcaaaggcttggcatataccaaaggccagctgcatgcccatcagtctggtctttttcctctgcggtcatgttggctttcatgctggatcaaatgttttactttcccagactggtggcatctgagttccccatcctaccactctcaccccactttcctgccccacctaaaccctcgttttagtaatttgtagtgactgttcccttccctctgttgcagggaaccaggaggaaagggaaagatgttgccatatttcctactctttaggcatggactctcctttccctttgttagtgtcctgggttcccatggactcagggatttgttggctaaggtttctctgtgcatatatatatatatacatatgtatatatatttaaatacacatatatattgtacagaataaaaatgttttattgaatacactgtgcttatgcgttacgtacaggctcagcttccttccagggctagatacctcttcaggattagagacaagtgaaaccccaacactgctgagccctgaatgtggaaagagcccagctggtatctcgttcaccattgtttttctctcctccacataggttcagagttccagtattgtaaccaagtattgtggcctattttccgtagttcaagtgagcagaatactgaggcctttcacgtgaaataggtagctaccctgtatttgaagagttggccacttgctagtggtcagaatagtaaggagcccacttctgtgccctggcagagatacagtgccagctacttaaagaagagtagaatttagagacaaaaggtaatctggtcccatatttttcaagtttacatagcctaaattactcttggaacaatgagggccacttgaccaaaccttagtccctgctcctgtttccatgttcatactacttgattttgacattttatgggtaaataggggccaaagtcaactgtaaatagaaactgcattttgaggagaccctggaaaagaaatatgtgacccaaagtcctatgtggcattctgcctctagagtattaaagtgatagcttccctaccactcaggctgttttataaaatgtaactggtttaacttgctactaacaagcctgtagttgaacaacttcctcctgtattaggggctaagctgtttacttcctctctatagctgctgatagagatgaaagctttgtccacaatttacttatcttttgcctgtattgtaaagaaaattttggaaaatcacatttcagtacttaataagacatctccaggaactagtgagcctctctgcaacattaatggaacatttagggggataaaaagtatataaggcagactcccaaggagtttatacatgtttatgatcccaattgtggtaatcagatctaaaattcttcactatatacattcatccaatg

SEQ ID NO: 371700 - DNA, 2471 bp, Homo sapiens
gtcagaaaagagggaggcctgccccagactggcagagaactccttgatcccacaatgggaataaaaccccacttagggtgggtagcggcctgataggcctctggagggtggagagccacggctggcagagaatgggacagaaggcactggccaggggagtgaccacttatttgctgcaggacaaactgcggacaggcgagaaggcagtggtacgtttccgcttcctgaaacacccagagtacctgaaggtgggcgccaaactgctgttccgggagggtgtcaccaagggcatcggccatgtcactgatgtacaagccattacagcaggagaagcccaggccaacatgggcttctgaacccttcaggcagggacagttctattgctgtccctacaatatataaggtgacttctggccatgctgccctgccattggcggctctgtgtgttaataggctagggagagaggggtgctgtctgccacttgctccctgccaactttctggagaggtgccaaacttggtgtggccaggaaagggcagtcctgagggagaagacaggattcagggcagtgctccgaagctgtgtgctcacctggttggctcatcaaacctggcaaccctgtggcctgtctgccggagctgactggatccactcatcaattcttcgtccccactactaagactgggcatgttttgctggtgtggtctctgcacttcaggaatggtcacaacagggggtagccctcaaaagcactcctttttctatacctcttctcaaggccatgtaagttgcccatctctacctggctgtggacaaaaggttatctgctcttggccatctggtggtggtggcggcccagagtctgaagaaatggcacagggacagtgaatggtagtgttgccaccctgtgctgaggcctgaggcctcttcctcagctttatctccctttccttcactcaagggccatttccccagtccctatctcccccatcccctcccggcttataggccccacaggtgctatttgttgtgctggcccaggcgtggggctaccaagcaaaggcttggcatataccaaaggccagctgcatgcccatcagtctggtctttttcctctgcggtcatgttggctttcatgctggatcaaatgttttactttcccagactggtggcatctgagttccccatcctaccactctcaccccactttcctgccccacctaaaccctcgttttagtaatttgtagtgactgttcccttccctctgttgcagggaaccaggaggaaagggaaagatgttgccatatttcctactctttaggcatggactctcctttccctttgttagtgtcctgggttcccatggactcagggatttgttggctaaggtttctctgtgcatatatatatatatacatatgtatatatatttaaatacacatatatattgtacagaataaaaatgttttattgaatacactgtgcttatgcgttacgtacaggctcagcttccttccagggctagatacctcttcaggattagagacaagtgaaaccccaacactgctgagccctgaatgtggaaagagcccagctggtatctcgttcaccattgtttttctctcctccacataggttcagagttccagtattgtaaccaagtattgtggcctattttccgtagttcaagtgagcagaatactgaggcctttcacgtgaaataggtagctaccctgtatttgaagagttggccacttgctagtggtcagaatagtaaggagcccacttctgtgccctggcagagatacagtgccagctacttaaagaagagtagaatttagagacaaaaggtaatctggtcccatatttttcaagtttacatagcctaaattactcttggaacaatgagggccacttgaccaaaccttagtccctgctcctgtttccatgttcatactacttgattttgacattttatgggtaaataggggccaaagtcaactgtaaatagaaactgcattttgaggagaccctggaaaagaaatatgtgacccaaagtcctatgtggcattctgcctctagagtattaaagtgatagcttccctaccactcaggctgttttataaaatgtaactggtttaacttgctactaacaagcctgtagttgaacaacttcctcctgtattaggggctaagctgtttacttcctctctatagctgctgatagagatgaaagctttgtccacaatttacttatcttttgcctgtattgtaaagaaaattttggaaaatcacatttcagtacttaataagacatctccaggaactagtgagcctctctgcaacattaatggaacatttagggggataaaaagtatataaggcagactcccaaggagtttatacatgtttatgatcccaattgtggtaatcagatctaaaattcttcactatatacattcatccaatg

SEQ ID NO: 371701 - DNA, 3007 bp, Homo sapiens
cagtggcagtaagggcggcggcgacggcggcggcggtcgggggaggggccgggcggggggctggcggcagcggcggatggactcgcgggtatcggagctgttcggcggctgctgccggcccggagggggcccggccgtgggcggaaccctcaaggctaggggggccggcagcagcagcggctgcggggggccaaagggaaagaagaagaacggaaggaacagagggggcaaagccaacaaccccccgtatttgccccccgaggctgaagatggaaacattgaatataaattgaagctggtgaatccatcccagtaccgctttgagcacctggtgacacaaatgaagtggcggctccaggagggacgtggtgaggccgtctaccagattggggtagaggacaatgggctgctggtggggctggctgaggaggaaatgcgagcttcgctcaagaccctgcaccggatggcagagaaggttggggcagacataaccgttcttcgagagcgagaagtggattatgatagcgacatgccccggaagatcaccgaggtgctagtacgaaaggtccctgacaaccaacagttcctagacctccgtgtggccgtcctggggaatgtggactctgggaagtcaactctgcttggagtcctgacccagggagagctggacaatgggcggggccgggctcggctcaaccttttccgccacctgcatgagattcagtctggccgaacctccagcatcagcttcgagatcctgggctttaacagcaagggagaggtggtgaattacagcgactcacggacagcagaagagatctgtgagagcagctccaagatgatcaccttcatcgacctggcaggccaccataagtacctacacaccaccatctttggcctcacatcatactgccccgactgcgccctgctcctcgtcagtgccaacactgggattgctggcaccacaagggaacatctggggctggccctggccctgaaagtgcccttcttcatcgtggtcagcaagatcgacctatgtgccaagaccacagtggagaggacagtacgccagctggagcgggtcctcaagcagcctggctgccacaaggtccccatgctggtcacctctgaggatgatgccgtcactgctgcccagcagtttgctcagtcacccaatgtcacccccatcttcacattgtccagtgtgtctggagagagtctggacctcctcaaagtctttctgaatattctgccgccactcaccaacagcaaagagcaggaggaactcatgcagcagctgacggagttccaggtggatgaaatctacacagtaccagaggtggggactgttgttggaggaacactttccagtgggatttgccgtgagggggaccagctggtggtgggccccacggatgatggctgcttcctggagctgagagtatgcagcatccagcgcaaccgctctgcctgtcgtgtgctgcgagctggtcaggctgctacactggcgcttggggactttgaccgtgcactgcttcgcaagggcatggtgatggtgagcccggagatgaatcctaccatctgctcggtgtttgaggcagagatagtcttactgttccatgccaccaccttccgacgaggattccaggtgacagtacacgtgggcaacgtacgtcagacggcagtggtggaaaagatccatgccaaggacaaactgcggacaggcgagaaggcagtggtacgtttccgcttcctgaaacacccagagtacctgaaggtgggcgccaaactgctgttccgggagggtgtcaccaagggcatcggccatgtcactgatgtacaagccattacagcaggagaagcccaggccaacatgggcttctgaacccttcaggcagggacagttctattgctgtccctacaatatataaggtgacttctggccatgctgccctgccattggcggctctgtgtgttaataggctagggagagaggggtgctgtctgccacttgctccctgccaactttctggagaggtgccaaacttggtgtggccaggaaagggcagtcctgagggagaagacaggattcagggcagtgctccgaagctgtgtgctcacctggttggctcatcaaacctggcaaccctgtggcctgtctgccggagctgactggatccactcatcaattcttcgtccccactactaagactgggcatgttttgctggtgtggtctctgcacttcaggaatggtcacaacagggggtagccctcaaaagcactcctttttctatacctcttctcaaggccatgtaagttgcccatctctacctggctgtggacaaaaggttatctgctcttggccatctggtggtggtggcggcccagagtctgaagaaatggcacagggacagtgaatggtagtgttgccaccctgtgctgaggcctgaggcctcttcctcagctttatctccctttccttcactcaagggccatttccccagtccctatctcccccatcccctcccggcttataggccccacaggtgctatttgttgtgctggcccaggcgtggggctaccaagcaaaggcttggcatataccaaaggccagctgcatgcccatcagtctggtctttttcctctgcggtcatgttggctttcatgctggatcaaatgttttactttcccagactggtggcatctgagttccccatcctaccactctcaccccactttcctgccccacctaaaccctcgttttagtaatttgtagtgactgttcccttccctctgttgcagggaaccaggaggaaagggaaagatgttgccatatttcctactctttaggcatggactctcctttccctttgttagtgtcctgggttcccatggactcagggatttgttggctaaggtttctctgtgcatatatatatatatacatatgtatatatatttaaatacacatatatattgtacagctcgtgccgaattcggcacgag

SEQ ID NO: 371702 - DNA, 3544 bp, Homo sapiens
cctgcctcaggtttatttgtacaaatagcacaggaggaccccagccccatgcagatggtagcccaggggcgggggtggggggtcgcaccagtccttctgtcctcatgttggcagagatatctactctgaagcctttgtaggggcctgggtacgtttgggagcctgagctggaactgaagctggggctgcagcctgggccttggtttgatccttggccttggccttggcctttggccggcacagcctgagccccttggcaatacgggcacgattcggggtgggcaatgtaggcaagtcgatcgagcttgcggctgacaccctttgggatcttgggcttaacctccttgggctttacgagggccttgatagcctcggcacgtgcactcatggccttggcattgttggcctgcatcttctttaggccctttttgttgtgcttcttggcaaagcgcatgttcctcaggaacttggggtccacccccttaagagattcgtatctttgtgatcggggtttcttgataccatttctgtgccattttcgggactggttgtgtgtggtgtggttcttggacttggccatgtctgcaccataagccgcggctcccgaagcgacatgccccggaagatcaccgaggtgctagtacgaaaggtccctgacaaccaacagttcctagacctccgtgtggccgtcctggggaatgtggactctgggaagtcaactctgcttggagtcctgacccagggagagctggacaatgggcggggccgggctcggctcaaccttttccgccacctgcatgagattcagtctggccgaacctccagcatcagcttcgagatcctgggctttaacagcaagggagaggtgcatgggatcaatgggacccaatggggccagactctgaggatgggatggtagtagtgaaggacataggatgggggtagagtgtggagactttttgaaatagtatagatgaatgccctgaggggactgtgaacaagctctgcccctcttaggaaatcaatggggaatcaactaaattaaataaaaaatggggtcaagattaagaggcagggtcacccagggaatggtttaggtcctggcaactctgaaggggttggaagggctggcaggaggcactgagggccctgggccctgggccaggtggtgaattacagcgactcacggacagcagaagagatctgtgagagcagctccaagatgatcaccttcatcgacctggcaggccaccataagtacctacacaccaccatctttggcctcacatcatactgccccgactgcgccctgctcctcgtcagtgccaacactgggattgctggcaccacaagggaacatctggggctggccctggccctgaaagtgcccttcttcatcgtggtcagcaagatcgacctatgtgccaagaccacagtggagaggacagtacgccagctggagcgggtcctcaagcagcctggctgccacaaggtccccatgctggtcacctctgaggatgatgccgtcactgctgcccagcagtttgctcagtcacccaatgtcacccccatcttcacattgtccagtgtgtctggagagagtctggacctcctcaaagtctttctgaatattctgccgccactcaccaacagcaaagagcaggaggaactcatgcagcagctgacggagttccaggtggatgaaatctacacagtaccagaggtggggactgttgttggaggaacactttccagattaggctttcactatcagaagagctggagaacggtagtctgttggctttggagggaagaaacagtattgctgcctattggggaatctccaggcccctgagagagaagtgtgggtcttgagctccaggaagaaaactagagtgtattcaactgacttcatctcacacagggaaatgagagacgtcacttaagactcttctttctttctttctttcttttttttgagacagagtctcgctctgttgcccaggctggattgcagtggagcgatcttggctcactgcaacctctgcctcctgggttccagcaattctcctgcctcagccttgagtagctggaattacaggcgcctaccaccatgcccggctaatttttgtatttttagtagagatggggtcgtcaccatattggccaggctggtcttgaattcctgacctcaagtgatccacctgcctcagcctccccaagtgctaggattacaggtgtgagccaacgcggctggcctaagactctgcaaagcagagaatgaaacccaaggggataacttgctccttcagtgattaggtgtcggtgttgttaaaccagcaagtgtctctctgtccaccatcactgctggccttttatgaaattagtcttctgattctgaactctggcagtgagccctgttacatccaagtcagaatttagggttcttccccacttgagggactcaaccctagaagggaaggaatgctctgggtgatcctaatagagaagtaggtatggggaccttggctgacactgtgccacctgccctctgggctgcagtgggatttgccgtgagggggaccagctggtggtgggccccacggatgatggctgcttcctggagctgagagtatgcagcatccagcgcaaccgctctgcctgtcgtgtgctgcgagctggtcaggctgctacactggcgcttggggactttgaccgtgcactgcttcgcaagggcatggtgatggtgagcccggagatgaatcctaccatctgctcggtgtttgaggcagagatagtcttactgttccatgccaccaccttccgacgaggattccaggtgacagtacacgtgggcaacgtacgtcagacggcagtggtggaaaagatccatgccaaggacaaactgcggacaggcgagaaggcagtggtacgtttccgcttcctgaaacacccagagtacctgaaggtgggcgccaaactgctgttccgggagggtgtcaccaagggcatcggccatgtcactgatgtacaagccattacagcaggagaagcccaggccaacatgggcttctgaacccttcaggcagggacagttctattgctgtccctacaatatataaggtgacttctggccatgctgccctgccattggcggctctgtgtgttaataggctagggagagaggggtgctgtctgccacttgctccctgccaactttctggagaggtgccaaacttggtgtggccaggaaagggcagtcctgagggagaagacaggattcagggcagtgctccgaagctgtgtgctcacctggttggctcatcaaacctggcaaccctgtggcctgtctgccggagctgactggatccactcatcaattcttcgtccccactactaagactgggcatgttttgctggtgtggtctctgcacttcaggaatggtcacaacagggggtagccctcaaaagcactccttcaacatggggactctagagtgactgcagctcagctgactgcgcgttcagttagaccctgcggggg

SEQ ID NO: 371703 - DNA, 3043 bp, Homo sapiens
cctgcctcaggtttatttgtacaaatagcacaggaggaccccagccccatgcagatggtagcccaggggcgggggtggggggtcgcaccagtccttctgtcctcatgttggcagagatatctactctgaagcctttgtaggggcctgggtacgtttgggagcctgagctggaactgaagctggggctgcagcctgggccttggtttgatccttggccttggccttggcctttggccggcacagcctgagccccttggcaatacgggcacgattcggggtgggcaatgtaggcaagtcgatcgagcttgcggctgacaccctttgggatcttgggcttaacctccttgggctttacgagggccttgatagcctcggcacgtgcactcatggccttggcattgttggcctgcatcttctttaggccctttttgttgtgcttcttggcaaagcgcatgttcctcaggaacttggggtccacccccttaagagattcgtatctttgtgatcggggtttcttgataccatttctgtgccattttcgggactggttgtgtgtggtgtggttcttggacttggccatgtctgcaccataagccgcggctcccgaagcgacatgccccggaagatcaccgaggtgctagtacgaaaggtccctgacaaccaacagttcctagacctccgtgtggccgtcctggggaatgtggactctgggaagtcaactctgcttggagtcctgacccagggagagctggacaatgggcggggccgggctcggctcaaccttttccgccacctgcatgagattcagtctggccgaacctccagcatcagcttcgagatcctgggctttaacagcaagggagaggtgcatgggatcaatgggacccaatggggccagactctgaggatgggatggtagtagtgaaggacataggatgggggtagagtgtggagactttttgaaatagtatagatgaatgccctgaggggactgtgaacaagctctgcccctcttaggaaatcaatggggaatcaactaaattaaataaaaaatggggtcaagattaagaggcagggtcacccagggaatggtttaggtcctggcaactctgaaggggttggaagggctggcaggaggcactgagggccctgggccctgggccaggtggtgaattacagcgactcacggacagcagaagagatctgtgagagcagctccaagatgatcaccttcatcgacctggcaggccaccataagtacctacacaccaccatctttggcctcacatcatactgccccgactgcgccctgctcctcgtcagtgccaacactgggattgctggcaccacaagggaacatctggggctggccctggccctgaaagtgcccttcttcatcgtggtcagcaagatcgacctatgtgccaagaccacagtggagaggacagtacgccagctggagcgggtcctcaagcagcctggctgccacaaggtccccatgctggtcacctctgaggatgatgccgtcactgctgcccagcagtttgctcagtcacccaatgtcacccccatcttcacattgtccagtgtgtctggagagagtctggacctcctcaaagtctttctgaatattctgccgccactcaccaacagcaaagagcaggaggaactcatgcagcagctgacggagttccaggtggatgaaatctacacagtaccagaggtggggactgttgttggaggaacactttccagattaggctttcactatcagaagagctggagaacggtagtctgttggctttggagggaagaaacagtattgctgcctattggggaatctccaggcccctgagagagaagtgtgggtcttgagctccaggaagaaaactagagtgtattcaactgacttcatctcacacagggaaatgagagacgtcacttaagactcttctttctttctttctttcttttttttgagacagagtctcgctctgttgcccaggctggattgcagtggagcgatcttggctcactgcaacctctgcctcctgggttccagcaattctcctgcctcagccttgagtagctggaattacaggcgcctaccaccatgcccggctaatttttgtatttttagtagagatggggtcgtcaccatattggccaggctggtcttgaattcctgacctcaagtgatccacctgcctcagcctccccaagtgctaggattacaggtgtgagccaacgcggctggcctaagactctgcaaagcagagaatgaaacccaaggggataacttgctccttcagtgattaggtgtcggtgttgttaaaccagcaagtgtctctctgtccaccatcactgctggccttttatgaaattagtcttctgattctgaactctggcagtgagccctgttacatccaagtcagaatttagggttcttccccacttgagggactcaaccctagaagggaaggaatgctctgggtgatcctaatagagaagtaggtatggggaccttggctgacactgtgccacctgccctctgggctgcagtgggatttgccgtgagggggaccagctggtggtgggccccacggatgatggctgcttcctggagctgagagtatgcagcatccagcgcaaccgctctgcctgtcgtgtgctgcgagctggtcaggctgctacactggcgcttggggactttgaccgtgcactgcttcgcaaggtgaggtgggtgcatgggttggggagggaacgctaagagaagtgcctaggagactggctactgaatgagcacctatctaaggtgcttcagagaaactcagaggaaacacactctctgacccaagaagcttctggtctagctacgtagactataaaaacagcttaacgtactcatgaggtacagataactaaatatgaatcactatgttacactgtttttaatgaacactatttttagtgttcaggaccctaaaaatgtgaagcgttagatgggctagaggacgtaggaggtgggtaaagactcattccc

SEQ ID NO: 371704 - DNA, 2996 bp, Homo sapiens
cctgcctcaggtttatttgtacaaatagcacaggaggaccccagccccatgcagatggtagcccaggggcgggggtggggggtcgcaccagtccttctgtcctcatgttggcagagatatctactctgaagcctttgtaggggcctgggtacgtttgggagcctgagctggaactgaagctggggctgcagcctgggccttggtttgatccttggccttggccttggcctttggccggcacagcctgagccccttggcaatacgggcacgattcggggtgggcaatgtaggcaagtcgatcgagcttgcggctgacaccctttgggatcttgggcttaacctccttgggctttacgagggccttgatagcctcggcacgtgcactcatggccttggcattgttggcctgcatcttctttaggccctttttgttgtgcttcttggcaaagcgcatgttcctcaggaacttggggtccacccccttaagagattcgtatctttgtgatcggggtttcttgataccatttctgtgccattttcgggactggttgtgtgtggtgtggttcttggacttggccatgtctgcaccataagccgcggctcccgaagcgacatgccccggaagatcaccgaggtgctagtacgaaaggtccctgacaaccaacagttcctagacctccgtgtggccgtcctggggaatgtggactctgggaagtcaactctgcttggagtcctgacccagggagagctggacaatgggcggggccgggctcggctcaaccttttccgccacctgcatgagattcagtctggccgaacctccagcatcagcttcgagatcctgggctttaacagcaagggagaggtgcatgggatcaatgggacccaatggggccagactctgaggatgggatggtagtagtgaaggacataggatgggggtagagtgtggagactttttgaaatagtatagatgaatgccctgaggggactgtgaacaagctctgcccctcttaggaaatcaatggggaatcaactaaattaaataaaaaatggggtcaagattaagaggcagggtcacccagggaatggtttaggtcctggcaactctgaaggggttggaagggctggcaggaggcactgagggccctgggccctgggccaggtggtgaattacagcgactcacggacagcagaagagatctgtgagagcagctccaagatgatcaccttcatcgacctggcaggccaccataagtacctacacaccaccatctttggcctcacatcatactgccccgactgcgccctgctcctcgtcagtgccaacactgggattgctggcaccacaagggaacatctggggctggccctggccctgaaagtgcccttcttcatcgtggtcagcaagatcgacctatgtgccaagaccacagtggagaggacagtacgccagctggagcgggtcctcaagcagcctggctgccacaaggtccccatgctggtcacctctgaggatgatgccgtcactgctgcccagcagtttgctcagtcacccaatgtcacccccatcttcacattgtccagtgtgtctggagagagtctggacctcctcaaagtctttctgaatattctgccgccactcaccaacagcaaagagcaggaggaactcatgcagcagctgacggagttccaggtggatgaaatctacacagtaccagaggtggggactgttgttggaggaacactttccagtgggatttgccgtgagggggaccagctggtggtgggccccacggatgatggctgcttcctggagctgagagtatgcagcatccagcgcaaccgctctgcctgtcgtgtgctgcgagctggtcaggctgctacactggcgcttggggactttgaccgtgcactgcttcgcaagggcatggtgatggtgagcccggagatgaatcctaccatctgctcggtgtttgaggcagagatagtcttactgttccatgccaccaccttccgacgaggattccaggtgacagtacacgtgggcaacgtacgtcagacggcagtggtggaaaagatccatgccaaggacaaactgcggacaggcgagaaggcagtggtacgtttccgcttcctgaaacacccagagtacctgaaggttcagagttccagtattgtaaccaagtattgtggcctattttccgtagttcaagtgagcagaatactgaggcctttcacgtgaaataggtagctaccctgtatttgaagagttggccacttgctagtggtcagaatagtaaggagcccacttctgtgccctggcagagatacagtgccagctacttaaagaagagtagaatttagagacaaaaggtaatctggtcccatatttttcaagtttacatagcctaaattactcttggaacaatgagggccacttgaccaaaccttagtccctgctcctgtttccatgttcatactacttgattttgacattttatgggtaaataggggccaaagtcaactgtaaatagaaactgcattttgaggagaccctggaaaagaaatatgtgacccaaagtcctatgtggcattctgcctctagagtattaaagtgatagcttccctaccactcaggctgttttataaaatgtaactggtttaacttgctactaacaagcctgtagttgaacaacttcctcctgtattaggggctaagctgtttacttcctctctatagctgctgatagagatgaaagctttgtccacaatttacttatcttttgcctgtattgtaaagaaaattttggaaaatcacatttcagtacttaataagacatctccaggaactagtgagcctctctgcaacattaatggaacatttagggggataaaaagtatataaggcagactcccaaggagtttatacatgtttatgatcccaattgtggtaatcagatctaaaattcttcactatatacattcatccaatg

SEQ ID NO: 371705 - DNA, 1379 bp, Homo sapiens
  misc_feature (28)..(28): n is a, c, g, or t
  misc_feature (59)..(59): n is a, c, g, or t
gccgacccccaacacctggaccccctgngaaaaccccgccgcgcccttgaaaccctggnaattcggcacgaggactggtggcatctgagttccccatcctaccactctcaccccactttcctgccccacctaaaccctcgttttagtaatttgtagtgactgttcccttccctctgttgcagggaaccaggaggaaagggaaagatgttgccatatttcctactctttaggcatggactctcctttccctttgttagtgtcctgggttcccatggactcagggatttgttggctaaggtttctctgtgcatatatatatatatacatatgtatatatatttaaatacacatatatattgtacagaataaaaatgttttattgaatacactgtgcttatgcgttacgtacaggctcagcttccttccagggctagatacctcttcaggattagagacaagtgaaaccccaacactgctgagccctgaatgtggaaagagcccagctggtatctcgttcaccattgtttttctctcctccacataggttcagagttccagtattgtaaccaagtattgtggcctattttccgtagttcaagtgagcagaatactgaggcctttcacgtgaaataggtagctaccctgtatttgaagagttggccacttgctagtggtcagaatagtaaggagcccacttctgtgccctggcagagatacagtgccagctacttaaagaagagtagaatttagagacaaaaggtaatctggtcccatatttttcaagtttacatagcctaaattactcttggaacaatgagggccacttgaccaaaccttagtccctgctcctgtttccatgttcatactacttgattttgacattttatgggtaaataggggccaaagtcaactgtaaatagaaactgcattttgaggagaccctggaaaagaaatatgtgacccaaagtcctatgtggcattctgcctctagagtattaaagtgatagcttccctaccactcaggctgttttataaaatgtaactggtttaacttgctactaacaagcctgtagttgaacaacttcctcctgtattaggggctaagctgtttacttcctctctatagctgctgatagagatgaaagctttgtccacaatttacttatcttttgcctgtattgtaaagaaaattttggaaaatcacatttcagtacttaataagacatctccaggaactagtgagcctctctgcaacattaatggaacatttagggggataaaaagtatataaggcagactcccaaggagtttatacatgtttatgatcccaattgtggtaatcagatctaaaattcttcactatatacattcatccaatg

SEQ ID NO: 371706 - DNA, 375 bp, Homo sapiens
ggggagggagagtctgatgttagagctgcccttcctgggcctggggtctgttcctccccagggcatggtgatggtgagcccggagatgaatcctaccatctgctcggtgtttgaggcagagatagtcttactgttccatgccaccaccttccgacgaggattccaggtgacagtacacgtgggcaacgtacgtcagacggcagtggtggaaaagatccatgccaaggtgagagggacctggccttccatttctccagaggtcagaaaagagggaggcctgccccagactggcagagaactccttgatcccacaatgggaataaaaccccacttagggtgggtagcggcctgataggcctctggagggtggagagc

SEQ ID NO: 371707 - DNA, 1618 bp, Homo sapiens
acagaggagacatagacttctgggaaaagcaggctgaagatggaaacattgaatataaattgaagctggtgaatccatcccagtaccgctttgagcacctggtgacacaaatgaagtggcggctccaggagggacgtggtgaggcctgtcacccccatcttcacattgtccagtgtgtctggagagagtctggacctcctcaaagtctttctgaatattctgccgccactcaccaacagcaaagagcaggaggaactcatgcagcagctgacggagttccaggtggatgaaatctacacagtaccagaggtggggactgttgttggaggaacactttccagtgggatttgccgtgagggggaccagctggtggtgggccccacggatgatggctgcttcctggagctgagagtatgcagcatccagcgcaaccgctctgcctgtcgtgtgctgcgagctggtcaggctgctacactggcgcttggggactttgaccgtgcactgcttcgcaagggcatggtgatggtgagcccggagatgaatcctaccatctgctcggtgtttgaggcagagatagtcttactgttccatgccaccaccttccgacgaggattccaggtgacagtacacgtgggcaacgtacgtcagacggcagtggtggaaaagatccatgccaaggacaaactgcggacaggcgagaaggcagtggtacgtttccgcttcctgaaacacccagagtacctgaaggtgggcgccaaactgctgttccgggagggtgtcaccaagggcatcggccatgtcactgatgtacaagccattacagcaggagaagcccaggccaacatgggcttctgaacccttcaggcagggacagttctattgctgtccctacaatatataaggtgacttctggccatgctgccctgccattggcggctctgtgtgttaataggctagggagagaggggtgctgtctgccacttgctccctgccaactttctggagaggtgccaaacttggtgtggccaggaaagggcagtcctgagggagaagacaggattcagggcagtgctccgaagctgtgtgctcacctggttggctcatcaaacctggcaaccctgtggcctgtctgccggagctgactggatccactcatcaattcttcgtccccactactaagactgggcatgttgtgctggcccaggcgtggggctaccaagcaaaggcttggcatataccaaaggccagctgcatgcccatcagtctggtctttttcctctgcggtcatgttggctttcatgctggatcaaatgttttactttcccagactggtggcatctgagttccccatcctaccactctcaccccactttcctgccccacctaaaccctcgttttagtaatttgtagtgactgttcccttccctctgttgcagggaaccaggaggaaagggaaagatgttgccatatttcctactctttaggcatggactctcctttccctttgttagtgtcctgggttcccatggactcagggatttgttggctaaggtttctctgtgcatatatatatatatacatatgtatatatatttaaatacacatatatattgtacag

SEQ ID NO: 371708 - DNA, 3408 bp, Homo sapiens
gtcgacgagagagagagagagagagaactagtctcggggggccaaagggaaagaagaagaacggaaggaacagagggggcaaagccaacaaccccccgtatttgccccccgaggctgaagatggaaacattgaatataaattgaagctggtgaatccatcccagtaccgctttgagcacctggtgacacaaatgaagtggcggctccaggagggacgtggtgaggccgtctaccagattggggtagaggacaatgggctgctggtggggctggctgaggaggaaatgcgagcttcgctcaagaccctgcaccggatggcagagaaggttggggcagacataaccgttcttcgagagcgagaagtggattatgatagcgacatgccccggaagatcaccgaggtgctagtacgaaaggtccctgacaaccaacagttcctagacctccgtgtggccgtcctggggaatgtggactctgggaagtcaactctgcttggagtcctgacccagggagagctggacaatgggcggggccgggctcggctcaaccttttccgccacctgcatgagattcagtctggccgaacctccagcatcagcttcgagatcctgggctttaacagcaagggagaggtggtgaattacagcgactcacggacagcagaagagatctgtgagagcagctccaagatgatcaccttcatcgacctggcaggccaccataagtacctacacaccaccatctttggcctcacatcatactgccccgactgcgccctgctcctcgtcagtgccaacactgggattgctggcaccacaagggaacatctggggctggccctggccctgaaagtgcccttcttcatcgtggtcagcaagatcgacctatgtgccaagaccacagtggagaggacagtacgccagctggagcgggtcctcaagcagcctggctgccacaaggtccccatgctggtcacctctgaggatgatgccgtcactgctgcccagcagtttgctcagtcacccaatgtcacccccatcttcacattgtccagtgtgtctggagagagtctggacctcctcaaagtctttctgaatattctgccgccactcaccaacagcaaagagcaggaggaactcatgcagcagctgacggagttccaggtggatgaaatctacacagtaccagaggtggggactgttgttggaggaacactttccagtgggatttgccgtgagggggaccagctggtggtgggccccacggatgatggctgcttcctggagctgagagtatgcagcatccagcgcaaccgctctgcctgtcgtgtgctgcgagctggtcaggctgctacactggcgcttggggactttgaccgtgcactgcttcgcaagggcatggtgatggtgagcccggagatgaatcctaccatctgctcggtgtttgaggcagagatagtcttactgttccatgccaccaccttccgacgaggattccaggtgacagtacacgtgggcaacgtacgtcagacggcagtggtggaaaagatccatgccaaggacaaactgcggacaggcgagaaggcagtggtacgtttccgcttcctgaaacacccagagtacctgaaggtgggcgccaaactgctgttccgggagggtgtcaccaagggcatcggccatgtcactgatgtacaagccattacagcaggagaagcccaggccaacatgggcttctgaacccttcaggcagggacagttctattgctgtccctacaatatataaggtgacttctggccatgctgccctgccattggcggctctgtgtgttaataggctagggagagaggggtgctgtctgccacttgctccctgccaactttctggagaggtgccaaacttggtgtggccaggaaagggcagtcctgagggagaagacaggattcagggcagtgctccgaagctgtgtgctcacctggttggctcatcaaacctggcaaccctgtggcctgtctgccggagctgactggatccactcatcaattcttcgtccccactactaagactgggcatgttttgctggtgtggtctctgcacttcaggaatggtcacaacagggggtagccctcaaaagcactcctttttctatacctcttctcaaggccatgtaagttgcccatctctacctggctgtggacaaaaggttatctgctcttggccatctggtggtggtggcggcccagagtctgaagaaatggcacagggacagtgaatggtagtgttgccaccctgtgctgaggcctgaggcctcttcctcagctttatctccctttccttcactcaagggccatttccccagtccctatctcccccatcccctcccggcttataggccccacaggtgctatttgttgtgctggcccaggcgtggggctaccaagcaaaggcttggcatataccaaaggccagctgcatgcccatcagtctggtctttttcctctgcggtcatgttggctttcatgctggatcaaatgttttactttcccagactggtggcatctgagttccccatcctaccactctcaccccactttcctgccccacctaaaccctcgttttagtaatttgtagtgactgttcccttccctctgttgcagggaaccaggaggaaagggaaagatgttgccatatttcctactctttaggcatggactctcctttccctttgttagtgtcctgggttcccatggactcagggatttgttggctaaggtttctctgtgcatatatatatatatacatatgtatatatatttaaatacacatatatattgtacagaataaaaatgttttattgaaaaaacaaaaaacacagggcggccgccctatcagcgtgccggatcaagcacgacaaacaacagcctctaatctgtcacaagagatccacaccctcgcaagaccgactgctccgctgcccactccctcaaccctagcaagggggcacccactacaccgtgggatcacccagaagggagcagacacggagggcatccataataccacaagaacgagaagcaccactgcattcaaaccaacactcacaggtgcctggcgcgcccacaatgacaactggccgggacctccccgggcacctgccgagagaattcacagcaacacggccgcgagcactacacgtggggcacaagagacgtgcacgcgaaacgggtccaccaagccgaaacctaacagcctgaacacaataccagcagcatgtcacaacaaacattgggcacctacaccacaagcgaccccacagagatccaccaccgctattatcacgtccccagacaccaagggcagaccgcacccatagaagctctggggccaagtgcacaccacgggcacataccc

SEQ ID NO: 371709 - DNA, 4807 bp, Homo sapiens
cagtggcagtaagggcggcggcgacggcggcggcggtcgggggaggggccgggcggggggctggcggcagcggcggatggactcgcgggtatcggagctgttcggcggctgctgccggcccggagggggcccggccgtgggcggaaccctcaaggctaggggggccggcagcagcagcggctgcggggggccaaagggaaagaagaagaacggaaggaacagagggggcaaagccaacaaccccccgtatttgccccccgaggctgaagatggaaacattgaatataaattgaagctggtgaatccatcccagtaccgctttgagcacctggtgacacaaatgaagtggcggctccaggagggacgtggtgaggccgtctaccagattggggtagaggacaatgggctgctggtggggctggctgaggaggaaatgcgagcttcgctcaagaccctgcaccggatggcagagaaggttggggcagacataaccgttcttcgagagcgagaagtggattatgatagcgacatgccccggaagatcaccgaggtgctagtacgaaaggtccctgacaaccaacagttcctagacctccgtgtggccgtcctggggaatgtggactctgggaagtcaactctgcttggagtcctgacccagggagagctggacaatgggcggggccgggctcggctcaaccttttccgccacctgcatgagattcagtctggccgaacctccagcatcagcttcgagatcctgggctttaacagcaagggagaggtggtgaattacagcgactcacggacagcagaagagatctgtgagagcagctccaagatgatcaccttcatcgacctggcaggccaccataagtacctacacaccaccatctttggcctcacatcatactgccccgactgcgccctgctcctcgtcagtgccaacactgggattgctggcaccacaagggaacatctggggctggccctggccctgaaagtgcccttcttcatcgtggtcagcaagatcgacctatgtgccaagaccacagtggagaggacagtacgccagctggagcgggtcctcaagcagcctggctgccacaaggtccccatgctggtcacctctgaggatgatgccgtcactgctgcccagcagtttgctcagtcacccaatgtcacccccatcttcacattgtccagtgtgtctggagagagtctggacctcctcaaagtctttctgaatattctgccgccactcaccaacagcaaagagcaggaggaactcatgcagcagctgacggagttccaggtggatgaaatctacacagtaccagaggtggggactgttgttggaggaacactttccagattaggctttcactatcagaagagctggagaacggtagtctgttggctttggagggaagaaacagtattgctgcctattggggaatctccaggcccctgagagagaagtgtgggtcttgagctccaggaagaaaactagagtgtattcaactgacttcatctcacacagggaaatgagagacgtcacttaagactcttctttctttctttctttcttttttttgagacagagtctcgctctgttgcccaggctggattgcagtggagcgatcttggctcactgcaacctctgcctcctgggttccagcaattctcctgcctcagccttgagtagctggaattacaggcgcctaccaccatgcccggctaatttttgtatttttagtagagatggggtcgtcaccatattggccaggctggtcttgaattcctgacctcaagtgatccacctgcctcagcctccccaagtgctaggattacaggtgtgagccaacgcggctggcctaagactctgcaaagcagagaatgaaacccaaggggataacttgctccttcagtgattaggtgtcggtgttgttaaaccagcaagtgtctctctgtccaccatcactgctggccttttatgaaattagtcttctgattctgaactctggcagtgagccctgttacatccaagtcagaatttagggttcttccccacttgagggactcaaccctagaagggaaggaatgctctgggtgatcctaatagagaagtaggtatggggaccttggctgacactgtgccacctgccctctgggctgcagtgggatttgccgtgagggggaccagctggtggtgggccccacggatgatggctgcttcctggagctgagagtatgcagcatccagcgcaaccgctctgcctgtcgtgtgctgcgagctggtcaggctgctacactggcgcttggggactttgaccgtgcactgcttcgcaagggcatggtgatggtgagcccggagatgaatcctaccatctgctcggtgtttgaggcagagatagtcttactgttccatgccaccaccttccgacgaggattccaggtgacagtacacgtgggcaacgtacgtcagacggcagtggtggaaaagatccatgccaaggacaaactgcggacaggcgagaaggcagtggtacgtttccgcttcctgaaacacccagagtacctgaaggtgggcgccaaactgctgttccgggagggtgtcaccaagggcatcggccatgtcactgatgtacaagccattacagcaggagaagcccaggccaacatgggcttctgaacccttcaggcagggacagttctattgctgtccctacaatatataaggtgacttctggccatgctgccctgccattggcggctctgtgtgttaataggctagggagagaggggtgctgtctgccacttgctccctgccaactttctggagaggtgccaaacttggtgtggccaggaaagggcagtcctgagggagaagacaggattcagggcagtgctccgaagctgtgtgctcacctggttggctcatcaaacctggcaaccctgtggcctgtctgccggagctgactggatccactcatcaattcttcgtccccactactaagactgggcatgttttgctggtgtggtctctgcacttcaggaatggtcacaacagggggtagccctcaaaagcactcctttttctatacctcttctcaaggccatgtaagttgcccatctctacctggctgtggacaaaaggttatctgctcttggccatctggtggtggtggcggcccagagtctgaagaaatggcacagggacagtgaatggtagtgttgccaccctgtgctgaggcctgaggcctcttcctcagctttatctccctttccttcactcaagggccatttccccagtccctatctcccccatcccctcccggcttataggccccacaggtgctatttgttgtgctggcccaggcgtggggctaccaagcaaaggcttggcatataccaaaggccagctgcatgcccatcagtctggtctttttcctctgcggtcatgttggctttcatgctggatcaaatgttttactttcccagactggtggcatctgagttccccatcctaccactctcaccccactttcctgccccacctaaaccctcgttttagtaatttgtagtgactgttcccttccctctgttgcagggaaccaggaggaaagggaaagatgttgccatatttcctactctttaggcatggactctcctttccctttgttagtgtcctgggttcccatggactcagggatttgttggctaaggtttctctgtgcatatatatatatatacatatgtatatatatttaaatacacatatatattgtacagaataaaaatgttttattgaatacactgtgcttatgcgttacgtacaggctcagcttccttccagggctagatacctcttcaggattagagacaagtgaaaccccaacactgctgagccctgaatgtggaaagagcccagctggtatctcgttcaccattgtttttctctcctccacataggttcagagttccagtattgtaaccaagtattgtggcctattttccgtagttcaagtgagcagaatactgaggcctttcacgtgaaataggtagctaccctgtatttgaagagttggccacttgctagtggtcagaatagtaaggagcccacttctgtgccctggcagagatacagtgccagctacttaaagaagagtagaatttagagacaaaaggtaatctggtcccatatttttcaagtttacatagcctaaattactcttggaacaatgagggccacttgaccaaaccttagtccctgctcctgtttccatgttcatactacttgattttgacattttatgggtaaataggggccaaagtcaactgtaaatagaaactgcattttgaggagaccctggaaaagaaatatgtgacccaaagtcctatgtggcattctgcctctagagtattaaagtgatagcttccctaccactcaggctgttttataaaatgtaactggtttaacttgctactaacaagcctgtagttgaacaacttcctcctgtattaggggctaagctgtttacttcctctctatagctgctgatagagatgaaagctttgtccacaatttacttatcttttgcctgtattgtaaagaaaattttggaaaatcacatttcagtacttaataagacatctccaggaactagtgagcctctctgcaacattaatggaacatttagggggataaaaagtatataaggcagactcccaaggagtttatacatgtttatgatcccaattgtggtaatcagatctaaaattcttcactatatacattcatccaatg

SEQ ID NO: 371710 - DNA, 4615 bp, Homo sapiens
agtgggaattgaggggaagtagggattgggtctgtacagtgtatggtaactgctcactgtttcttttcaggctgaagatggaaacattgaatataaattgaagctggtgaatccatcccagtaccgctttgagcacctggtgacacaaatgaagtggcggctccaggagggacgtggtgaggccgtctaccagattggggtagaggacaatgggctgctggtggggctggctgaggaggaaatgcgagcttcgctcaagaccctgcaccggatggcagagaaggttggggcagacataaccgttcttcgagagcgagaagtggattatgatagcgacatgccccggaagatcaccgaggtgctagtacgaaaggtccctgacaaccaacagttcctagacctccgtgtggccgtcctggggaatgtggactctgggaagtcaactctgcttggagtcctgacccagggagagctggacaatgggcggggccgggctcggctcaaccttttccgccacctgcatgagattcagtctggccgaacctccagcatcagcttcgagatcctgggctttaacagcaagggagaggtggtgaattacagcgactcacggacagcagaagagatctgtgagagcagctccaagatgatcaccttcatcgacctggcaggccaccataagtacctacacaccaccatctttggcctcacatcatactgccccgactgcgccctgctcctcgtcagtgccaacactgggattgctggcaccacaagggaacatctggggctggccctggccctgaaagtgcccttcttcatcgtggtcagcaagatcgacctatgtgccaagaccacagtggagaggacagtacgccagctggagcgggtcctcaagcagcctggctgccacaaggtccccatgctggtcacctctgaggatgatgccgtcactgctgcccagcagtttgctcagtcacccaatgtcacccccatcttcacattgtccagtgtgtctggagagagtctggacctcctcaaagtctttctgaatattctgccgccactcaccaacagcaaagagcaggaggaactcatgcagcagctgacggagttccaggtggatgaaatctacacagtaccagaggtggggactgttgttggaggaacactttccagattaggctttcactatcagaagagctggagaacggtagtctgttggctttggagggaagaaacagtattgctgcctattggggaatctccaggcccctgagagagaagtgtgggtcttgagctccaggaagaaaactagagtgtattcaactgacttcatctcacacagggaaatgagagacgtcacttaagactcttctttctttctttctttcttttttttgagacagagtctcgctctgttgcccaggctggattgcagtggagcgatcttggctcactgcaacctctgcctcctgggttccagcaattctcctgcctcagccttgagtagctggaattacaggcgcctaccaccatgcccggctaatttttgtatttttagtagagatggggtcgtcaccatattggccaggctggtcttgaattcctgacctcaagtgatccacctgcctcagcctccccaagtgctaggattacaggtgtgagccaacgcggctggcctaagactctgcaaagcagagaatgaaacccaaggggataacttgctccttcagtgattaggtgtcggtgttgttaaaccagcaagtgtctctctgtccaccatcactgctggccttttatgaaattagtcttctgattctgaactctggcagtgagccctgttacatccaagtcagaatttagggttcttccccacttgagggactcaaccctagaagggaaggaatgctctgggtgatcctaatagagaagtaggtatggggaccttggctgacactgtgccacctgccctctgggctgcagtgggatttgccgtgagggggaccagctggtggtgggccccacggatgatggctgcttcctggagctgagagtatgcagcatccagcgcaaccgctctgcctgtcgtgtgctgcgagctggtcaggctgctacactggcgcttggggactttgaccgtgcactgcttcgcaagggcatggtgatggtgagcccggagatgaatcctaccatctgctcggtgtttgaggcagagatagtcttactgttccatgccaccaccttccgacgaggattccaggtgacagtacacgtgggcaacgtacgtcagacggcagtggtggaaaagatccatgccaaggacaaactgcggacaggcgagaaggcagtggtacgtttccgcttcctgaaacacccagagtacctgaaggtgggcgccaaactgctgttccgggagggtgtcaccaagggcatcggccatgtcactgatgtacaagccattacagcaggagaagcccaggccaacatgggcttctgaacccttcaggcagggacagttctattgctgtccctacaatatataaggtgacttctggccatgctgccctgccattggcggctctgtgtgttaataggctagggagagaggggtgctgtctgccacttgctccctgccaactttctggagaggtgccaaacttggtgtggccaggaaagggcagtcctgagggagaagacaggattcagggcagtgctccgaagctgtgtgctcacctggttggctcatcaaacctggcaaccctgtggcctgtctgccggagctgactggatccactcatcaattcttcgtccccactactaagactgggcatgttttgctggtgtggtctctgcacttcaggaatggtcacaacagggggtagccctcaaaagcactcctttttctatacctcttctcaaggccatgtaagttgcccatctctacctggctgtggacaaaaggttatctgctcttggccatctggtggtggtggcggcccagagtctgaagaaatggcacagggacagtgaatggtagtgttgccaccctgtgctgaggcctgaggcctcttcctcagctttatctccctttccttcactcaagggccatttccccagtccctatctcccccatcccctcccggcttataggccccacaggtgctatttgttgtgctggcccaggcgtggggctaccaagcaaaggcttggcatataccaaaggccagctgcatgcccatcagtctggtctttttcctctgcggtcatgttggctttcatgctggatcaaatgttttactttcccagactggtggcatctgagttccccatcctaccactctcaccccactttcctgccccacctaaaccctcgttttagtaatttgtagtgactgttcccttccctctgttgcagggaaccaggaggaaagggaaagatgttgccatatttcctactctttaggcatggactctcctttccctttgttagtgtcctgggttcccatggactcagggatttgttggctaaggtttctctgtgcatatatatatatatacatatgtatatatatttaaatacacatatatattgtacagaataaaaatgttttattgaatacactgtgcttatgcgttacgtacaggctcagcttccttccagggctagatacctcttcaggattagagacaagtgaaaccccaacactgctgagccctgaatgtggaaagagcccagctggtatctcgttcaccattgtttttctctcctccacataggttcagagttccagtattgtaaccaagtattgtggcctattttccgtagttcaagtgagcagaatactgaggcctttcacgtgaaataggtagctaccctgtatttgaagagttggccacttgctagtggtcagaatagtaaggagcccacttctgtgccctggcagagatacagtgccagctacttaaagaagagtagaatttagagacaaaaggtaatctggtcccatatttttcaagtttacatagcctaaattactcttggaacaatgagggccacttgaccaaaccttagtccctgctcctgtttccatgttcatactacttgattttgacattttatgggtaaataggggccaaagtcaactgtaaatagaaactgcattttgaggagaccctggaaaagaaatatgtgacccaaagtcctatgtggcattctgcctctagagtattaaagtgatagcttccctaccactcaggctgttttataaaatgtaactggtttaacttgctactaacaagcctgtagttgaacaacttcctcctgtattaggggctaagctgtttacttcctctctatagctgctgatagagatgaaagctttgtccacaatttacttatcttttgcctgtattgtaaagaaaattttggaaaatcacatttcagtacttaataagacatctccaggaactagtgagcctctctgcaacattaatggaacatttagggggataaaaagtatataaggcagactcccaaggagtttatacatgtttatgatcccaattgtggtaatcagatctaaaattcttcactatatacattcatccaatg

SEQ ID NO: 371711 - DNA, 4947 bp, Homo sapiens
cctgcctcaggtttatttgtacaaatagcacaggaggaccccagccccatgcagatggtagcccaggggcgggggtggggggtcgcaccagtccttctgtcctcatgttggcagagatatctactctgaagcctttgtaggggcctgggtacgtttgggagcctgagctggaactgaagctggggctgcagcctgggccttggtttgatccttggccttggccttggcctttggccggcacagcctgagccccttggcaatacgggcacgattcggggtgggcaatgtaggcaagtcgatcgagcttgcggctgacaccctttgggatcttgggcttaacctccttgggctttacgagggccttgatagcctcggcacgtgcactcatggccttggcattgttggcctgcatcttctttaggccctttttgttgtgcttcttggcaaagcgcatgttcctcaggaacttggggtccacccccttaagagattcgtatctttgtgatcggggtttcttgataccatttctgtgccattttcgggactggttgtgtgtggtgtggttcttggacttggccatgtctgcaccataagccgcggctcccgaagcgacatgccccggaagatcaccgaggtgctagtacgaaaggtccctgacaaccaacagttcctagacctccgtgtggccgtcctggggaatgtggactctgggaagtcaactctgcttggagtcctgacccagggagagctggacaatgggcggggccgggctcggctcaaccttttccgccacctgcatgagattcagtctggccgaacctccagcatcagcttcgagatcctgggctttaacagcaagggagaggtgcatgggatcaatgggacccaatggggccagactctgaggatgggatggtagtagtgaaggacataggatgggggtagagtgtggagactttttgaaatagtatagatgaatgccctgaggggactgtgaacaagctctgcccctcttaggaaatcaatggggaatcaactaaattaaataaaaaatggggtcaagattaagaggcagggtcacccagggaatggtttaggtcctggcaactctgaaggggttggaagggctggcaggaggcactgagggccctgggccctgggccaggtggtgaattacagcgactcacggacagcagaagagatctgtgagagcagctccaagatgatcaccttcatcgacctggcaggccaccataagtacctacacaccaccatctttggcctcacatcatactgccccgactgcgccctgctcctcgtcagtgccaacactgggattgctggcaccacaagggaacatctggggctggccctggccctgaaagtgcccttcttcatcgtggtcagcaagatcgacctatgtgccaagaccacagtggagaggacagtacgccagctggagcgggtcctcaagcagcctggctgccacaaggtccccatgctggtcacctctgaggatgatgccgtcactgctgcccagcagtttgctcagtcacccaatgtcacccccatcttcacattgtccagtgtgtctggagagagtctggacctcctcaaagtctttctgaatattctgccgccactcaccaacagcaaagagcaggaggaactcatgcagcagctgacggagttccaggtggatgaaatctacacagtaccagaggtggggactgttgttggaggaacactttccagattaggctttcactatcagaagagctggagaacggtagtctgttggctttggagggaagaaacagtattgctgcctattggggaatctccaggcccctgagagagaagtgtgggtcttgagctccaggaagaaaactagagtgtattcaactgacttcatctcacacagggaaatgagagacgtcacttaagactcttctttctttctttctttcttttttttgagacagagtctcgctctgttgcccaggctggattgcagtggagcgatcttggctcactgcaacctctgcctcctgggttccagcaattctcctgcctcagccttgagtagctggaattacaggcgcctaccaccatgcccggctaatttttgtatttttagtagagatggggtcgtcaccatattggccaggctggtcttgaattcctgacctcaagtgatccacctgcctcagcctccccaagtgctaggattacaggtgtgagccaacgcggctggcctaagactctgcaaagcagagaatgaaacccaaggggataacttgctccttcagtgattaggtgtcggtgttgttaaaccagcaagtgtctctctgtccaccatcactgctggccttttatgaaattagtcttctgattctgaactctggcagtgagccctgttacatccaagtcagaatttagggttcttccccacttgagggactcaaccctagaagggaaggaatgctctgggtgatcctaatagagaagtaggtatggggaccttggctgacactgtgccacctgccctctgggctgcagtgggatttgccgtgagggggaccagctggtggtgggccccacggatgatggctgcttcctggagctgagagtatgcagcatccagcgcaaccgctctgcctgtcgtgtgctgcgagctggtcaggctgctacactggcgcttggggactttgaccgtgcactgcttcgcaagggcatggtgatggtgagcccggagatgaatcctaccatctgctcggtgtttgaggcagagatagtcttactgttccatgccaccaccttccgacgaggattccaggtgacagtacacgtgggcaacgtacgtcagacggcagtggtggaaaagatccatgccaaggacaaactgcggacaggcgagaaggcagtggctagggagagaggggtgctgtctgccacttgctccctgccaactttctggagaggtgccaaacttggtgtggccaggaaagggcagtcctgagggagaagacaggattcagggcagtgctccgaagctgtgtgctcacctggttggctcatcaaacctggcaaccctgtggcctgtctgccggagctgactggatccactcatcaattcttcgtccccactactaagactgggcatgttttgctggtgtggtctctgcacttcaggaatggtcacaacagggggtagccctcaaaagcactcctttttctatacctcttctcaaggccatgtaagttgcccatctctacctggctgtggacaaaaggttatctgctcttggccatctggtggtggtggcggcccagagtctgaagaaatggcacagggacagtgaatggtagtgttgccaccctgtgctgaggcctgaggcctcttcctcagctttatctccctttccttcactcaagggccatttccccagtccctatctcccccatcccctcccggcttataggccccacaggtgctatttgttgtgctggcccaggcgtggggctaccaagcaaaggcttggcatataccaaaggccagctgcatgcccatcagtctggtctttttcctctgcggtcatgttggctttcatgctggatcaaatgttttactttcccagactggtggcatctgagttccccatcctaccactctcaccccactttcctgccccacctaaaccctcgttttagtaatttgtagtgactgttcccttccctctgttgcagggaaccaggaggaaagggaaagatgttgccatatttcctactctttaggcatggactctcctttccctttgttagtgtcctgggttcccatggactcagggatttgttggctaaggtttctctgtgcatatatatatatatacatatgtatatatatttaaatacacatatatattgtacagaataaaaatgttttattgaatacactgtgcttatgcgttacgtacaggctcagcttccttccagggctagatacctcttcaggattagagacaagtgaaaccccaacactgctgagccctgaatgtggaaagagcccagctggtatctcgttcaccattgtttttctctcctccacataggttcagagttccagtattgtaaccaagtattgtggcctattttccgtagttcaagtgagcagaatactgaggcctttcacgtgaaataggtagctaccctgtatttgaagagttggccacttgctagtggtcagaatagtaaggagcccacttctgtgccctggcagagatacagtgccagctacttaaagaagagtagaatttagagacaaaaggtaatctggtcccatatttttcaagtttacatagcctaaattactcttggaacaatgagggccacttgaccaaaccttagtccctgctcctgtttccatgttcatactacttgattttgacattttatgggtaaataggggccaaagtcaactgtaaatagaaactgcattttgaggagaccctggaaaagaaatatgtgacccaaagtcctatgtggcattctgcctctagagtattaaagtgatagcttccctaccactcaggctgttttataaaatgtaactggtttaacttgctactaacaagcctgtagttgaacaacttcctcctgtattaggggctaagctgtttacttcctctctatagctgctgatagagatgaaagctttgtccacaatttacttatcttttgcctgtattgtaaagaaaattttggaaaatcacatttcagtacttaataagacatctccaggaactagtgagcctctctgcaacattaatggaacatttagggggataaaaagtatataaggcagactcccaaggagtttatacatgtttatgatcccaattgtggtaatcagatctaaaattcttcactatatacattcatccaatg

SEQ ID NO: 371712 - DNA, 2367 bp, Homo sapiens
gtggtgatctagaggatcccttcgatggtgggcaacgtacgtcagacggcagtggtggaaaagatccatgccaaggacaaactgcggacaggcgagaaggcagtggtacgtttccgcttcctgaaacacccagagtacctgaaggtgggcgccaaactgctgttccgggagggtgtcaccaagggcatcggccatgtcactgatgtacaagccattacagcaggagaagcccaggccaacatgggcttctgaacccttcaggcagggacagttctattgctgtccctacaatatataaggtgacttctggccatgctgccctgccattggcggctctgtgtgttaataggctagggagagaggggtgctgtctgccacttgctccctgccaactttctggagaggtgccaaacttggtgtggccaggaaagggcagtcctgagggagaagacaggattcagggcagtgctccgaagctgtgtgctcacctggttggctcatcaaacctggcaaccctgtggcctgtctgccggagctgactggatccactcatcaattcttcgtccccactactaagactgggcatgttttgctggtgtggtctctgcacttcaggaatggtcacaacagggggtagccctcaaaagcactcctttttctatacctcttctcaaggccatgtaagttgcccatctctacctggctgtggacaaaaggttatctgctcttggccatctggtggtggtggcggcccagagtctgaagaaatggcacagggacagtgaatggtagtgttgccaccctgtgctgaggcctgaggcctcttcctcagctttatctccctttccttcactcaagggccatttccccagtccctatctcccccatcccctcccggcttataggccccacaggtgctatttgttgtgctggcccaggcgtggggctaccaagcaaaggcttggcatataccaaaggccagctgcatgcccatcagtctggtctttttcctctgcggtcatgttggctttcatgctggatcaaatgttttactttcccagactggtggcatctgagttccccatcctaccactctcaccccactttcctgccccacctaaaccctcgttttagtaatttgtagtgactgttcccttccctctgttgcagggaaccaggaggaaagggaaagatgttgccatatttcctactctttaggcatggactctcctttccctttgttagtgtcctgggttcccatggactcagggatttgttggctaaggtttctctgtgcatatatatatatatacatatgtatatatatttaaatacacatatatattgtacagaataaaaatgttttattgaatacactgtgcttatgcgttacgtacaggctcagcttccttccagggctagatacctcttcaggattagagacaagtgaaaccccaacactgctgagccctgaatgtggaaagagcccagctggtatctcgttcaccattgtttttctctcctccacataggttcagagttccagtattgtaaccaagtattgtggcctattttccgtagttcaagtgagcagaatactgaggcctttcacgtgaaataggtagctaccctgtatttgaagagttggccacttgctagtggtcagaatagtaaggagcccacttctgtgccctggcagagatacagtgccagctacttaaagaagagtagaatttagagacaaaaggtaatctggtcccatatttttcaagtttacatagcctaaattactcttggaacaatgagggccacttgaccaaaccttagtccctgctcctgtttccatgttcatactacttgattttgacattttatgggtaaataggggccaaagtcaactgtaaatagaaactgcattttgaggagaccctggaaaagaaatatgtgacccaaagtcctatgtggcattctgcctctagagtattaaagtgatagcttccctaccactcaggctgttttataaaatgtaactggtttaacttgctactaacaagcctgtagttgaacaacttcctcctgtattaggggctaagctgtttacttcctctctatagctgctgatagagatgaaagctttgtccacaatttacttatcttttgcctgtattgtaaagaaaattttggaaaatcacatttcagtacttaataagacatctccaggaactagtgagcctctctgcaacattaatggaacatttagggggataaaaagtatataaggcagactcccaaggagtttatacatgtttatgatcccaattgtggtaatcagatctaaaattcttcactatatacattcatccaatg

SEQ ID NO: 371713 - DNA, 2493 bp, Homo sapiens
ggatcccttcgattgggggcacttagaggtggggagcagagaatctcttatccaacatcaacatctggtcagattgaactcttcaatctcttgcactcaaagcttgttaagatagttaagcgtgcataagttgcccgccaatcgaatcgataggtgggcaacgtacgtcagacggcagtggtggaaaagatccatgccaaggacaaactgcggacaggcgagaaggcagtggtacgtttccgcttcctgaaacacccagagtacctgaaggtgggcgccaaactgctgttccgggagggtgtcaccaagggcatcggccatgtcactgatgtacaagccattacagcaggagaagcccaggccaacatgggcttctgaacccttcaggcagggacagttctattgctgtccctacaatatataaggtgacttctggccatgctgccctgccattggcggctctgtgtgttaataggctagggagagaggggtgctgtctgccacttgctccctgccaactttctggagaggtgccaaacttggtgtggccaggaaagggcagtcctgagggagaagacaggattcagggcagtgctccgaagctgtgtgctcacctggttggctcatcaaacctggcaaccctgtggcctgtctgccggagctgactggatccactcatcaattcttcgtccccactactaagactgggcatgttttgctggtgtggtctctgcacttcaggaatggtcacaacagggggtagccctcaaaagcactcctttttctatacctcttctcaaggccatgtaagttgcccatctctacctggctgtggacaaaaggttatctgctcttggccatctggtggtggtggcggcccagagtctgaagaaatggcacagggacagtgaatggtagtgttgccaccctgtgctgaggcctgaggcctcttcctcagctttatctccctttccttcactcaagggccatttccccagtccctatctcccccatcccctcccggcttataggccccacaggtgctatttgttgtgctggcccaggcgtggggctaccaagcaaaggcttggcatataccaaaggccagctgcatgcccatcagtctggtctttttcctctgcggtcatgttggctttcatgctggatcaaatgttttactttcccagactggtggcatctgagttccccatcctaccactctcaccccactttcctgccccacctaaaccctcgttttagtaatttgtagtgactgttcccttccctctgttgcagggaaccaggaggaaagggaaagatgttgccatatttcctactctttaggcatggactctcctttccctttgttagtgtcctgggttcccatggactcagggatttgttggctaaggtttctctgtgcatatatatatatatacatatgtatatatatttaaatacacatatatattgtacagaataaaaatgttttattgaatacactgtgcttatgcgttacgtacaggctcagcttccttccagggctagatacctcttcaggattagagacaagtgaaaccccaacactgctgagccctgaatgtggaaagagcccagctggtatctcgttcaccattgtttttctctcctccacataggttcagagttccagtattgtaaccaagtattgtggcctattttccgtagttcaagtgagcagaatactgaggcctttcacgtgaaataggtagctaccctgtatttgaagagttggccacttgctagtggtcagaatagtaaggagcccacttctgtgccctggcagagatacagtgccagctacttaaagaagagtagaatttagagacaaaaggtaatctggtcccatatttttcaagtttacatagcctaaattactcttggaacaatgagggccacttgaccaaaccttagtccctgctcctgtttccatgttcatactacttgattttgacattttatgggtaaataggggccaaagtcaactgtaaatagaaactgcattttgaggagaccctggaaaagaaatatgtgacccaaagtcctatgtggcattctgcctctagagtattaaagtgatagcttccctaccactcaggctgttttataaaatgtaactggtttaacttgctactaacaagcctgtagttgaacaacttcctcctgtattaggggctaagctgtttacttcctctctatagctgctgatagagatgaaagctttgtccacaatttacttatcttttgcctgtattgtaaagaaaattttggaaaatcacatttcagtacttaataagacatctccaggaactagtgagcctctctgcaacattaatggaacatttagggggataaaaagtatataaggcagactcccaaggagtttatacatgtttatgatcccaattgtggtaatcagatctaaaattcttcactatatacattcatccaatg

SEQ ID NO: 371714 - DNA, 4176 bp, Homo sapiens
cctgcctcaggtttatttgtacaaatagcacaggaggaccccagccccatgcagatggtagcccaggggcgggggtggggggtcgcaccagtccttctgtcctcatgttggcagagatatctactctgaagcctttgtaggggcctgggtacgtttgggagcctgagctggaactgaagctggggctgcagcctgggccttggtttgatccttggccttggccttggcctttggccggcacagcctgagccccttggcaatacgggcacgattcggggtgggcaatgtaggcaagtcgatcgagcttgcggctgacaccctttgggatcttgggcttaacctccttgggctttacgagggccttgatagcctcggcacgtgcactcatggccttggcattgttggcctgcatcttctttaggccctttttgttgtgcttcttggcaaagcgcatgttcctcaggaacttggggtccacccccttaagagattcgtatctttgtgatcggggtttcttgataccatttctgtgccattttcgggactggttgtgtgtggtgtggttcttggacttggccatgtctgcaccataagccgcggctcccgaagcgacatgccccggaagatcaccgaggtgctagtacgaaaggtccctgacaaccaacagttcctagacctccgtgtggccgtcctggggaatgtggactctgggaagtcaactctgcttggagtcctgacccagggagagctggacaatgggcggggccgggctcggctcaaccttttccgccacctgcatgagattcagtctggccgaacctccagcatcagcttcgagatcctgggctttaacagcaagggagaggtgcatgggatcaatgggacccaatggggccagactctgaggatgggatggtagtagtgaaggacataggatgggggtagagtgtggagactttttgaaatagtatagatgaatgccctgaggggactgtgaacaagctctgcccctcttaggaaatcaatggggaatcaactaaattaaataaaaaatggggtcaagattaagaggcagggtcacccagggaatggtttaggtcctggcaactctgaaggggttggaagggctggcaggaggcactgagggccctgggccctgggccaggtggtgaattacagcgactcacggacagcagaagagatctgtgagagcagctccaagatgatcaccttcatcgacctggcaggccaccataagtacctacacaccaccatctttggcctcacatcatactgccccgactgcgccctgctcctcgtcagtgccaacactgggattgctggcaccacaagggaacatctggggctggccctggccctgaaagtgcccttcttcatcgtggtcagcaagatcgacctatgtgccaagaccacagtggagaggacagtacgccagctggagcgggtcctcaagcagcctggctgccacaaggtccccatgctggtcacctctgaggatgatgccgtcactgctgcccagcagtttgctcagtcacccaatgtcacccccatcttcacattgtccagtgtgtctggagagagtctggacctcctcaaagtctttctgaatattctgccgccactcaccaacagcaaagagcaggaggaactcatgcagcagctgacggagttccaggtggatgaaatctacacagtaccagaggtggggactgttgttggaggaacactttccagattaggctttcactatcagaagagctggagaacggtagtctgttggctttggagggaagaaacagtattgctgcctattggggaatctccaggcccctgagagagaagtgtgggtcttgagctccaggaagaaaactagagtgtattcaactgacttcatctcacacagggaaatgagagacgtcacttaagactcttctttctttctttctttcttttttttgagacagagtctcgctctgttgcccaggctggattgcagtggagcgatcttggctcactgcaacctctgcctcctgggttccagcaattctcctgcctcagccttgagtagctggaattacaggcgcctaccaccatgcccggctaatttttgtatttttagtagagatggggtcgtcaccatattggccaggctggtcttgaattcctgacctcaagtgatccacctgcctcagcctccccaagtgctaggattacaggtgtgagccaacgcggctggcctaagactctgcaaagcagagaatgaaacccaaggggataacttgctccttcagtgattaggtgtcggtgttgttaaaccagcaagtgtctctctgtccaccatcactgctggccttttatgaaattagtcttctgattctgaactctggcagtgagccctgttacatccaagtcagaatttagggttcttccccacttgagggactcaaccctagaagggaaggaatgctctgggtgatcctaatagagaagtaggtatggggaccttggctgacactgtgccacctgccctctgggctgcagtgggatttgccgtgagggggaccagctggtggtgggccccacggatgatggctgcttcctggagctgagagtatgcagcatccagcgcaaccgctctgcctgtcgtgtgctgcgagctggtcaggctgctacactggcgcttggggactttgaccgtgcactgcttcgcaagggcatggtgatggtgagcccggagatgaatcctaccatctgctcggtgtttgaggcagagatagtcttactgttccatgccaccaccttccgacgaggattccaggtgacagtacacgtgggcaacgtacgtcagacggcagtggtggaaaagatccatgccaaggacaaactgcggacaggcgagaaggcagtggtacgtttccgcttcctgaaacacccagagtacctgaaggtgggcgccaaactgctgttccgggagggtgtcaccaagggcatcggccatgtcactgatgtacaagccattacagcaggagaagcccaggccaacatgggcttctgaacccttcaggcagggacagttctattgctgtccctacaatatataaggtgacttctggccatgctgccctgccattggcggctctgtgtgttaataggctagggagagaggggtgctgtctgccacttgctccctgccaactttctggagaggtgccaaacttggtgtggccaggaaagggcagtcctgagggagaagacaggattcagggcagtgctccgaagctgtgtgctcacctggttggctcatcaaacctggcaaccctgtggcctgtctgccggagctgactggatccactcatcaattcttcgtccccactactaagactgggcatgttttgctggtgtggtctctgcacttcaggaatggtcacaacagggggtagccctcaaaagcactcctttttctatacctcttctcaaggccatgtaagttgcccatctctacctggctgtggacaaaaggttatctgctcttggccatctggtggtggtggcggcccagagtctgaagaaatggcacagggacagtgaatggtagtgttgccaccctgtgctgaggcctgaggcctcttcctcagctttatctccctttccttcactcaagggccatttccccagtccctatctcccccatcccctcccggcttataggccccacaggtgctatttgttgtgctggcccaggcgtggggctaccaagcaaaggcttggcatataccaaaggccagctgcatgcccatcagtctggtctttttcctctgcggtcatgttggctttcatgctggatcaaatgttttactttcccagactggtggcatctgagttccccatcctaccactctcaccccactttcctgccccacctaaaccctcgttttagtaatttgtagtgactgttcccttccctctgttgcagggaaccaggaggaaagggaaagatgttgccatatttcctactctttaggcatggactctcctttccctttgttagtgtcctgggttcccatggactcagggatttgttggctaaggtttctctgtgcatatatatatatatacatatgtatatatatttaaatacacatatatattgtacag

SEQ ID NO: 371715 - DNA, 3252 bp, Homo sapiens
cctgcctcaggtttatttgtacaaatagcacaggaggaccccagccccatgcagatggtagcccaggggcgggggtggggggtcgcaccagtccttctgtcctcatgttggcagagatatctactctgaagcctttgtaggggcctgggtacgtttgggagcctgagctggaactgaagctggggctgcagcctgggccttggtttgatccttggccttggccttggcctttggccggcacagcctgagccccttggcaatacgggcacgattcggggtgggcaatgtaggcaagtcgatcgagcttgcggctgacaccctttgggatcttgggcttaacctccttgggctttacgagggccttgatagcctcggcacgtgcactcatggccttggcattgttggcctgcatcttctttaggccctttttgttgtgcttcttggcaaagcgcatgttcctcaggaacttggggtccacccccttaagagattcgtatctttgtgatcggggtttcttgataccatttctgtgccattttcgggactggttgtgtgtggtgtggttcttggacttggccatgtctgcaccataagccgcggctcccgaagcgacatgccccggaagatcaccgaggtgctagtacgaaaggtccctgacaaccaacagttcctagacctccgtgtggccgtcctggggaatgtggactctgggaagtcaactctgcttggagtcctgacccagggagagctggacaatgggcggggccgggctcggctcaaccttttccgccacctgcatgagattcagtctggccgaacctccagcatcagcttcgagatcctgggctttaacagcaagggagaggtgcatgggatcaatgggacccaatggggccagactctgaggatgggatggtagtagtgaaggacataggatgggggtagagtgtggagactttttgaaatagtatagatgaatgccctgaggggactgtgaacaagctctgcccctcttaggaaatcaatggggaatcaactaaattaaataaaaaatggggtcaagattaagaggcagggtcacccagggaatggtttaggtcctggcaactctgaaggggttggaagggctggcaggaggcactgagggccctgggccctgggccaggtggtgaattacagcgactcacggacagcagaagagatctgtgagagcagctccaagatgatcaccttcatcgacctggcaggccaccataagtacctacacaccaccatctttggcctcacatcatactgccccgactgcgccctgctcctcgtcagtgccaacactgggattgctggcaccacaagggaacatctggggctggccctggccctgaaagtgcccttcttcatcgtggtcagcaagatcgacctatgtgccaagaccacagtggagaggacagtacgccagctggagcgggtcctcaagcagcctggctgccacaaggtccccatgctggtcacctctgaggatgatgccgtcactgctgcccagcagtttgctcagtcacccaatgtcacccccatcttcacattgtccagtgtgtctggagagagtctggacctcctcaaagtctttctgaatattctgccgccactcaccaacagcaaagagcaggaggaactcatgcagcagctgacggagttccaggtggatgaaatctacacagtaccagaggtggggactgttgttggaggaacactttccagattaggctttcactatcagaagagctggagaacggtagtctgttggctttggagggaagaaacagtattgctgcctattggggaatctccaggcccctgagagagaagtgtgggtcttgagctccaggaagaaaactagagtgtattcaactgacttcatctcacacagggaaatgagagacgtcacttaagactcttctttctttctttctttcttttttttgagacagagtctcgctctgttgcccaggctggattgcagtggagcgatcttggctcactgcaacctctgcctcctgggttccagcaattctcctgcctcagccttgagtagctggaattacaggcgcctaccaccatgcccggctaatttttgtatttttagtagagatggggtcgtcaccatattggccaggctggtcttgaattcctgacctcaagtgatccacctgcctcagcctccccaagtgctaggattacaggtgtgagccaacgcggctggcctaagactctgcaaagcagagaatgaaacccaaggggataacttgctccttcagtgattaggtgtcggtgttgttaaaccagcaagtgtctctctgtccaccatcactgctggccttttatgaaattagtcttctgattctgaactctggcagtgagccctgttacatccaagtcagaatttagggttcttccccacttgagggactcaaccctagaagggaaggaatgctctgggtgatcctaatagagaagtaggtatggggaccttggctgacactgtgccacctgccctctgggctgcagtgggatttgccgtgagggggaccagctggtggtgggccccacggatgatggctgcttcctggagctgagagtatgcagcatccagcgcaaccgctctgcctgtcgtgtgctgcgagctggtcaggctgctacactggcgcttggggactttgaccgtgcactgcttcgcaagggcatggtgatggtgagcccggagatgaatcctaccatctgctcggtgtttgaggcagagatagtcttactgttccatgccaccaccttccgacgaggattccaggtgacagtacacgtgggcaacgtacgtcagacggcagtggtggaaaagatccatgccaaggacaaactgcggacaggcgagaaggcagtggtacgtttccgcttcctgaaacacccagagtacctgaaggttcagagttccagtattgtaaccaagtattgtggcctattttccgtagttcaagtgagcagaatactgaggcctttcacgtgaaataggtagctaccctgtatttgaagagttggccacttgctagtggtcagaatagtaaggagcccacttctgtgccctggcagagatacagtgccagctacttaaagaagagtagaatttagagacaaaaggtaaagagcagctgatatgtaaattgcaaagcccaccccaggaataaagaaagaaaatcttacatcatt

SEQ ID NO: 371716 - DNA, 388 bp, Homo sapiens
cccttgacccagtcttcagttagaggggtgagagattggagttcttatctctggcaattcatccacagttcctagacctccgtgtggccgtcctggggaatgtggactctgggaagtcaactctgcttggagtcctgacccagggagagctggacaatgggcggggccgggctcggctcaaccttttccgccacctgcatgagattcagtctggccgaacctccagcatcagcttcgagatcctgggctttaacagcaagggagaggtgcatgggatcaatgggacccaatggggccagactctgaggatgggatggtagtagtgaaggacataggatgggggtagagtgtggagactttttgaaatagtatagatgaatgccctgag

SEQ ID NO: 371717 - DNA, 555 bp, Homo sapiens
catctctaaaaaaaattttttttaaataaataactaacagtaaccttaaaatgaaattatggttcttaatgatagtggcttgttacatctcttatagccccacataggttagatttttcaatataaaattagaggataggcacattctttctttttagatgcttaagaaattacctcacataaacattttaccatttaaaaaatgatgtttaccagtccatttcagttcttcaactgaggtccattgtaaaatatactacttttgctgtataccaagctacagttgtagatattgattcaagtaaaggtgatacttcctcttccagttgatttttatactcttaatttgtgtatacatacattttcacacatgaatatgtgtgtgtaagagacagagtgcattcatttgcacccagggttggaggaaagaagagaaagaaatgagaatatgtatattggagatacttggctatttgtacctcacctgcccatgaaggctaaaaatggatggttaaacacctgtctctgtgctcatgatgaaaatgacctttgcaa

SEQ ID NO: 371718 - DNA, 257 bp, Homo sapiens
tttatgaaaggatatgaaaaattagcatatcctttacaaacccagattggcatttagaattgaggaaaggtgtgtaacatcaatttacttattttggttaagcaaattctatcaaataataatatgtgcagttagtatctcctgttccacctcgtagctgctttacctaaaccatgcattgacacgtacctccaaggcctcaaagtgcccacagtgtgtgctcccacagcattaaaatgcacccccttaacatttta

SEQ ID NO: 371719 - DNA, 253 bp, Homo sapiens
acccttcccacaacacagactatttttcaaatagaaataaacatatggatgtgaaactgcttgaaaagaatttttttaaatataataaatgaaacaactagacagaagataaggaaataggggacttaaacgacacaataaatcaactaggtttaacatacatgtatagaacactctagtaaacaacaatagcattcacattcttctcaagaacacatgggacattttccaagatagaccatatgttaggcag

SEQ ID NO: 371720 - DNA, 1565 bp, Homo sapiens
gaggaacttggctgggcctaaactcaatccgtggtctggtacaggtttcagggcaaagcggccatgcgttccgggggccgcgggcgaccccgcctgcggctgggggaacgtggcctcatggagccactcttgccgccgaagcgccgcctgctaccgcgggttcggctcttgcctctgttgctggcgctggccgtgggctcggcgttctacaccatttggagcggctggcaccgcaggactgaggagctgccgctgggccgggagctgcgggtcccattgatcggaagcctccccgaagcccggctgcggagggtggtgggacaactggatccacagcgtctctggagcacttatctgcgccccctgctggttgtgcgaaccccgggcagcccgggaaatctccaagtcagaaagttcctggaggccacgctgcggtccctgacagcaggttggcacgtggagctggatcccttcacagcctcaacacccctggggccagtggactttggcaatgtggtggccacactggacccaagggctgcccgtcacctcacccttgcctgccattatgactcgaagctcttcccacccggatcgaccccctttgtaggggccacggattcggctgtgccctgtgccctgctgctggagctggcccaagcacttgacctggagctgagcagggccaaaaaacaggcagccccggtgaccctgcaactgctcttcttggatggtgaagaggcgctgaaggagtggggacccaaggactccctttacggttcccggcacctggcccagctcatggagtctatacctcacagccccggccccaccaggatccaggctattgagctctttatgcttcttgatctcctgggagcccccaatcccaccttctacagccacttccctcgcacggtccgctggttccatcggctgaggagcattgagaagcgtctgcaccgtttgaacctgctgcagtctcatccccaggaagtgatgtacttccaacccggggagccctttggctctgtggaagacgaccacatccccttcctccgcagaggggtacccgtgctccatctcatctccacgcccttccctgctgtctggcacacccctgcggacaccgaggtcaatctccacccacccacggtacacaacttgtgccgcattctcgctgtgttcctggctgaatacctggggctctagcgtgcttggccaatgactgtggagaggactgtgagagagaaggtcccagcgggggccagtgaagctcaggcaggatctgcctagggtgtgctggtttgtccttttcatacctttgtctcctaattgtgctacaattggaagaccttctttcttttgattgtctcaagctgccacccttcaaggacagggaagagaccactgtgggatgacagccagaggaataagaacttgctccctccccagaggtaaacacttggtccaaaggtttgcagggcctgggcaacagagcgagactccatctcaataaataaataaataaataaatattttttaaaaagagtaaaagactaaaa

SEQ ID NO: 371721 - DNA, 1599 bp, Homo sapiens
gaggaacttggctgggcctaaactcaatccgtggtctggtacaggtttcagggcaaagcggccatgcgttccgggggccgcgggcgaccccgcctgcggctgggggaacgtggcctcatggagccactcttgccgccgaagcgccgcctgctaccgcgggttcggctcttgcctctgttgctggcgctggccgtgggctcggcgttctacaccatttggagcggctggcaccgcaggactgaggagctgccgctgggccgggagctgcgggtcccattgatcggaagcctccccgaagcccggctgcggagggtggtgggacaactggatccacagcgtctctggagcacttatctgcgccccctgctggttgtgcgaaccccgggcagcccgggaaatctccaagtcagaaagttcctggaggccacgctgcggtccctgacagcaggttggcacgtggagctggatcccttcacagcctcaacacccctggggccagtggactttggcaatgtggtggccacactggacccaagggctgcccgtcacctcacccttgcctgccattatgactcgaagctcttcccacccggatcgaccccctttgtaggggccacggattcggctgtgccctgtgccctgctgctggagctggcccaagcacttgacctggagctgagcagggccaaaaaacaggcagccccggtgaccctgcaactgctcttcttggatggtgaagaggcgctgaaggagtggggacccaaggactccctttacggttcccggcacctggcccagctcatggagtctatacctcacagccccggccccaccaggatccaggctattgagctctttatgcttcttgatctcctgggagcccccaatcccaccttctacagccacttccctcgcacggtccgctggttccatcggctgaggagcattgagaagcgtctgcaccgtttgaacctgctgcagtctcatccccaggaagtgatgtacttccaacccggggagccctttggctctgtggaagacgaccacatccccttcctccgcagaggggtacccgtgctccatctcatctccacgcccttccctgctgtctggcacacccctgcggacaccgaggtcaatctccacccacccacggtacacaacttgtgccgcattctcgctgtgttcctggctgaatacctggggctctagcgtgcttggccaatgactgtggagaggactgtgagagagaaggtcccagcgggggccagtgaagctcaggcaggatctgcctagggtgtgctggtttgtccttttcatacctttgtctcctaattgtgctacaattggaagaccttctttcttttgattgtctcaagctgccacccttcaaggacagggaagagaccactgtgggatgacagccagaggaataagaacttgctccctccccagaggtaaacacttggtccaaaggtttgcagggaccaaatactgttttttttttttttgagacggagcctgggcaacagagcgagactccatctcaataaataaataaataaataaatattttttaaaaagagtaaaagactaaaa

SEQ ID NO: 371722 - DNA, 479 bp, Homo sapiens
caagtagctgggattacaggcgcccaccaccacacccagctaatttttgtatttttagtagagacagggtttcaccatgttggccaagctggtttcgaactcctgacctcaggtgatccacctgccttggtctccctaagtgctgggattacaggcatgagccaccacaccaggccacaagatcttgtctcaaaaaaaagaatgtctatgtcttagactctgagggattgaatgagaccaggaacatagtgagcccacaggaaggagtaactggcattcactcttgttgggctgaccagggctttgtctctgggtgctctgccttcctctgatttgtggactggggaccttcgactactaaggactaacccttcctctctaatcgcccccacttccagagaagcgtctgcaccgtttgaacctgctgcagtctcatccccaggaagtgatgtacttccaacccggggagccctttggct

SEQ ID NO: 371723 - DNA, 291 bp, Homo sapiens
gcaaggttacctagaggttgggcttgggctcctgggttgtggtgggctgcagtggacctgacaaagtctcctctgtcacttcaggggtacccgtgctccatctcatctccacgcccttccctgctgtctggcacacccctgcggacaccgaggtcaatctccacccacccacggtacacaacttgtgccgcattctcgctgtgttcctggctgaatacctggggctctagcgtgcttggccaatgactgtggagaggactgtgagagagaaggtcccagcgggggccagtg

SEQ ID NO: 371724 - DNA, 1221 bp, Homo sapiens
gaggaacttggctgggcctaaactcaatccgtggtctggtacaggtttcagggcaaagcggccatgcgttccgggggccgcgggcgaccccgcctgcggctgggggaacgtggcctcatggagccactcttgccgccgaagcgccgcctgctaccgcgggttcggctcttgcctctgttgctggcgctggccgtgggctcggcgttctacaccatttggagcggctggcaccgcaggactgaggagctgccgctgggccgggagctgcgggtcccattgatcggaagcctccccgaagcccggctgcggagggtggtgggacaactggatccacagcgtctctggagcacttatctgcgccccctgctggttgtgcgaaccccgggcagcccgggaaatctccaagtcagaaaggcagccccggtgaccctgcaactgctcttcttggatggtgaagaggcgctgaaggagtggggacccaaggactccctttacggttcccggcacctggcccagctcatggagtctatacctcacagccccggccccaccaggatccaggctattgagctctttatgcttcttgatctcctgggagcccccaatcccaccttctacagccacttccctcgcacggtccgctggttccatcggctgaggagcattgagaagcgtctgcaccgtttgaacctgctgcagtctcatccccaggaagtgatgtacttccaacccggggagccctttggctctgtggaagacgaccacatccccttcctccgcagaggggtacccgtgctccatctcatctccacgcccttccctgctgtctggcacacccctgcggacaccgaggtcaatctccacccacccacggtacacaacttgtgccgcattctcgctgtgttcctggctgaatacctggggctctagcgtgcttggccaatgactgtggagaggactgtgagagagaaggtcccagcgggggccagtgaagctcaggcaggatctgcctagggtgtgctggtttgtccttttcatacctttgtctcctaattgtgctacaattggaagaccttctttcttttgattgtctcaagctgccacccttcaaggacagggaagagaccactgtgggatgacagcctgggcaacagagcgagactccatctcaataaataaataaataaataaatattttttaaaaagagtaaaagactaaaa

SEQ ID NO: 371725 - DNA, 989 bp, Homo sapiens
tgtgggtatgttgactgtgagggctatgtcctgagctggctctggcacccccctgctgcccccacaggcagccccggtgaccctgcaactgctcttcttggatggtgaagaggcgctgaaggagtggggacccaaggactccctttacggttcccggcacctggcccagctcatggagtctatacctcacagccccggccccaccaggatccaggctatttcctagcctttctccttaggagctctttatgcttcttgatctcctgggagcccccaatcccaccttctacagccacttccctcgcacggtccgctggttccatcggctgaggagcattgagaagcgtctgcaccgtttgaacctgctgcagtctcatccccaggaagtgatgtacttccaacccggggagccctttggctctgtggaagacgaccacatccccttcctccgcagaggggtacccgtgctccatctcatctccacgcccttccctgctgtctggcacacccctgcggacaccgaggtcaatctccacccacccacggtacacaacttgtgccgcattctcgctgtgttcctggctgaatacctggggctctagcgtgcttggccaatgactgtggagaggactgtgagagagaaggtcccagcgggggccagtgaagctcaggcaggatctgcctagggtgtgctggtttgtccttttcatacctttgtctcctaattgtgctacaattggaagaccttctttcttttgattgtctcaagctgccacccttcaaggacagggaagagaccactgtgggatgacagccagaggaataagaacttgctccctccccagaggtaaacacttggtccaaaggtttgcagggaccaaatactgttttttttttttttgagacggagcctgggcaacagagcgagactccatctcaataaataaataaataaataaatattttttaaaaagagtaaaagactaaaa

SEQ ID NO: 371726 - DNA, 6354 bp, Homo sapiens
agactgcgcgagggcggccccgggggcgagcggctgtgcgcggggccaagggcgggggcagcaggccggagtcctgaaagtcgagcgagctccgggttttgaaaatgttggagggaaaagctcctcggagatgagcgtgaccccctggctcgtggtggccgcctgttctcactaacgccatggcggggaccggagtgagaaaccggtgtctgtcactgactgcaaagtgagcgagaagcaggctgcgggccgtcccagcacgacgtggagccccgcggagacctcgagatgccccgcggggaagctcctggccccgggagacggggggctaaggacgaggccctgggcgaagaatcgggggagcggtggagccccgagttccatctgcagaggaaattggcggacagcagccacagtgaacagcaagatcgaaacagagtttctgaagaacttatcatggttgtccaagaaatgaaaaaatacttcccctcggagagacgcaataaaccaagcactctagatgccctcaactatgctctccgctgtgtccacagcgttcaagcaaacagtgagtttttccagattctcagtcagaatggagcacctcaggcagatgtgagcatgtacagtcttgaggagctggccactatcgcttcagaacacacttccaaaaacacagatacctttgtggcagtattttcatttctgtctggaaggttagtgcacatttctgaacaggctgctttgatcctgaatcgtaagaaagatgtcctggcgtcttctcactttgttgacctgcttgcacctcaagacatgagggtattctacgcgcacactgccagagctcagcttcctttctggaacaactggacccaaagagcagctgcacggtatgaatgtgctccggtgaaaccttttttctgcaggatccgtggaggtgaagacagaaagcaagagaagtgtcactccccattccggatcatcccctatctgattcatgtacatcaccctgcccagccagaattggaatcggaaccttgctgtctcactgtggttgaaaagattcactctggttatgaagctcctcggatcccagtgaataaaagaatcttcaccaccacacacaccccagggtgtgtttttcttgaagtagatgaaaaagcagtgcctttgctgggttacctacctcaggacctgattggaacatcgatcctaagctacctgcaccctgaagatcgttctctgatggttgccatacaccaaaaagttttgaagtatgcagggcatcctccctttgaacattctcccattcgattttgtactcaaaacggagactacatcatactggattccagttggtccagctttgtgaatccctggagccggaagatttctttcatcattggtcggcataaagttcgaacgagcccactaaatgaggatgtttttgctaccaaaattaaaaagatgaacgataatgacaaagacataacagaattacaagaacaaatttacaaacttctcttacagccagttcacgtgagcgtgtccagcggctacgggagcctggggagcagcgggtcgcaggagcagcttgtcagcatcgcctcctccagtgaggccagtgggcaccgtgtggaggagacgaaggcggagcagatgaccttgcagcaggtctatgccagtgtgaacaaaattaaaaatctgggtcagcagctctacattgagtcaatgaccaaatcatcattcaagccagtgacggggacacgcacagaaccgaatggtggtggtgagtcagcgaatggtggtggtgaatgtaagacctttacttccttccaccaaacactgaaaaacaatagtgtgtacactgagccctgtgaggatttgaggaacgatgagcacagcccatcctatcaacagatcaactgtatcgacagtgtcatcagatacctgaagagctacaacattccagctttgaaaagaaagtgtatctcctgtacaaatacaacttcttcctcctcagaagaagacaaacagaaccacaaggcagatgatgtccaagccttacaagctggtttgcaaatcccagccatacctaaatcagaaatgccaacaaatggacggtccatagacacaggaggaggagctccacagatcctgtccacggcgatgctgagcttggggtcgggcataagccaatgcggttacagcagcaccattgtccatgtcccacccccagagacagccagggatgctaccctcttctgtgagccctggaccctgaacatgcagccagcccctttgacctcggaagaatttaaacacgtggggctcacagcggctgttctgtcagcgcacacccagaaggaagagcagaattatgttgataaattccgagaaaagatcctgtcatcaccctacagctcctatcttcagcaagaaagcaggagcaaagctaaatattcatattttcaaggagattctacttccaagcagacgcggtcggccggctgcaggaaagggaagcacaagcggaagaagctgccggagccgccagacagcagcagctcgaacaccggctctggtccccgcaggggagcgcatcagaacgcacagccctgctgcccctccgcggcctcctctccgcacacctcgagcccgaccttcccacctgccgccatggtgcccagccaggccccttacctcgtcccagcttttcccctcccagccgcgacctcacccggaagagaatacgcagcccccggaactgcaccggaaggcctgcatgggccgcccttgtccgagggcttgcagccttacccagctttcccttttccttacttggatacttttatgaccgttttcctgcctgacccccctgtctgtcctctgttgtcgccatcgtttttgccatgtccattcctgggggcgacagcctcttctgcgatatcaccctcaatgtcgtcagcaatgagtccaactctggacccacccccttcagtcaccagccaaaggagagaggaggaaaagtgggaggcacaaagcgaggggcacccgttcattacttcgagaagcagctcacccttgcagttaaacttacttcaggaagagatgcccagaccctctgaatctccagatcagatgagaaggaacacgtgcccacaaactgagtattgtgttacaggcaacaatggcagtgagagcagtcctgctactaccggtgcactgtccacggggtcacctcccagggagaatccatcccatcctactgccagcgctctgtccacaggatcgcctcccatgaagaatccatcccatcctactgccagcgctctgtccacgggatcgcctcccatgaagaatccatcccatcctactgccagcacactgtccatgggattgcctcccagcaggactccatcccatcctactgccactgttctgtccacggggtcacctcccagcgaatccccatccagaactggttcagcagcatcaggaagcagcgacagcagtatataccttactagtagtgtttattcttctaaaatctcccaaaatgggcagcaatctcaggacgtacagaaaaaagaaacatttcctaatgtcgccgaagagcccatctggagaatgatacggcagacacctgagcgcattctcatgacataccaggtacctgagagggttaaagaagttgtactaaaagaagacctggaaaagctagaaagtatgaggcagcagcagccccagttttctcatgggcaaaaggaggagctggctaaggtgtataattggattcaaagccagactgtcactcaagaaatcgacattcaagcctgtgtcacttgtgaaaatgaagattcagctgatggtgcggccacatcctgtggtcaggttctggtagaagacagctgttgagtgactgtgaggatgaaccttcataccctttccaagacgtgttacacagacagacctttttaagtcctggacttttaaatgaccatgaagttatcattgaatgttaagattttttcttcttgattttttaatacacgtaatctttttgaagcagacattgtatacagaatcttacttctctttgttcctgatatattaaaatggccagttaggctctttttgtagttgaattgtcttctaaagagattggatggcctctaaagaggtatgtgtatctttatttcagatgtcacccagagtaaattataattagaagtatagctagaatgagccccaaaccttagcctcatttattttgttctgttacataagtcattttccccttagagtgcttgaagaaatgccacctacaggttgtgtacttttcataatggtttccatgaatgtagtacgttcatacaggcttcattcaacctggcgttcccctccataattaagatgaaacattccggttttctcacaacacattagcacatactgtccattagcatatctgggataaccaggttttgggggttgagttttggccttcatccttgtagatccctttcctattgatttcccaccttccagtgaaattctgaaagtcttatcttaaaaatcgatccgcttaccatgggcctattcttgtaagtttcagttagcatttgcatgtgtaatattaaaatgaaagagcttcttacccagtgctgttgcccttttgagtatttttgtttttaaaataatgattgtaaaatgttttacaagtaatgtaaaagctagtatcattcttacatacttctgtgtttaaattttcattcttaccaaaacagttaactctttctttccaatcaatttatacaaaagaggtcgctccagccctaccacaggtctgactggcactgccttttgtttgcccttgaacagggcagtgttgtggggactgcaaaagagaaaacgtccaggcgagcccagttgtcctcgcccacagggtcctgcaggctccatcagtcaccgctttctatggcgtttgtagttgtgtcttttaagaagtgagtgtgattgtttacttgataaatcagctcactctctggtgctttttagagaagtccctgattccttcttaaacttggaatgatagatgaaattcacacccctgcagatcagaaaaaacaaatagaagaaaatgagggttacagtaacctgttgtctttatataacttgcaacaaactaatttatttttttttcctttttttgtttttggttttttatggttttttaaggaaaatacttttctcctttgaagttttacagctttttgtaaatgcgtcctgataatgattaggaaaatcgaccttttcatccatgatgaccatcctcatagctcagatttcctttcaaagtagtggctttctggatggtaattccatcttaaggtgtcagaactattttcaaatgctgcctttgacagttcttggaattttctgatattaagcagttccatgcaaatattcgtgttttataaatagctctcatagtctgctccatcttgatagttaagtgatttctgaagcgtttgtgtgtgtgttgatcaggttgtgtgatatttttgcttgataaagaatcaaatttgaaacaattaaccagccagtagattgtctgtcagtgaccttctgtagtaataaagtttttgccactgtaaataaaaacagtatccgtagctatcaggatcattgcgcactcatatatgctaagccttctgttctctaatagaagcctttcttttccattgtttctggatatttgtattatccaaatgtgcttatttctttgccttagcacacgttttatggagtacttgttatactaggtttgatttgaaactggtgcttgtcgcagaactgtcagagcatgaggagcgctcctcctgtgggtggacgcattcacgcactcccaggttgcacctgctgctggcggtgagcagggggttcagcagcttgaccgatgccccccgagggggctctccccagcttaaactttgttgtttaaatttgttaactttttatattaatgactattgaaagtggtaataaaaatttatattataggcttcaatgttttcatgaatgttacccaaaaagctgtgttttctttggtcagaggtcaaaatttatgaaaaacaaaatgctgtatgaatggaaatcattttgcaattgagtgacacttcattgtaattcacagtgtaaatttaatccaaactgaaattttgtttcaactgaatttgtaattaactctgaatttgtttttaatcattagtaatatttcagttgggtatctttttaagtaaaaacaacaaataaactctgtacatgtaaaacgtgaaaaaaaaaaagctt

SEQ ID NO: 371727 - DNA, 6279 bp, Homo sapiens
agactgcgcgagggcggccccgggggcgagcggctgtgcgcggggccaagggcgggggcagcaggccggagtcctgaaagtcgagcgagctccgggttttgaaaatgttggagggaaaagctcctcggagatgagcgtgaccccctggctcgtggtggccgcctgttctcactaacgccatggcggggaccggagtgagaaaccggtgtctgtcactgactgcaaagtgagcgagaagcaggctgcgggccgtcccagcacgacgtggagccccgcggagacctcgagatgccccgcggggaagctcctggccccgggagacggggggctaaggacgaggccctgggcgaagaatcgggggagcggtggagccccgagttccatctgcagaggaaattggcggacagcagccacagtgaacagcaagatcgaaacagagtttctgaagaacttatcatggttgtccaagaaatgaaaaaatacttcccctcggagagacgcaataaaccaagcactctagatgccctcaactatgctctccgctgtgtccacagcgttcaagcaaacagtgagtttttccagattctcagtcagaatggagcacctcaggcagatgtgagcatgtacagtcttgaggagctggccactatcgcttcagaacacacttccaaaaacacagatacctttgtggcagtattttcatttctgtctggaaggttagtgcacatttctgaacaggctgctttgatcctgaatcgtaagaaagatgtcctggcgtcttctcactttgttgacctgcttgcacctcaagacatgagggtattctacgcgcacactgccagagctcagcttcctttctggaacaactggacccaaagagcagctgcacggtatgaatgtgctccggtgaaaccttttttctgcaggatccgtggaggtgaagacagaaagcaagagaagtgtcactccccattccggatcatcccctatctgattcatgtacatcaccctgcccagccagaattggaatcggaaccttgctgtctcactgtggttgaaaagattcactctggttatgaagctcctcggatcccagtgaataaaagaatcttcaccaccacacacaccccagggtgtgtttttcttgaagtagatgaaaaagcagtgcctttgctgggttacctacctcaggacctgattggaacatcgatcctaagctacctgcaccctgaagatcgttctctgatggttgccatacaccaaaaagttttgaagtatgcagggcatcctccctttgaacattctcccattcgattttgtactcaaaacggagactacatcatactggattccagttggtccagctttgtgaatccctggagccggaagatttctttcatcattggtcggcataaagttcgaacgagcccactaaatgaggatgtttttgctaccaaaattaaaaagatgaacgataatgacaaagacataacagaattacaagaacaaatttacaaacttctcttacagccagttcacgtgagcgtgtccagcggctacgggagcctggggagcagcgggtcgcaggagcagcttgtcagcatcgcctcctccagtgaggccagtgggcaccgtgtggaggagacgaaggcggagcagatgaccttgcagcaggtctatgccagtgtgaacaaaattaaaaatctgggtcagcagctctacattgagtcaatgaccaaatcatcattcaagccagtgacggggacacgcacagaaccgaatggtggtggtgaatgtaagacctttacttccttccaccaaacactgaaaaacaatagtgtgtacactgagccctgtgaggatttgaggaacgatgagcacagcccatcctatcaacagatcaactgtatcgacagtgtcatcagatacctgaagagctacaacattccagctttgaaaagaaagtgtatctcctgtacaaatacaacttcttcctcctcagaagaagacaaacagaaccacaaggcagatgatgtccaagccttacaagctggtttgcaaatcccagccatacctaaatcagaaatgccaacaaatggacggtccatagacacaggaggaggagctccacagatcctgtccacggcgatgctgagcttggggtcgggcataagccaatgcggttacagcagcaccattgtccatgtcccacccccagagacagccagggatgctaccctcttctgtgagccctggaccctgaacatgcagccagcccctttgacctcggaagaatttaaacacgtggggctcacagcggctgttctgtcagcgcacacccagaaggaagagcagaattatgttgataaattccgagaaaagatcctgtcatcaccctacagctcctatcttcagcaagaaagcaggagcaaagctaaatattcatattttcaaggagattctacttccaagcagacgcggtcggccggctgcaggaaagggaagcacaagcggaagaagctgccggagccgccagacagcagcagctcgaacaccggctctggtccccgcaggggagcgcatcagaacgcacagccctgctgcccctccgcggcctcctctccgcacacctcgagcccgaccttcccacctgccgccatggtgcccagccaggccccttacctcgtcccagcttttcccctcccagccgcgacctcacccggaagagaatacgcagcccccggaactgcaccggaaggcctgcatgggccgcccttgtccgagggcttgcagccttacccagctttcccttttccttacttggatacttttatgaccgttttcctgcctgacccccctgtctgtcctctgttgtcgccatcgtttttgccatgtccattcctgggggcgacagcctcttctgcgatatcaccctcaatgtcgtcagcaatgagtccaactctggacccacccccttcagtcaccagccaaaggagagaggaggaaaagtgggaggcacaaagcgaggggcacccgttcattacttcgagaagcagctcacccttgcagttaaacttacttcaggaagagatgcccagaccctctgaatctccagatcagatgagaaggaacacgtgcccacaaactgagtattgtgttacaggcaacaatggcagtgagagcagtcctgctactaccggtgcactgtccacggggtcacctcccagggagaatccatcccatcctactgccagcgctctgtccacaggatcgcctcccatgaagaatccatcccatcctactgccagcacactgtccatgggattgcctcccagcaggactccatcccatcctactgccactgttctgtccacggggtcacctcccagcgaatccccatccagaactggttcagcagcatcaggaagcagcgacagcagtatataccttactagtagtgtttattcttctaaaatctcccaaaatgggcagcaatctcaggacgtacagaaaaaagaaacatttcctaatgtcgccgaagagcccatctggagaatgatacggcagacacctgagcgcattctcatgacataccaggtacctgagagggttaaagaagttgtactaaaagaagacctggaaaagctagaaagtatgaggcagcagcagccccagttttctcatgggcaaaaggaggagctggctaaggtgtataattggattcaaagccagactgtcactcaagaaatcgacattcaagcctgtgtcacttgtgaaaatgaagattcagctgatggtgcggccacatcctgtggtcaggttctggtagaagacagctgttgagtgactgtgaggatgaaccttcataccctttccaagacgtgttacacagacagacctttttaagtcctggacttttaaatgaccatgaagttatcattgaatgttaagattttttcttcttgattttttaatacacgtaatctttttgaagcagacattgtatacagaatcttacttctctttgttcctgatatattaaaatggccagttaggctctttttgtagttgaattgtcttctaaagagattggatggcctctaaagaggtatgtgtatctttatttcagatgtcacccagagtaaattataattagaagtatagctagaatgagccccaaaccttagcctcatttattttgttctgttacataagtcattttccccttagagtgcttgaagaaatgccacctacaggttgtgtacttttcataatggtttccatgaatgtagtacgttcatacaggcttcattcaacctggcgttcccctccataattaagatgaaacattccggttttctcacaacacattagcacatactgtccattagcatatctgggataaccaggttttgggggttgagttttggccttcatccttgtagatccctttcctattgatttcccaccttccagtgaaattctgaaagtcttatcttaaaaatcgatccgcttaccatgggcctattcttgtaagtttcagttagcatttgcatgtgtaatattaaaatgaaagagcttcttacccagtgctgttgcccttttgagtatttttgtttttaaaataatgattgtaaaatgttttacaagtaatgtaaaagctagtatcattcttacatacttctgtgtttaaattttcattcttaccaaaacagttaactctttctttccaatcaatttatacaaaagaggtcgctccagccctaccacaggtctgactggcactgccttttgtttgcccttgaacagggcagtgttgtggggactgcaaaagagaaaacgtccaggcgagcccagttgtcctcgcccacagggtcctgcaggctccatcagtcaccgctttctatggcgtttgtagttgtgtcttttaagaagtgagtgtgattgtttacttgataaatcagctcactctctggtgctttttagagaagtccctgattccttcttaaacttggaatgatagatgaaattcacacccctgcagatcagaaaaaacaaatagaagaaaatgagggttacagtaacctgttgtctttatataacttgcaacaaactaatttatttttttttcctttttttgtttttggttttttatggttttttaaggaaaatacttttctcctttgaagttttacagctttttgtaaatgcgtcctgataatgattaggaaaatcgaccttttcatccatgatgaccatcctcatagctcagatttcctttcaaagtagtggctttctggatggtaattccatcttaaggtgtcagaactattttcaaatgctgcctttgacagttcttggaattttctgatattaagcagttccatgcaaatattcgtgttttataaatagctctcatagtctgctccatcttgatagttaagtgatttctgaagcgtttgtgtgtgtgttgatcaggttgtgtgatatttttgcttgataaagaatcaaatttgaaacaattaaccagccagtagattgtctgtcagtgaccttctgtagtaataaagtttttgccactgtaaataaaaacagtatccgtagctatcaggatcattgcgcactcatatatgctaagccttctgttctctaatagaagcctttcttttccattgtttctggatatttgtattatccaaatgtgcttatttctttgccttagcacacgttttatggagtacttgttatactaggtttgatttgaaactggtgcttgtcgcagaactgtcagagcatgaggagcgctcctcctgtgggtggacgcattcacgcactcccaggttgcacctgctgctggcggtgagcagggggttcagcagcttgaccgatgccccccgagggggctctccccagcttaaactttgttgtttaaatttgttaactttttatattaatgactattgaaagtggtaataaaaatttatattataggcttcaatgttttcatgaatgttacccaaaaagctgtgttttctttggtcagaggtcaaaatttatgaaaaacaaaatgctgtatgaatggaaatcattttgcaattgagtgacacttcattgtaattcacagtgtaaatttaatccaaactgaaattttgtttcaactgaatttgtaattaactctgaatttgtttttaatcattagtaatatttcagttgggtatctttttaagtaaaaacaacaaataaactctgtacatgtaaaacgtgaaaaaaaaaaagctt

SEQ ID NO: 371728 - DNA, 5051 bp, Homo sapiens
cacatataatactagtcagcacaaataatccatcagtcatcacagaaagttctgttggacacaggctccacctgggagatgctgtgtacttcacacagcatcacgtaagatgcacaggtcttcccacattccacccttagtgattgccagggttgatcagttgtacaggaagcgtcagcttaacattggaaagctccccatcaaccttaaacctatggtttcattccttgataatctttgttggaaatttttgtttcattccttatttttctaaatacaatcgtagccattctatgtgtaatgtgctctgcaccttattttattcattacgtgttgtggatatctttctattagtgcattttagatctgcactcatttttaatagccgcatgatattctgttgatatatacatgataaagtgccatgatttaattttggtaagaaagtatatgttcttaattacatgctgggtacttttaattgcacatccctttattctgtttcaggtgaatgtaagacctttacttccttccaccaaacactgaaaaacaatagtgtgtacactgagccctgtgaggatttgaggaacgatgagcacagcccatcctatcaacagatcaactgtatcgacagtgtcatcagatacctgaagagctacaacattccagctttgaaaagaaagtgtatctcctgtacaaatacaacttcttcctcctcagaagaagacaaacagaaccacaaggcagatgatgtccaagccttacaagctggtttgcaaatcccagccatacctaaatcagaaatgccaacaaatggacggtccatagacacaggaggaggagctccacagatcctgtccacggcgatgctgagcttggggtcgggcataagccaatgcggttacagcagcaccattgtccatgtcccacccccagagacagccagggatgctaccctcttctgtgagccctggaccctgaacatgcagccagcccctttgacctcggaagaatttaaacacgtggggctcacagcggctgttctgtcagcgcacacccagaaggaagagcagaattatgttgataaattccgagaaaagatcctgtcatcaccctacagctcctatcttcagcaagaaagcaggagcaaagctaaatattcatattttcaaggagattctacttccaagcagacgcggtcggccggctgcaggaaagggaagcacaagcggaagaagctgccggagccgccagacagcagcagctcgaacaccggctctggtccccgcaggggagcgcatcagaacgcacagccctgctgcccctccgcggcctcctctccgcacacctcgagcccgaccttcccacctgccgccatggtgcccagccaggccccttacctcgtcccagcttttcccctcccagccgcgacctcacccggaagagaatacgcagcccccggaactgcaccggaaggcctgcatgggccgcccttgtccgagggcttgcagccttacccagctttcccttttccttacttggatacttttatgaccgttttcctgcctgacccccctgtctgtcctctgttgtcgccatcgtttttgccatgtccattcctgggggcgacagcctcttctgcgatatcaccctcaatgtcgtcagcaatgagtccaactctggacccacccccttcagtcaccagccaaaggagagaggaggaaaagtgggaggcacaaagcgaggggcacccgttcattacttcgagaagcagctcacccttgcagttaaacttacttcaggaagagatgcccagaccctctgaatctccagatcagatgagaaggaacacgtgcccacaaactgagtattgtgttacaggcaacaatggcagtgagagcagtcctgctactaccggtgcactgtccacggggtcacctcccagggagaatccatcccatcctactgccagcgctctgtccacaggatcgcctcccatgaagaatccatcccatcctactgccagcgctctgtccacgggatcgcctcccatgaagaatccatcccatcctactgccagcacactgtccatgggattgcctcccagcaggactccatcccatcctactgccactgttctgtccacggggtcacctcccagcgaatccccatccagaactggttcagcagcatcaggaagcagcgacagcagtatataccttactagtagtgtttattcttctaaaatctcccaaaatgggcagcaatctcaggacgtacagaaaaaagaaacatttcctaatgtcgccgaagagcccatctggagaatgatacggcagacacctgagcgcattctcatgacataccaggtacctgagagggttaaagaagttgtactaaaagaagacctggaaaagctagaaagtatgaggcagcagcagccccagttttctcatgggcaaaaggaggagctggctaaggtgtataattggattcaaagccagactgtcactcaagaaatcgacattcaagcctgtgtcacttgtgaaaatgaagattcagctgatggtgcggccacatcctgtggtcaggttctggtagaagacagctgttgagtgactgtgaggatgaaccttcataccctttccaagacgtgttacacagacagacctttttaagtcctggacttttaaatgaccatgaagttatcattgaatgttaagattttttcttcttgattttttaatacacgtaatctttttgaagcagacattgtatacagaatcttacttctctttgttcctgatatattaaaatggccagttaggctctttttgtagttgaattgtcttctaaagagattggatggcctctaaagaggtatgtgtatctttatttcagatgtcacccagagtaaattataattagaagtatagctagaatgagccccaaaccttagcctcatttattttgttctgttacataagtcattttccccttagagtgcttgaagaaatgccacctacaggttgtgtacttttcataatggtttccatgaatgtagtacgttcatacaggcttcattcaacctggcgttcccctccataattaagatgaaacattccggttttctcacaacacattagcacatactgtccattagcatatctgggataaccaggttttgggggttgagttttggccttcatccttgtagatccctttcctattgatttcccaccttccagtgaaattctgaaagtcttatcttaaaaatcgatccgcttaccatgggcctattcttgtaagtttcagttagcatttgcatgtgtaatattaaaatgaaagagcttcttacccagtgctgttgcccttttgagtatttttgtttttaaaataatgattgtaaaatgttttacaagtaatgtaaaagctagtatcattcttacatacttctgtgtttaaattttcattcttaccaaaacagttaactctttctttccaatcaatttatacaaaagaggtcgctccagccctaccacaggtctgactggcactgccttttgtttgcccttgaacagggcagtgttgtggggactgcaaaagagaaaacgtccaggcgagcccagttgtcctcgcccacagggtcctgcaggctccatcagtcaccgctttctatggcgtttgtagttgtgtcttttaagaagtgagtgtgattgtttacttgataaatcagctcactctctggtgctttttagagaagtccctgattccttcttaaacttggaatgatagatgaaattcacacccctgcagatcagaaaaaacaaatagaagaaaatgagggttacagtaacctgttgtctttatataacttgcaacaaactaatttatttttttttcctttttttgtttttggttttttatggttttttaaggaaaatacttttctcctttgaagttttacagctttttgtaaatgcgtcctgataatgattaggaaaatcgaccttttcatccatgatgaccatcctcatagctcagatttcctttcaaagtagtggctttctggatggtaattccatcttaaggtgtcagaactattttcaaatgctgcctttgacagttcttggaattttctgatattaagcagttccatgcaaatattcgtgttttataaatagctctcatagtctgctccatcttgatagttaagtgatttctgaagcgtttgtgtgtgtgttgatcaggttgtgtgatatttttgcttgataaagaatcaaatttgaaacaattaaccagccagtagattgtctgtcagtgaccttctgtagtaataaagtttttgccactgtaaataaaaacagtatccgtagctatcaggatcattgcgcactcatatatgctaagccttctgttctctaatagaagcctttcttttccattgtttctggatatttgtattatccaaatgtgcttatttctttgccttagcacacgttttatggagtacttgttatactaggtttgatttgaaactggtgcttgtcgcagaactgtcagagcatgaggagcgctcctcctgtgggtggacgcattcacgcactcccaggttgcacctgctgctggcggtgagcagggggttcagcagcttgaccgatgccccccgagggggctctccccagcttaaactttgttgtttaaatttgttaactttttatattaatgactattgaaagtggtaataaaaatttatattataggcttcaatgttttcatgaatgttacccaaaaagctgtgttttctttggtcagaggtcaaaatttatgaaaaacaaaatgctgtatgaatggaaatcattttgcaattgagtgacacttcattgtaattcacagtgtaaatttaatccaaactgaaattttgtttcaactgaatttgtaattaactctgaatttgtttttaatcattagtaatatttcagttgggtatctttttaagtaaaaacaacaaataaactctgtacatgtaaaacgtgaaaaaaaaaaagctt

SEQ ID NO: 371729 - DNA, 1175 bp, Homo sapiens
tgtggtcgtctagaggatcccgtccactgttcgatgtttttggttttttatggttttttaaggaaaatacttttctcctttgaagttttacagctttttgtaaatgcgtcctgataatgattaggaaaatcgaccttttcatccatgatgaccatcctcatagctcagatttcctttcaaagtagtggctttctggatggtaattccatcttaaggtgtcagaactattttcaaatgctgcctttgacagttcttggaattttctgatattaagcagttccatgcaaatattcgtgttttataaatagctctcatagtctgctccatcttgatagttaagtgatttctgaagcgtttgtgtgtgtgttgatcaggttgtgtgatatttttgcttgataaagaatcaaatttgaaacaattaaccagccagtagattgtctgtcagtgaccttctgtagtaataaagtttttgccactgtaaataaaaacagtatccgtagctatcaggatcattgcgcactcatatatgctaagccttctgttctctaatagaagcctttcttttccattgtttctggatatttgtattatccaaatgtgcttatttctttgccttagcacacgttttatggagtacttgttatactaggtttgatttgaaactggtgcttgtcgcagaactgtcagagcatgaggagcgctcctcctgtgggtggacgcattcacgcactcccaggttgcacctgctgctggcggtgagcagggggttcagcagcttgaccgatgccccccgagggggctctccccagcttaaactttgttgtttaaatttgttaactttttatattaatgactattgaaagtggtaataaaaatttatattataggcttcaatgttttcatgaatgttacccaaaaagctgtgttttctttggtcagaggtcaaaatttatgaaaaacaaaatgctgtatgaatggaaatcattttgcaattgagtgacacttcattgtaattcacagtgtaaatttaatccaaactgaaattttgtttcaactgaatttgtaattaactctgaatttgtttttaatcattagtaatatttcagttgggtatctttttaagtaaaaacaacaaataaactctgtacatgtaaaacgtgaaaaaaaaaaagctt

SEQ ID NO: 371730 - DNA, 5450 bp, Homo sapiens
  misc_feature (5381)..(5381): n is a, c, g, or t
  misc_feature (5391)..(5392): n is a, c, g, or t
agactgcgcgagggcggccccgggggcgagcggctgtgcgcggggccaagggcgggggcagcaggccggagtcctgaaagtcgagcgagctccgggttttgaaaatgttggagggaaaagctcctcggagatgagcgtgaccccctggctcgtggtggccgcctgttctcactaacgccatggcggggaccggagtgagaaaccggtgtctgtcactgactgcaaagtgagcgagaagcaggctgcgggccgtcccagcacgacgtggagccccgcggagacctcgagatgccccgcggggaagctcctggccccgggagacggggggctaaggacgaggccctgggcgaagaatcgggggagcggtggagccccgagttccatctgcagaggaaattggcggacagcagccacagtgaacagcaagatcgaaacagagtttctgaagaacttatcatggttgtccaagaaatgaaaaaatacttcccctcggagagacgcaataaaccaagcactctagatgccctcaactatgctctccgctgtgtccacagcgttcaagcaaacagtgagtttttccagattctcagtcagaatggagcacctcaggcagatgtgagcatgtacagtcttgaggagctggccactatcgcttcagaacacacttccaaaaacacagatacctttgtggcagtattttcatttctgtctggaaggttagtgcacatttctgaacaggctgctttgatcctgaatcgtaagaaagatgtcctggcgtcttctcactttgttgacctgcttgcacctcaagacatgagggtattctacgcgcacactgccagagctcagcttcctttctggaacaactggacccaaagagcagctgcacggtatgaatgtgctccggtgaaaccttttttctgcaggatccgtggaggtgaagacagaaagcaagagaagtgtcactccccattccggatcatcccctatctgattcatgtacatcaccctgcccagccagaattggaatcggaaccttgctgtctcactgtggttgaaaagattcactctggttatgaagctcctcggatcccagtgaataaaagaatcttcaccaccacacacaccccagggtgtgtttttcttgaagtagatgaaaaagcagtgcctttgctgggttacctacctcaggacctgattggaacatcgatcctaagctacctgcaccctgaagatcgttctctgatggttgccatacaccaaaaagttttgaagtatgcagggcatcctccctttgaacattctcccattcgattttgtactcaaaacggagactacatcatactggattccagttggtccagctttgtgaatccctggagccggaagatttctttcatcattggtcggcataaagttcgaacgagcccactaaatgaggatgtttttgctaccaaaattaaaaagatgaacgataatgacaaagacataacagaattacaagaacaaatttacaaacttctcttacagccagttcacgtgagcgtgtccagcggctacgggagcctggggagcagcgggtcgcaggagcagcttgtcagcatcgcctcctccagtgaggccagtgggcaccgtgtggaggagacgaaggcggagcagatgaccttgcagcaggtctatgccagtgtgaacaaaattaaaaatctgggtcagcagctctacattgagtcaatgaccaaatcatcattcaagccagtgacggggacacgcacagaaccgaatggtggtggtgaatgtaagacctttacttccttccaccaaacactgaaaaacaatagtgtgtacactgagccctgtgaggatttgaggaacgatgagcacagcccatcctatcaacagatcaactgtatcgacagtgtcatcagatacctgaagagctacaacattccagctttgaaaagaaagtgtatctcctgtacaaatacaacttcttcctcctcagaagaagacaaacagaaccacaaggcagatgatgtccaagccttacaagctggtttgcaaatcccagccatacctaaatcagaaatgccaacaaatggacggtccatagacacaggaggaggagctccacagatcctgtccacggcgatgctgagcttggggtcgggcataagccaatgcggttacagcagcaccattgtccatgtcccacccccagagacagccagggatgctaccctcttctgtgagccctggaccctgaacatgcagccagcccctttgacctcggaagaatttaaacacgtggggctcacagcggctgttctgtcagcgcacacccagaaggaagagcagaattatgttgataaattccgagaaaagatcctgtcatcaccctacagctcctatcttcagcaagaaagcaggagcaaagctaaatattcatattttcaaggagattctacttccaagcagacgcggtcggccggctgcaggaaagggaagcacaagcggaagaagctgccggagccgccagacagcagcagctcgaacaccggctctggtccccgcaggggagcgcatcagaacgcacagccctgctgcccctccgcggcctcctctccgcacacctcgagcccgaccttcccacctgccgccatggtgcccagccaggccccttacctcgtcccagcttttcccctcccagccgcgacctcacccggaagagaatacgcagcccccggaactgcaccggaaggcctgcatgggccgcccttgtccgagggcttgcagccttacccagctttcccttttccttacttggatacttttatgaccgttttcctgcctgacccccctgtctgtcctctgttgtcgccatcgtttttgccatgtccattcctgggggcgacagcctcttctgcgatatcaccctcaatgtcgtcagcaatgagtccaactctggacccacccccttcagtcaccagccaaaggagagaggaggaaaagtgggaggcacaaagcgaggggcacccgttcattacttcgagaagcagctcacccttgcagttaaacttacttcaggaagagatgcccagaccctctgaatctccagatcagatgagaaggaacacgtgcccacaaactgagtattgtgttacaggcaacaatggcagtgagagcagtcctgctactaccggtgcactgtccacggggtcacctcccagggagaatccatcccatcctactgccagcgctctgtccacaggatcgcctcccatgaagaatccatcccatcctactgccagcgctctgtccacgggatcgcctcccatgaagaatccatcccatcctactgccagcacactgtccatgggattgcctcccagcaggactccatcccatcctactgccactgttctgtccacggggtcacctcccagcgaatccccatccagaactggttcagcagcatcaggaagcagcgacagcagtatataccttactagtagtgtttattcttctaaaatctcccaaaatgggcagcaatctcaggacgtacagaaaaaagaaacatttcctaatgtcgccgaagagcccatctggagaatgatacggcagacacctgagcgcattctcatgacataccaggtacctgagagggttaaagaagttgtactaaaagaagacctggaaaagctagaaagtatgaggcagcagcagccccagttttctcatgggcaaaaggaggagctggctaaggtgtataattggattcaaagccagactgtcactcaagaaatcgacattcaagcctgtgtcacttgtgaaaatgaagattcagctgatggtgcggccacatcctgtggtcaggttctggtagaagacagctgttgagtgactgtgaggatgaaccttcataccctttccaagacgtgttacacagacagacctttttaagtcctggacttttaaatgaccatgaagttatcattgaatgttaagattttttcttcttgattttttaatacacgtaatctttttgaagcagacattgtatacagaatcttacttctctttgttcctgatatattaaaatggccagttaggctctttttgtagttgaattgtcttctaaagagattggatggcctctaaagaggtatgtgtatctttatttcagatgtcacccagagtaaattataattagaagtatagctagaatgagccccaaaccttagcctcatttattttgttctgttacataagtcattttccccttagagtgcttgaagaaatgccacctacaggttgtgtacttttcataatggtttccatgaatgtagtacgttcatacaggcttcattcaacctggcgttcccctccataattaagatgaaacattccggttttctcacaacacattagcacatactgtccattagcatatctgggataaccaggttttgggggttgagttttggccttcatccttgtagatccctttcctattgatttcccaccttccagtgaaattctgaaagtcttatcttaaaaatcgatccgcttaccatgggcctattcttgtaagtttcagttagcatttgcatgtgtaatattaaaatgaaagagcttcttacccagtgctgttgcccttttgagtatttttgtttttaaaataatgattgtaaaatgttttacaagtaatgtaaaagctagtatcattcttacatacttctgtgtttaaattttcattcttaccaaaacagttaactctttctttccaatcaatttatacaaaagaggtcgctccagccctaccacaggtctgactggcactgccttttgtttgcccttgaacagggcagtgttgtggggactgcaaaagagaaaacgtccaggcgagcccagttgtcctcgcccacagggtcctgcaggctccatcagtcaccgctttctatggcgtttgtagttgtgtcttttaagaagtgagtgtgattgtttacttgataaatcagctcactctctggtgctttttagagaagtccctgattccttcttaaacttggaatgatagatgaaattcacacccctgcagatcagaaaaaacaaatagaagaaaatgagggttacagtaacctgttgtctttatataacttgcaacaaactaatttatttttttttcctttttttgtttttggttttttatggttttttaaggaaaatacttttctcctttgaagttttacagctttttgtaaatgcgtcctgataatgattaggaaaatcgaccttttcatccatgatgaccatcctcatagctcagatttcctttcaaagtagtggctttctggatggaactgcttaatatcagaaaattncaagaactgnnaaaggcagcatttgaaaatagttctgacaccttaagatggaattaccatccagagtcg

SEQ ID NO: 371731 - DNA, 1206 bp, Homo sapiens
agactgcgcgagggcggccccgggggcgagcggctgtgcgcggggccaagggcgggggcagcaggccggagtcctgaaagtcgagcgagctccgggttttgaaaatgttggagggaaaagctcctcggagatgagcgtgaccccctggctcgtggtggccgcctgttctcactaacgccatggcggggaccggagtgagaaaccggtgtctgtcactgactgcaaagtgagcgagaagcaggctgcgggccgtcccagcacgacgtggagccccgcggagacctcgagatgccccgcggggaagctcctggccccgggagacggggggctaaggacgaggccctgggcgaagaatcgggggagcggtggagccccgagttccatctgcagaggaaattggcggacagcagccacagtgaacagcaagatcgaaacagagtttctgaagaacttatcatggttgtccaagaaatgaaaaaatacttcccctcggagagacgcaataaaccaagcactctagatgccctcaactatgctctccgctgtgtccacagcgttcaagcaaacagtgagtttttccagattctcagtcagaatggagcacctcaggcagatgtgagcatgtacagtcttgaggagctggccactatcgcttcagaacacacttccaaaaacacagatacctttgtggcagtattttcatttctgtctggaaggttagtgcacatttctgaacaggctgctttgatcctgaatcgtaagaaagatgtcctggcgtcttctcactttgttgacctgcttgcacctcaagacatgagggtattctacgcgcacactgccagagctcagcttcctttctggaacaactggacccaaagaggtaacaggaccaatgttcagatgtctatctttcctcatcaagatcagtttcattcttacaggaatagtacagaaattaacatattatttagaacatgcacactatctggtttttcttattcctgttatagaaagtcacgtgatgaaaacagcattttaaaagcttctgataacatactcaatacgtttgtttccattttgtcacatctgtttcacagatgatatgtcataaatattatttcattaccagcgtattgtatagtggtttagttgctatgaaggctctgtttcctttaagttaaaattaaatgtttttcctccttcatg

SEQ ID NO: 371732 - DNA, 499 bp, Homo sapiens
tggaggtgaagacagaaagcaagagaagtgtcactccccattccggatcatcccctatctgattcatgtacatcaccctgcccagccagaattggaatcggaaccttgctgtctcactgtggttgaaaagattcactctggttatgaaggtaagtcagtagataagatgcagaaatgtcagcaatcagataggaacatgggaaagtctgtttacgtcagtcatagaacaacaaaaagagctcttgggtctccaatttgacccttaaactcttcaggcatttgaagctggttttcattgatgtctctgtttactgacttttagcttcttgtacagtcattgtcttcatggtcagcatggctgaacgaatggtctcagcacaggacttggtgacagatacggttttctagtcctctctctgctggtgacccattcagtgtggccttttgcttgtgttgtgtgaaataagagtgctgaaattgtttcccagagaggccacaa

SEQ ID NO: 371733 - DNA, 6333 bp, Homo sapiens
agactgcgcgagggcggccccgggggcgagcggctgtgcgcggggccaagggcgggggcagcaggccggagtcctgaaagtcgagcgagctccgggttttgaaaatgttggagggaaaagctcctcggagatgagcgtgaccccctggctcgtggtggccgcctgttctcactaacgccatggcggggaccggagtgagaaaccggtgtctgtcactgactgcaaagtgagcgagaagcaggctgcgggccgtcccagcacgacgtggagccccgcggagacctcgagatgccccgcggggaagctcctggccccgggagacggggggctaaggacgaggccctgggcgaagaatcgggggagcggtggagccccgagttccatctgcagaggaaattggcggacagcagccacagtgaacagcaagatcgaaacagagtttctgaagaacttatcatggttgtccaagaaatgaaaaaatacttcccctcggagagacgcaataaaccaagcactctagatgccctcaactatgctctccgctgtgtccacagcgttcaagcaaacagtgagtttttccagattctcagtcagaatggagcacctcaggcagatgtgagcatgtacagtcttgaggagctggccactatcgcttcagaacacacttccaaaaacacagatacctttgtggcagtattttcatttctgtctggaaggttagtgcacatttctgaacaggctgctttgatcctgaatcgtaagaaagatgtcctggcgtcttctcactttgttgacctgcttgcacctcaagacatgagggtattctacgcgcacactgccagagctcagcttcctttctggaacaactggacccaaagagcagctgcacggtatgaatgtgctccggtgaaaccttttttctgcaggatccgtggaggtgaagacagaaagcaagagaagtgtcactccccattccggatcatcccctatctgattcatgtacatcaccctgcccagccagaattggaatcggaaccttgctgtctcactgtggttgaaaagattcactctggttatgaagctcctcggatcccagtgaataaaagaatcttcaccaccacacacaccccagggtgtgtttttcttgaagtagatgaaaaagcagtgcctttgctgggttacctacctcaggacctgattggaacatcgatcctaagctacctgcaccctgaagatcgttctctgatggttgccatacaccaaaaagttttgaagtatgcagggcatcctccctttgaacattctcccattcgattttgtactcaaaacggagactacatcatactggattccagttggtccagctttgtgaatccctggagccggaagatttctttcatcattggtcggcataaagttcgaacgagcccactaaatgaggatgtttttgctaccaaaattaaaaagatgaacgataatgacaaagacataacagaattacaagaacaaatttacaaacttctcttacagccagttcacgtgagcgtgtccagcggctacgggagcctggggagcagcgggtcgcaggagcagcttgtcagcatcgcctcctccagtgaggccagtgggcaccgtgtggaggagacgaaggcggagcagatgaccttgcagcaggtctatgccagtgtgaacaaaattaaaaatctgggtcagcagctctacattgagtcaatgaccaaatcatcattcaagccagtgacggggacacgcacagaaccgaatggtggtggtgaatgtaagacctttacttccttccaccaaacactgaaaaacaatagtgtgtacactgagccctgtgaggatttgaggaacgatgagcacagcccatcctatcaacagatcaactgtatcgacagtgtcatcagatacctgaagagctacaacattccagctttgaaaagaaagtgtatctcctgtacaaatacaacttcttcctcctcagaagaagacaaacagaaccacaaggcagatgatgtccaagccttacaagctggtttgcaaatcccagccatacctaaatcagaaatgccaacaaatggacggtccatagacacaggaggaggagctccacagatcctgtccacggcgatgctgagcttggggtcgggcataagccaatgcggttacagcagcaccattgtccatgtcccacccccagagacagccagggatgctaccctcttctgtgagccctggaccctgaacatgcagccagcccctttgacctcggaagaatttaaacacgtggggctcacagcggctgttctgtcagcgcacacccagaaggaagagcagaattatgttgataaattccgagaaaagatcctgtcatcaccctacagctcctatcttcagcaagaaagcaggagcaaagctaaatattcatattttcaaggagattctacttccaagcagacgcggtcggccggctgcaggaaagggaagcacaagcggaagaagctgccggagccgccagacagcagcagctcgaacaccggctctggtccccgcaggggagcgcatcagaacgcacagccctgctgcccctccgcggcctcctctccgcacacctcgagcccgaccttcccacctgccgccatggtgcccagccaggccccttacctcgtcccagcttttcccctcccagccgcgacctcacccggaagagaatacgcagcccccggaactgcaccggaaggcctgcatgggccgcccttgtccgagggcttgcagccttacccagctttcccttttccttacttggatacttttatgaccgttttcctgcctgacccccctgtctgtcctctgttgtcgccatcgtttttgccatgtccattcctgggggcgacagcctcttctgcgatatcaccctcaatgtcgtcagcaatgagtccaactctggacccacccccttcagtcaccagccaaaggagagaggaggaaaagtgggaggcacaaagcgaggggcacccgttcattacttcgagaagcagctcacccttgcagttaaacttacttcaggaagagatgcccagaccctctgaatctccagatcagatgagaaggaacacgtgcccacaaactgagtattgtgttacaggcaacaatggcagtgagagcagtcctgctactaccggtgcactgtccacggggtcacctcccagggagaatccatcccatcctactgccagcgctctgtccacaggatcgcctcccatgaagaatccatcccatcctactgccagcgctctgtccacgggatcgcctcccatgaagaatccatcccatcctactgccagcacactgtccatgggattgcctcccagcaggactccatcccatcctactgccactgttctgtccacggggtcacctcccagcgaatccccatccagaactggttcagcagcatcaggaagcagcgacagcagtatataccttactagtagtgtttattcttctaaaatctcccaaaatgggcagcaatctcaggacgtacagaaaaaagaaacatttcctaatgtcgccgaagagcccatctggagaatgatacggcagacacctgagcgcattctcatgacataccaggtacctgagagggttaaagaagttgtactaaaagaagacctggaaaagctagaaagtatgaggcagcagcagccccagttttctcatgggcaaaaggaggagctggctaaggtgtataattggattcaaagccagactgtcactcaagaaatcgacattcaagcctgtgtcacttgtgaaaatgaagattcagctgatggtgcggccacatcctgtggtcaggttctggtagaagacagctgttgagtgactgtgaggatgaaccttcataccctttccaagacgtgttacacagacagacctttttaagtcctggacttttaaatgaccatgaagttatcattgaatgttaagattttttcttcttgattttttaatacacgtaatctttttgaagcagacattgtatacagaatcttacttctctttgttcctgatatattaaaatggccagttaggctctttttgtagttgaattgtcttctaaagagattggatggcctctaaagaggtatgtgtatctttatttcagatgtcacccagagtaaattataattagaagtatagctagaatgagccccaaaccttagcctcatttattttgttctgttacataagtcattttccccttagagtgcttgaagaaatgccacctacaggttgtgtacttttcataatggtttccatgaatgtagtacgttcatacaggcttcattcaacctggcgttcccctccataattaagatgaaacattccggttttctcacaacacattagcacatactgtccattagcatatctgggataaccaggttttgggggttgagttttggccttcatccttgtagatccctttcctattgatttcccaccttccagtgaaattctgaaagtcttatcttaaaaatcgatccgcttaccatgggcctattcttgtaagtttcagttagcatttgcatgtgtaatattaaaatgaaagagcttcttacccagtgctgttgcccttttgagtatttttgtttttaaaataatgattgtaaaatgttttacaagtaatgtaaaagctagtatcattcttacatacttctgtgtttaaattttcattcttaccaaaacagttaactctttctttccaatcaatttatacaaaagaggtcgctccagccctaccacaggtctgactggcactgccttttgtttgcccttgaacagggcagtgttgtggggactgcaaaagagaaaacgtccaggcgagcccagttgtcctcgcccacagggtcctgcaggctccatcagtcaccgctttctatggcgtttgtagttgtgtcttttaagaagtgagtgtgattgtttacttgataaatcagctcactctctggtgctttttagagaagtccctgattccttcttaaacttggaatgatagatgaaattcacacccctgcagatcagaaaaaacaaatagaagaaaatgagggttacagtaacctgttgtctttatataacttgcaacaaactaatttatttttttttcctttttttgtttttggttttttatggttttttaaggaaaatacttttctcctttgaagttttacagctttttgtaaatgcgtcctgataatgattaggaaaatcgaccttttcatccatgatgaccatcctcatagctcagatttcctttcaaagtagtggctttctggatggtaattccatcttaaggtgtcagaactattttcaaatgctgcctttgacagttcttggaattttctgatattaagcagttccatgcaaatattcgtgttttataaatagctctcatagtctgctccatcttgatagttaagtgatttctgaagcgtttgtgtgtgtgttgatcaggttgtgtgatatttttgcttgataaagaatcaaatttgaaacaattaaccagccagtagattgtctgtcagtgaccttctgtagtaataaagtttttgccactgtaaataaaaacagtatccgtagctatcaggatcattgcgcactcatatatgctaagccttctgttctctaatagaagcctttcttttccattgtttctggatatttgtattatccaaatgtgcttatttctttgccttagcacacgttttatggagtacttgttatactaggtttgatttgaaactggtgcttgtcgcagaactgtcagagcatgaggagcgctcctcctgtgggtggacgcattcacgcactcccaggttgcacctgctgctggcggtgagcagggggttcagcagcttgaccgatgccccccgagggggctctccccagcttaaactttgttgtttaaatttgttaactttttatattaatgactattgaaagtggtaataaaaatttatattataggcttcaatgttttcatgaatgttacccaaaaagctgtgttttctttggtcagaggtcaaaatttatgaaaaacaaaatgctgtatgaatggaaatcattttgcaattgagtgacacttcattgtaattcacagtgtaaatttaatccaaactgaaattttgtttcaactgaatttgtaattaactctgaatttgtttttaatcattagtaatatttcagttgggtatctttttaagtaaaaacaacaaataaactctgtacatgtaaaacgtgaaaaaaaaaaagctt

SEQ ID NO: 371734 - DNA, 5806 bp, Homo sapiens
tcagtagagctgtattacctacctaggacctgactggaacatcgatcctaagctacctgcaccctgaagatcgttctctgatggtggccatacaccaaaaagttttgaagtatgcagggcatcctccctttgaacattctcccatacgattttgtactcaaaacggagactacatcatactggattccagttggtccagcacaagaaccaggctgctttgatcctgaatcgtaagaaagatgtcctggcgtcttctcactttgttgacctgcttgcacctcaagacatgagggtattctacgcgcacactgccagagctcagcttcctttctggaacaactggacccaaagagcagctgcacggtatgaatgtgctccggtgaaaccttttttctgcaggatccgtggaggtgaagacagaaagcaagagaagtgtcactccccattccggatcatcccctatctgattcatgtacatcaccctgcccagccagaattggaatcggaaccttgctgtctcactgtggttgaaaagattcactctggttatgaagctcctcggatcccagtgaataaaagaatcttcaccaccacacacaccccagggtgtgtttttcttgaagtagatgaaaaagcagtgcctttgctgggttacctacctcaggacctgattggaacatcgatcctaagctacctgcaccctgaagatcgttctctgatggttgccatacaccaaaaagttttgaagtatgcagggcatcctccctttgaacattctcccattcgattttgtactcaaaacggagactacatcatactggattccagttggtccagctttgtgaatccctggagccggaagatttctttcatcattggtcggcataaagttcgaacgagcccactaaatgaggatgtttttgctaccaaaattaaaaagatgaacgataatgacaaagacataacagaattacaagaacaaatttacaaacttctcttacagccagttcacgtgagcgtgtccagcggctacgggagcctggggagcagcgggtcgcaggagcagcttgtcagcatcgcctcctccagtgaggccagtgggcaccgtgtggaggagacgaaggcggagcagatgaccttgcagcaggtctatgccagtgtgaacaaaattaaaaatctgggtcagcagctctacattgagtcaatgaccaaatcatcattcaagccagtgacggggacacgcacagaaccgaatggtggtggtgaatgtaagacctttacttccttccaccaaacactgaaaaacaatagtgtgtacactgagccctgtgaggatttgaggaacgatgagcacagcccatcctatcaacagatcaactgtatcgacagtgtcatcagatacctgaagagctacaacattccagctttgaaaagaaagtgtatctcctgtacaaatacaacttcttcctcctcagaagaagacaaacagaaccacaaggcagatgatgtccaagccttacaagctggtttgcaaatcccagccatacctaaatcagaaatgccaacaaatggacggtccatagacacaggaggaggagctccacagatcctgtccacggcgatgctgagcttggggtcgggcataagccaatgcggttacagcagcaccattgtccatgtcccacccccagagacagccagggatgctaccctcttctgtgagccctggaccctgaacatgcagccagcccctttgacctcggaagaatttaaacacgtggggctcacagcggctgttctgtcagcgcacacccagaaggaagagcagaattatgttgataaattccgagaaaagatcctgtcatcaccctacagctcctatcttcagcaagaaagcaggagcaaagctaaatattcatattttcaaggagattctacttccaagcagacgcggtcggccggctgcaggaaagggaagcacaagcggaagaagctgccggagccgccagacagcagcagctcgaacaccggctctggtccccgcaggggagcgcatcagaacgcacagccctgctgcccctccgcggcctcctctccgcacacctcgagcccgaccttcccacctgccgccatggtgcccagccaggccccttacctcgtcccagcttttcccctcccagccgcgacctcacccggaagagaatacgcagcccccggaactgcaccggaaggcctgcatgggccgcccttgtccgagggcttgcagccttacccagctttcccttttccttacttggatacttttatgaccgttttcctgcctgacccccctgtctgtcctctgttgtcgccatcgtttttgccatgtccattcctgggggcgacagcctcttctgcgatatcaccctcaatgtcgtcagcaatgagtccaactctggacccacccccttcagtcaccagccaaaggagagaggaggaaaagtgggaggcacaaagcgaggggcacccgttcattacttcgagaagcagctcacccttgcagttaaacttacttcaggaagagatgcccagaccctctgaatctccagatcagatgagaaggaacacgtgcccacaaactgagtattgtgttacaggcaacaatggcagtgagagcagtcctgctactaccggtgcactgtccacggggtcacctcccagggagaatccatcccatcctactgccagcgctctgtccacaggatcgcctcccatgaagaatccatcccatcctactgccagcgctctgtccacgggatcgcctcccatgaagaatccatcccatcctactgccagcacactgtccatgggattgcctcccagcaggactccatcccatcctactgccactgttctgtccacggggtcacctcccagcgaatccccatccagaactggttcagcagcatcaggaagcagcgacagcagtatataccttactagtagtgtttattcttctaaaatctcccaaaatgggcagcaatctcaggacgtacagaaaaaagaaacatttcctaatgtcgccgaagagcccatctggagaatgatacggcagacacctgagcgcattctcatgacataccaggtacctgagagggttaaagaagttgtactaaaagaagacctggaaaagctagaaagtatgaggcagcagcagccccagttttctcatgggcaaaaggaggagctggctaaggtgtataattggattcaaagccagactgtcactcaagaaatcgacattcaagcctgtgtcacttgtgaaaatgaagattcagctgatggtgcggccacatcctgtggtcaggttctggtagaagacagctgttgagtgactgtgaggatgaaccttcataccctttccaagacgtgttacacagacagacctttttaagtcctggacttttaaatgaccatgaagttatcattgaatgttaagattttttcttcttgattttttaatacacgtaatctttttgaagcagacattgtatacagaatcttacttctctttgttcctgatatattaaaatggccagttaggctctttttgtagttgaattgtcttctaaagagattggatggcctctaaagaggtatgtgtatctttatttcagatgtcacccagagtaaattataattagaagtatagctagaatgagccccaaaccttagcctcatttattttgttctgttacataagtcattttccccttagagtgcttgaagaaatgccacctacaggttgtgtacttttcataatggtttccatgaatgtagtacgttcatacaggcttcattcaacctggcgttcccctccataattaagatgaaacattccggttttctcacaacacattagcacatactgtccattagcatatctgggataaccaggttttgggggttgagttttggccttcatccttgtagatccctttcctattgatttcccaccttccagtgaaattctgaaagtcttatcttaaaaatcgatccgcttaccatgggcctattcttgtaagtttcagttagcatttgcatgtgtaatattaaaatgaaagagcttcttacccagtgctgttgcccttttgagtatttttgtttttaaaataatgattgtaaaatgttttacaagtaatgtaaaagctagtatcattcttacatacttctgtgtttaaattttcattcttaccaaaacagttaactctttctttccaatcaatttatacaaaagaggtcgctccagccctaccacaggtctgactggcactgccttttgtttgcccttgaacagggcagtgttgtggggactgcaaaagagaaaacgtccaggcgagcccagttgtcctcgcccacagggtcctgcaggctccatcagtcaccgctttctatggcgtttgtagttgtgtcttttaagaagtgagtgtgattgtttacttgataaatcagctcactctctggtgctttttagagaagtccctgattccttcttaaacttggaatgatagatgaaattcacacccctgcagatcagaaaaaacaaatagaagaaaatgagggttacagtaacctgttgtctttatataacttgcaacaaactaatttatttttttttcctttttttgtttttggttttttatggttttttaaggaaaatacttttctcctttgaagttttacagctttttgtaaatgcgtcctgataatgattaggaaaatcgaccttttcatccatgatgaccatcctcatagctcagatttcctttcaaagtagtggctttctggatggtaattccatcttaaggtgtcagaactattttcaaatgctgcctttgacagttcttggaattttctgatattaagcagttccatgcaaatattcgtgttttataaatagctctcatagtctgctccatcttgatagttaagtgatttctgaagcgtttgtgtgtgtgttgatcaggttgtgtgatatttttgcttgataaagaatcaaatttgaaacaattaaccagccagtagattgtctgtcagtgaccttctgtagtaataaagtttttgccactgtaaataaaaacagtatccgtagctatcaggatcattgcgcactcatatatgctaagccttctgttctctaatagaagcctttcttttccattgtttctggatatttgtattatccaaatgtgcttatttctttgccttagcacacgttttatggagtacttgttatactaggtttgatttgaaactggtgcttgtcgcagaactgtcagagcatgaggagcgctcctcctgtgggtggacgcattcacgcactcccaggttgcacctgctgctggcggtgagcagggggttcagcagcttgaccgatgccccccgagggggctctccccagcttaaactttgttgtttaaatttgttaactttttatattaatgactattgaaagtggtaataaaaatttatattataggcttcaatgttttcatgaatgttacccaaaaagctgtgttttctttggtcagaggtcaaaatttatgaaaaacaaaatgctgtatgaatggaaatcattttgcaattgagtgacacttcattgtaattcacagtgtaaatttaatccaaactgaaattttgtttcaactgaatttgtaattaactctgaatttgtttttaatcattagtaatatttcagttgggtatctttttaagtaaaaacaacaaataaactctgtacatgtaaaacgtgaaaaaaaaaaagctt

SEQ ID NO: 371735 - DNA, 6116 bp, Homo sapiens
agactgcgcgagggcggccccgggggcgagcggctgtgcgcggggccaagggcgggggcagcaggccggagtcctgaaagtcgagcgagctccgggttttgaaaatgttggagggaaaagctcctcggagatgagcgtgaccccctggctcgtggtggccgcctgttctcactaacgccatggcggggaccggagtgagaaaccggtgtctgtcactgactgcaaagtgagcgagaagcaggctgcgggccgtcccagcacgacgtggagccccgcggagacctcgagatgccccgcggggaagctcctggccccgggagacggggggctaaggacgaggccctgggcgaagaatcgggggagcggtggagccccgagttccatctgcagaggaaattggcggacagcagccacagtgaacagcaagatcgaaacagagtttctgaagaacttatcatggttgtccaagaaatgaaaaaatacttcccctcggagagacgcaataaaccaagcactctagatgccctcaactatgctctccgctgtgtccacagcgttcaagcaaacagtgagtttttccagattctcagtcagaatggagcacctcaggcagatgtgagcatgtacagtcttgaggagctggccactatcgcttcagaacacacttccaaaaacacagatacctttgtggcagtattttcatttctgtctggaaggttagtgcacatttctgaacaggctgctttgatcctgaatcgtaagaaagatgtcctggcgtcttctcactttgttgacctgcttgcacctcaagacatgagggtattctacgcgcacactgccagagctcagcttcctttctggaacaactggacccaaagagcagctgcacggtatgaatgtgctccggtgaaaccttttttctgcaggatccgtggaggtgaagacagaaagcaagagaagtgtcactccccattccggatcatcccctatctgattcatgtacatcaccctgcccagccagaattggaatcggaaccttgctgtctcactgtggttgaaaagattcactctggttatgaagctcctcggatcccagtgaataaaagaatcttcaccaccacacacaccccagggtgtgtttttcttgaagtagatgaaaaagcagtgcctttgctgggttacctacctcaggacctgattggaacatcgatcctaagctacctgcaccctgaagatcgttctctgatggttgccatacaccaaaaagttttgaagtatgcagggcatcctccctttgaacattctcccattcgattttgtactcaaaacggagactacatcatactggattccagttggtccagctttgtgaatccctggagccggaagatttctttcatcattggtcggcataaagttcgaacgagcccactaaatgaggatgtttttgctaccaaaattaaaaagatgaacgataatgacaaagacataacagaattacaagaacaaatttacaaacttctcttacagccagttcacgtgagcgtgtccagcggctacgggagcctggggagcagcgggtcgcaggagcagcttgtcagcatcgcctcctccagtgaggccagtgggcaccgtgtggaggagacgaaggcggagcagatgaccttgcagcaggtctatgccagtgtgaacaaaattaaaaatctgggtcagcagctctacattgagtcaatgaccaaatcatcattcaagccagtgacggggacacgcacagaaccgaatggtggtggtgaatgtaagacctttacttccttccaccaaacactgaaaaacaatagtgtgtacactgagccctgtgaggatttgaggaacgatgagcacagcccatcctatcaacagatcaactgtatcgacagtgtcatcagatacctgaagagctacaacattccagctttgaaaagaaagtgtatctcctgtacaaatacaacttcttcctcctcagaagaagacaaacagaaccacaaggcagatgatgtccaagccttacaagctggtttgcaaatcccagccatacctaaatcagaaatgccaacaaatggacggtccatagacacaggaggaggagctccacagatcctgtccacggcgatgctgagcttggggtcgggcataagccaatgcggttacagcagcaccattgtccatgtcccacccccagagacagccagggatgctaccctcttctgtgagccctggaccctgaacatgcagccagcccctttgacctcggaagaatttaaacacgtggggctcacagcggctgttctgtcagcgcacacccagaaggaagagcagaattatgttgataaattccgagaaaagatcctgtcatcaccctacagctcctatcttcagcaagaaagcaggagcaaagctaaatattcatattttcaaggagattctacttccaagcagacgcggtcggccggctgcaggaaagggaagcacaagcggaagaagctgccggagccgccagacagcagcagctcgaacaccggctctggtccccgcaggggagcgcatcagaacgcacagccctgctgcccctccgcggcctcctctccgcacacctcgagcccgaccttcccacctgccgccatggtgcccagccaggccccttacctcgtcccagcttttcccctcccagccgcgacctcacccggaagagaatacgcagcccccggaactgcaccggaaggcctgcatgggccgcccttgtccgagggcttgcagccttacccagctttcccttttccttacttggatacttttatgaccgttttcctgcctgacccccctgtctgtcctctgttgtcgccatcgtttttgccatgtccattcctgggggcgacagcctcttctgcgatatcaccctcaatgtcgtcagcaatgagtccaactctggacccacccccttcagtcaccagccaaaggagagaggaggaaaagtgggaggcacaaagcgaggggcacccgttcattacttcgagaagcagctcacccttgcagttaaacttacttcaggaagagatgcccagaccctctgaatctccagatcagatgagaaggaacacgtgcccacaaactgagtattgtgttacaggcaacaatggcagtgagagcagtcctgctactaccgtgttctgtccacggggtcacctcccagcgaatccccatccagaactggttcagcagcatcaggaagcagcgacagcagtatataccttactagtagtgtttattcttctaaaatctcccaaaatgggcagcaatctcaggacgtacagaaaaaagaaacatttcctaatgtcgccgaagagcccatctggagaatgatacggcagacacctgagcgcattctcatgacataccaggtacctgagagggttaaagaagttgtactaaaagaagacctggaaaagctagaaagtatgaggcagcagcagccccagttttctcatgggcaaaaggaggagctggctaaggtgtataattggattcaaagccagactgtcactcaagaaatcgacattcaagcctgtgtcacttgtgaaaatgaagattcagctgatggtgcggccacatcctgtggtcaggttctggtagaagacagctgttgagtgactgtgaggatgaaccttcataccctttccaagacgtgttacacagacagacctttttaagtcctggacttttaaatgaccatgaagttatcattgaatgttaagattttttcttcttgattttttaatacacgtaatctttttgaagcagacattgtatacagaatcttacttctctttgttcctgatatattaaaatggccagttaggctctttttgtagttgaattgtcttctaaagagattggatggcctctaaagaggtatgtgtatctttatttcagatgtcacccagagtaaattataattagaagtatagctagaatgagccccaaaccttagcctcatttattttgttctgttacataagtcattttccccttagagtgcttgaagaaatgccacctacaggttgtgtacttttcataatggtttccatgaatgtagtacgttcatacaggcttcattcaacctggcgttcccctccataattaagatgaaacattccggttttctcacaacacattagcacatactgtccattagcatatctgggataaccaggttttgggggttgagttttggccttcatccttgtagatccctttcctattgatttcccaccttccagtgaaattctgaaagtcttatcttaaaaatcgatccgcttaccatgggcctattcttgtaagtttcagttagcatttgcatgtgtaatattaaaatgaaagagcttcttacccagtgctgttgcccttttgagtatttttgtttttaaaataatgattgtaaaatgttttacaagtaatgtaaaagctagtatcattcttacatacttctgtgtttaaattttcattcttaccaaaacagttaactctttctttccaatcaatttatacaaaagaggtcgctccagccctaccacaggtctgactggcactgccttttgtttgcccttgaacagggcagtgttgtggggactgcaaaagagaaaacgtccaggcgagcccagttgtcctcgcccacagggtcctgcaggctccatcagtcaccgctttctatggcgtttgtagttgtgtcttttaagaagtgagtgtgattgtttacttgataaatcagctcactctctggtgctttttagagaagtccctgattccttcttaaacttggaatgatagatgaaattcacacccctgcagatcagaaaaaacaaatagaagaaaatgagggttacagtaacctgttgtctttatataacttgcaacaaactaatttatttttttttcctttttttgtttttggttttttatggttttttaaggaaaatacttttctcctttgaagttttacagctttttgtaaatgcgtcctgataatgattaggaaaatcgaccttttcatccatgatgaccatcctcatagctcagatttcctttcaaagtagtggctttctggatggtaattccatcttaaggtgtcagaactattttcaaatgctgcctttgacagttcttggaattttctgatattaagcagttccatgcaaatattcgtgttttataaatagctctcatagtctgctccatcttgatagttaagtgatttctgaagcgtttgtgtgtgtgttgatcaggttgtgtgatatttttgcttgataaagaatcaaatttgaaacaattaaccagccagtagattgtctgtcagtgaccttctgtagtaataaagtttttgccactgtaaataaaaacagtatccgtagctatcaggatcattgcgcactcatatatgctaagccttctgttctctaatagaagcctttcttttccattgtttctggatatttgtattatccaaatgtgcttatttctttgccttagcacacgttttatggagtacttgttatactaggtttgatttgaaactggtgcttgtcgcagaactgtcagagcatgaggagcgctcctcctgtgggtggacgcattcacgcactcccaggttgcacctgctgctggcggtgagcagggggttcagcagcttgaccgatgccccccgagggggctctccccagcttaaactttgttgtttaaatttgttaactttttatattaatgactattgaaagtggtaataaaaatttatattataggcttcaatgttttcatgaatgttacccaaaaagctgtgttttctttggtcagaggtcaaaatttatgaaaaacaaaatgctgtatgaatggaaatcattttgcaattgagtgacacttcattgtaattcacagtgtaaatttaatccaaactgaaattttgtttcaactgaatttgtaattaactctgaatttgtttttaatcattagtaatatttcagttgggtatctttttaagtaaaaacaacaaataaactctgtacatgtaaaacgtgaaaaaaaaaaagctt

SEQ ID NO: 371736 - DNA, 2176 bp, Homo sapiens
agactgcgcgagggcggccccgggggcgagcggctgtgcgcggggccaagggcgggggcagcaggccggagtcctgaaagtcgagcgagctccgggttttgaaaatgttggagggaaaagctcctcggagatgagcgtgaccccctggctcgtggtggccgcctgttctcactaacgccatggcggggaccggagtgagaaaccggtgtctgtcactgactgcaaagtgagcgagaagcaggctgcgggccgtcccagcacgacgtggagccccgcggagacctcgagatgccccgcggggaagctcctggccccgggagacggggggctaaggacgaggccctgggcgaagaatcgggggagcggtggagccccgagttccatctgcagaggaaattggcggacagcagccacagtgaacagcaagatcgaaacagagtttctgaagaacttatcatggttgtccaagaaatgaaaaaatacttcccctcggagagacgcaataaaccaagcactctagatgccctcaactatgctctccgctgtgtccacagcgttcaagcaaacagtgagtttttccagattctcagtcagaatggagcacctcaggcagatgtgagcatgtacagtcttgaggagctggccactatcgcttcagaacacacttccaaaaacacagatacctttgtggcagtattttcatttctgtctggaaggttagtgcacatttctgaacaggctgctttgatcctgaatcgtaagaaagatgtcctggcgtcttctcactttgttgacctgcttgcacctcaagacatgagggtattctacgcgcacactgccagagctcagcttcctttctggaacaactggacccaaagagcagctgcacggtatgaatgtgctccggtgaaaccttttttctgcaggatccgtggaggtgaagacagaaagcaagagaagtgtcactccccattccggatcatcccctatctgattcatgtacatcaccctgcccagccagaattggaatcggaaccttgctgtctcactgtggttgaaaagattcactctggttatgaagctcctcggatcccagtgaataaaagaatcttcaccaccacacacaccccagggtgtgtttttcttgaagtagatgaaaaagcagtgcctttgctgggttacctacctcaggacctgattggaacatcgatcctaagctacctgcaccctgaagatcgttctctgatggttgccatacaccaaaaagttttgaagtatgcagggcatcctccctttgaacattctcccattcgattttgtactcaaaacggagactacatcatactggattccagttggtccagctttgtgaatccctggagccggaagatttctttcatcattggtcggcataaagttcgaacgagcccactaaatgaggatgtttttgctaccaaaattaaaaagatgaacgataatgacaaagacataacagaattacaagaacaaatttacaaacttctcttacagccagttcacgtgagcgtgtccagcggctacgggagcctggggagcagcgggtcgcaggagcagcttgtcagcatcgcctcctccagtgaggccagtgggcaccgtgtggaggagacgaaggcggagcagatgaccttgcagcaggtctatgccagtgtgaacaaaattaaaaatctgggtcagcagctctacattgagtcaatgaccaaatcatcattcaagccagtgacggggacacgcacagaaccgaatggtggtggtgagtcagcgaatggtggtggtgagtcagccggcagccccaaggatctccttccatgggctgtcactctctgcatagacgtcatgtatgtgattcgtgagcataaagtcatgaccctgtgttgctgcttttcatatttcttgatttgcctagatagcaatagtaatagcaatagtagtaataataatggcagcaacaaatactgttctgaaaggaaatggtattagaatgtatttgtaacagttgcagttcacttttactgaagaattaacttctctgtaaataccaacgaattatagatttccctccctacatgggcatctctttaaacaaaaagagtggattttagaatgcattttaaataataaagtatattaaaatgaaaat

SEQ ID NO: 371737 - DNA, 1255 bp, Homo sapiens
agactgcgcgagggcggccccgggggcgagcggctgtgcgcggggccaagggcgggggcagcaggccggagtcctgaaagtcgagcgagctccgggttttgaaaatgttggagggaaaagctcctcggagatgagcgtgaccccctggctcgtggtggccgcctgttctcactaacgccatggcggggaccggagtgagaaaccggtgtctgtcactgactgcaaagtgagcgagaagcaggctgcgggccgtcccagcacgacgtggagccccgcggagacctcgagatgccccgcggggaagctcctggccccgggagacggggggctaaggacgaggccctgggcgaagaatcgggggagcggtggagccccgagttccatctgcagaggaaattggcggacagcagccacagtgaacagcaagatcgaaacagagtttctgaagaacttatcatggttgtccaagaaatgaaaaaatacttcccctcggagagacgcaataaaccaagcactctagatgccctcaactatgctctccgctgtgtccacagcgttcaagcaaacagtgagtttttccagattctcagtcagaatggagcacctcaggcagatgtgagcatgtacagtcttgaggagctggccactatcgcttcagaacacacttccaaaaacacattccaatacctactacttcaagttgtaacaactggatgttatagaacaggatacctttgtggcagtattttcatttctgtctggaaggttagtgcacatttctgaacaggctgctttgatcctgaatcgtaagaaagatgtcctggcgtcttctcactttgttgacctgcttgcacctcaagacatgagggtattctacgcgcacactgccagagctcagcttcctttctggaacaactggacccaaagaggtaacaggaccaatgttcagatgtctatctttcctcatcaagatcagtttcattcttacaggaatagtacagaaattaacatattatttagaacatgcacactatctggtttttcttattcctgttatagaaagtcacgtgatgaaaacagcattttaaaagcttctgataacatactcaatacgtttgtttccattttgtcacatctgtttcacagatgatatgtcataaatattatttcattaccagcgtattgtatagtggtttagttgctatgaaggctctgtttcctttaagttaaaattaaatgtttttcctccttcatg

SEQ ID NO: 371738 - DNA, 3556 bp, Homo sapiens
agggaagcgcgcggccgcgagccctgggcgccagcggagactcgctgtttgtggcccaggtgcaggaagcttacgcggtggcagccgctcgctgaggtagtctctcgcggcgccggggatccctgaacacagacagcgcgggactgagaaggaaagcttctttctgggcagccagagccgcaaaggtggagccgcgttggcgccctccgcgggaccagcgcctcggatgcgggcggagcgcggggggccgcggctgcgggagcgcgaagcggggggccaggggcgcctcatgtgagagccgcgggacctgcagccgccgccgtccccggagcacggggtggtgtgtgggggaagccgcccccggcagcaggatgaaacgaggaggaagagatagtgaccgtaattcatcagaagaaggaactgcagagaaatccaagaaactgaggactacaaatgagcattctcagacttgtgattggggtaatctccttcaggacattattctccaagtatttaaatatttgcctcttcttgaccgggctcatgcttcacaagtttgccgcaactggaaccaggtatttcacatgcctgacttgtggagatgttttgaatttgaactgaatcagccagctacatcttatttgaaagctacccatccagagctgatcaaacagattattaaaagacattcaaaccatctacaatatgtcagcttcaaggtggacagcagcaaggaatcagctgaagcagcttgtgatatactatcgcaacttgtgaattgctctttaaaaacacttggacttatttcaactgctcgaccaagctttatggatttaccaaagtctcactttatctctgcactgacagttgtgttcgtaaactccaaatccctgtcttcgcttaagatagatgatactccagtagatgatccatctctcaaagtactagtggccaacaatagtgatacactcaagctgttgaaaatgagcagctgtcctcatgtctctccagcaggtatcctttgtgtggctgatcagtgtcacggcttaagagaactagccctgaactaccacttattgagtgatgagttgttacttgcattgtcttctgaaaaacatgttcgattagaacatttgcgcattgatgtagtcagtgagaatcctggacagacacacttccatactattcagaagagtagctgggatgctttcatcagacattcacccaaagtgaacttagtgatgtatttttttttatatgaagaagaatttgaccccttctttcgctatgaaatacctgccacccatctgtactttgggagatcagtaagcaaagatgtgcttggccgtgtgggaatgacatgccctagactggttgaactagtagtgtgtgcaaatggattacggccacttgatgaagagttaattcgcattgcagaacgttgcaaaaatttgtcagctattggactaggggaatgtgaagtctcatgtagtgcctttgttgagtttgtgaagatgtgtggtggccgcctatctcaattatccattatggaagaagtactaattcctgaccaaaagtatagtttggagcagattcactgggaagtgtccaagcatcttggtagggtgtggtttcccgacatgatgcccacttggtaaaaactgcatgatgaatagcaccttaatttcaagcaaatgtattataattaaagttttatttgctgtagttctgatataattctactattttgtggcacagaaatttgatatcttcagtcagtatatgtaaagattgtttatcggaagacccatgaatgagttttggtcagaaaattccacttgtttccttagtgtaatagcagtcatatctccgaattttttttaatgtggttcggatgtgaaataaccagttatacgtattaaacagtttacagtctaaaggaaacaaaacctatatgttataatatccaagaagtactaataggttttctgaaatgttatattctctatgcatttaaaaaaaaatgtaaacttgacattttagggtcttcagttacacatacacctgttataaggtgtttaatatagctcaggaaagtgagcattttgtgagaaaaatgaatatatcatatctaatggaaaagattggatgaatgttctcaaatgttacaaagctgtttaaagaaaaaggtatatataagtaatcagaacacttagaagactgatagatgtcacacagtggtattatagaaggataatacagagccaagatcaaattaaaagacaataaatggaacagaagggaggcagtgtttagctttgtataaacttttaggtttgctctgtaatctgctaaaccatatacattcttttgtgatatgttattatgtatgtggcacttgaggcactgtatgtaaagtaaggaatgctttactagttctccttggttttatctttgtttaaactagctttaaagtattaaacaataattgaaatgaaaagcttacctattttaaaaagccaaatttaaataaatatagaactttaaaatgtttatcagttgtttccatgaaagaatattagtttccagtaaattttagtgatggctcactcacttttctattttggaattacatagttatgtaagtaaaatttttaaaaatcataaagggagcaccattgtacagtctagcataaacagcaaattttaaagaggacatatttaagttcataatcatatttttcagtaaatattgctcagtgaactggaaaactttaatagaaaaatgtctgcagttttgtgattgttaatttggttaaaccgatattttatattatttaagttaggtaacattttatattactttcatatgaataaaagtaatccatgcattgtagagtctataaaatgttgagtttttttagatgatataaactttgattctgggcactagtgctagtagatattactaccctcctgagggaaatcagaaatgatttaaccccagtggaatacattaattcttaaagcggctcttttcagtagtgtgacttttagaaagtgtctcagtagttaaggaagctaacagtcttagatctacttttaaaacggatggccttcttaagaataaagcaaaaggtgattttctacataatttttgctttccaaaagtgatgatatgctctcctacagcaacatatgagaagaaaaaaggcttatctagattcgaaaattaacagcaattatagtaatatatcccctccttctaaatagtaaaaagctctgattgtacaagaattacctgtgctagtcaagttgttgtttttccttgaacaactttggaaaaatggatttgacagtacataatcagttctactaaccaaagcttgtatttggaaatttactttttgtacaaattgaattatataatgcttaaaatactttgtcactttataagcaaaatgcatagtacttaatttgtttatactgtaaagtatatgttaaatgcttttatcactttgagaataaaaagttactaatgctgttgtattttact

SEQ ID NO: 371739 - DNA, 4715 bp, Homo sapiens
gctgaggcaggcagatcacctgaggtcaggagttcaagaccagcctggccaacatggtgaaaccctgtctctactaaaaatacaaaaaattagctgggcgtggtggcaggcacctgtaatcccagctacttgggaggctgaggcaggagaattgctggaaccatgatcgtgccactgcactccagcctgggtgacagagcgagaccccatcttgaatgaatgagtgaacggaatgaatgaatgagtgaacggaatgaatgaatgaatcattctctgccttctgggtagtaaccctggtttttagcatgttgtgtactttaatgtcgttaatgctggactgctttcctacacaacagtcatatctcaacagttcaacagtcgtatctcccctttgaaaagccttaatagtattgcatttctcacagaaaccctgttttattaaactaattttggaaatttaagcacaggaatatcaagtaatttgctcaaagccacatagccagtgagaggtagagccagaattcaaacccaaggagcttggttccagagcccattctctttagccataatactgttttgccatgaaaaaactatctttcaaagaaactaatggaatgaaagtgctaagaatacatagaataaacaaataggtataattcagaaacacaacttggggaaaacagtgcaatattaagtgatgtgtttgaagaagcagctacattccagaccaaacaattcatagtaggggtggttttgcttattttaggcggagttaagaaatgtctggcagtaacacatagcatagcccagtgcctgtccgtggcagggggtgatttcaggaagaaactgttccacctcagatcatcaggcattaagagtctcataaggagcgcacaacctagatccctcatgtggacatttcacaataagattctcactcctatgagaatctaatgtagctgctgatctgacaggaggaggagttcagactgtaaagcttgctcacttcctgctatggggcccagttctggtcctcaggccagaaccacaggacccctgtatagactattaaatgtggaacatcctctctggaggttcttgggaccctggttggcctggaattcaagaacaaatatccttagatgacttttaagaaacctttacaaagtatcgctgtaggttcccttttatattcattttagttaagttgaccacaacttttgaaatataaattcttagcatagtttcaaaatcataatactctctcccatgtagtatatactgtatattatactgataaatgtagatgtttaaaaacatgccaaaaaagtgtaaaatttataaaaccattgttggccttcattggcatttttcataatagtttgttttggtattcttgaattactgatccagtttttcctgcatgtttgtgtatataaacacacatctcagtgacagaagaatgaattttgagtttatttctattcaaaagttgagtaggaaaaaaactgatgcatttttcggaataggatgaaacgaggaggaagagatagtgaccgtaattcatcagaagaaggaactgcagagaaatccaagaaactgaggactacaaatgagcattctcagacttgtgattggggtaatctccttcaggacattattctccaagtatttaaatatttgcctcttcttgaccgggctcatgcttcacaagtttgccgcaactggaaccaggtatttcacatgcctgacttgtggagatgttttgaatttgaactgaatcagccagctacatcttatttgaaagctacccatccagagctgatcaaacagattattaaaagacattcaaaccatctacaatatgtcagcttcaaggtggacagcagcaaggaatcagctgaagcagcttgtgatatactatcgcaacttgtgaattgctctttaaaaacacttggacttatttcaactgctcgaccaagctttatggatttaccaaagtctcactttatctctgcactgacagttgtgttcgtaaactccaaatccctgtcttcgcttaagatagatgatactccagtagatgatccatctctcaaagtactagtggccaacaatagtgatacactcaagctgttgaaaatgagcagctgtcctcatgtctctccagcaggtatcctttgtgtggctgatcagtgtcacggcttaagagaactagccctgaactaccacttattgagtgatgagttgttacttgcattgtcttctgaaaaacatgttcgattagaacatttgcgcattgatgtagtcagtgagaatcctggacagacacacttccatactattcagaagagtagctgggatgctttcatcagacattcacccaaagtgaacttagtgatgtatttttttttatatgaagaagaatttgaccccttctttcgctatgaaatacctgccacccatctgtactttgggagatcagtaagcaaagatgtgcttggccgtgtgggaatgacatgccctagactggttgaactagtagtgtgtgcaaatggattacggccacttgatgaagagttaattcgcattgcagaacgttgcaaaaatttgtcagctattggactaggggaatgtgaagtctcatgtagtgcctttgttgagtttgtgaagatgtgtggtggccgcctatctcaattatccattatggaagaagtactaattcctgaccaaaagtatagtttggagcagattcactgggaagtgtccaagcatcttggtagggtgtggtttcccgacatgatgcccacttggtaaaaactgcatgatgaatagcaccttaatttcaagcaaatgtattataattaaagttttatttgctgtagttctgatataattctactattttgtggcacagaaatttgatatcttcagtcagtatatgtaaagattgtttatcggaagacccatgaatgagttttggtcagaaaattccacttgtttccttagtgtaatagcagtcatatctccgaattttttttaatgtggttcggatgtgaaataaccagttatacgtattaaacagtttacagtctaaaggaaacaaaacctatatgttataatatccaagaagtactaataggttttctgaaatgttatattctctatgcatttaaaaaaaaatgtaaacttgacattttagggtcttcagttacacatacacctgttataaggtgtttaatatagctcaggaaagtgagcattttgtgagaaaaatgaatatatcatatctaatggaaaagattggatgaatgttctcaaatgttacaaagctgtttaaagaaaaaggtatatataagtaatcagaacacttagaagactgatagatgtcacacagtggtattatagaaggataatacagagccaagatcaaattaaaagacaataaatggaacagaagggaggcagtgtttagctttgtataaacttttaggtttgctctgtaatctgctaaaccatatacattcttttgtgatatgttattatgtatgtggcacttgaggcactgtatgtaaagtaaggaatgctttactagttctccttggttttatctttgtttaaactagctttaaagtattaaacaataattgaaatgaaaagcttacctattttaaaaagccaaatttaaataaatatagaactttaaaatgtttatcagttgtttccatgaaagaatattagtttccagtaaattttagtgatggctcactcacttttctattttggaattacatagttatgtaagtaaaatttttaaaaatcataaagggagcaccattgtacagtctagcataaacagcaaattttaaagaggacatatttaagttcataatcatatttttcagtaaatattgctcagtgaactggaaaactttaatagaaaaatgtctgcagttttgtgattgttaatttggttaaaccgatattttatattatttaagttaggtaacattttatattactttcatatgaataaaagtaatccatgcattgtagagtctataaaatgttgagtttttttagatgatataaactttgattctgggcactagtgctagtagatattactaccctcctgagggaaatcagaaatgatttaaccccagtggaatacattaattcttaaagcggctcttttcagtagtgtgacttttagaaagtgtctcagtagttaaggaagctaacagtcttagatctacttttaaaacggatggccttcttaagaataaagcaaaaggtgattttctacataatttttgctttccaaaagtgatgatatgctctcctacagcaacatatgagaagaaaaaaggcttatctagattcgaaaattaacagcaattatagtaatatatcccctccttctaaatagtaaaaagctctgattgtacaagaattacctgtgctagtcaagttgttgtttttccttgaacaactttggaaaaatggatttgacagtacataatcagttctactaaccaaagcttgtatttggaaatttactttttgtacaaattgaattatataatgcttaaaatactttgtcactttataagcaaaatgcatagtacttaatttgtttatactgtaaagtatatgttaaatgcttttatcactttgagaataaaaagttactaatgctgttgtattttact

SEQ ID NO: 371740 - DNA, 3412 bp, Homo sapiens
agggaagcgcgcggccgcgagccctgggcgccagcggagactcgctgtttgtggcccaggtgcaggaagcttacgcggtggcagccgctcgctgaggtagtctctcgcggcgccggggatccctgaacacagacagcgcgggactgagaaggaaagcttctttctgggcagccagagccgcaaaggtggagccgcgttggcgccctccgcgggaccagcgcctcggatgcgggcggagcgcggggggccgcggctgcgggagcgcgaagcggggggccaggggcgcctcatgtgagagccgcgggacctgcagccgccgccgtccccggagcacggggtggtgtgtgggggaagccgcccccggcagcaggatgaaacgaggaggaagagatagtgaccgtaattcatcagaagaaggaactgcagagaaatccaagaaactgaggactacaaatgagcattctcagacttgtgattggggtaatctccttcaggacattattctccaagtatttaaatatttgcctcttcttgaccgggctcatgcttcacaagtttgccgcaactggaaccaggtggacagcagcaaggaatcagctgaagcagcttgtgatatactatcgcaacttgtgaattgctctttaaaaacacttggacttatttcaactgctcgaccaagctttatggatttaccaaagtctcactttatctctgcactgacagttgtgttcgtaaactccaaatccctgtcttcgcttaagatagatgatactccagtagatgatccatctctcaaagtactagtggccaacaatagtgatacactcaagctgttgaaaatgagcagctgtcctcatgtctctccagcaggtatcctttgtgtggctgatcagtgtcacggcttaagagaactagccctgaactaccacttattgagtgatgagttgttacttgcattgtcttctgaaaaacatgttcgattagaacatttgcgcattgatgtagtcagtgagaatcctggacagacacacttccatactattcagaagagtagctgggatgctttcatcagacattcacccaaagtgaacttagtgatgtatttttttttatatgaagaagaatttgaccccttctttcgctatgaaatacctgccacccatctgtactttgggagatcagtaagcaaagatgtgcttggccgtgtgggaatgacatgccctagactggttgaactagtagtgtgtgcaaatggattacggccacttgatgaagagttaattcgcattgcagaacgttgcaaaaatttgtcagctattggactaggggaatgtgaagtctcatgtagtgcctttgttgagtttgtgaagatgtgtggtggccgcctatctcaattatccattatggaagaagtactaattcctgaccaaaagtatagtttggagcagattcactgggaagtgtccaagcatcttggtagggtgtggtttcccgacatgatgcccacttggtaaaaactgcatgatgaatagcaccttaatttcaagcaaatgtattataattaaagttttatttgctgtagttctgatataattctactattttgtggcacagaaatttgatatcttcagtcagtatatgtaaagattgtttatcggaagacccatgaatgagttttggtcagaaaattccacttgtttccttagtgtaatagcagtcatatctccgaattttttttaatgtggttcggatgtgaaataaccagttatacgtattaaacagtttacagtctaaaggaaacaaaacctatatgttataatatccaagaagtactaataggttttctgaaatgttatattctctatgcatttaaaaaaaaatgtaaacttgacattttagggtcttcagttacacatacacctgttataaggtgtttaatatagctcaggaaagtgagcattttgtgagaaaaatgaatatatcatatctaatggaaaagattggatgaatgttctcaaatgttacaaagctgtttaaagaaaaaggtatatataagtaatcagaacacttagaagactgatagatgtcacacagtggtattatagaaggataatacagagccaagatcaaattaaaagacaataaatggaacagaagggaggcagtgtttagctttgtataaacttttaggtttgctctgtaatctgctaaaccatatacattcttttgtgatatgttattatgtatgtggcacttgaggcactgtatgtaaagtaaggaatgctttactagttctccttggttttatctttgtttaaactagctttaaagtattaaacaataattgaaatgaaaagcttacctattttaaaaagccaaatttaaataaatatagaactttaaaatgtttatcagttgtttccatgaaagaatattagtttccagtaaattttagtgatggctcactcacttttctattttggaattacatagttatgtaagtaaaatttttaaaaatcataaagggagcaccattgtacagtctagcataaacagcaaattttaaagaggacatatttaagttcataatcatatttttcagtaaatattgctcagtgaactggaaaactttaatagaaaaatgtctgcagttttgtgattgttaatttggttaaaccgatattttatattatttaagttaggtaacattttatattactttcatatgaataaaagtaatccatgcattgtagagtctataaaatgttgagtttttttagatgatataaactttgattctgggcactagtgctagtagatattactaccctcctgagggaaatcagaaatgatttaaccccagtggaatacattaattcttaaagcggctcttttcagtagtgtgacttttagaaagtgtctcagtagttaaggaagctaacagtcttagatctacttttaaaacggatggccttcttaagaataaagcaaaaggtgattttctacataatttttgctttccaaaagtgatgatatgctctcctacagcaacatatgagaagaaaaaaggcttatctagattcgaaaattaacagcaattatagtaatatatcccctccttctaaatagtaaaaagctctgattgtacaagaattacctgtgctagtcaagttgttgtttttccttgaacaactttggaaaaatggatttgacagtacataatcagttctactaaccaaagcttgtatttggaaatttactttttgtacaaattgaattatataatgcttaaaatactttgtcactttataagcaaaatgcatagtacttaatttgtttatactgtaaagtatatgttaaatgcttttatcactttgagaataaaaagttactaatgctgttgtattttact

SEQ ID NO: 371741 - DNA, 3223 bp, Homo sapiens
taccaaatacataattattttttaaagactataaattgatttactccattagtttatacagtcactttggaataaatcagtgtaaaagccaacattaaatatgtctcttatcataatgaaagctaggtcttgtcttgacaattgcccttatactttttcagagagacttagaaaaggccaagttggaggtgagggtggagggtggatgattgaaagaatattctttaagttataatgcaataaactagtaatgatacttctataaaatgaatatgtgtacagagaaatataaatatatacatgagtaatcttgaagtctgggtatttggggaaaaaagtaaaaaaataataaaatattcatgagtaaacggtgtttcttttctaaggtggacagcagcaaggaatcagctgaagcagcttgtgatatactatcgcaacttgtgaattgctctttaaaaacacttggacttatttcaactgctcgaccaagctttatggatttaccaaagtctcactttatctctgcactgacagttgtgttcgtaaactccaaatccctgtcttcgcttaagatagatgatactccagtagatgatccatctctcaaagtactagtggccaacaatagtgatacactcaagctgttgaaaatgagcagctgtcctcatgtctctccagcaggtatcctttgtgtggctgatcagtgtcacggcttaagagaactagccctgaactaccacttattgagtgatgagttgttacttgcattgtcttctgaaaaacatgttcgattagaacatttgcgcattgatgtagtcagtgagaatcctggacagacacacttccatactattcagaagagtagctgggatgctttcatcagacattcacccaaagtgaacttagtgatgtatttttttttatatgaagaagaatttgaccccttctttcgctatgaaatacctgccacccatctgtactttgggagatcagtaagcaaagatgtgcttggccgtgtgggaatgacatgccctagactggttgaactagtagtgtgtgcaaatggattacggccacttgatgaagagttaattcgcattgcagaacgttgcaaaaatttgtcagctattggactaggggaatgtgaagtctcatgtagtgcctttgttgagtttgtgaagatgtgtggtggccgcctatctcaattatccattatggaagaagtactaattcctgaccaaaagtatagtttggagcagattcactgggaagtgtccaagcatcttggtagggtgtggtttcccgacatgatgcccacttggtaaaaactgcatgatgaatagcaccttaatttcaagcaaatgtattataattaaagttttatttgctgtagttctgatataattctactattttgtggcacagaaatttgatatcttcagtcagtatatgtaaagattgtttatcggaagacccatgaatgagttttggtcagaaaattccacttgtttccttagtgtaatagcagtcatatctccgaattttttttaatgtggttcggatgtgaaataaccagttatacgtattaaacagtttacagtctaaaggaaacaaaacctatatgttataatatccaagaagtactaataggttttctgaaatgttatattctctatgcatttaaaaaaaaatgtaaacttgacattttagggtcttcagttacacatacacctgttataaggtgtttaatatagctcaggaaagtgagcattttgtgagaaaaatgaatatatcatatctaatggaaaagattggatgaatgttctcaaatgttacaaagctgtttaaagaaaaaggtatatataagtaatcagaacacttagaagactgatagatgtcacacagtggtattatagaaggataatacagagccaagatcaaattaaaagacaataaatggaacagaagggaggcagtgtttagctttgtataaacttttaggtttgctctgtaatctgctaaaccatatacattcttttgtgatatgttattatgtatgtggcacttgaggcactgtatgtaaagtaaggaatgctttactagttctccttggttttatctttgtttaaactagctttaaagtattaaacaataattgaaatgaaaagcttacctattttaaaaagccaaatttaaataaatatagaactttaaaatgtttatcagttgtttccatgaaagaatattagtttccagtaaattttagtgatggctcactcacttttctattttggaattacatagttatgtaagtaaaatttttaaaaatcataaagggagcaccattgtacagtctagcataaacagcaaattttaaagaggacatatttaagttcataatcatatttttcagtaaatattgctcagtgaactggaaaactttaatagaaaaatgtctgcagttttgtgattgttaatttggttaaaccgatattttatattatttaagttaggtaacattttatattactttcatatgaataaaagtaatccatgcattgtagagtctataaaatgttgagtttttttagatgatataaactttgattctgggcactagtgctagtagatattactaccctcctgagggaaatcagaaatgatttaaccccagtggaatacattaattcttaaagcggctcttttcagtagtgtgacttttagaaagtgtctcagtagttaaggaagctaacagtcttagatctacttttaaaacggatggccttcttaagaataaagcaaaaggtgattttctacataatttttgctttccaaaagtgatgatatgctctcctacagcaacatatgagaagaaaaaaggcttatctagattcgaaaattaacagcaattatagtaatatatcccctccttctaaatagtaaaaagctctgattgtacaagaattacctgtgctagtcaagttgttgtttttccttgaacaactttggaaaaatggatttgacagtacataatcagttctactaaccaaagcttgtatttggaaatttactttttgtacaaattgaattatataatgcttaaaatactttgtcactttataagcaaaatgcatagtacttaatttgtttatactgtaaagtatatgttaaatgcttttatcactttgagaataaaaagttactaatgctgttgtattttact

SEQ ID NO: 371742 - DNA, 3502 bp, Homo sapiens
agggaagcgcgcggccgcgagccctgggcgccagcggagactcgctgtttgtggcccaggtgcaggaagcttacgcggtggcagccgctcgctgaggtagtctctcgcggcgccggggatccctgaacacagacagcgcgggactgagaaggaaagcttctttctgggcagccagagccgcaaaggtggagccgcgttggcgccctccgcgggaccagcgcctcggatgcgggcggagcgcggggggccgcggctgcgggagcgcgaagcggggggccaggggcgcctcatgtgagagccgcgggacctgcagccgccgccgtccccggagcacggggtggtgtgtgggggaagccgcccccggcagcaggatgaaacgaggaggaagagatagtgaccgtaattcatcagaagaaggaactgcagagaaatccaagaaactgaggactacaaatgagcattctcagacttgtgattggggtaatctccttcaggacattattctccaagtatttaaatatttgcctcttcttgaccgggctcatgcttcacaagtttgccgcaactggaaccaggtatttcacatgcctgacttgtggagatgttttgaatttgaactgaatcagccagctacatcttatttgaaagctacccatccagagctgatcaaacagattattaaaagacattcaaaccatctacaatatgtcagcttcaaggtggacagcagcaaggaatcagctgaagcagcttgtgatatactatcgcaacttgtgaattgctctttaaaaacacttggacttatttcaactgctcgaccaagctttatggatttaccaaagtctcactttatctctgcactgacagttgtgttcgtaaactccaaatccctgtcttcgcttaagatagatgatactccagtagatgatccatctctcaaagtactagtggccaacaatagtgatacactcaagctgttgaaaatgagcagctgtcctcatgtctctccagcaggtatcctttgtgtggctgatcagtgtcacggcttaagagaactagccctgaactaccacttattgagtgatgagttgttacttgcattgtcttctgaaaaacatgttcgattagaacatttgcgcattgatgtagtcagtgagaatcctggacagacacacttccatactattcagaagagtagctgggatgctttcatcagacattcacccaaagtgaacttagtgatgtatttttttttatatgaagaagaatttgaccccttctttcgctatgaaatacctgccacccatctgtactttgggagatcagtaagcaaagatgtgcttggccgtgtgggaatgacatgccctagactggttgaactagtagtgtgtgcaaatggattacggccacttgatgaagagttaattcgcattgcagaacgttgcaaaaatttgtcagctattggactaggggaatgtgaagtctcatgtagtgcctttgttgagtttgtgaagatgtgtggtggccgcctatctcaattatccattatggaagaagtactaattcctgaccaaaagtatagtttggagcagattcactgggaagtgtccaagcatcttggtagggtgtggtttcccgacatgatgcccacttggtaaaaactgcatgatgaatagcaccttaatttcaagcaaatgtattataattaaagttttatttgctgtagttctgatataattctactattttgtggcacagaaatttgatatcttcagtcagtatatgtaaagattgtttatcggaagacccatgaatgagttttggtcagaaaattccacttgtttccttagtgtaatagcagtcatatctccgaattttttttaatgtggttcggatgtgaaataaccagttatacgtattaaacagtttacagtctaaaggaaacaaaacctatatgttataatatccaagaagtactaataggttttctgaaatgttatattctctatgcatttaaaaaaaaatgtaaacttgacattttagggtcttcagttacacatacacctgttataaggtgtttaatatagctcaggaaagtgagcattttgtgagaaaaatgaatatatcatatctaatggaaaagattggatgaatgttctcaaatgttacaaagctgtttaaagaaaaaggtatatataagtaatcagaacacttagaagactgatagatgtcacacagtggtattatagaaggataatacagagccaagatcaaattaaaagacaataaatggaacagaagggaggcagtgtttagctttgtataaacttttaggtttgctctgtaatctgctaaaccatatacattcttttgtgatatgttattatgtatgtggcacttgaggcactgtatgtaaagtaaggaatgctttactagttctccttggttttatctttgtttaaactagctttaaagtattaaacaataattgaaatgaaaagcttacctattttaaaaagccaaatttaaataaatatagaacttttgatggctcactcacttttctattttggaattacatagttatgtaagtaaaatttttaaaaatcataaagggagcaccattgtacagtctagcataaacagcaaattttaaagaggacatatttaagttcataatcatatttttcagtaaatattgctcagtgaactggaaaactttaatagaaaaatgtctgcagttttgtgattgttaatttggttaaaccgatattttatattatttaagttaggtaacattttatattactttcatatgaataaaagtaatccatgcattgtagagtctataaaatgttgagtttttttagatgatataaactttgattctgggcactagtgctagtagatattactaccctcctgagggaaatcagaaatgatttaaccccagtggaatacattaattcttaaagcggctcttttcagtagtgtgacttttagaaagtgtctcagtagttaaggaagctaacagtcttagatctacttttaaaacggatggccttcttaagaataaagcaaaaggtgattttctacataatttttgctttccaaaagtgatgatatgctctcctacagcaacatatgagaagaaaaaaggcttatctagattcgaaaattaacagcaattatagtaatatatcccctccttctaaatagtaaaaagctctgattgtacaagaattacctgtgctagtcaagttgttgtttttccttgaacaactttggaaaaatggatttgacagtacataatcagttctactaaccaaagcttgtatttggaaatttactttttgtacaaattgaattatataatgcttaaaatactttgtcactttataagcaaaatgcatagtacttaatttgtttatactgtaaagtatatgttaaatgcttttatcactttgagaataaaaagttactaatgctgttgtattttact

SEQ ID NO: 371743 - DNA, 1502 bp, Homo sapiens
agggaagcgcgcggccgcgagccctgggcgccagcggagactcgctgtttgtggcccaggtgcaggaagcttacgcggtggcagccgctcgctgaggtagtctctcgcggcgccggggatccctgaacacagacagcgcgggactgagaaggaaagcttctttctgggcagccagagccgcaaaggtggagccgcgttggcgccctccgcgggaccagcgcctcggatgcgggcggagcgcggggggccgcggctgcgggagcgcgaagcggggggccaggggcgcctcatgtgagagccgcgggacctgcagccgccgccgtccccggagcacggggtggtgtgtgggggaagccgcccccggcagcaggatgaaacgaggaggaagagatagtgaccgtaattcatcagaagaaggaactgcagagaaatccaagaaactgaggactacaaatgagcattctcagacttgtgattggggtaatctccttcaggacattattctccaagtatttaaatatttgcctcttcttgaccgggctcatgcttcacaagtttgccgcaactggaaccaggtatttcacatgcctgacttgtggagatgttttgaatttgaactgaatcagccagctacatcttatttgaaagctacccatccagagctgatcaaacagattattaaaagacattcaaaccatctacaatatgtcagcttcaaggtggacagcagcaaggaatcagctgaagcagcttgtgatatactatcgcaacttgtgaattgctctttaaaaacacttggacttatttcaactgctcgaccaagctttatggatttaccaaagtctcactttatctctgcactgacagttgtgttcgtaaactccaaatccctgtcttcgcttaagatagatgatactccagtagatgatccatctctcaaagtactagtggccaacaatagtgatacactcaagctgttgaaaatgagcagctgtcctcatgtctctccagcagaaacgtgttcagttgatcatcaaatacttaaaggaccttgaaagcttgtctggctctaattaaagcacagctacttggtgatcttaacagaaacctgtcctctctcggagaagtgcaacctcttccactgcgctgacagctttgtgggaagagggagaactacaggaaacaatgaagaagtcagaaggtgcctgtttacccaaacgtgtctgcagccatgttcctgcataccccggttagaagaaccgctgaagcactatgctatcagcttaaaatctaggtgactacaaaaccctggaaagtttggcacataaactacattaggcaagatcaaggatgacatttgttctttgattaatcattatcactgccattcaatgtgacctgccaaacatacacaacttacatctttacagcaatcctaaatcctaagatttagtgatgttagtatgcttaaagacacaagccagttactagctagttccaaa

SEQ ID NO: 371744 - DNA, 2774 bp, Homo sapiens
gctgaggcaggcagatcacctgaggtcaggagttcaagaccagcctggccaacatggtgaaaccctgtctctactaaaaatacaaaaaattagctgggcgtggtggcaggcacctgtaatcccagctacttgggaggctgaggcaggagaattgctggaaccatgatcgtgccactgcactccagcctgggtgacagagcgagaccccatcttgaatgaatgagtgaacggaatgaatgaatgagtgaacggaatgaatgaatgaatcattctctgccttctgggtagtaaccctggtttttagcatgttgtgtactttaatgtcgttaatgctggactgctttcctacacaacagtcatatctcaacagttcaacagtcgtatctcccctttgaaaagccttaatagtattgcatttctcacagaaaccctgttttattaaactaattttggaaatttaagcacaggaatatcaagtaatttgctcaaagccacatagccagtgagaggtagagccagaattcaaacccaaggagcttggttccagagcccattctctttagccataatactgttttgccatgaaaaaactatctttcaaagaaactaatggaatgaaagtgctaagaatacatagaataaacaaataggtataattcagaaacacaacttggggaaaacagtgcaatattaagtgatgtgtttgaagaagcagctacattccagaccaaacaattcatagtaggggtggttttgcttattttaggcggagttaagaaatgtctggcagtaacacatagcatagcccagtgcctgtccgtggcagggggtgatttcaggaagaaactgttccacctcagatcatcaggcattaagagtctcataaggagcgcacaacctagatccctcatgtggacatttcacaataagattctcactcctatgagaatctaatgtagctgctgatctgacaggaggaggagttcagactgtaaagcttgctcacttcctgctatggggcccagttctggtcctcaggccagaaccacaggacccctgtatagactattaaatgtggaacatcctctctggaggttcttgggaccctggttggcctggaattcaagaacaaatatccttagatgacttttaagaaacctttacaaagtatcgctgtaggttcccttttatattcattttagttaagttgaccacaacttttgaaatataaattcttagcatagtttcaaaatcataatactctctcccatgtagtatatactgtatattatactgataaatgtagatgtttaaaaacatgccaaaaaagtgtaaaatttataaaaccattgttggccttcattggcatttttcataatagtttgttttggtattcttgaattactgatccagtttttcctgcatgtttgtgtatataaacacacatctcagtgacagaagaatgaattttgagtttatttctattcaaaagttgagtaggaaaaaaactgatgcatttttcggaataggatgaaacgaggaggaagagatagtgaccgtaattcatcagaagaaggaactgcagagaaatccaagaaactgaggactacaaatgagcattctcagacttgtgattggggtaatctccttcaggacattattctccaagtatttaaatatttgcctcttcttgaccgggctcatgcttcacaagtttgccgcaactggaaccaggtatttcacatgcctgacttgtggagatgttttgaatttgaactgaatcagccagctacatcttatttgaaagctacccatccagagctgatcaaacagattattaaaagacattcaaaccatctacaatatgtcagcttcaaggtaatattttaaatccttcttttaaaaaataaagtatttttagtggctttgtttcctaaaccagtacatcttctcatgcctttaaaatatttgctttttcagggaaaatgcttaaaaatttagaattattgtataccttagaagctgtcacaaaatattatatttgatggagctaaattactctattaattattaataatttcttaaaacagcaaaagcagccactaaataagcataagtcattgataaagctgtgaattacattgaattattgtgaacgattttgaggaagaagaaatatctaataaaataaaaattgggagattataattgagtagagcttaattgctatttctatctaacaggaacttagtgttacttactgatggctttttgaaatgggatcttcagatgaaaaggaagcatagaaactttatgtagaagatttagatgaatatattttagagagaaatagaaaaaggtacatgggagaatgccaaagggaactgtttatttctttttgttgctggaaggaaggtattggaaatcatgcagtgatgagataaatgaagtgggtggctttttgcgatatccagaataatttaagaaatcatagctggatgtgggtacctgtagtcccatagtcccagcttctcaggaggctgaggcgggaagattgcatgagcccaggagtttgaggttgtggtgagctatgattgtgcagctgtactacagccttggtgacagagcgagaccctgtctctatttaaaaaaataaaaaatcacagtggtttgtgtgaggcttgtcatgttttgtttgggtgatgaataatgaaatatggacatgtttactggatctttaaacaccagattttgtggtagcaaataacttattg

SEQ ID NO: 371745 - DNA, 3465 bp, Homo sapiens
agggaagcgcgcggccgcgagccctgggcgccagcggagactcgctgtttgtggcccaggtgcaggaagcttacgcggtggcagccgctcgctgaggtagtctctcgcggcgccggggatccctgaacacagacagcgcgggaggagcgcggggggccgcggctgcgggagcgcgaagcggggggccaggggcgcctcatgtgagagccgcgggacctgcagccgccgccgtccccggagcacggggtggtgtgtgggggaagccgcccccggcagcaggatgaaacgaggaggaagagatagtgaccgtaattcatcagaagaaggaactgcagagaaatccaagaaactgaggactacaaatgagcattctcagacttgtgattggggtaatctccttcaggacattattctccaagtatttaaatatttgcctcttcttgaccgggctcatgcttcacaagtttgccgcaactggaaccaggtatttcacatgcctgacttgtggagatgttttgaatttgaactgaatcagccagctacatcttatttgaaagctacccatccagagctgatcaaacagattattaaaagacattcaaaccatctacaatatgtcagcttcaaggtggacagcagcaaggaatcagctgaagcagcttgtgatatactatcgcaacttgtgaattgctctttaaaaacacttggacttatttcaactgctcgaccaagctttatggatttaccaaagtctcactttatctctgcactgacagttgtgttcgtaaactccaaatccctgtcttcgcttaagatagatgatactccagtagatgatccatctctcaaagtactagtggccaacaatagtgatacactcaagctgttgaaaatgagcagctgtcctcatgtctctccagcaggtatcctttgtgtggctgatcagtgtcacggcttaagagaactagccctgaactaccacttattgagtgatgagttgttacttgcattgtcttctgaaaaacatgttcgattagaacatttgcgcattgatgtagtcagtgagaatcctggacagacacacttccatactattcagaagagtagctgggatgctttcatcagacattcacccaaagtgaacttagtgatgtatttttttttatatgaagaagaatttgaccccttctttcgctatgaaatacctgccacccatctgtactttgggagatcagtaagcaaagatgtgcttggccgtgtgggaatgacatgccctagactggttgaactagtagtgtgtgcaaatggattacggccacttgatgaagagttaattcgcattgcagaacgttgcaaaaatttgtcagctattggactaggggaatgtgaagtctcatgtagtgcctttgttgagtttgtgaagatgtgtggtggccgcctatctcaattatccattatggaagaagtactaattcctgaccaaaagtatagtttggagcagattcactgggaagtgtccaagcatcttggtagggtgtggtttcccgacatgatgcccacttggtaaaaactgcatgatgaatagcaccttaatttcaagcaaatgtattataattaaagttttatttgctgtagttctgatataattctactattttgtggcacagaaatttgatatcttcagtcagtatatgtaaagattgtttatcggaagacccatgaatgagttttggtcagaaaattccacttgtttccttagtgtaatagcagtcatatctccgaattttttttaatgtggttcggatgtgaaataaccagttatacgtattaaacagtttacagtctaaaggaaacaaaacctatatgttataatatccaagaagtactaataggttttctgaaatgttatattctctatgcatttaaaaaaaaatgtaaacttgacattttagggtcttcagttacacatacacctgttataaggtgtttaatatagctcaggaaagtgagcattttgtgagaaaaatgaatatatcatatctaatggaaaagattggatgaatgttctcaaatgttacaaagctgtttaaagaaaaaggtatatataagtaatcagaacacttagaagactgatagatgtcacacagtggtattatagaaggataatacagagccaagatcaaattaaaagacaataaatggaacagaagggaggcagtgtttagctttgtataaacttttaggtttgctctgtaatctgctaaaccatatacattcttttgtgatatgttattatgtatgtggcacttgaggcactgtatgtaaagtaaggaatgctttactagttctccttggttttatctttgtttaaactagctttaaagtattaaacaataattgaaatgaaaagcttacctattttaaaaagccaaatttaaataaatatagaactttaaaatgtttatcagttgtttccatgaaagaatattagtttccagtaaattttagtgatggctcactcacttttctattttggaattacatagttatgtaagtaaaatttttaaaaatcataaagggagcaccattgtacagtctagcataaacagcaaattttaaagaggacatatttaagttcataatcatatttttcagtaaatattgctcagtgaactggaaaactttaatagaaaaatgtctgcagttttgtgattgttaatttggttaaaccgatattttatattatttaagttaggtaacattttatattactttcatatgaataaaagtaatccatgcattgtagagtctataaaatgttgagtttttttagatgatataaactttgattctgggcactagtgctagtagatattactaccctcctgagggaaatcagaaatgatttaaccccagtggaatacattaattcttaaagcggctcttttcagtagtgtgacttttagaaagtgtctcagtagttaaggaagctaacagtcttagatctacttttaaaacggatggccttcttaagaataaagcaaaaggtgattttctacataatttttgctttccaaaagtgatgatatgctctcctacagcaacatatgagaagaaaaaaggcttatctagattcgaaaattaacagcaattatagtaatatatcccctccttctaaatagtaaaaagctctgattgtacaagaattacctgtgctagtcaagttgttgtttttccttgaacaactttggaaaaatggatttgacagtacataatcagttctactaaccaaagcttgtatttggaaatttactttttgtacaaattgaattatataatgcttaaaatactttgtcactttataagcaaaatgcatagtacttaatttgtttatactgtaaagtatatgttaaatgcttttatcactttgagaataaaaagttactaatgctgttgtattttact

SEQ ID NO: 371746 - DNA, 2896 bp, Homo sapiens
agggaagcgcgcggccgcgagccctgggcgccagcggagactcgctgtttgtggcccaggtgcaggaagcttacgcggtggcagccgctcgctgaggtagtctctcgcggcgccggggatccctgaacacagacagcgcgggactgagaaggaaagcttctttctgggcagccagagccgcaaaggtggagccgcgttggcgccctccgcgggaccagcgcctcggatgcgggcggagcgcggggggccgcggctgcgggagcgcgaagcggggggccaggggcgcctcatgtgagagccgcgggacctgcagccgccgccgtccccggagcacggggtggtgtgtgggggaagccgcccccggcagcaggatgaaacgaggaggaagagatagtgaccgtaattcatcagaagaaggaactgcagagaaatccaagaaactgaggactacaaatgagcattctcagacttgtgattggggtaatctccttcaggacattattctccaagtatttaaatatttgcctcttcttgaccgggctcatgcttcacaagtttgccgcaactggaaccaggtatttcacatgcctgacttgtggagatgttttgaatttgaactgaatcagccagctacatcttatttgaaagctacccatccagagctgatcaaacagattattaaaagacattcaaaccatctacaatatgtcagcttcaaggtggacagcagcaaggaatcagctgaagcagcttgtgatatactatcgcaacttgtgaattgctctttaaaaacacttggacttatttcaactgctcgaccaagctttatggatttaccaaagtctcactttatctctgcactgacagttgtgttcgtaaactccaaatccctgtcttcgcttaagatagatgatactccagtagatgatccatctctcaaagtactagtggccaacaatagtgatacactcaagctgttgaaaatgagcagctgtcctcatgtctctccagcaggtatcctttgtgtggctgatcagtgtcacggcttaagagaactagccctgaactaccacttattgagtgatgagttgttacttgcattgtcttctgaaaaacatgttcgattagaacatttgcgcattgatgtagtcagtgagaatcctggacagacacacttccatactattcagaagagtagctgggatgctttcatcagacattcacccaaagtgaacttagtgatgtatttttttttatatgaagaagaatttgaccccttctttcgctatgaaatacctgccacccatctgtactttgggagatcagtaagcaaagatgtgcttggccgtgtgggaatgacatgccctagactggttgaactagtagtgtgtgcaaatggattacggccacttgatgaagagttaattcgcattgcagaacgttgcaaaaatttgtcagctattggactaggggaatgtgaagtctcatgtagtgcctttgttgagtttgtgaagatgtgtggtggccgcctatctcaattatccattatggaagaagtactaattcctgaccaaaagtatagtttggagcagattcactgggaagtgtccaagcatcttggtagggtgtggtttcccgacatgatgcccacttggtaaaaactgcatgatgaatagcaccttaatttcaagcaaatgtattataattaaagttttatttgctgtagttctgatataattctactattttgtggcacagaaatttgatatcttcagtcagtatatgtaaagattgtttatcggaagacccatgaatgagttttggtcagaaaattccacttgtttccttagtgtaatagcagtcatatctccgaattttttttaatgtggttcggatgtgaaataaccagttatacgtattaaacagtttacagtctaaaggaaacaaaacctatatgttataatatccaagaagtactaataggttttctgaaatgttatattctctatgcatttaaaaaaaaatgtaaacttgacattttagggtcttcagttacacatacacctgttataaggtgtttaatatagctcaggaaagtgagcattttgtgagaaaaatgaatatatcatatctaatggaaaagattggatgaatgttctcaaatgttacaaagctgtttaaagaaaaaggtatatataagtaatcagaacacttagaagactgatagatgtcacacagtggtattatagaaggataatacagagccaagatcaaattaaaagacaataaatggaacagaagggaggcagtgtttagctttgtataaacttttaggtttgctctgtaatctgctaaaccatatacattcttttgtgatatgttattatgtatgtggcacttgaggcactgtatgtaaagtaaggaatgctttactagttctccttggttttatctttgtttaaactagctttaaagtattaaacaataattgaaatgaaaagcttacctattttaaaaagccaaatttaaataaatatagaactttaaaatgtttatcagttgtttccatgaaagaatattagtttccagtaaattttagtgatggctcactcacttttctattttggaattacatagttatgtaagtaaaatttttaaaaatcataaagggagcaccattgtacagtctagcataaacagcaaattttaaagaggacatatttaagttcataatcatatttttcagtaaatattgctcagtgaactggaaaactttaatagaaaaatgtctgcagttttgtgattgttaatttggttaaaccgatattttatattatttaagttaggtaacattttatattactttcatatgaataaaagtaatccatgcattgta

SEQ ID NO: 371747 - DNA, 1583 bp, Homo sapiens
agggaagcgcgcggccgcgagccctgggcgccagcggagactcgctgtttgtggcccaggtgcaggaagcttacgcggtggcagccgctcgctgaggtagtctctcgcggcgccggggatccctgaacacagacagcgcgggactgagaaggaaagcttctttctgggcagccagagccgcaaaggtggagccgcgttggcgccctccgcgggaccagcgcctcggatgcgggcggagcgcggggggccgcggctgcgggagcgcgaagcggggggccaggggcgcctcatgtgagagccgcgggacctgcagccgccgccgtccccggagcacggggtggtgtgtgggggaagccgcccccggcagcaggatgaaacgaggaggaagagatagtgaccgtaattcatcagaagaaggaactgcagagaaatccaagaaactgaggactacaaatgagcattctcagacttgtgattggggtaatctccttcaggacattattctccaagtatttaaatatttgcctcttcttgaccgggctcatgcttcacaagtttgccgcaactggaaccaggtatttcacatgcctgacttgtggagatgttttgaatttgaactgaatcagccagctacatcttatttgaaagctacccatccagagctgatcaaacagattattaaaagacattcaaaccatctacaatatgtcagcttcaaggtggacagcagcaaggaatcagctgaagcagcttgtgatatactatcgcaacttgtgaattgctctttaaaaacacttggacttatttcaactgctcgaccaagctttatggatttaccaaagtctcactttatctctgcactgacagttgtgttcgtaaactccaaatccctgtcttcgcttaagatagatgatactccagtagatgatccatctctcaaagtactagtggccaacaatagtgatacactcaagctgttgaaaatgagcagctgtcctcatgtctctccagcagctatctctgaccgccggaggctgtgtcttctctgtcaaaggctggaatcgacctcccaggtgtgcgggctctgtccccgacttaggaccggcgtcctacctccaggctgaagactggacaaaagcggtgacaatcttcccggtctaaccaggactgcaggagacggggattcccgggatgcgcgacttttgagggcaaaactgggaagtcccaataaggacttcggatcaggttctgatcaggttcaaaccagagcgagttggtcgcccagtaaattgtaccaaatgttccgcggtaataactaacgacagtgcatgatataaataaatgcgatagacagtgtttttaaactactcaagaaatcagctacttgtacccagaagtccctccattaaataacattactctccttttcttcttccacgattcaggactgtcctgagtctgccgcaagtgaccagaggggacgaaaggtcccagggctgcacgtaacgagcggctgcgactccccagtcctcaactttgctctcaagtgcgctccgagcgtcacccggcgctgtccccgcact

SEQ ID NO: 371748 - DNA, 2767 bp, Homo sapiens
gttggaaaatcccactttacttcaagtgaagtcactgggttgtccccatgaaatatctccacaatgggtgtgctagacctttactctctgtggcaccaccaagaccccctcaccctgccagagccctctgaagtgtactcagaatggaggggctggaagtggggccagtggtcctggtagtcagcctccccttctgacacaagaattatcgtggaacagcttgtgtgaccgatcaactggtctctccatctttaagccattgtcttgttgactctgttactgcagagtttggggaggtctcatggcttctcgcatcctatttcctgagcttccctgaagccaacttctggccactggtatgtgatgcgagcacagtgcctcctcctgctcctccaggaagcttctgctgattgaacgcaggccagatggcgagatccggagcaaccttcttagatcaagggaagaaaggggcacaagaggggagtaggtaacaagataaaaggagctccctccctgatgactacagagccatcgtggcagccctgggcctccatttcagacgttcatcttgcctaagccaccaccatcagggtctcagtcagtcatcattctcatttactcgggtggctgggtgagggcggaatactaccttccagctgtctgagattaagcctaagccaccaccatcagggtctcagtcagtcatcattctcatttactcgggtggctgggcgagggcggaatactaccttccagctgtctgagattaagcagaacagcagctaaagcagtaacagcaggtctccttcagcagcttgccacagggaagagggtcccgcgtgaaccgaactcaacttccacctgcgcagaggtagctaccatttgcgtagaggtagctgggtctttaaggttagagggaaggcgcagggagggagagacggcgggtgggggttgaacaaagtggagattcacaaaagcagactagggcgggcgacgtgatcagatgacctgtgcgggcggcagcctcctgccctcctccccttcgtgcgccggctggagcgaagagttcttttgacagccgtgagcttccccgccaggaacttactggggctgcatcaccctagaaacgtggctttgggctgtggaaacgctgcctctgtggaagtctctcctcgcgggggtggacgggtcgctgcgcgcccagcgttcttctgcggttctcacagcccgccgccgccgccgcctcggggacctttgcggggaggcctcagggcaccttcctcctctctctcaggcacgtcctcgacctcagttgccacgtgcacatgctggtgccttccaggctggagtatagtggcatgatcatagatcactgcagcctcaaactcctgggctcaagcgatcctcccacctcagcctccatatagctggtggggaccaagtttctaacacatgaatgttgggagacacattcagaccatcgcagtggccttataaaaagagacacaagagcttgctctctgccatgtgagaataccacaagaagactgtcctcagcaaatcagaaagcgggtggaccctcatcagacaccagatgtgcctgcaccttgatcttggacttgccagccttcagaacagtaagaaagaaatgtgtgttgtttaagccacccagtctatggtaacttgctatagcagcccactaggagaccccaagatatttaaaaactcatcagcacctgctttctgcatctggaccctgatcttctggtgggtttaccagttacttgtagagtgtccctgtgatagttttaggtgtcaacttgacaggattgagggatgcctagatggctggggaagcactgtttctgagaaggaccatgtttttggaggagactgttttatgagtgaatttcaggggacacattcagatcatggcagtggcattataaagagagacacaaaagcttgctctctctctctgccatgtaagactaccacacaaagactgccatctgcaaaccagaagcaggtgggctttcctcagacaccagatctgcctgcaccttgatcttggacttgccagccttcagaactctaagaaagaaatggtagcatggcttggtctaagttggaaggcctgagaaacaagcacatggtggaactgagttcaaggataaagacttgagaatacctgctcagtggactgagtagggaagatcaaccctcaatgtaggcaggcactatccaatcacctgagggcccagatggaacaaaaaggtggaagaagggtgaattctctcttccagagctgtgacacccttctcatgcccttgtaccacacaactctaggtcctttggcctttggactctgacacttgcaccagtggccctctggggctctcaagcctttagccttgaacttagttacaccatgtgcctccttgtttctcaggccttccaacttggatcaggccatgccaccggcttctctgattctccagcttgcagatggtatattgtgaccctggcatttaataactatgactttggtcttaagcaattttcttcctctgtggattgatatttacatatcaatgtggataataatttcttaccacggtaactgttgtgaggtaaaaatgagttaacataagtaaaaccgagcacatgcaaaccatccgaaatggttaatacttactatttgtacttgaagaaataaatgtttttgacaataaacttcttgtgcagttttcctcaaaaaaatcaa

SEQ ID NO: 371749 - DNA, 2376 bp, Homo sapiens
gttggaaaatcccactttacttcaagtgaagtcactgggttgtccccatgaaatatctccacaatgggtgtgctagacctttactctctgtggcaccaccaagaccccctcaccctgccagagccctctgaagtgtactcagaatggaggggctggaagtggggccagtggtcctggtagtcagcctccccttctgacacaagaattatcgtggaacagcttgtgtgaccgatcaactggtctctccatctttaagccattgtcttgttgactctgttactgcagagtttggggaggtctcatggcttctcgcatcctatttcctgagcttccctgaagccaacttctggccactggtatgtgatgcgagcacagtgcctcctcctgctcctccaggaagcttctgctgattgaacgcaggccagatggcgagatccggagcaaccttcttagatcaagggaagaaaggggcacaagaggggagtaggtaacaagataaaaggagctccctccctgatgactacagagccatcgtggcagccctgggcctccatttcagacgttcatcttgcctaagccaccaccatcagggtctcagtcagtcatcattctcatttactcgggtggctgggtgagggcggaatactaccttccagctgtctgagattaagcctaagccaccaccatcagggtctcagtcagtcatcattctcatttactcgggtggctgggcgagggcggaatactaccttccagctgtctgagattaagcagaacagcagctaaagcagtaacagcaggtctccttcagcagcttgccacagggaagagggtcccgcgtgaaccgaactcaacttccacctgcgcagaggtagctaccatttgcgtagaggtagctgggtctttaaggttagagggaaggcgcagggagggagagacggcgggtgggggttgaacaaagtggagattcacaaaagcagactagggcgggcgacgtgatcagatgacctgtgcgggcggcagcctcctgccctcctccccttcgtgcgccggctggagcgaagagttcttttgacagccgtgagcttccccgccaggaacttactggggctgcatcaccctagaaacgtggctttgggctgtggaaacgctgcctctgtggaagtctctcctcgcgggggtggacgggtcgctgcgcgcccagcgttcttctgcggttctcacagcccgccgccgccgccgcctcggggacctttgcggggaggcctcagggcaccttcctcctctctctcaggcacgtcctcgacctcagttgccacgtgcacatgctggtgccttccaggctggagtatagtggcatgatcatagatcactgcagcctcaaactcctgggctcaagcgatcctcccacctcagcctccatatagctggtggggaccaagtttctaacacatgaatgttgggagacacattcagaccatcgcagtggccttataaaaagagacacaagagcttgctctctgccatgtgagaataccacaagaagactgtcctcagcaaatcagaaagcgggtggaccctcatcagacaccagatgtgcctgcaccttgatcttggacttgccagccttcagaacagtaagaaagaaatgtgtgttgtttaagccacccagtctatggtaacttgctatagcagcccactaggagaccccaagatatttaaaaactcatcagcacctgctttctgcatctggaccctgatcttctggtgggtttaccagttacttgtagagtgtccctgtgatagttttaggtgtcaacttgacaggattgagggatgcctagatggctggggaagcactgtttctgagaaggaccatgtttttggaggagactgttttatgagtgaatttcaggggacacattcagatcatggcagtggcattataaagagagacacaaaagcttgctctctctctctgccatgtaagactaccacacaaagactgccatctgcaaaccagaagcaggtgggctttcctcagacaccagatctgcctgcaccttgatcttggacttgcgccatgccaccggcttctctgattctccagcttgcagatggtatattgtgaccctggcatttaataactatgactttggtcttaagcaattttcttcctctgtggattgatatttacatatcaatgtggataataatttcttaccacggtaactgttgtgaggtaaaaatgagttaacataagtaaaaccgagcacatgcaaaccatccgaaatggttaatacttactatttgtacttgaagaaataaatgtttttgacaataaacttcttgtgcagttttcctcaaaaaaatcaa

SEQ ID NO: 371750 - DNA, 1538 bp, Homo sapiens
ccgttctccattcccgacctccgcaccctacccggtccgcagggcaccttcctcctctctctcaggcacgtcctcgacctcagttgccacgtgcacatgctggtgccttccaggctggagtatagtggcatgatcatagatcactgcagcctcaaactcctgggctcaagcgatcctcccacctcagcctccatatagctggtggggaccaagtttctaacacatgaatgttgggagacacattcagaccatcgcagtggccttataaaaagagacacaagagcttgctctctgccatgtgagaataccacaagaagactgtcctcagcaaatcagaaagcgggtggaccctcatcagacaccagatgtgcctgcaccttgatcttggacttgccagccttcagaacagtaagaaagaaatgtgtgttgtttaagccacccagtctatggtaacttgctatagcagcccactaggagaccccaagatatttaaaaactcatcagcacctgctttctgcatctggaccctgatcttctggtgggtttaccagttacttgtagagtgtccctgtgatagttttaggtgtcaacttgacaggattgagggatgcctagatggctggggaagcactgtttctgagaaggaccatgtttttggaggagactgttttatgagtgaatttcaggggacacattcagatcatggcagtggcattataaagagagacacaaaagcttgctctctctctctgccatgtaagactaccacacaaagactgccatctgcaaaccagaagcaggtgggctttcctcagacaccagatctgcctgcaccttgatcttggacttgccagccttcagaactctaagaaagaaatggtagcatggcttggtctaagttggaaggcctgagaaacaagcacatggtggaactgagttcaaggataaagacttgagaatacctgctcagtggactgagtagggaagatcaaccctcaatgtaggcaggcactatccaatcacctgagggcccagatggaacaaaaaggtggaagaagggtgaattctctcttccagagctgtgacacccttctcatgcccttgtaccacacaactctaggtcctttggcctttggactctgacacttgcaccagtggccctctggggctctcaagcctttagccttgaacttagttacaccatgtgcctccttgtttctcaggccttccaacttggatcaggccatgccaccggcttctctgattctccagcttgcagatggtatattgtgaccctggcatttaataactatgactttggtcttaagcaattttcttcctctgtggattgatatttacatatcaatgtggataataatttcttaccacggtaactgttgtgaggtaaaaatgagttaacataagtaaaaccgagcacatgcaaaccatccgaaatggttaatacttactatttgtacttgaagaaataaatgtttttgacaataaacttcttgtgcagttttcctcaaaaaaatcaa

SEQ ID NO: 371751 - DNA, 1179 bp, Homo sapiens
tacttccacaggggaagaaaatgcttaagaccaaagtcatagttattaaatgccaggtcacaatataccatctgcaagctggagaatcagaaacagtgcttccccagcccactaggagaccccaagatatttaaaaactcatcagcacctgctttctgcatctggaccctgatcttctggtgggtttaccagttacttgtagagtgtccctgtgatagttttaggtgtcaacttgacaggattgagggatgcctagatggctggggaagcactgtttctgagaaggaccatgtttttggaggagactgttttatgagtgaatttcaggggacacattcagatcatggcagtggcattataaagagagacacaaaagcttgctctctctctctgccatgtaagactaccacacaaagactgccatctgcaaaccagaagcaggtgggctttcctcagacaccagatctgcctgcaccttgatcttggacttgccagccttcagaactctaagaaagaaatggtagcatggcttggtctaagttggaaggcctgagaaacaagcacatggtggaactgagttcaaggataaagacttgagaatacctgctcagtggactgagtagggaagatcaaccctcaatgtaggcaggcactatccaatcacctgagggcccagatggaacaaaaaggtggaagaagggtgaattctctcttccagagctgtgacacccttctcatgcccttgtaccacacaactctaggtcctttggcctttggactctgacacttgcaccagtggccctctggggctctcaagcctttagccttgaacttagttacaccatgtgcctccttgtttctcaggccttccaacttggatcaggccatgccaccggcttctctgattctccagcttgcagatggtatattgtgaccctggcatttaataactatgactttggtcttaagcaattttcttcctctgtggattgatatttacatatcaatgtggataataatttcttaccacggtaactgttgtgaggtaaaaatgagttaacataagtaaaaccgagcacatgcaaaccatccgaaatggttaatacttactatttgtacttgaagaaataaatgtttttgacaataaacttcttgtgcagttttcctcaaaaaaatcaa

SEQ ID NO: 371752 - DNA, 1645 bp, Homo sapiens
  misc_feature (1638)..(1638): n is a, c, g, or t
  misc_feature (1641)..(1641): n is a, c, g, or t
  misc_feature (1644)..(1645): n is a, c, g, or t
gttggaaaatcccactttacttcaagtgaagtcactgggttgtccccatgaaatatctccacaatgggtgtgctagacctttactctctgtggcaccaccaagaccccctcaccctgccagagccctctgaagtgtactcagaatggaggggctggaagtggggccagtggtcctggtagtcagcctccccttctgacacaagaattatcgtggaacagcttgtgtgaccgatcaactggtctctccatctttaagccattgtcttgttgactctgttactgcagagtttggggaggtctcatggcttctcgcatcctatttcctgagcttccctgaagccaacttctggccactggtatgtgatgcgagcacagtgcctcctcctgctcctccaggaagcttctgctgattgaacgcaggccagatggcgagatccggagcaaccttcttagatcaagggaagaaaggggcacaagaggggagtaggtaacaagataaaaggagctccctccctgatgactacagagccatcgtggcagccctgggcctccatttcagacgttcatcttgcctaagccaccaccatcagggtctcagtcagtcatcattctcatttactcgggtggctgggtgagggcggaatactaccttccagctgtctgagattaagcctaagccaccaccatcagggtctcagtcagtcatcattctcatttactcgggtggctgggcgagggcggaatactaccttccagctgtctgagattaagcagaacagcagctaaagcagtaacagcaggtctccttcagcagcttgccacagggaagagggtcccgcgtgaaccgaactcaacttccacctgcgcagaggtagctaccatttgcgtagaggtagctgggtctttaaggttagagggaaggcgcagggagggagagacggcgggtgggggttgaacaaagtggagattcacaaaagcagactagggcgggcgacgtgatcagatgacctgtgcgggcggcagcctcctgccctcctccccttcgtgcgccggctggagcgaagagttcttttgacagccgtgagcttccccgccaggaacttactggggctgcatcaccctagaaacgtggctttgggctgtggaaacgctgcctctgtggaagtctctcctcgcgggggtggacgggtcgctgcgcgcccagcgttcttctgcggttctcacagcccgccgccgccgccgcctcggggacctttgcggggaggcctcaggtcagcgccgcccttgcgatggcgggagagcagagcggccccagggcctctgagctccggccccggcacgtcccgccctctcctccgcttgcgggagccggggcgcctcggagggaaaccttccggacacaggccgggagaagaggggccgtggcgccatcgcgcagcttcctggtttcggccatgttttttttttttttgagacggagtttcgctctttttgcccaggctggagggcaatggcgccgtctcggctccctgcagccgccgcctcccgggttgaagggactctccggcctcaggccgcggtgttcttgtaaattagaaccggcctatgcgccaagcgcgggtctcgcggctgcggagngangcnn

SEQ ID NO: 371753 - DNA, 2884 bp, Homo sapiens
gttggaaaatcccactttacttcaagtgaagtcactgggttgtccccatgaaatatctccacaatgggtgtgctagacctttactctctgtggcaccaccaagaccccctcaccctgccagagccctctgaagtgtactcagaatggaggggctggaagtggggccagtggtcctggtagtcagcctccccttctgacacaagaattatcgtggaacagcttgtgtgaccgatcaactggtctctccatctttaagccattgtcttgttgactctgttactgcagagtttggggaggtctcatggcttctcgcatcctatttcctgagcttccctgaagccaacttctggccactggtatgtgatgcgagcacagtgcctcctcctgctcctccaggaagcttctgctgattgaacgcaggccagatggcgagatccggagcaaccttcttagatcaagggaagaaaggggcacaagaggggagtaggtaacaagataaaaggagctccctccctgatgactacagagccatcgtggcagccctgggcctccatttcagacgttcatcttgcctaagccaccaccatcagggtctcagtcagtcatcattctcatttactcgggtggctgggtgagggcggaatactaccttccagctgtctgagattaagcctaagccaccaccatcagggtctcagtcagtcatcattctcatttactcgggtggctgggcgagggcggaatactaccttccagctgtctgagattaagcagaacagcagctaaagcagtaacagcaggtctccttcagcagcttgccacagggaagagggtcccgcgtgaaccgaactcaacttccacctgcgcagaggtagctaccatttgcgtagaggtagctgggtctttaaggttagagggaaggcgcagggagggagagacggcgggtgggggttgaacaaagtggagattcacaaaagcagactagggcgggcgacgtgatcagatgacctgtgcgggcggcagcctcctgccctcctccccttcgtgcgccggctggagcgaagagttcttttgacagccgtgagcttccccgccaggaacttactggggctgcatcaccctagaaacgtggctttgggctgtggaaacgctgcctctgtggaagtctctcctcgcgggggtggacgggtcgctgcgcgcccagcgttcttctgcggttctcacagcccgccgccgccgccgcctcggggacctttgcggggaggcctcaggtaccagtcaggactggtagactttaatgtggagaacttctgaaacagcagttctcaaaatgttacctccagacacacagaatctgcatcacccaggaacttgtaaccatgcaaattctcagccacccagacttcctgcatcagaaactctggggcccagcagcctgtgttttaacaaagcccttcaggctggagtatagtggcatgatcatagatcactgcagcctcaaactcctgggctcaagcgatcctcccacctcagcctccatatagctggtggggaccaagtttctaacacatgaatgttgggagacacattcagaccatcgcagtggccttataaaaagagacacaagagcttgctctctgccatgtgagaataccacaagaagactgtcctcagcaaatcagaaagcgggtggaccctcatcagacaccagatgtgcctgcaccttgatcttggacttgccagccttcagaacagtaagaaagaaatgtgtgttgtttaagccacccagtctatggtaacttgctatagcagcccactaggagaccccaagatatttaaaaactcatcagcacctgctttctgcatctggaccctgatcttctggtgggtttaccagttacttgtagagtgtccctgtgatagttttaggtgtcaacttgacaggattgagggatgcctagatggctggggaagcactgtttctgagaaggaccatgtttttggaggagactgttttatgagtgaatttcaggggacacattcagatcatggcagtggcattataaagagagacacaaaagcttgctctctctctctgccatgtaagactaccacacaaagactgccatctgcaaaccagaagcaggtgggctttcctcagacaccagatctgcctgcaccttgatcttggacttgccagccttcagaactctaagaaagaaatggtagcatggcttggtctaagttggaaggcctgagaaacaagcacatggtggaactgagttcaaggataaagacttgagaatacctgctcagtggactgagtagggaagatcaaccctcaatgtaggcaggcactatccaatcacctgagggcccagatggaacaaaaaggtggaagaagggtgaattctctcttccagagctgtgacacccttctcatgcccttgtaccacacaactctaggtcctttggcctttggactctgacacttgcaccagtggccctctggggctctcaagcctttagccttgaacttagttacaccatgtgcctccttgtttctcaggccttccaacttggatcaggccatgccaccggcttctctgattctccagcttgcagatggtatattgtgaccctggcatttaataactatgactttggtcttaagcaattttcttcctctgtggattgatatttacatatcaatgtggataataatttcttaccacggtaactgttgtgaggtaaaaatgagttaacataagtaaaaccgagcacatgcaaaccatccgaaatggttaatacttactatttgtacttgaagaaataaatgtttttgacaataaacttcttgtgcagttttcctcaaaaaaatcaa

SEQ ID NO: 371754 - DNA, 2395 bp, Homo sapiens
gttggaaaatcccactttacttcaagtgaagtcactgggttgtccccatgaaatatctccacaatgggtgtgctagacctttactctctgtggcaccaccaagaccccctcaccctgccagagccctctgaagtgtactcagaatggaggggctggaagtggggccagtggtcctggtagtcagcctccccttctgacacaagaattatcgtggaacagcttgtgtgaccgatcaactggtctctccatctttaagccattgtcttgttgactctgttactgcagagtttggggaggtctcatggcttctcgcatcctatttcctgagcttccctgaagccaacttctggccactggtatgtgatgcgagcacagtgcctcctcctgctcctccaggaagcttctgctgattgaacgcaggccagatggcgagatccggagcaaccttcttagatcaagggaagaaaggggcacaagaggggagtaggtaacaagataaaaggagctccctccctgatgactacagagccatcgtggcagccctgggcctccatttcagacgttcatcttgcctaagccaccaccatcagggtctcagtcagtcatcattctcatttactcgggtggctgggtgagggcggaatactaccttccagctgtctgagattaagcctaagccaccaccatcagggtctcagtcagtcatcattctcatttactcgggtggctgggcgagggcggaatactaccttccagctgtctgagattaagcagaacagcagctaaagcagtaacagcaggtctccttcagcagcttgccacagggaagagggtcccgcgtgaaccgaactcaacttccacctgcgcagaggtagctaccatttgcgtagaggtagctgggtctttaaggttagagggaaggcgcagggagggagagacggcgggtgggggttgaacaaagtggagattcacaaaagcagactagggcgggcgacgtgatcagatgacctgtgcgggcggcagcctcctgccctcctccccttcgtgcgccggctggagcgaagagttcttttgacagccgtgagcttccccgccaggaacttactggggctgcatcaccctagaaacgtggctttgggctgtggaaacgctgcctctgtggaagtctctcctcgcgggggtggacgggtcgctgcgcgcccagcgttcttctgcggttctcacagcccgccgccgccgccgcctcggggacctttgcggggaggcctcagggcaccttcctcctctctctcaggcacgtcctcgacctcagttgccacgtgcacatgctggtgccttccaggctggagtatagtggcatgatcatagatcactgcagcctcaaactcctgggctcaagcgatcctcccacctcagcctccatatagctggtggggaccaagtttctaacacatgaatgttgggagacacattcagaccatcgcagtggccttataaaaagagacacaagagcttgctctctgccatgtgagaataccacaagaagactgtcctcagcaaatcagaaagcgggtggaccctcatcagacaccagatgtgcctgcaccttgatcttggacttgccagccttcagaacagtaagaaagaaatgtgtgttgtttaagccacccagtctatggtaacttgctatagcagcccactaggagaccccaagatatttaaaaactcatcagcacctgctttctgcatctggaccctgatcttctggtgggtttaccagttacttgtagagtgtccctgtgatagttttaggtgtcaacttgacaggattgagggatgcctagatggctggggaagcactgtttctgagaaggaccatgtttttggaggagactgttttatgagtgaatttcaggggacacattcagatcatggcagtggcattataaagagagacacaaaagcttgctctctctctctgccatgtaagactaccacacaaagactgccatctgcaaaccagaagcaggtgggctttcctcagacaccagatctgcctgcaccttgatcttggacttgcgccttccaacttggatcaggccatgccaccggcttctctgattctccagcttgcagatggtatattgtgaccctggcatttaataactatgactttggtcttaagcaattttcttcctctgtggattgatatttacatatcaatgtggataataatttcttaccacggtaactgttgtgaggtaaaaatgagttaacataagtaaaaccgagcacatgcaaaccatccgaaatggttaatacttactatttgtacttgaagaaataaatgtttttgacaataaacttcttgtgcagttttcctcaaaaaaatcaa

SEQ ID NO: 371755 - DNA, 1143 bp, Homo sapiens
ggtcaccccgcggactggacgggaacctggcggggtcaggtcccgtcaagcagcctggctcatggctgtgtgcggcctggggagccgtcttggcctggggagccgtcttggcctgcgcgggtgcttcggcgccgccaggctcctgtatccccgtttccagagccgcggccctcagggcgtggaagacggggacaggccacagccttcctcgaagacacccaggatccccaagatttacaccaaaacgggagacaaagggttttctagtaccttcacaggagaaaggagacccaaagatgaccaagtgtttgaagccgtgggaactacagatgaattaagttcagctattgggtttgctctggaattagtcacagaaaagggccatacatttgccgaagagcttcagaaaatccagtgcacattgcaggacgtcggctcggccctggcgacaccatgctcctcggcccgggaggctcacttaaagtataccacgttcaaggcggggcccatcctggagctggagcagtggatcgacaagtacaccagccagctcccaccactcacggccttcatcctgccttcgggaggcaagatcagctcggcgctgcatttctgccgggccgtgtgccgccgggccgagagacgtgtggtgcctcttgtccagatgggagagaccgatgcgaacgtggccaagttcttaaacagactcagtgactatctcttcacgctagccagatatgcagccatgaaggaggggaatcaagagaaaatatacaagaaaaatgacccatcggccgagtctgagggactctgaaatcacagaaagtgggagcttggaggatccctccatggcgatggccgtggagagaggagcttgcccttctggggtcctggttcctgaagagctcacccagagaggctcaaagcagccttttgtcccagctcagctttgatctacacctcttgccaccttcctcaagggactgtgaccctttggggattctgtccctgaccctgcttccccaagctctcctgggtcttggagggatgtgggaatgaattggcattgcaggaaagacaggtaaagtgattgctgcaatgagaaggagctgtgcggaaaaggaataaaagttggaaaggctg

SEQ ID NO: 371756 - DNA, 441 bp, Homo sapiens
catcttcatcggccgcatacggcgtgattgattgcggcatcttcatcggcgaaaacggcatcttcatcggccgatgaagatgccgttttcggccgagtctgagggactctgaaatcacagaaagtgggagcttggaggatccctccatggcgatggccgtggagagaggagcttgcccttctggggtcctggttcctgaagagctcacccagagaggctcaaagcagccttttgtcccagctcagctttgatctacacctcttgccaccttcctcaagggactgtgaccctttggggattctgtccctgaccctgcttccccaagctctcctgggtcttggagggatgtgggaatgaattggcattgcaggaaagacaggtaaagtgattgctgcaatgagaaggagctgtgcggaaaaggaataaaagttggaaaggctg

SEQ ID NO: 371757 - DNA, 1286 bp, Homo sapiens
  misc_feature (762)..(763): n is a, c, g, or t
gcctgcgctggcctctggcccatgccatgtgaagctgcctccctctcatccctcacttttcaggtgagcctgtgtgtgccactgaggttagtatactgagtgaaagaggtgagttagtataatgcacagtacatccaatgtgatcccttttgtgactgttgttttttacataagccaaagtttagaaggtggactcaaggatggaccagatcaggatgggccaggtcatgctgtgatcacagacaaccccaaaatctcctgacttatgacaccaaagatggacttgctgttcccacttcatgcccatcacagggtatattctttggctccatgcggccttcattctgggacacaggctgctagtacagctgctgcctggggcaattatcagtcattgtggcagagggaaaagaggtcatggtgaagctcacattggctcctgacgctgccaggggattgtgcagtgtcagtgttgtcgccagtgaggtttacccaagatgtgattattgctgattgaaaacttttcccactaccccaccatgatgacttgaaatatagtcaacattggcagtttttgacagtctttatggagactaaactttgttggtaaataaaagttgaaaaaaaaatgactaggtgcagcggctcacatgtctaatcccagcgctttgggaggccgaggtgggagaatcacttgagctcaggagtttgagaccagcctgagcaacatagcaagacttcatctctactaaaaagaaaacnnagtcgattacaatcaatggcccgggtttacaacgtagggatgggaaaccctggcgtacccaactaatcgcttggggaaatcccctttgccaggtggcgaataagcaaaggccgaacgtaggctttcaaaagttggccacttagggcaatggaaattaggcgtaatattgtaaaatgggtaaatttgtaatcgctatttatccaagggcaaaaggaatctcttaatcaggaatccggataactcaggttgtcttgtcaaagtctctttagaagggttcacctaggggaaaccttttaaggggccctaagtgaaccccttaaatttgggggggccgttataagctccggggccctttaatttgcgtaacctacctgtaagaggcttagggcttttggttcacaggacatcgtttcacgctcgtcacttacggccttgcgatctttctcctttcactactctcctgctgctgtcgttctgatttctcttggtgttgctcactcggagtgctcttccatgtctgccc

SEQ ID NO: 371758 - DNA, 958 bp, Homo sapiens
ggtcaccccgcggactggacgggaacctggcggggtcaggtcccgtcaagcagcctggctcatggctgtgtgcggcctggggagccgtcttggcctggggagccgtcttggcctgcgcgggtgcttcggcgccgccaggctcctgtatccccgtttccagagccgcggccctcagggcgtggaagacggggacaggccacagccttcctcgaagacacccaggatccccaagatttacaccaaaacgggagacaaagggttttctagtaccttcacaggagaaaggagacccaaagatgaccaagtgtttgaagccgtgggaactacagatgaattaagttcagctattgggtttgctctggaattagtcacagaaaagggccatacatttgccgaagagcttcagaaagtgagtaacaccatctcacccaagctgggaatcttcagccccggtggccatcacgggactcagcatccagccaccagttactctttgtgtcacctggggctagttactctccctctgtgagctccatttcttcatctgtaaaatgcggacaggccaggtatggtggctcacacctgcaatctcagctacttgggagactgaggcaggaagatcacttgaggccaggagcctaggtaacataataagaccctgactctacaaaatatttgaaaattagccaggcatagtggtgaatgcctgtagccttagctactcaggaaactgaggtaggaggatctcttgagcccaggaggtcaaggctgcagtgagctgtgatcatgccactgcactcctgcctgggcaagagattgagaccctgtctcaggccgagcaccatggttcaattaagcctgtaatcccagcactttgggcggccaaggtgggagcatcacttcaagccaggagttcaagaccagcctgggcaacttagggagaccctgtctctacaaa

SEQ ID NO: 371759 - DNA, 707 bp, Homo sapiens
gcaacctctgcctcccgggttcaagcgagtctcctcattattactattcttaacacttacctgttcctggctaccatttctccatggcgggcctgactaggtttgctctggaattagtcacagaaaagggccatacatttgccgaagagcttcagaaagtgagtaacaccatctcacccaagctgggaatcttcagccccggtggccatcacgggactcagcatccagccaccagttactctttgtgtcacctggggctagttactctccctctgtgagctccatttcttcatctgtaaaatgcggacaggccaggtatggtggctcacacctgcaatctcagctacttgggagactgaggcaggaagatcacttgaggccaggagcctaggtaacataataagaccctgactctacaaaatatttgaaaattagccaggcatagtggtgaatgcctgtagccttagctactcaggaaactgaggtaggaggatctcttgagcccaggaggtcaaggctgcagtgagctgtgatcatgccactgcactcctgcctgggcaagagattgagaccctgtctcaggccgagcaccatggttcaattaagcctgtaatcccagcactttgggcggccaaggtgggagcatcacttcaagccaggagttcaagaccagcctgggcaacttagggagaccctgtctctacaaa

SEQ ID NO: 371760 - DNA, 2494 bp, Homo sapiens
ggtcaccccgcggactggacgggaacctggcggggtcaggtcccgtcaagcagcctggctcatggctgtgtgcggcctggggagccgtcttggcctggggagccgtcttggcctgcgcgggtgcttcggcgccgccaggctcctgtatccccgtttccagagccgcggccctcagggcgtggaagacggggacaggccacagccttcctcgaagacacccaggatccccaagatttacaccaaaacgggagacaaagggttttctagtaccttcacaggagaaaggagacccaaagatgaccaagtgtttgaagccgtgggaactacagatgaattaagttcagctattgggtttgctctggaattagtcacagaaaagggccatacatttgccgaagagcttcagaaaatccagtgcacattgcaggacgtcggctcggccctggcgacaccatgctcctcggcccgggaggctcacttaaagtataccacgttcaaggcggggcccatcctggagctggagcagtggatcgacaagtacaccagccagctcccaccactcacggccttcatcctgccttcgggaggcaagatcagctcggcgctgcatttctgccgggccgtgtgccgccgggccgagagacgtgtggtgcctcttgtccagatgggagagaccgatgcgaacgtggccaagttcttaaacagactcagtgactatctcttcacgctagccagatatgcagccatgaaggaggggaatcaagagaaaatatacaagaaaaatgacccatcggccgagtctgagggactctgaaatcacagaaagtgggagcttggaggatccctccatggcgatggccgtggagagaggagcttgcccttctggggtcctggttcctgaagagctcacccagagaggctcaaagcagccttttgtcccagctcagctttgatctacacctcttgccaccttcctcaagggactgtgaccctttggggattctgtccctgaccctgcttccccaagctctcctgggtcttggagggatgtgggaatgaattggcattgcaggaaagacaggtaaagtgattgctgcaatgagaaggagctgtgcggaaaaggaataaaagttggaaaggctggagccgtgtgtgtgtgtgtgtgtgtgtgtgtgtgtgtgtgtgtgtgtgtgagagagagccctcccactgccagctcaggttgttcacagatttggaatgggaccagaggcccttgaaaatgtaattgtgatttacctgtgccaaaggtgctttaaatgtcacatttgtaaaggggaaggcggacaagatttggaagtttagtcacctctgagccacccatcaccgccaaagtgtgggggaaggatagctgcagattgacaggcgaggctcagaaactcctggcttagattgaagtgtgtgtgatgggggtgcagcttagaggaccccctctgaaagggatggagatgctgatgagaacaacactaccacttgaaggtgaacattccctgtctggttggactgagtcaagggtctgcggtgcagcatcttcagcttgagaaaatgaggttgtcagtttccagcaaggctgacatccaccagactgatttctccgatgttgcacttggctggcttatgcctctgagatcggtgccacggctgtatttatttcagttgtcactgctgctccctcctgctatgaaacgacactgccagtgccagcagtgtccttgggaaaggcaatatttatgaagggcagaagaggcagccccaagaacctaaagactgcaggctgctaattgcaggaaatgactttggaagggcaggctcttgtccagtttcagggctgaaatgcctggcgaactccattcagccatcacatattgactgagtggctgcttagcatgggccaccgcgctaggctcgggacagctggtctttccggccattgccttcattcttaccacctggcctgcaaagtttgcaggagggccaggtatattcacttgtgtcttctgggtcctttcattgctgacaggctgtgatggccctcttgagccttgggcagggtgggtgaggtgcagatgaccaggagtgtgtgaatgccttccaggaggtggctttgttccgtgcctccctgcccccatcgtcactaccaggtctggtacggagtcggtgctcagtgtttgcaaaacagagctgaaaacggactttgggaggccgaggcaggcagatcacctgaggtcaggagtttgagaccagcctggtcaacatggtaaaaccccatttctgctaaaaaaaaaaaaaaaaaaaaaaattagctgggcatggtggcgggtgcctgtaatcccagctattcaggaggctgaggcaggagaatcacttgaacctacgaggcagaggctgcagtgagccaagatcgtgacacgacactccagcctggctgatagagtgagactccgtcacaaaaaaa

SEQ ID NO: 371761 - DNA, 1628 bp, Homo sapiens
ggtcaccccgcggactggacgggaacctggcggggtcaggtcccgtcaagcagcctggctcatggctgtgtgcggcctggggagccgtcttggcctggggagccgtcttggcctgcgcgggtgcttcggcgccgccaggctcctgtatccccgtttccagagccgcggccctcagggcgtggaagacggggacaggccacagccttcctcgaagacacccaggatccccaagatttacaccaaaacgggagacaaagggttttctagtaccttcacaggagaaaggagacccaaagatgaccaagtgtttgaagccgtgggaactacagatgaattaagttcagctattgggtttgctctggaattagtcacagaaaagggccatacatttgccgaagagcttcagaaaatccagtgcacattgcaggacgtcggctcggccctggcgacaccatgctcctcggcccgggaggctcacttaaagtataccacgttcaaggcggggcccatcctggagctggagcagtggatcgacaagtacaccagccagctcccaccactcacggccttcatcctgccttcgggaggcaagatcagctcggcgctgcatttctgccgggccgtgtgccgccgggccgagagacgtgtggtgcctcttgtccagatgggagagaccgatgcgaacgtggccaagttcttaaacagactcagtgactatctcttcacgctagccagatatgcagccatgaaggaggggaatcaagagaaaatatacaagaaaaatgacccatcggccgagtctgagggactctgaaatcacagaaagtgggagcttggaggatccctccatggcgatggccgtggagagaggagcttgcccttctggggtcctggttcctgaagagctcacccagagaggctcaaagcagccttttgtcccagctcagctttgatctacacctcttgccaccttcctcaagggactgtgaccctttggggattctgtccctgaccctgcttccccaagctctcctgggtcttggagggatgtgggaatgaattggcattgcaggaaagacaggtaaagtgattgctgcaatgagaaggagctgtgcggaaaaggaataaaagttggaaaggctgaaaaaaaaaaaaaaaaaaaaaaaaaaaaaaaaaaaaaaataaaaaaaaaaaaaaaaaaaaaactcctggggggaccctccccgttaaaaaaccattatatgattagtcaaaaaaaaaataaaacccccggggggggcccccgccccaaattcgcctttttgggggcttcttacatttaccgggccgagttttaaaacgtgtaacttggaaaacccttggtttccccacttatgggtttgtataaatccccttttccccttggcgacattccaaaaggcccccccattccgctttacaaaacgttggccaccctatagtggaaggggcacttttatccccttaacctctgttaaaaattcgcttaatttttttttaaaatactcactttttaacccaatggctcaaaatgggaaaccccttttaacacaaaagaatcccccttttgcggtaaggggtgtcccctctggacaaagaagcctcctttt

SEQ ID NO: 371762 - DNA, 2449 bp, Homo sapiens
ggtcaccccgcggactggacgggaacctggcggggtcaggtcccgtcaagcagcctggctcatggctgtgtgcggcctggggagccgtcttggcctggggagccgtcttggcctgcgcgggtgcttcggcgccgccaggctcctgtatccccgtttccagagccgcggccctcagggcgtggaagacggggacaggccacagccttcctcgaagacacccaggatccccaagatttacaccaaaacgggagacaaagggttttctagtaccttcacaggagaaaggagacccaaagatgaccaagtgtttgaagccgtgggaactacagatgaattaagttcagctattgggtttgctctggaattagtcacagaaaagggccatacatttgccgaagagcttcagaaaatccagtgcacattgcaggacgtcggctcggccctggcgacaccatgctcctcggcccgggaggctcacttaatcgggaggcaagatcagctcggcgctgcatttctgccgggccgtgtgccgccgggccgagagacgtgtggtgcctcttgtccagatgggagagaccgatgcgaacgtggccaagttcttaaacagactcagtgactatctcttcacgctagccagatatgcagccatgaaggaggggaatcaagagaaaatatacaagaaaaatgacccatcggccgagtctgagggactctgaaatcacagaaagtgggagcttggaggatccctccatggcgatggccgtggagagaggagcttgcccttctggggtcctggttcctgaagagctcacccagagaggctcaaagcagccttttgtcccagctcagctttgatctacacctcttgccaccttcctcaagggactgtgaccctttggggattctgtccctgaccctgcttccccaagctctcctgggtcttggagggatgtgggaatgaattggcattgcaggaaagacaggtaaagtgattgctgcaatgagaaggagctgtgcggaaaaggaataaaagttggaaaggctggagccgtgtgtgtgtgtgtgtgtgtgtgtgtgtgtgtgtgtgtgtgtgtgagagagagccctcccactgccagctcaggttgttcacagatttggaatgggaccagaggcccttgaaaatgtaattgtgatttacctgtgccaaaggtgctttaaatgtcacatttgtaaaggggaaggcggacaagatttggaagtttagtcacctctgagccacccatcaccgccaaagtgtgggggaaggatagctgcagattgacaggcgaggctcagaaactcctggcttagattgaagtgtgtgtgatgggggtgcagcttagaggaccccctctgaaagggatggagatgctgatgagaacaacactaccacttgaaggtgaacattccctgtctggttggactgagtcaagggtctgcggtgcagcatcttcagcttgagaaaatgaggttgtcagtttccagcaaggctgacatccaccagactgatttctccgatgttgcacttggctggcttatgcctctgagatcggtgccacggctgtatttatttcagttgtcactgctgctccctcctgctatgaaacgacactgccagtgccagcagtgtccttgggaaaggcaatatttatgaagggcagaagaggcagccccaagaacctaaagactgcaggctgctaattgcaggaaatgactttggaagggcaggctcttgtccagtttcagggctgaaatgcctggcgaactccattcagccatcacatattgactgagtggctgcttagcatgggccaccgcgctaggctcgggacagctggtctttccggccatctttcttgctggcaagtcagcaaacattaccttcttagtcacgtgcatatttttgccttcattcttaccacctggcctgcaaagtttgcaggagggccaggtatattcacttgtgtcttctgggtcctttcattgctgacaggctgtgatggccctcttgagccttgggcagggtgggtgaggtgcagatgaccaggagtgtgtgaatgccttccaggaggtggctttgttccgtgcctccctgcccccatcgtcactaccaggtctggtacggagtcggtgctcagtgtttgcaaaacagagctgaaaacggactttgggaggccgaggcaggcagatcacctgaggtcaggagtttgagaccagcctggtcaacatggtaaaaccccatttctgctaaaaaaaaaaaaaaaaaaaaaaattagctgggcatggtggcgggtgcctgtaatcccagctattcaggaggctgaggcaggagaatcacttgaacctacgaggcagaggctgcagtgagccaagatcgtgacacgacactccagcctggctgatagagtgagactccgtcacaaaaaaa

SEQ ID NO: 371763 - DNA, 2478 bp, Homo sapiens
ggaggcattactagttgtcacactgggtgcaggggtgccactggcacctggtgggtggagaccaaaggtgctgtcagcatcctacactgcacaggatgcacaggacagccccgaacacacagaatgatccagaatgtcagtagggcctagtccagcagtgtcagcatcagccagggcaggaactagacctgcagagccccgggcccagcccagcccagccctcctgagtcagaatctgcacgtcgctgagatcccctggtgatgcctgtgcacactgtagtttgggaaacacccaaactgatcacgcacctgagccctgatcactcaaaggtgcaaaaaccggctcagagaggagtccaaagtcatctgccccatggggtagggccggggcaatggcctcatcctgcaggaatggccccagccttgacactggagtagagtccttggcattcacagcagctggcctcgtgtgccatccatcaagtgcaagatggctgggcccccgccctccctgcacaatgtgcccagagtgcgtcatttatatctcctccttgtaggcggatatgggaagacccagttagcgttgatctctcatttcaaaccattctgtttgcttctctctctctgcccctccagactcagtgactatctcttcacgctagccagatatgcagccatgaaggaggggaatcaagagaaaatatacaagaaaaatgacccatcggccgagtctgagggactctgaaatcacagaaagtgggagcttggaggatccctccatggcgatggccgtggagagaggagcttgcccttctggggtcctggttcctgaagagctcacccagagaggctcaaagcagccttttgtcccagctcagctttgatctacacctcttgccaccttcctcaagggactgtgaccctttggggattctgtccctgaccctgcttccccaagctctcctgggtcttggagggatgtgggaatgaattggcattgcaggaaagacaggtaaagtgattgctgcaatgagaaggagctgtgcggaaaaggaataaaagttggaaaggctggagccgtgtgtgtgtgtgtgtgtgtgtgtgtgtgtgtgtgtgtgtgtgtgagagagagccctcccactgccagctcaggttgttcacagatttggaatgggaccagaggcccttgaaaatgtaattgtgatttacctgtgccaaaggtgctttaaatgtcacatttgtaaaggggaaggcggacaagatttggaagtttagtcacctctgagccacccatcaccgccaaagtgtgggggaaggatagctgcagattgacaggcgaggctcagaaactcctggcttagattgaagtgtgtgtgatgggggtgcagcttagaggaccccctctgaaagggatggagatgctgatgagaacaacactaccacttgaaggtgaacattccctgtctggttggactgagtcaagggtctgcggtgcagcatcttcagcttgagaaaatgaggttgtcagtttccagcaaggctgacatccaccagactgatttctccgatgttgcacttggctggcttatgcctctgagatcggtgccacggctgtatttatttcagttgtcactgctgctccctcctgctatgaaacgacactgccagtgccagcagtgtccttgggaaaggcaatatttatgaagggcagaagaggcagccccaagaacctaaagactgcaggctgctaattgcaggaaatgactttggaagggcaggctcttgtccagtttcagggctgaaatgcctggcgaactccattcagccatcacatattgactgagtggctgcttagcatgggccaccgcgctaggctcgggacagctggtctttccggccatctttcttgctggcaagtcagcaaacattaccttcttagtcacgtgcatatttttgccttcattcttaccacctggcctgcaaagtttgcaggagggccaggtatattcacttgtgtcttctgggtcctttcattgctgacaggctgtgatggccctcttgagccttgggcagggtgggtgaggtgcagatgaccaggagtgtgtgaatgccttccaggaggtggctttgttccgtgcctccctgcccccatcgtcactaccaggtctggtacggagtcggtgctcagtgtttgcaaaacagagctgaaaacggactttgggaggccgaggcaggcagatcacctgaggtcaggagtttgagaccagcctggtcaacatggtaaaaccccatttctgctaaaaaaaaaaaaaaaaaaaaaaattagctgggcatggtggcgggtgcctgtaatcccagctattcaggaggctgaggcaggagaatcacttgaacctacgaggcagaggctgcagtgagccaagatcgtgacacgacactccagcctggctgatagagtgagactccgtcacaaaaaaa

SEQ ID NO: 371764 - DNA, 1743 bp, Homo sapiens
ggacgcgtgggtcgacccacgcgtccggcttggaggatccctccatggcgatggccgtggagagaggagcttgcccttctggggtcctggttcctgaagagctcacccagagaggctcaaagcagccttttgtcccagctcagctttgatctacacctcttgccaccttcctcaagggactgtgaccctttggggattctgtccctgaccctgcttccccaagctctcctgggtcttggagggatgtgggaatgaattggcattgcaggaaagacaggtaaagtgattgctgcaatgagaaggagctgtgcggaaaaggaataaaagttggaaaggctggagccgtgtgtgtgtgtgtgtgtgtgtgtgtgtgtgtgtgtgtgtgtgtgagagagagccctcccactgccagctcaggttgttcacagatttggaatgggaccagaggcccttgaaaatgtaattgtgatttacctgtgccaaaggtgctttaaatgtcacatttgtaaaggggaaggcggacaagatttggaagtttagtcacctctgagccacccatcaccgccaaagtgtgggggaaggatagctgcagattgacaggcgaggctcagaaactcctggcttagattgaagtgtgtgtgatgggggtgcagcttagaggaccccctctgaaagggatggagatgctgatgagaacaacactaccacttgaaggtgaacattccctgtctggttggactgagtcaagggtctgcggtgcagcatcttcagcttgagaaaatgaggttgtcagtttccagcaaggctgacatccaccagactgatttctccgatgttgcacttggctggcttatgcctctgagatcggtgccacggctgtatttatttcagttgtcactgctgctccctcctgctatgaaacgacactgccagtgccagcagtgtccttgggaaaggcaatatttatgaagggcagaagaggcagccccaagaacctaaagactgcaggctgctaattgcaggaaatgactttggaagggcaggctcttgtccagtttcagggctgaaatgcctggcgaactccattcagccatcacatattgactgagtggctgcttagcatgggccaccgcgctaggctcgggacagctggtctttccggccatctttcttgctggcaagtcagcaaacattaccttcttagtcacgtgcatatttttgccttcattcttaccacctggcctgcaaagtttgcaggagggccaggtatattcacttgtgtcttctgggtcctttcattgctgacaggctgtgatggccctcttgagccttgggcagggtgggtgaggtgcagatgaccaggagtgtgtgaatgccttccaggaggtggctttgttccgtgcctccctgcccccatcgtcactaccaggtctggtacggagtcggtgctcagtgtttgcaaaacagagctgaaaacggactttgggaggccgaggcaggcagatcacctgaggtcaggagtttgagaccagcctggtcaacatggtaaaaccccatttctgctaaaaaaaaaaaaaaaaaaaaaaattagctgggcatggtggcgggtgcctgtaatcccagctattcaggaggctgaggcaggagaatcacttgaacctacgaggcagaggctgcagtgagccaagatcgtgacacgacactccagcctggctgatagagtgagactccgtcacaaaaaaa

SEQ ID NO: 371765 - DNA, 2547 bp, Homo sapiens
ggtcaccccgcggactggacgggaacctggcggggtcaggtcccgtcaagcagcctggctcatggctgtgtgcggcctggggagccgtcttggcctggggagccgtcttggcctgcgcgggtgcttcggcgccgccaggctcctgtatccccgtttccagagccgcggccctcagggcgtggaagacggggacaggccacagccttcctcgaagacacccaggatccccaagatttacaccaaaacgggagacaaagggttttctagtaccttcacaggagaaaggagacccaaagatgaccaagtgtttgaagccgtgggaactacagatgaattaagttcagctattgggtttgctctggaattagtcacagaaaagggccatacatttgccgaagagcttcagaaaatccagtgcacattgcaggacgtcggctcggccctggcgacaccatgctcctcggcccgggaggctcacttaaagtataccacgttcaaggcggggcccatcctggagctggagcagtggatcgacaagtacaccagccagctcccaccactcacggccttcatcctgccttcgggaggcaagatcagctcggcgctgcatttctgccgggccgtgtgccgccgggccgagagacgtgtggtgcctcttgtccagatgggagagaccgatgcgaacgtggccaagttcttaaacagactcagtgactatctcttcacgctagccagatatgcagccatgaaggaggggaatcaagagaaaatatacaagaaaaatgacccatcggccgagtctgagggactctgaaatcacagaaagtgggagcttggaggatccctccatggcgatggccgtggagagaggagcttgcccttctggggtcctggttcctgaagagctcacccagagaggctcaaagcagccttttgtcccagctcagctttgatctacacctcttgccaccttcctcaagggactgtgaccctttggggattctgtccctgaccctgcttccccaagctctcctgggtcttggagggatgtgggaatgaattggcattgcaggaaagacaggtaaagtgattgctgcaatgagaaggagctgtgcggaaaaggaataaaagttggaaaggctggagccgtgtgtgtgtgtgtgtgtgtgtgtgtgtgtgtgtgtgtgtgtgtgagagagagccctcccactgccagctcaggttgttcacagatttggaatgggaccagaggcccttgaaaatgtaattgtgatttacctgtgccaaaggtgctttaaatgtcacatttgtaaaggggaaggcggacaagatttggaagtttagtcacctctgagccacccatcaccgccaaagtgtgggggaaggatagctgcagattgacaggcgaggctcagaaactcctggcttagattgaagtgtgtgtgatgggggtgcagcttagaggaccccctctgaaagggatggagatgctgatgagaacaacactaccacttgaaggtgaacattccctgtctggttggactgagtcaagggtctgcggtgcagcatcttcagcttgagaaaatgaggttgtcagtttccagcaaggctgacatccaccagactgatttctccgatgttgcacttggctggcttatgcctctgagatcggtgccacggctgtatttatttcagttgtcactgctgctccctcctgctatgaaacgacactgccagtgccagcagtgtccttgggaaaggcaatatttatgaagggcagaagaggcagccccaagaacctaaagactgcaggctgctaattgcaggaaatgactttggaagggcaggctcttgtccagtttcagggctgaaatgcctggcgaactccattcagccatcacatattgactgagtggctgcttagcatgggccaccgcgctaggctcgggacagctggtctttccggccatctttcttgctggcaagtcagcaaacattaccttcttagtcacgtgcatatttttgccttcattcttaccacctggcctgcaaagtttgcaggagggccaggtatattcacttgtgtcttctgggtcctttcattgctgacaggctgtgatggccctcttgagccttgggcagggtgggtgaggtgcagatgaccaggagtgtgtgaatgccttccaggaggtggctttgttccgtgcctccctgcccccatcgtcactaccaggtctggtacggagtcggtgctcagtgtttgcaaaacagagctgaaaacggactttgggaggccgaggcaggcagatcacctgaggtcaggagtttgagaccagcctggtcaacatggtaaaaccccatttctgctaaaaaaaaaaaaaaaaaaaaaaattagctgggcatggtggcgggtgcctgtaatcccagctattcaggaggctgaggcaggagaatcacttgaacctacgaggcagaggctgcagtgagccaagatcgtgacacgacactccagcctggctgatagagtgagactccgtcacaaaaaaa

SEQ ID NO: 371766 - DNA, 760 bp, Homo sapiens
ggtcaccccgcggactggacgggaacctggcggggtcaggtcccgtcaagcagcctggctcatggctgtgtgcggcctggggagccgtcttggcctggggagccgtcttggcctgcgcgggtgcttcggcgccgccaggctcctgtatccccgtttccagagccgcggccctcagggcgtggaagacggggacaggccacagccttcctcgaagacacccaggatccccaagatttacaccaaaacgggagacaaagggttttctagtaccttcacaggagaaaggagacccaaagatgaccaagtgtttgaagccgtgggaactacagatgaattaagttcagctattggccaaagtttagaaggtggactcaaggatggaccagatcaggatgggccaggtcatgctgtgatcacagacaaccccaaaatctcctgacttatgacaccaaagatggacttgctgttcccacttcatgcccatcacagggtttgctctggaattagtcacagaaaagggccatacatttgccgaagagcttcagaaaagtataccacgttcaaggcggggcccatcctggagctggagcagtggatcgacaagtacaccagccagctcccaccactcacggccttcatcctgccttgacagacgctgtcctccagttccccaagtccctccaggtcctcaccggtccctcccagccctgcccactctggagcagcgtgcccggtgggtgtgccgtggcagggctcctgg

SEQ ID NO: 371767 - DNA, 1393 bp, Homo sapiens
ggtcaccccgcggactggacgggaacctggcggggtcaggtcccgtcaagcagcctggctcatggctgtgtgcggcctggggagccgtcttggcctggggagccgtcttggcctgcgcgggtgcttcggcgccgccaggctcctgtatccccgtttccagagccgcggccctcagggcgtggaagacggggacaggccacagccttcctcgaagacacccaggatccccaagatttacaccaaaacgggagacaaagggttttctagtaccttcacaggagaaaggagacccaaagatgaccaagtgtttgaagccgtgggaactacagatgaattaagttcagctattgggtttgctctggaattagtcacagaaaagggccatacatttgccgaagagcttcagaaaatccagtgcacattgcaggacgtcggctcggccctggcgacaccatgctcctcggcccgggaggctcacttaaagtataccacgttcaaggcggggcccatcctggagctggagcagtggatcgacaagtacaccagccagctcccaccactcacggccttcatcctgccttcgggaggcaagatcagctcggcgctgcatttctgccgggccgtgtgccgccgggccgagagacgtgtggtgcctcttgtccagatgggagagaccgatgcgaacgtggccaagttcttaaacagactcagtgactatctcttcacgctagccagatatgcagccatgaaggaggggaatcaagagaaaatatacaagaaaaatgacccatcggccgagtctgagggactctgaaatcacagaaagtgggagcttggaggatccctccatggcgatggccgtggagagaggagcttgcccttctggggtcctggttcctgaagagctcacccagagaggctcaaagcagccttttgtcccagctcagctttgatctacacctcttgccaccttcctcaagggactgtgaccctttggggattctgtccctgaccctgcttccccaagctctcctgggtcttggagggatgtgggaatgaattggcattgcaggaaagacaggtaaagtgattgctgcaatgagaaggagctgtgcggaaaaggaataaaagttggaaaggctggagccgtgtgtgtgtgtgtgtgtgtgtgtgtgtgtgtgtgtgtgtgtgtgagagagagccctcccactgccagctcaggttgttcacagatttggaatgggaccagaggcccttgaaaatgtaattgtgatttacctgtgaaaaaaacaacctccctacctcgaaaaaaaactcgaggggggcccgggcccaatttccccatggggggccattcacattaaatggccgggctttacaacgtcgtactggg

SEQ ID NO: 371768 - DNA, 2634 bp, Homo sapiens
ggtcaccccgcggactggacgggaacctggcggggtcaggtcccgtcaagcagcctggctcatggctgtgtgcggcctggggagccgtcttggcctggggagccgtcttggcctgcgcgggtgcttcggcgccgccaggctcctgtatccccgtttccagagccgcggccctcagggcgtggaagacggggacaggccacagccttcctcgaagacacccaggatccccaagatttacaccaaaacgggagacaaagggttttctagtaccttcacaggagaaaggagacccaaagatgaccaagtgtttgaagccgtgggaactacagatgaattaagttcagctattgggtttgctctggaattagtcacagaaaagggccatacatttgccgaagagcttcagaaaatccagtgcacattgcaggacgtcggctcggccctggcgacaccatgctcctcggcccgggaggctcacttaaagtataccacgttcaaggcggggcccatcctggagctggagcagtggatcgacaagtacaccagccagctcccaccactcacggccttcatcctgccttgacagacgctgtcctccagttccccaagtccctccaggtcctcaccggtccctcccagccctgcccactctggagcagcgtgcccgtcgggaggcaagatcagctcggcgctgcatttctgccgggccgtgtgccgccgggccgagagacgtgtggtgcctcttgtccagatgggagagaccgatgcgaacgtggccaagttcttaaacagactcagtgactatctcttcacgctagccagatatgcagccatgaaggaggggaatcaagagaaaatatacaagaaaaatgacccatcggccgagtctgagggactctgaaatcacagaaagtgggagcttggaggatccctccatggcgatggccgtggagagaggagcttgcccttctggggtcctggttcctgaagagctcacccagagaggctcaaagcagccttttgtcccagctcagctttgatctacacctcttgccaccttcctcaagggactgtgaccctttggggattctgtccctgaccctgcttccccaagctctcctgggtcttggagggatgtgggaatgaattggcattgcaggaaagacaggtaaagtgattgctgcaatgagaaggagctgtgcggaaaaggaataaaagttggaaaggctggagccgtgtgtgtgtgtgtgtgtgtgtgtgtgtgtgtgtgtgtgtgtgtgagagagagccctcccactgccagctcaggttgttcacagatttggaatgggaccagaggcccttgaaaatgtaattgtgatttacctgtgccaaaggtgctttaaatgtcacatttgtaaaggggaaggcggacaagatttggaagtttagtcacctctgagccacccatcaccgccaaagtgtgggggaaggatagctgcagattgacaggcgaggctcagaaactcctggcttagattgaagtgtgtgtgatgggggtgcagcttagaggaccccctctgaaagggatggagatgctgatgagaacaacactaccacttgaaggtgaacattccctgtctggttggactgagtcaagggtctgcggtgcagcatcttcagcttgagaaaatgaggttgtcagtttccagcaaggctgacatccaccagactgatttctccgatgttgcacttggctggcttatgcctctgagatcggtgccacggctgtatttatttcagttgtcactgctgctccctcctgctatgaaacgacactgccagtgccagcagtgtccttgggaaaggcaatatttatgaagggcagaagaggcagccccaagaacctaaagactgcaggctgctaattgcaggaaatgactttggaagggcaggctcttgtccagtttcagggctgaaatgcctggcgaactccattcagccatcacatattgactgagtggctgcttagcatgggccaccgcgctaggctcgggacagctggtctttccggccatctttcttgctggcaagtcagcaaacattaccttcttagtcacgtgcatatttttgccttcattcttaccacctggcctgcaaagtttgcaggagggccaggtatattcacttgtgtcttctgggtcctttcattgctgacaggctgtgatggccctcttgagccttgggcagggtgggtgaggtgcagatgaccaggagtgtgtgaatgccttccaggaggtggctttgttccgtgcctccctgcccccatcgtcactaccaggtctggtacggagtcggtgctcagtgtttgcaaaacagagctgaaaacggactttgggaggccgaggcaggcagatcacctgaggtcaggagtttgagaccagcctggtcaacatggtaaaaccccatttctgctaaaaaaaaaaaaaaaaaaaaaaattagctgggcatggtggcgggtgcctgtaatcccagctattcaggaggctgaggcaggagaatcacttgaacctacgaggcagaggctgcagtgagccaagatcgtgacacgacactccagcctggctgatagagtgagactccgtcacaaaaaaa

SEQ ID NO: 371769 - DNA, 2395 bp, Homo sapiens
ggtcaccccgcggactggacgggaacctggcggggtcaggtcccgtcaagcagcctggctcatggctgtgtgcggcctggggagccgtcttggcctggggagccgtcttggcctgcgcgggtgcttcggcgccgccaggctcctgtatccccgtttccagagccgcggccctcagggcgtggaagacggggacaggccacagccttcctcgaagacacccaggatccccaagatttacaccaaaacgggagacaaagatccagtgcacattgcaggacgtcggctcggccctggcgacaccatgctcctcggcccgggaggctcacttaaagtataccacgttcaaggcggggcccatcctggagctggagcagtggatcgacaagtacaccagccagctcccaccactcacggccttcatcctgccttcgggaggcaagatcagctcggcgctgcatttctgccgggccgtgtgccgccgggccgagagacgtgtggtgcctcttgtccagatgggagagaccgatgcgaacgtggccaagttcttaaacagactcagtgactatctcttcacgctagccagatatgcagccatgaaggaggggaatcaagagaaaatatacaagaaaaatgacccatcggccgagtctgagggactctgaaatcacagaaagtgggagcttggaggatccctccatggcgatggccgtggagagaggagcttgcccttctggggtcctggttcctgaagagctcacccagagaggctcaaagcagccttttgtcccagctcagctttgatctacacctcttgccaccttcctcaagggactgtgaccctttggggattctgtccctgaccctgcttccccaagctctcctgggtcttggagggatgtgggaatgaattggcattgcaggaaagacaggtaaagtgattgctgcaatgagaaggagctgtgcggaaaaggaataaaagttggaaaggctggagccgtgtgtgtgtgtgtgtgtgtgtgtgtgtgtgtgtgtgtgtgtgtgagagagagccctcccactgccagctcaggttgttcacagatttggaatgggaccagaggcccttgaaaatgtaattgtgatttacctgtgccaaaggtgctttaaatgtcacatttgtaaaggggaaggcggacaagatttggaagtttagtcacctctgagccacccatcaccgccaaagtgtgggggaaggatagctgcagattgacaggcgaggctcagaaactcctggcttagattgaagtgtgtgtgatgggggtgcagcttagaggaccccctctgaaagggatggagatgctgatgagaacaacactaccacttgaaggtgaacattccctgtctggttggactgagtcaagggtctgcggtgcagcatcttcagcttgagaaaatgaggttgtcagtttccagcaaggctgacatccaccagactgatttctccgatgttgcacttggctggcttatgcctctgagatcggtgccacggctgtatttatttcagttgtcactgctgctccctcctgctatgaaacgacactgccagtgccagcagtgtccttgggaaaggcaatatttatgaagggcagaagaggcagccccaagaacctaaagactgcaggctgctaattgcaggaaatgactttggaagggcaggctcttgtccagtttcagggctgaaatgcctggcgaactccattcagccatcacatattgactgagtggctgcttagcatgggccaccgcgctaggctcgggacagctggtctttccggccatctttcttgctggcaagtcagcaaacattaccttcttagtcacgtgcatatttttgccttcattcttaccacctggcctgcaaagtttgcaggagggccaggtatattcacttgtgtcttctgggtcctttcattgctgacaggctgtgatggccctcttgagccttgggcagggtgggtgaggtgcagatgaccaggagtgtgtgaatgccttccaggaggtggctttgttccgtgcctccctgcccccatcgtcactaccaggtctggtacggagtcggtgctcagtgtttgcaaaacagagctgaaaacggactttgggaggccgaggcaggcagatcacctgaggtcaggagtttgagaccagcctggtcaacatggtaaaaccccatttctgctaaaaaaaaaaaaaaaaaaaaaaattagctgggcatggtggcgggtgcctgtaatcccagctattcaggaggctgaggcaggagaatcacttgaacctacgaggcagaggctgcagtgagccaagatcgtgacacgacactccagcctggctgatagagtgagactccgtcacaaaaaaa

SEQ ID NO: 371770 - DNA, 2561 bp, Homo sapiens
ggtcaccccgcggactggacgggaacctggcggggtcaggtcccgtcaagcagcctggctcatggctgtgtgcggcctggggagccgtcttggcctggggagccgtcttggcctgcgcgggtgcttcggcgccgccaggctcctgtatccccgtttccagagccgcggccctcagggcgtggaagacggggacaggccacagccttcctcgaagacacccaggatccccaagatttacaccaaaacgggagacaaagggttttctagtaccttcacaggagaaaggagacccaaagatgaccaagtgtttgaagccgtgggaactacagatgaattaagttcagctattgggtttgctctggaattagtcacagaaaagggccatacatttgccgaagagcttcagaaaagtataccacgttcaaggcggggcccatcctggagctggagcagtggatcgacaagtacaccagccagctcccaccactcacggccttcatcctgccttgacagacgctgtcctccagttccccaagtccctccaggtcctcaccggtccctcccagccctgcccactctggagcagcgtgcccgtcgggaggcaagatcagctcggcgctgcatttctgccgggccgtgtgccgccgggccgagagacgtgtggtgcctcttgtccagatgggagagaccgatgcgaacgtggccaagttcttaaacagactcagtgactatctcttcacgctagccagatatgcagccatgaaggaggggaatcaagagaaaatatacaagaaaaatgacccatcggccgagtctgagggactctgaaatcacagaaagtgggagcttggaggatccctccatggcgatggccgtggagagaggagcttgcccttctggggtcctggttcctgaagagctcacccagagaggctcaaagcagccttttgtcccagctcagctttgatctacacctcttgccaccttcctcaagggactgtgaccctttggggattctgtccctgaccctgcttccccaagctctcctgggtcttggagggatgtgggaatgaattggcattgcaggaaagacaggtaaagtgattgctgcaatgagaaggagctgtgcggaaaaggaataaaagttggaaaggctggagccgtgtgtgtgtgtgtgtgtgtgtgtgtgtgtgtgtgtgtgtgtgtgagagagagccctcccactgccagctcaggttgttcacagatttggaatgggaccagaggcccttgaaaatgtaattgtgatttacctgtgccaaaggtgctttaaatgtcacatttgtaaaggggaaggcggacaagatttggaagtttagtcacctctgagccacccatcaccgccaaagtgtgggggaaggatagctgcagattgacaggcgaggctcagaaactcctggcttagattgaagtgtgtgtgatgggggtgcagcttagaggaccccctctgaaagggatggagatgctgatgagaacaacactaccacttgaaggtgaacattccctgtctggttggactgagtcaagggtctgcggtgcagcatcttcagcttgagaaaatgaggttgtcagtttccagcaaggctgacatccaccagactgatttctccgatgttgcacttggctggcttatgcctctgagatcggtgccacggctgtatttatttcagttgtcactgctgctccctcctgctatgaaacgacactgccagtgccagcagtgtccttgggaaaggcaatatttatgaagggcagaagaggcagccccaagaacctaaagactgcaggctgctaattgcaggaaatgactttggaagggcaggctcttgtccagtttcagggctgaaatgcctggcgaactccattcagccatcacatattgactgagtggctgcttagcatgggccaccgcgctaggctcgggacagctggtctttccggccatctttcttgctggcaagtcagcaaacattaccttcttagtcacgtgcatatttttgccttcattcttaccacctggcctgcaaagtttgcaggagggccaggtatattcacttgtgtcttctgggtcctttcattgctgacaggctgtgatggccctcttgagccttgggcagggtgggtgaggtgcagatgaccaggagtgtgtgaatgccttccaggaggtggctttgttccgtgcctccctgcccccatcgtcactaccaggtctggtacggagtcggtgctcagtgtttgcaaaacagagctgaaaacggactttgggaggccgaggcaggcagatcacctgaggtcaggagtttgagaccagcctggtcaacatggtaaaaccccatttctgctaaaaaaaaaaaaaaaaaaaaaaattagctgggcatggtggcgggtgcctgtaatcccagctattcaggaggctgaggcaggagaatcacttgaacctacgaggcagaggctgcagtgagccaagatcgtgacacgacactccagcctggctgatagagtgagactccgtcacaaaaaaa

SEQ ID NO: 371771 - DNA, 4049 bp, Homo sapiens
tacagctgttcctgctgattgctttttaagctaggctcaagtgtggggccacggaatccttcaggtgcccttcaaatcagacattacatttcagctctcagggctagaatgcttccccctcttatcttgggcaggtctttgaagaagccagtttagccttggtaattttgaatttggccatagtatacggaggagagctaggtagctatcaaaacgcttagacaaacgtatggtaaaatgcagcccagcctgaacctccgcaaaacccccaaacctggagcagcaagtgggcaaaggagtgtgtgtttggggcagggtactgagtcccatatgtaatcaagagacctggagggcccaaggaagtcagtgacacccccacaagctacatatcctccaatggattgtggtggtcatctccggctaccgaagccaccttgcttattcccataggcttacaaacattatgatgcttcacacgagttgtgggtgaagtgaaggaattggaaagtcccggtctaaggccctgcaaaactgctgtctggtaaaaacaagtgactatggcaaggccctgaatgtactacgtatagacttaagtcagtatttgtgcctaacagcaaagcatgccacaagaggctcctcaaaagccgggtaattgatgccattgttttcttgacctagttgaagagtcaaagaagagaaggtgatgcagaaacttctttccagtgaagtgacagatccaagcaaggaacacctgcctgtgaggggagcggtaggggagggggtagattcggcagcactcgggtagtggcagggaccacatattgtcggtgttaaccactgttatcactggcccaggtcgagtgaggacgagtcatttccccactaagcacttggggagtggcagggaccacatattgtcagtgttaaccactgttatgactggcccaggtcgggtgacgacgagccatttccgcactattgtcccttcttcctcactgcacccccagccctgcaccctcagctccaaatacacattctcgttcactcaacgtttgttgacacctagcgtgggccctgtgggatggggtaaaagttcggtgttgggaggagccccggtgacagatttttggttttggtggtggcttttgggcaaggacaggtcagttcataaaagatgacgccccaggtctggatcgaattctcctgggagccagaccaaagcaccttcctggactgcaaagtgtggaagccgccgcgggccgggcgcggggaggtgtcatgcgccggaacctgcgcttggggccaagctctggagctgacgcgcaggggcaaggcgccccgcgtcccggactggcggctccgcgcatgctcctcccaccggcgtcgcaggcctcgagaggctccggaagtactgggtgcagcctgatggcgcaggaggtagacacggcacagggcgccgagatgcggcggggcgcgggcgcggctcggggacgcgcttcctggtgctgggccctggcgctgctttggctcgcggtggttccgggctggtcccgggtctcgggcatcccctcccggcgccactggccggtgccctacaagcgctttgacttccgtccaaaacctgatccttattgtcaagctaagtatactttctgtccaactggctcacctatcccagttatggagggtgatgatgacattgaagtttttcgattacaagccccagtatgggaatttaaatatggagacctcctgggacacttgaaaattatgcatgatgccattggattcagaagtacattaactggcaagaactacacaatggaatggtatgaacttttccaacttggcaactgtacatttccccatctccgacctgaaatggatgcccctttctggtgtaatcaaggcgctgcctgcttttttgagggaattgatgatgttcactggaaggaaaatgggacattagttcaagtagcaactatatcaggaaacatgttcaaccaaatggcaaagtgggtgaaacaggacaatgaaacaggaatttattatgagacatggaatgtaaaagccagcccagaaaagggggcagagacatggtttgattcctacgactgttccaaatttgtgttaaggacctttaacaagttggctgaatttggagcagagttcaagaacatagaaaccaactatacaagaatatttctttacagtggagaacctacttatctgggaaatgaaacatctgtttttgggccaacaggaaacaagactcttggtttagccataaaaagattttattaccccttcaaaccacatttgccaactaaagaatttctgttgagtctcttgcaaatttttgatgcagtgattgtgcacaaacagttctatttgttttataattttgaatattggtttttacctatgaaattcccttttattaaaataacatatgaagaaatccctttacctatcagaaacaaaacactctctggtttataaaacaccttaattctactgctcttttttctccaatcaccagcatctgtttttcagggggtgattttacttttgtgaattccttagcctttcttccttggtgcataaagttaaaatgcacatcagcagaattgctgcatattaacatctcaggactcttctcttgtaaagaagctgaaattcgtactatattggccaaagtgagcgagttaggtgatcttggtttcaatttccgagcctttgttaatatggagaattatggttcatatcagttatgtaggacctttggacccagggtcctacagatagatatggtgtgcccagattttaaaaataccttcaaaaataaaaaatacattcagtgacattttcatggtgggagctcttctttctgatatggcagttacactttttcacttaagtgctttagtttagactaactttacaacttctataacttttggaaccaagtttagtatagtctgattacattccattcacctaactttagacattcgtttagacaccataactggagtgattgtgcttctagatgtggcaaatccagtgttaacacatatttctggctgagattttggaactagctagtaactggcttgtgttctttaagcatactaacatcactaaatcttaggatttaggattgctgtaaagatgtaagttgtgtatgtttggcaggtcacattgaatggcagtgataatgattaatcaaagaacaaatgtcatccttgatcttgcctaatgtagtttatgtgccaaactttccagggttttgtagtcacctagattttaagctgatagcatagtgcttcagcggttcttctaaccggggtatgcaggaacatggctgcagacacgtttgggtaaacaggcaccttctgacttcttcattgtttcctgtagttctccctcttcccacaaagctgtcagcgcagtggaagaggttgcacttctccgagagaggacaggtttctgttaagatcaccaagtagctgtgctttaattagagccagacaagctttcaaggtcctttaagtatttgatgatcaactgaacacgtttctattcaaggagaaaacaccattcagtaagaagatggagtagatatcagataaaacaattcacgtttaatatgtaaatgtaccaattatgtgattcagtttcaactttcaagtacttcctgagaggttagtacattattattgagctctcacagaaagcttaatcatagatataattaacctgatccaaatgagtaaagtggaccttagaaaggctaagtgatctttctctggctatccagctagtagtaatgaagtcaggtcttgaaccccggttctgctgactgaattggatgcactatagtacaggcttttagcaccgaagtgtggtcctcagaccagtgcctgccaaccagatgttactggtctgtgaggaaataagtacagatactgacaggaagcttttataaacaatttattggagtgtttttgtttctgttgggtctaattaaaaaaattggagcttgt

SEQ ID NO: 371772 - DNA, 2152 bp, Homo sapiens
tacagctgttcctgctgattgctttttaagctaggctcaagtgtggggccacggaatccttcaggtgcccttcaaatcagacattacatttcagctctcagggctagaatgcttccccctcttatcttgggcaggtctttgaagaagccagtttagccttggtaattttgaatttggccatagtatacggaggagagctaggtagctatcaaaacgcttagacaaacgtatggtaaaatgcagcccagcctgaacctccgcaaaacccccaaacctggagcagcaagtgggcaaaggagtgtgtgtttggggcagggtactgagtcccatatgtaatcaagagacctggagggcccaaggaagtcagtgacacccccacaagctacatatcctccaatggattgtggtggtcatctccggctaccgaagccaccttgcttattcccataggcttacaaacattatgatgcttcacacgagttgtgggtgaagtgaaggaattggaaagtcccggtctaaggccctgcaaaactgctgtctggtaaaaacaagtgactatggcaaggccctgaatgtactacgtatagacttaagtcagtatttgtgcctaacagcaaagcatgccacaagaggctcctcaaaagccgggtaattgatgccattgttttcttgacctagttgaagagtcaaagaagagaaggtgatgcagaaacttctttccagtgaagtgacagatccaagcaaggaacacctgcctgtgaggggagcggtaggggagggggtagattcggcagcactcgggtagtggcagggaccacatattgtcggtgttaaccactgttatcactggcccaggtcgagtgaggacgagtcatttccccactaagcacttggggagtggcagggaccacatattgtcagtgttaaccactgttatgactggcccaggtcgggtgacgacgagccatttccgcactattgtcccttcttcctcactgcacccccagccctgcaccctcagctccaaatacacattctcgttcactcaacgtttgttgacacctagcgtgggccctgtgggatggggtaaaagttcggtgttgggaggagccccggtgacagatttttggttttggtggtggcttttgggcaaggacaggtcagttcataaaagatgacgccccaggtctggatcgaattctcctgggagccagaccaaagcaccttcctggactgcaaagtgtggaagccgccgcgggccgggcgcggggaggtgtcatgcgccggaacctgcgcttggggccaagctctggagctgacgcgcaggggcaaggcgccccgcgtcccggactggcggctccgcgcatgctcctcccaccggcgtcgcaggcctcgagaggctccggaagtactgggtgcagcctgatggcgcaggaggtagacacggcacagggcgccgagatgcggcggggcgcgggcgcggctcggggacgcgcttcctggtgctgggccctggcgctgctttggctcgcggtggttccgggctggtcccgggtctcgggcatcccctcccggcgccactggccggtgccctacaagcgctttgacttccgtccaaaacctgatccttattgtcaagctaagtatactttctgtccaactggctcacctatcccagttatggagggtgatgatgacattgaagtttttcgattacaagccccagtatgggaatttaaatatggagacctcctgggacacttgaaaattatgcatgatgccattggattcagaagtacattaactggcaagaactacacaatggaatggtatgaacttttccaacttggcaactgtacatttccccatctccgacctgaaatggatgcccctttctggtgtaatcaaggcgctgcctgcttttttgagggaattgatgatgttcactggaaggaaaatgggacattagttcaagtagcaactatatcaggtaagttgtgaaaatatagcaatatttgatcattgcatcaaaaaccaaatgaaagaaattgttatacttccattgaaacatttcagtaatgttttacttagaggtcatttgtaaaatgtacttttggaaccattaaactttgggaatttttttcatctctta

SEQ ID NO: 371773 - DNA, 715 bp, Homo sapiens
tgaggtctgtagagctgcttccagagactggcatgggggctcctcacacttattctaagctctaaggaaattatcagcttgtccacataacatgcaggcctcctatttgagatgagccaaataggggtgtagtggccaaagctggggtggatgagggcctggagtttggggccacagagtggatatgacagtagcagcatggaagaacagctgaacagttgttctacttgatatgcatttgtgatgtgccacattttctcctatcaggttacctggacccatgggttgtgtcacagttgcttttatacatgtactgtctttacacagaaaattatgcatgatgccattggattcagaagtacattaactggcaagaactacacaatggaatggtatgaacttttccaacttggcaactgtacatttccccatctccgacctgaaatggatgcccctttctggtgtaatcaaggcgctgcctgcttttttgagggaattgatgatgttcactggaaggaaaatgggacattagttcaagtagcaactatatcaggtaagttgtgaaaatatagcaatatttgatcattgcatcaaaaaccaaatgaaagaaattgttatacttccattgaaacatttcagtaatgttttacttagaggtcatttgtaaaatgtacttttggaaccattaaactttgggaatttttttcatctctta

SEQ ID NO: 371774 - DNA, 1658 bp, Homo sapiens
tcttgtaaagaagctgaaattcgtactatattggccaaagtgagcgagttaggtgatcttggtttcaatttccgagcctttgttaatatggagaattatggtggtttataaaacaccttaattctactgctcttttttctccaatcaccagcatctgtttttcagggggtgattttacttttgtgaattccttagcctttcttccttggtgcataaagttaaaatgcacatcagcagaattgctgcatattaacatctcaggactcttctcttgtaaagaagctgaaattcgtactatattggccaaagtgagcgagttaggtgatcttggtttcaatttccgagcctttgttaatatggagaattatggttcatatcagttatgtaggacctttggacccagggtcctacagatagatatggtgtgcccagattttaaaaataccttcaaaaataaaaaatacattcagtgacattttcatggtgggagctcttctttctgatatggcagttacactttttcacttaagtgctttagtttagactaactttacaacttctataacttttggaaccaagtttagtatagtctgattacattccattcacctaactttagacattcgtttagacaccataactggagtgattgtgcttctagatgtggcaaatccagtgttaacacatatttctggctgagattttggaactagctagtaactggcttgtgttctttaagcatactaacatcactaaatcttaggatttaggattgctgtaaagatgtaagttgtgtatgtttggcaggtcacattgaatggcagtgataatgattaatcaaagaacaaatgtcatccttgatcttgcctaatgtagtttatgtgccaaactttccagggttttgtagtcacctagattttaagctgatagcatagtgcttcagcggttcttctaaccggggtatgcaggaacatggctgcagacacgtttgggtaaacaggcaccttctgacttcttcattgtttcctgtagttctccctcttcccacaaagctgtcagcgcagtggaagaggttgcacttctccgagagaggacaggtttctgttaagatcaccaagtagctgtgctttaattagagccagacaagctttcaaggtcctttaagtatttgatgatcaactgaacacgtttctattcaaggagaaaacaccattcagtaagaagatggagtagatatcagataaaacaattcacgtttaatatgtaaatgtaccaattatgtgattcagtttcaactttcaagtacttcctgagaggttagtacattattattgagctctcacagaaagcttaatcatagatataattaacctgatccaaatgagtaaagtggaccttagaaaggctaagtgatctttctctggctatccagctagtagtaatgaagtcaggtcttgaaccccggttctgctgactgaattggatgcactatagtacaggcttttagcaccgaagtgtggtcctcagaccagtgcctgccaaccagatgttactggtctgtgaggaaataagtacagatactgacaggaagcttttataaacaatttattggagtgtttttgtttctgttgggtctaattaaaaaaattggagcttgt

SEQ ID NO: 371775 - DNA, 544 bp, Homo sapiens
cactccagggaaggagtgagaatcagtgagtgtgttttctggtcccactgatggtaggacaccttgaggtcagtggggaagctggcctgggtagagggctgtgggtgctgggccaggcaagcccatcccttggagaagcagacccagacatggcaggggcaccccagctccgcctgtgtggcctctgggcagctggctttccctaggcacaacacttccctgcatgtatcagtgttggatgtatcatccccctctctggctcctttcacaacccaatacctccccaccacctttaacaccatcccttgagttcattctgttttcctaaaattcagtcacagatgcaccaacaccaatctgctcttcaagatggagttctggcattgccacttcagaaatccaatctgccgtatcctagcctggatgcagtcttctttcctcctgacagcactggtttgatagagcctagtgatctgtttactccctacttccctcgccagactctacacttctgtttttaaaaaaacttcttgaaacttttcta

SEQ ID NO: 371776 - DNA, 532 bp, Homo sapiens
ccttaggcctgttttataaggccactactcatattcacgagggatctgcccttatgacctaatcgtctcccaaaggccccacctccaaataacattactttggaggttaggtctttaacatgaattttggagggacacaaacattccttctatagcactcacacacctatcatgacatctgtggctcttgatgtccctcgggtgggctgtcaggagaatagaaaggtgcctgtgcttcaggcctgagacttctttccgtgtgtaggctcacactgcctgagaaatttgggttccttgtttcgtctttaaacagcttcttcctttactagtcgaggctttttcaggtgcccattgcaggagacccctttgtagagtcacgggggcttaatcagaatccccttctctccatatacccaaccccgtagactgtggtgaggattgaatgagacctacttagcatgattcctgacagagtgtgcactcaagtagatactagctattatcgttactattatttctcttaaaaaagaaa

SEQ ID NO: 371777 - DNA, 3470 bp, Homo sapiens
gtgggtctgcacctggattttggagtcccagtgctgctgcagctctgagcattcccacgtcaccagagaagccggtgggcaatgagatcatgtctgctttcaggttgtggcctggcctgctgatcatgttgggttctctctgccatagaggttcaccgtgtggcctttcaacacacgtagaaataggacacagagctctggagtttcttcagcttcacaatgggcgtgttaactacagagagctgttactagaacaccaggatgcgtatcaggctggaatcgtgtttcctgattgtttttaccctagcatctgcaaaggaggaaaattccatgatgtgtctgagagcactcactggactccgtttcttaatgcaagcgttcattatatccgagagaactatccccttccctgggagaaggacacagagaaactggtagctttcttgtttggaattacttctcacatggcggcagatgtcagctggcatagtctgggccttgaacaaggattccttaggaccatgggagctattgattttcacggctcctattcagaggctcattcggctggtgattttggaggagatgtgttgagccagtttgaatttaattttaattaccttgcacgacgctggtatgtgccagtcaaagatctactgggaatttatgagaaactgtatggtcgaaaagtcatcaccgaaaatgtaatcgttgattgttcacatatccagttcttagaaatgtatggtgagatgctagctgtttccaagttatatcccacttactctacaaagtccccgtttttggtggaacaattccaagagtattttcttggaggactggatgatatggcattttggtccactaatatttaccatctaacaagcttcatgttggagaatgggaccagtgactgcaacctgcctgagaaccctctgttcattgcatgtggcggccagcaaaaccacacccagggctcaaaaatgcagaaaaatgattttcacagaaatttgactacatccctaactgaaagtgttgacaggaatataaactatactgaaagaggagtgttctttagtgtaaattcctggaccccggattccatgtcctttatctacaaggctttggaaaggaacataaggacaatgttcataggtggctctcagttgtcacaaaagcacgtctccagccccttagcatcttacttcttgtcatttccttatgcgaggcttggctgggcaatgacctcagctgacctcaaccaggatgggcacggtgacctcgtggtgggcgcaccaggctacagccgccccggccacatccacatcgggcgcgtgtacctcatctacggcaatgacctgggcctgccacctgttgacctggacctggacaaggaggcccacaggatccttgaaggcttccagccctcaggtcggtttggctcggccttggctgtgttggactttaacgtggacggcgtgcctgacctggccgtgggagctccctcggtgggctccgagcagctcacctacaaaggtgccgtgtatgtctactttggttccaaacaaggaggaatgtcttcttcccctaacatcaccatttcttgccaggacatctactgtaacttgggctggactctcttggctgcagatgtgaatggagacagtgaacccgatctggtcatcggctccccttttgcaccaggtggagggaagcagaagggaattgtggctgcgttttattctggccccagcctgagcgacaaagaaaaactgaacgtggaggcagccaactggacggtgagaggcgaggaagacttctcctggtttggatattcccttcacggtgtcactgtggacaacagaaccttgctgttggttgggagcccgacctggaagaatgccagcaggctgggccatttgttacacatccgagatgagaaaaagagccttgggagggtgtatggctacttcccaccaaacggccaaagctggtttaccatttctggagacaaggcaatggggaaactgggtacttccctttccagtggccacgtactgatgaatgggactctgaaacaagtgctgctggttggagcccctacgtacgatgacgtgtctaaggtggcattcctgaccgtgaccctacaccaaggcggagccactcgcatgtacgcactcatatctgacgcgcagcctctgctgctcagcaccttcagcggagaccgccgcttctcccgatttggtggcgttctgcacttgagtgacctggatgatgatggcttagatgaaatcatcatggcagcccccctgaggatagcagatgtaacctctggactgattgggggagaagacggccgagtatatgtatataatggcaaagagaccacccttggtgacatgactggcaaatgcaaatcatggataactccatgtccagaagaaaaggcccaatatgtattgatttctcctgaagccagctcaaggtttgggagctccctcatcaccgtgaggtccaaggcaaagaaccaagtcgtcattgctgctggaaggagttctttgggagcccgactctccggggcacttcacgtctatagccttggctcagattgaagatttcactgcatttccccactctgcccacctctctcatgctgaatcacatccatggtgagcattttgatggacaaagtggcacatccagtggagcggtggtagatcctgatagacatggggctcctgggagtagagagacacactaacagccacaccctctggaaatctgatacagtaaatatatgactgcaccagaaatatgtgaaatagcagacattctgcttactcatgtctccttccacagtttacttcctcgctccctttgcatctaaacctttcttctttcccaacttattgcctgtagtcagacctgctgtacaacctatttcctcttcctcttgaatgtctttccaatggctggaaaggtccctctgtggttatctgttagaacagtctctgtacacaattcctcctaaaaacatccttttttaaaaaaagaattgttcagccataaagaaagaacaagatcatgccctttgcagggacatggatggagctggaggccattatccttcataaactattgcaggaacagaaaaccaaacactccatattctcacttgtaagtgggagctaaatgagaacacgtggacacatagagggaaacaacacacactggggcctatgagagggcggaaggtgggaggagggagagatcaggaaaaataactaatggatacttagggtgatgaaataatctgtgtaacaaacccccatgacacacctttatgtatgtaacaaaccagcacttcctgcgcatgtacccctgaacttaaaagttaaaaaaaagttgaacttaaaaataacagattggcccatgccaatcaaagtataatagaaagcatagtatacaga

SEQ ID NO: 371778 - DNA, 1031 bp, Homo sapiens
ctttttttatttttggcataagctgatttattatttatgagaactttagtataagaagcatcctgcaatcacaaaagtggaactagttgatattttgaaatcatacttgatttaaccaccttcagaaattctataaaacactagcaacttccttttatcagacttatgaggtagttacattatttttccttttattgacatgattcatcaaaaaattattttatccaagctcataaactaagtcaataaaactgcaaggaaaaatgacaaaaattctatcttatgcctgatcttagtcaaatcaaatgttgccctctgggattccaattcttcatgtcacagttaagtagtacttattatgtattttacagtgatacgacccaaaatagcagcagtgtgctctgaggtgtgccaaaagtgtgccctgtgaaatataagtattatcaaatacaatcttaaaaatcctaagagattcgtaatgctagagggtgctgtatgttcacattccgacaagaacaccatgacgcgtgttcctgacccacagtgtggtggcacaggggccactgcgtgctcgagtctagcccagcctgtcctgttccattctgttctgcagcttccctctaatggcttcccatgaccacacacaggagtggggaaaccttacttgtacttcatcggttttcttccaaatcagcgacgggagtaacatttttattcctatcaccaaaccacctgaaaaatggactcctaaacttcctcatatgacatcacattaggctaatcatgtaccctcaatatcatcagggtaagtgtatttattctgttattattacatttgtagtgcaagagctggacactctagaatcttccatgcacactactttgggaggcttaacaaatgttctagtgcctaactgtacttaacctccagaaaatattttaaaaggtaggtaggatgttaaagaggatggcagctttcaggcttacaaatattagccatttgttttaaacccaaatctctgtggaaatga

SEQ ID NO: 371779 - DNA, 441 bp, Homo sapiens
gagccagcggccgcccacgaagctgtcggtgcgcagcagcgccgcagagaggcccgccaggcgcccagcgtagcagcggagctgggccgggccgggcgcaggcccggaggcagggaccaggccgccggcgcgggggcggaggcggcagcctggaaacgtcgacccgaggcgccgggccccacagctccgcagccaaatgcaggtcgccatggcccgggcaacgacggcgacaggaaacaggcaagcgggcgcgcgcgcacgggaacgcaggggtcgcggggaagcaagaggagcgaggaggcgccggggacgcgcggggaaagcgtgggagctggcggaaggttgcagagccacagagcagcgccctctctccgcgtctttctcgctgcaccgccgcgccgccctctgcaccttgccctaagcgccgcgcggcttctctcc

SEQ ID NO: 371780 - DNA, 2954 bp, Homo sapiens
gagccagcggccgcccacgaagctgtcggtgcgcagcagcgccgcagagaggcccgccaggcgcccagcgtagcagcggagctgggccgggccgggcgcaggcccggaggcagggaccaggccgccggcgcgggggcggaggcggcagcctggaaacgtcgacccgaggcgccgggccccacagctccgcagccaaatgcaggtcgccatggcccgggcaacgacggcgacaggaaacaggttgtggcctggcctgctgatcatgttgggttctctctgccatagaggttcaccgtgtggcctttcaacacacgtagaaataggacacagagctctggagtttcttcagcttcacaatgggcgtgttaactacagagagctgttactagaacaccaggatgcgtatcaggctggaatcgtgtttcctgattgtttttaccctagcatctgcaaaggaggaaaattccatgatgtgtctgagagcactcactggactccgtttcttaatgcaagcgttcattatatccgagagaactatccccttccctgggagaaggacacagagaaactggtagctttcttgtttggaattacttctcacatggcggcagatgtcagctggcatagtctgggccttgaacaaggattccttaggaccatgggagctattgattttcacggctcctattcagaggctcattcggctggtgattttggaggagatgtgttgagccagtttgaatttaattttaattaccttgcacgacgctggtatgtgccagtcaaagatctactgggaatttatgagaaactgtatggtcgaaaagtcatcaccgaaaatgtaatcgttgattgttcacatatccagttcttagaaatgtatggtgagatgctagctgtttccaagttatatcccacttactctacaaagtccccgtttttggtggaacaattccaagagtattttcttggaggactggatgatatggcattttggtccactaatatttaccatctaacaagcttcatgttggagaatgggaccagtgactgcaacctgcctgagaaccctctgttcattgcatgtggcggccagcaaaaccacacccagggctcaaaaatgcagaaaaatgattttcacagaaatttgactacatccctaactgaaagtgttgacaggaatataaactatactgaaagaggagtgttctttagtgtaaattcctggaccccggattccatgtcctttatctacaaggctttggaaaggaacataaggacaatgttcataggtggctctcagttgtcacaaaagcacgtctccagccccttagcatcttacttcttgtcatttccttatgcgaggcttggctgggcaatgacctcagctgacctcaaccaggatgggcacggtgacctcgtggtgggcgcaccaggctacagccgccccggccacatccacatcgggcgcgtgtacctcatctacggcaatgacctgggcctgccacctgttgacctggacctggacaaggaggcccacaggatccttgaaggcttccagccctcaggtcggtttggctcggccttggctgtgttggactttaacgtggacggcgtgcctgacctggccgtgggagctccctcggtgggctccgagcagctcacctacaaaggtgccgtgtatgtctactttggttccaaacaaggaggaatgtcttcttcccctaacatcaccatttcttgccaggacatctactgtaacttgggctggactctcttggctgcagatgtgaatggagacagtgaacccgatctggtcatcggctccccttttgcaccaggtggagggaagcagaagggaattgtggctgcgttttattctggccccagcctgagcgacaaagaaaaactgaacgtggaggcagccaactggacggtgagaggcgaggaagacttctcctggtttggatattcccttcacggtgtcactgtggacaacagaaccttgctgttggttgggagcccgacctggaagaatgccagcaggctgggccatttgttacacatccgagatgagaaaaagagccttgggagggtgtatggctacttcccaccaaacggccaaagctggtttaccatttctggagacaaggcaatggggaaactgggtacttccctttccagtggccacgtactgatgaatgggactctgaaacaagtgctgctggttggagcccctacgtacgatgacgtgtctaaggtggcattcctgaccgtgaccctacaccaaggcggagccactcgcatgtacgcactcatatctgacgcgcagcctctgctgctcagcaccttcagcggagaccgccgcttctcccgatttggtggcgttctgcacttgagtgacctggatgatgatggcttagatgaaatcatcatggcagcccccctgaggatagcagatgtaacctctggactgattgggggagaagacggccgagtatatgtatataatggcaaagagaccacccttggtgacatgactggcaaatgcaaatcatggataactccatgtccagaagaaaaggcccaatatgtattgatttctcctgaagccagctcaaggtttgggagctccctcatcaccgtgaggtccaaggcaaagaaccaagtcgtcattgctgctggaaggagttctttgggagcccgactctccggggcacttcacgtctatagccttggctcagattgaagatttcactgcatttccccactctgcccacctctctcatgctgaatcacatccatggtgagcattttgatggacaaagtggcacatccagtggagcggtggtagatcctgatagacatggggctcctgggagtagagagacacactaacagccacaccctctggaaatctgatacagtaaatatatgactgcaccagaaatatg

SEQ ID NO: 371781 - DNA, 3120 bp, Homo sapiens
gtgggtctgcacctggattttggagtcccagtgctgctgcagctctgagcattcccacgtcaccagagaagccggtgggcaatgagatcatgtctgctttcaggttgtggcctggcctgctgatcatgttgggttctctctgccatagaggttcaccgtgtggcctttcaacacacgtagaaataggacacagagctctggagtttcttcagcttcacaatgggcgtgttaactacagagagctgttactagaacaccaggatgcgtatcaggctggaatcgtgtttcctgattgtttttaccctagcatctgcaaaggaggaaaattccatgatgtgtctgagagcactcactggactccgtttcttaatgcaagcgttcattatatccgagagaactatccccttccctgggagaaggacacagagaaactggtagctttcttgtttggaattacttctcacatggcggcagatgtcagctggcatagtctgggccttgaacaaggattccttaggaccatgggagctattgattttcacggctcctattcagaggctcattcggctggtgattttggaggagatgtgttgagccagtttgaatttaattttaattaccttgcacgacgctggtatgtgccagtcaaagatctactgggaatttatgagaaactgtatggtcgaaaagtcatcaccgaaaatgtaatcgttgattgttcacatatccagttcttagaaatgtatggtgagatgctagctgtttccaagttatatcccacttactctacaaagtccccgtttttggtggaacaattccaagagtattttcttggaggactggatgatatggcattttggtccactaatatttaccatctaacaagcttcatgttggagaatgggaccagtgactgcaacctgcctgagaaccctctgttcattgcatgtggcggccagcaaaaccacacccagggctcaaaaatgcagaaaaatgattttcacagaaatttgactacatccctaactgaaagtgttgacaggaatataaactatactgaaagaggagtgttctttagtgtaaattcctggaccccggattccatgtcctttatctacaaggctttggaaaggaacataaggacaatgttcataggtggctctcagttgtcacaaaagcacgtctccagccccttagcatcttacttcttgtcatttccttatgcgaggcttggctgggcaatgacctcagctgacctcaaccaggatgggcacggtgacctcgtggtgggcgcaccaggctacagccgccccggccacatccacatcgggcgcgtgtacctcatctacggcaatgacctgggcctgccacctgttgacctggacctggacaaggaggcccacaggatccttgaaggcttccagccctcaggtcggtttggctcggccttggctgtgttggactttaacgtggacggcgtgcctgacctggccgtgggagctccctcggtgggctccgagcagctcacctacaaaggtgccgtgtatgtctactttggttccaaacaaggaggaatgtcttcttcccctaacatcaccatttcttgccaggacatctactgtaacttgggctggactctcttggctgcagatgtgaatggagacagtgaacccgatctggtcatcggctccccttttgcaccaggtggagggaagcagaagggaattgtggctgcgttttattctggccccagcctgagcgacaaagaaaaactgaacgtggaggcagccaactggacggtgagaggcgaggaagacttctcctggtttggatattcccttcacggtgtcactgtggacaacagaaccttgctgttggttgggagcccgacctggaagaatgccagcaggctgggccatttgttacacatccgagatgagaaaaagagccttgggagggtgtatggctacttcccaccaaacggccaaagctggtttaccatttctggagacaaggcaatggggaaactgggtacttccctttccagtggccacgtactgatgaatgggactctgaaacaagtgctgctggttggagcccctacgtacgatgacgtgtctaaggtggcattcctgaccgtgaccctacaccaaggcggagccactcgcatgtacgcactcatatctgacgcgcagcctctgctgctcagcaccttcagcggagaccgccgcttctcccgatttggtggcgttctgcacttgagtgacctggatgatgatggcttagatgaaatcatcatggcagcccccctgaggatagcagatgtaacctctggactgattgggggagaagacggccgagtatatgtatataatggcaaagagaccacccttggtgacatgactggcaaatgcaaatcatggataactccatgtccagaagaaaaggcccaatatgtattgatttctcctgaagccagctcaaggtttgggagctccctcatcaccgtgaggtccaaggcaaagaaccaagtcgtcattgctgctggaaggagttctttgggagcccgactctccggggcacttcacgtctatagccttggctcagattgaagatttcactgcatttccccactctgcccacctctctcatgctgaatcacatccatggtgagcattttgatggacaaagtggcacatccagtggagcggtggtagatcctgatagacatggggctcctgggagtagagagacacactaacagccagagcctttcaagcaagcaagcaagagggaaggagggagagagggagagagagagagagagagagagagagagagagagagagagagagagagagagaaaagaagcacgagacgcagagagacgacgacgagaagagacgacgacaggaaacgagacgagagagaccagactatatgtgagagagcacacacgatgtcgcgagcgcgagagagagcgagagagagacacagaagagagagagagagagcgagagagagagagagacgagagagagagagagagagagagagagagagagcagagagagaccagcgagcatattcgccaaaagagacactcaaggtggcccaccc

SEQ ID NO: 371782 - DNA, 2898 bp, Homo sapiens
gagccagcggccgcccacgaagctgtcggtgcgcagcagcgccgcagagaggcccgccaggcgcccagcgtagcagcggagctgggccgggccgggcgcaggcccggaggcagggaccaggccgccggcgcgggggcggaggcggcagcctggaaacgtcgacccgaggcgccgggccccacagctccgcagccaaatgcaggtcgccatggcccgggcaacgacggcgacaggaaacaggttgtggcctggcctgctgatcatgttgggttctctctgccatagaggttcaccgtgtggcctttcaacacacgtagaaatagctgttactagaacaccaggatgcgtatcaggctggaatcgtgtttcctgattgtttttaccctagcatctgcaaaggaggaaaattccatgatgtgtctgagagcactcactggactccgtttcttaatgcaagcgttcattatatccgagagaactatccccttccctgggagaaggacacagagaaactggtagctttcttgtttggaattacttctcacatggcggcagatgtcagctggcatagtctgggccttgaacaaggattccttaggaccatgggagctattgattttcacggctcctattcagaggctcattcggctggtgattttggaggagatgtgttgagccagtttgaatttaattttaattaccttgcacgacgctggtatgtgccagtcaaagatctactgggaatttatgagaaactgtatggtcgaaaagtcatcaccgaaaatgtaatcgttgattgttcacatatccagttcttagaaatgtatggtgagatgctagctgtttccaagttatatcccacttactctacaaagtccccgtttttggtggaacaattccaagagtattttcttggaggactggatgatatggcattttggtccactaatatttaccatctaacaagcttcatgttggagaatgggaccagtgactgcaacctgcctgagaaccctctgttcattgcatgtggcggccagcaaaaccacacccagggctcaaaaatgcagaaaaatgattttcacagaaatttgactacatccctaactgaaagtgttgacaggaatataaactatactgaaagaggagtgttctttagtgtaaattcctggaccccggattccatgtcctttatctacaaggctttggaaaggaacataaggacaatgttcataggtggctctcagttgtcacaaaagcacgtctccagccccttagcatcttacttcttgtcatttccttatgcgaggcttggctgggcaatgacctcagctgacctcaaccaggatgggcacggtgacctcgtggtgggcgcaccaggctacagccgccccggccacatccacatcgggcgcgtgtacctcatctacggcaatgacctgggcctgccacctgttgacctggacctggacaaggaggcccacaggatccttgaaggcttccagccctcaggtcggtttggctcggccttggctgtgttggactttaacgtggacggcgtgcctgacctggccgtgggagctccctcggtgggctccgagcagctcacctacaaaggtgccgtgtatgtctactttggttccaaacaaggaggaatgtcttcttcccctaacatcaccatttcttgccaggacatctactgtaacttgggctggactctcttggctgcagatgtgaatggagacagtgaacccgatctggtcatcggctccccttttgcaccaggtggagggaagcagaagggaattgtggctgcgttttattctggccccagcctgagcgacaaagaaaaactgaacgtggaggcagccaactggacggtgagaggcgaggaagacttctcctggtttggatattcccttcacggtgtcactgtggacaacagaaccttgctgttggttgggagcccgacctggaagaatgccagcaggctgggccatttgttacacatccgagatgagaaaaagagccttgggagggtgtatggctacttcccaccaaacggccaaagctggtttaccatttctggagacaaggcaatggggaaactgggtacttccctttccagtggccacgtactgatgaatgggactctgaaacaagtgctgctggttggagcccctacgtacgatgacgtgtctaaggtggcattcctgaccgtgaccctacaccaaggcggagccactcgcatgtacgcactcatatctgacgcgcagcctctgctgctcagcaccttcagcggagaccgccgcttctcccgatttggtggcgttctgcacttgagtgacctggatgatgatggcttagatgaaatcatcatggcagcccccctgaggatagcagatgtaacctctggactgattgggggagaagacggccgagtatatgtatataatggcaaagagaccacccttggtgacatgactggcaaatgcaaatcatggataactccatgtccagaagaaaaggcccaatatgtattgatttctcctgaagccagctcaaggtttgggagctccctcatcaccgtgaggtccaaggcaaagaaccaagtcgtcattgctgctggaaggagttctttgggagcccgactctccggggcacttcacgtctatagccttggctcagattgaagatttcactgcatttccccactctgcccacctctctcatgctgaatcacatccatggtgagcattttgatggacaaagtggcacatccagtggagcggtggtagatcctgatagacatggggctcctgggagtagagagacacactaacagccacaccctctggaaatctgatacagtaaatatatgactgcaccagaaatatg

SEQ ID NO: 371783 - DNA, 2076 bp, Homo sapiens
gagccagcggccgcccacgaagctgtcggtgcgcagcagcgccgcagagaggcccgccaggcgcccagcgtagcagcggagctgggccgggccgggcgcaggcccggaggcagggaccaggccgccggcgcgggggcggaggcggcagcctggaaacgtcgacccgaggcgccgggccccacagctccgcagccaaatgcaggtcgccatggcccgggcaacgacggcgacaggaaacaggttgtggcctggcctgctgatcatgttgggttctctctgccatagaggttcaccgtgtggcctttcaacacacgtagaaataggacacagagctctggagtttcttcagcttcacaatgggcgtgttaactacagagagctgttactagaacaccaggatgcgtatcaggctggaatcgtgtttcctgattgtttttaccctagcatctgcaaaggaggaaaattccatgatgtgtctgagagcactcactggactccgtttcttaatgcaagcgttcattatatccgagagaactatccccttccctgggagaaggtaggcgtggtcctccaatccttaaaatatttagcaccaaacctgccatgcactgtgtttgcacccgcattgaccccatttgtaccgctctgtaagggctgcccaccattccaccttcagtgtcatgcacattgcttggacatagtagatggctagctaatacttgaattacttataaacacggtttgggatacatcacttcatcattttgctccaatagtaattaatctgaaagcacttccaacacatcgtaaaacgtttccaaaagtccttatggttttgtgtgtgtgtgtgtggttttgtttctgtttttgtgtttttcagacagagtgtcgctctgcactccagcctgggcgacagagcgagactccttctcaaaaaaaaaaaaaaaaaaaaaaaaaagtagaaatgagggtataagggtataattaaaattgattttaaaaagccacacaaacagtaataacattgtctctctcctcaatttttttcttcaggcccaatatgtattgatttctcctgaagccagctcaaggtttgggagctccctcatcaccgtgaggtccaaggcaaagaaccaagtcgtcattgctgctggaaggagttctttgggagcccgactctccggggcacttcacgtctatagccttggctcagattgaagatttcactgcatttccccactctgcccacctctctcatgctgaatcacatccatggtgagcattttgatggacaaagtggcacatccagtggagcggtggtagatcctgatagacatggggctcctgggagtagagagacacactaacagccacaccctctggaaatctgatacagtaaatatatgactgcaccagaaatatgtgaaatagcagacattctgcttactcatgtctccttccacagtttacttcctcgctccctttgcatctaaacctttcttctttcccaacttattgcctgtagtcagacctgctgtacaacctatttcctcttcctcttgaatgtctttccaatggctggaaaggtccctctgtggttatctgttagaacagtctctgtacacaattcctcctaaaaacatccttttttaaaaaaagaattgttcagccataaagaaagaacaagatcatgccctttgcagggacatggatggagctggaggccattatccttcataaactattgcaggaacagaaaaccaaacactccatattctcacttgtaagtgggagctaaatgagaacacgtggacacatagagggaaacaacacacactggggcctatgagagggcggaaggtgggaggagggagagatcaggaaaaataactaatggatacttagggtgatgaaataatctgtgtaacaaacccccatgacacacctttatgtatgtaacaaaccagcacttcctgcgcatgtacccctgaacttaaaagttaaaaaaaagttgaacttaaaaataacagattggcccatgccaatcaaagtataatagaaagcatagtatacaga

SEQ ID NO: 371784 - DNA, 1693 bp, Homo sapiens
gagccagcggccgcccacgaagctgtcggtgcgcagcagcgccgcagagaggcccgccaggcgcccagcgtagcagcggagctgggccgggccgggcgcaggcccggaggcagggaccaggccgccggcgcgggggcggaggcggcagcctggaaacgtcgacccgaggcgccgggccccacagctccgcagccaaatgcaggtcgccatggcccgggcaacgacggcgacaggaaacaggttgtggcctggcctgctgatcatgttgggttctctctgccatagaggttcaccgtgtggcctttcaacacacgtagaaataggacacagagctctggagtttcttcagcttcacaatgggcgtgttaactacagagagctgttactagaacaccaggatgcgtatcaggctggaatcgtgtttcctgattgtttttaccctagcatctgcaaaggaggaaaattccatgatgtgtctgagagcactcactggactccgtttcttaatgcaagcgttcattatatccgagagaactatccccttccctgggagaaggtaggcgtggtcctccaatccttaaaatatttagcaccaaacctgccatgcactgtgtttgcacccgcattgaccccatttgtaccgctctgtaagggctgcccaccattccaccttcagtgtcatgcacattgcttggacatagtagatggctagctaatacttgaattacttataaacacggtttgggatacatcacttcatcattttgctccaatagtaattaatctgaaagcacttccaacacatcgtaaaacgtttccaaaagtccttatggttttgtgtgtgtgtgtgtggttttgtttctgtttttgtgtttttcagacagagtgtcgctctgcactccagcctgggcgacagagcgagactccttctcaaaaaaaaaaaaaaaaaaaaaaaaaagtagaaatgagggtataagggtataattaaaattgattttaaaaagccacacaaacagtaataacattgtctctctcctcaatttttttcttcaggcccaatatgtattgatttctcctgaagccagctcaaggtttgggagctccctcatcaccgtgaggtccaaggcaaagaaccaagtcgtcattgctgctggaaggagttctttgggagcccgactctccggggcacttcacgtctatagccttggctcagattgaagatttcactgcatttccccactctgcccacctctctcatgctgaatcacatccatgcttccctctaatggcttcccatgaccacacacaggagtggggaaaccttacttgtacttcatcggttttcttccaaatcagcgacgggagtaacatttttattcctatcaccaaaccacctgaaaaatggactcctaaacttcctcatatgacatcacattaggctaatcatgtaccctcaatatcatcagggtaagtgtatttattctgttattattacatttgtagtgcaagagctggacactctagaatcttccatgcacactactttgggaggcttaacaaatgttctagtgcctaactgtacttaacctccagaaaatattttaaaaggtaggtaggatgttaaagaggatggcagctttcaggcttacaaatattagccatttgttttaaacccaaatctctgtggaaatga

SEQ ID NO: 371785 - DNA, 370 bp, Homo sapiens
cagcttctaggggaagtccttactattcaagatatgttttccacattgtaccagaactaagcatgcactgccctacttctcctttatgatttatgtgccagaatagggattggggtgagcatccttagctgcggttttcagaacttatagatgtgagaaagcggtctgtaaacaaagggaaagtggcatttgagttcaagccaggggatctggccagtgtcttattcatctttatatttctagagcatagcatgatgcctggactaccataggaactcaatagatgttatgaatgagccatgaattctgtcttgtgtcccttacagaaccaagtcgtcattgctgctggaaggagttctttgggagcccg

SEQ ID NO: 371786 - DNA, 376 bp, Homo sapiens
cagggacatggatggagctggaggccattatccttcataaactattgcaggaacagaaaaccaaacactccatattctcacttgtaagtgggagctaaatgagaacacgtggacacatagagggaaacaacacacactggggcctatgagagggcggaaggtgggaggagggagagatcaggaaaaataactaatggatacttagggtgatgaaataatctgtgtaacaaacccccatgacacacctttatgtatgtaacaaaccagcacttcctgcgcatgtacccctgaacttaaaagttaaaaaaaagttgaacttaaaaataacagattggcccatgccaatcaaagtataatagaaagcatagtatacaga

SEQ ID NO: 371787 - DNA, 166 bp, Homo sapiens
aaaaggatgagttgtcttctttagaaaaactgaacgtggaggcagccaactggacggtgagaggcgaggaagacttctcctggtttggatattcccttcacggtgtcactgtggacaacagaaccttgctgttggttgggagcccgacctggaagaatgccagcag

SEQ ID NO: 371788 - DNA, 1090 bp, Homo sapiens
gtgggtctgcacctggattttggagtcccagtgctgctgcagctctgagcattcccacgtcaccagagaagccggtgggcaatgagatcatgtctgctttcaggttgtggcctggcctgctgatcatgttgggttctctctgccatagaggttcaccgtgtggcctttcaacacacgtagaaataggacacagagctctggagtttcttcagcttcacaatgggcgtgttaactacagagagctgttactagaacaccaggatgcgtatcaggctggaatcgtgtttcctgattgtttttaccctagcatctgcaaaggaggaaaattccatgatgtgtctgagagcactcactggactccgtttcttaatgcaagcgttcattatatccgagagaactatccccttccctgggagaaggacacagagaaactggtagctttcttgtttggaattacttctcacatggcggcagatgtcagctggcatagtctgggccttgaacaaggattccttaggaccatgggagctattgattttcacggctcctattcagaggctcattcggctggtgattttggtactgtttatttacatttgctaaattttctcgtggtatagttcacttataatgacatcactactgtgctttaaatatgtgtgtctttaatattttgctggttgcatgtattttctatttaatgttgcagttcatttagagtagagatgtacctcatttaacatagagatgtatttctaaaaacttgtgtctatatgtatttttttgttaaaaaattctacactttgttgttgacatgtcataattttagaaaaactttacttatacattgggttaaaattcattagctagtgtctcctactttcctaatactttagctttaaactagtaaactccaccttttgcctgtagtagtaaattgcttttaaatatttaaactaggtggtgaatggtgtttattaaacccttatggtcgatatttccttaaagtaaaacaaaaaacacctttggttatatggccagttctttcttaatttatatgtttcactaactaagatttttaaaagataat

SEQ ID NO: 371789 - DNA, 1034 bp, Homo sapiens
gtgggtctgcacctggattttggagtcccagtgctgctgcagctctgagcattcccacgtcaccagagaagccggtgggcaatgagatcatgtctgctttcaggttgtggcctggcctgctgatcatgttgggttctctctgccatagaggttcaccgtgtggcctttcaacacacgtagaaatagctgttactagaacaccaggatgcgtatcaggctggaatcgtgtttcctgattgtttttaccctagcatctgcaaaggaggaaaattccatgatgtgtctgagagcactcactggactccgtttcttaatgcaagcgttcattatatccgagagaactatccccttccctgggagaaggacacagagaaactggtagctttcttgtttggaattacttctcacatggcggcagatgtcagctggcatagtctgggccttgaacaaggattccttaggaccatgggagctattgattttcacggctcctattcagaggctcattcggctggtgattttggtactgtttatttacatttgctaaattttctcgtggtatagttcacttataatgacatcactactgtgctttaaatatgtgtgtctttaatattttgctggttgcatgtattttctatttaatgttgcagttcatttagagtagagatgtacctcatttaacatagagatgtatttctaaaaacttgtgtctatatgtatttttttgttaaaaaattctacactttgttgttgacatgtcataattttagaaaaactttacttatacattgggttaaaattcattagctagtgtctcctactttcctaatactttagctttaaactagtaaactccaccttttgcctgtagtagtaaattgcttttaaatatttaaactaggtggtgaatggtgtttattaaacccttatggtcgatatttccttaaagtaaaacaaaaaacacctttggttatatggccagttctttcttaatttatatgtttcactaactaagatttttaaaagataat

SEQ ID NO: 371790 - DNA, 2817 bp, Homo sapiens
gtgggtctgcacctggattttggagtcccagtgctgctgcagctctgagcattcccacgtcaccagagaagccggtgggcaatgagatcatgtctgctttcaggttgtggcctggcctgctgatcatgttgggttctctctgccatagaggttcaccgtgtggcctttcaacacacgtagaaataggacacagagctctggagtttcttcagcttcacaatgggcgtgttaactacagagagctgttactagaacaccaggatgcgtatcaggctggaatcgtgtttcctgattgtttttaccctagcatctgcaaaggaggaaaattccatgatgtgtctgagagcactcactggactccgtttcttaatgcaagcgttcattatatccgagagaactatccccttccctgggagaaggacacagagaaactggtagctttcttgtttggaattacttctcacatggcggcagatgtcagctggcatagtctgggccttgaacaaggattccttaggaccatgggagctattgattttcacggctcctattcagaggctcattcggctggtgattttggaggagatgtgttgagccagtttgaatttaattttaattaccttgcacgacgctggtatgtgccagtcaaagatctactgggaatttatgagaaactgtatggtcgaaaagtcatcaccgaaaatgtaatcgttgattgttcacatatccagttcttagaaatgtatggtgagatgctagctgtttccaagttatatcccacttactctacaaagtccccgtttttggtggaacaattccaagagtattttcttggaggactggatgatatggcattttggtccactaatatttaccatctaacaagcttcatgttggagaatgggaccagtgactgcaacctgcctgagaaccctctgttcattgcatgtggcggccagcaaaaccacacccagggctcaaaaatgcagaaaaatgattttcacagaaatttgactacatccctaactgaaagtgttgacaggaatataaactatactgaaagaggagtgttctttagtgtaaattcctggaccccggattccatgtcctttatctacaaggctttggaaaggaacataaggacaatgttcataggtggctctcagttgtcacaaaagcacgtctccagccccttagcatcttacttcttgtcatttccttatgcgaggcttggctgggcaatgacctcagctgacctcaaccaggatgggcacggtgacctcgtggtgggcgcaccaggctacagccgccccggccacatccacatcgggcgcgtgtacctcatctacggcaatgacctgggcctgccacctgttgacctggacctggacaaggaggcccacaggatccttgaaggcttccagccctcaggtcggtttggctcggccttggctgtgttggactttaacgtggacggcgtgcctgacctggccgtgggagctccctcggtgggctccgagcagctcacctacaaaggtgccgtgtatgtctactttggttccaaacaaggaggaatgtcttcttcccctaacatcaccatttcttgccaggacatctactgtaacttgggctggactctcttggctgcagatgtgaatggagacagtgaacccgatctggtcatcggctccccttttgcaccaggtggagggaagcagaagggaattgtggctgcgttttattctggccccagcctgagcgacaaagaaaaactgaacgtggaggcagccaactggacggtgagaggcgaggaagacttctcctggtttggatattcccttcacggtgtcactgtggacaacagaaccttgctgttggttgggagcccgacctggaagaatgccagcaggctgggccatttgttacacatccgagatgagaaaaagagccttgggagggtgtatggctacttcccaccaaacggccaaagctggtttaccatttctggagacaaggcaatggggaaactgggtacttccctttccagtggccacgtactgatgaatgggactctgaaacaagtgctgctggttggagcccctacgtacgatgacgtgtctaaggtggcattcctgaccgtgaccctacaccaaggcggagccactcgcatgtacgcactcatatctgacgcgcagcctctgctgctcagcaccttcagcggagaccgccgcttctcccgatttggtggcgttctgcacttgagtgacctggatgatgatggcttagatgaaatcatcatggcagcccccctgaggatagcagatgtaacctctggactgattgggggagaagacggccgagtatatgtatataatggcaaagagaccacccttggtgacatgactggcaaatgcaaatcatggataactccatgtccagaagaaaaggcccaatatgtattgatttctcctgaagccagctcaaggtttgggagctccctcatcaccgtgaggtccaaggcaaagaaccaagtcgtcattgctgctggaaggagttctttgggagcccgactctccggggcacttcacgtctatagccttggctcagattgaagatttcactgcatttccccactctgcccacctctctcatgctgaatcacatccatggtgagcattttgatggacaaagtggcacatccagtggagcggtggtagatcctgatagacatggggctcctgggagtagagagacacactaacagccacaccctctggaaatctgatacagtaaatatatgactgcaccagaaatatg

SEQ ID NO: 371791 - DNA, 3087 bp, Homo sapiens
gtgggtctgcacctggattttggagtcccagtgctgctgcagctctgagcattcccacgtcaccagagaagccggtgggcaatgagatcatgtctgctttcaggttgtggcctggcctgctgatcatgttgggttctctctgccatagaggttcaccgtgtggcctttcaacacacgtagaaataggacacagagctctggagtttcttcagcttcacaatgggcgtgttaactacagagagctgttactagaacaccaggatgcgtatcaggctggaatcgtgtttcctgattgtttttaccctagcatctgcaaaggaggaaaattccatgatgtgtctgagagcactcactggactccgtttcttaatgcaagcgttcattatatccgagagaactatccccttccctgggagaaggacacagagaaactggtagctttcttgtttggaattacttctcacatggcggcagatgtcagctggcatagtctgggccttgaacaaggattccttaggaccatgggagctattgattttcacggctcctattcagaggctcattcggctggtgattttggaggagatgtgttgagccagtttgaatttaattttaattaccttgcacgacgctggtatgtgccagtcaaagatctactgggaatttatgagaaactgtatggtcgaaaagtcatcaccgaaaatgtaatcgttgattgttcacatatccagttcttagaaatgtatggtgagatgctagctgtttccaagttatatcccacttactctacaaagtccccgtttttggtggaacaattccaagagtattttcttggaggactggatgatatggcattttggtccactaatatttaccatctaacaagcttcatgttggagaatgggaccagtgactgcaacctgcctgagaaccctctgttcattgcatgtggcggccagcaaaaccacacccagggctcaaaaatgcagaaaaatgattttcacagaaatttgactacatccctaactgaaagtgttgacaggaatataaactatactgaaagaggagtgttctttagtgtaaattcctggaccccggattccatgtcctttatctacaaggctttggaaaggaacataaggacaatgttcataggtggctctcagttgtcacaaaagcacgtctccagccccttagcatcttacttcttgtcatttccttatgcgaggcttggctgggcaatgacctcagctgacctcaaccaggatgggcacggtgacctcgtggtgggcgcaccaggctacagccgccccggccacatccacatcgggcgcgtgtacctcatctacggcaatgacctgggcctgccacctgttgacctggacctggacaaggaggcccacaggatccttgaaggcttccagccctcaggtcggtttggctcggccttggctgtgttggactttaacgtggacggcgtgcctgacctggccgtgggagctccctcggtgggctccgagcagctcacctacaaaggtgccgtgtatgtctactttggttccaaacaaggaggaatgtcttcttcccctaacatcaccatttcttgccaggacatctactgtaacttgggctggactctcttggctgcagatgtgaatggagacagtgaacccgatctggtcatcggctccccttttgcaccaggtggagggaagcagaagggaattgtggctgcgttttattctggccccagcctgagcgacaaagaaaaactgaacgtggaggcagccaactggacggtgagaggcgaggaagacttctcctggtttggatattcccttcacggtgtcactgtggacaacagaaccttgctgttggttgggagcccgacctggaagaatgccagcaggctgggccatttgttacacatccgagatgagaaaaagagccttgggagggtgtatggctacttcccaccaaacggccaaagctggtttaccatttctggagacaaggcaatggggaaactgggtacttccctttccagtggccacgtactgatgaatgggactctgaaacaagtgctgctggttggagcccctacgtacgatgacgtgtctaaggtggcattcctgaccgtgaccctacaccaaggcggagccactcgcatgtacgcactcatatctgacgcgcagcctctgctgctcagcaccttcagcggagaccgccgcttctcccgatttggtggcgttctgcacttgagtgacctggatgatgatggcttagatgaaatcatcatggcagcccccctgaggatagcagatgtaacctctggactgattgggggagaagacggccgagtatatgtatataatggcaaagagaccacccttggtgacatgactggcaaatgcaaatcatggataactccatgtccagaagaaaaggcccaatatgtattgatttctcctgaagccagctcaaggtttgggagctccctcatcaccgtgaggtccaaggcaaagaaccaagtcgtcattgctgctggaaggagttctttgggagcccgactctccggggcacttcacgtctatagccttggctcagattgaagatttcactgcatttccccactctgcccacctctctcatgctgaatcacatccatgcttccctctaatggcttcccatgaccacacacaggagtggggaaaccttacttgtacttcatcggttttcttccaaatcagcgacgggagtaacatttttattcctatcaccaaaccacctgaaaaatggactcctaaacttcctcatatgacatcacattaggctaatcatgtaccctcaatatcatcagggtaagtgtatttattctgttattattacatttgtagtgcaagagctggacactctagaatcttccatgcacactactttgggaggcttaacaaatgttctagtgcctaactgtacttaacctccagaaaatattttaaaaggtaggtaggatgttaaagaggatggcagctttcaggcttacaaatattagccatttgttttaaacccaaatctctgtggaaatga

SEQ ID NO: 371792 - DNA, 2702 bp, Homo sapiens
  misc_feature (2638)..(2638): n is a, c, g, or t
  misc_feature (2702)..(2702): n is a, c, g, or t
gagccagcggccgcccacgaagctgtcggtgcgcagcagcgccgcagagaggcccgccaggcgcccagcgtagcagcggagctgggccgggccgggcgcaggcccggaggcagggaccaggccgccggcgcgggggcggaggcggcagcctggaaacgtcgacccgaggcgccgggccccacagctccgcagccaaatgcaggtcgccatggcccgggcaacgacggcgacaggaaacaggttgtggcctggcctgctgatcatgttgggttctctctgccatagaggttcaccgtgtggcctttcaacacacgtagaaataggacacagagctctggagtttcttcagcttcacaatgggcgtgttaactacagagagctgttactagaacaccaggatgcgtatcaggctggaatcgtgtttcctgattgtttttaccctagcatctgcaaaggaggaaaattccatgatgtgtctgagagcactcactggactccgtttcttaatgcaagcgttcattatatccgagagaactatccccttccctgggagaaggacacagagaaactggtagctttcttgtttggaattacttctcacatggcggcagatgtcagctggcatagtctgggccttgaacaaggattccttaggaccatgggagctattgattttcacggctcctattcagaggctcattcggctggtgattttggaggagatgtgttgagccagtttgaatttaattttaattaccttgcacgacgctggtatgtgccagtcaaagatctactgggaatttatgagaaactgtatggtcgaaaagtcatcaccgaaaatgtaatcgttgattgttcacatatccagttcttagaaatgtatggtgagatgctagctgtttccaagttatatcccacttactctacaaagtccccgtttttggtggaacaattccaagagtattttcttggaggactggatgatatggcattttggtccactaatatttaccatctaacaagcttcatgttggagaatgggaccagtgactgcaacctgcctgagaaccctctgttcattgcatgtggcggccagcaaaaccacacccagggctcaaaaatgcagaaaaatgattttcacagaaatttgactacatccctaactgaaagtgttgacaggaatataaactatactgaaagaggagtgttctttagtgtaaattcctggaccccggattccatgtcctttatctacaaggctttggaaaggaacataaggacaatgttcataggtggctctcagttgtcacaaaagcacgtctccagccccttagcatcttacttcttgtcatttccttatgcgaggcttggctgggcaatgacctcagctgacctcaaccaggatgggcacggtgacctcgtggtgggcgcaccaggctacagccgccccggccacatccacatcgggcgcgtgtacctcatctacggcaatgacctgggcctgccacctgttgacctggacctggacaaggaggcccacaggatccttgaaggcttccagccctcaggtcggtttggctcggccttggctgtgttggactttaacgtggacggcgtgcctgacctggccgtgggagctccctcggtgggctccgagcagctcacctacaaaggtgccgtgtatgtctactttggttccaaacaaggaggaatgtcttcttcccctaacatcaccatttcttgccaggacatctactgtaacttgggctggactctcttggctgcagatgtgaatggagacagtgaacccgatctggtcatcggctccccttttgcaccaggtggagggaagcagaagggaattgtggctgcgttttattctggccccagcctgagcgacaaagaaaaactgaacgtggaggcagccaactggacggtgagaggcgaggaagacttctcctggtttggatattcccttcacggtgtcactgtggacaacagaaccttgctgttggttgggagcccgacctggaagaatgccagcaggctgggccatttgttacacatccgagatgagaaaaagagccttgggagggtgtatggctacttcccaccaaacggccaaagctggtttaccatttctggagacaaggcaatggggaaactgggtacttccctttccagtggccacgtactgatgaatgggactctgaaacaagtgctgctggttggagcccctacgtacgatgacgtgtctaaggtggcattcctgaccgtgaccctacaccaaggcggagccactcgcatgtacgcactcatatctgacgcgcagcctctgctgctcagcaccttcagcggagaccgccgcttctcccgatttggtggcgttctgcacttgagtgacctggatgatgatggcttagatgaaatcatcatggcagcccccctgaggatagcagatgtaacctctggactgattgggggagaagacggccgagtatatgtatataatggcaaagagaccacccttggtgacatgactggcaaatgcaaatcatggataactccatgtccagaagaaaagcaccgggaggtccaagcaaagaaccaagtcgtcatgctgctggaggagtccttnggaagccgacttttcgggcacttacgttatagccttgctttgagttactacatttccccttgcn

SEQ ID NO: 371793 - DNA, 1227 bp, Homo sapiens
gagccagcggccgcccacgaagctgtcggtgcgcagcagcgccgcagagaggcccgccaggcgcccagcgtagcagcggagctgggccgggccgggcgcaggcccggaggcagggaccaggccgccggcgcgggggcggaggcggcagcctggaaacgtcgacccgaggcgccgggccccacagctccgcagccaaatgcaggtcgccatggcccgggcaacgacggcgacaggaaacaggttgtggcctggcctgctgatcatgttgggttctctctgccatagaggttcaccgtgtggcctttcaacacacgtagaaataggacacagagctctggagtttcttcagcttcacaatgggcgtgttaactacagagagctgttactagaacaccaggatgcgtatcaggctggaatcgtgtttcctgattgtttttaccctagcatctgcaaaggaggaaaattccatgatgtgtctgagagcactcactggactccgtttcttaatgcaagcgttcattatatccgagagaactatccccttccctgggagaaggacacagagaaactggtagctttcttgtttggaattacttctcacatggcggcagatgtcagctggcatagtctgggccttgaacaaggattccttaggaccatgggagctattgattttcacggctcctattcagaggctcattcggctggtgattttggtactgtttatttacatttgctaaattttctcgtggtatagttcacttataatgacatcactactgtgctttaaatatgtgtgtctttaatattttgctggttgcatgtattttctatttaatgttgcagttcatttagagtagagatgtacctcatttaacatagagatgtatttctaaaaacttgtgtctatatgtatttttttgttaaaaaattctacactttgttgttgacatgtcataattttagaaaaactttacttatacattgggttaaaattcattagctagtgtctcctactttcctaatactttagctttaaactagtaaactccaccttttgcctgtagtagtaaattgcttttaaatatttaaactaggtggtgaatggtgtttattaaacccttatggtcgatatttccttaaagtaaaacaaaaaacacctttggttatatggccagttctttcttaatttatatgtttcactaactaagatttttaaaagataat

SEQ ID NO: 371794 - DNA, 308 bp, Homo sapiens
agacgccaaatcagcgaagctggtcagcagcgacacaccataggaggtatgttccacaggttccctgagcacgaaattctagccagacttcccaccctattgggatatcccccgtaagaccttctacatttgggtccggcagtgctccagtcatttactagggccaaggaaaacctggactgcagactccatgtgatgtcagaaagaaggcaagaccaagagggcgaaaaaaaagtagatgctgtcatgctttctgtacagcctgcagaaccatgagctaagtaaacctcttttctttataaattact

SEQ ID NO: 371795 - DNA, 99 bp, Homo sapiens
cgtgcagctggtgagccttcaccatgggcccaggagaagcggatcatatgaacaaggcctggggatgggacagttgagctggggctgcaggggctaagg

SEQ ID NO: 371796 - DNA, 443 bp, Homo sapiens
cgattctcctgcctcagccttccgagtagctgggattacaggcatgtgccaccacgcccggctaattttgtacttttagtagagatggggtttctccatgttggtcaggctggtcttcaactcccgacctcaggtgatccgcccgtcttggcctcccaaagtggtgggattacaggcatgagccaccgcgcctggcctgaaaatttttagtacttttaatatacccttgtgcacaggctagttatgtggaattatttttgacagttttaaatagttggattttgtgtgtaggggtgcaggatcttgctctgttgctggggctggagtgcagtggcgcgatcatagctcactgcagcctcaaactcctgggctcaagagatgcttccatctcagcctctggtgtagcaagcactacaggagcaggccaccacgcccggataatt

SEQ ID NO: 371797 - DNA, 900 bp, Homo sapiens
ttatttattccactttaacggtgattgtgtgcgaggtcctcgtttgtcctttggctttgctccatgtaccctatctcggtgtttttgttaactgtcatttatattcccaaaggattgtctctacattagcaccattttctgacattgacaatggctacggtctatacattgtacccaagtctttgtatcactactatccgggccttttccccctgtctagtagaaatagacttcctgcatcatctaagggtgcgggcccgtctcggcgattatagaacctaggagttgaacagctgaaatcagatgatagcaatggtatagaaaataatgtccccaggcatagaaaaaatgagtctctgggccagtgaatacaaaacatcatgtcgagaatcattggaagatatacagagttcgtatttcagctttgtttatccttcctgttaagagcctctgagtttttagttttaaaaggatgaaaagcttatgcaacatgctcagcaggagcttcatcaacgatatatgtcagatctaaagggtctcactgtgccacccagctggagtatagtggtgcaaacacagcttgctgcaacctcaatctcctggactcgagtgatcctcctgcctcagcttcctgagtaactgggactacaggcgtgtaccaccatgcttggctaattgttaaatgttttgtagagatagggtctcactatgttgcccagactggtctcgaactcctgggctcaagtgatcctctcacctcagatttccaaagtgttggattataggtgtaagccactgagcccagtttgaatgcttttttatatattttttggccatttgtatgtcatctttggagaaatgtctattcaaatcctttgctcattaaaattattttctgat

SEQ ID NO: 371798 - DNA, 4274 bp, Homo sapiens
gagggccgggcgcggtaagagcgtctcgggggagtggggcaaggcggccgggcccctcccattccgccttttcttcagcgtcctacccgcggcactggctgcgagcgccgggccacctgcgagtgtgcgcagggactctggacacccgcggcggcgagctgagggagcagtctccacgaggacccaggcggaccctctggcgccatgcgcgccctccccggcctgctggaggccagggcgcgtacgccccggctgctcctcctccagtgccttctcgctgccgcgcgcccaagctcggcggacggcagtgccccagattcgccttttacaagtccacctctcagagaagaaataatggcaaataacttttccttggagagtcataacatatcactgactgaacattctagtatgccagtagaaaaaaatatcactttagaaaggccttctaatgtaaatctcacatgccagttcacaacatctggggatttgaatgcagtaaatgtgacttggaaaaaagatggtgaacaacttgagaataattatcttgtcagtgcaacaggaagcaccttgtatacccaatacaggttcaccatcattaatagcaaacaaatgggaagttattcttgtttctttcgagaggaaaaggaacaaaggggaacatttaatttcaaagtccctgaacttcatgggaaaaacaagccattgatctcttacgtaggggattctactgtcttgacatgtaaatgtcaaaattgttttcctttaaattggacctggtacagtagtaatgggagtgtaaaggttcctgttggtgttcaaatgaataaatatgtgatcaatggaacatatgctaacgaaacaaagctgaagataacacaacttttggaggaagatggggaatcttactggtgccgtgcactattccaattaggcgagagtgaagaacacattgagcttgtggtgctgagctatttggtgcccctcaaaccatttcttgtaatagtggctgaggtgattcttttagtggccaccattctgctttgtgaaaagtacacacaaaagaaaaagaagcactcagatgaggggaaagaatttgagcagattgaacagctgaaatcagatgatagcaatggtatagaaaataatgtccccaggcatagaaaaaatgagtctctgggccagtgaatacaaaacatcatgtcgagaatcattggaagatatacagagttcgtatttcagctttgtttatccttcctgttaagagcctctgagtttttagttttaaaaggatgaaaagcttatgcaacatgctcagcaggagcttcatcaacgatatatgtcagatctaaaggtatattttcattctgtaattatgttacataaaagcaatgtaaatcagaataaatatgttagaccagaataaaattaattatattctggtcttcaaaggacacacagaacagatatcagcagaatcacttaatacttcatagaacaaaaatcactcaaaacctgtttataaccaaagaattcatgaaaaagaaagcctttgccatttgtcttagaaagttattttttaaaaaaaaatcatacttactattagtatctatggaagtatatgtaacaatttttatgtaaaggtcatctttctgtgatagtgaaaaaatatgtctttactaagttgaaatgaatactttctgcctttgctaatgatagttattctacaatctccacaagaaaaatataccttttatccggaaatattggtttaaggcaaataaataaaactgtgcttgctctaaagctctgcactacaaaagcaaattttccagtctttattccactcataaccactgctttccccaccaggctaaagtgcttcttagtcttaaatagggtttttaacttcataaggtacaccattgtttatgttttagggtgcaggtccatatagtcgtaatacttaaaacactgctacactgatgcttttgtggctcatggtttcctggttctttgatttaacacctggcttcctggtatctatggctggttaaatatctaaacctgcattattagtgctttacaataataattcccttgactgaagtccagaaatactaaagcacttcttttttattgctgtgaatgccttagacttatcttccaaaataggatacttcgtttctattgcatatataactgaaatattttataaactcactgtaatcaaatcttataaaatctgaatcaacatgaaaagttgtcaatgcttgaatgaatactaaaatcataccacaagatactagataacataaatgaccatgaagtgtcccactgctcaaagggcaacaactttaagaacagaagcaaagagtggtggtgtggaacccaagattcttggcgactagggaatttaaaggttggggaggaggaattcaatgatttgacaagaaatactttataaaaatttgctccatgtattggctaagaaaaatataataaaattttggtagtgaaaattgtatcactaatgtttaccaatattactagtatgaataatacacataaggtagtgacttggaagctgctcaatactttgttgctataacaaaatgcaatattttgttgtaaagcatcttaactacacatataagtttgctgaacttgaatacatcccggtaatggcaaacttcattttattcttggttttcattttattctggtctcagggccatacatttattttagtttaattaattattattttgacaacattacttgggtaatatctatataatggtagataaccaatcagttagcttaattaatctaagctatttgaattcagggaaatattagtcaaatctgctgtttgactaaatacaattcaaagcagtgtatttgtgacttggaatatagaacacaaacaaatgtgtaacccatctgcagtatgcattcttccattttaccaccactaaccattgaggctcatacaattttcaagcaacaagcattgcttcccaaaggtaaaataatcaggaatatttctatagtaaatggagtttttaattggcaatactgtttatttttttctagcaaagacaatttatctcagtaaccttaaataggaaaagtactcaaaaattaaagttgacttttggctttttgtagtctctctggaggacttccagaaaattaccactgttggattttaatctgcttccattaaccaatcttacagagatgataaatgaattaactaatattgaccaaatataaattgactgcaaataataagccgcataaaagttgaagtaggaaaactactccaagtttatatattaggcaccttggggaattctcttagtctttccagctaacaaggattttcagcataataagtagatttaatgatggcataaaattcccagatactttcatatacattttttgccaaagtgtaaatcttctccttttgcagtctttttgttattatcccaacatctagctgctcaggccctaatttagaactcattctgatattttcttcttctgtattaattaatacttatgggtcatgaatccctgctcctttgacctttttaatagctcatgaatccatcccattgcctccccaactctgcccacacctgctgcaacactaatgccttgattttcctacctcagtctccttttctattaatccctcttttgcgtggctgcctgagtccactttctcaaacacaaacctcactatgcaactttggaatctctgtaggctcacctttgccatttcttaatattgcattctccaaattgctaatctctatccagtctcttgaactagacttggcacatggagattccgctcagaaagtgctcttcacacttctacctgcttgactaaccccagattatctttcaagactttaatctgatcttgtgtcttagagaagcccccatacctggtagagcatgtaccatcttacatgcttaaataactccacatttatttgtgtttattactctgtgttataaatatacatttgttggtctctctcttggattattttgtttctttgtcctgtaactaccactgaaagggtgcaatacagctttcttgaaatgtgtattgaacggatgaatgtataaataaaaattaaattttgtaaatttctgcttattcttagaaaaagaatctaaattgtgacaaatcagaattgaaaaaagtattctaataaagaaaaacaagcttttataacttcagtatt

SEQ ID NO: 371799 - DNA, 4175 bp, Homo sapiens
gagggccgggcgcggtaagagcgtctcgggggagtggggcaaggcggccgggcccctcccattccgccttttcttcagcgtcctacccgcggcactggctgcgagcgccgggccacctgcgagtgtgcgcagggactctggacacccgcggcggcgagctgagggagcagtctccacgaggacccaggcggaccctctggcgccatgcgcgccctccccggcctgctggaggccagggcgcgtacgccccggctgctcctcctccagtgccttctcgctgccgcgcgcccaagctcggcggacggcagtgccccagattcgccttttacaagtccacctctcagagaagaaataatggcaaataacttttccttggagagtcataacatatcactgactgaacattctagtatgccagtagaaaaaaatatcactttagaaaggccttctaatgtaaatctcacatgccagttcacaacatctggggatttgaatgcagtaaatgtgacttggaaaaaagatggtgaacaacttgagaataattatcttgtcagtgcaacaggaagcaccttgtatacccaatacaggttcaccatcattaatagcaaacaaatgggaagttattcttgtttctttcgagaggaaaaggaacaaaggggaacatttaatttcaaagtccctgaacttcatgggaaaaacaagccattgatctcttacgtaggggattctactgtcttgacatgtaaatgtcaaaattgttttcctttaaattggacctggtacagtagtaatgggagtgtaaaggttcctgttggtgttcaaatgaataaatatgtgatcaatggaacatatgctaacgaaacaaagctgaagataacacaacttttggaggaagatggggaatcttactggtgccgtgcactattccaattaggcgagagtgaagaacacattgagcttgtggtgctgagctatttggtgcccctcaaaccatttcttgtaatagtggctgaggtgattcttttagtggccaccattctgctttgtgaaaagtacacacaaaagaaaaagaagcactcagatgaggggaaagaatttgagcagattgaacagctgaaatcagatgatagcaatggtatagaaaataatgtccccaggcatagaaaaaatgagtctctgggccagtgaatacaaaacatcatgtcgagaatcattggaagatatacagagttcgtatttcagctttgtttatccttcctgttaagagcctctgagtttttagttttaaaaggatgaaaagcttatgcaacatgctcagcaggagcttcatcaacgatatatgtcagatctaaaggtatattttcattctgtaattatgttacataaaagcaatgtaaatcagaataaatatgttagaccagaataaaattaattatattctggtcttcaaaggacacacagaacagatatcagcagaatcacttaatacttcatagaacaaaaatcactcaaaacctgtttataaccaaagaattcatgaaaaagaaagcctttgccatttgtcttagaaagttattttttaaaaaaaaatcatacttactattagtatctatggaagtatatgtaacaatttttatgtaaaggtcatctttctgtgatagtgaaaaaatatgtctttactaagttgaaatgaatactttctgcctttgctaatgatagttattctacaatctccacaagaaaaatataccttttatccggaaatattggtttaaggcaaataaataaaactgtgcttgctctaaagctctgcactacaaaagcaaattttccagtctttattccactcataaccactgctttccccaccaggctaaagtgcttcttagtcttaaatagggtttttaacttcataaggtacaccattgtttatgttttagggtgcaggtccatatagtcgtaatacttaaaacactgctacactgatgcttttgtggctcatggtttcctggttctttgatttaacacctggcttcctggtatctatggctggttaaatatctaaacctgcattattagtgctttacaataataattcccttgactgaagtccagaaatactaaagcacttcttttttattgctgtgaatgccttagacttatcttccaaaataggatacttcgtttctattgcatatataactgaaatattttataaactcactgtaatcaaatcttataaaatctgaatcaacatgaaaagttgtcaatgcttgaatgaatactaaaatcataccacaagatactagataacataaatgaccatgaagtgtcccactgctcaaagggcaacaactttaagaacagaagcaaagagtggtggtgtggaacccaagattcttggcgactagggaatttaaaggttggggaggaggaattcaatgatttgacaagaaatactttataaaaatttgctccatgtattggctaagaaaaatataataaaattttggtagtgaaaattgtatcactaatgtttaccaatattactagtatgaataatacacataaggtagtgacttggaagctgctcaatactttgttgctataacaaaatgcaatattttgttgtaaagcatcttaactacacatataagtttgctgaacttgaatacatcccggtaatggcaaacttcattttattcttggttttcattttattctggtctcagggccatacatttattttagtttaattaattattattttgacaacattacttgggtaatatctatataatggtagataaccaatcagttagcttaattaatctaagctatttgaattcagggaaatattagtcaaatctgctgtttgactaaatacaattcaaagcagtgtatttgtgacttggaatatagaacacaaacaaatgtgtaacccatctgcagtatgcattcttccattttaccaccactaaccattgaggctcatacaattttcaagcaacaagcattgcttcccaaaggtaaaataatcaggaatatttctatagtaaatggagtttttaattggcaatactgtttatttttttctagcaaagacaatttatctcagtaaccttaaataggaaaagtactcaaaaattaaagttgacttttggctttttgtagtctctctggaggacttccagaaaattaccactgttggattttaatctgcttccattaaccaatcttacagagatgataaatgaattaactaatattgaccaaatataaattgactgcaaataataagccgcataaaagttgaagtaggaaaactactccaagtttatatattaggcaccttggggaattctcttagtctttccagctaacaaggattttcagcataataagtagatttaatgatggcataaaattcccagatactttcatatacattttttgccaaagtgtaaatcttctccttttgcagtctttttgttattatcccaacatctagctgctcaggccctaatttagaactcattctgatattttcttcttctgtattaattaatacttatgggtcatgaatccctgctcctttgacctttttaatagctcatgaatccatcccattgcctccccaactctgcccacacctgctgcaacactaatgccttgattttcctacctcagtctccttttctattaatccctcttttgcgtggctgcctgagtccactttctcaaacacaaacctcactatgcaactttggaatctctgtaggctcacctttgccatttcttaatattgcattctccaaattgctaatctctatccagtctcttgaactagacttggcacatggagattccgctcagaaagtgctcttcacacttctacctgcttgactaaccccagattatctttcaagactttaatctgatcttgtgtcttagagaagcccccatacctggtagagcatgtaccatcttacatgcttaaataactccacatttatttgtgtttattactctgtgttataaatatacatttgttggtctctctcttggattattttgtttctttgtcctgtaactaccactgaaagggtgcaatacagctttcttgaaatgtgtattgaacggatgaatgtataaataaaaattaaattttgtaa

SEQ ID NO: 371800 - DNA, 617 bp, Homo sapiens
cgaactctgcattgctgggttagctcccgaacttacgcaggctggttccatccaaacttgtcatgggtggtcagtccactttctcaaacacaaacctcactatgcaactttggaatctctgtaggctcacctttgccatttcttaatattgcattctccaaattgctaatctctatccagtctcttgaactagacttggcacatggagattccgctcagaaagtgctcttcacacttctacctgcttgactaaccccagattatctttcaagactttaatctgatcttgtgtcttagagaagcccccatacctggtagagcatgtaccatcttacatgcttaaataactccacatttatttgtgtttattactctgtgttataaatatacatttgttggtctctctcttggattattttgtttctttgtcctgtaactaccactgaaagggtgcaatacagctttcttgaaatgtgtattgaacggatgaatgtataaataaaaattaaattttgtaaatttctgcttattcttagaaaaagaatctaaattgtgacaaatcagaattgaaaaaagtattctaataaagaaaaacaagcttttataacttcagtatt

SEQ ID NO: 371801 - DNA, 1720 bp, Homo sapiens
gagggccgggcgcggtaagagcgtctcgggggagtggggcaaggcggccgggcccctcccattccgccttttcttcagcgtcctacccgcggcactggctgcgagcgccgggccacctgcgagtgtgcgcagggactctggacacccgcggcggcgagctgagggagcagtctccacgaggacccaggcggaccctctggcgccatgcgcgccctccccggcctgctggaggccagggcgcgtacgccccggctgctcctcctccagtgccttctcgctgccgcgcgcccaagctcggcggacggcagtgccccagattcgccttttacaagtccacctctcagagaagaaataatggcaaataacttttccttggagagtcataacatatcactgactgaacattctagtatgccagtagaaaaaaatatcactttagaaaggccttctaatgtaaatctcacatgccagttcacaacatctggggatttgaatgcagtaaatgtgacttggaaaaaagatggtgaacaacttgagaataattatcttgtcagtgcaacaggaagcaccttgtatacccaatacaggttcaccatcattaatagcaaacaaatgggaagttattcttgtttctttcgagaggaaaaggaacaaaggggaacatttaatttcaaagtccctgaacttcatgggaaaaacaagccattgatctcttacgtaggggattctactgtcttgacatgtaaatgtcaaaattgttttcctttaaattggacctggtacagtagtaatgggagtgtaaaggttcctgttggtgttcaaatgaataaatatgtgatcaatggaacatatgctaacgaaacaaagctgaagataacacaacttttggaggaagatggggaatcttactggtgccgtgcactattccaattaggcgagagtgaagaacacattgagcttgtggtgctgagctatttggtgcccctcaaaccatttcttgtaatagtggctgaggtgattcttttagtggccaccattctgctttgtgaaaagtacacacaaaagaaaaagaagcactcagatgaggggaaagaatttgagcagattgaacagctgaaatcagatgatagcaatggtatagaaaataatgtccccaggcatagaaaaaatgagtctctgggccagtgaatacaaaacatcatgtcgagaatcattggaagatatacagagttcgtatttcagctttgtttatccttcctgttaagagcctctgagtttttagttttaaaaggatgaaaagcttatgcaacatgctcagcaggagcttcatcaacgatatatgtcagatctaaagggtctcactgtgccacccagctggagtatagtggtgcaaacacagcttgctgcaacctcaatctcctggactcgagtgatcctcctgcctcagcttcctgagtaactgggactacaggcgtgtaccaccatgcttggctaattgttaaatgttttgtagagatagggtctcactatgttgcccagactggtctcgaactcctgggctcaagtgatcctctcacctcagatttccaaagtgttggattataggtgtaagccactgagcccagtttgaatgcttttttatatattttttggccatttgtatgtcatctttggagaaatgtctattcaaatcctttgctcattaaaattattttctgat

SEQ ID NO: 371802 - DNA, 4050 bp, Homo sapiens
aattccccaggagtgcagaggttctcagaactgcaatactctgagatgaattttgaaagcaaaagcaacagtggggatcagcatcaacttggattcgccttttacaagtccacctctcagagaagaaataatggcaaataacttttccttggagagtcataacatatcactgactgaacattctagtatgccagtagaaaaaaatatcactttagaaaggccttctaatgtaaatctcacatgccagttcacaacatctggggatttgaatgcagtaaatgtgacttggaaaaaagatggtgaacaacttgagaataattatcttgtcagtgcaacaggaagcaccttgtatacccaatacaggttcaccatcattaatagcaaacaaatgggaagttattcttgtttctttcgagaggaaaaggaacaaaggggaacatttaatttcaaagtccctgaacttcatgggaaaaacaagccattgatctcttacgtaggggattctactgtcttgacatgtaaatgtcaaaattgttttcctttaaattggacctggtacagtagtaatgggagtgtaaaggttcctgttggtgttcaaatgaataaatatgtgatcaatggaacatatgctaacgaaacaaagctgaagataacacaacttttggaggaagatggggaatcttactggtgccgtgcactattccaattaggcgagagtgaagaacacattgagcttgtggtgctgagctatttggtgcccctcaaaccatttcttgtaatagtggctgaggtgattcttttagtggccaccattctgctttgtgaaaagtacacacaaaagaaaaagaagcactcagatgaggggaaagaatttgagcagattgaacagctgaaatcagatgatagcaatggtatagaaaataatgtccccaggcatagaaaaaatgagtctctgggccagtgaatacaaaacatcatgtcgagaatcattggaagatatacagagttcgtatttcagctttgtttatccttcctgttaagagcctctgagtttttagttttaaaaggatgaaaagcttatgcaacatgctcagcaggagcttcatcaacgatatatgtcagatctaaaggtatattttcattctgtaattatgttacataaaagcaatgtaaatcagaataaatatgttagaccagaataaaattaattatattctggtcttcaaaggacacacagaacagatatcagcagaatcacttaatacttcatagaacaaaaatcactcaaaacctgtttataaccaaagaattcatgaaaaagaaagcctttgccatttgtcttagaaagttattttttaaaaaaaaatcatacttactattagtatctatggaagtatatgtaacaatttttatgtaaaggtcatctttctgtgatagtgaaaaaatatgtctttactaagttgaaatgaatactttctgcctttgctaatgatagttattctacaatctccacaagaaaaatataccttttatccggaaatattggtttaaggcaaataaataaaactgtgcttgctctaaagctctgcactacaaaagcaaattttccagtctttattccactcataaccactgctttccccaccaggctaaagtgcttcttagtcttaaatagggtttttaacttcataaggtacaccattgtttatgttttagggtgcaggtccatatagtcgtaatacttaaaacactgctacactgatgcttttgtggctcatggtttcctggttctttgatttaacacctggcttcctggtatctatggctggttaaatatctaaacctgcattattagtgctttacaataataattcccttgactgaagtccagaaatactaaagcacttcttttttattgctgtgaatgccttagacttatcttccaaaataggatacttcgtttctattgcatatataactgaaatattttataaactcactgtaatcaaatcttataaaatctgaatcaacatgaaaagttgtcaatgcttgaatgaatactaaaatcataccacaagatactagataacataaatgaccatgaagtgtcccactgctcaaagggcaacaactttaagaacagaagcaaagagtggtggtgtggaacccaagattcttggcgactagggaatttaaaggttggggaggaggaattcaatgatttgacaagaaatactttataaaaatttgctccatgtattggctaagaaaaatataataaaattttggtagtgaaaattgtatcactaatgtttaccaatattactagtatgaataatacacataaggtagtgacttggaagctgctcaatactttgttgctataacaaaatgcaatattttgttgtaaagcatcttaactacacatataagtttgctgaacttgaatacatcccggtaatggcaaacttcattttattcttggttttcattttattctggtctcagggccatacatttattttagtttaattaattattattttgacaacattacttgggtaatatctatataatggtagataaccaatcagttagcttaattaatctaagctatttgaattcagggaaatattagtcaaatctgctgtttgactaaatacaattcaaagcagtgtatttgtgacttggaatatagaacacaaacaaatgtgtaacccatctgcagtatgcattcttccattttaccaccactaaccattgaggctcatacaattttcaagcaacaagcattgcttcccaaaggtaaaataatcaggaatatttctatagtaaatggagtttttaattggcaatactgtttatttttttctagcaaagacaatttatctcagtaaccttaaataggaaaagtactcaaaaattaaagttgacttttggctttttgtagtctctctggaggacttccagaaaattaccactgttggattttaatctgcttccattaaccaatcttacagagatgataaatgaattaactaatattgaccaaatataaattgactgcaaataataagccgcataaaagttgaagtaggaaaactactccaagtttatatattaggcaccttggggaattctcttagtctttccagctaacaaggattttcagcataataagtagatttaatgatggcataaaattcccagatactttcatatacattttttgccaaagtgtaaatcttctccttttgcagtctttttgttattatcccaacatctagctgctcaggccctaatttagaactcattctgatattttcttcttctgtattaattaatacttatgggtcatgaatccctgctcctttgacctttttaatagctcatgaatccatcccattgcctccccaactctgcccacacctgctgcaacactaatgccttgattttcctacctcagtctccttttctattaatccctcttttgcgtggctgcctgagtccactttctcaaacacaaacctcactatgcaactttggaatctctgtaggctcacctttgccatttcttaatattgcattctccaaattgctaatctctatccagtctcttgaactagacttggcacatggagattccgctcagaaagtgctcttcacacttctacctgcttgactaaccccagattatctttcaagactttaatctgatcttgtgtcttagagaagcccccatacctggtagagcatgtaccatcttacatgcttaaataactccacatttatttgtgtttattactctgtgttataaatatacatttgttggtctctctcttggattattttgtttctttgtcctgtaactaccactgaaagggtgcaatacagctttcttgaaatgtgtattgaacggatgaatgtataaataaaaattaaattttgtaaatttctgcttattcttagaaaaagaatctaaattgtgacaaatcagaattgaaaaaagtattctaataaagaaaaacaagcttttataacttcagtatt

SEQ ID NO: 371803 - DNA, 4112 bp, Homo sapiens
gagggccgggcgcggtaagagcgtctcgggggagtggggcaaggcggccgggcccctcccattccgccttttcttcagcgtcctacccgcggcactggctgcgagcgccgggccacctgcgagtgtgcgcagggactctggacacccgcggcggcgagctgagggagcagtctccacgaggacccaggcggaccctctggcgccatgcgcgccctccccggcctgctggaggccagggcgcgtacgccccggctgctcctcctccagtgccttctcgctgccgcgcgcccaagctcggcggacggcagtgccccagattcgccttttacaagtccacctctcagagaagaaataatggcaaataacttttccttggagagtcataacatatcactgactggaagcaccttgtatacccaatacaggttcaccatcattaatagcaaacaaatgggaagttattcttgtttctttcgagaggaaaaggaacaaaggggaacatttaatttcaaagtccctgaacttcatgggaaaaacaagccattgatctcttacgtaggggattctactgtcttgacatgtaaatgtcaaaattgttttcctttaaattggacctggtacagtagtaatgggagtgtaaaggttcctgttggtgttcaaatgaataaatatgtgatcaatggaacatatgctaacgaaacaaagctgaagataacacaacttttggaggaagatggggaatcttactggtgccgtgcactattccaattaggcgagagtgaagaacacattgagcttgtggtgctgagctatttggtgcccctcaaaccatttcttgtaatagtggctgaggtgattcttttagtggccaccattctgctttgtgaaaagtacacacaaaagaaaaagaagcactcagatgaggggaaagaatttgagcagattgaacagctgaaatcagatgatagcaatggtatagaaaataatgtccccaggcatagaaaaaatgagtctctgggccagtgaatacaaaacatcatgtcgagaatcattggaagatatacagagttcgtatttcagctttgtttatccttcctgttaagagcctctgagtttttagttttaaaaggatgaaaagcttatgcaacatgctcagcaggagcttcatcaacgatatatgtcagatctaaaggtatattttcattctgtaattatgttacataaaagcaatgtaaatcagaataaatatgttagaccagaataaaattaattatattctggtcttcaaaggacacacagaacagatatcagcagaatcacttaatacttcatagaacaaaaatcactcaaaacctgtttataaccaaagaattcatgaaaaagaaagcctttgccatttgtcttagaaagttattttttaaaaaaaaatcatacttactattagtatctatggaagtatatgtaacaatttttatgtaaaggtcatctttctgtgatagtgaaaaaatatgtctttactaagttgaaatgaatactttctgcctttgctaatgatagttattctacaatctccacaagaaaaatataccttttatccggaaatattggtttaaggcaaataaataaaactgtgcttgctctaaagctctgcactacaaaagcaaattttccagtctttattccactcataaccactgctttccccaccaggctaaagtgcttcttagtcttaaatagggtttttaacttcataaggtacaccattgtttatgttttagggtgcaggtccatatagtcgtaatacttaaaacactgctacactgatgcttttgtggctcatggtttcctggttctttgatttaacacctggcttcctggtatctatggctggttaaatatctaaacctgcattattagtgctttacaataataattcccttgactgaagtccagaaatactaaagcacttcttttttattgctgtgaatgccttagacttatcttccaaaataggatacttcgtttctattgcatatataactgaaatattttataaactcactgtaatcaaatcttataaaatctgaatcaacatgaaaagttgtcaatgcttgaatgaatactaaaatcataccacaagatactagataacataaatgaccatgaagtgtcccactgctcaaagggcaacaactttaagaacagaagcaaagagtggtggtgtggaacccaagattcttggcgactagggaatttaaaggttggggaggaggaattcaatgatttgacaagaaatactttataaaaatttgctccatgtattggctaagaaaaatataataaaattttggtagtgaaaattgtatcactaatgtttaccaatattactagtatgaataatacacataaggtagtgacttggaagctgctcaatactttgttgctataacaaaatgcaatattttgttgtaaagcatcttaactacacatataagtttgctgaacttgaatacatcccggtaatggcaaacttcattttattcttggttttcattttattctggtctcagggccatacatttattttagtttaattaattattattttgacaacattacttgggtaatatctatataatggtagataaccaatcagttagcttaattaatctaagctatttgaattcagggaaatattagtcaaatctgctgtttgactaaatacaattcaaagcagtgtatttgtgacttggaatatagaacacaaacaaatgtgtaacccatctgcagtatgcattcttccattttaccaccactaaccattgaggctcatacaattttcaagcaacaagcattgcttcccaaaggtaaaataatcaggaatatttctatagtaaatggagtttttaattggcaatactgtttatttttttctagcaaagacaatttatctcagtaaccttaaataggaaaagtactcaaaaattaaagttgacttttggctttttgtagtctctctggaggacttccagaaaattaccactgttggattttaatctgcttccattaaccaatcttacagagatgataaatgaattaactaatattgaccaaatataaattgactgcaaataataagccgcataaaagttgaagtaggaaaactactccaagtttatatattaggcaccttggggaattctcttagtctttccagctaacaaggattttcagcataataagtagatttaatgatggcataaaattcccagatactttcatatacattttttgccaaagtgtaaatcttctccttttgcagtctttttgttattatcccaacatctagctgctcaggccctaatttagaactcattctgatattttcttcttctgtattaattaatacttatgggtcatgaatccctgctcctttgacctttttaatagctcatgaatccatcccattgcctccccaactctgcccacacctgctgcaacactaatgccttgattttcctacctcagtctccttttctattaatccctcttttgcgtggctgcctgagtccactttctcaaacacaaacctcactatgcaactttggaatctctgtaggctcacctttgccatttcttaatattgcattctccaaattgctaatctctatccagtctcttgaactagacttggcacatggagattccgctcagaaagtgctcttcacacttctacctgcttgactaaccccagattatctttcaagactttaatctgatcttgtgtcttagagaagcccccatacctggtagagcatgtaccatcttacatgcttaaataactccacatttatttgtgtttattactctgtgttataaatatacatttgttggtctctctcttggattattttgtttctttgtcctgtaactaccactgaaagggtgcaatacagctttcttgaaatgtgtattgaacggatgaatgtataaataaaaattaaattttgtaaatttctgcttattcttagaaaaagaatctaaattgtgacaaatcagaattgaaaaaagtattctaataaagaaaaacaagcttttataacttcagtatt

SEQ ID NO: 371804 - DNA, 3040 bp, Homo sapiens
ccgtgtggtacccgaaccgctataacctcctgttcatgacttggctacacaccccttgtaggcaacttctctgtaataagccttaaagatgccttttttactatccctctacatacctcctctcaaaatctttttgctctcacttggactgatcctgacacaggctgctcccaacaactcacctgactgtcctcccccaggggtttagggacagccctcactgaagtataaagcgttgagctcaacgcttaatacttcatagaacaaaaatcactcaaaacctgtttataaccaaagaattcatgaaaaagaaagcctttgccatttgtcttagaaagttattttttaaaaaaaaatcatacttactattagtatctatggaagtatatgtaacaatttttatgtaaaggtcatctttctgtgatagtgaaaaaatatgtctttactaagttgaaatgaatactttctgcctttgctaatgatagttattctacaatctccacaagaaaaatataccttttatccggaaatattggtttaaggcaaataaataaaactgtgcttgctctaaagctctgcactacaaaagcaaattttccagtctttattccactcataaccactgctttccccaccaggctaaagtgcttcttagtcttaaatagggtttttaacttcataaggtacaccattgtttatgttttagggtgcaggtccatatagtcgtaatacttaaaacactgctacactgatgcttttgtggctcatggtttcctggttctttgatttaacacctggcttcctggtatctatggctggttaaatatctaaacctgcattattagtgctttacaataataattcccttgactgaagtccagaaatactaaagcacttcttttttattgctgtgaatgccttagacttatcttccaaaataggatacttcgtttctattgcatatataactgaaatattttataaactcactgtaatcaaatcttataaaatctgaatcaacatgaaaagttgtcaatgcttgaatgaatactaaaatcataccacaagatactagataacataaatgaccatgaagtgtcccactgctcaaagggcaacaactttaagaacagaagcaaagagtggtggtgtggaacccaagattcttggcgactagggaatttaaaggttggggaggaggaattcaatgatttgacaagaaatactttataaaaatttgctccatgtattggctaagaaaaatataataaaattttggtagtgaaaattgtatcactaatgtttaccaatattactagtatgaataatacacataaggtagtgacttggaagctgctcaatactttgttgctataacaaaatgcaatattttgttgtaaagcatcttaactacacatataagtttgctgaacttgaatacatcccggtaatggcaaacttcattttattcttggttttcattttattctggtctcagggccatacatttattttagtttaattaattattattttgacaacattacttgggtaatatctatataatggtagataaccaatcagttagcttaattaatctaagctatttgaattcagggaaatattagtcaaatctgctgtttgactaaatacaattcaaagcagtgtatttgtgacttggaatatagaacacaaacaaatgtgtaacccatctgcagtatgcattcttccattttaccaccactaaccattgaggctcatacaattttcaagcaacaagcattgcttcccaaaggtaaaataatcaggaatatttctatagtaaatggagtttttaattggcaatactgtttatttttttctagcaaagacaatttatctcagtaaccttaaataggaaaagtactcaaaaattaaagttgacttttggctttttgtagtctctctggaggacttccagaaaattaccactgttggattttaatctgcttccattaaccaatcttacagagatgataaatgaattaactaatattgaccaaatataaattgactgcaaataataagccgcataaaagttgaagtaggaaaactactccaagtttatatattaggcaccttggggaattctcttagtctttccagctaacaaggattttcagcataataagtagatttaatgatggcataaaattcccagatactttcatatacattttttgccaaagtgtaaatcttctccttttgcagtctttttgttattatcccaacatctagctgctcaggccctaatttagaactcattctgatattttcttcttctgtattaattaatacttatgggtcatgaatccctgctcctttgacctttttaatagctcatgaatccatcccattgcctccccaactctgcccacacctgctgcaacactaatgccttgattttcctacctcagtctccttttctattaatccctcttttgcgtggctgcctgagtccactttctcaaacacaaacctcactatgcaactttggaatctctgtaggctcacctttgccatttcttaatattgcattctccaaattgctaatctctatccagtctcttgaactagacttggcacatggagattccgctcagaaagtgctcttcacacttctacctgcttgactaaccccagattatctttcaagactttaatctgatcttgtgtcttagagaagcccccatacctggtagagcatgtaccatcttacatgcttaaataactccacatttatttgtgtttattactctgtgttataaatatacatttgttggtctctctcttggattattttgtttctttgtcctgtaactaccactgaaagggtgcaatacagctttcttgaaatgtgtattgaacggatgaatgtataaataaaaattaaattttgtaaatttctgcttattcttagaaaaagaatctaaattgtgacaaatcagaattgaaaaaagtattctaataaagaaaaacaagcttttataacttcagtatt

SEQ ID NO: 371805 - DNA, 1177 bp, Homo sapiens
atcagcaaatagtttttaggtatgttctagtttctttgttctgatatacagagataaaaatccatctagaatagagatatttttagtgctaagaatttttttcttttcttttctttttttttttttgagatgaagtctcgcccttgccttccaggctggagtgcaatggcacgatcttggttcactgcaacctccgcctcctgggttcaagcaattctcctgcctcagcctccggagtagctgggattacacgcacctgccaccatacccagttaatttttgtatttttagtagagacggggtttcaccatgttggtcaggctggtctcgaactcctgacctcagatgatccacctacctcagcctcccaaaatgctgggattacaggtgtgagccaccgcagctggtgaattgtttagagagaatctgaaatgcattatgtggtatttgagagaatgttattgaatttctatctctttttcagtggaagaagttgttccgaatgtaattgaaccttccttcggcctgggtaggatcatgtatacggtatttgaacatacattccatgtacgagaaggagatgaacagagaacattcttcagtttccctgctgtagttgctccattcaaatgttccgtcctcccactgagccaaaaccaggagttcatgccatttgtcaaggaattatcggaagccctgaccaggcatggagtatctcacaaagtagacgattcctctgggtcaatcggaaggcgctatgccaggactgatgagattggcgtggcttttggtgtcaccattgactttgacacagtgaacaagaccccccacactgcaactctgagggaccgtgactcaatgcggcagataagagcagagatctctgagctgcccagcatagtccaagacctagccaatggcaacatcacatgggctgatgtggaggccaggtatcctctgtttgaagggcaagagactggtaaaaaagagacaatcgaggaatgaggacaattttgacaacttttgaccacttgcgctaataaaaaaaaaaaaaactactcttatgtccactttacaaaagaaaacagcattgtgattactcccagggaccgtattttatcttcagtggctgcctgattttacccccacaattaaagttgaaggaatcctgaaaaaa

SEQ ID NO: 371806 - DNA, 657 bp, Homo sapiens
cttaacatctactctttgagcggatttcagagaattcacaatggcagaaattgagcactttgtagatcccagtgagaaagaccaccccaagttccagaatgtggcagaccttcacctttatttgtattcagcaaaagcccaggtcagcggacagtccgctcggaaaatgcgcctgggagatgctgttgaacagggtgtgattaataacacagtattaggctatttcattggccgcatctacctctacctcacgaaggttggaatatctccagataaactccgcttccggcagcacatggagaatgagatggcccattatgcctgtgactgttgggatgcagaatccaaaacatcctacggttggattgagattgttggatgtgctgatcgttcctgttatgacctctcctgtcatgcacgagccaccaaagtcccacttgtagctgagaaacctctgaaagaacccatatcctttctggtcactccaaaaactcaggattcacatgtgaacatcttgctaatgaataagtccaagtctttaccttgttctatggataaatggagatgttttagacactgtagtaacgcttgtttaaacctattattttacctatccctttgttcctttcctattctctgtacttgtagtctgacgtg

SEQ ID NO: 371807 - DNA, 826 bp, Homo sapiens
atcagcaaatagtttttaggtatgttctagtttctttgttctgatatacagagataaaaatccatctagaatagagatatttttagtgctaagaatttttttcttttcttttctttttttttttttgagatgaagtctcgcccttgccttccaggctggagtgcaatggcacgatcttggttcactgcaacctccgcctcctgggttcaagcaattctcctgcctcagcctccggagtagctgggattacacgcacctgccaccatacccagttaatttttgtatttttagtagagacggggtttcaccatgttggtcaggctggtctcgaactcctgacctcagatgatccacctacctcagcctcccaaaatgctgggattacaggtgtgagccaccgcagctggtgaattgtttagagagaatctgaaatgcattatgtggtatttgagagaatgttattgaatttctatctctttttcagtggaagaagttgttccgaatgtaattgaaccttccttcggcctgggtaggatcatgtatacggtatttgaacatacattccatgtacgagaaggagatgaacagagaacagtaagttgttgtgtacagtgtgctgttatagtgtcagaaaataaaaattttctgaattacattgtgaagtacattaataagactctagaatggtcaattagttattactataatctagtgctattaacactcatctttgcttaagtatgtatagacaaaccagtttcctgtgttatcttatttgagctttaggttattctagaagctattgttttagttgcctggtgctctc

SEQ ID NO: 371808 - DNA, 2895 bp, Homo sapiens
gctccccattgtccttgtcaatactgtgagactcatccaatatcctatccacctctacgtagtctggattaaagggctcttcatcctcatggaagaagtgtctcatctgagccagggggggcggcgatttcatcatgctccgagccgggcggcgcgcgccgcttccgtcgccaccctctctggacagcccagggccgcaggctcatgccctctccgcgtccagtgctgcttagaggtgctcgcgccgctctgctgctgctgctgccgccccggctcttagcccgaccctcgctcctgctccgccggtccctcagcgcggcctcctgcgccccgatctccttgcccgccgccgcctcccggagcagcatggacggcgcgggggctgaggaggtgctggcacctctgaggctagcagtgcgccagcagggagatcttgtgcgaaaactcaaagaagataaagcaccccaagtagacgtagacaaagcagtggctgagctcaaagcccgcaagagggttctggaagcaaaggagctggcgttacagcccaaagatgatattgtagaccgagcaaaaatggaagataccctgaagaggaggtttttctatgatcaagcttttgctatttatggaggtgttagtggtctgtatgactttgggccagttggctgtgctttgaagaacaatattattcagacctggaggcagcactttatccaagaggaacagatcctggagatcgattgcaccatgctcacccctgagccagttttaaagacctctggccatgtagacaaatttgctgacttcatggtgaaagacgtaaaaaatggagaatgttttcgtgctgaccatctattaaaagctcatttacagaaattgatgtctgataagaagtgttctgtcgaaaagaaatcagaaatggaaagtgttttggcccagcttgataactatggacagcaagaacttgcggatctttttgtgaactataatgtaaaatctcccattactggaaatgatctatcccctccagtgtcttttaacttaatgttcaagactttcattgggcctggaggaaacatgcctgggtacttgagaccagaaactgcacaggggattttcttgaatttcaaacgacttttggagttcaaccaaggaaagttgccttttgctgctgcccagattggaaattcttttagaaatgagatctcccctcgatctggactgatcagagtcagagaattcacaatggcagaaattgagcactttgtagatcccagtgagaaagaccaccccaagttccagaatgtggcagaccttcacctttatttgtattcagcaaaagcccaggtcagcggacagtccgctcggaaaatgcgcctgggagatgctgttgaacagggtgtgattaataacacagtattaggctatttcattggccgcatctacctctacctcacgaaggttggaatatctccagataaactccgcttccggcagcacatggagaatgagatggcccattatgcctgtgactgttgggatgcagaatccaaaacatcctacggttggattgagattgttggatgtgctgatcgttcctgttatgacctctcctgtcatgcacgagccaccaaagtcccacttgtagctgagaaacctctgaaagaacccaaaacagtcaatgttgttcagtttgaacccagtaagggagcaattggtaaggcatataagaaggatgcaaaactggtgatggagtatcttgccatttgtgatgagtgctacattacagaaatggagatgctgctgaatgagaaaggggaattcacaattgaaactgaagggaaaacatttcagttaacaaaagacatgatcaatgtgaagagattccagaaaacactatatgtggaagaagttgttccgaatgtaattgaaccttccttcggcctgggtaggatcatgtatacggtatttgaacatacattccatgtacgagaaggagatgaacagagaacattcttcagtttccctgctgtagttgctccattcaaatgttccgtcctcccactgagccaaaaccaggagttcatgccatttgtcaaggaattatcggaagccctgaccaggcatggagtatctcacaaagtagacgattcctctgggtcaatcggaaggcgctatgccaggactgatgagattggcgtggcttttggtgtcaccattgactttgacacagtgaacaagaccccccacactgcaactctgagggaccgtgactcaatgcggcagataagagcagagatctctgagctgcccagcatagtccaagacctagccaatggcaacatcacatgggctgatgtggaggccaggtatcctctgtttgaagggcaagagactggtaaaaaagagacaatcgaggaatgaggacaattttgacaacttttgaccacttgcgctaataaaaaaaaaaaaaactactcttatgtccactttacaaaagaaaacagcattgtgattactcccagggaccgtattttatcttcagtggctgcctgattttacccccacaattaaagttgaaggaatcctgaaaaaaaaaaggaaaaaaaaaaaaaagaaaaggcaacacaaagcacaataaaaaaagcaaaagaaaggggggagcaaataaccaccaagggggcaaattacgcaccatttttatagaggcgcccaatggtattatatagagagcgcgcgacaaacaagtggagaaaccacgtgcataaggaccctctgtgggacatagcaaccacacgtagcggaaaaccacggttggtaacgcctcgtgagttcgttaatacggataaacagccgcgacgaccagcgaacaagaaccaactgcaagagcacgac

SEQ ID NO: 371809 - DNA, 2572 bp, Homo sapiens
  misc_feature (2470)..(2470): n is a, c, g, or t
gctccccattgtccttgtcaatactgtgagactcatccaatatcctatccacctctacgtagtctggattaaagggctcttcatcctcatggaagaagtgtctcatctgagccagggggggcggcgatttcatcatgctccgagccgggcggcgcgcgccgcttccgtcgccaccctctctggacagcccagggccgcaggctcatgccctctccgcgtccagtgctgcttagaggtgctcgcgccgctctgctgctgctgctgccgccccggctcttagcccgaccctcgctcctgctccgccggtccctcagcgcggcctcctgcgccccgatctccttgcccgccgccgcctcccggagcagcatggacggcgcgggggctgaggaggtgctggcacctctgaggctagcagtgcgccagcagggagatcttgtgcgaaaactcaaagaagataaagcaccccaagtagacgtagacaaagcagtggctgagctcaaagcccgcaagagggttctggaagcaaaggagctggcgttacagcccaaagatgatattgtagaccgagcaaaaatggaagataccctgaagaggaggtttttctatgatcaagcttttgctatttatggaggtgttagtggtctgtatgactttgggccagttggctgtgctttgaagaacaatattattcagacctggaggcagcactttatccaagaggaacagatcctggagatcgattgcaccatgctcacccctgagccagttttaaagacctctggccatgtagacaaatttgctgacttcatggtgaaagacgtaaaaaatggagaatgttttcgtgctgaccatctattaaaagctcatttacagaaattgatgtctgataagaagtgttctgtcgaaaagaaatcagaaatggaaagtgttttggcccagcttgataactatggacagcaagaacttgcggatctttttgtgaactataatgtaaaatctcccattactggaaatgatctatcccctccagtgtcttttaacttaatgttcaagactttcattgggcctggaggaaacatgcctgggtacttgagaccagaaactgcacaggggattttcttgaatttcaaacgacttttggagttcaaccaaggaaagttgccttttgctgctgcccagattggaaattcttttagaaatgagatctcccctcgatctggactgatcagagtcagagaattcacaatggcagaaattgagcactttgtagatcccagtgagaaagaccaccccaagttccagaatgtggcagaccttcacctttatttgtattcagcaaaagcccaggtcagcggacagtccgctcggaaaatgcgcctgggagatgctgttgaacagggtgtgattaataacacagtattaggctatttcattggccgcatctacctctacctcacgaaggttggaatatctccagataaactccgcttccggcagcacatggagaatgagatggcccattatgcctgtgactgttgggatgcagaatccaaaacatcctacggttggattgagattgttggatgtgctgatcgttcctgttatgacctctcctgtcatgcacgagccaccaaagtcccacttgtagctgagaaacctctgaaagaacccaaaacagtcaatgttgttcagtttgaacccagtaagggagcaattggtaaggcatataagaaggatgcaaaactggtgatggagtatcttgccatttgtgatgagtgctacattacagaaatggagatgctgctgaatgagaaaggggaattcacaattgaaactgaagggaaaacatttcagttaacaaaagacatgatcaatgtgaagagattccagaaaacactatatgtggaagaagttgttccgaatgtaattgaaccttccttcggcctgggtaggatcatgtatacggtatttgaacatacattccatgtacgagaaggagatgaacagagaacattcttcagtttccctgctgtagttgctccattcaaatgttccgtcctcccactgagccaaaaccaggagttcatgccatttgtcaaggaattatcggaagccctgaccaggcatggagtatctcacaaagtagacgattcctctgggtcaatcggaaggcgctatgccaggactgatgagattggcgtggcttttggtgtcaccattgactttgacacagtgaacaagaccccccacactgcaactctgagggaccgtgactcaatgcggcagataagagcagagatctctgagctgcccagcatagtccaagacctagccaatggcaacatcacatgggctgatgtggaggccaggtatcctctgtttgaagggcaagagactggtaaaaaagagacaatcgaggaatgaggacaattttgacaacttttgaccacttgcgctaataaacacaaancctcccattgtccacttacaaaacacagtttggatatccccgggacgtttatatttcaggggctgttttaccccacataaggtagggatctcgaaaacaacc

SEQ ID NO: 371810 - DNA, 2710 bp, Homo sapiens
  misc_feature (253)..(253): n is a, c, g, or t
gtcactcgtataaaaacctatgctttgaaggttctcgtgtgtctcggcctgcaggtctcgctcagagctgtgtccctgaacatccaccctgctggggtggcttgacgcacttctgtgcaaatctgttcgctcgcaaccctacctacctctctcccgaaccggagaaaaccttcggcggggtccttccgggttttgtgtcgaatctgcggcggcgacccggcgccgcgtcacgcggtggtgaatgtgcggcagnacgcgcgccgcgtcgtttacgcggcgatttcatcatgctccgagccgggcggcgcgcgccgcttccgtcgccaccctctctggacagcccagggccgcaggctcatgccctctccgcgtccagtgctgcttagaggtgctcgcgccgctctgctgctgctgctgccgccccggctcttagcccgaccctcgctcctgctccgccggtccctcagcgcggcctcctgcgccccgatctccttgcccgccgccgcctcccggagcagcatggacggcgcgggggctgaggaggtgctggcacctctgaggctagcagtgcgccagcagggagatcttgtgcgaaaactcaaagaagataaagcaccccaagtagacgtagacaaagcagtggctgagctcaaagcccgcaagagggttctggaagcaaaggagctggcgttacagcccaaagatgatattgtagaccgagcaaaaatggaagataccctgaagaggaggtttttctatgatcaagcttttgctatttatggaggtgttagtggtctgtatgactttgggccagttggctgtgctttgaagaacaatattattcagacctggaggcagcactttatccaagaggaacagatcctggagatcgattgcaccatgctcacccctgagccagttttaaagacctctggccatgtagacaaatttgctgacttcatggtgaaagacgtaaaaaatggagaatgttttcgtgctgaccatctattaaaagctcatttacagaaattgatgtctgataagaagtgttctgtcgaaaagaaatcagaaatggaaagtgttttggcccagcttgataactatggacagcaagaacttgcggatctttttgtgaactataatgtaaaatctcccattactggaaatgatctatcccctccagtgtcttttaacttaatgttcaagactttcattgggcctggaggaaacatgcctgggtacttgagaccagaaactgcacaggggattttcttgaatttcaaacgacttttggagttcaaccaaggaaagttgccttttgctgctgcccagattggaaattcttttagaaatgagatctcccctcgatctggactgatcagagtcagagaattcacaatggcagaaattgagcactttgtagatcccagtgagaaagaccaccccaagttccagaatgtggcagaccttcacctttatttgtattcagcaaaagcccaggtcagcggacagtccgctcggaaaatgcgcctgggagatgctgttgaacagggtgtgattaataacacagtattaggctatttcattggccgcatctacctctacctcacgaaggttggaatatctccagataaactccgcttccggcagcacatggagaatgagatggcccattatggttggattgagattgttggatgtgctgatcgttcctgttatgacctctcctgtcatgcacgagccaccaaagtcccacttgtagctgagaaacctctgaaagaacccaaaacagtcaatgttgttcagtttgaacccagtaagggagcaattggtaaggcatataagaaggatgcaaaactggtgatggagtatcttgccatttgtgatgagtgctacattacagaaatggagatgctgctgaatgagaaaggggaattcacaattgaaactgaagggaaaacatttcagttaacaaaagacatgatcaatgtgaagagattccagaaaacactatatgtggaagaagttgttccgaatgtaattgaaccttccttcggcctgggtaggatcatgtatacggtatttgaacatacattccatgtacgagaaggagatgaacagagaacattcttcagtttccctgctgtagttgctccattcaaatgttccgtcctcccactgagccaaaaccaggagttcatgccatttgtcaaggaattatcggaagccctgaccaggcatggagtatctcacaaagtagacgattcctctgggtcaatcggaaggcgctatgccaggactgatgagattggcgtggcttttggtgtcaccattgactttgacacagtgaacaagaccccccacactgcaactctgagggaccgtgactcaatgcggcagataagagcagagatctctgagctgcccagcatagtccaagacctagccaatggcaacatcacatgggctgatgtggaggccaggtatcctctgtttgaagggcaagagactggtaaaaaagagacaatcgaggaatgaggacaattttgacaacttttgaccacttgcgctaataaaaaaaaaaaaaactactcttatgtccactttacaaaagaaaacagcattgtgattactcccagggaccgtattttatcttcagtggctgcctgattttacccccacaattaaagttgaaggaatcctgaaaaaa

SEQ ID NO: 371811 - DNA, 1963 bp, Homo sapiens
actatgataggtagcgaggctgggtggcttggctgtgctttgaagaacaatattattcagacctggaggcagcactttatccaagaggaacagatcctggagatcgattgcaccatgctcacccctgagccagttttaaagacctctggccatgtagacaaatttgctgacttcatggtgaaagacgtaaaaaatggagaatgttttcgtgctgaccatctattaaaagctcatttacagaaattgatgtctgataagaagtgttctgtcgaaaagaaatcagaaatggaaagtgttttggcccagcttgataactatggacagcaagaacttgcggatctttttgtgaactataatgtaaaatctcccattactggaaatgatctatcccctccagtgtcttttaacttaatgttcaagactttcattgggcctggaggaaacatgcctgggtacttgagaccagaaactgcacaggggattttcttgaatttcaaacgacttttggagttcaaccaaggaaagttgccttttgctgctgcccagattggaaattcttttagaaatgagatctcccctcgatctggactgatcagagtcagagaattcacaatggcagaaattgagcactttgtagatcccagtgagaaagaccaccccaagttccagaatgtggcagaccttcacctttatttgtattcagcaaaagcccaggtcagcggacagtccgctcggaaaatgcgcctgggagatgctgttgaacagggtgtgattaataacacagtattaggctatttcattggccgcatctacctctacctcacgaaggttggaatatctccagataaactccgcttccggcagcacatggagaatgagatggcccattatgcctgtgactgttgggatgcagaatccaaaacatcctacggttggattgagattgttggatgtgctgatcgttcctgttatgacctctcctgtcatgcacgagccaccaaagtcccacttgtagctgagaaacctctgaaagaacccaaaacagtcaatgttgttcagtttgaacccagtaagggagcaattggtaaggcatataagaaggatgcaaaactggtgatggagtatcttgccatttgtgatgagtgctacattacagaaatggagatgctgctgaatgagaaaggggaattcacaattgaaactgaagggaaaacatttcagttaacaaaagacatgatcaatgtgaagagattccagaaaacactatatgtggaagaagttgttccgaatgtaattgaaccttccttcggcctgggtaggatcatgtatacggtatttgaacatacattccatgtacgagaaggagatgaacagagaacattcttcagtttccctgctgtagttgctccattcaaatgttccgtcctcccactgagccaaaaccaggagttcatgccatttgtcaaggaattatcggaagccctgaccaggcatggagtatctcacaaagtagacgattcctctgggtcaatcggaaggcgctatgccaggactgatgagattggcgtggcttttggtgtcaccattgactttgacacagtgaacaagaccccccacactgcaactctgagggaccgtgactcaatgcggcagataagagcagagatctctgagctgcccagcatagtccaagacctagccaatggcaacatcacatgggctgatgtggaggccaggtatcctctgtttgaagggcaagagactggtaaaaaagagacaatcgaggaatgaggacaattttgacaacttttgaccacttgcgctaataaaaaaaaaaaaaactactcttatgtccactttacaaaagaaaacagcattgtgattactcccagggaccgtattttatcttcagtggctgcctgattttacccccacaattaaagttgaaggaatcctgaaaaaa

SEQ ID NO: 371812 - DNA, 3044 bp, Homo sapiens
  misc_feature (253)..(253): n is a, c, g, or t
gtcactcgtataaaaacctatgctttgaaggttctcgtgtgtctcggcctgcaggtctcgctcagagctgtgtccctgaacatccaccctgctggggtggcttgacgcacttctgtgcaaatctgttcgctcgcaaccctacctacctctctcccgaaccggagaaaaccttcggcggggtccttccgggttttgtgtcgaatctgcggcggcgacccggcgccgcgtcacgcggtggtgaatgtgcggcagnacgcgcgccgcgtcgtttacgcggcgatttcatcatgctccgagccgggcggcgcgcgccgcttccgtcgccaccctctctggacagcccagggccgcaggctcatgccctctccgcgtccagtgctgcttagaggtgctcgcgccgctctgctgctgctgctgccgccccggctcttagcccgaccctcgctcctgctccgccggtccctcagcgcggcctcctgcgccccgatctccttgcccgccgccgcctcccggagcagcatggacggcgcgggggctgaggaggtgctggcacctctgaggctagcagtgcgccagcagggagatcttgtgcgaaaactcaaagaagataaagcaccccaagtagacgtagacaaagcagtggctgagctcaaagcccgcaagagggttctggaagcaaaggagctggcgttacagcccaaagatgatattgtagaccgagcaaaaatggaagataccctgaagaggaggtttttctatgatcaagcttttgctatttatggaggtgttagtggtctgtatgactttgggccagttggctgtgctttgaagaacaatattattcagacctggaggcagcactttatccaagaggaacagatcctggagatcgattgcaccatgctcacccctgagccagttttaaagacctctggccatgtagacaaatttgctgacttcatggtgaaagacgtaaaaaatggagaatgttttcgtgctgaccatctattaaaagctcatttacagaaattgatgtctgataagaagtgttctgtcgaaaagaaatcagaaatggaaagtgttttggcccagcttgataactatggacagcaagaacttgcggatctttttgtgaactataatgtaaaatctcccattactggaaatgatctatcccctccagtgtcttttaacttaatgttcaagactttcattgggcctggaggaaacatgcctgggtacttgagaccagaaactgcacaggggattttcttgaatttcaaacgacttttggagttcaaccaaggaaagttgccttttgctgctgcccagattggaaattcttttagaaatgagatctcccctcgatctggactgatcagagtcagagaattcacaatggcagaaattgagcactttgtagatcccagtgagaaagaccaccccaagttccagaatgtggcagaccttcacctttatttgtattcagcaaaagcccaggtcagcggacagtccgctcggaaaatgcgcctgggagatgctgttgaacagggtgtgattaataacacagtattaggctatttcattggccgcatctacctctacctcacgaaggttggaatatctccagataaactccgcttccggcagcacatggagaatgagatggcccattatgcctgtgactgttgggatgcagaatccaaaacatcctacggttggattgagattgttggatgtgctgatcgttcctgttatgacctctcctgtcatgcacgagccaccaaagtcccacttgtagctgagaaacctctgaaagaacccaaaacagtcaatgttgttcagtttgaacccagtaagggagcaattggtaaggcatataagaaggatgcaaaactggtgatggagtatcttgccatttgtgatgagtgctacattacagaaatggagatgctgctgaatgagaaaggggaattcacaattgaaactgaagggaaaacatttcagttaacaaaagacatgatcaatgtgaagagattccagaaaacactatatgtggaagaagttgttccgaatgtaattgaaccttccttcggcctgggtaggatcatgtatacggtatttgaacatacattccatgtacgagaaggagatgaacagagaacattcttcagtttccctgctgtagttgctccattcaaatgttccgtcctcccactgagccaaaaccaggagttcatgccatttgtcaaggaattatcggaagccctgaccaggcatggagtatctcacaaagtagacgattcctctgggtcaatcggaaggcgctatgccaggactgatgagattggcgtggcttttggtgtcaccattgactttgacacagtgaacaagaccccccacactgcaactctgagggaccgtgactcaatgcggcagataagagcagagatctctgagctgcccagcatagtccaagacctagccaatggcaacatcacatgggctgatgtggaggccaggtatcctctgtttgaagggcaagagactggtgatggagtatcttgccatttgtgatgagtgctacgttacagaaagtggagatgctgctgatatgagacaggggaattcacaattgaaactggagggaaaacatttcagttaggcaaaagacatgatcaatgtgaagagattccagaagacactatatgtggaagaagttgttccgaatgtaattgaaccttccttcggcctgggtaggatcatgtatacggtatttgaacatacattccatgtacgagaaggagatgaacagagaacattcttcagatttgccctgctgtagtttgctcccattcaaatgttccgtcctcccaactgaggccaaaaccaggagttcatgccattgtccacggattatcggaagcccctgacaggcatggagtctctcacaaagtagagattctctgggtcaacaggaaggggtatgccggactgttgaattgcgtggtttgggggaccactggttgatggggagagaccca

SEQ ID NO: 371813 - DNA, 2094 bp, Homo sapiens
  misc_feature (253)..(253): n is a, c, g, or t
gtcactcgtataaaaacctatgctttgaaggttctcgtgtgtctcggcctgcaggtctcgctcagagctgtgtccctgaacatccaccctgctggggtggcttgacgcacttctgtgcaaatctgttcgctcgcaaccctacctacctctctcccgaaccggagaaaaccttcggcggggtccttccgggttttgtgtcgaatctgcggcggcgacccggcgccgcgtcacgcggtggtgaatgtgcggcagnacgcgcgccgcgtcgtttacgcggcgatttcatcatgctccgagccgggcggcgcgcgccgcttccgtcgccaccctctctggacagcccagggccgcaggctcatgccctctccgcgtccagtgctgcttagaggtgctcgcgccgctctgctgctgctgctgccgccccggctcttagcccgaccctcgctcctgctccgccggtccctcagcgcggcctcctgcgccccgatctccttgcccgccgccgcctcccggagcagcatggacggcgcgggggctgaggaggtgctggcacctctgaggctagcagtgcgccagcagggagatcttgtgcgaaaactcaaagaagataaagcaccccaagtagacgtagacaaagcagtggctgagctcaaagcccgcaagagggttctggaagcaaaggagctggcgttacagcccaaagatgatattgtagaccgagcaaaaatggaagataccctgaagaggaggtttttctatgatcaagcttttgctatttatggaggtgttagtggtctgtatgactttgggccagttggctgtgctttgaagaacaatattattcagacctggaggcagcactttatccaagaggaacagatcctggagatcgattgcaccatgctcacccctgagccagttttaaagacctctggccatgtagacaaatttgctgacttcatggtgaaagacgtaaaaaatggagaatgttttcgtgctgaccatctattaaaagctcatttacagaaattgatgtctgataagaagtgttctgtcgaaaagaaatcagaaatggaaagtgttttggcccagcttgataactatggacagcaagaacttgcggatctttttgtgaactataatgtaaaatctcccattactggaaatgatctatcccctccagtgtcttttaacttaatgttcaagactttcattgggcctggaggaaacatgcctgggtacttgagaccagaaactgcacaggggattttcttgaatttcaaacgacttttggagttcaaccaaggaaagttgccttttgctgctgcccagattggaaattcttttagaaatgagatctcccctcgatctggactgatcagagtcagagaattcacaatggcagaaattgagcactttgtagatcccagtgagaaagaccaccccaagttccagaatgtggcagaccttcacctttatttgtattcagcaaaagcccaggtcagcggacagtccgctcggaaaatgcgcctgggagatgctgttgaacagggtgtgattaataacacagtattaggctatttcattggccgcatctacctctacctcacgaaggttggaatatctccagataaactccgcttccggcagcacatggagaatgagatggcccattatgcctgtgactgttgggatgcagaatccaaaacatcctacggttggattgagattgttggatgtgctgatcgttcctgttatgacctctcctgtcatgcacgagccaccaaagtcccacttgtagctgagaaacctctgaaagaacccaaaacagtcaatgttgttcagtttgaacccagtaagggagcaattggtaaggcatataagaaggatgcaaaactggtgatggagtatcttgccatttgtgatgagtgctacattacagaaatggagatgctgctgaatgagaaaggggaattcacaattgaaactggagggaaaacatttcagttaacgtgttccgaattgtattgaaactttctttcggccgggtaggaacatgtttaccggatttggacatacatttcatgtacgaaa

SEQ ID NO: 371814 - DNA, 1287 bp, Homo sapiens
attatggtcggggcctttcggtcggaaccgtctttttgcacagaggttccaacactacgaacacgggcgtggaagatgctggcgcacagggtgtgattaataacacagtattaggctatttcattggccgcatctacctctacctcacgaaggttggaatatctccagataaactccgcttccggcagcacatggagaatgagatggcccattatgcctgtgactgttgggatgcagaatccaaaacatcctacggttggattgagattgttggatgtgctgatcgttcctgttatgacctctcctgtcatgcacgagccaccaaagtcccacttgtagctgagaaacctctgaaagaacccaaaacagtcaatgttgttcagtttgaacccagtaagggagcaattggtaaggcatataagaaggatgcaaaactggtgatggagtatcttgccatttgtgatgagtgctacattacagaaatggagatgctgctgaatgagaaaggggaattcacaattgaaactgaagggaaaacatttcagttaacaaaagacatgatcaatgtgaagagattccagaaaacactatatgtggaagaagttgttccgaatgtaattgaaccttccttcggcctgggtaggatcatgtatacggtatttgaacatacattccatgtacgagaaggagatgaacagagaacattcttcagtttccctgctgtagttgctccattcaaatgttccgtcctcccactgagccaaaaccaggagttcatgccatttgtcaaggaattatcggaagccctgaccaggcatggagtatctcacaaagtagacgattcctctgggtcaatcggaaggcgctatgccaggactgatgagattggcgtggcttttggtgtcaccattgactttgacacagtgaacaagaccccccacactgcaactctgagggaccgtgactcaatgcggcagataagagcagagatctctgagctgcccagcatagtccaagacctagccaatggcaacatcacatgggctgatgtggaggccaggtatcctctgtttgaagggcaagagactggtaaaaaagagacaatcgaggaatgaggacaattttgacaacttttgaccacttgcgctaataaaaaaaaaaaaaactactcttatgtccactttacaaaagaaaacagcattgtgattactcccagggaccgtattttatcttcagtggctgcctgattttacccccacaattaaagttgaaggaatcctgaaaaaa

SEQ ID NO: 371815 - DNA, 1392 bp, Homo sapiens
  misc_feature (253)..(253): n is a, c, g, or t
gtcactcgtataaaaacctatgctttgaaggttctcgtgtgtctcggcctgcaggtctcgctcagagctgtgtccctgaacatccaccctgctggggtggcttgacgcacttctgtgcaaatctgttcgctcgcaaccctacctacctctctcccgaaccggagaaaaccttcggcggggtccttccgggttttgtgtcgaatctgcggcggcgacccggcgccgcgtcacgcggtggtgaatgtgcggcagnacgcgcgccgcgtcgtttacgcggcgatttcatcatgctccgagccgggcggcgcgcgccgcttccgtcgccaccctctctggacagcccagggccgcaggctcatgccctctccgcgtccagtgctgcttagaggtgctcgcgccgctctgctgctgctgctgccgccccggctcttagcccgaccctcgctcctgctccgccggtccctcagcgcggcctcctgcgccccgatctccttgcccgccgccgcctcccggagcagcatggacggcgcgggggctgaggaggtgctggcacctctgaggctagcagtgcgccagcagggagatcttgtgcgaaaactcaaagaagataaagcaccccaagtagacgtagacaaagcagtggctgagctcaaagcccgcaagagggttctggaagcaaaggagctggcgttacagcccaaagatgatattgtagaccgagcaaaaatggaagataccctgaagaggaggtttttctatgatcaagcttttgctatttatggaggtgttagtggtctgtatgactttgggccagttggctgtgctttgaagaacaatattattcagacctggaggcagcactttatccaagaggaacagatcctggagatcgattgcaccatgctcacccctgagccagttttaaagacctctggccatgtagacaaatttgctgacttcatggtgaaagacgtaaaaaatggagaatgttttcgtgctgaccatctattaaaagctcatttacagaaattgatgtctgataagaagtgttctgtcgaaaagaaatcagaaatggaaagtgttttggcccagcttgataactatggacagcaagaacttgcggatctttttgtgaactataatgtaaaatctcccattactggaaatgatctatcccctccagtgtcttttaacttaatgttcaagactttcattgggcctggaggaaacatgcctggtcttgagaccgctggcggggattctgaattcaacgcttggggtcacccaggaatgcctgggcgccatgggacttgaaggacccgccgggggtaacacgaatacgcggaatgctgtaccaggacccctatgggagccttataacaaggcccaccg

SEQ ID NO: 371816 - DNA, 736 bp, Homo sapiens
  misc_feature (6)..(6): n is a, c, g, or t
  misc_feature (16)..(16): n is a, c, g, or t
  misc_feature (26)..(26): n is a, c, g, or t
ggagcngcggcccccncccattggcnccgaggtccccgacgtcaccgcgacccccgcgaggctgcttttcttcgcgcccacccgccgcgcggcgccgcttgaggagatggaagccccggccgctgacgccatcatgtcgcccgaagaggagctggacgggtacgagccggagcctctcgggaagcggccggctccgtcctcccactgagccaaaaccaggagttcatgccatttgtcaaggaattatcggaagccctgaccaggcatggagtatctcacaaagtagacgattcctctgggtcaatcggaaggcgctatgccaggactgatgagattggcgtggcttttggtgtcaccattgactttgacacagtgaacaagaccccccacactgcaactctgagggaccgtgactcaatgcggcagataagagcagagatctctgagctgcccagcatagtccaagacctagccaatggcaacatcacatgggctgatgtggaggccaggtatcctctgtttgaagggcaagagactggtaaaaaagagacaatcgaggaatgaggacaattttgacaacttttgaccacttgcgctaataaaaaaaaaaaaaactactcttatgtccactttacaaaagaaaacagcattgtgattactcccagggaccgtattttatcttcagtggctgcctgattttacccccacaattaaagttgaaggaatcctgaaaaaa

SEQ ID NO: 371817 - DNA, 1960 bp, Homo sapiens
ctgggattacaggcatgagccactgtgtccagccttatttttgctttctttgatttctgagttactcagaaactatttcagggcagtttaagaaggctgtactttttagtgtaggtatatggaacatctttttttgttttgtactatttcttttggacatatgtttgtgagctaattaaacttttctgtttcacttggtcactgaggttcataggtttttctcttaaaagacagaatgggctttggtttgggtcactgccacttgtttgaatatttaggtagtctccacagaaagtcttttatgtggaaccaaaaaattaccgtcttttatatacagtagctttcagaatgctttcacatcatttgacttttttagtaacgggcttgtgaagcaagcagagcaggtggtagagacctgctttttaggtggagaaactaaggttcagaaagagttcatgacttggcctaaattcggagctgaaaccaggtgtttctgatgctggttctgcttctcttttgccatactgcttttcatgtcatgttttctggcattttggtaatgacgttatgcttgaacacttgctgaatattaacctcttttggtttgggatattagcatttagatatttacaaattaacatatttggatttttttctttttaaatcatccagttcttcagtttccctgctgtagttgctccattcaaatgttccgtcctcccactgagccaaaaccaggagttcatgccatttgtcaaggaattatgtaagcaaattcaattgggtaaactccatgggaacaccatcaaggagactgaattttaggaaatgtatcatttatttcaataaaaatatagactgaataaagaatataaatgattttataaagagtacatgattttagcctgtactcttatttctaagcgagaggatatgcttgctcagatgttttattctggcatttgagtgaggcaaggtaggacccaagagtcagatttaaaaattatttacttctcatactgaccttggtgccaagttcatcgagggaacctgagtggagtgtagcaaccataatggatctacagccacagaatccacagccctgaaaggaatcctggtggtcatctggcacatccacttatttcagagctgggaaatggggagagtccattgacctgcttagagccataaaaatagaggtggtggagtcaggactcaccttctggccttggctcttggtcccatatttgttccccctatagctgtatcagatggaggtatgagtgaagatttggattcccgcaagggatttattaaactttagggatatttctttctcttgcaactcaacttgtggctttcttgtcttggtcccatttataagtctcctgagcttgtaagacagtagttagataacactgggcttaactccattgttttatttttaatttactttgtttattttggatagcggaagccctgaccaggcatggagtatctcacaaagtagacgattcctctgggtcaatcggaaggcgctatgccaggactgatgagattggcgtggcttttggtgtcaccattgactttgacacagtgaacaagaccccccacactgcaactctgagggaccgtgactcaatgcggcagataagagcagagatctctgagctgcccagcatagtccaagacctagccaatggcaacatcacatgggctgatgtggaggccaggtatcctctgtttgaagggcaagagactggtaaaaaagagacaatcgaggaatgaggacaattttgacaacttttgaccacttgcgctaataaaaaaaaaaaaaactactcttatgtccactttacaaaagaaaacagcattgtgattactcccagggaccgtattttatcttcagtggctgcctgattttacccccacaattaaagttgaaggaatcctgaaaaaa

SEQ ID NO: 371818 - DNA, 644 bp, Homo sapiens
taaaagacactggaggggatagatcatttccagtaatgggagattttacattatagttcacaaaaagatccgcaagttcttgctgtccatagttatcaagcccgtcctcccactgagccaaaaccaggagttcatgccatttgtcaaggaattatcggaagccctgaccaggcatggagtatctcacaaagtagacgattcctctgggtcaatcggaaggcgctatgccaggactgatgagattggcgtggcttttggtgtcaccattgactttgacacagtgaacaagaccccccacactgcaactctgagggaccgtgactcaatgcggcagataagagcagagatctctgagctgcccagcatagtccaagacctagccaatggcaacatcacatgggctgatgtggaggccaggtatcctctgtttgaagggcaagagactggtaaaaaagagacaatcgaggaatgaggacaattttgacaacttttgaccacttgcgctaataaaaaaaaaaaaaactactcttatgtccactttacaaaagaaaacagcattgtgattactcccagggaccgtattttatcttcagtggctgcctgattttacccccacaattaaagttgaaggaatcctgaaaaaa

SEQ ID NO: 371819 - DNA, 698 bp, Homo sapiens
gctccccattgtccttgtcaatactgtgagactcatccaatatcctatccacctctacgtagtctggattaaagggctcttcatcctcatggaagaagtgtctcatctgagccagggggggcggcgatttcatcatgctccgagccgggcggcgcgcgccgcttccgtcgccaccctctctggacagcccagggccgcaggctcatgccctctccgcgtccagtgctgcttagaggtgctcgcgccgctctgctgctgctgctgccgccccggctcttagcccgaccctcgctcctgctccgccggtccctcagcgcggcctcctgcgccccgatctccttgcccgccgccgcctcccggagcagcatggacggcgcgggggctgaggaggtgctggcacctctgaggctagcagtgcgccagcagggagatcttgtgcgaaaactcaaagaagataaagcaccccaagtagacgtagacaaagcagtggctgagctcaaagcccgcaagagggttctggaagcaaaggagctggcgttacagcccaaagatgatattgtagaccgagcaaaaatggaagataccctgaagaggaggtttttctatgatcaagcttttgctatttatggaggtgttacggtgggtctggtattgacctttttgggggggcccaagttttgggccttttgttttggcct

SEQ ID NO: 371820 - DNA, 631 bp, Homo sapiens
cagtagccttggtcagagctctccagtttgccagtcttatgtaattccctcacacgagttacttgactgagtcctgtttgttctaatagttaaatttaatacacatgaagtaacttcaagggacatggagatttagaaaagttaggaaaggctttgtggcagaattgagttgtctgggggaactggtgggcgttttgggctagaagagcatgaacccatgcctggcatgacattgtttggctctgtgtaaggtttcctgagttcaggatgaatcttcttcttaaaaatctgaacaagttggttgatacttggcttctctttccttgtctctagatctctgagctgcccagcatagtccaagacctagccaatggcaacatcacatgggctgatgtggaggccaggtatcctctgtttgaagggcaagagactggtaaaaaagagacaatcgaggaatgaggacaattttgacaacttttgaccacttgcgctaataaaaaaaaaaaaaactactcttatgtccactttacaaaagaaaacagcattgtgattactcccagggaccgtattttatcttcagtggctgcctgattttacccccacaattaaagttgaaggaatcctgaaaaaa

SEQ ID NO: 371821 - DNA, 2749 bp, Homo sapiens
  misc_feature (253)..(253): n is a, c, g, or t
gtcactcgtataaaaacctatgctttgaaggttctcgtgtgtctcggcctgcaggtctcgctcagagctgtgtccctgaacatccaccctgctggggtggcttgacgcacttctgtgcaaatctgttcgctcgcaaccctacctacctctctcccgaaccggagaaaaccttcggcggggtccttccgggttttgtgtcgaatctgcggcggcgacccggcgccgcgtcacgcggtggtgaatgtgcggcagnacgcgcgccgcgtcgtttacgcggcgatttcatcatgctccgagccgggcggcgcgcgccgcttccgtcgccaccctctctggacagcccagggccgcaggctcatgccctctccgcgtccagtgctgcttagaggtgctcgcgccgctctgctgctgctgctgccgccccggctcttagcccgaccctcgctcctgctccgccggtccctcagcgcggcctcctgcgccccgatctccttgcccgccgccgcctcccggagcagcatggacggcgcgggggctgaggaggtgctggcacctctgaggctagcagtgcgccagcagggagatcttgtgcgaaaactcaaagaagataaagcaccccaagtagacgtagacaaagcagtggctgagctcaaagcccgcaagagggttctggaagcaaaggagctggcgttacagcccaaagatgatattgtagaccgagcaaaaatggaagataccctgaagaggaggtttttctatgatcaagcttttgctatttatggaggtgttagtggtctgtatgactttgggccagttggctgtgctttgaagaacaatattattcagacctggaggcagcactttatccaagaggaacagatcctggagatcgattgcaccatgctcacccctgagccagttttaaagacctctggccatgtagacaaatttgctgacttcatggtgaaagacgtaaaaaatggagaatgttttcgtgctgaccatctattaaaagctcatttacagaaattgatgtctgataagaagtgttctgtcgaaaagaaatcagaaatggaaagtgttttggcccagcttgataactatggacagcaagaacttgcggatctttttgtgaactataatgtaaaatctcccattactggaaatgatctatcccctccagtgtcttttaacttaatgttcaagactttcattgggcctggaggaaacatgcctgggtacttgagaccagaaactgcacaggggattttcttgaatttcaaacgacttttggagttcaaccaaggaaagttgccttttgctgctgcccagattggaaattcttttagaaatgagatctcccctcgatctggactgatcagagtcagagaattcacaatggcagaaattgagcactttgtagatcccagtgagaaagaccaccccaagttccagaatgtggcagaccttcacctttatttgtattcagcaaaagcccaggtcagcggacagtccgctcggaaaatgcgcctgggagatgctgttgaacagggtgtgattaataacacagtattaggctatttcattggccgcatctacctctacctcacgaaggttggaatatctccagataaactccgcttccggcagcacatggagaatgagatggcccattatgcctgtgactgttgggatgcagaatccaaaacatcctacggttggattgagattgttggatgtgctgatcgttcctgttatgacctctcctgtcatgcacgagccaccaaagtcccacttgtagctgagaaacctctgaaagaacccaaaacagtcaatgttgttcagtttgaacccagtaagggagcaattggtaaggcatataagaaggatgcaaaactggtgatggagtatcttgccatttgtgatgagtgctacattacagaaatggagatgctgctgaatgagaaaggggaattcacaattgaaactgaagggaaaacatttcagttaacaaaagacatgatcaatgtgaagagattccagaaaacactatatgtggaagaagttgttccgaatgtaattgaaccttccttcggcctgggtaggatcatgtatacggtatttgaacatacattccatgtacgagaaggagatgaacagagaacattcttcagtttccctgctgtagttgctccattcaaatgttccgtcctcccactgagccaaaaccaggagttcatgccatttgtcaaggaattatcggaagccctgaccaggcatggagtatctcacaaagtagacgattcctctgggtcaatcggaaggcgctatgccaggactgatgagattggcgtggcttttggtgtcaccattgactttgacacagtgaacaagaccccccacactgcaactctgagggaccgtgactcaatgcggcagataagagcagagatctctgagctgcccagcatagtccaagacctagccaatggcaacatcacatgggctgatgtggaggccaggtatcctctgtttgaagggcaagagactggtaaaaaagagacaatcgaggaatgaggacaattttgacaacttttgaccacttgcgctaataaaaaaaaaaaaaactactcttatgtccactttacaaaagaaaacagcattgtgattactcccagggaccgtattttatcttcagtggctgcctgattttacccccacaattaaagttgaaggaatcctgaaaaaa

SEQ ID NO: 371822 - DNA, 2596 bp, Homo sapiens
gctccccattgtccttgtcaatactgtgagactcatccaatatcctatccacctctacgtagtctggattaaagggctcttcatcctcatggaagaagtgtctcatctgagccagggggggcggcgatttcatcatgctccgagccgggcggcgcgcgccgcttccgtcgccaccctctctggacagcccagggccgcaggctcatgccctctccgcgtccagtgctgcttagaggtgctcgcgccgctctgctgctgctgctgccgccccggctcttagcccgaccctcgctcctgctccgccggtccctcagcgcggcctcctgcgccccgatctccttgcccgccgccgcctcccggagcagcatggacggcgcgggggctgaggaggtgctggcacctctgaggctagcagtgcgccagcagggagatcttgtgcgaaaactcaaagaagataaagcaccccaagtagacgtagacaaagcagtggctgagctcaaagcccgcaagagggttctggaagcaaaggagctggcgttacagcccaaagatgatattgtagaccgagcaaaaatggaagataccctgaagaggaggtttttctatgatcaagcttttgctatttatggaggtgttagtggtctgtatgactttgggccagttggctgtgctttgaagaacaatattattcagacctggaggcagcactttatccaagaggaacagatcctggagatcgattgcaccatgctcacccctgagccagttttaaagacctctggccatgtagacaaatttgctgacttcatggtgaaagacgtaaaaaatggagaatgttttcgtgctgaccatctattaaaagctcatttacagaaattgatgtctgataagaagtgttctgtcgaaaagaaatcagaaatggaaagtgttttggcccagcttgataactatggacagcaagaacttgcggatctttttgtgaactataatgtaaaatctcccattactggaaatgatctatcccctccagtgtcttttaacttaatgttcaagactttcattgggcctggaggaaacatgcctgggtacttgagaccagaaactgcacaggggattttcttgaatttcaaacgacttttggagttcaaccaaggaaagttgccttttgctgctgcccagattggaaattcttttagaaatgagatctcccctcgatctggactgatcagagtcagagaattcacaatggcagaaattgagcactttgtagatcccagtgagaaagaccaccccaagttccagaatgtggcagaccttcacctttatttgtattcagcaaaagcccaggtcagcggacagtccgctcggaaaatgcgcctgggagatgctgttgaacagggtgtgattaataacacagtattaggctatttcattggccgcatctacctctacctcacgaaggttggaatatctccagataaactccgcttccggcagcacatggagaatgagatggcccattatgcctgtgactgttgggatgcagaatccaaaacatcctacggttggattgagattgttggatgtgctgatcgttcctgttatgacctctcctgtcatgcacgagccaccaaagtcccacttgtagctgagaaacctctgaaagaacccaaaacagtcaatgttgttcagtttgaacccagtaagggagcaattggtaaggcatataagaaggatgcaaaactggtgatggagtatcttgccatttgtgatgagtgctacattacagaaatggagatgctgctgaatgagaaaggggaattcacaattgaaactgaagggaaaacatttcagttaacaaaagacatgatcaatgtgaagagattccagaaaacactatatgtggaagaagttgttccgaatgtaattgaaccttccttcggcctgggtaggatcatgtatacggtatttgaacatacattccatgtacgagaaggagatgaacagagaacattcttcagtttccctgctgtagttgctccattcaaatgttccgtcctcccactgagccaaaaccaggagttcatgccatttgtcaaggaattatcggaagccctgaccaggcatggagtatctcacaaagtagacgattcctctgggtcaatcggaaggcgctatgccaggactgatgagattggcgtggcttttggtgtcaccattgactttgacacagtgaacaagaccccccacactgcaactctgagggaccgtgactcaatgcggcagataagagcagagatctctgagctgcccagcatagtccaagacctagccaatggcaacatcacatgggctgatgtggaggccaggtatcctctgtttgaagggcaagagactggtaaaaaagagacaatcgaggaatgaggacaattttgacaacttttgaccacttgcgctaataaaaaaaaaaaaaactactcttatgtccactttacaaaagaaaacagcattgtgattactcccagggaccgtattttatcttcagtggctgcctgattttacccccacaattaaagttgaaggaatcctgaaaaaa

SEQ ID NO: 371823 - DNA, 2618 bp, Homo sapiens
gctccccattgtccttgtcaatactgtgagactcatccaatatcctatccacctctacgtagtctggattaaagggctcttcatcctcatggaagaagtgtctcatctgagccagggggggcggcgatttcatcatgctccgagccgggcggcgcgcgccgcttccgtcgccaccctctctggacagcccagggccgcaggctcatgccctctccgcgtccagtgctgcttagaggtgctcgcgccgctctgctgctgctgctgccgccccggctcttagcccgaccctcgctcctgctccgccggtccctcagcgcggcctcctgcgccccgatctccttgcccgccgccgcctcccggagcagcatggacggcgcgggggctgaggaggtgctggcacctctgaggctagcagtgcgccagcagggagatcttgtgcgaaaactcaaagaagataaagcaccccaagtagacgtagacaaagcagtggctgagctcaaagcccgcaagagggttctggaagcaaaggagctggcgttacagcccaaagatgatattgtagaccgagcaaaaatggaagataccctgaagaggaggtttttctatgatcaagcttttgctatttatggaggtgttagtggtctgtatgactttgggccagttggctgtgctttgaagaacaatattattcagacctggaggcagcactttatccaagaggaacagatcctggagatcgattgcaccatgctcacccctgagccagttttaaagacctctggccatgtagacaaatttgctgacttcatggtgaaagacgtaaaaaatggagaatgttttcgtgctgaccatctattaaaagctcatttacagaaattgatgtctgataagaagtgttctgtcgaaaagaaatcagaaatggaaagtgttttggcccagcttgataactatggacagcaagaacttgcggatctttttgtgaactataatgtaaaatctcccattactggaaatgatctatcccctccagtgtcttttaacttaatgttcaagactttcattgggcctggaggaaacatgcctgggtacttgagaccagaaactgcacaggggattttcttgaatttcaaacgacttttggagttcaaccaaggaaagttgccttttgctgctgcccagattggaaattcttttagaaatgagatctcccctcgatctggactgatcagagtcagagaattcacaatggcagaaattgagcactttgtagatcccagtgagaaagaccaccccaagttccagaatgtggcagaccttcacctttatttgtattcagcaaaagcccaggtcagcggacagtccgctcggaaaatgcgcctgggagatgctgttgaacagggtgtgattaataacacagtattaggctatttcattggccgcatctacctctacctcacgaaggttggaatatctccagataaactccgcttccggcagcacatggagaatgagatggcccattatgcctgtgactgttgggatgcagaatccaaaacatcctacggttggattgagattgttggatgtgctgatcgttcctgttatgacctctcctgtcatgcacgagccaccaaagtcccacttgtagctgagaaacctctgaaagaacccaaaacagtcaatgttgttcagtttgaacccagtaagggagcaattggtaaggcatataagaaggatgcaaaactggtgatggagtatcttgccatttgtgatgagtgctacattacagaaatggagatgctgctgaatgagaaaggggaattcacaattgaaactgaagggaaaacatttcagttaacaaaagacatgatcaatgtgaagagattccagaaaacactatatgtggaagaagttgttccgaatgtaattgaaccttccttcggcctgggtaggatcatgtatacggtatttgaacatacattccatgtacgagaaggagatgaacagagaacattcttcagtttccctgctgtagttgctccattcaaatgttccgtcctcccactgagccaaaaccaggagttcatgccatttgtcaaggaattatcggaagccctgaccaggcatggagtatctcacaaagtagacgattcctctgggtcaatcggaaggcgctatgccaggactgatgagattggcgtggcttttggtgtcaccattgactttgacacagtgaacaagaccccccacactgcaactctgagggaccgtgactcaatgcggcagataagagcagagatctctgagctgcccagcatagtccaagacctagccaatggcaacatcacatgggctgatgtggaggccaggtatcctctgtttgaagggcaagagactggtaaaaaagagacaatcgaggaatgaggacaattttgacaacttttgaccacttgcgctaataaaaaaaaaaaaaactactcttatgtccactttacaaaagaaaacagcattgtgattactcccagggaccgtattttatcttcagtggctgcctgattttacccccacaattaaagttgaaggaatcctgaaaaaatcctgaacaaacttgtgatcta

SEQ ID NO: 371824 - DNA, 2188 bp, Homo sapiens
  misc_feature (8)..(8): n is a, c, g, or t
  misc_feature (40)..(41): n is a, c, g, or t
  misc_feature (44)..(44): n is a, c, g, or t
gtgggggngaaagaaaattacggctaggtacgaggctggnngtngagtaaagcaccccaagtagacgtagacaaagcagtggctgagctcaaagcccgcaagagggttctggaagcaaaggagctggcgttacagcccaaagatgatattgtagaccgagcaaaaatggaagataccctgaagaggaggtttttctatgatcaagcttttgctatttatggaggtgttagtggtctgtatgactttgggccagttggctgtgctttgaagaacaatattattcagacctggaggcagcactttatccaagaggaacagatcctggagatcgattgcaccatgctcacccctgagccagttttaaagacctctggccatgtagacaaatttgctgacttcatggtgaaagacgtaaaaaatggagaatgttttcgtgctgaccatctattaaaagctcatttacagaaattgatgtctgataagaagtgttctgtcgaaaagaaatcagaaatggaaagtgttttggcccagcttgataactatggacagcaagaacttgcggatctttttgtgaactataatgtaaaatctcccattactggaaatgatctatcccctccagtgtcttttaacttaatgttcaagactttcattgggcctggaggaaacatgcctgggtacttgagaccagaaactgcacaggggattttcttgaatttcaaacgacttttggagttcaaccaaggaaagttgccttttgctgctgcccagattggaaattcttttagaaatgagatctcccctcgatctggactgatcagagtcagagaattcacaatggcagaaattgagcactttgtagatcccagtgagaaagaccaccccaagttccagaatgtggcagaccttcacctttatttgtattcagcaaaagcccaggtcagcggacagtccgctcggaaaatgcgcctgggagatgctgttgaacagggtgtgattaataacacagtattaggctatttcattggccgcatctacctctacctcacgaaggttggaatatctccagataaactccgcttccggcagcacatggagaatgagatggcccattatgcctgtgactgttgggatgcagaatccaaaacatcctacggttggattgagattgttggatgtgctgatcgttcctgttatgacctctcctgtcatgcacgagccaccaaagtcccacttgtagctgagaaacctctgaaagaacccaaaacagtcaatgttgttcagtttgaacccagtaagggagcaattggtaaggcatataagaaggatgcaaaactggtgatggagtatcttgccatttgtgatgagtgctacattacagaaatggagatgctgctgaatgagaaaggggaattcacaattgaaactgaagggaaaacatttcagttaacaaaagacatgatcaatgtgaagagattccagaaaacactatatgtggaagaagttgttccgaatgtaattgaaccttccttcggcctgggtaggatcatgtatacggtatttgaacatacattccatgtacgagaaggagatgaacagagaacattcttcagtttccctgctgtagttgctccattcaaatgttccgtcctcccactgagccaaaaccaggagttcatgccatttgtcaaggaattatcggaagccctgaccaggcatggagtatctcacaaagtagacgattcctctgggtcaatcggaaggcgctatgccaggactgatgagattggcgtggcttttggtgtcaccattgactttgacacagtgaacaagaccccccacactgcaactctgagggaccgtgactcaatgcggcagataagagcagagatctctgagctgcccagcatagtccaagacctagccaatggcaacatcacatgggctgatgtggaggccaggtatcctctgtttgaagggcaagagactggtaaaaaagagacaatcgaggaatgaggacaattttgacaacttttgaccacttgcgctaataaaaaaaaaaaaaactactcttatgtccactttacaaaagaaaacagcattgtgattactcccagggaccgtattttatcttcagtggctgcctgattttacccccacaattaaagttgaaggaatcctgaaaaaa

SEQ ID NO: 371825 - DNA, 3060 bp, Homo sapiens
  misc_feature (253)..(253): n is a, c, g, or t
  misc_feature (2775)..(2775): n is a, c, g, or t
  misc_feature (2815)..(2815): n is a, c, g, or t
  misc_feature (2825)..(2825): n is a, c, g, or t
  misc_feature (2843)..(2844): n is a, c, g, or t
gtcactcgtataaaaacctatgctttgaaggttctcgtgtgtctcggcctgcaggtctcgctcagagctgtgtccctgaacatccaccctgctggggtggcttgacgcacttctgtgcaaatctgttcgctcgcaaccctacctacctctctcccgaaccggagaaaaccttcggcggggtccttccgggttttgtgtcgaatctgcggcggcgacccggcgccgcgtcacgcggtggtgaatgtgcggcagnacgcgcgccgcgtcgtttacgcggcgatttcatcatgctccgagccgggcggcgcgcgccgcttccgtcgccaccctctctggacagcccagggccgcaggctcatgccctctccgcgtccagtgctgcttagaggtgctcgcgccgctctgctgctgctgctgccgccccggctcttagcccgaccctcgctcctgctccgccggtccctcagcgcggcctcctgcgccccgatctccttgcccgccgccgcctcccggagcagcatggacggcgcgggggctgaggaggtgctggcacctctgaggctagcagtgcgccagcagggagatcttgtgcgaaaactcaaagaagataaagcaccccaagtagacgtagacaaagcagtggctgagctcaaagcccgcaagagggttctggaagcaaaggagctggcgttacagcccaaagatgatattgtagaccgagcaaaaatggaagataccctgaagaggaggtttttctatgatcaagcttttgctatttatggaggtgttagtggtctgtatgactttgggccagttggctgtgctttgaagaacaatattattcagacctggaggcagcactttatccaagaggaacagatcctggagatcgattgcaccatgctcacccctgagccagttttaaagacctctggccatgtagacaaatttgctgacttcatggtgaaagacgtaaaaaatggagaatgttttcgtgctgaccatctattaaaagctcatttacagaaattgatgtctgataagaagtgttctgtcgaaaagaaatcagaaatggaaagtgttttggcccagcttgataactatggacagcaagaacttgcggatctttttgtgaactataatgtaaaatctcccattactggaaatgatctatcccctccagtgtcttttaacttaatgttcaagactttcattgggcctggaggaaacatgcctgggtacttgagaccagaaactgcacaggggattttcttgaatttcaaacgacttttggagttcaaccaaggaaagttgccttttgctgctgcccagattggaaattcttttagaaatgagatctcccctcgatctggactgatcagagtcagagaattcacaatggcagaaattgagcactttgtagatcccagtgagaaagaccaccccaagttccagaatgtggcagaccttcacctttatttgtattcagcaaaagcccaggtcagcggacagtccgctcggaaaatgcgcctgggagatgctgttgaacagggtgtgattaataacacagtattaggctatttcattggccgcatctacctctacctcacgaaggttggaatatctccagataaactccgcttccggcagcacatggagaatgagatggcccattatgcctgtgactgttgggatgcagaatccaaaacatcctacggttggattgagattgttggatgtgctgatcgttcctgttatgacctctcctgtcatgcacgagccaccaaagtcccacttgtagctgagaaacctctgaaagaacccaaaacagtcaatgttgttcagtttgaacccagtaagggagcaattggtaaggcatataagaaggatgcaaaactggtgatggagtatcttgccatttgtgatgagtgctacattacagaaatggagatgctgctgaatgagaaaggggaattcacaattgaaactgaagggaaaacatttcagttaacaaaagacatgatcaatgtgaagagattccagaaaacactatatgtggaagaagttgttccgaatgtaattgaaccttccttcggcctgggtaggatcatgtatacggtatttgaacatacattccatgtacgagaaggagatgaacagagaacattcttcagtttccctgctgtagttgctccattcaaatgttccgtcctcccactgagccaaaaccaggagttcatgccatttgtcaaggaattatcggaagccctgaccaggcatggagtatctcacaaagtagacgattcctctgggtcaatcggaaggcgctatgccaggactgatgagattggcgtggcttttggtgtcaccattgactttgacacagtgaacaagaccccccacactgcaactctgagggaccgtgactcaatgcggcagataagagcagagatctctgagctgcccagcatagtccaagacctagccaatggcaacatcacatgggctgatgtggaggccaggtatcctctgttttaccagtctcttgcaagaaggaagctcctgcccctcctaaagctgaagccaaagcgaaggctttaaaggccaagaaggcagtgttgaaaggtgtccacagccacaaaaagaagaagatccgcacgtcacccaccttccggcggccgaagacactgcgactccggagacagcccaaatatcctcggaagagcgctcccaggagaaacaagcttgaccactatgctatcatcaagtttccgntgaccactgagtctgccatgaagaagatagaagacaaaanacacttgtgntcattgtggatgttaaanncaacaagcaccagattaaaaaggctgtgaggaagctgttgacattgatgtggccaaggtcaacaaccttgattacggcttgatggagagaagaagggatatgttctggtggatcctgataacgatgctttgggatgttggcacaaaaatgggatcatctagagtgagttcagatagctaattctgaatatatatatatatataattagtacacata

SEQ ID NO: 371826 - DNA, 3454 bp, Homo sapiens
  misc_feature (253)..(253): n is a, c, g, or t
gtcactcgtataaaaacctatgctttgaaggttctcgtgtgtctcggcctgcaggtctcgctcagagctgtgtccctgaacatccaccctgctggggtggcttgacgcacttctgtgcaaatctgttcgctcgcaaccctacctacctctctcccgaaccggagaaaaccttcggcggggtccttccgggttttgtgtcgaatctgcggcggcgacccggcgccgcgtcacgcggtggtgaatgtgcggcagnacgcgcgccgcgtcgtttacgcggcgatttcatcatgctccgagccgggcggcgcgcgccgcttccgtcgccaccctctctggacagcccagggccgcaggctcatgccctctccgcgtccagtgctgcttagaggtgctcgcgccgctctgctgctgctgctgccgccccggctcttagcccgaccctcgctcctgctccgccggtccctcagcgcggcctcctgcgccccgatctccttgcccgccgccgcctcccggagcagcatggacggcgcgggggctgaggaggtgctggcacctctgaggctagcagtgcgccagcagggagatcttgtgcgaaaactcaaagaagataaagcaccccaagtagacgtagacaaagcagtggctgagctcaaagcccgcaagagggttctggaagcaaaggagctggcgttacagcccaaagatgatattgtagaccgagcaaaaatggaagataccctgaagaggaggtttttctatgatcaagcttttgctatttatggaggtgttagtggtctgtatgactttgggccagttggctgtgctttgaagaacaatattattcagacctggaggcagcactttatccaagaggaacagatcctggagatcgattgcaccatgctcacccctgagccagttttaaagacctctggccatgtagacaaatttgctgacttcatggtgaaagacgtaaaaaatggagaatgttttcgtgctgaccatctattaaaagctcatttacagaaattgatgtctgataagaagtgttctgtcgaaaagaaatcagaaatggaaagtgttttggcccagcttgataactatggacagcaagaacttgcggatctttttgtgaactataatgtaaaatctcccattactggaaatgatctatcccctccagtgtcttttaacttaatgttcaagactttcattgggcctggaggaaacatgcctgggtacttgagaccagaaactgcacaggggattttcttgaatttcaaacgacttttggagttcaaccaaggaaagttgccttttgctgctgcccagattggaaattcttttagaaatgagatctcccctcgatctggactgatcagagtcagagaattcacaatggcagaaattgagcactttgtagatcccagtgagaaagaccaccccaagttccagaatgtggcagaccttcacctttatttgtattcagcaaaagcccaggtcagcggacagtccgctcggaaaatgcgcctgggagatgctgttgaacagggtgtgattaataacacagtattaggctatttcattggccgcatctacctctacctcacgaaggttggaatatctccagataaactccgcttccggcagcacatggagaatgagatggcccattatgcctgtgactgttgggatgcagaatccaaaacatcctacggttggattgagattgttggatgtgctgatcgttcctgttatgacctctcctgtcatgcacgagccaccaaagtcccacttgtagctgagaaacctctgaaagaacccaaaacagtcaatgttgttcagtttgaacccagtaagggagcaattggtaaggcatataagaaggatgcaaaactggtgatggagtatcttgccatttgtgatgagtgctacattacagaaatggagatgctgctgaatgagaaaggggaattcacaattgaaactgaagggaaaacatttcagttaacaaaagacatgatcaatgtgaagagattccagaaaacactatatgtggaagaagttgttccgaatgtaattgaaccttccttcggcctgggtaggatcatgtatacggtatttgaacatacattccatgtacgagaaggagatgaacagagaacattcttcagtttccctgctgtagttgctccattcaaatgttccgtcctcccactgagccaaaaccaggagttcatgccatttgtcaaggaattatgtaagcaaattcaattgggtaaactccatgggaacaccatcaaggagactgaattttaggaaatgtatcatttatttcaataaaaatatagactgaataaagaatataaatgattttataaagagtacatgattttagcctgtactcttatttctaagcgagaggatatgcttgctcagatgttttattctggcatttgagtgaggcaaggtaggacccaagagtcagatttaaaaattatttacttctcatactgaccttggtgccaagttcatcgagggaacctgagtggagtgtagcaaccataatggatctacagccacagaatccacagccctgaaaggaatcctggtggtcatctggcacatccacttatttcagagctgggaaatggggagagtccattgacctgcttagagccataaaaatagaggtggtggagtcaggactcaccttctggccttggctcttggtcccatatttgttccccctatagctgtatcagatggaggtatgagtgaagatttggattcccgcaagggatttattaaactttagggatatttctttctcttgcaactcaacttgtggctttcttgtcttggtcccatttataagtctcctgagcttgtaagacagtagttagataacactgggcttaactccattgttttatttttaatttactttgtttattttggatagcggaagccctgaccaggcatggagtatctcacaaagtagacgattcctctgggtcaatcggaaggcgctatgccaggactgatgagattggcgtggcttttggtgtcaccattgactttgacacagtgaacaagaccccccacactgcaactctgagggaccgtgactcaatgcggcagataagagcagagatctctgagctgcccagcatagtccaagacctagccaatggcaacatcacatgggctgatgtggaggccaggtatcctctgtttgaagggcaagagactggtaaaaaagagacaatcgaggaatgaggacaattttgacaacttttgaccacttgcgctaataaaaaaaaaaaaaactactcttatgtccactttacaaaagaaaacagcattgtgattactcccagggaccgtattttatcttcagtggctgcctgattttacccccacaattaaagttgaaggaatcctgaaaaaa

SEQ ID NO: 371827 - DNA, 2027 bp, Homo sapiens
  misc_feature (253)..(253): n is a, c, g, or t
gtcactcgtataaaaacctatgctttgaaggttctcgtgtgtctcggcctgcaggtctcgctcagagctgtgtccctgaacatccaccctgctggggtggcttgacgcacttctgtgcaaatctgttcgctcgcaaccctacctacctctctcccgaaccggagaaaaccttcggcggggtccttccgggttttgtgtcgaatctgcggcggcgacccggcgccgcgtcacgcggtggtgaatgtgcggcagnacgcgcgccgcgtcgtttacgcggcgatttcatcatgctccgagccgggcggcgcgcgccgcttccgtcgccaccctctctggacagcccagggccgcaggctcatgccctctccgcgtccagtgctgcttagaggtgctcgcgccgctctgctgctgctgctgccgccccggctcttagcccgaccctcgctcctgctccgccggtccctcagcgcggcctcctgcgccccgatctccttgcccgccgccgcctcccggagcagcatggacggcgcgggggctgaggaggtgctggcacctctgaggctagcagtgcgccagcagggagatcttgtgcgaaaactcaaagaagataaagcaccccaagtagacgtagacaaagcagtggctgagctcaaagcccgcaagagggttctggaagcaaaggagctggcgttacagcccaaagatgatattgtagaccgagcaaaaatggaagataccctgaagaggaggtttttctatgatcaagcttttgctatttatggaggtgttagtggtctgtatgactttgggccagttggctgtgctttgaagaacaatattattcagacctggaggcagcactttatccaagaggaacagatcctggagatcgattgcaccatgctcacccctgagccagttttaaagacctctggccatgtagacaaatttgctgacttcatggtgaaagacgtaaaaaatggagaatgttttcgtgctgaccatctattaaaagctcatttacagaaattgatgtctgataagaagtgttctgtcgaaaagaaatcagaaatggaaagtgttttggcccagcttgataactatggacagcaagaacttgcggatctttttgtgaactataatgtaaaatctcccattactggaaatgatctatcccctccagtgtcttttaacttaatgttcaagactttcattgggcctggaggaaacatgcctgggtacttgagaccagaaactgcacaggggattttcttgaatttcaaacgacttttggagttcaaccaaggaaagttgccttttgagaattcacaatggcagaaattgagcactttgtagatcccagtgagaaagaccaccccaagttccagaatgtggcagaccttcacctttatttgtattcagcaaaagcccaggtcagcggacagtccgctcggaaaatgcgcctgggagatgctgttgaacagggtgtgattaataacacagtattaggctatttcattggccgcatctacctctacctcacgaaggttggaatatctccagataaactccgcttccggcagcacatggagaatgagatggcccattatgcctgtgactgttgggatgcagaatccaaaacatcctacggttggattgagattgttggatgtgctgatcgttcctgttatgacctctcctgtcatgcacgagccaccaaagtcccacttgtagctgagaaacctctgaaagaacccaaaacagtcaatgttgttcagtttgaacccagtaagggagcaattggtaaggcatataagaaggatgcaaaactggtgatggagtatcttgccatttgtgatgagtgctacattacagaaatggagatgctgctgaatgagaaaggggaattcacaattgaaactggagggaaaacatttcagttaacgtgttccgaattgtattgaaactttctttcggccgggtaggaacatgtttaccggatttggacatacatttcatgtacgaaa

SEQ ID NO: 371828 - DNA, 1255 bp, Homo sapiens
ctgggattacaggcatgagccactgtgtccagccttatttttgctttctttgatttctgagttactcagaaactatttcagggcagtttaagaaggctgtactttttagtgtaggtatatggaacatctttttttgttttgtactatttcttttggacatatgtttgtgagctaattaaacttttctgtttcacttggtcactgaggttcataggtttttctcttaaaagacagaatgggctttggtttgggtcactgccacttgtttgaatatttaggtagtctccacagaaagtcttttatgtggaaccaaaaaattaccgtcttttatatacagtagctttcagaatgctttcacatcatttgacttttttagtaacgggcttgtgaagcaagcagagcaggtggtagagacctgctttttaggtggagaaactaaggttcagaaagagttcatgacttggcctaaattcggagctgaaaccaggtgtttctgatgctggttctgcttctcttttgccatactgcttttcatgtcatgttttctggcattttggtaatgacgttatgcttgaacacttgctgaatattaacctcttttggtttgggatattagcatttagatatttacaaattaacatatttggatttttttctttttaaatcatccagttcttcagtttccctgctgtagttgctccattcaaatgttccgtcctcccactgagccaaaaccaggagttcatgccatttgtcaaggaattatcggaagccctgaccaggcatggagtatctcacaaagtagacgattcctctgggtcaatcggaaggcgctatgccaggactgatgagattggcgtggcttttggtgtcaccattgactttgacacagtgaacaagaccccccacactgcaactctgagggaccgtgactcaatgcggcagataagagcagagatctctgagctgcccagcatagtccaagacctagccaatggcaacatcacatgggctgatgtggaggccaggtatcctctgtttgaagggcaagagactggtaaaaaagagacaatcgaggaatgaggacaattttgacaacttttgaccacttgcgctaataaaaaaaaaaaaaactactcttatgtccactttacaaaagaaaacagcattgtgattactcccagggaccgtattttatcttcagtggctgcctgattttacccccacaattaaagttgaaggaatcctgaaaaaa

SEQ ID NO: 371829 - DNA, 778 bp, Homo sapiens
gaagacctgatccatgtgagaaaattcccgtagaaagagctgatagtgtcggcatgaagtacgttcccgtagagtagtaatttgaacccttctccatttacggatcgtcgtggttaccgatctagtcgtcctagcgttcagtgtgagacaatagcattcacagagatatggatgaagggcgcctcgaaggcatgtacccagtgatcctaggctcggccgagtgtgctatctcaggccgtcctcccactgagccaaaaccaggagttcatgccatttgtcaaggaattatcggaagccctgaccaggcatggagtatctcacaaagtagacgattcctctgggtcaatcggaaggcgctatgccaggactgatgagattggcgtggcttttggtgtcaccattgactttgacacagtgaacaagaccccccacactgcaactctgagggaccgtgactcaatgcggcagataagagcagagatctctgagctgcccagcatagtccaagacctagccaatggcaacatcacatgggctgatgtggaggccaggtatcctctgtttgaagggcaagagactggtaaaaaagagacaatcgaggaatgaggacaattttgacaacttttgaccacttgcgctaataaaaaaaaaaaaaactactcttatgtccactttacaaaagaaaacagcattgtgattactcccagggaccgtattttatcttcagtggctgcctgattttacccccacaattaaagttgaaggaatcctgaaaaaa

SEQ ID NO: 371830 - DNA, 508 bp, Homo sapiens
tcaggaggctgatctccttcatttggggcaggttctataggatatagctctcgaaagaatgagatacaagtcagcagatatttattaggcacttatgacattaccaaccttagttaccagccttaggtgaatgtctcccaggagctttagaaggcacttgaatcatgagacatttcccccatctctgaaaagcatgaagaatgtgtgtggggagggtgaagggcttggcagagagaaagaggacactgaaggtgatcagcccctctctccacctccagcatattgggaaggcatccgtcttcatctcattaccaactcgtcaaaacagcaccatctggtcacctgttttgcagaggcagcccccatttccacttttaacagcattgcatggagcaggggatagtgggggaaaccagtggctgggagtcctatgccactctcaacatgaatgcttacaggtacgctggcacacactaccaatgaaaaggcttttttaaaataatgaaaa

SEQ ID NO: 371831 - DNA, 1235 bp, Homo sapiens
ggttctggctactgaatgatcccacagctgaggtctattgtcatcgctccacttctatttttagcagcactaaaaacattcccaaaaaaaatgttttttagctttttaactgtagattcaccactaagaaattggcattggaacagtccacagagcttattcaaatttcacccattttacatgcactcatttgtgttgcatgtgatatatagttctatttcattttatcacctgtgtagatggatgaaaacagcaacataagcaagatacagagctgttccgtcatcacagagctctgccatactatccttttatagccatctctacctctgtcccccatttctaacccctggaaaccactaatctgttcttcataattttcttatttcaagaatcttacgtaaataggatcacgaagtataacctttgagaatggccttttcactccattcccttgagatacatccaggtagttgcatgtatcaatagttaattcctttttattgctacacagtactccatagtatgaatatactatgtacatagcatatatatttatagtttaaccattcaccttgaacattttggttgtttccagtttgggggcattaacaataaagctgatctgaacaatcaggtataatagtccccctttatctttgaagattatatcccaagactcccagtgagtgtctgaaaccatggatagtatatacactatccatatgtgctatatgtactatatgtcctctatatattttttctatacatacatacctttgatgtttaattaagcactgcaagaaactgacagcaataaatagaacaattatactgtaattaaatgaatgtggcctcaaaatgtactgttctcacatattttcagactgtgggtaactgaaactgcataaagcaaaactggctgggtgcggtggtgcacacctgtaatcccaggactttggcaggctggtctcgaactcctgacctcaagcgattcgcccacctcgacctcccaaagtgctgggattacaggcgtgagccactgcacccagctgaacacaatctgtaccttccatgtactgatttatgtctttgtctgtaactcctgtccacctaaaatgtacaaaaccaaactgtaattctactgtctcaggcacactttctcaggacctcttgagcctgtgttccccaggccatggtcactcatattggctcaaaataaatctctttaaaac

SEQ ID NO: 371832 - DNA, 842 bp, Homo sapiens
  misc_feature (53)..(53): n is a, c, g, or t
ataaccctctccactcgcagttgtgcgccggtgggcgcccgcggtgcacctcnaggcgagacttgaaatctgtgctttgagggacactgtggctgtttacctgacacccgaaagcaagtcaagttttaagcaggctttggaagccctgccccagctttccagtggagcagataaaaagttactggaagagctcctgaacaagttcaagagtagcatgcacttgcagctcacctgtttccaagcagcttcttcaaccatgatgaaaacataaatatctgccacataaaagaagtccaggaaaataacacgtaataagactgttcactctctaagtaccctaaaggtatttggtgtattaaacattgggtttgccatttttctcttttttcttcctctgacttcgaaaattgttggtatacatttcaaccaaaatgacctcatttgaaatgcccaggaagtatttgttttgccattcttactagatcagatcctgtatgactttaaaatacattttaaaatatattttgcatctcagcagaaggttgagtgctgcaggaagagctgcttctgcagggagttttctggaatggcgtggcacatattgaagcatttctcagtgtcccgttcacggaagcgcaggcagctcccacgacacacggagagactgactgatacgagatttggaaagctatgtagacatctttggagctcttactgtcctaaactgtacagctgtgcttaaaacccttatttcatataaatggccttaagttttctaattcaagcgggtttttggaaaaatttatggtctccattaaaatacatattacaactggggtaga

SEQ ID NO: 371833 - DNA, 3232 bp, Homo sapiens
ccgcggagtcttcggcgagacctaccgggccctgtctgtgccggccgtgagctgcggcaggacggctggagattacttctctaacaggatcaccagtttgctccacaaagcacaatgtctcgatcacgacaacccccccttgtgaccggcatctctccaaatgaagggataccatggacgaaggtcacaatcaggggagaaaatctggggactggccccaccgacctcataggcttgaccatttgtggacataattgcctcctgacggcagaatggatgtctgcaagtaaaatagtatgtcgagtgggacaagccaaaaatgacaaaggagacattattgtcaccactaagtcaggtggcagaggaacctcaacagtctctttcaagctactcaaacctgagaaaataggcattttggatcagtctgctgtgtgggttgatgaaatgaattattatgatatgcgcactgacaggaacaaaggaattccgcccttgtccttacgtcctgctaacccgcttggcattgagattgaaaaaagtaaattttcgcagaaggacttagaaatgctattccatggaatgagtgctgattttacaagtgagaatttctcagcagcctggtatcttatagagaatcactcaaacaccagttttgagcagctcaaaatggcagtcaccaacctaaagagacaggctaacaagaagagtgagggcagcctggcctatgtgaaaggcggtctcagtacattcttcgaagcacaggatgccctctcagccatccatcaaaaactagaagcagatggaacggaaaaagtagaaggatccatgacgcagaaactggagaatgttctgaacagagcaagtaatactgcagacacattgtttcaagaagtattaggtcggaaagacaaggcagattccactagaaatgcactcaatgtgcttcagcgatttaagtttcttttcaaccttcctctaaatattgaaaggaatattcaaaagggtgattatgatgtggttattaatgattatgaaaaggccaagtcactttttgggaaaacggaggtgcaagttttcaagaaatattatgctgaagtagaaacaaggattgaagctttaagagaattacttctggataaattgcttgagacaccatcaactttacatgaccaaaaacgttacataaggtacctgtctgaccttcatgcgtctggtgaccctgcttggcaatgcattggagcccaacacaagtggatccttcagctcatgcacagttgcaaagagggctacgtgaaagatctgaaaggtaacccaggcctgcacagtcccatgttggatcttgataatgatacacgtccctcagtgttgggccatctcagtcagacagcgtccctgaagaggggcagcagctttcagtctggtcgagacgacacgtggagatacaaaactccccacagggtggcctttgttgaaaaattgacaaaactcgtcttgagccagctgcctaacttctggaaactctggatctcctacgttaatggaagcctcttcagtgagactgctgagaagtcaggccagattgaaagatcaaagaatgtaaggcaaagacaaaatgattttaagaaaatgattcaggaagtaatgcactccctggtgaagcttacccgcggagccctgcttcccctcagcatccgggatggggaagccaagcagtacggaggctgggaggtgaagtgcgagctctccggacagtggctcgctcacgccatccagactgtaagacttactcatgaatcgttgactgcccttgaaattcctaatgacctgttacagactatccaggatctcatcttggatctccgagtacgttgcgtaatggccacgttgcagcacacggcggaagaaataaagagattagctgaaaaagaagactggattgttgacaatgaaggactgacttctctaccatgtcagtttgaacagtgcatcgtgtgttctctgcagtcactgaagggggttctggagtgcaagccgggagaggccagtgtcttccaacaacctaaaacacaggaggaggtttgccagctaagcatcaatataatgcaggtttttatatactgtctggaacagttgagcaccaagcctgatgcagatatagatactacacatctctctgttgatgtttcttcccctgacttgtttggaagtatccatgaagacttcagcttgacctcagaacagcgccttttgatagtcctaagtaattgctgctatctagaacgtcacaccttcctaaatatcgcagaacattttgaaaagcacaacttccagggaatagaaaaaatcacacaggttagcatggcctcattgaaagaactagatcaaagactctttgaaaattacatcgagttgaaagcagatcccatcgttggctccttagaacctggaatttatgcaggatattttgattggaaggactgcctgcctccaacaggtgtcagaaactatttaaaagaagcactggtgaatataattgccgtgcatgcagaggtgttcaccatttccaaagaactggtccctcgggtactatccaaggtgatagaagcagtttctgaagagctcagtcgactgatgcagtgtgtttcatccttcagcaaaaatggagctttacaggcgagacttgaaatctgtgctttgagggacactgtggctgtttacctgacacccgaaagcaagtcaagttttaagcaggctttggaagccctgccccagctttccagtggagcagataaaaagttactggaagagctcctgaacaagttcaagagtagcatgcacttgcagctcacctgtttccaagcagcttcttcaaccatgatgaaaacataaatatctgccacataaaagaagtccaggaaaataacacagaaggttgagtgctgcaggaagagctgcttctgcagggagttttctggaatggcgtggcacatattgaagcatttctcagtgtcccgttcacggaagcgcaggcagctcccacgacacacggagagactgactgatacgagatttggaaagctatgtagacatctttggagctcttactgtcctaaactgtacagctgtgcttaaaacccttatttcatataaatggccttaagttttctaattcaagcgggtttttggaaaaatttatggtctccattaaaatacatattacaactggggtaga

SEQ ID NO: 371834 - DNA, 3786 bp, Homo sapiens
ccgcggagtcttcggcgagacctaccgggccctgtctgtgccggccgtgagctgcggcaggacggctggagattacttctctaacaggatcaccagtttgctccacaaagcacaatgtctcgatcacgacaacccccccttgtgaccggcatctctccaaatgaagggataccatggacgaaggtcacaatcaggggagaaaatctggggactggccccaccgacctcataggcttgaccatttgtggacataattgcctcctgacggcagaatggatgtctgcaagtaaaatagtatgtcgagtgggacaagccaaaaatgacaaaggagacattattgtcaccactaagtcaggtggcagaggaacctcaacagtctctttcaagctactcaaacctgagaaaataggcattttggatcagtctgctgtgtgggttgatgaaatgaattattatgatatgcgcactgacaggaacaaaggaattccgcccttgtccttacgtcctgctaacccgcttggcattgagattgaaaaaagtaaattttcgcagaaggacttagaaatgctattccatggaatgagtgctgattttacaagtgagaatttctcagcagcctggtatcttatagagaatcactcaaacaccagttttgagcagctcaaaatggcagtcaccaacctaaagagacaggctaacaagaagagtgagggcagcctggcctatgtgaaaggcggtctcagtacattcttcgaagcacaggatgccctctcagccatccatcaaaaactagaagcagatggaacggaaaaagtagaaggatccatgacgcagaaactggagaatgttctgaacagagcaagtaatactgcagacacattgtttcaagaagtattaggtcggaaagacaaggcagattccactagaaatgcactcaatgtgcttcagcgatttaagtttcttttcaaccttcctctaaatattgaaaggaatattcaaaagggtgattatgatgtggttattaatgattatgaaaaggccaagtcactttttgggaaaacggaggtgcaagttttcaagaaatattatgctgaagtagaaacaaggattgaagctttaagagaattacttctggataaattgcttgagacaccatcaactttacatgaccaaaaacgttacataaggtacctgtctgaccttcatgcgtctggtgaccctgcttggcaatgcattggagcccaacacaagtggatccttcagctcatgcacagttgcaaagagggctacgtgaaagatctgaaaggtaacccaggcctgcacagtcccatgttggatcttgataatgatacacgtccctcagtgttgggccatctcagtcagacagcgtccctgaagaggggcagcagctttcagtctggtcgagacgacacgtggagatacaaaactccccacagggtggcctttgttgaaaaattgacaaaactcgtcttgagccagctgcctaacttctggaaactctggatctcctacgttaatggaagcctcttcagtgagactgctgagaagtcaggccagattgaaagatcaaagaatgtaaggcaaagacaaaatgattttaagaaaatgattcaggaagtaatgcactccctggtgaagcttacccgcggagccctgcttcccctcagcatccgggatggggaagccaagcagtacggaggctgggaggtgaagtgcgagctctccggacagtggctcgctcacgccatccagactgtaagacttactcatgaatcgttgactgcccttgaaattcctaatgacctgttacagactatccaggatctcatcttggatctccgagtacgttgcgtaatggccacgttgcagcacacggcggaagaaataaagagattagctgaaaaagaagactggattgttgacaatgaaggactgacttctctaccatgtcagtttgaacagtgcatcgtgtgttctctgcagtcactgaagggggttctggagtgcaagccgggagaggccagtgtcttccaacaacctaaaacacaggaggaggtttgccagctaagcatcaatataatgcaggtttttatatactgtctggaacagttgagcaccaagcctgatgcagatatagatactacacatctctctgttgatgtttcttcccctgacttgtttggaagtatccatgaagacttcagcttgacctcagaacagcgccttttgatagtcctaagtaattgctgctatctagaacgtcacaccttcctaaatatcgcagaacattttgaaaagcacaacttccagggaatagaaaaaatcacacaggttagcatggcctcattgaaagaactagatcaaagactctttgaaaattacatcgagttgaaagcagatcccatcgttggctccttagaacctggaatttatgcaggatattttgattggaaggactgcctgcctccaacaggtgtcagaaactatttaaaagaagcactggtgaatataattgccgtgcatgcagaggtgttcaccatttccaaagaactggtccctcgggtactatccaaggtgatagaagcagtttctgaagagctcagtcgactgatgcagtgtgtttcatccttcagcaaaaatggagctttacaggcgagacttgaaatctgtgctttgagggacactgtggctgtttacctgacacccgaaagcaagtcaagttttaagcaggctttggaagccctgccccagctttccagtggagcagataaaaagttactggaagagctcctgaacaagttcaagagtagcatgcacttgcagctcacctgtttccaagcagcttcttcaaccatgatgaaaacataaatatctgccacataaaagaagtccaggaaaataacacgtaataagactgttcactctctaagtaccctaaaggtatttggtgtattaaacattgggtttgccatttttctcttttttcttcctctgacttcgaaaattgttggtatacatttcaaccaaaatgacctcatttgaaatgcccaggaagtatttgttttgccattcttactagatcagatcctgtatgactttaaaatacattttaaaatatattttgcatctcagcagaaggttgagtgctgcaggaagagctgcttctgcagggagttttctggaatggcgtggcacatattgaagcatttctcagtgtcccgttcacggaagcgcaggcagctcccacgacacacggagagactgactgatacgagatttggaaagctatgtagacatctttggagctcttactgtcctaaactgtacagctgtgcttaaaacccttatttcatataaatggccttaagttttctaattcaagcgggtttttggaaaaatttatggtctccattaaaatacatattacaactggggtagaaaaaaaaaaaaaaaaaaaaaaaaaaaaaaaaagggggggggcaaaaaatttcccccggggggccccagtttttcgcctgttcccgctttttttttccaaaggggcccccctatggggagccgtaataatagaagaggcacgcgcgcgtgtttacacgcgtcgggcgggaaacaactgccttgggctttttgaaggaccccttcttctgtgcggggcctttttgggccccccccaggatttaggctgggaatatactttccggtctttgtgtttacccgcgctttctctgtgaattgctctggtttttatacggtgtctacatatgg

SEQ ID NO: 371835 - DNA, 1683 bp, Homo sapiens
ggccgtcggctatctgtcgggctgtaaaacaagtgtctccgtcctggaggttactggaagagctcctgaacaagttcaagagtagcatgcacttgcagctcacctgtttccaagcagcttcttcaaccatgatgaaaacataaatatctgccacataaaagaagtccaggaaaataacacgtaataagactgttcactctctaagtaccctaaaggtatttggtgtattaaacattgggtttgccatttttctcttttttcttcctctgacttcgaaaattgttggtatacatttcaaccaaaatgacctcatttgaaatgcccaggaagtatttgttttgccattcttactagatcagatcctgtatgactttaaaatacattttaaaatatattttgcatctcagcagaaggttgagtgctgcaggaagagctgcttctgcagggagttttctggaatggcgtggcacatattgaagcatttctcagtgtcccgttcacggaagcgcaggcagctcccacgacacacggagagactgactgatacgagatttggaaagctatgtagacatctttggagctcttactgtcctaaactgtacagctgtgcttaaaacccttatttcatataaatggccttaagttttctaattcaagcgggtttttggaaaaatttatggtctccattaaaatacatattacaactggggtagattatttgtggtccaggtgtctgtgatttaactttgcgttttgctatctgatttttatttttcacagggctaagcatgagctttcattctcactcactcttaatttgtcgtgcgtcactacacatgcacgtgttgcagtccctgaggccctgtgtgttatctgtgatggagtgtgaatgtgtaacgggcactgtgttacactctcaggtgttggcggggcggtcgcagacttcagggtcccctaacggaaaggccaggctccgcgtggacggccaactccctgcccgctccttcagcaggtgactgtctctgccacttcttacctgctgaaggatcttgctcagtagctggaacaatgctgctgtcacacagtctcttctctgaaacttcaggatgctccttggtcaccaggcaatgggagctgtagaccagccgcatgcacttgccccacattcactgctgactggcttcactggaataggttcaggtcaccgggacttctctcagagtcagcagcccacccaactccctcataccgtcgcatctgaaaattttcagagaggaattctctttgtagtcggcttgtcagggttttcaagtttttctatggttatttttaaatctctttttttaaatgctaaaattaatgtcctcattaatgcaagtaattttagagcacagtgtagccatgtacagtttccattatttaaaataaataaatgtgttggttcatttggtgtatggggggacatcatggtaactggaaatgaaagtttaatctttcacaaatgtgcttgataaagctgttaagaattgtctttcctaagtatgttaactgttgtatctaactcaactgtgagctaagtttaaaaactgcaatcatgaatgtttgtgatattttaaatatctactacagcacattcagccaataaagaatctgcctttaatgtaagttgtaatttacttgaca

SEQ ID NO: 371836 - DNA, 3267 bp, Homo sapiens
ccgcggagtcttcggcgagacctaccgggccctgtctgtgccggccgtgagctgcggcaggacggctggagattacttctctaacaggatcaccagtttgctccacaaagcacaatgtctcgatcacgacaacccccccttgtgaccggcatctctccaaatgaagggataccatggacgaaggtcacaatcaggggagaaaatctggggactggccccaccgacctcataggcttgaccatttgtggacataattgcctcctgacggcagaatggatgtctgcaagtaaaatagtatgtcgagtgggacaagccaaaaatgacaaaggagacattattgtcaccactaagtcaggtggcagaggaacctcaacagtctctttcaagctactcaaacctgagaaaataggcattttggatcagtctgctgtgtgggttgatgaaatgaattattatgatatgcgcactgacaggaacaaaggaattccgcccttgtccttacgtcctgctaacccgcttggcattgagattgaaaaaagtaaattttcgcagaaggacttagaaatgctattccatggaatgagtgctgattttacaagtgagaatttctcagcagcctggtatcttatagagaatcactcaaacaccagttttgagcagctcaaaatggcagtcaccaacctaaagagacaggctaacaagaagagtgagggcagcctggcctatgtgaaaggcggtctcagtacattcttcgaagcacaggatgccctctcagccatccatcaaaaactagaagcagatggaacggaaaaagtagaaggatccatgacgcagaaactggagaatgttctgaacagagcaagtaatactgcagacacattgtttcaagaagtattaggtcggaaagacaaggcagattccactagaaatgcactcaatgtgcttcagcgatttaagtttcttttcaaccttcctctaaatattgaaaggaatattcaaaagggtgattatgatgtggttattaatgattatgaaaaggccaagtcactttttgggaaaacggaggtgcaagttttcaagaaatattatgctgaagtagaaacaaggattgaagctttaagagaattacttctggataaattgcttgagacaccatcaactttacatgaccaaaaacgttacataaggtacctgtctgaccttcatgcgtctggtgaccctgcttggcaatgcattggagcccaacacaagtggatccttcagctcatgcacagttgcaaagagggctacgtgaaagatctgaaaggtaacccaggcctgcacagtcccatgttggatcttgataatgatacacgtccctcagtgttgggccatctcagtcagacagcgtccctgaagaggggcagcagctttcagtctggtcgagacgacacgtggagatacaaaactccccacagggtggcctttgttgaaaaattgacaaaactcgtcttgagccagctgcctaacttctggaaactctggatctcctacgttaatggaagcctcttcagtgagactgctgagaagtcaggccagattgaaagatcaaagaatgtaaggcaaagacaaaatgattttaagaaaatgattcaggaagtaatgcactccctggtgaagcttacccgcggagccctgcttcccctcagcatccgggatggggaagccaagcagtacggaggctgggaggtgaagtgcgagctctccggacagtggctcgctcacgccatccagactgtaagacttactcatgaatcgttgactgcccttgaaattcctaatgacctgttacagactatccaggatctcatcttggatctccgagtacgttgcgtaatggccacgttgcagcacacggcggaagaaataaagagattagctgaaaaagaagactggattgttgacaatgaaggactgacttctctaccatgtcagtttgaacagtgcatcgtgtgttctctgcagtcactgaagggggttctggagtgcaagccgggagaggccagtgtcttccaacaacctaaaacacaggaggaggtttgccagctaagcatcaatataatgcaggtttttatatactgtctggaacagttgagcaccaagcctgatgcagatatagatactacacatctctctgttgatgtttcttcccctgacttgtttggaagtatccatgaagacttcagcttgacctcagaacagcgccttttgatagtcctaagtaattgctgctatctagaacgtcacaccttcctaaatatcgcagaacattttgaaaagcacaacttccagggaatagaaaaaatcacacaggttagcatggcctcattgaaagaactagatcaaagactctttgaaaattacatcgagttgaaagcagatcccatcgttggctccttagaacctggaatttatgcaggatattttgattggaaggactgcctgcctccaacaggtgtcagaaactatttaaaagaagcactggtgaatataattgccgtgcatgcagaggtgttcaccatttccaaagaactggtccctcgggtactatccaaggtgatagaagcagtttctgaagagctcagtcgactgatgcagtgtgtttcatccttcagcaaaaatggagctttacaggcgagacttgaaatctgtgctttgagggacactgtggctgtttacctgacacccgaaagcaagtcaagttttaagcaggctttggaagccctgccccagctttccagtggagcagataaaaagttactggaagagctcctgaacaagttcaagagtagcatgcacttgcagctcacctgtttccaagcagcttcttcaaccatgatgaaaacataaatatctgccacataaaagaagtccaggaaaataacacgtaataagactgttcactctctaagtaccctaaagagaaggttgagtgctgcaggaagagctgcttctgcagggagttttctggaatggcgtggcacatattgaagcatttctcagtgtcccgttcacggaagcgcaggcagctcccacgacacacggagagactgactgatacgagatttggaaagctatgtagacatctttggagctcttactgtcctaaactgtacagctgtgcttaaaacccttatttcatataaatggccttaagttttctaattcaagcgggtttttggaaaaatttatggtctccattaaaatacatattacaactggggtaga

SEQ ID NO: 371837 - DNA, 2767 bp, Homo sapiens
ccgcggagtcttcggcgagacctaccgggccctgtctgtgccggccgtgagctgcggcaggacggctggagattacttctctaacaggatcaccagtttgctccacaaagcacaatgtctcgatcacgacaacccccccttgtgaccggcatctctccaaatgaagggataccatggacgaaggtcacaatcaggggagaaaatctggggactggccccaccgacctcataggcttgaccatttgtggacataattgcctcctgacggcagaatggatgtctgcaagtaaaatagtatgtcgagtgggacaagccaaaaatgacaaaggagacattattgtcaccactaagtcaggtggcagaggaacctcaacagtctctttcaagctactcaaacctgagaaaataggcattttggatcagtctgctgtgtgggttgatgaaatgaattattatgatatgcgcactgacaggaacaaaggaattccgcccttgtccttacgtcctgctaacccgcttggcattgagattgaaaaaagtaaattttcgcagaaggacttagaaatgctattccatggaatgagtgctgattttacaagtgagaatttctcagcagcctggtatcttatagagaatcactcaaacaccagttttgagcagctcaaaatggcagtcaccaacctaaagagacaggctaacaagaagagtgagggcagcctggcctatgtgaaaggcggtctcagtacattcttcgaagcacaggatgccctctcagccatccatcaaaaactagaagcagatggaacggaaaaagtagaaggatccatgacgcagaaactggagaatgttctgaacagagcaagtaatactgcagacacattgtttcaagaagtattaggtcggaaagacaaggcagattccactagaaatgcactcaatgtgcttcagcgatttaagtttcttttcaaccttcctctaaatattgaaaggaatattcaaaagggtgattatgatgtggttattaatgattatgaaaaggccaagtcactttttgggaaaacggaggtgcaagttttcaagaaatattatgctgaagtagaaacaaggattgaagctttaagagaattacttctggataaattgcttgagacaccatcaactttacatgaccaaaaacgttacataaggtacctgtctgaccttcatgcgtctggtgaccctgcttggcaatgcattggagcccaacacaagtggatccttcagctcatgcacagttgcaaagagggctacgtgaaagatctgaaaggtaacccaggcctgcacagtcccatgttggatcttgataatgatacacgtccctcagtgttgggccatctcagtcagacagcgtccctgaagaggggcagcagctttcagtctggtcgagacgacacgtggagatacaaaactccccacagggtggcctttgttgaaaaattgacaaaactcgtcttgagccagctgcctaacttctggaaactctggatctcctacgttaatggaagcctcttcagtgagactgctgagaagtcaggccagattgaaagatcaaagaatgtaaggcaaagacaaaatgattttaagaaaatgattcaggaagtaatgcactccctggtgaagcttacccgcggagccctgcttcccctcagcatccgggatggggaagccaagcagtacggaggctgggaggtgaagtgcgagctctccggacagtggctcgctcacgccatccagactgtaagacttactcatgaatcgttgactgcccttgaaattcctaatgacctgttacagactatccaggatctcatcttggatctccgagtacgttgcgtaatggccacgttgcagcacacggcggaagaaataaagagattagctgaaaaagaagactggattgttgacaatgaaggactgacttctctaccatgtcagtttgaacagtgcatcgtgtgttctctgcagtcactgaagggggttctggagtgcaagccgggagaggccagtgtcttccaacaacctaaaacacaggaggaggtttgccagctaagcatcaatataatgcaggtttttatatactgtctggaacagttgagcaccaagcctgatgcagatatagatactacacatctctctgttgatgtttcttcccctgacttgtttggaagtatccatgaagacttcagcttgacctcagaacagcgccttttgatagtcctaagtaattgctgctatctagaacgtcacaccttcctaaatatcgcagaacattttgaaaagcacaacttccagggaatagaaaaaatcacacaggttagcatggcctcattgaaagaactagatcaaagactctttgaaaattacatcgagttgaaagcagatcccatcgttggctccttagaacctggaatttatgcaggatattttgattggaaggactgcctgcctccaacagttctgggacacatgtgcagagcgtgcaggtttcttacatagatacagatgtgccgtggtgtttggtagtcatgggacgaccagaggcaggagccatgctgacctcttcacaagatgacacctctacgtaattacagtcattgccgagtctggtggttcttccccatacgtaaatgtcctaatgaatgaccgaataaggattataagacatttttctttccactcagcatatattgctcttacttttctatcaataaaaaaataaatccataag

SEQ ID NO: 371838 - DNA, 199 bp, Homo sapiens
tgaaatgaattattatgatatgcgcactgacaggaacaaaggaattccgcccttgtccttacgtcctgctaacccgcttggcattgagattgaaaagtgagtaccatcttgctttcagtcttctttatttttcagttcctgaaaagttttatatacttacaggaaagggactcaaactccagaaacatcccaggaaaca

SEQ ID NO: 371839 - DNA, 3460 bp, Homo sapiens
ccgcggagtcttcggcgagacctaccgggccctgtctgtgccggccgtgagctgcggcaggacggctggagattacttctctaacaggatcaccagtttgctccacaaagcacaatgtctcgatcacgacaacccccccttgtgaccggcatctctccaaatgaagggataccatggacgaaggtcacaatcaggggagaaaatctggggactggccccaccgacctcataggcttgaccatttgtggacataattgcctcctgacggcagaatggatgtctgcaagtaaaatagtatgtcgagtgggacaagccaaaaatgacaaaggagacattattgtcaccactaagtcaggtggcagaggaacctcaacagtctctttcaagctactcaaacctgagaaaataggcattttggatcagtctgctgtgtgggttgatgaaatgaattattatgatatgcgcactgacaggaacaaaggaattccgcccttgtccttacgtcctgctaacccgcttggcattgagattgaaaaaagtaaattttcgcagaaggacttagaaatgctattccatggaatgagtgctgattttacaagtgagaatttctcagcagcctggtatcttatagagaatcactcaaacaccagttttgagcagctcaaaatggcagtcaccaacctaaagagacaggctaacaagaagagtgagggcagcctggcctatgtgaaaggcggtctcagtacattcttcgaagcacaggatgccctctcagccatccatcaaaaactagaagcagatggaacggaaaaagtagaaggatccatgacgcagaaactggagaatgttctgaacagagcaagtaatactgcagacacattgtttcaagaagtattaggtcggaaagacaaggcagattccactagaaatgcactcaatgtgcttcagcgatttaagtttcttttcaaccttcctctaaatattgaaaggaatattcaaaagggtgattatgatgtggttattaatgattatgaaaaggccaagtcactttttgggaaaacggaggtgcaagttttcaagaaatattatgctgaagtagaaacaaggattgaagctttaagagaattacttctggataaattgcttgagacaccatcaactttacatgaccaaaaacgttacataaggtacctgtctgaccttcatgcgtctggtgaccctgcttggcaatgcattggagcccaacacaagtggatccttcagctcatgcacagttgcaaagagggctacgtgaaagatctgaaaggtaacccaggcctgcacagtcccatgttggatcttgataatgatacacgtccctcagtgttgggccatctcagtcagacagcgtccctgaagaggggcagcagctttcagtctggtcgagacgacacgtggagatacaaaactccccacagggtggcctttgttgaaaaattgacaaaactcgtcttgagccagctgcctaacttctggaaactctggatctcctacgttaatggaagcctcttcagtgagactgctgagaagtcaggccagattgaaagatcaaagaatgtaaggcaaagacaaaatgattttaagaaaatgattcaggaagtaatgcactccctggtgaagcttacccgcggagccctgcttcccctcagcatccgggatggggaagccaagcagtacggaggctgggaggtgaagtgcgagctctccggacagtggctcgctcacgccatccagactgtaagacttactcatgaatcgttgactgcccttgaaattcctaatgacctgttacagactatccaggatctcatcttggatctccgagtacgttgcgtaatggccacgttgcagcacacggcggaagaaataaagagattagctgaaaaagaagactggattgttgacaatgaaggactgacttctctaccatgtcagtttgaacagtgcatcgtgtgttctctgcagtcactgaagggggttctggagtgcaagccgggagaggccagtgtcttccaacaacctaaaacacaggaggaggtttgccagctaagcatcaatataatgcaggtttttatatactgtctggaacagttgagcaccaagcctgatgcagatatagatactacacatctctctgttgatgtttcttcccctgacttgtttggaagtatccatgaagacttcagcttgacctcagaacagcgccttttgatagtcctaagtaattgctgctatctagaacgtcacaccttcctaaatatcgcagaacattttgaaaagcacaacttccagggaatagaaaaaatcacacaggttagcatggcctcattgaaagaactagatcaaagactctttgaaaattacatcgagttgaaagcagatcccatcgttggctccttagaacctggaatttatgcaggatattttgattggaaggactgcctgcctccaacaggtgtcagaaactatttaaaagaagcactggtgaatataattgccgtgcatgcagaggtgttcaccatttccaaagaactggtccctcgggtactatccaaggtgatagaagcagtttctgaagagctcagtcgactgatgcagtgtgtttcatccttcagcaaaaatggagctttacaggcgagacttgaaatctgtgctttgagggacactgtggctgtttacctgacacccgaaagcaagtcaagttttaagcaggctttggaagccctgccccagctttccagtggagcagataaaaagttactggaagagctcctgaacaagttcaagagtagcatgcacttgcagctcacctgtttccaagcagcttcttcaaccatgatgaaaacataaatatctgccacataaaagaagtccaggaaaataacacgtaataagactgttcactctctaagtaccctaaaggtatttggtgtattaaacattgggtttgccatttttctcttttttcttcctctgacttcgaaaattgttggtatacatttcaaccaaaatgacctcatttgaaatgcccaggaagtatttgttttgccattcttactagatcagatcctgtatgactttaaaatacattttaaaatatattttgcatctcagcagaaggttgagtgctgcaggaagagctgcttctgcagggagttttctggaatggcgtggcacatattgaagcatttctcagtgtcccgttcacggaagcgcaggcagctcccacgacacacggagagactgactgatacgagatttggaaagctatgtagacatctttggagctcttactgtcctaaactgtacagctgtgcttaaaacccttatttcatataaatggccttaagttttctaattcaagcgggtttttggaaaaatttatggtctccattaaaatacatattacaactggggtaga

SEQ ID NO: 371840 - DNA, 545 bp, Homo sapiens
accggatggccaagccctgaccacgcttaccagtgaagtcttacgagatcaggtgaaatgctggaacagtgagccggagaaaagaccctccctttaccacctgagtgagattgtggagaatctgctgcctggccaatataaaaaaaaaaaaaatcgatgtcgactcgagtcaccaggtcaccgcggacgaactgcggatccgatgtgtgggcgtacgggcaagtactcatgccgattcatcacctccacgatgtcgactcgagtcaccaggtcaccgcggacgaactgcggatccgatgtgtgggcgtacggtgtatggggggacatcatggtaactggaaatgaaagtttaatctttcacaaatgtgcttgataaagctgttaagaattgtctttcctaagtatgttaactgttgtatctaactcaactgtgagctaagtttaaaaactgcaatcatgaatgtttgtgatattttaaatatctactacagcacattcagccaataaagaatctgcctttaatgtaagttgtaatttacttgaca

SEQ ID NO: 371841 - DNA, 4429 bp, Homo sapiens
ccgcggagtcttcggcgagacctaccgggccctgtctgtgccggccgtgagctgcggcaggacggctggagattacttctctaacaggatcaccagtttgctccacaaagcacaatgtctcgatcacgacaacccccccttgtgaccggcatctctccaaatgaagggataccatggacgaaggtcacaatcaggggagaaaatctggggactggccccaccgacctcataggcttgaccatttgtggacataattgcctcctgacggcagaatggatgtctgcaagtaaaatagtatgtcgagtgggacaagccaaaaatgacaaaggagacattattgtcaccactaagtcaggtggcagaggaacctcaacagtctctttcaagctactcaaacctgagaaaataggcattttggatcagtctgctgtgtgggttgatgaaatgaattattatgatatgcgcactgacaggaacaaaggaattccgcccttgtccttacgtcctgctaacccgcttggcattgagattgaaaaaagtaaattttcgcagaaggacttagaaatgctattccatggaatgagtgctgattttacaagtgagaatttctcagcagcctggtatcttatagagaatcactcaaacaccagttttgagcagctcaaaatggcagtcaccaacctaaagagacaggctaacaagaagagtgagggcagcctggcctatgtgaaaggcggtctcagtacattcttcgaagcacaggatgccctctcagccatccatcaaaaactagaagcagatggaacggaaaaagtagaaggatccatgacgcagaaactggagaatgttctgaacagagcaagtaatactgcagacacattgtttcaagaagtattaggtcggaaagacaaggcagattccactagaaatgcactcaatgtgcttcagcgatttaagtttcttttcaaccttcctctaaatattgaaaggaatattcaaaagggtgattatgatgtggttattaatgattatgaaaaggccaagtcactttttgggaaaacggaggtgcaagttttcaagaaatattatgctgaagtagaaacaaggattgaagctttaagagaattacttctggataaattgcttgagacaccatcaactttacatgaccaaaaacgttacataaggtacctgtctgaccttcatgcgtctggtgaccctgcttggcaatgcattggagcccaacacaagtggatccttcagctcatgcacagttgcaaagagggctacgtgaaagatctgaaaggtaacccaggcctgcacagtcccatgttggatcttgataatgatacacgtccctcagtgttgggccatctcagtcagacagcgtccctgaagaggggcagcagctttcagtctggtcgagacgacacgtggagatacaaaactccccacagggtggcctttgttgaaaaattgacaaaactcgtcttgagccagctgcctaacttctggaaactctggatctcctacgttaatggaagcctcttcagtgagactgctgagaagtcaggccagattgaaagatcaaagaatgtaaggcaaagacaaaatgattttaagaaaatgattcaggaagtaatgcactccctggtgaagcttacccgcggagccctgcttcccctcagcatccgggatggggaagccaagcagtacggaggctgggaggtgaagtgcgagctctccggacagtggctcgctcacgccatccagactgtaagacttactcatgaatcgttgactgcccttgaaattcctaatgacctgttacagactatccaggatctcatcttggatctccgagtacgttgcgtaatggccacgttgcagcacacggcggaagaaataaagagattagctgaaaaagaagactggattgttgacaatgaaggactgacttctctaccatgtcagtttgaacagtgcatcgtgtgttctctgcagtcactgaagggggttctggagtgcaagccgggagaggccagtgtcttccaacaacctaaaacacaggaggaggtttgccagctaagcatcaatataatgcaggtttttatatactgtctggaacagttgagcaccaagcctgatgcagatatagatactacacatctctctgttgatgtttcttcccctgacttgtttggaagtatccatgaagacttcagcttgacctcagaacagcgccttttgatagtcctaagtaattgctgctatctagaacgtcacaccttcctaaatatcgcagaacattttgaaaagcacaacttccagggaatagaaaaaatcacacaggttagcatggcctcattgaaagaactagatcaaagactctttgaaaattacatcgagttgaaagcagatcccatcgttggctccttagaacctggaatttatgcaggatattttgattggaaggactgcctgcctccaacaggtgtcagaaactatttaaaagaagcactggtgaatataattgccgtgcatgcagaggtgttcaccatttccaaagaactggtccctcgggtactatccaaggtgatagaagcagtttctgaagagctcagtcgactgatgcagtgtgtttcatccttcagcaaaaatggagctttacaggcgagacttgaaatctgtgctttgagggacactgtggctgtttacctgacacccgaaagcaagtcaagttttaagcaggctttggaagccctgccccagctttccagtggagcagataaaaagttactggaagagctcctgaacaagttcaagagtagcatgcacttgcagctcacctgtttccaagcagcttcttcaaccatgatgaaaacataaatatctgccacataaaagaagtccaggaaaataacacgtaataagactgttcactctctaagtaccctaaaggtatttggtgtattaaacattgggtttgccatttttctcttttttcttcctctgacttcgaaaattgttggtatacatttcaaccaaaatgacctcatttgaaatgcccaggaagtatttgttttgccattcttactagatcagatcctgtatgactttaaaatacattttaaaatatattttgcatctcagcagaaggttgagtgctgcaggaagagctgcttctgcagggagttttctggaatggcgtggcacatattgaagcatttctcagtgtcccgttcacggaagcgcaggcagctcccacgacacacggagagactgactgatacgagatttggaaagctatgtagacatctttggagctcttactgtcctaaactgtacagctgtgcttaaaacccttatttcatataaatggccttaagttttctaattcaagcgggtttttggaaaaatttatggtctccattaaaatacatattacaactggggtagattatttgtggtccaggtgtctgtgatttaactttgcgttttgctatctgatttttatttttcacagggctaagcatgagctttcattctcactcactcttaatttgtcgtgcgtcactacacatgcacgtgttgcagtccctgaggccctgtgtgttatctgtgatggagtgtgaatgtgtaacgggcactgtgttacactctcaggtgttggcggggcggtcgcagacttcagggtcccctaacggaaaggccaggctccgcgtggacggccaactccctgcccgctccttcagcaggtgactgtctctgccacttcttacctgctgaaggatcttgctcagtagctggaacaatgctgctgtcacacagtctcttctctgaaacttcaggatgctccttggtcaccaggcaatgggagctgtagaccagccgcatgcacttgccccacattcactgctgactggcttcactggaataggttcaggtcaccgggacttctctcagagtcagcagcccacccaactccctcataccgtcgcatctgaaaattttcagagaggaattctctttgtagtcggcttgtcagggttttcaagtttttctatggttatttttaaatctctttttttaaatgctaaaattaatgtcctcattaatgcaagtaattttagagcacagtgtagccatgtacagtttccattatttaaaataaataaatgtgttggttcatttggtgtatggggggacatcatggtaactggaaatgaaagtttaatctttcacaaatgtgcttgataaagctgttaagaattgtctttcctaagtatgttaactgttgtatctaactcaactgtgagctaagtttaaaaactgcaatcatgaatgtttgtgatattttaaatatctactacagcacattcagccaataaagaatctgcctttaatgtaagttgtaatttacttgaca

SEQ ID NO: 371842 - DNA, 2901 bp, Homo sapiens
  misc_feature (2887)..(2887): n is a, c, g, or t
ccgcggagtcttcggcgagacctaccgggccctgtctgtgccggccgtgagctgcggcaggacggctggagattacttctctaacaggatcaccagtttgctccacaaagcacaatgtctcgatcacgacaacccccccttgtgaccggcatctctccaaatgaagggataccatggacgaaggtcacaatcaggggagaaaatctggggactggccccaccgacctcataggcttgaccatttgtggacataattgcctcctgacggcagaatggatgtctgcaagtaaaatagtatgtcgagtgggacaagccaaaaatgacaaaggagacattattgtcaccactaagtcaggtggcagaggaacctcaacagtctctttcaagctactcaaacctgagaaaataggcattttggatcagtctgctgtgtgggttgatgaaatgaattattatgatatgcgcactgacaggaacaaaggaattccgcccttgtccttacgtcctgctaacccgcttggcattgagattgaaaaaagtaaattttcgcagaaggacttagaaatgctattccatggaatgagtgctgattttacaagtgagaatttctcagcagcctggtatcttatagagaatcactcaaacaccagttttgagcagctcaaaatggcagtcaccaacctaaagagacaggctaacaagaagagtgagggcagcctggcctatgtgaaaggcggtctcagtacattcttcgaagcacaggatgccctctcagccatccatcaaaaactagaagcagatggaacggaaaaagtagaaggatccatgacgcagaaactggagaatgttctgaacagagcaagtaatactgcagacacattgtttcaagaagtattaggtcggaaagacaaggcagattccactagaaatgcactcaatgtgcttcagcgatttaagtttcttttcaaccttcctctaaatattgaaaggaatattcaaaagggtgattatgatgtggttattaatgattatgaaaaggccaagtcactttttgggaaaacggaggtgcaagttttcaagaaatattatgctgaagtagaaacaaggattgaagctttaagagaattacttctggataaattgcttgagacaccatcaactttacatgaccaaaaacgttacataaggtacctgtctgaccttcatgcgtctggtgaccctgcttggcaatgcattggagcccaacacaagtggatccttcagctcatgcacagttgcaaagagggctacgtgaaagatctgaaaggtaacccaggcctgcacagtcccatgttggatcttgataatgatacacgtccctcagtgttgggccatctcagtcagacagcgtccctgaagaggggcagcagctttcagtctggtcgagacgacacgtggagatacaaaactccccacagggtggcctttgttgaaaaattgacaaaactcgtcttgagccagctgcctaacttctggaaactctggatctcctacgttaatggaagcctcttcagtgagactgctgagaagtcaggccagattgaaagatcaaagaatgtaaggcaaagacaaaatgattttaagaaaatgattcaggaagtaatgcactccctggtgaagcttacccgcggagccctgcttcccctcagcatccgggatggggaagccaagcagtacggaggctgggaggtgaagtgcgagctctccggacagtggctcgctcacgccatccagactgtaagacttactcatgaatcgttgactgcccttgaaattcctaatgacctgttacagactatccaggatctcatcttggatctccgagtacgttgcgtaatggccacgttgcagcacacggcggaagaaataaagagattagctgaaaaagaagactggattgttgacaatgaaggactgacttctctaccatgtcagtttgaacagtgcatcgtgtgttctctgcagtcactgaagggggttctggagtgcaagccgggagaggccagtgtcttccaacaacctaaaacacaggaggaggtttgccagctaagcatcaatataatgcaggtttttatatactgtctggaacagttgagcaccaagcctgatgcagatatagatactacacatctctctgttgatgtttcttcccctgacttgtttggaagtatccatgaagacttcagcttgacctcagaacagcgccttttgatagtcctaagtaattgctgctatctagaacgtcacaccttcctaaatatcgcagaacattttgaaaagcacaacttccagggaatagaaaaaatcacacaggttagcatggcctcattgaaagaactagatcaaagactctttgaaaattacatcgagttgaaagcagatcccatcgttggctccttagaacctggaatttatgcagaaatgagatgttggaaggccttccaacatctcatttcttagaaagacttgacttttgtttagtctttctaagaaatagatcatggagccaagtgaagtgcactttgtcaaatgtaagggtctgctttgttcttgttgcttttctgttttttaaccttttgttccgccatttaaaaaaagaaaaaaaaaagcttatgtttcttgtcaaatgcagaaatgttccttccgccactcgctgaagttttgcattctggcttgtgcagtttttattgtctgtgtcagacgtacagccagacatgttctctattggcatttttccgattctgttcagatgacagcgaccgccttttcattccccccgccacctgtactcaccctcacgctctttgaagaaatgagatgttggaaggggggatcctctagagcgacngcaggcaggagttg

SEQ ID NO: 371843 - DNA, 1558 bp, Homo sapiens
ccgcggagtcttcggcgagacctaccgggccctgtctgtgccggccgtgagctgcggcaggacggctggagattacttctctaacaggatcaccagtttgctccacaaagcacaatgtctcgatcacgacaacccccccttgtgaccggcatctctccaaatgaagggataccatggacgaaggtcacaatcaggggagaaaatctggggactggccccaccgacctcataggcttgaccatttgtggacataattgcctcctgacggcagaatggatgtctgcaagtaaaatagtatgtcgagtgggacaagccaaaaatgacaaaggagacattattgtcaccactaagtcaggtggcagaggaacctcaacagtctctttcaagctactcaaacctgagaaaataggcattttggatcagtctgctgtgtgggttgatgaaatgaattattatgatatgcgcactgacaggaacaaaggaattccgcccttgtccttacgtcctgctaacccgcttggcattgagattgaaaaaagtaaattttcgcagaaggacttagaaatgctattccatggaatgagtgctgattttacaagtgagaatttctcagcagcctggtatcttatagagaatcactcaaacaccagttttgagcagctcaaaatggcagtcaccaacctaaagagacaggctaacaagaagagtgagggcagcctggcctatgtgaaaggcggtctcagtacattcttcgaagcacaggatgccctctcagccatccatcaaaaactagaagcagatggaacggaaaaagtagaaggatccatgacgcagaaactggagaatgttctgaacagagcaagtaatactgcagacacattgtttcaagaagtattaggtcggaaagacaaggcagattccactagaaatgcactcaatgtgcttcagcgatttaagtttcttttcaaccttcctctaaatattgaaaggaatattcaaaagggtgattatgatgtggttattaatgattatgaaaaggccaagtcactttttgggaaaacggaggtgcaagttttcaagaaatattatgctgaagtagaaacaaggattgaagctttaagagaattacttctggataaattgcttgagacaccatcaactttacatgaccaaaaacgttacataaggtacctgtctgaccttcatgcgtctggtgaccctgcttggcaatgcattggagcccaacacaagtggatccttcagctcatgcacagttgcaaagagggctacgtgaaagatctgaaagatcacacaggccaaaaaggctatgtgaaaaggaccttgtcaatttgtgattgtagcagctggttcttttccactgccctggcttactgtgcatctggaagaagacttctggcagccggaagtcatttcatgtctaaacttgtccccatccttcatagaaaaaaaattttgatgatgaatgtcaaacacacattgaatgctaactttacttggtaattaaaaatactgataattgtaagtacttttgttctgt

SEQ ID NO: 371844 - DNA, 291 bp, Homo sapiens
tgctaatcttcctaatcttatctctagctgctggactcacacaaaccaaactccatccagtctaatcaagtttgcgagcaggtctgtgttttcccactgcgatggccctgcttctgccatctttgaatattctccacccatctccatctatcaaaatccttcgtattcccaaaggcctttgtcagaatctgctcttctcctttttcttcctctgaattacttactgccttgtgccttatcaacctgggagacataagtcctagctctttgtataactccacacttatctgc

SEQ ID NO: 371845 - DNA, 1899 bp, Homo sapiens
ccggccagagcctcaagcttcgctgctgggcagttggctggaggggctgctgctgggaacacctggagtctccgcgggcagatctcatattttggattctggatatattataatgagtgacactttgacagcggatgtcattggtcgaagagttgaagttaatggagaacatgcaacagtacgttttgctggtgttgtccctcccgtggcaggaccctggttaggagtagaatgggacaatcccgagagaggaaagcatgatgggagccacgaagggactgtgtattttaaatgcaggcacccgacaggaggatcctttattcgtccgaacaaggtaaattttggaacagactttcttactgcaattaagaaccgctatgtgttagaagatggaccagaggaagatagaaaagagcaaattgttacaattggaaataaacctgtggagactatcggttttgactctattatgaaacagcaaagtcagctgagcaagttgcaagaagtttctctgaggaactgtgcagtaagttgtgctggtgaaaaaggaggagttgctgaagcatgtcctaatatcagaaaggtagatttgtcaaaaaacctgttgtcatcatgggatgaagtgatacacattgctgatcagctcagacacctggaagtccttaatgtcagtgaaaataaactaaaatttccctccggttcagtattaactggaacgctttctgtactgaaggttttagtcctcaatcaaacaggaataacgtgggctgaggtgctgcggtgtgtcgcggggtgcccaggcctggaggaactctaccttgagtctaacaacattttcatttccgaaaggccaacagatgttctccagacagtcaagttattagatctttcctctaatcaattaattgatgaaaatcagctgtatctgatagcccacctgcccaggttagaacaattaatcctctctgacactggaatttcttctctacattttccggatgctggaattgggtgcaaaacgtccatgttcccatccttgaagtacctggtagtaaacgacaatcagatatcacaatggtcgtttttcaatgagctagagaagttaccaagtctacgggctttgtcctgcctaagaaaccccctgaccaaagaggacaaagaagcagagacggcgcgactactcattatcgccagcattggccagctgaagacgctgaacaaatgtgagattctccccgaggagaggcggagagctgagcttgactaccgaaaagcttttggaaatgagtggaaacaggctggtggacataaggatccggaaaaaaacagactcagcgaagaattcctcacagcccatcccagataccagttcctctgcctgaaatatggtgcacctgaagattgggaactcaaaacacagcaaccacttatgctgaaaaaccagctactaacactgaagataaaataccctcatcaacttgatcagaaagtcctggagaaacaactgccgggctccatgacaattcaaaaggtgaagggattgctgtcacgtcttctcaaagttcctgtgtcagaccttctgttgtcctatgaaagtcccaaaaagccgggcagagaaatcgagctggaaaatgacctaaagtcattacagttttattctgtggaaaatggagattgtctattagtgcgatggtgacaaccaactaataaaatttaaagaccacactgcttatcgtgtctggggttcaccggaaataaatgattcactggaacaattctactgtcaaaacaaagggggtttacaacttgtcctaagtataacaagggatgtattttttgttgggaagtgaccatttctaggcttatacataatagcaataataaaggctttgaacctac

SEQ ID NO: 371846 - DNA, 949 bp, Homo sapiens
ccggccagagcctcaagcttcgctgctgggcagttggctggaggggctgctgctgggaacacctggagtctccgcgggcagatctcatattttggattctggatatattataatgagtgacactttgacagcggatgtcattggtcgaagagttgaagttaatggagaacatgcaacagtacgttttgctggtgttgtccctcccgtggcaggcacccgacaggaggatcctttattcgtccgaacaaggtaaattttggaacagactttcttactgcaattaagaaccgctatgtgttagaagatggaccagaggaagatagaaaagagcaaattgttacaattggaaataaacctgtggagactatcggttttgactctattatgaaacagcaaagtcagctgagcaagttgcaagaagtttctctgaggaactgtgcagtaagttgtgctggtgaaaaaggaggagttgctgaagcatgtcctaatatcagaaaggtagatttgtcaaaaaacctgttgtcatcatgggatgaagtgatacacattgctgatcagctcagacacctggaagtccttaatgtcagtgaaaataaactaaaatttccctccggttcagtattaactggaacgctttctgtactgaaggttttagtcctcaatcaaacaggaataacgtgggctgaggtgctgcggtgtgtcgcggggtgcccaggcctggaggaactctaccttgagtctaacaacattttcatttccgaaaggccaacagatgttctccagacagtcaagttattagatctttcctctaatcaattaattgatgaaaatcagctgtatctgatagcccacctgcccaggttagaacaattaatcctctctgacactggaatttcttctctacattttccggatgctggaattggtatataagattagtaaagttccc

SEQ ID NO: 371847 - DNA, 1814 bp, Homo sapiens
ccggccagagcctcaagcttcgctgctgggcagttggctggaggggctgctgctgggaacacctggagtctccgcgggcagatctcatattttggattctggatatattataatgagtgacactttgacagcggatgtcattggtcgaagagttgaagttaatggagaacatgcaacagtacgttttgctggtgttgtccctcccgtggcaggcacccgacaggaggatcctttattcgtccgaacaaggtaaattttggaacagactttcttactgcaattaagaaccgctatgtgttagaagatggaccagaggaagatagaaaagagcaaattgttacaattggaaataaacctgtggagactatcggttttgactctattatgaaacagcaaagtcagctgagcaagttgcaagaagtttctctgaggaactgtgcagtaagttgtgctggtgaaaaaggaggagttgctgaagcatgtcctaatatcagaaaggtagatttgtcaaaaaacctgttgtcatcatgggatgaagtgatacacattgctgatcagctcagacacctggaagtccttaatgtcagtgaaaataaactaaaatttccctccggttcagtattaactggaacgctttctgtactgaaggttttagtcctcaatcaaacaggaataacgtgggctgaggtgctgcggtgtgtcgcggggtgcccaggcctggaggaactctaccttgagtctaacaacattttcatttccgaaaggccaacagatgttctccagacagtcaagttattagatctttcctctaatcaattaattgatgaaaatcagctgtatctgatagcccacctgcccaggttagaacaattaatcctctctgacactggaatttcttctctacattttccggatgctggaattgggtgcaaaacgtccatgttcccatccttgaagtacctggtagtaaacgacaatcagatatcacaatggtcgtttttcaatgagctagagaagttaccaagtctacgggctttgtcctgcctaagaaaccccctgaccaaagaggacaaagaagcagagacggcgcgactactcattatcgccagcattggccagctgaagacgctgaacaaatgtgagattctccccgaggagaggcggagagctgagcttgactaccgaaaagcttttggaaatgagtggaaacaggctggtggacataaggatccggaaaaaaacagactcagcgaagaattcctcacagcccatcccagataccagttcctctgcctgaaatatggtgcacctgaagattgggaactcaaaacacagcaaccacttatgctgaaaaaccagctactaacactgaagataaaataccctcatcaacttgatcagaaagtcctggagaaacaactgccgggctccatgacaattcaaaaggtgaagggattgctgtcacgtcttctcaaagttcctgtgtcagaccttctgttgtcctatgaaagtcccaaaaagccgggcagagaaatcgagctggaaaatgacctaaagtcattacagttttattctgtggaaaatggagattgtctattagtgcgatggtgacaaccaactaataaaatttaaagaccacactgcttatcgtgtctggggttcaccggaaataaatgattcactggaacaattctactgtcaaaacaaagggggtttacaacttgtcctaagtataacaagggatgtattttttgttgggaagtgaccatttctaggcttatacataatagcaataataaaggctttgaacctac

SEQ ID NO: 371848 - DNA, 1757 bp, Homo sapiens
ccggccagagcctcaagcttcgctgctgggcagttggctggaggggctgctgctgggaacacctggagtctccgcgggcagatctcatattttggattctggatatattataatgagtgacactttgacagcggatgtcattggtcgaagagttgaagttaatggagaacatgcaacagtacgttttgctggtgttgtccctcccgtggcaggaccctggttaggagtagaatgggacaatcccgagagaggaaagcatgatgggagccacgaagggactgtgtattttaaatgcaggcacccgacaggaggatcctttattcgtccgaacaaggtaaattttggaacagactttcttactgcaattaagaaccgctatgtgttagaagatggaccagaggaagatagaaaagagcaaattgttacaattggaaataaacctgtggagactatcggttttgactctattatgaaacagcaaagtcagctgagcaagttgcaagaagtttctctgaggaactgtgcagtaagttgtgctggtgaaaaaggaggagttgctgaagcatgtcctaatatcagaaaggtagatttgtcaaaaaacctgttgtcatcatgggatgaagtgatacacattgctgatcagctcagacacctggaagtccttaatgtcagtgaaaataaactaaaatttccctccggttcagtattaactggaacgctttctgtactgaaggttttagtcctcaatcaaacaggaataacgtgggctgaggccaacagatgttctccagacagtcaagttattagatctttcctctaatcaattaattgatgaaaatcagctgtatctgatagcccacctgcccaggttagaacaattaatcctctctgacactggaatttcttctctacattttccggatgctggaattgtggtcgtttttcaatgagctagagaagttaccaagtctacgggctttgtcctgcctaagaaaccccctgaccaaagaggacaaagaagcagagacggcgcgactactcattatcgccagcattggccagctgaagacgctgaacaaatgtgagattctccccgaggagaggcggagagctgagcttgactaccgaaaagcttttggaaatgagtggaaacaggctggtggacataaggatccggaaaaaaacagactcagcgaagaattcctcacagcccatcccagataccagttcctctgcctgaaatatggtgcacctgaagattgggaactcaaaacacagcaaccacttatgctgaaaaaccagctactaacactgaagataaaataccctcatcaacttgatcagaaagtcctggagaaacaactgccgggctccatgacaattcaaaaggtgaagggattgctgtcacgtcttctcaaagttcctgtgtcagaccttctgttgtcctatgaaagtcccaaaaagccgggcagagaaatcgagctggaaaatgacctaaagtcattacagttttattctgtggaaaatggagattgtctattagtgcgatggtgacaaccaactaataaaatttaaagaccacactgcttatcgtgtctggggttcaccggaaataaatgattcactggaacaattctactgtcaaaacaaagggggtttacaacttgtcctaagtataacaagggatgtattttttgttgggaagtgaccatttctaggcttatacataatagcaataataaaggctttgaacctac

SEQ ID NO: 371849 - DNA, 1176 bp, Homo sapiens
gaaacagccagcagaggccgcctgagcctgaaccgagtttctcttccaggtgctgcggtgtgtcgcggggtgcccaggcctggaggaactctaccttgagtctaacaacattttcatttccgaaaggccaacagatgttctccagacagtcaagttattagatctttcctctaatcaattaattgatgaaaatcagctgtatctgatagcccacctgcccaggttagaacaattaatcctctctgacactggaatttcttctctacattttccggatgctggaattgggtgcaaaacgtccatgttcccatccttgaagtacctggtagtaaacgacaatcagatatcacaatggtcgtttttcaatgagctagagaagttaccaagtctacgggctttgtcctgcctaagaaaccccctgaccaaagaggacaaagaagcagagacggcgcgactactcattatcgccagcattggccagctgaagacgctgaacaaatgtgagattctccccgaggagaggcggagagctgagcttgactaccgaaaagcttttggaaatgagtggaaacaggctggtggacataaggatccggaaaaaaacagactcagcgaagaattcctcacagcccatcccagataccagttcctctgcctgaaatatggtgcacctgaagattgggaactcaaaacacagcaaccacttatgctgaaaaaccagctactaacactgaagataaaataccctcatcaacttgatcagaaagtcctggagaaacaactgccgggctccatgacaattcaaaaggtgaagggattgctgtcacgtcttctcaaagttcctgtgtcagaccttctgttgtcctatgaaagtcccaaaaagccgggcagagaaatcgagctggaaaatgacctaaagtcattacagttttattctgtggaaaatggagattgtctattagtgcgatggtgacaaccaactaataaaatttaaagaccacactgcttatcgtgtctggggttcaccggaaataaatgattcactggaacaattctactgtcaaaacaaagggggtttacaacttgtcctaagtataacaagggatgtattttttgttgggaagtgaccatttctaggcttatacataatagcaataataaaggctttgaacctac

SEQ ID NO: 371850 - DNA, 1499 bp, Homo sapiens
ccggccagagcctcaagcttcgctgctgggcagttggctggaggggctgctgctgggaacacctggagtctccgcgggcagatctcatattttggattctggatatattataatgagtgacactttgacagcggatgtcattggtcgaagagttgaagttaatggagaacatgcaacagtacgttttgctggtgttgtccctcccgtggcaggcacccgacaggaggatcctttattcgtccgaacaaggtaaattttggaacagactttcttactgcaattaagaaccgctatgtgttagaagatggaccagaggaagatagaaaagagcaaattgttacaattggaaataaacctgtggagactatcggttttgactctattatgaaacagcaaagatatcagaaaggtagatttgtcaaaaaacctgttgtcatcatgggatgaagtgatacacattgctgatcagctcagacacctggaagtccttaatgtcagtgaaaataaactaaaatttccctccggttcagtattaactggaacgctttctgtactgaaggttttagtcctcaatcaaacaggaataacgtgggctgaggtgctgcggtgtgtcgcggggtgcccaggcctggaggaactctaccttgagtctaacaacattttcatttccgaaagtggtcgtttttcaatgagctagagaagttaccaagtctacgggctttgtcctgcctaagaaaccccctgaccaaagaggacaaagaagcagagacggcgcgactactcattatcgccagcattggccagctgaagacgctgaacaaatgtgagattctccccgaggagaggcggagagctgagcttgactaccgaaaagcttttggaaatgagtggaaacaggctggtggacataaggatccggaaaaaaacagactcagcgaagaattcctcacagcccatcccagataccagttcctctgcctgaaatatggtgcacctgaagattgggaactcaaaacacagcaaccacttatgctgaaaaaccagctactaacactgaagataaaataccctcatcaacttgatcagaaagtcctggagaaacaactgccgggctccatgacaattcaaaaggtgaagggattgctgtcacgtcttctcaaagttcctgtgtcagaccttctgttgtcctatgaaagtcccaaaaagccgggcagagaaatcgagctggaaaatgacctaaagtcattacagttttattctgtggaaaatggagattgtctattagtgcgatggtgacaaccaactaataaaatttaaagaccacactgcttatcgtgtctggggttcaccggaaataaatgattcactggaacaattctactgtcaaaacaaagggggtttacaacttgtcctaagtataacaagggatgtattttttgttgggaagtgaccatttctaggcttatacataatagcaataataaaggctttgaacctac

SEQ ID NO: 371851 - DNA, 2083 bp, Homo sapiens
ttaactgtttcaatacatacaaaaaggccagtttttattctaaaataaagaacatttattatcacaagttggataaaaacacacagcttttacaaaaatgatttttgatagaaaaatatgtttgaatacactgtgatatttgtaggaacaccacactattgctgtatctccagctaaagcttcaaggaaactctatttcttataatcaaaatatccactatttaccacaacccgtctttggaaagaagttcatagtgtattctgaacaaaccaaagcatttactcggaagttacattcccatgcctggcagtcacttgtgtatgtttaatacagttacacatgatgtaattacagaatggcggcgctggaagggaccttgtagatcatttagttggcaccctaattttacagagggggaactaaggccagagttgagagatgtcctcaggatacctgagtcccattccagtgttcgttcagtaattcataaggaagtcatcataaaggtttaaaaagaaaacgttaatgactcgctccctttattcttctgtgctgagagtatcattctggtttattcagattaagaaagaaatacactactgaaatggtatgaaactcactgtcaaagggcacttaggtccgttggctccgtttcccacagttccccaaatgaacaggtggtacaagactcaggctttcccctaattacttacttgggtaaagtgacttgggtaaaatgaaagatacagccaggcgctgggctcatgcttgtaatcccagcactttggggggccaaggcgggcggatcacgaggtcaggagttcaagaccagcctggccaacatggtgaaaccccgtctctactaaaaatacaaaagttagctgggtgtggtgatgggcaccagctactcaggaggctgaggcaggagaattgtttgaacccgggaagcggaggttgcagtgagccgagattacaccattgcactccagcctgggcgacagagcaagacttacttaagtaagtaagtaagtcagtctcaaaaaaaaaaaaaaaaaaaaaaagacagatacagctatcattgcaatgatactgtggtctcatcacatgagctagttttacaggtaactgtcatttgagagaacgaatggacttttcttgtcttttgataggctccatgacaattcaaaaggtgaagggattgctgtcacgtcttctcaaagttcctgtgtcagaccttctgttgtcctatgaaagtcccaaagtaagttgcccagcaaaatacaaagtcaaagtcaagcttagtcctcgtattatgacattaaactgtctctagatagcaacagtttgattctaaatggagaccatgggtctgtttgtttgattttaagggtaagctactgcctggggacggggtgggggaagagtatgtgtagcatgctttatcggatctgtcttaatcacatccttccccaccttcgttctaattttagaagccgggcagagaaatcgagctggaaaatgacctaaagtcattacagttttattctgtggaaaatggagattgtctattagtgcgatggtgacaaccaactaataaaatttaaagaccacactgcttatcgtgtctggggttcaccggaaataaatgattcactggaacaattctactgtcaaaacaaagggggtttacaacttgtcctaagtataacaagggatgtattttttgttgggaagtgaccatttctaggcttatacataatagcaataataaaggctttgaacctactaaaaaaattttctgatcttatttcatatttatttttacagctcatcactgcatttcatgataagatttaaatattaaatagaaagaaactagctagcctaataaaatctgaacacagttaatatctgtcataagactagttttaatggaattctctattgaaactactattttaaagggttactagaaatgatttggttggtcattttgggaaatgtcccttaaacttggggagacatcctctactatgtataacaatatgctattatctgtcttctcagttgcactatttctaa

SEQ ID NO: 371852 - DNA, 1787 bp, Homo sapiens
ttaactgtttcaatacatacaaaaaggccagtttttattctaaaataaagaacatttattatcacaagttggataaaaacacacagcttttacaaaaatgatttttgatagaaaaatatgtttgaatacactgtgatatttgtaggaacaccacactattgctgtatctccagctaaagcttcaaggaaactctatttcttataatcaaaatatccactatttaccacaacccgtctttggaaagaagttcatagtgtattctgaacaaaccaaagcatttactcggaagttacattcccatgcctggcagtcacttgtgtatgtttaatacagttacacatgatgtaattacagaatggcggcgctggaagggaccttgtagatcatttagttggcaccctaattttacagagggggaactaaggccagagttgagagatgtcctcaggatacctgagtcccattccagtgttcgttcagtaattcataaggaagtcatcataaaggtttaaaaagaaaacgttaatgactcgctccctttattcttctgtgctgagagtatcattctggtttattcagattaagaaagaaatacactactgaaatggtatgaaactcactgtcaaagggcacttaggtccgttggctccgtttcccacagttccccaaatgaacaggtggtacaagactcaggctttcccctaattacttacttgggtaaagtgacttgggtaaaatgaaagatacagccaggcgctgggctcatgcttgtaatcccagcactttggggggccaaggcgggcggatcacgaggtcaggagttcaagaccagcctggccaacatggtgaaaccccgtctctactaaaaatacaaaagttagctgggtgtggtgatgggcaccagctactcaggaggctgaggcaggagaattgtttgaacccgggaagcggaggttgcagtgagccgagattacaccattgcactccagcctgggcgacagagcaagacttacttaagtaagtaagtaagtcagtctcaaaaaaaaaaaaaaaaaaaaaaagacagatacagctatcattgcaatgatactgtggtctcatcacatgagctagttttacaggtaactgtcatttgagagaacgaatggacttttcttgtcttttgataggctccatgacaattcaaaaggtgaagggattgctgtcacgtcttctcaaagttcctgtgtcagaccttctgttgtcctatgaaagtcccaaagtaagttgcccagcaaaatacaaagtcaaagtcaagcttagtcctcgtattatgacattaaactgtctctagatagcaacagtttgattctaaatggagaccatgggtctgtttgtttgattttaagggtaagctactgcctggggacggggtgggggaagagtatgtgtagcatgctttatcggatctgtcttaatcacatccttccccaccttcgttctaattttagaagccgggcagagaaatcgagctggaaaatgacctaaagtcattacagttttattctgtggaaaatggagattgtctattagtgcgatggtgacaaccaactaataaaatttaaagaccacactgcttatcgtgtctggggttcaccggaaataaatgattcactggaacaattctactgtcaaaacaaagggggtttacaacttgtcctaagtataacaagggatgtattttttgttgggaagtgaccatttctaggcttatacataatagcaataataaaggctttgaacctac

SEQ ID NO: 371853 - DNA, 2375 bp, Homo sapiens
  misc_feature (1)..(1): n is a, c, g, or t
ncgttatagacctggctcccgtgcaagccgctgtcgcccgcgcctcgcggggttttccaccccctcttccgcccgcgcttttttttgggggacaccccgcgccgtcggtccgcccgtgtgtttctgtgaaccgtcgtggaccgttgcattcttcactcgtggtggcgccgcgcccccccacgcctgtgttttgaacctttttctgttcgggcggcgcgcgccccaccactatctttgtttgtgttcgttggtcttttcggctgacgactggtgttttttggtgtcttgtgtgtgtgttttttttttttttttttttttgtttttttttattctaaaataaagaacatttattatcacaagttggataaaaacacacagcttttacaaaaatgatttttgatagaaaaatatgtttgaatacactgtgatatttgtaggaacaccacactattgctgtatctccagctaaagcttcaaggaaactctatttcttataatcaaaatatccactatttaccacaacccgtctttggaaagaagttcatagtgtattctgaacaaaccaaagcatttactcggaagttacattcccatgcctggcagtcacttgtgtatgtttaatacagttacacatgatgtaattacagaatggcggcgctggaagggaccttgtagatcatttagttggcaccctaattttacagagggggaactaaggccagagttgagagatgtcctcaggatacctgagtcccattccagtgttcgttcagtaattcataaggaagtcatcataaaggtttaaaaagaaaacgttaatgactcgctccctttattcttctgtgctgagagtatcattctggtttattcagattaagaaagaaatacactactgaaatggtatgaaactcactgtcaaagggcacttaggtccgttggctccgtttcccacagttccccaaatgaacaggtggtacaagactcaggctttcccctaattacttacttgggtaaagtgacttgggtaaaatgaaagatacagccaggcgctgggctcatgcttgtaatcccagcactttggggggccaaggcgggcggatcacgaggtcaggagttcaagaccagcctggccaacatggtgaaaccccgtctctactaaaaatacaaaagttagctgggtgtggtgatgggcaccagctactcaggaggctgaggcaggagaattgtttgaacccgggaagcggaggttgcagtgagccgagattacaccattgcactccagcctgggcgacagagcaagacttacttaagtaagtaagtaagtcagtctcaaaaaaaaaaaaaaaaaaaaaaagacagatacagctatcattgcaatgatactgtggtctcatcacatgagctagttttacaggtaactgtcatttgagagaacgaatggacttttcttgtcttttgataggctccatgacaattcaaaaggtgaagggattgctgtcacgtcttctcaaagttcctgtgtcagaccttctgttgtcctatgaaagtcccaaagtaagttgcccagcaaaatacaaagtcaaagtcaagcttagtcctcgtattatgacattaaactgtctctagatagcaacagtttgattctaaatggagaccatgggtctgtttgtttgattttaagggtaagctactgcctggggacggggtgggggaagagtatgtgtagcatgctttatcggatctgtcttaatcacatccttccccaccttcgttctaattttagaagccgggcagagaaatcgagctggaaaatgacctaaagtcattacagttttattctgtggaaaatggagattgtctattagtgcgatggtgacaaccaactaataaaatttaaagaccacactgcttatcgtgtctggggttcaccggaaataaatgattcactggaacaattctactgtcaaaacaaagggggtttacaacttgtcctaagtataacaagggatgtattttttgttgggaagtgaccatttctaggcttatacataatagcaataataaaggctttgaacctactaaaaaaattttctgatcttatttcatatttatttttacagctcatcactgcatttcatgataagatttaaatattaaatagaaagaaactagctagcctaataaaatctgaacacagttaatatctgtcataagactagttttaatggaattctctattgaaactactattttaaagggttactagaaatgatttggttggtcattttgggaaatgtcccttaaacttggggagacatcctctactatgtataacaatatgctattatctgtcttctcagttgcactatttctaa

SEQ ID NO: 371854 - DNA, 1164 bp, Homo sapiens
ccggccagagcctcaagcttcgctgctgggcagttggctggaggggctgctgctgggaacacctggagtctccgcgggcagatctcatattttggattctggatatattataatgagtgacactttgacagcggatgtcattggtcgaagagttgaagttaatggagaacatgcaacagtacgttttgctggtgttgtccctcccgtggcaggaccctggttaggagtagaatgggacaatcccgagagaggaaagcatgatgggagccacgaagggactgtgtattttaaatgcaggcacccgacaggaggatcctttattcgtccgaacaaggtaaattttggaacagactttcttactgcaattaagaaccgctatgtgttagaagatggaccagaggaagatagaaaagagcaaattgttacaattggaaataaacctgtggagactatcggttttgactctattatgaaacagcaaagtcagctgagcaagttgcaagaagtttctctgaggaactgtgcagtaagttgtgctggtgaaaaaggaggagttgctgaagcatgtcctaatatcagaaaggtagatttgtcaaaaaacctgttgtcatcatgggatgaagtgatacacattgctgatcagctcagacacctggaagtccttaatgtcagtgaaaataaactaaaatttccctccggttcagtattaactggaacgctttctgtactgaaggttttagtcctcaatcaaacaggaataacgtgggctgaggtgctgcggtgtgtcgcggggtgcccaggcctggaggaactctaccttgagtctaacaacattttcatttccgaaaggccaacagatgttctccagacagtcaagttattagatctttcctctaatcaattaattgatgaaaatcagctgtatctgatagcccacctgcccaggtaatttgcccctaaatgcctgatacaatagtgttcagtcaattcttagtgaagcagttttcatatgctatgtatgctttctcaatagaaacgtggtaacaatgatggaatttctaaattgagtaattccctttgggaaattttcatttgaattcatttagaaaatttacttgtgaaccctgtataatgtggactatgtctgtaccagataatttgaag

SEQ ID NO: 371855 - DNA, 1018 bp, Homo sapiens
tactgagcacccagcctggcactgcacggtctggtggaaacgtgagaagtgtcctgtggatcgtgtctcaggtggcaccaggtttctgtcagcgcagaaagagaactgttaccaaaggtgacactcggggaaaacatttgaagtatttgaaggcagtcttctcttgctagttttgagtcaggacacctaaggaacaatgatgtaatacacatgtaaacatgttgcttttcatttgttgtcttttgttgagtttcactggtcattaacaatgagctagataagctacagagtctgcagctctgggtagatagaagattctgcccttggaagtggtcgttgtccatcactcctaaaaatcacactgaataaaggcagctccatgtgtcctgggaaaggcacaggctctctggacgcttacctatcctttgtttgtttgtttgttttgtttttacttatagtggcctttggtttatcattcatctcttttgctttcttaaacagaatatggtgcacctgaagattgggaactcaaaacacagcaaccacttatgctgaaaaaccagctactaacactgaagataaaataccctcatcaacttgatcagaaagtcctggagaaacaactgccgggctccatgacaattcaaaaggtgaagggattgctgtcacgtcttctcaaagttcctgtgtcagaccttctgttgtcctatgaaagtcccaaaaagccgggcagagaaatcgagctggaaaatgacctaaagtcattacagttttattctgtggaaaatggagattgtctattagtgcgatggtgacaaccaactaataaaatttaaagaccacactgcttatcgtgtctggggttcaccggaaataaatgattcactggaacaattctactgtcaaaacaaagggggtttacaacttgtcctaagtataacaagggatgtattttttgttgggaagtgaccatttctaggcttatacataatagcaataataaaggctttgaacctac

SEQ ID NO: 371856 - DNA, 1758 bp, Homo sapiens
  misc_feature (19)..(19): n is a, c, g, or t
gaggtgactctaaggatcncacaaccatagaatggcggcgctggaagggaccttgtagatcatttagttggcaccctaattttacagagggggaactaaggccagagttgagagatgtcctcaggatacctgagtcccattccagtgttcgttcagtaattcataaggaagtcatcataaaggtttaaaaagaaaacgttaatgactcgctccctttattcttctgtgctgagagtatcattctggtttattcagattaagaaagaaatacactactgaaatggtatgaaactcactgtcaaagggcacttaggtccgttggctccgtttcccacagttccccaaatgaacaggtggtacaagactcaggctttcccctaattacttacttgggtaaagtgacttgggtaaaatgaaagatacagccaggcgctgggctcatgcttgtaatcccagcactttggggggccaaggcgggcggatcacgaggtcaggagttcaagaccagcctggccaacatggtgaaaccccgtctctactaaaaatacaaaagttagctgggtgtggtgatgggcaccagctactcaggaggctgaggcaggagaattgtttgaacccgggaagcggaggttgcagtgagccgagattacaccattgcactccagcctgggcgacagagcaagacttacttaagtaagtaagtaagtcagtctcaaaaaaaaaaaaaaaaaaaaaaagacagatacagctatcattgcaatgatactgtggtctcatcacatgagctagttttacaggtaactgtcatttgagagaacgaatggacttttcttgtcttttgataggctccatgacaattcaaaaggtgaagggattgctgtcacgtcttctcaaagttcctgtgtcagaccttctgttgtcctatgaaagtcccaaagtaagttgcccagcaaaatacaaagtcaaagtcaagcttagtcctcgtattatgacattaaactgtctctagatagcaacagtttgattctaaatggagaccatgggtctgtttgtttgattttaagggtaagctactgcctggggacggggtgggggaagagtatgtgtagcatgctttatcggatctgtcttaatcacatccttccccaccttcgttctaattttagaagccgggcagagaaatcgagctggaaaatgacctaaagtcattacagttttattctgtggaaaatggagattgtctattagtgcgatggtgacaaccaactaataaaatttaaagaccacactgcttatcgtgtctggggttcaccggaaataaatgattcactggaacaattctactgtcaaaacaaagggggtttacaacttgtcctaagtataacaagggatgtattttttgttgggaagtgaccatttctaggcttatacataatagcaataataaaggctttgaacctactaaaaaaattttctgatcttatttcatatttatttttacagctcatcactgcatttcatgataagatttaaatattaaatagaaagaaactagctagcctaataaaatctgaacacagttaatatctgtcataagactagttttaatggaattctctattgaaactactattttaaagggttactagaaatgatttggttggtcattttgggaaatgtcccttaaacttggggagacatcctctactatgtataacaatatgctattatctgtcttctcagttgcactatttctaa

SEQ ID NO: 371857 - DNA, 1846 bp, Homo sapiens
  misc_feature (80)..(80): n is a, c, g, or t
tgacagcatagaagatcaggactggggggtaggctaggatgtgggggcaatgaatgaagcgaacagattttcgttcattntggttctcagagttgttataattttttatttttatgggcttggtgagggaggtagggaccttgtagatcatttagttggcaccctaattttacagagggggaactaaggccagagttgagagatgtcctcaggatacctgagtcccattccagtgttcgttcagtaattcataaggaagtcatcataaaggtttaaaaagaaaacgttaatgactcgctccctttattcttctgtgctgagagtatcattctggtttattcagattaagaaagaaatacactactgaaatggtatgaaactcactgtcaaagggcacttaggtccgttggctccgtttcccacagttccccaaatgaacaggtggtacaagactcaggctttcccctaattacttacttgggtaaagtgacttgggtaaaatgaaagatacagccaggcgctgggctcatgcttgtaatcccagcactttggggggccaaggcgggcggatcacgaggtcaggagttcaagaccagcctggccaacatggtgaaaccccgtctctactaaaaatacaaaagttagctgggtgtggtgatgggcaccagctactcaggaggctgaggcaggagaattgtttgaacccgggaagcggaggttgcagtgagccgagattacaccattgcactccagcctgggcgacagagcaagacttacttaagtaagtaagtaagtcagtctcaaaaaaaaaaaaaaaaaaaaaaagacagatacagctatcattgcaatgatactgtggtctcatcacatgagctagttttacaggtaactgtcatttgagagaacgaatggacttttcttgtcttttgataggctccatgacaattcaaaaggtgaagggattgctgtcacgtcttctcaaagttcctgtgtcagaccttctgttgtcctatgaaagtcccaaagtaagttgcccagcaaaatacaaagtcaaagtcaagcttagtcctcgtattatgacattaaactgtctctagatagcaacagtttgattctaaatggagaccatgggtctgtttgtttgattttaagggtaagctactgcctggggacggggtgggggaagagtatgtgtagcatgctttatcggatctgtcttaatcacatccttccccaccttcgttctaattttagaagccgggcagagaaatcgagctggaaaatgacctaaagtcattacagttttattctgtggaaaatggagattgtctattagtgcgatggtgacaaccaactaataaaatttaaagaccacactgcttatcgtgtctggggttcaccggaaataaatgattcactggaacaattctactgtcaaaacaaagggggtttacaacttgtcctaagtataacaagggatgtattttttgttgggaagtgaccatttctaggcttatacataatagcaataataaaggctttgaacctactaaaaaaattttctgatcttatttcatatttatttttacagctcatcactgcatttcatgataagatttaaatattaaatagaaagaaactagctagcctaataaaatctgaacacagttaatatctgtcataagactagttttaatggaattctctattgaaactactattttaaagggttactagaaatgatttggttggtcattttgggaaatgtcccttaaacttggggagacatcctctactatgtataacaatatgctattatctgtcttctcagttgcactatttctaa

SEQ ID NO: 371858 - DNA, 1543 bp, Homo sapiens
tactgagcacccagcctggcactgcacggtctggtggaaacgtgagaagtgtcctgtggatcgtgtctcaggtggcaccaggtttctgtcagcgcagaaagagaactgttaccaaaggtgacactcggggaaaacatttgaagtatttgaaggcagtcttctcttgctagttttgagtcaggacacctaaggaacaatgatgtaatacacatgtaaacatgttgcttttcatttgttgtcttttgttgagtttcactggtcattaacaatgagctagataagctacagagtctgcagctctgggtagatagaagattctgcccttggaagtggtcgttgtccatcactcctaaaaatcacactgaataaaggcagctccatgtgtcctgggaaaggcacaggctctctggacgcttacctatcctttgtttgtttgtttgttttgtttttacttatagtggcctttggtttatcattcatctcttttgctttcttaaacagaatatggtgcacctgaagattgggaactcaaaacacagcaaccacttatgctgaaaaaccagctactaacactgaagataaaataccctcatcaacttgatcagaaagtcctggagaaacaactgccgggctccatgacaattcaaaaggtgaagggattgctgtcacgtcttctcaaagttcctgtgtcagaccttctgttgtcctatgaaagtcccaaagtaagttgcccagcaaaatacaaagtcaaagtcaagcttagtcctcgtattatgacattaaactgtctctagatagcaacagtttgattctaaatggagaccatgggtctgtttgtttgattttaagggtaagctactgcctggggacggggtgggggaagagtatgtgtagcatgctttatcggatctgtcttaatcacatccttccccaccttcgttctaattttagaagccgggcagagaaatcgagctggaaaatgacctaaagtcattacagttttattctgtggaaaatggagattgtctattagtgcgatggtgacaaccaactaataaaatttaaagaccacactgcttatcgtgtctggggttcaccggaaataaatgattcactggaacaattctactgtcaaaacaaagggggtttacaacttgtcctaagtataacaagggatgtattttttgttgggaagtgaccatttctaggcttatacataatagcaataataaaggctttgaacctactaaaaaaattttctgatcttatttcatatttatttttacagctcatcactgcatttcatgataagatttaaatattaaatagaaagaaactagctagcctaataaaatctgaacacagttaatatctgtcataagactagttttaatggaattctctattgaaactactattttaaagggttactagaaatgatttggttggtcattttgggaaatgtcccttaaacttggggagacatcctctactatgtataacaatatgctattatctgtcttctcagttgcactatttctaa

SEQ ID NO: 371859 - DNA, 429 bp, Homo sapiens
ttcacggtgaaaaaattttattttccatacaggccaacagatgttctccagacagtcaagttattagatctttcctctaatcaattaattgatgaaaatcagctgtatctgatagcccacctgcccaggtaatttgcccctaaatgcctgatacaatagtgttcagtcaattcttagtgaagcagttttcatatgctatgtatgctttctcaatagaaacgtggtaacaatgatggaatttctaaattgagtaattccctttgggaaattttcatttgaattcatttagaaaatttacttgtgaaccctgtataatgtggactatgtctgtaccagataatttgaagaatgaataatttgaccctggtgataatgcggaaagtcttcattcattaaactccgggcagtagaccgtgtctctttcctctg

SEQ ID NO: 371860 - DNA, 414 bp, Homo sapiens
tgggattaaaaacccagggtgtaggaaaaaaatttacaaaccgagtctggttgataccccatagcattttacattgttctgtgtaatcaaattgtacattttgaatttcaggttagaacaattaatcctctctgacactggaatttcttctctacattttccggatgctggaattggtatataagattagtaaagttccccactgcccccccacactatacttcagctactttcacttctactgtgtaacttcattcctctttttatagggtgcaaaacgtccatgttcccatccttgaagtacctggtagtaaacgacaatcagatatcacaagtaagagctgctcggagtatgcccagcacactgttgcctctttccactctcatggcagagtttggaggttccttctacca

SEQ ID NO: 371861 - DNA, 2195 bp, Homo sapiens
ccggccagagcctcaagcttcgctgctgggcagttggctggaggggctgctgctgggaacacctggagtctccgcgggcagatctcatattttggattctggatatattataatgagtgacactttgacagcggatgtcattggtcgaagagttgaagttaatggagaacatgcaacagtacgttttgctggtgttgtccctcccgtggcaggaccctggttaggagtagaatgggacaatcccgagagaggaaagcatgatgggagccacgaagggactgtgtattttaaatgcaggcacccgacaggaggatcctttattcgtccgaacaaggtaaattttggaacagactttcttactgcaattaagaaccgctatgtgttagaagatggaccagaggaagatagaaaagagcaaattgttacaattggaaataaacctgtggagactatcggttttgactctattatgaaacagcaaagtcagctgagcaagttgcaagaagtttctctgaggaactgtgcagtaagttgtgctggtgaaaaaggaggagttgctgaagcatgtcctaatatcagaaaggtagatttgtcaaaaaacctgttgtcatcatgggatgaagtgatacacattgctgatcagctcagacacctggaagtccttaatgtcagtgaaaataaactaaaatttccctccggttcagtattaactggaacgctttctgtactgaaggttttagtcctcaatcaaacaggaataacgtgggctgaggtgctgcggtgtgtcgcggggtgcccaggcctggaggaactctaccttgagtctaacaacattttcatttccgaaaggccaacagatgttctccagacagtcaagttattagatctttcctctaatcaattaattgatgaaaatcagctgtatctgatagcccacctgcccaggttagaacaattaatcctctctgacactggaatttcttctctacattttccggatgctggaattgggtgcaaaacgtccatgttcccatccttgaagtacctggtagtaaacgacaatcagatatcacaatggtcgtttttcaatgagctagagaagttaccaagtctacgggctttgtcctgcctaagaaaccccctgaccaaagaggacaaagaagcagagacggcgcgactactcattatcgccagcattggccagctgaagacgctgaacaaatgtgagattctccccgaggagaggcggagagctgagcttgactaccgaaaagcttttggaaatgagtggaaacaggctggtggacataaggatccggaaaaaaacagactcagcgaagaattcctcacagcccatcccagataccagttcctctgcctgaaatatggtgcacctgaagattgggaactcaaaacacagcaaccacttatgctgaaaaaccagctactaacactgaagataaaataccctcatcaacttgatcagaaagtcctggagaaacaactgccgggctccatgacaattcaaaaggtgaagggattgctgtcacgtcttctcaaagttcctgtgtcagaccttctgttgtcctatgaaagtcccaaaaagccgggcagagaaatcgagctggaaaatgacctaaagtcattacagttttattctgtggaaaatggagattgtctattagtgcgatggtgacaaccaactaataaaatttaaagaccacactgcttatcgtgtctggggttcaccggaaataaatgattcactggaacaattctactgtcaaaacaaagggggtttacaacttgtcctaagtataacaagggatgtattttttgttgggaagtgaccatttctaggcttatacataatagcaataataaaggctttgaacctactaaaaaaattttctgatcttatttcatatttatttttacagctcatcactgcatttcatgataagatttaaatattaaatagaaagaaactagctagcctaataaaatctgaacacagttaatatctgtcataagactagttttaatggaattctctattgaaactactattttaaagggttactagaaatgatttggttggtcattttgggaaatgtcccttaaacttggggagacatcctctactatgtataacaatatgctattatctgtcttctcagttgcactatttctaa

SEQ ID NO: 371862 - DNA, 1822 bp, Homo sapiens
ccggccagagcctcaagcttcgctgctgggcagttggctggaggggctgctgctgggaacacctggagtctccgcgggcagatctcatattttggattctggatatattataatgagtgacactttgacagcggatgtcattggtcgaagagttgaagttaatggagaacatgcaacagtacgttttgctggtgttgtccctcccgtggcaggaccctggttaggagtagaatgggacaatcccgagagaggaaagcatgatgggagccacgaagggactgtgtattttaaatgcaggcacccgacaggaggatcctttattcgtccgaacaaggtaaattttggaacagactttcttactgcaattaagaaccgctatgtgttagaagatggaccagaggaagatagaaaagagcaaattgttacaattggaaataaacctgtggagactatcggttttgactctattatgaaacagcaaagtcagctgagcaagttgcaagaagtttctctgaggaactgtgcagtaagttgtgctggtgaaaaaggaggagttgctgaagcatgtcctaatatcagaaaggtagatttgtcaaaaaacctgttgtcatcatgggatgaagtgatacacattgctgatcagctcagacacctggaagtccttaatgtcagtgaaaataaactaaaatttccctccggttcagtattaactggaacgctttctgtactgaaggttttagtcctcaatcaaacaggaataacgtgggctgaggccaacagatgttctccagacagtcaagttattagatctttcctctaatcaattaattgatgaaaatcagctgtatctgatagcccacctgcccaggttagaacaattaatcctctctgacactggaatttcttctctacattttccggatgctggaattgggtgcaaaacgtccatgttcccatccttgaagtacctggtagtaaacgacaatcagatatcacaatggtcgtttttcaatgagctagagaagttaccaagtctacgggctttgtcctgcctaagaaaccccctgaccaaagaggacaaagaagcagagacggcgcgactactcattatcgccagcattggccagctgaagacgctgaacaaatgtgagattctccccgaggagaggcggagagctgagcttgactaccgaaaagcttttggaaatgagtggaaacaggctggtggacataaggatccggaaaaaaacagactcagcgaagaattcctcacagcccatcccagataccagttcctctgcctgaaatatggtgcacctgaagattgggaactcaaaacacagcaaccacttatgctgaaaaaccagctactaacactgaagataaaataccctcatcaacttgatcagaaagtcctggagaaacaactgccgggctccatgacaattcaaaaggtgaagggattgctgtcacgtcttctcaaagttcctgtgtcagaccttctgttgtcctatgaaagtcccaaaaagccgggcagagaaatcgagctggaaaatgacctaaagtcattacagttttattctgtggaaaatggagattgtctattagtgcgatggtgacaaccaactaataaaatttaaagaccacactgcttatcgtgtctggggttcaccggaaataaatgattcactggaacaattctactgtcaaaacaaagggggtttacaacttgtcctaagtataacaagggatgtattttttgttgggaagtgaccatttctaggcttatacataatagcaataataaaggctttgaacctac

SEQ ID NO: 371863 - DNA, 1491 bp, Homo sapiens
ctgggaaggggggtggggtatgcttctccaaggcgtggagattttgggggccagtggtcccacatgagtgcactggctgagctctggcctctcagctcggcatgtttgtacgcacttcctgggacatacgttgaccggcatatgcaaccacgttgcttgagccatggcccgccgtgggccgtacgatcggtgactgagacataagtatcccatgtagccaaactgagtgtcctacatgagaggcacacgtggcatttcgcccgatgaaaataaactaaaatttccctccggttcagtattaactggaacgctttctgtactgaaggttttagtcctcaatcaaacaggaataacgtgggctgaggtgctgcggtgtgtcgcggggtgcccaggcctggaggaactctaccttgagtctaacaacattttcatttccgaaaggccaacagatgttctccagacagtcaagttattagatctttcctctaatcaattaattgatgaaaatcagctgtatctgatagcccacctgcccaggttagaacaattaatcctctctgacactggaatttcttctctacattttccggatgctggaattgggtgcaaaacgtccatgttcccatccttgaagtacctggtagtaaacgacaatcagatatcacaatggtcgtttttcaatgagctagagaagttaccaagtctacgggctttgtcctgcctaagaaaccccctgaccaaagaggacaaagaagcagagacggcgcgactactcattatcgccagcattggccagctgaagacgctgaacaaatgtgagattctccccgaggagaggcggagagctgagcttgactaccgaaaagcttttggaaatgagtggaaacaggctggtggacataaggatccggaaaaaaacagactcagcgaagaattcctcacagcccatcccagataccagttcctctgcctgaaatatggtgcacctgaagattgggaactcaaaacacagcaaccacttatgctgaaaaaccagctactaacactgaagataaaataccctcatcaacttgatcagaaagtcctggagaaacaactgccgggctccatgacaattcaaaaggtgaagggattgctgtcacgtcttctcaaagttcctgtgtcagaccttctgttgtcctatgaaagtcccaaaaagccgggcagagaaatcgagctggaaaatgacctaaagtcattacagttttattctgtggaaaatggagattgtctattagtgcgatggtgacaaccaactaataaaatttaaagaccacactgcttatcgtgtctggggttcaccggaaataaatgattcactggaacaattctactgtcaaaacaaagggggtttacaacttgtcctaagtataacaagggatgtattttttgttgggaagtgaccatttctaggcttatacataatagcaataataaaggctttgaacctac

SEQ ID NO: 371864 - DNA, 2424 bp, Homo sapiens
ccggccagagcctcaagcttcgctgctgggcagttggctggaggggctgctgctgggaacacctggagtctccgcgggcagatctcatattttggattctggatatattataatgagtgacactttgacagcggatgtcattggtcgaagagttgaagttaatggagaacatgcaacagtacgttttgctggtgttgtccctcccgtggcaggaccctggttaggagtagaatgggacaatcccgagagaggaaagcatgatgggagccacgaagggactgtgtattttaaatgcaggcacccgacaggaggatcctttattcgtccgaacaaggtaaattttggaacagactttcttactgcaattaagaaccgctatgtgttagaagatggaccagaggaagatagaaaagagcaaattgttacaattggaaataaacctgtggagactatcggttttgactctattatgaaacagcaaagtcagctgagcaagttgcaagaagtttctctgaggaactgtgcagtaagttgtgctggtgaaaaaggaggagttgctgaagcatgtcctaatatcagaaaggtagatttgtcaaaaaacctgttgtcatcatgggatgaagtgatacacattgctgatcagctcagacacctggaagtccttaatgtcagtgaaaataaactaaaatttccctccggttcagtattaactggaacgctttctgtactgaaggttttagtcctcaatcaaacaggaataacgtgggctgaggtgctgcggtgtgtcgcggggtgcccaggcctggaggaactctaccttgagtctaacaacattttcatttccgaaaggccaacagatgttctccagacagtcaagttattagatctttcctctaatcaattaattgatgaaaatcagctgtatctgatagcccacctgcccaggttagaacaattaatcctctctgacactggaatttcttctctacattttccggatgctggaattgggtgcaaaacgtccatgttcccatccttgaagtacctggtagtaaacgacaatcagatatcacaatggtcgtttttcaatgagctagagaagttaccaagtctacgggctttgtcctgcctaagaaaccccctgaccaaagaggacaaagaagcagagacggcgcgactactcattatcgccagcattggccagctgaagacgctgaacaaatgtgagattctccccgaggagaggcggagagctgagcttgactaccgaaaagcttttggaaatgagtggaaacaggctggtggacataaggatccggaaaaaaacagactcagcgaagaattcctcacagcccatcccagataccagttcctctgcctgaaatatggtgcacctgaagattgggaactcaaaacacagcaaccacttatgctgaaaaaccagctactaacactgaagataaaataccctcatcaacttgatcagaaagtcctggagaaacaactgccgggctccatgacaattcaaaaggtgaagggattgctgtcacgtcttctcaaagttcctgtgtcagaccttctgttgtcctatgaaagtcccaaagtaagttgcccagcaaaatacaaagtcaaagtcaagcttagtcctcgtattatgacattaaactgtctctagatagcaacagtttgattctaaatggagaccatgggtctgtttgtttgattttaagggtaagctactgcctggggacggggtgggggaagagtatgtgtagcatgctttatcggatctgtcttaatcacatccttccccaccttcgttctaattttagaagccgggcagagaaatcgagctggaaaatgacctaaagtcattacagttttattctgtggaaaatggagattgtctattagtgcgatggtgacaaccaactaataaaatttaaagaccacactgcttatcgtgtctggggttcaccggaaataaatgattcactggaacaattctactgtcaaaacaaagggggtttacaacttgtcctaagtataacaagggatgtattttttgttgggaagtgaccatttctaggcttatacataatagcaataataaaggctttgaacctactaaaaaaattttctgatcttatttcatatttatttttacagctcatcactgcatttcatgataagatttaaatattaaatagaaagaaactagctagcctaataaaatctgaacacagttaatatctgtcataagactagttttaatggaattctctattgaaactactattttaaagggttactagaaatgatttggttggtcattttgggaaatgtcccttaaacttggggagacatcctctactatgtataacaatatgctattatctgtcttctcagttgcactatttctaa

SEQ ID NO: 371865 - DNA, 1472 bp, Homo sapiens
ccggccagagcctcaagcttcgctgctgggcagttggctggaggggctgctgctgggaacacctggagtctccgcgggcagatctcatattttggattctggatatattataatgagtgacactttgacagcggatgtcattggtcgaagagttgaagttaatggagaacatgcaacagtacgttttgctggtgttgtccctcccgtggcaggaccctggttaggagtagaatgggacaatcccgagagaggaaagcatgatgggagccacgaagggactgtgtattttaaatgcaggcacccgacaggaggatcctttattcgtccgaacaaggtaaattttggaacagactttcttactgcaattaagaaccgctatgtgttagaagatggaccagaggaagatagaaaagagcaaattgttacaattggaaataaacctgtggagactatcggttttgactctattatgaaacagcaaagtcagctgagcaagttgcaagaagtttctctgaggaactgtgcagtaagttgtgctggtgaaaaaggaggagttgctgaagcatgtcctaatatcagaaaggtagatttgtcaaaaaacctgttgtcatcatgggatgaagtgatacacattgctgatcagctcagacacctggaagtccttaatgtcagtgaaaataaactaaaatttccctccggttcagtattaactggaacgctttctgtactgaaggttttagtcctcaatcaaacaggaataacgtgggctgaggtgctgcggtgtgtcgcggggtgcccaggcctggaggaactctaccttgagtctaacaacattttcatttccgaaaggccaacagatgttctccagacagtcaagttattagatctttcctctaatcaattaattgatgaaaatcagctgtatctgatagcccacctgcccaggttagaacaattaatcctctctgacactggaatttcttctctacattttccggatgctggaattgggtgcaaaacgtccatgttcccatccttgaagtacctggtagtaaacgacaatcagatatcacaatggtcgtttttcaatgagctagagaagttaccaagtctacgggctttgtcctgcctaagaaaccccctgaccaaagaggacaaagaagcagagacggcgcgactactcattatcgccagcattggccagctgaagacgctgaacaaatgtgagattctccccgaggagaggcggagagctgagcttgactaccgaaaagcttttggaaatgagtggaaacaggctggtggacataaggatccggaaaaaaacagactcagcgaagaattcctcacagcccatcccagataccagttcctctgcctgaaatatggtgcacctgaagattgggaactcaaaacacagcaaccacttatgctgaaaaaccagctactaacactgatagattaagcggggc

SEQ ID NO: 371866 - DNA, 150 bp, Homo sapiens
ttgtacatgtgcttctatgttttctaatgtgtatttaatgaagcttcccatgtgccaggtatcttcaaagccctagagacatggtggtcaatgtgggtggccaggccccagctcttgtgcagcttacatcaagaagggtttatgaggagt

SEQ ID NO: 371867 - DNA, 3948 bp, Homo sapiens
tccatcccacatggcggcgctcctgaggagactgctgcagcgcgagaggccttcggcggcctctggccgccccgtaggacggcgcgaggccaacctgggcactgatgccggggttgcggtgcgagtgcggttcgctcccagccccacaggcttcttgcacctgggtggcctccgcactgccttgtacaactacatctttgctaagaagtaccaggggagcttcatcctgaggctagaggacacagatcagactcgcgttgtgcctggggcagcagagaatattgaggacatgctggagtgggcaggcatcccgcctgatgagagcccccgccggggcggtcctgctgggccctaccagcaatctcagcggttggagctgtatgcccaggccacagaagcgctgctgaagaccggagctgcttacccctgtttctgctcaccccagcggctggagctcctgaagaaggaggccttgcggaaccaccagacgccccggtatgacaatcggtgcaggaacatgagccaggagcaggtggcccagaagctggccaaggaccccaagcctgcgatccgcttccgcctggagcaggtggtgccagccttccaggacctggtgtatggctggaataggcatgaagtggccagcgtggagggagacccagtcatcatgaagagcgacggcttccccacataccacctggcctgcgtggtggacgaccaccacatgggcatcagccacgtgctgcgaggctctgagtggctcgtctccactgccaagcacctgctcctctaccaggccctgggctggcagccaccccacttcgcccacctgcccctgctcctcaacagggatggcagcaagctctccaagaggcaaggggacgttttcctggagcactttgctgctgatggcttcctgcccgattccttgttggacatcatcaccaactgtggctcaggttttgcagagaaccaaatgggcaggaccctgccggagctgatcacacagttcaacctgacacaggtcacctgtcactcagccctgctggacctggagaagctcccagaattcaacagactgcacctccagcggctggtgagcaatgagagccagaggcgccagctggtggggaagctgcaggtccttgtggaggaggcctttggttgccagctgcaaaacagggatgtcctcaacccagtctacgtggagaggatcctcctgctgagacagggtcacatttgccgcctgcaggacttggtgtccccagtatactcttacctgtggactcgccctgcagtaggtcgagcacagctggacgccatctcggagaaggtggatgtgattgccaagcgtgtgctggggcttctagaaagatctggtatgagcttaactcaggatatgctgaatggagaactgaagaagctatcagaaggtctggaaggcaccaagtacagtaatgtgatgaaactccttcggatggccctcagtggacagcagcaaggacctcctgtagctgagatgatgttggccttgggaccaaaggaagtacgggaacggatccagaaggtggtttccagctagggagaggatgtgtcgggcagtggagatcgccctaagaacctgtgagcttagaaacagctttcagagaccagaaggaggcctggggcccgtcgggaagtttgctgaaggaactaagagtggaaacaatctctgactgcacacaagtgcatttgtgatccaccacaggcacgtttttgtcaattggctggggaagcccaacccatctaacctcctggactctggaaaggcattctccgggtctggtttctcacacattacacagcagaggtttggagttagttcacagaaaagttaacatcccggaacagtgcagaaggcttgggtttcagtttgctagggcccccataacaaaatgccacagaaccaggtggtttaaacagatttattttctcacatttggaggctagaagttcaagatcaaggtgtcagcaggcctggtttttcctagaggcctcttttgttggcttgcagacagctgtcttctcactgtgtccttgtgcggtcttccctccatgcacacacatctctagtttcattatgtgcccaacgttcctcttctaagaacaccagttggactggattttaactttaaccagcctcatttaagttaatcacctctttaaatgctcaatctccaagtacagtctcattctgaggttccaggggtttctcaacgtaagaatttagggggacagaattcagcccgtagcagctgggcagcaggactcatgggtcccagttctcaggccccaaggactcagagcagcaaaggatacgtgacacaagcagggctgaactggacaccagactttctttggggttgtaaaaggagaagtgtgactccactgccaagggtaagcactcttgtcttatgctaccctttattcttgaaccttggggcagcctgtgtctcccttccctaaacgtcatctgttccgtttttccagtcttccagacctggtccttggactggagaccttcacccttcctattttgtggctttctcttcaaatccacctcgtccttcctccatgacttataagtcatcatctctgctggtttctgaaatgagatatgcttcttggggtcttcagtgaagaggaatagcaagtgaaaggaggatggtggcagggtacatgaacccctaccaggcttctaggcttcccctgcatggcagccagcctctaagttggcccccaaccatccctgccttcttctattcacacccttgtgtggttccttcccacattgaataggcctgacttgtgtaaccactacactattgaagaaatgagagtttgacttctgagggtaagtcataaaatacatcgtggcttctgtcttgttttctttgatcgcttactttgggggaagccagcttccaggtcatgaaaatactcaagcagccttatggagtgctccacatgacaagggatggaggcctcccaccaatagccatgggagtgtgcaatcttgaaagctggtccttcaattccagccaagcattcacatgaccgcaatcctagctgatctcgcttgtgacctctatgggagaccctaagccagaaccactcagagaagctgctctggaacgtcagacacacatgaactgtgagatagtaaacgtttattgtttaaagctacttggtttggggataatttgcgtttcagcagtagacaatatatttattttgtccaggggagtggaaaggcgattacagagtttgttgagccccatagagtcctagtctttgcttaaagaaatataccagttctttctaatacagaatccattaagttcgttggttgcaaacaatagaaaccaactctgcctcacttatgtttattggaggccataagagagccacagcatctaccaaaaagccaaaaaaaaaacaggttttggaaaagacaggaactagctacaggagctaatggccaatcttgtctgagttctttgatggcgacacatgaactacagccgttttgttgttgttaatttctccgtgttttcccctcagttttggatgactctgctcaaggttcagattctgaggagcaagtatctgttgggctatctgaggtcctgctaccattccttggccagtaataggtagtttcacagggattatatgcaatggaggaaaagttgttctcaaggaaaactagggagctttctccagaagatgatgtaatggcagaaacaacaggtggttgaccacagaaggggacaataataatacttgtaatttattgtgcgcttatatgagcctcaccctctcccaggtgtcagataatgctcgtaaatgccttagtccatcatctcagtaaattttttttataacactaaaaaaagaagcagtatt

SEQ ID NO: 371868 - DNA, 3642 bp, Homo sapiens
taaaattggaacgatacagagaagattagcatggcccctgcgcaaggatgacacgcaaattcgtgaagcgttccatattattgaaaaaaaaagaaagaaaaaccccaagactattttgagatgtgtgttctaatctcagcggctggagctcctgaagaaggaggccttgcggaaccaccagacgccccggtatgacaatcggtgcaggaacatgagccaggagcaggtggcccagaagctggccaaggaccccaagcctgcgatccgcttccgcctggagcaggtggtgccagccttccaggacctggtgtatggctggaataggcatgaagtggccagcgtggagggagacccagtcatcatgaagagcgacggcttccccacataccacctggcctgcgtggtggacgaccaccacatgggcatcagccacgtgctgcgaggctctgagtggctcgtctccactgccaagcacctgctcctctaccaggccctgggctggcagccaccccacttcgcccacctgcccctgctcctcaacagggatggcagcaagctctccaagaggcaaggggacgttttcctggagcactttgctgctgatggcttcctgcccgattccttgttggacatcatcaccaactgtggctcaggttttgcagagaaccaaatgggcaggaccctgccggagctgatcacacagttcaacctgacacaggtcacctgtcactcagccctgctggacctggagaagctcccagaattcaacagactgcacctccagcggctggtgagcaatgagagccagaggcgccagctggtggggaagctgcaggtccttgtggaggaggcctttggttgccagctgcaaaacagggatgtcctcaacccagtctacgtggagaggatcctcctgctgagacagggtcacatttgccgcctgcaggacttggtgtccccagtatactcttacctgtggactcgccctgcagtaggtcgagcacagctggacgccatctcggagaaggtggatgtgattgccaagcgtgtgctggggcttctagaaagatctggtatgagcttaactcaggatatgctgaatggagaactgaagaagctatcagaaggtctggaaggcaccaagtacagtaatgtgatgaaactccttcggatggccctcagtggacagcagcaaggacctcctgtagctgagatgatgttggccttgggaccaaaggaagtacgggaacggatccagaaggtggtttccagctagggagaggatgtgtcgggcagtggagatcgccctaagaacctgtgagcttagaaacagctttcagagaccagaaggaggcctggggcccgtcgggaagtttgctgaaggaactaagagtggaaacaatctctgactgcacacaagtgcatttgtgatccaccacaggcacgtttttgtcaattggctggggaagcccaacccatctaacctcctggactctggaaaggcattctccgggtctggtttctcacacattacacagcagaggtttggagttagttcacagaaaagttaacatcccggaacagtgcagaaggcttgggtttcagtttgctagggcccccataacaaaatgccacagaaccaggtggtttaaacagatttattttctcacatttggaggctagaagttcaagatcaaggtgtcagcaggcctggtttttcctagaggcctcttttgttggcttgcagacagctgtcttctcactgtgtccttgtgcggtcttccctccatgcacacacatctctagtttcattatgtgcccaacgttcctcttctaagaacaccagttggactggattttaactttaaccagcctcatttaagttaatcacctctttaaatgctcaatctccaagtacagtctcattctgaggttccaggggtttctcaacgtaagaatttagggggacagaattcagcccgtagcagctgggcagcaggactcatgggtcccagttctcaggccccaaggactcagagcagcaaaggatacgtgacacaagcagggctgaactggacaccagactttctttggggttgtaaaaggagaagtgtgactccactgccaagggtaagcactcttgtcttatgctaccctttattcttgaaccttggggcagcctgtgtctcccttccctaaacgtcatctgttccgtttttccagtcttccagacctggtccttggactggagaccttcacccttcctattttgtggctttctcttcaaatccacctcgtccttcctccatgacttataagtcatcatctctgctggtttctgaaatgagatatgcttcttggggtcttcagtgaagaggaatagcaagtgaaaggaggatggtggcagggtacatgaacccctaccaggcttctaggcttcccctgcatggcagccagcctctaagttggcccccaaccatccctgccttcttctattcacacccttgtgtggttccttcccacattgaataggcctgacttgtgtaaccactacactattgaagaaatgagagtttgacttctgagggtaagtcataaaatacatcgtggcttctgtcttgttttctttgatcgcttactttgggggaagccagcttccaggtcatgaaaatactcaagcagccttatggagtgctccacatgacaagggatggaggcctcccaccaatagccatgggagtgtgcaatcttgaaagctggtccttcaattccagccaagcattcacatgaccgcaatcctagctgatctcgcttgtgacctctatgggagaccctaagccagaaccactcagagaagctgctctggaacgtcagacacacatgaactgtgagatagtaaacgtttattgtttaaagctacttggtttggggataatttgcgtttcagcagtagacaatatatttattttgtccaggggagtggaaaggcgattacagagtttgttgagccccatagagtcctagtctttgcttaaagaaatataccagttctttctaatacagaatccattaagttcgttggttgcaaacaatagaaaccaactctgcctcacttatgtttattggaggccataagagagccacagcatctaccaaaaagccaaaaaaaaaacaggttttggaaaagacaggaactagctacaggagctaatggccaatcttgtctgagttctttgatggcgacacatgaactacagccgttttgttgttgttaatttctccgtgttttcccctcagttttggatgactctgctcaaggttcagattctgaggagcaagtatctgttgggctatctgaggtcctgctaccattccttggccagtaataggtagtttcacagggattatatgcaatggaggaaaagttgttctcaaggaaaactagggagctttctccagaagatgatgtaatggcagaaacaacaggtggttgaccacagaaggggacaataataatacttgtaatttattgtgcgcttatatgagcctcaccctctcccaggtgtcagataatgctcgtaaatgccttagtccatcatctcagtaaattttttttataacactaaaaaaagaagcagtatt

SEQ ID NO: 371869 - DNA, 3855 bp, Homo sapiens
tccatcccacatggcggcgctcctgaggagactgctgcagcgcgagaggccttcggcggcctctggccgccccgtaggacggcgcgaggccaacctgggcactgatgccggggttgcggtgcgagtgcggttcgctcccagccccacaggcttcttgcacctgggtggcctccgcactgccttgtacaactacatctttgctaagaagtaccaggggagcttcatcctgaggctagaggacacagatcagactcgcgttgtgcctggggcagcagagaatattgaggacatgctggagtgggcaggcatcccgcctgatgagagcccccgccggggcggtcctgctgggccctaccagcaatctcagcggttggagctgtatgcccaggccacagaagcgctgctgaagaccggagctgcttacccctgtttctgctcaccccagcggctggagctcctgaagaaggaggccttgcggaaccaccagacgccccggtatgacaatcggtgcaggaacatgagccaggagcaggtggcccagaagctggccaaggaccccaagcctgcgatccgcttccgcctggagcaggtggtgccagccttccaggacctggtgtatggctggaataggcatgaagtggccagcgtggagggagacccagtcatcatgaagagcgacggcttccccacataccacctggcctgcgtggtggacgaccaccacatgggcatcagccacgtgctgcgaggctctgagtggctcgtctccactgccaagcacctgctcctctaccaggccctgggctggcagccaccccacttcgcccacctgcccctgctcctcaacagggatggcagcaagctctccaagaggcaaggggacgttttcctggagcactttgctgctgatggcttcctgcccgattccttgttggacatcatcaccaactgtggctcaggttttgcagagaaccaaatgggcaggaccctgccggagctgatcacacagttcaacctgacacaggtcacctgtcactcagccctgctggacctggagaagctcccagaattcaacagactgcacctccagcggctggtgagcaatgagagccagaggcgccagctggtggggaagctgcaggtccttgtggaggaggcctttggttgccagctgcaaaacagggatgtcctcaacccagtctacgtggagaggatcctcctgctgagacagggtcacatttgccgcctgcaggacttggtgtccccagtatactcttacctgtggactcgccctgcagtaggtcgagcacagctggacgccatctcggagaaggtggatgtgattgccaagcgtgtgctggggcttctagaaagatctggtatgagcttaactcaggatatgctgaatggagaactgaagaagctatcagaaggtctggaaggcaccaagtacagtaatgtgatgaaactccttcggatggccctcagtggacagcagcaaggacctcctgtagctgagatgatgttggccttgggaccaaaggaagtacgggaacggatccagaaggtggtttccagctagggagaggatgtgtcgggcagtggagatcgccctaagaacctgtgagcttagaaacagctttcagagaccagaaggaggcctggggcccgtcgggaagtttgctgaaggaactaagagtggaaacaatctctgactgcacacaagtgcatttgtgatccaccacaggcacgtttttgtcaattggctggggaagcccaacccatctaacctcctggactctggaaaggcattctccgggtctggtttctcacacattacacagcagaggtttggagttagttcacagaaaagttaacatcccggaacagtgcagaaggcttgggtttcagtttgctagggcccccataacaaaatgccacagaaccaggtggtttaaacagatttattttctcacatttggaggctagaagttcaagatcaaggtgtcagcaggcctggtttttcctagaggcctcttttgttggcttgcagacagctgtcttctcactgtgtccttgtgcggtcttccctccatgcacacacatctctagtttcattatgtgcccaacgttcctcttctaagaacaccagttggactggattttaactttaaccagcctcatttaagttaatcacctctttaaatgctcaatctccaagtacagtctcattctgaggttccaggggtttctcaacgtaagaatttagggggacagaattcagcccgtagcagctgggcagcaggactcatgggtcccagttctcaggccccaaggactcagagcagcaaaggatacgtgacacaagcagggctgaactggacaccagactttctttggggttgtaaaaggagaagtgtgactccactgccaaggtcttccagacctggtccttggactggagaccttcacccttcctattttgtggctttctcttcaaatccacctcgtccttcctccatgacttataagtcatcatctctgctggtttctgaaatgagatatgcttcttggggtcttcagtgaagaggaatagcaagtgaaaggaggatggtggcagggtacatgaacccctaccaggcttctaggcttcccctgcatggcagccagcctctaagttggcccccaaccatccctgccttcttctattcacacccttgtgtggttccttcccacattgaataggcctgacttgtgtaaccactacactattgaagaaatgagagtttgacttctgagggtaagtcataaaatacatcgtggcttctgtcttgttttctttgatcgcttactttgggggaagccagcttccaggtcatgaaaatactcaagcagccttatggagtgctccacatgacaagggatggaggcctcccaccaatagccatgggagtgtgcaatcttgaaagctggtccttcaattccagccaagcattcacatgaccgcaatcctagctgatctcgcttgtgacctctatgggagaccctaagccagaaccactcagagaagctgctctggaacgtcagacacacatgaactgtgagatagtaaacgtttattgtttaaagctacttggtttggggataatttgcgtttcagcagtagacaatatatttattttgtccaggggagtggaaaggcgattacagagtttgttgagccccatagagtcctagtctttgcttaaagaaatataccagttctttctaatacagaatccattaagttcgttggttgcaaacaatagaaaccaactctgcctcacttatgtttattggaggccataagagagccacagcatctaccaaaaagccaaaaaaaaaacaggttttggaaaagacaggaactagctacaggagctaatggccaatcttgtctgagttctttgatggcgacacatgaactacagccgttttgttgttgttaatttctccgtgttttcccctcagttttggatgactctgctcaaggttcagattctgaggagcaagtatctgttgggctatctgaggtcctgctaccattccttggccagtaataggtagtttcacagggattatatgcaatggaggaaaagttgttctcaaggaaaactagggagctttctccagaagatgatgtaatggcagaaacaacaggtggttgaccacagaaggggacaataataatacttgtaatttattgtgcgcttatatgagcctcaccctctcccaggtgtcagataatgctcgtaaatgccttagtccatcatctcagtaaattttttttataacactaaaaaaagaagcagtatt

SEQ ID NO: 371870 - DNA, 3894 bp, Homo sapiens
tccatcccacatggcggcgctcctgaggagactgctgcagcgcgagaggccttcggcggcctctggccgccccgtaggacggcgcgaggccaacctgggcactgatgccggggttgcggtgcgagtgcggttcgctcccagccccacaggcttcttgcacctgggtggcctccgcactgccttgtacaactacatctttgctaagaagtaccaggggagcttcatcctgaggctagaggacacagatcagactcgcgttgtgcctggggcagcagagaatattgaggacatgctggagtgggcaggcatcccgcctgatgagagcccccgccggggcggtcctgctgggccctaccagcaatctcagcggttggagctgtatgcccaggccacagaagcgctgctgaagaccggagctgcttacccctgtttctgctcaccccagcggctggagctcctgaagaaggaggccttgcggaaccaccagacgccccggtatgacaatcggtgcaggaacatgagccaggagcaggtggcccagaagctggccaaggaccccaagcctgcgatccgcttccgcctggagcaggtggtgccagccttccaggacctggtgtatggctggaataggcatgaagtggccagcgtggagggagacccagtcatcatgaagagcgacggcttccccacataccacctggcctgcgtggtggacgaccaccacatgggcatcagccacgtgctgcgaggctctgagtggctcgtctccactgccaagcacctgctcctctaccaggccctgggctggcagccaccccacttcgcccacctgcccctgctcctcaacagggatggcagcaagctctccaagaggcaaggggacgttttcctggagcactttgctgctgatggcttcctgcccgattccttgttggacatcatcaccaactgtggctcaggttttgcagagaaccaaatgggcaggaccctgccggagctgatcacacagttcaacctgacacaggtcacctgtcactcagccctgctggacctggagaagctcccagaattcaacagactgcacctccagcggctggtgagcaatgagagccagaggcgccagctggtggggaagctgcaggtccttgtggaggaggcctttggttgccagctgcaaaacagggatgtcctcaacccagtctacgtggagaggatcctcctgctgagacagggtcacatttgccgcctgcaggacttggtgtccccagtatactcttacctgtggactcgccctgcagtaggtcgagcacagctggacgccatctcggagaaggtggatgtgattgccaagcgtgtgctggggcttctagaaagatctggtatgagcttaactcaggatatgctgaatggagaactgaagaagctatcagaaggtctggaaggcaccaagtacagtaatgtgatgaaactccttcggatggccctcagtggacagcagcaaggacctcctgtagctgagatgatgttggccttgggaccaaaggaagtacgggaacggatccagaaggtggtttccagctagggagaggatgtgtcgggcagtggagatcgccctaagaacctgtgagcttagaaacagctttcagagaccagaaggaggcctggggcccgtcgggaagtttgctgaaggaactaagagtggaaacaatctctgactgcacacaagtgcatttgtgatccaccacaggcacgtttttgtcaattggctggggaagcccaacccatctaacctcctggactctggaaaggcattctccgggtctggtttctcacacattacacagcagaggtttggagttagttcacagaaaagttaacatcccggaacagtgcagaaggcttgggtttcagtttgctagggcccccataacaaaatgccacagaaccaggtggtttaaacagatttattttctcacatttggaggctagaagttcaagatcaaggtgtcagcaggcctggtttttcctagaggcctcttttgttggcttgcagacagctgtcttctcactgtgtccttgtgcggtcttccctccatgcacacacatctctagtttcattatgtgcccaacgttcctcttctaagaacaccagttggactggattttaactttaaccagcctcatttaagttaatcacctctttaaatgctcaatctccaagtacagtctcattctgaggttccaggggtttctcaacgtaagaatttagggggacagaattcagcccgtagcagctgggcagcaggactcatgggtcccagttctcaggccccaaggactcagagcagcaaaggatacgtgacacaagcagggctgaactggacaccagactttctttggggttgtcctttattcttgaaccttggggcagcctgtgtctcccttccctaaacgtcatctgttccgtttttccagtcttccagacctggtccttggactggagaccttcacccttcctattttgtggctttctcttcaaatccacctcgtccttcctccatgacttataagtcatcatctctgctggtttctgaaatgagatatgcttcttggggtcttcagtgaagaggaatagcaagtgaaaggaggatggtggcagggtacatgaacccctaccaggcttctaggcttcccctgcatggcagccagcctctaagttggcccccaaccatccctgccttcttctattcacacccttgtgtggttccttcccacattgaataggcctgacttgtgtaaccactacactattgaagaaatgagagtttgacttctgagggtaagtcataaaatacatcgtggcttctgtcttgttttctttgatcgcttactttgggggaagccagcttccaggtcatgaaaatactcaagcagccttatggagtgctccacatgacaagggatggaggcctcccaccaatagccatgggagtgtgcaatcttgaaagctggtccttcaattccagccaagcattcacatgaccgcaatcctagctgatctcgcttgtgacctctatgggagaccctaagccagaaccactcagagaagctgctctggaacgtcagacacacatgaactgtgagatagtaaacgtttattgtttaaagctacttggtttggggataatttgcgtttcagcagtagacaatatatttattttgtccaggggagtggaaaggcgattacagagtttgttgagccccatagagtcctagtctttgcttaaagaaatataccagttctttctaatacagaatccattaagttcgttggttgcaaacaatagaaaccaactctgcctcacttatgtttattggaggccataagagagccacagcatctaccaaaaagccaaaaaaaaaacaggttttggaaaagacaggaactagctacaggagctaatggccaatcttgtctgagttctttgatggcgacacatgaactacagccgttttgttgttgttaatttctccgtgttttcccctcagttttggatgactctgctcaaggttcagattctgaggagcaagtatctgttgggctatctgaggtcctgctaccattccttggccagtaataggtagtttcacagggattatatgcaatggaggaaaagttgttctcaaggaaaactagggagctttctccagaagatgatgtaatggcagaaacaacaggtggttgaccacagaaggggacaataataatacttgtaatttattgtgcgcttatatgagcctcaccctctcccaggtgtcagataatgctcgtaaatgccttagtccatcatctcagtaaattttttttataacactaaaaaaagaagcagtatt

SEQ ID NO: 371871 - DNA, 423 bp, Homo sapiens
ccttccctaaacgtcatctgttccgtttttccagtcttccagacctggtccttggactggagaccttcacccttcctattttgtggctttctcttcaaatccacctcgtccttcctccatgacttataagtcatcatctctgctggtttctgaaatgagatatgcttcttggggtcttcagtgaagaggaatagcaagtgaaaggaggatggtggcagggtacatgaacccctaccaggcttctaggcttcccctgcatggcagccagcctctaagttggcccccaaccatccctgccttcttctattcacacccttgtgtggttccttcccacattgaataggcctgacttgtgtaaccactacactattgaagaaatgagagtttgacttctgagggtaagtcataaaatacatcgtggct

SEQ ID NO: 371872 - DNA, 167 bp, Homo sapiens
gctgtgtgcaccttagctgtcattattccctgtgttccaggcatcccgcctgatgagagcccccgccggggcggtcctgctgggccctaccagcaatctcagcggttggagctgtatgcccaggccacagaagcgctgctgaagaccggagctgcttacccctgttt

SEQ ID NO: 371873 - DNA, 4124 bp, Homo sapiens
gctgaggtgcaggagcggaaataattcaaattgccaggagtttcttgtgttttttgtgccatcccatctctttcgatcttttttttcatgcattccatacatgtgcattgatgacaacctgtgtaacaggtgttgtagacgctgggatacagtgatcattgagaaaggtaggggccttgctctgtggaagtctgcattctagtggctgccgcagacacttataaaaaataagtgtaattttagagtcacatgtgccatgcgggaagtgaaacaggataggagactggggattaagaaggacgctccagaaggctttactgagcaggcttcttgcacctgggtggcctccgcactgccttgtacaactacatctttgctaagaagtaccaggggagcttcatcctgaggctagaggacacagatcagactcgcgttgtgcctggggcagcagagaatattgaggacatgctggagtgggcaggcatcccgcctgatgagagcccccgccggggcggtcctgctgggccctaccagcaatctcagcggttggagctgtatgcccaggccacagaagcgctgctgaagaccggagctgcttacccctgtttctgctcaccccagcggctggagctcctgaagaaggaggccttgcggaaccaccagacgccccggtatgacaatcggtgcaggaacatgagccaggagcaggtggcccagaagctggccaaggaccccaagcctgcgatccgcttccgcctggagcaggtggtgccagccttccaggacctggtgtatggctggaataggcatgaagtggccagcgtggagggagacccagtcatcatgaagagcgacggcttccccacataccacctggcctgcgtggtggacgaccaccacatgggcatcagccacgtgctgcgaggctctgagtggctcgtctccactgccaagcacctgctcctctaccaggccctgggctggcagccaccccacttcgcccacctgcccctgctcctcaacagggatggcagcaagctctccaagaggcaaggggacgttttcctggagcactttgctgctgatggcttcctgcccgattccttgttggacatcatcaccaactgtggctcaggttttgcagagaaccaaatgggcaggaccctgccggagctgatcacacagttcaacctgacacaggtcacctgtcactcagccctgctggacctggagaagctcccagaattcaacagactgcacctccagcggctggtgagcaatgagagccagaggcgccagctggtggggaagctgcaggtccttgtggaggaggcctttggttgccagctgcaaaacagggatgtcctcaacccagtctacgtggagaggatcctcctgctgagacagggtcacatttgccgcctgcaggacttggtgtccccagtatactcttacctgtggactcgccctgcagtaggtcgagcacagctggacgccatctcggagaaggtggatgtgattgccaagcgtgtgctggggcttctagaaagatctggtatgagcttaactcaggatatgctgaatggagaactgaagaagctatcagaaggtctggaaggcaccaagtacagtaatgtgatgaaactccttcggatggccctcagtggacagcagcaaggacctcctgtagctgagatgatgttggccttgggaccaaaggaagtacgggaacggatccagaaggtggtttccagctagggagaggatgtgtcgggcagtggagatcgccctaagaacctgtgagcttagaaacagctttcagagaccagaaggaggcctggggcccgtcgggaagtttgctgaaggaactaagagtggaaacaatctctgactgcacacaagtgcatttgtgatccaccacaggcacgtttttgtcaattggctggggaagcccaacccatctaacctcctggactctggaaaggcattctccgggtctggtttctcacacattacacagcagaggtttggagttagttcacagaaaagttaacatcccggaacagtgcagaaggcttgggtttcagtttgctagggcccccataacaaaatgccacagaaccaggtggtttaaacagatttattttctcacatttggaggctagaagttcaagatcaaggtgtcagcaggcctggtttttcctagaggcctcttttgttggcttgcagacagctgtcttctcactgtgtccttgtgcggtcttccctccatgcacacacatctctagtttcattatgtgcccaacgttcctcttctaagaacaccagttggactggattttaactttaaccagcctcatttaagttaatcacctctttaaatgctcaatctccaagtacagtctcattctgaggttccaggggtttctcaacgtaagaatttagggggacagaattcagcccgtagcagctgggcagcaggactcatgggtcccagttctcaggccccaaggactcagagcagcaaaggatacgtgacacaagcagggctgaactggacaccagactttctttggggttgtaaaaggagaagtgtgactccactgccaagggtaagcactcttgtcttatgctaccctttattcttgaaccttggggcagcctgtgtctcccttccctaaacgtcatctgttccgtttttccagtcttccagacctggtccttggactggagaccttcacccttcctattttgtggctttctcttcaaatccacctcgtccttcctccatgacttataagtcatcatctctgctggtttctgaaatgagatatgcttcttggggtcttcagtgaagaggaatagcaagtgaaaggaggatggtggcagggtacatgaacccctaccaggcttctaggcttcccctgcatggcagccagcctctaagttggcccccaaccatccctgccttcttctattcacacccttgtgtggttccttcccacattgaataggcctgacttgtgtaaccactacactattgaagaaatgagagtttgacttctgagggtaagtcataaaatacatcgtggcttctgtcttgttttctttgatcgcttactttgggggaagccagcttccaggtcatgaaaatactcaagcagccttatggagtgctccacatgacaagggatggaggcctcccaccaatagccatgggagtgtgcaatcttgaaagctggtccttcaattccagccaagcattcacatgaccgcaatcctagctgatctcgcttgtgacctctatgggagaccctaagccagaaccactcagagaagctgctctggaacgtcagacacacatgaactgtgagatagtaaacgtttattgtttaaagctacttggtttggggataatttgcgtttcagcagtagacaatatatttattttgtccaggggagtggaaaggcgattacagagtttgttgagccccatagagtcctagtctttgcttaaagaaatataccagttctttctaatacagaatccattaagttcgttggttgcaaacaatagaaaccaactctgcctcacttatgtttattggaggccataagagagccacagcatctaccaaaaagccaaaaaaaaaacaggttttggaaaagacaggaactagctacaggagctaatggccaatcttgtctgagttctttgatggcgacacatgaactacagccgttttgttgttgttaatttctccgtgttttcccctcagttttggatgactctgctcaaggttcagattctgaggagcaagtatctgttgggctatctgaggtcctgctaccattccttggccagtaataggtagtttcacagggattatatgcaatggaggaaaagttgttctcaaggaaaactagggagctttctccagaagatgatgtaatggcagaaacaacaggtggttgaccacagaaggggacaataataatacttgtaatttattgtgcgcttatatgagcctcaccctctcccaggtgtcagataatgctcgtaaatgccttagtccatcatctcagtaaattttttttataacactaaaaaaagaagcagtatt

SEQ ID NO: 371874 - DNA, 3363 bp, Homo sapiens
tccatcccacatggcggcgctcctgaggagactgctgcagcgcgagaggccttcggcggcctctggccgccccgtaggacggcgcgaggccaacctgggcactgatgccggggttgcggtgcgagtgcggttcgctcccagccccacaggcttcttgcacctgggtggcctccgcactgccttgtacaactacatctttgctaagaagtaccaggggagcttcatcctgaggctagaggacacagatcagactcgcgttgtgcctggggcagcagagaatattgaggacatgctggagtgggcaggcatcccgcctgatgagagcccccgccggggcggtcctgctgggccctaccagcaatctcagcggttggagctgtatgcccaggccacagaagcgctgctgaagaccggagctgcttacccctgtttctgctcaccccagcggctggagctcctgaagaaggaggccttgcggaaccaccagacgccccggtatgacaatcggtgcaggaacatgagccaggagcaggtggcccagaagctggccaaggaccccaagcctgcgatccgcttccgcctggagcaggtggtgccagccttccaggacctggtgtatggctggaataggcatgaagtggccagcgtggagggagacccagtcatcatgaagagcgacggcttccccacataccacctggcctgcgtggtggacgaccaccacatgggcatcagccacgtgctgcgaggctctgagtggctcgtctccactgccaagcacctgctcctctaccaggccctgggctggcagccaccccacttcgcccacctgcccctgctcctcaacagggatggcagcaagctctccaagaggcaaggggacgttttcctggagcactttgctgctgatggcttcctgcccgattccttgttggacatcatcaccaactgtggctcaggttttgcagagaaccaaatgggcaggaccctgccggagctgatcacacagttcaacctgacacaggtcacctgtcactcagccctgctggacctggagaagctcccagaattcaacagactgcacctccagcggctggtgagcaatgagagccagaggcgccagctggtggggaagctgcaggtccttgtggaggaggcctttggttgccagctgcaaaacagggatgtcctcaacccagtctacgtggagaggatcctcctgctgagacagggtcacatttgccgcctgcaggacttggtgtccccagtatactcttacctgtggactcgccctgcagtaggtcgagcacagctggacgccatctcggagaaggtggatgtgattgccaagcgtgtgctggggcttctagaaagatctggtatgagcttaactcaggatatgctgaatggagaactgaagaagctatcagaaggtctggaaggcaccaagtacagtaatgtgatgaaactccttcggatggccctcagtggacagcagcaaggacctcctgtagctgagatgatgttggccttgggaccaaaggaagtacgggaacggatccagaaggtggtttccagctagggagaggatgtgtcgggcagtggagatcgccctaagaacctgtgagcttagaaacagctttcagagaccagaaggaggcctggggcccgtcgggaagtttgctgaaggaactaagagtggaaacaatctctgactgcacacaagtgcatttgtgatccaccacaggcacgtttttgtcaattggctggggaagcccaacccatctaacctcctggactctggaaaggcattctccgggtctggtttctcacacattacacagcagaggtttggagttagttcacagaaaagttaacatcccggaacagtgcagaaggcttgggtttcagtttgctagggcccccataacaaaatgccacagaaccaggtggtttaaacagatttattttctcacatttggaggctagaagttcaagatcaaggtgtcagcaggcctggtttttcctagaggcctcttttgttggcttgcagacagctgtcttctcactgtgtccttgtgcggtcttccctccatgcacacacatctctagtttcattatgtgcccaacgttcctcttctaagaacaccagttggactggattttaactttaaccagcctcatttaagttaatcacctctttaaatgctcaatctccaagtacagtctcattctgaggttccaggggtttctcaacgtaagaatttagggggacagaattcagcccgtagcagctgggcagcaggactcatgggtcccagttctcaggccccaaggactcagagcagcaaaggatacgtgacacaagcagggctgaactggacaccagactttctttggggttgtaaaaggagaagtgtgactccactgccaagggtaagcactcttgtcttatgctaccctttattcttgaaccttggggcagcctgtgtctcccttccctaaacgtcatctgttccgtttttccagtcttccagacctggtccttggactggagaccttcacccttcctattttgtggctttctcttcaaatccacctcgtccttcctccatgacttataagtcatcatctctgctggtttctgaaatgagatatgcttcttggggtcttcagtgaagaggaatagcaagtgaaaggaggatggtggcagggtacatgaacccctaccaggcttctaggcttcccctgcatggcagccagcctctaagttggcccccaaccatccctgccttcttctattcacacccttgtgtggttccttcccacattgaataggcctgacttgtgtaaccactacactattgaagaaatgagagtttgacttctgagggtaagtcataaaatacatcgtggcttctgtcttgttttctttgatcgcttactttgggggaagccagcttccaggtcatgaaaatactcaagcagccttatggagtgctccacatgacaagggatggaggcctcccaccaatagccatgggagtgtgcaatcttgaaagctggtccttcaattccagccaagcattcacatgaccgcaatcctagctgatctcgcttgtgacctctatgggagaccctaagccagaaccactcagagaagctgctctggaacgtcagacacacatgaactgtgagatagtaaacgtttattgtttaaagctacttggtttggggataatttgcgtttcagcagtagacaatatatttattttgtccaggggagtggaaaggcgattacagagtttgttgagccccatagagtcctagtctttgcttaaagaaatataccagttctttcta

SEQ ID NO: 371875 - DNA, 2947 bp, Homo sapiens
tccatcccacatggcggcgctcctgaggagactgctgcagcgcgagaggccttcggcggcctctggccgccccgtaggacggcgcgaggccaacctgggcactgatgccggggttgcggtgcgagtgcggttcgctcccagccccacaggcttcttgcacctgggtggcctccgcactgccttgtacaactacatctttgctaagaagtaccaggggagcttcatcctgaggctagaggacacagatcagactcgcgttgtgcctggggcagcagagaatattgaggacatgctggagtgggcaggcatcccgcctgatgagagcccccgccggggcggtcctgctgggccctaccagcaatctcagcggttggagctgtatgcccaggccacagaagcgctgctgaagaccggagctgcttacccctgtttctgctcaccccagcggctggagctcctgaagaaggaggccttgcggaaccaccagacgccccggtatgacaatcggtgcaggaacatgagccaggagcaggtggcccagaagctggccaaggaccccaagcctgcgatccgcttccgcctggagcaggtggtgccagccttccaggacctggtgtatggctggaataggcatgaagtggccagcgtggagggagacccagtcatcatgaagagcgacggcttccccacataccacctggcctgcgtggtggacgaccaccacatgggcatcagccacgtgctgcgaggctctgagtggctcgtctccactgccaagcacctgctcctctaccaggccctgggctggcagccaccccacttcgcccacctgcccctgctcctcaacagggatggcagcaagctctccaagaggcaaggggacgttttcctggagcactttgctgctgatggcttcctgcccgattccttgttggacatcatcaccaactgtggctcaggttttgcagagaaccaaatgggcaggaccctgccggagctgatcacacagttcaacctgacacaggtcacctgtcactcagccctgctggacctggagaagctcccagaattcaacagactgcacctccagcggctggtgagcaatgagagccagaggcgccagctggtggggaagctgcaggtccttgtggaggaggcctttggttgccagctgcaaaacagggatgtcctcaacccagtctacgtggagaggatcctcctgctgagacagggtcacatttgccgcctgcaggacttggtgtccccagtatactcttacctgtggactcgccctgcagtaggtcgagcacagctggacgccatctcggagaaggtggatgtgattgccaagcgtgtgctggggcttctagaaagatctggtatgagcttaactcaggatatgctgaatggagaactgaagaagctatcagaaggtctggaaggcaccaagtacagtaatgtgatgaaactccttcggatggccctcagtggacagcagcaaggacctcctgtagctgagatgatgttggccttgggaccaaaggaagtacgggaacggatccagaaggtggtttccagctagggagaggatgtgtcgggcagtggagatcgccctaagaacctgtgagcttagaaacagctttcagagaccagaaggaggcctggggcccttcagtgaagaggaatagcaagtgaaaggaggatggtggcagggtacatgaacccctaccaggcttctaggcttcccctgcatggcagccagcctctaagttggcccccaaccatccctgccttcttctattcacacccttgtgtggttccttcccacattgaataggcctgacttgtgtaaccactacactattgaagaaatgagagtttgacttctgagggtaagtcataaaatacatcgtggcttctgtcttgttttctttgatcgcttactttgggggaagccagcttccaggtcatgaaaatactcaagcagccttatggagtgctccacatgacaagggatggaggcctcccaccaatagccatgggagtgtgcaatcttgaaagctggtccttcaattccagccaagcattcacatgaccgcaatcctagctgatctcgcttgtgacctctatgggagaccctaagccagaaccactcagagaagctgctctggaacgtcagacacacatgaactgtgagatagtaaacgtttattgtttaaagctacttggtttggggataatttgcgtttcagcagtagacaatatatttattttgtccaggggagtggaaaggcgattacagagtttgttgagccccatagagtcctagtctttgcttaaagaaatataccagttctttctaatacagaatccattaagttcgttggttgcaaacaatagaaaccaactctgcctcacttatgtttattggaggccataagagagccacagcatctaccaaaaagccaaaaaaaaaacaggttttggaaaagacaggaactagctacaggagctaatggccaatcttgtctgagttctttgatggcgacacatgaactacagccgttttgttgttgttaatttctccgtgttttcccctcagttttggatgactctgctcaaggttcagattctgaggagcaagtatctgttgggctatctgaggtcctgctaccattccttggccagtaataggtagtttcacagggattatatgcaatggaggaaaagttgttctcaaggaaaactagggagctttctccagaagatgatgtaatggcagaaacaacaggtggttgaccacagaaggggacaataataatacttgtaatttattgtgcgcttatatgagcctcaccctctcccaggtgtcagataatgctcgtaaatgccttagtccatcatctcagtaaattttttttataacactaaaaaaagaagcagtatt

SEQ ID NO: 371876 - DNA, 1022 bp, Homo sapiens
gtactctgagtccggagtttgtgttctttaatacataggctacccaagttctgtgagttttgagtataactcagaattcagtagataacagcatcaaaacggttaaactataggtggcatatgctcacactactgtaattccaactaattcaattattcaactgctatccactttagcattcacattctgatttgaggaagtgtgttgtaaccataatattacattttcaaacagaacctttttaaagtttctgtgcttttatctttggtaatccagttagtaaagttcagtctctgagtgttaaaatgacatatcagttctgttcaaagatacgaatttttatgtgtttatataaaaatactatctactttcttttttaggtaactcagcagttgaaggcgcgattcttaccaagtccagttgttattaagaaacgtattgaaggacttattgagagagaatatttggcacgaacacctgaggatcgcaaagtatacacatatgtagcataaaatgcgttcagaaatttgatttattcttggactgtactcttcgcatggactgggaagttcttttaaatcattaaatattaagacgaccatctcttctattaaattacagtacatgttctagaccattgagatcaagcctttactccctttgagagtttccaacatcagttgattgagcttcaggctttacaacgtttatccctgtagagatcatctttacagttcctcgggaaaatgtgaatgtgctgcgttttgttttctcaccatagagaaaagagcttgggacttgaccacagtctaaatggtacaactgccagatgtagtcttctggttgccagtcgaggacacttgactccttaattgcattgaattcatccactatgtagcattttcttttgaaaattctgatctaccaatagtgacaaacatttgtatttttcttgaatttaatggaagtccaaccatggtaagtcaacttcctgtggttaggtatgagttgtttcctgatg

SEQ ID NO: 371877 - DNA, 4174 bp, Homo sapiens
aggagaaggaggaggaggaggacgacgttcggcctgcgcagtgagatgtttgtccggtcgccgccgccgccgccatcgcggaggagcgcgataaagggagccgagccggacgtgagggggaccccgcggagccgccgcgccagcgcagccccccagccgcatcggagtcgccagagtccgagccgccgccgccgccgccgccgcccccgccgccgccgcggctgcccaggggccggccagctccccagccctgcccgggggtcgcgccgccgccgcccccagcgtcgcccctagcctgcctgcccgccttaaatgtgacaccggcgtcgcggagcgcgacctgaagccgccgccggggaggggacgagcaccatgtcgaatctgagcaaaggcacgggcagccggaaggacaccaagatgcggatccgggcctttccgatgaccatggatgaaaaatatgtaaacagcatttgggaccttctgaaaaatgcaattcaagaaatccagcgtaagaataacagtggtcttagttttgaggagctctatagaaatgcatatacaatggttttgcataaacatggagaaaagctctacactggactaagagaagttgttaccgaacatctcataaataaggtgcgagaagatgtactaaattcattgaataacaactttcttcaaacgctaaatcaagcttggaatgatcatcaaacagctatggtgatgattagagacatactaatgtacatggaccgtgtgtatgtacaacaaaataatgtggagaacgtctacaatttgggattaattatttttcgagatcaagttgtacgttatgggtgtattagggatcatctacggcaaactctattggatatgattgcaagagagcggaaaggagaagtcgtagacagaggcgcaataagaaatgcttgccagatgttaatgattttaggtctcgaaggaagatcagtctatgaagaagattttgaggctccttttttggaaatgtctgcagaattttttcagatggaaagccagaaatttttagcagaaaatagtgcttcagtatatataaagaaagtagaagctagaattaatgaagaaatagaacgagtgatgcactgccttgacaaatcaacggaagaaccaattgtaaaggtggttgaaagggaactcatttccaagcacatgaagactatagtagaaatggagaattctgggctagtacatatgttgaaaaatggaaagacagaagaccttggttgcatgtacaagttatttagtcgtgtgccaaatggtttgaaaacaatgtgtgagtgtatgagttcctatttgagggagcaaggtaaagctcttgtttctgaagaaggagaaggaaagaatcctgttgactatatccagggcttattggatctgaagagtaggttcgatcgcttcctcctggaatcattcaacaatgaccgtctctttaaacaaactattgcgggtgactttgagtattttctcaacctcaactccaggtctcctgaatacctctcattatttattgatgataagctgaaaaagggagtcaaagggctaacagaacaagaagtagaaacaatattggataaagcaatggtcctttttaggtttatgcaagaaaaagatgtatttgaacgttattataaacaacacttggcaaggagacttctcacaaataaaagtgtttctgatgactctgaaaaaaacatgatatctaagttaaagactgaatgtggatgtcagttcacgtcaaaactggaaggaatgtttagggatatgagcatctcaaacacaacgatggatgaattcaggcaacatctacaggcaactggtgtatctttaggtggtgttgatcttacagtccgggtgctcacgacaggatattggcccactcagtcagccacaccaaagtgcaacatcccaccagcaccaagacatgcttttgagatattcagaaggttctacttagccaaacacagtggtcgacagctcacactccagcatcatatgggttctgcagatctcaatgccacattttatggaccagttaaaaaggaagatggatctgaagttggtgttggaggtgcacaagtaactggctctaatacacggaagcacatattgcaagtttccactttccagatgaccatattaatgctctttaataatagagaaaaatacacatttgaggaaattcagcaagagacagatatccctgaaagagagcttgttagagccctacagtccctcgcctgtggtaaaccaacacagcgggttcttacaaaagaacccaaatcaaaggaaatagaaaatggtcatatatttacagttaatgatcaattcacatccaaactacacagagtcaagattcaaacagttgctgccaaacaaggtgaatccgacccagagaggaaagaaacaaggcagaaagtagacgacgacagaaaacatgagatagaagctgctatagtgcggataatgaaatctagaaagaagatgcagcacaatgttctagtagcggaggtaactcagcagttgaaggcgcgattcttaccaagtccagttgttattaagaaacgtattgaaggacttattgagagagaatatttggcacgaacacctgaggatcgcaaagtatacacatatgtagcataaaatgcgttcagaaatttgatttattcttggactgtactcttcgcatggactgggaagttcttttaaatcattaaatattaagacgaccatctcttctattaaattacagtacatgttctagaccattgagatcaagcctttactccctttgagagtttccaacatcagttgattgagcttcaggctttacaacgtttatccctgtagagatcatctttacagttcctcgggaaaatgtgaatgtgctgcgttttgttttctttactgtatgaaaacaggaaaataaaagagaaatttagaaaatacagctcattacaataaaattgttggatttcatttccccaggtcttcagtgttgatgtaaatgtgttttgtagtgttgcttagcactttgcgcattgtgtaagttgggtaacaaaaatggcaaaagaaatgcagatttcccagttatcttgctctgaagacatttctttagctagtcttatttaattttaaaggtttgataaatatacaaagacccaagcatacaatttgagcatgctgtattctaccacttgcacttactcatcttctagccttatgaccaggaacctttgttttgggctcaagtacacatcctgatttggtttctccctgttgtaatttgagatttcccaaattaagtcttataatgattaggttttgttctgagttatttctagagaaagaaagtattttagtatgtgtaaattgtacaataatttttttgctgttgtactcactgctaatagtggattgtatagggtggtgtttttatttcatttattgtagacaaaaataatgaatttagtatacacatacccactaattcaagtatgtcagagcacaaagttggcagctggttatatttaattcagcccctctgaaaagcacatacagtctatactttgtttataaataccctaggtcctccctgcccctaaatatatattttggtgaagctgtggtgcactattaattttctgtttcaaaatgcaatctaaagatgcaataaatatgatgaccttgatagttttaatgaaatcttcaattcttgcagctgtgttttggaaagtgattaagcaatatttctcaaacctgatgattcttggatatttagctattgtcctccaaagagtcatcgtttcacgttttcaaacatgtgctttgtgctgaagattcttgtcagatatcctgtgcttccagagtatttttatcttcaattttatttaattttgtttcattttgttttcataagacaatgtttcagatatgtaatggggcaaaccactatagatttctgttggatagaaaaatgaaatgttactaataagtttaaattgacccttcgttgactatcagtactgttgatacatttattagaatgtatgtctcagaagatggtttctgtttaaatttatggtcaagttacaacaactgaattctaatatggattaaaaactccacataaatattt

SEQ ID NO: 371878 - DNA, 3548 bp, Homo sapiens
aggagaaggaggaggaggaggacgacgttcggcctgcgcagtgagatgtttgtccggtcgccgccgccgccgccatcgcggaggagcgcgataaagggagccgagccggacgtgagggggaccccgcggagccgccgcgccagcgcagccccccagccgcatcggagtcgccagagtccgagccgccgccgccgccgccgccgcccccgccgccgccgcggctgcccaggggccggccagctccccagccctgcccgggggtcgcgccgccgccgcccccagcgtcgcccctagcctgcctgcccgccttaaatgtgacaccggcgtcgcggagcgcgacctgaagccgccgccggggaggggacgagcaccatgtcgaatctgagcaaaggcacgggcagccggaaggacaccaagatgcggatccgggcctttccgatgaccatggatgaaaaatatgtaaacagcatttgggaccttctgaaaaatgcaattcaagaaatccagcgtaagaataacagtggtcttagttttgaggagctctatagaaatgcatatacaatggttttgcataaacatggagaaaagctctacactggactaagagaagttgttaccgaacatctcataaataaggtgcgagaagatgtactaaattcattgaataacaactttcttcaaacgctaaatcaagcttggaatgatcatcaaacagctatggtgatgattagagacatactaatgtacatggaccgtgtgtatgtacaacaaaataatgtggagaacgtctacaatttgggattaattatttttcgagatcaagttgtacgttatgggtgtattagggatcatctacggcaaactctattggatatgattgcaagagagcggaaaggagaagtcgtagacagaggcgcaataagaaatgcttgccagatgttaatgattttaggtctcgaaggaagatcagtctatgaagaagattttgaggctccttttttggaaatgtctgcagaattttttcagatggaaagccagaaatttttagcagaaaatagtgcttcagtatatataaagaaagtagaagctagaattaatgaagaaatagaacgagtgatgcactgccttgacaaatcaacggaagaaccaattgtaaaggtggttgaaagggaactcatttccaagcacatgaagactatagtagaaatggagaattctgggctagtacatatgttgaaaaatggaaagacagaagaccttggttgcatgtacaagttatttagtcgtgtgccaaatggtttgaaaacaatgtgtgagtgtatgagttcctatttgagggagcaaggtaaagctcttgtttctgaagaaggagaaggaaagaatcctgttgactatatccagggcttattggatctgaagagtaggttcgatcgcttcctcctggaatcattcaacaatgaccgtctctttaaacaaactattgcgggtgactttgagtattttctcaacctcaactccaggtctcctgaatacctctcattatttattgatgataagctgaaaaagggagtcaaagggctaacagaacaagaagtagaaacaatattggataaagcaatggtcctttttaggtttatgcaagaaaaagatgtatttgaacgttattataaacaacacttggcaaggagacttctcacaaataaaagtgtttctgatgactctgaaaaaaacatgatatctaagttaaagactgaatgtggatgtcagttcacgtcaaaactggaaggaatgtttagggatatgagcatctcaaacacaacgatggatgaattcaggcaacatctacaggcaactggtgtatctttaggtggtgttgatcttacagtccgggtgctcacgacaggatattggcccactcagtcagccacaccaaagtgcaacatcccaccagcaccaagacatgcttttgagatattcagaaggttctacttagccaaacacagtggtcgacagctcacactccagcatcatatgggttctgcagatctcaatgccacattttatggaccagttaaaaaggaagatggatctgaagttggtgttggaggtgcacaagtaactggctctaatacacggaagcacatattgcaagtttccactttccagatgaccatattaatgctctttaataatagagaaaaatacacatttgaggaaattcagcaagagacagatatccctgaaagagagcttgttagagccctacagtccctcgcctgtggtaaaccaacacagcgggttcttacaaaagaacccaaatcaaaggaaatagaaaatggtcatatatttacagttaatgatcaattcacatccaaactacacagagtcaagattcaaacagttgctgccaaacaaggtgaatccgacccagagaggaaagaaacaaggcagaaagtagacgacgacagaaaacatgagatagaagctgctatagtgcggataatgaaatctagaaagaagatgcagcacaatgttctagtagcggaggtaactcagcagttgaaggcgcgattcttaccaagtccagttgttattaagaaacgtattgaaggacttattgagagagaatatttggcacgaacacctgaggatcgcaaagtatacacatatgtagcataaaatgcgttcagaaatttgatttattcttggactgtactcttcgcatggactgggaagttcttttaaatcattaaatattaagacgaccatctcttctattaaattacagtacatgttctagaccattgagatcaagcctttactccctttgagagtttccaacatcagttgattgagcttcaggctttacaacgtttatccctgtagagatcatctttacagttcctcgggaaaatgtgaatgtgctgcgttttgttttctttactgtatgaaaacaggaaaataaaagagaaatttagaaaatacagctcattacaataaaattgttggatttcatttccccaggtcttcagtgttgatgtaaatgtgttttgtagtgttgcttagcactttgcgcattgtgtaagttgggtaacaaaaatggcaaaagaaatgcagatttcccagttatcttgctctgaagacatttctttagctagtcttatttaattttaaaggtttgataaatatacaaagacccaagcatacaatttgagcatgctgtattctaccacttgcacttactcatcttctagccttatgaccaggaacctttgttttgggctcaagtacacatcctgatttggtttctccctgttgtaatttgagatttcccaaattaagtcttataatgattaggttttgttctgagttatttctagagaaagaaagtattttagtatgtgtaaattgtacaataatttttttgctgttgtactcactgctaatagtggattgtccttagggggggttaaggttcccgttatattagacgagcaatcctgtggcatatataaaaaacccgccctagggtggaaaataaaaaagtg

SEQ ID NO: 371879 - DNA, 3141 bp, Homo sapiens
aggagaaggaggaggaggaggacgacgttcggcctgcgcagtgagatgtttgtccggtcgccgccgccgccgccatcgcggaggagcgcgataaagggagccgagccggacgtgagggggaccccgcggagccgccgcgccagcgcagccccccagccgcatcggagtcgccagagtccgagccgccgccgccgccgccgccgcccccgccgccgccgcggctgcccaggggccggccagctccccagccctgcccgggggtcgcgccgccgccgcccccagcgtcgcccctagcctgcctgcccgccttaaatgtgacaccggcgtcgcggagcgcgacctgaagccgccgccggggaggggacgagcaccatgtcgaatctgagcaaaggcacgggcagccggaaggacaccaagatgcggatccgggcctttccgatgaccatggatgaaaaatatgtaaacagcatttgggaccttctgaaaaatgcaattcaagaaatccagcgtaagaataacagtggtcttagttttgaggagctctatagaaatgcatatacaatggttttgcataaacatggagaaaagctctacactggactaagagaagttgttaccgaacatctcataaataaggaataatacataagtgatgttgtgtcctcagtgcatcacatcaggaggcacttgatgtcagtttatcccattattggtgatgttaactttgatcattggtgtccgccagatttctccactgtaaaggtgcgagaagatgtactaaattcattgaataacaactttcttcaaacgctaaatcaagcttggaatgatcatcaaacagctatggtgatgattagagacatactaatgtacatggaccgtgtgtatgtacaacaaaataatgtggagaacgtctacaatttgggattaattatttttcgagatcaagttgtacgttatgggtgtattagggatcatctacggcaaactctattggatatgattgcaagagagcggaaaggagaagtcgtagacagaggcgcaataagaaatgcttgccagatgttaatgattttaggtctcgaaggaagatcagtctatgaagaagattttgaggctccttttttggaaatgtctgcagaattttttcagatggaaagccagaaatttttagcagaaaatagtgcttcagtatatataaagaaagtagaagctagaattaatgaagaaatagaacgagtgatgcactgccttgacaaatcaacggaagaaccaattgtaaaggtggttgaaagggaactcatttccaagcacatgaagactatagtagaaatggagaattctgggctagtacatatgttgaaaaatggaaagacagaagaccttggttgcatgtacaagttatttagtcgtgtgccaaatggtttgaaaacaatgtgtgagtgtatgagttcctatttgagggagcaaggtaaagctcttgtttctgaagaaggagaaggaaagaatcctgttgactatatccagggcttattggatctgaagagtaggttcgatcgcttcctcctggaatcattcaacaatgaccgtctctttaaacaaactattgcgggtgactttgagtattttctcaacctcaactccaggtctcctgaatacctctcattatttattgatgataagctgaaaaagggagtcaaagggctaacagaacaagaagtagaaacaatattggataaagcaatggtcctttttaggtttatgcaagaaaaagatgtatttgaacgttattataaacaacacttggcaaggagacttctcacaaataaaagtgtttctgatgactctgaaaaaaacatgatatctaagttaaagactgaatgtggatgtcagttcacgtcaaaactggaaggaatgtttagggatatgagcatctcaaacacaacgatggatgaattcaggcaacatctacaggcaactggtgtatctttaggtggtgttgatcttacagtccgggtgctcacgacaggatattggcccactcagtcagccacaccaaagtgcaacatcccaccagcaccaagacatgcttttgagatattcagaaggttctacttagccaaacacagtggtcgacagctcacactccagcatcatatgggttctgcagatctcaatgccacattttatggaccagttaaaaaggaagatggatctgaagttggtgttggaggtgcacaagtaactggctctaatacacggaagcacatattgcaagtttccactttccagatgaccatattaatgctctttaataatagagaaaaatacacatttgaggaaattcagcaagagacagatatccctgaaagagagcttgttagagccctacagtccctcgcctgtggtaaaccaacacagcgggttcttacaaaagaacccaaatcaaaggaaatagaaaatggtcatatatttacagttaatgatcaattcacatccaaactacacagagtcaagattcaaacagttgctgccaaacaaggtgaatccgacccagagaggaaagaaacaaggcagaaagtagacgacgacagaaaacatgagatagaagctgctatagtgcggataatgaaatctagaaagaagatgcagcacaatgttctagtagcggaggtaactcagcagttgaaggcgcgattcttaccaagtccagttgttattaagaaacgtattgaaggacttattgagagagaatatttggcacgaacacctgaggatcgcaaagtatacacatatgtagcataaaatgcgttcagaaatttgatttattcttggactgtactcttcgcatggactgggaagttcttttaaatcattaaatattaagacgaccatctcttctattaaattacagtacatgttctagaccattgagatcaagcctttactccctttgagagtttccaacatcagttgattgagcttcaggctttacaacgtttatccctgtagagatcatctttacagttcctcgggaaaatgtgaatgtgctgcgttttgttttctttactgtatgaaaacaggaaaataaaagagaaatttagaaaatacagctcattacaataaaattgttggatttca

SEQ ID NO: 371880 - DNA, 2961 bp, Homo sapiens
aggagaaggaggaggaggaggacgacgttcggcctgcgcagtgagatgtttgtccggtcgccgccgccgccgccatcgcggaggagcgcgataaagggagccgagccggacgtgagggggaccccgcggagccgccgcgccagcgcagccccccagccgcatcggagtcgccagagtccgagccgccgccgccgccgccgccgcccccgccgccgccgcggctgcccaggggccggccagctccccagccctgcccgggggtcgcgccgccgccgcccccagcgtcgcccctagcctgcctgcccgccttaaatgtgacaccggcgtcgcggagcgcgacctgaagccgccgccggggaggggacgagcaccatgtcgaatctgagcaaaggcacgggcagccggaaggacaccaagatgcggatccgggcctttccgatgaccatggatgaaaaatatgtaaacagcatttgggaccttctgaaaaatgcaattcaagaaatccagcgtaagaataacagtggtcttagttttgaggagctctatagaaatgcatatacaatggttttgcataaacatggagaaaagctctacactggactaagagaagttgttaccgaacatctcataaataaggtgcgagaagatgtactaaattcattgaataacaactttcttcaaacgctaaatcaagcttggaatgatcatcaaacagctatggtgatgattagagacatactaatgtacatggaccgtgtgtatgtacaacaaaataatgtggagaacgtctacaatttgggattaattatttttcgagatcaagttgtacgttatgggtgtattagggatcatctacggcaaactctattggatatgattgcaagagagcggaaaggagaagtcgtagacagaggcgcaataagaaatgcttgccagatgttaatgattttaggtctcgaaggaagatcagtctatgaagaagattttgaggctccttttttggaaatgtctgcagaattttttcagatggaaagccagaaatttttagcagaaaatagtgcttcagtatatataaagaaagtagaagctagaattaatgaagaaatagaacgagtgatgcactgccttgacaaatcaacggaagaaccaattgtaaaggtggttgaaagggaactcatttccaagcacatgaagactatagtagaaatggagaattctgggctagtacatatgttgaaaaatggaaagacagaagaccttggttgcatgtacaagttatttagtcgtgtgccaaatggtttgaaaacaatgtgtgagtgtatgagttcctatttgagggagcaaggtaaagctcttgtttctgaagaaggagaaggaaagaatcctgttgactatatccagggcttattggatctgaagagtaggttcgatcgcttcctcctggaatcattcaacaatgaccgtctctttaaacaaactattgcgggtgactttgagtattttctcaacctcaactccaggtctcctgaatacctctcattatttattgatgataagctgaaaaagggagtcaaagggctaacagaacaagaagtagaaacaatattggataaagcaatggtcctttttaggtttatgcaagaaaaagatgtatttgaacgttattataaacaacacttggcaaggagacttctcacaaataaaagtgtttctgatgactctgaaaaaaacatgatatctaagttaaagactgaatgtggatgtcagttcacgtcattcaggcaacatctacaggcaactggtgtatctttaggtggtgttgatcttacagtccgggtgctcacgacaggatattggcccactcagtcagccacaccaaagtgcaacatcccaccagcaccaagacatgcttttgagatattcagaaggttctacttagccaaacacagtggtcgacagctcacactccagcatcatatgggttctgcagatctcaatgccacattttatggaccagttaaaaaggaagatggatctgaagttggtgttggaggtgcacaagtaactggctctaatacacggaagcacatattgcaagtttccactttccagatgaccatattaatgctctttaataatagagaaaaatacacatttgaggaaattcagcaagagacagatatccctgaaagagagcttgttagagccctacagtccctcgcctgtggtaaaccaacacagcgggttcttacaaaagaacccaaatcaaaggaaatagaaaatggtcatatatttacagttaatgatcaattcacatccaaactacacagagtcaagattcaaacagttgctgccaaacaaggtgaatccgacccagagaggaaagaaacaaggcagaaagtagacgacgacagaaaacatgagatagaagctgctatagtgcggataatgaaatctagaaagaagatgcagcacaatgttctagtagcggaggtaactcagcagttgaaggcgcgattcttaccaagtccagttgttattaagaaacgtattgaaggacttattgagagagaatatttggcacgaacacctgaggatcgcaaagtatacacatatgtagcataaaatgcgttcagaaatttgatttattcttggactgtactcttcgcatggactgggaagttcttttaaatcattaaatattaagacgaccatctcttctattaaattacagtacatgttctagaccattgagatcaagcctttactccctttgagagtttccaacatcagttgattgagcttcaggctttacaacgtttatccctgtagagatcatctttacagttcctcgggaaaatgtgaatgtgctgcgttttgttttctttactgtatgaaaacaggaaaataaaagagaaatttagaaaatacagctcattacaataaaattgttggatttca

SEQ ID NO: 371881 - DNA, 1953 bp, Homo sapiens
tccgtctcaaaagaaaaaaaaaatagaaataaaaaaataaagtaagggcaatggcctttttactgtttggattataacaaattattgccttttgtttgcacagttgaggctttcagtgagcttaaatgaaaaattccgtcttttggctgtgtaagtttttgcctgcatatgcaaaggcttcataaaataatctctgtgactaaaatttcatttcatctgttctcaatcatcccttaacccagcgctatattaccttatgcctccaattcagtggtagccctctacggaatagaattccactccaacccctcattcatgatgcactaaatgagaatgtaagaatgatgctactgtgtgaagtaggagacactttctcaaaccgtatccctttttttgatgtatgtcaaccagatatctatgttttcaaacaatagtgtttttaagctgtaaatgaaccgtagtactgcttttgtagaactaaaattgtataattgttacatcatcttaattttgcagctaacagaacaagaagtagaaacaatattggataaagcaatggtcctttttaggtttatgcaagaaaaagatgtatttgaacgttattataaacaacacttggcaaggagacttctcacaaataaaagtgtttctgatgactctgaaaaaaacatgatatctaagttaaagactgaatgtggatgtcagttcacgtcaaaactggaaggaatgtttagggatatgagcatctcaaacacaacgatggatgaattcaggcaacatctacaggcaactggtgtatctttaggtggtgttgatcttacagtccgggtgctcacgacaggatattggcccactcagtcagccacaccaaagtgcaacatcccaccagcaccaagacatgcttttgagatattcagaaggttctacttagccaaacacagtggtcgacagctcacactccagcatcatatgggttctgcagatctcaatgccacattttatggaccagttaaaaaggaagatggatctgaagttggtgttggaggtgcacaagtaactggctctaatacacggaagcacatattgcaagtttccactttccagatgaccatattaatgctctttaataatagagaaaaatacacatttgaggaaattcagcaagagacagatatccctgaaagagagcttgttagagccctacagtccctcgcctgtggtaaaccaacacagcgggttcttacaaaagaacccaaatcaaaggaaatagaaaatggtcatatatttacagttaatgatcaattcacatccaaactacacagagtcaagattcaaacagttgctgccaaacaaggtgaatccgacccagagaggaaagaaacaaggcagaaagtagacgacgacagaaaacatgagatagaagctgctatagtgcggataatgaaatctagaaagaagatgcagcacaatgttctagtagcggaggtaactcagcagttgaaggcgcgattcttaccaagtccagttgttattaagaaacgtattgaaggacttattgagagagaatatttggcacgaacacctgaggatcgcaaagtatacacatatgtagcataaaatgcgttcagaaatttgatttattcttggactgtactcttcgcatggactgggaagttcttttaaatcattaaatattaagacgaccatctcttctattaaattacagtacatgttctagaccattgagatcaagcctttactccctttgagagtttccaacatcagttgattgagcttcaggctttacaacgtttatccctgtagagatcatctttacagttcctcgggaaaatgtgaatgtgctgcgttttgttttctttactgtatgaaaacaggaaaataaaagagaaatttagaaaatacagctcattacaataaaattgttggatttca

SEQ ID NO: 371882 - DNA, 3312 bp, Homo sapiens
aggagaaggaggaggaggaggacgacgttcggcctgcgcagtgagatgtttgtccggtcgccgccgccgccgccatcgcggaggagcgcgataaagggagccgagccggacgtgagggggaccccgcggagccgccgcgccagcgcagccccccagccgcatcggagtcgccagagtccgagccgccgccgccgccgccgccgcccccgccgccgccgcggctgcccaggggccggccagctccccagccctgcccgggggtcgcgccgccgccgcccccagcgtcgcccctagcctgcctgcccgccttaaatgtgacaccggcgtcgcggagcgcgacctgaagccgccgccggggaggggacgagcaccatgtcgaatctgagcaaaggcacgggcagccggaaggacaccaagatgcggatccgggcctttccgatgaccatggatgaaaaatatgtaaacagcatttgggaccttctgaaaaatgcaattcaagaaatccagcgtaagaataacagtggtcttagttttgaggagctctatagaaatgcatatacaatggttttgcataaacatggagaaaagctctacactggactaagagaagttgttaccgaacatctcataaataaggtgcgagaagatgtactaaattcattgaataacaactttcttcaaacgctaaatcaagcttggaatgatcatcaaacagctatggtgatgattagagacatactaatgtacatggaccgtgtgtatgtacaacaaaataatgtggagaacgtctacaatttgggattaattatttttcgagatcaagttgtacgttatgggtgtattagggatcatctacggcaaactctattggatatgattgcaagagagcggaaaggagaagtcgtagacagaggcgcaataagaaatgcttgccagatgttaatgattttaggtctcgaaggaagatcagtctatgaagaagattttgaggctccttttttggaaatgtctgcagaattttttcagatggaaagccagaaatttttagcagaaaatagtgcttcagtatatataaagaaagtagaagctagaattaatgaagaaatagaacgagtgatgcactgccttgacaaatcaacggaagaaccaattgtaaaggtggttgaaagggaactcatttccaagcacatgaagactatagtagaaatggagaattctgggctagtacatatgttgaaaaatggaaagacagaagaccttggttgcatgtacaagttatttagtcgtgtgccaaatggtttgaaaacaatgtgtgagtgtatgagttcctatttgagggagcaaggtaaagctcttgtttctgaagaaggagaaggaaagaatcctgttgactatatccagggcttattggatctgaagagtaggttcgatcgcttcctcctggaatcattcaacaatgaccgtctctttaaacaaactattgcgggtgactttgagtattttctcaacctcaactccaggtctcctgaatacctctcattatttattgatgataagctgaaaaagggagtcaaagggctaacagaacaagaagtagaaacaatattggataaagcaatggtcctttttaggtttatgcaagaaaaagatgtatttgaacgttattataaacaacacttggcaaggagacttctcacaaataaaagtgtttctgatgactctgaaaaaaacatgatatctaagttaaagactgaatgtggatgtcagttcacgtcaaaactggaaggaatgtttagggatatgagcatctcaaacacaacgatggatgaattcaggcaacatctacaggcaactggtgtatctttaggtggtgttgatcttacagtccgggtgctcacgacaggatattggcccactcagtcagccacaccaaagtgcaacatcccaccagcaccaagacatgcttttgagatattcagaaggttctacttagccaaacacagtggtcgacagctcacactccagcatcatatgggttctgcagatctcaatgccacattttatggaccagttaaaaaggaagatggatctgaagttggtgttggaggtgcacaagtaactggctctaatacacggaagcacatattgcaagtttccactttccagatgaccatattaatgctctttaataatagagaaaaatacacatttgaggaaattcagcaagagacagatatccctgaaagagagcttgttagagccctacagtccctcgcctgtggtaaaccaacacagcgggttcttacaaaagaacccaaatcaaaggaaatagaaaatggtcatatatttacagttaatgatcaattcacatccaaactacacagagtcaagattcaaacagttgctgccaaacaaggtgaatccgacccagagaggaaagaaacaaggcagaaagtagacgacgacagaaaacatgagatagaagctgctatagtgcggataatgaaatctagaaagaagatgcagcacaatgttctagtagcggaggtaactcagcagttgaaggcgcgattcttaccaagtccagttgttattaagaaacgtattgaaggacttattgagagagaatatttggcacgaacacctgaggatcgcaaagtatacacatatgtagcataaaatgcgttcagaaatttgatttattcttggactgtactcttcgcatggactgggaagttcttttaaatcattaaatattaagacgaccatctcttctattaaattacagtacatgttctagaccattgagatcaagcctttactccctttgagagtttccaacatcagttgattgagcttcaggctttacaacgtttatccctgtagagatcatctttacagttcctcgggaaaatgtgaatgtgctgcgttttgttttctttactgtatgaaaacaggaaaataaaagagaaatttagaaaatacagctcattacaataaaattgttggatttcaaaaaaaaaaaaaaaaaaaaaaaaaaaaaaattttttggggggctgggcccggaaaaagtttttaaaacctcttggttgggcgcgcgcgggggccacagtatgttaatgtgaacacttggcacaaaggtggtcaccaagaaaaaatcccggggcaacagatcactgggctgggtttcccacccaattaaaaaacgccgcggggggaaccgcgcttcgtttttgaacaattcccagagggggtccagagggcacaggggttgctacaacagggggtccaagagcgccgaattaaatacg

SEQ ID NO: 371883 - DNA, 3091 bp, Homo sapiens
aggagaaggaggaggaggaggacgacgttcggcctgcgcagtgagatgtttgtccggtcgccgccgccgccgccatcgcggaggagcgcgataaagggagccgagccggacgtgagggggaccccgcggagccgccgcgccagcgcagccccccagccgcatcggagtcgccagagtccgagccgccgccgccgccgccgccgcccccgccgccgccgcggctgcccaggggccggccagctccccagccctgcccgggggtcgcgccgccgccgcccccagcgtcgcccctagcctgcctgcccgccttaaatgtgacaccggcgtcgcggagcgcgacctgaagccgccgccggggaggggacgagcaccatgtcgaatctgagcaaaggcacgggcagccggaaggacaccaagatgcggatccgggcctttccgatgaccatggatgaaaaatatgtaaacagcatttgggaccttctgaaaaatgcaattcaagaaatccagcgtaagaataacagtggtcttagttttgaggagctctatagaaatgcatatacaatggttttgcataaacatggagaaaagctctacactggactaagagaagttgttaccgaacatctcataaataaggtgcgagaagatgtactaaattcattgaataacaactttcttcaaacgctaaatcaagcttggaatgatcatcaaacagctatggtgatgattagagacatactaatgtacatggaccgtgtgtatgtacaacaaaataatgtggagaacgtctacaatttgggattaattatttttcgagatcaagttgtacgttatgggtgtattagggatcatctacggcaaactctattggatatgattgcaagagagcggaaaggagaagtcgtagacagaggcgcaataagaaatgcttgccagatgttaatgattttaggtctcgaaggaagatcagtctatgaagaagattttgaggctccttttttggaaatgtctgcagaattttttcagatggaaagccagaaatttttagcagaaaatagtgcttcagtatatataaagaaagtagaagctagaattaatgaagaaatagaacgagtgatgcactgccttgacaaatcaacggaagaaccaattgtaaaggtggttgaaagggaactcatttccaagcacatgaagactatagtagaaatggagaattctgggctagtacatatgttgaaaaatggaaagacagaagaccttggttgcatgtacaagttatttagtcgtgtgccaaatggtttgaaaacaatgtgtgagtgtatgagttcctatttgagggagcaaggtaaagctcttgtttctgaagaaggagaaggaaagaatcctgttgactatatccagggcttattggatctgaagagtaggttcgatcgcttcctcctggaatcattcaacaatgaccgtctctttaaacaaactattgcgggtgactttgagtattttctcaacctcaactccaggtctcctgaatacctctcattatttattgatgataagctgaaaaagggagtcaaagggctaacagaacaagaagtagaaacaatattggataaagcaatggtcctttttaggtttatgcaagaaaaagatgtatttgaacgttattataaacaacacttggcaaggagacttctcacaaataaaagtgtttctgatgactctgaaaaaaacatgatatctaagttaaagactgaatgtggatgtcagttcacgtcaaaactggaaggaatgtttagggatatgagcatctcaaacacaacgatggatgaattcaggcaacatctacaggcaactggtgtatctttaggtggtgttgatcttacagtccgggtgctcacgacaggatattggcccactcagtcagccacaccaaagtgcaacatcccaccagcaccaagacatgcttttgagatattcagaaggttctacttagccaaacacagtggtcgacagctcacactccagcatcatatgggttctgcagatctcaatgccacattttatggaccagttaaaaaggaagatggatctgaagttggtgttggaggtgcacaagtaactggctctaatacacggaagcacatattgcaagtttccactttccagatgaccatattaatgctctttaataatagagaaaaatacacatttgaggaaattcagcaagagacagatatccctgaaagagagcttgttagagccctacagtccctcgcctgtggtaaaccaacacagcgggttcttacaaaagaacccaaatcaaaggaaatagaaaatggtcatatatttacagttaatgatcaattcacatccaaactacacagagtcaagattcaaacagttgctgccaaacaaggtgaatccgacccagagaggaaagaaacaaggcagaaagtagacgacgacagaaaacatgagatagaagctgctatagtgcggataatgaaatctagaaagaagatgcagcacaatgttctagtagcggaggtaactcagcagttgaaggcgcgattcttaccaagtccagttgttattaagaaacgtattgaaggacttattgagagagaatatttggcacgaacacctgaggatcgcaaagtatacacatatgtagcataaaatgcgttcagaaatttgatttattcttggactgtactcttcgcatggactgggaagttcttttaaatcattaaatattaagacgaccatctcttctattaaattacagtacatgttctagaccattgagatcaagcctttactccctttgagagtttccaacatcagttgattgagcttcaggctttacaacgtttatccctgtagagatcatctttacagttcctcgggaaaatgtgaatgtgctgcgttttgttttctttactgtatgaaaacaggaaaataaaagagaaatttagaaaatacagctcattacaataaaattgttggatttcacaaaaaaaaagagaatatgtagaaaataaaaaaaagaaaggaaatggaatggtggagggaaaaagatgaaagaaaa

SEQ ID NO: 371884 - DNA, 2713 bp, Homo sapiens
  misc_feature (2551)..(2551): n is a, c, g, or t
  misc_feature (2555)..(2556): n is a, c, g, or t
  misc_feature (2559)..(2560): n is a, c, g, or t
  misc_feature (2567)..(2568): n is a, c, g, or t
  misc_feature (2570)..(2570): n is a, c, g, or t
  misc_feature (2573)..(2573): n is a, c, g, or t
  misc_feature (2576)..(2576): n is a, c, g, or t
aggagaaggaggaggaggaggacgacgttcggcctgcgcagtgagatgtttgtccggtcgccgccgccgccgccatcgcggaggagcgcgataaagggagccgagccggacgtgagggggaccccgcggagccgccgcgccagcgcagccccccagccgcatcggagtcgccagagtccgagccgccgccgccgccgccgccgcccccgccgccgccgcggctgcccaggggccggccagctccccagccctgcccgggggtcgcgccgccgccgcccccagcgtcgcccctagcctgcctgcccgccttaaatgtgacaccggcgtcgcggagcgcgacctgaagccgccgccggggaggggacgagcaccatgtcgaatctgagcaaaggcacgggcagccggaaggacaccaagatgcggatccgggcctttccgatgaccatggatgaaaaatatgtaaacagcatttgggaccttctgaaaaatgcaattcaagaaatccagcgtaagaataacagtggtcttagttttgaggagctctatagaaatgcatatacaatggttttgcataaacatggagaaaagctctacactggactaagagaagttgttaccgaacatctcataaataaggtgcgagaagatgtactaaattcattgaataacaactttcttcaaacgctaaatcaagcttggaatgatcatcaaacagctatggtgatgattagagacatactaatgtacatggaccgtgtgtatgtacaacaaaataatgtggagaacgtctacaatttgggattaattatttttcgagatcaagttgtacgttatgggtgtattagggatcatctacggcaaactctattggatatgattgcaagagagcggaaaggagaagtcgtagacagaggcgcaataagaaatgcttgccagatgttaatgattttaggtctcgaaggaagatcagtctatgaagaagattttgaggctccttttttggaaatgtctgcagaattttttcagatggaaagccagaaatttttagcagaaaatagtgcttcagtatatataaagaaagtagaagctagaattaatgaagaaatagaacgagtgatgcactgccttgacaaatcaacggaagaaccaattgtaaaggtggttgaaagggaactcatttccaagcacatgaagactatagtagaaatggagaattctgggctagtacatatgttgaaaaatggaaagacagaagaccttggttgcatgtacaagttatttagtcgtgtgccaaatggtttgaaaacaatgtgtgagtgtatgagttcctatttgagggagcaaggtaaagctcttgtttctgaagaaggagaaggaaagaatcctgttgactatatccagggcttattggatctgaagagtaggttcgatcgcttcctcctggaatcattcaacaatgaccgtctctttaaacaaactattgcgggtgactttgagtattttctcaacctcaactccaggtctcctgaatacctctcattatttattgatgataagctgaaaaagggagtcaaagggctaacagaacaagaagtagaaacaatattggataaagcaatggtcctttttaggtttatgcaagaaaaagatgtatttgaacgttattataaacaacacttggcaaggagacttctcacaaataaaagtgtttctgatgactctgaaaaaaacatgatatctaagttaaagactgaatgtggatgtcagttcacgtcaaaactggaaggaatgtttagggatatgagcatctcaaacacaacgatggatgaattcaggcaacatctacaggcaactggtgtatctttaggtggtgttgatcttacagtccgggtgctcacgacaggatattggcccactcagtcagccacaccaaagtgcaacatcccaccagcaccaagacatgcttttgagatattcagaaggttctacttagccaaacacagtggtcgacagctcacactccagcatcatatgggttctgcagatctcaatgccacattttatggaccagttaaaaaggaagatggatctgaagttggtgttggaggtgcacaagtaactggctctaatacacggaagcacatattgcaagtttccactttccagatgaccatattaatgctctttaataatagagaaaaatacacatttgaggaaattcagcaagagacagatatccctgaaagagagcttgttagagccctacagtccctcgcctgtggtaaaccaacacagcgggttcttacaaaagaacccaaatcaaaggaaatagaaaatggtcatatatttacagttaatgatcaattcacatccaaactacacagagtcaagattcaaacagttgctgccaaacaaggtgaatccgacccagagaggaaagaaacaaggcagaaagtagacgacgacagaaaacatgagatagaagctgctatagtgcggataatgaaatctagaaagaagatgcagcacaatgttctagtagcggaggtanctcnncanntgaaggnncnatnttncccagtcccatggtattaagcacggtttgaggcctttggacacacacttcgggcgcaccttgggctcacgttcaccttgtgctacggcgccagattgatattggacagacttcatgcgggcgactaacccatcacac

SEQ ID NO: 371885 - DNA, 2570 bp, Homo sapiens
aggagaaggaggaggaggaggacgacgttcggcctgcgcagtgagatgtttgtccggtcgccgccgccgccgccatcgcggaggagcgcgataaagggagccgagccggacgtgagggggaccccgcggagccgccgcgccagcgcagccccccagccgcatcggagtcgccagagtccgagccgccgccgccgccgccgccgcccccgccgccgccgcggctgcccaggggccggccagctccccagccctgcccgggggtcgcgccgccgccgcccccagcgtcgcccctagcctgcctgcccgccttaaatgtgacaccggcgtcgcggagcgcgacctgaagccgccgccggggaggggacgagcaccatgtcgaatctgagcaaaggcacgggcagccggaaggacaccaagatgcggatccgggcctttccgatgaccatggatgaaaaatatgtaaacagcatttgggaccttctgaaaaatgcaattcaagaaatccagcgtaagaataacagtggtcttagttttgaggagctctatagaaatgcatatacaatggttttgcataaacatggagaaaagctctacactggactaagagaagttgttaccgaacatctcataaataaggtgcgagaagatgtactaaattcattgaataacaactttcttcaaacgctaaatcaagcttggaatgatcatcaaacagctatggtgatgattagagacatactaatgtacatggaccgtgtgtatgtacaacaaaataatgtggagaacgtctacaatttgggattaattatttttcgagatcaagttgtacgttatgggtgtattagggatcatctacggcaaactctattggatatgattgcaagagagcggaaaggagaagtcgtagacagaggcgcaataagaaatgcttgccagatgttaatgattttaggtctcgaaggaagatcagtctatgaagaagattttgaggctccttttttggaaatgtctgcagaattttttcagatggaaagccagaaatttttagcagaaaatagtgcttcagtatatataaagaaagtagaagctagaattaatgaagaaatagaacgagtgatgcactgccttgacaaatcaacggaagaaccaattgtaaaggtggttgaaagggaactcatttccaagcacatgaagactatagtagaaatggagaattctgggctagtacatatgttgaaaaatggaaagacagaagaccttggttgcatgtacaagttatttagtcgtgtgccaaatggtttgaaaacaatgtgtgagtgtatgagttcctatttgagggagcaaggtaaagctcttgtttctgaagaaggagaaggaaagaatcctgttgactatatccagggcttattggatctgaagagtaggttcgatcgcttcctcctggaatcattcaacaatgaccgtctctttaaacaaactattgcgggtgactttgagtattttctcaacctcaactccaggtctcctgaatacctctcattatttattgatgataagctgaaaaagggagtcaaagggctaacagaacaagaagtagaaacaatattggataaagcaatggtcctttttaggtttatgcaagaaaaagatgtatttgaacgttattataaacaacacttggcaaggagacttctcacaaataaaagtgtttctgatgactctgaaaaaaacatgatatctaagttaaagactgaatgtggatgtcagttcacgtcaaaactggaaggaatgtttagggatatgagcatctcaaacacaacgatggatgaattcaggcaacatctacaggcaactggtgtatctttaggtggtgttgatcttacagtccgggtgctcacgacaggatattggcccactcagtcagccacaccaaagtgcaacatcccaccagcaccaagacatgcttttgagatattcagaaggttctacttagccaaacacagtggtcgacagctcacactccagcatcatatgggttctgcagatctcaatgccacattttatggaccagttaaaaaggaagatggatctgaagttggtgttggaggtgcacaagtaactggctctaatacacggaagcacatattgcaagtttccactttccagatgaccatattaatgctctttaataatagagaaaaatacacatttgaggaaattcagcaagagacagatatccctgaaagagagcttgttagagccctacagtccctcgcctgtggtaaaccaacacagcgggttcttacaaaagaacccaaatcaaaggaaatagaaaatggtcatatatttacagttaatgatcaattcacatccaaactacacagagtcaagattcaaacagttgctgccaaacaaggtgaatccgacccagagaggaaagaaacaaggcagaaagtagacgacgacagaaaacatgagatagaagctgctatagtgcggataatgaaatctagaaagaagatgcagcacaatgttctagtagcggaggtgaggactcttcactactgggc

SEQ ID NO: 371886 - DNA, 2582 bp, Homo sapiens
aggagaaggaggaggaggaggacgacgttcggcctgcgcagtgagatgtttgtccggtcgccgccgccgccgccatcgcggaggagcgcgataaagggagccgagccggacgtgagggggaccccgcggagccgccgcgccagcgcagccccccagccgcatcggagtcgccagagtccgagccgccgccgccgccgccgccgcccccgccgccgccgcggctgcccaggggccggccagctccccagccctgcccgggggtcgcgccgccgccgcccccagcgtcgcccctagcctgcctgcccgccttaaatgtgacaccggcgtcgcggagcgcgacctgaagccgccgccggggaggggacgagcaccatgtcgaatctgagcaaaggcacgggcagccggaaggacaccaagatgcggatccgggcctttccgatgaccatggatgaaaaatatgtaaacagcatttgggaccttctgaaaaatgcaattcaagaaatccagcgtaagaataacagtggtcttagttttgaggagctctatagaaatgcatatacaatggttttgcataaacatggagaaaagctctacactggactaagagaagttgttaccgaacatctcataaataaggtgcgagaagatgtactaaattcattgaataacaactttcttcaaacgctaaatcaagcttggaatgatcatcaaacagctatggtgatgattagagacatactaatgtacatggaccgtgtgtatgtacaacaaaataatgtggagaacgtctacaatttgggattaattatttttcgagatcaagttgtacgttatgggtgtattagggatcatctacggcaaactctattggatatgattgcaagagagcggaaaggagaagtcgtagacagaggcgcaataagaaatgcttgccagatgttaatgattttaggtctcgaaggaagatcagtctatgaagaagattttgaggctccttttttggaaatgtctgcagaattttttcagatggaaagccagaaatttttagcagaaaatagtgcttcagtatatataaagaaagtagaagctagaattaatgaagaaatagaacgagtgatgcactgccttgacaaatcaacggaagaaccaattgtaaaggtggttgaaagggaactcatttccaagcacatgaagactatagtagaaatggagaattctgggctagtacatatgttgaaaaatggaaagacagaagaccttggttgcatgtacaagttatttagtcgtgtgccaaatggtttgaaaacaatgtgtgagtgtatgagttcctatttgagggagcaaggtaaagctcttgtttctgaagaaggagaaggaaagaatcctgttgactatatccagggcttattggatctgaagagtaggttcgatcgcttcctcctggaatcattcaacaatgaccgtctctttaaacaaactattgcgggtgactttgagtattttctcaacctcaactccaggtctcctgaatacctctcattatttattgatgataagctgaaaaagggagtcaaagggctaacagaacaagaagtagaaacaatattggataaagcaatggtcctttttaggtttatgcaagaaaaagatgtatttgaacgttattataaacaacacttggcaaggagacttctcacaaataaaagtgtttctgatgactctgaaaaaaacatgatatctaagttaaagactgaatgtggatgtcagttcacgtcaaaactggaaggaatgtttagggatatgagcatctcaaacacaacgatggatgaattcaggcaacatctacaggcaactggtgtatctttaggtggtgttgatcttacagtccgggtgctcacgacaggatattggcccactcagtcagccacaccaaagtgcaacatcccaccagcaccaagacatgcttttgagatattcagaaggttctacttagccaaacacagtggtcgacagctcacactccagcatcatatgggttctgcagatctcaatgccacattttatggaccagttaaaaaggaagatggatctgaagttggtgttggaggtgcacaagtaactggctctaatacacggaagcacatattgcaagtttccactttccagatgaccatattaatgctctttaataatagagaaaaatacacatttgaggaaattcagcaagagacagatatccctgaaagagagcttgttagagccctacagtccctcgcctgtggtaaaccaacacagcgggttcttacaaaagaacccaaatcaaaggaaatagaaaatggtcatatatttacagttaatgatcaattcacatccaaactacacagagtcaagattcaaacagttgctgccaaacaaggtgaatccgacccagagaggaaagaaacaaggcagaaagtcctttgcatagcttgtgccaactaggatggattctccagagggtgcccagaacaggaagaagggagcagcagctttcaggaggtctatctctatctgttccgtgcgatcagcatggccgctaccga

SEQ ID NO: 371887 - DNA, 2659 bp, Homo sapiens
  misc_feature (2497)..(2497): n is a, c, g, or t
  misc_feature (2501)..(2502): n is a, c, g, or t
  misc_feature (2505)..(2506): n is a, c, g, or t
  misc_feature (2513)..(2514): n is a, c, g, or t
  misc_feature (2516)..(2516): n is a, c, g, or t
  misc_feature (2519)..(2519): n is a, c, g, or t
  misc_feature (2522)..(2522): n is a, c, g, or t
aggagaaggaggaggaggaggacgacgttcggcctgcgcagtgagatgtttgtccggtcgccgccgccgccgccatcgcggaggagcgcgataaagggagccgagccggacgtgagggggaccccgcggagccgccgcgccagcgcagccccccagccgcatcggagtcgccagagtccgagccgccgccgccgccgccgccgcccccgccgccgccgcggctgcccaggggccggccagctccccagccctgcccgggggtcgcgccgccgccgcccccagcgtcgcccctagcctgcctgcccgccttaaatgtgacaccggcgtcgcggagcgcgacctgaagccgccgccggggaggggacgagcaccatgtcgaatctgagcaaaggcacgggcagccggaaggacaccaagatgcggatccgggcctttccgatgaccatggatgaaaaatatgtaaacagcatttgggaccttctgaaaaatgcaattcaagaaatccagcgtaagaataacagtggtcttagttttgaggagctctatagaaatgcatatacaatggttttgcataaacatggagaaaagctctacactggactaagagaagttgttaccgaacatctcataaataaggtgcgagaagatgtactaaattcattgaataacaactttcttcaaacgctaaatcaagcttggaatgatcatcaaacagctatggtgatgattagagacatactaatgtacatggaccgtgtgtatgtacaacaaaataatgtggagaacgtctacaatttgggattaattatttttcgagatcaagttgtacgttatgggtgtattagggatcatctacggcaaactctattggatatgattgcaagagagcggaaaggagaagtcgtagacagaggcgcaataagaaatgcttgccagatgttaatgattttaggtctcgaaggaagatcagtctatgaagaagattttgaggctccttttttggaaatgtctgcagaattttttcagatggaaagccagaaatttttagcagaaaatagtgcttcagtatatataaagaaagtagaagctagaattaatgaagaaatagaacgagtgatgcactgccttgacaaatcaacggaagaaccaattgtaaaggtggttgaaagggaactcatttccaagcacatgaagactatagtagaaatggagaattctgggctagtacatatgttgaaaaatggaaagacagaagaccttggttgcatgtacaagttatttagtcgtgtgccaaatggtttgaaaacaatgtgtgagtgtatgagttcctatttgagggagcaaggtaaagctcttgtttctgaagaaggagaaggaaagaatcctgttgactatatccagggcttattggatctgaagagtaggttcgatcgcttcctcctggaatcattcaacaatgaccgtctctttaaacaaactattgcgggtgactttgagtattttctcaacctcaactccaggtctcctgaatacctctcattatttattgatgataagctgaaaaagggagtcaaagggctaacagaacaagaagtagaaacaatattggataaagcaatggtcctttttaggtttatgcaagaaaaagatgtatttgaacgttattataaacaacacttggcaaggagacttctcacaaataaaagtgtttctgatgactctgaaaaaaacatgatatctaagttaaagactgaatgtggatgtcagttcacgtcattcaggcaacatctacaggcaactggtgtatctttaggtggtgttgatcttacagtccgggtgctcacgacaggatattggcccactcagtcagccacaccaaagtgcaacatcccaccagcaccaagacatgcttttgagatattcagaaggttctacttagccaaacacagtggtcgacagctcacactccagcatcatatgggttctgcagatctcaatgccacattttatggaccagttaaaaaggaagatggatctgaagttggtgttggaggtgcacaagtaactggctctaatacacggaagcacatattgcaagtttccactttccagatgaccatattaatgctctttaataatagagaaaaatacacatttgaggaaattcagcaagagacagatatccctgaaagagagcttgttagagccctacagtccctcgcctgtggtaaaccaacacagcgggttcttacaaaagaacccaaatcaaaggaaatagaaaatggtcatatatttacagttaatgatcaattcacatccaaactacacagagtcaagattcaaacagttgctgccaaacaaggtgaatccgacccagagaggaaagaaacaaggcagaaagtagacgacgacagaaaacatgagatagaagctgctatagtgcggataatgaaatctagaaagaagatgcagcacaatgttctagtagcggaggtanctcnncanntgaaggnncnatnttncccagtcccatggtattaagcacggtttgaggcctttggacacacacttcgggcgcaccttgggctcacgttcaccttgtgctacggcgccagattgatattggacagacttcatgcgggcgactaacccatcacac

SEQ ID NO: 371888 - DNA, 2637 bp, Homo sapiens
aggagaaggaggaggaggaggacgacgttcggcctgcgcagtgagatgtttgtccggtcgccgccgccgccgccatcgcggaggagcgcgataaagggagccgagccggacgtgagggggaccccgcggagccgccgcgccagcgcagccccccagccgcatcggagtcgccagagtccgagccgccgccgccgccgccgccgcccccgccgccgccgcggctgcccaggggccggccagctccccagccctgcccgggggtcgcgccgccgccgcccccagcgtcgcccctagcctgcctgcccgccttaaatgtgacaccggcgtcgcggagcgcgacctgaagccgccgccggggaggggacgagcaccatgtcgaatctgagcaaaggcacgggcagccggaaggacaccaagatgcggatccgggcctttccgatgaccatggatgaaaaatatgtaaacagcatttgggaccttctgaaaaatgcaattcaagaaatccagcgtaagaataacagtggtcttagttttgaggagctctatagaaatgcatatacaatggttttgcataaacatggagaaaagctctacactggactaagagaagttgttaccgaacatctcataaataaggtgcgagaagatgtactaaattcattgaataacaactttcttcaaacgctaaatcaagcttggaatgatcatcaaacagctatggtgatgattagagacatactaatgtacatggaccgtgtgtatgtacaacaaaataatgtggagaacgtctacaatttgggattaattatttttcgagatcaagttgtacgttatgggtgtattagggatcatctacggcaaactctattggatatgattgcaagagagcggaaaggagaagtcgtagacagaggcgcaataagaaatgcttgccagatgttaatgattttaggtctcgaaggaagatcagtctatgaagaagattttgaggctccttttttggaaatgtctgcagaattttttcagatggaaagccagaaatttttagcagaaaatagtgcttcagtatatataaagaaagtagaagctagaattaatgaagaaatagaacgagtgatgcactgccttgacaaatcaacggaagaaccaattgtaaaggtggttgaaagggaactcatttccaagcacatgaagactatagtagaaatggagaattctgggctagtacatatgttgaaaaatggaaagacagaagaccttggttgcatgtacaagttatttagtcgtgtgccaaatggtttgaaaacaatgtgtgagtgtatgagttcctatttgagggagcaaggtaaagctcttgtttctgaagaaggagaaggaaagaatcctgttgactatatccagggcttattggatctgaagagtaggttcgatcgcttcctcctggaatcattcaacaatgaccgtctctttaaacaaactattgcgggtgactttgagtattttctcaacctcaactccaggtctcctgaatacctctcattatttattgatgataagctgaaaaagggagtcaaagggctaacagaacaagaagtagaaacaatattggataaagcaatggtcctttttaggtttatgcaagaaaaagatgtatttgaacgttattataaacaacacttggcaaggagacttctcacaaataaaagtgtttctgatgactctgaaaaaaacatgatatctaagttaaagactgaatgtggatgtcagttcacgtcaaaactggaaggaatgtttagggatatgagcatctcaaacacaacgatggatgaattcaggcaacatctacaggcaactggtgtaagattctgcgttaatttctacttagatattcatgtaaagtcttttgtaatgggtatattttcatccacttagcagatgacagttgtttctttaaatgtcattagtgacaacatgtgttttatctgtgagtacttaattttccttcacattgcctcttattctgtgtttatgttaaaactttttattcttttaaaatttagttgtttcttcccacttgaaggaatacactgacaatttaataaagagaattattctgttgttaataaagataatacaaatctattataaaaaaaaaaaaaaaaaaaaaaaaaaaaaaaaaaaaaaaaaacaaaaaaaaaaaaaaacaaaaaaataacaaaaaaaaacaaaaaaaaaaaaaaaaaaacaaaacaaaaaaaaacaaagagagggccgacggaaaaaaacgataattcatcgaggaatcacgagcaaacaatcaaacaactacacatacagaaagaagaaagggcagatcaacaaacaggagcacttaaaaaaagaaacagacgaaggaaaccagacagaaacaaacaacagacaagaaaacagacaaaacaaacaaaagaagacaaccaaaacaagaacaaacacaaaacaaagcaagaaataacacaaaaacgaagcacagcacccaacagaaagacagataacacacaaagcaacaaaacagaagccacccagacacgaacacaatcaaaagaaaagaaaagagaaacaataaagacaagagacaaacaacgaaaaacacccaagcaa

SEQ ID NO: 371889 - DNA, 992 bp, Homo sapiens
gcagtggctcaatctcgtctcattgcaacctccacctcctgggttcaagtgattctcttactcatcttctagccttatgaccaggaacctttgttttgggctcaagtacacatcctgatttggtttctccctgttgtaatttgagatttcccaaattaagtcttataatgattaggttttgttctgagttatttctagagaaagaaagtattttagtatgtgtaaattgtacaataatttttttgctgttgtactcactgctaatagtggattgtatagggtggtgtttttatttcatttattgtagacaaaaataatgaatttagtatacacatacccactaattcaagtatgtcagagcacaaagttggcagctggttatatttaattcagcccctctgaaaagcacatacagtctatactttgtttataaataccctaggtcctccctgcccctaaatatatattttggtgaagctgtggtgcactattaattttctgtttcaaaatgcaatctaaagatgcaataaatatgatgaccttgatagttttaatgaaatcttcaattcttgcagctgtgttttggaaagtgattaagcaatatttctcaaacctgatgattcttggatatttagctattgtcctccaaagagtcatcgtttcacgttttcaaacatgtgctttgtgctgaagattcttgtcagatatcctgtgcttccagagtatttttatcttcaattttatttaattttgtttcattttgttttcataagacaatgtttcagatatgtaatggggcaaaccactatagatttctgttggatagaaaaatgaaatgttactaataagtttaaattgacccttcgttgactatcagtactgttgatacatttattagaatgtatgtctcagaagatggtttctgtttaaatttatggtcaagttacaacaactgaattctaatatggattaaaaactccacataaatattt

SEQ ID NO: 371890 - DNA, 762 bp, Homo sapiens
gaagactatagggaagaatagagtaagactcctaaagattggaatctggtatgaatttgtgatgaggttgtgacataaaaagcataataaaatatatgacaagaaatggttagataacagaactctagggagatttttggcaaggagattttaggaactgacatcctagtggtacttttaaattatttatttcactgactgaatcttggcagtacatactcttgtctcctcataaagccttagagattacagctacattttgagttagtaagacaacagatacctatctgagataattttggtgagttttaacttggagccatggtaataaaataatcaattgacctctgatagtcataagcaatgaaaattatttactggtaattttactactgaatattttcagctactgtttttcttccaggtaagaaattatattctgcataaaaacaaaatcaactttattatctcaaagttaaattcctcatttttgaaaaggataatttagtattcaagtaaacattaagacagtttctgaatgcgtacttgaattaataagtgtgtatattcagaggctgaaattggtttttatctgtggattacattgaattataataagcttgcttataaaccaaattttaaaattagatttatgataaatgtctttatttctattttagttgctgccaaacaaggtgaatccgacccagagaggaaagaaacaaggcagaaagtagacgacgacagaaaacatgagataga

SEQ ID NO: 371891 - DNA, 621 bp, Homo sapiens
aagaagaatgctatttcacatataaggaaactgaggcacagaggttaaatatttatcccaggtcacccagtttgttagggagctgggattggagcccaggtaattgactccaaaatcagtattctcaaccattattcaaagttggggaagggaaggtgtagtaggaaattcagcagtagcatgaagccagtcttacaggcccttgtaacttactataagaatataggattttactctgacaatgatgtcaagtcactggagggttgggaaatacctaggaagttgatttatgttctggagatcagaagaggagtctgtactatacatatacatttgatactcttctgtgtataggttatagcttaaaatatttctactagcctataacatttctttgatttaaattaaagattccacttcattattttattaaacagatatgtgcatgcctgtatatacgagtgtgtggatgtgtgtgtgcaaactaatgaactcttctgttactaggtgcgagaagatgtactaaattcattgaataacaactttcttcaaacgctaaatcaagcttggaatgatcatcaaacagctatggtgatgattagagacatactaatgtacatg

SEQ ID NO: 371892 - DNA, 7000 bp, Homo sapiens
aggagaaggaggaggaggaggacgacgttcggcctgcgcagtgagatgtttgtccggtcgccgccgccgccgccatcgcggaggagcgcgataaagggagccgagccggacgtgagggggaccccgcggagccgccgcgccagcgcagccccccagccgcatcggagtcgccagagtccgagccgccgccgccgccgccgccgcccccgccgccgccgcggctgcccaggggccggccagctccccagccctgcccgggggtcgcgccgccgccgcccccagcgtcgcccctagcctgcctgcccgccttaaatgtgacaccggcgtcgcggagcgcgacctgaagccgccgccggggaggggacgagcaccatgtcgaatctgagcaaaggcacgggcagccggaaggacaccaagatgcggatccgggcctttccgatgaccatggatgaaaaatatgtaaacagcatttgggaccttctgaaaaatgcaattcaagaaatccagcgtaagaataacagtggtcttagttttgaggagctctatagaaatgcatatacaatggttttgcataaacatggagaaaagctctacactggactaagagaagttgttaccgaacatctcataaataaggtgcgagaagatgtactaaattcattgaataacaactttcttcaaacgctaaatcaagcttggaatgatcatcaaacagctatggtgatgattagagacatactaatgtacatggaccgtgtgtatgtacaacaaaataatgtggagaacgtctacaatttgggattaattatttttcgagatcaagttgtacgttatgggtgtattagggatcatctacggcaaactctattggatatgattgcaagagagcggaaaggagaagtcgtagacagaggcgcaataagaaatgcttgccagatgttaatgattttaggtctcgaaggaagatcagtctatgaagaagattttgaggctccttttttggaaatgtctgcagaattttttcagatggaaagccagaaatttttagcagaaaatagtgcttcagtatatataaagaaagtagaagctagaattaatgaagaaatagaacgagtgatgcactgccttgacaaatcaacggaagaaccaattgtaaaggtggttgaaagggaactcatttccaagcacatgaagactatagtagaaatggagaattctgggctagtacatatgttgaaaaatggaaagacagaagaccttggttgcatgtacaagttatttagtcgtgtgccaaatggtttgaaaacaatgtgtgagtgtatgagttcctatttgagggagcaaggtaaagctcttgtttctgaagaaggagaaggaaagaatcctgttgactatatccagggcttattggatctgaagagtaggttcgatcgcttcctcctggaatcattcaacaatgaccgtctctttaaacaaactattgcgggtgactttgagtattttctcaacctcaactccaggtctcctgaatacctctcattatttattgatgataagctgaaaaagggagtcaaagggctaacagaacaagaagtagaaacaatattggataaagcaatggtcctttttaggtttatgcaagaaaaagatgtatttgaacgttattataaacaacacttggcaaggagacttctcacaaataaaagtgtttctgatgactctgaaaaaaacatgatatctaagttaaagactgaatgtggatgtcagttcacgtcaaaactggaaggaatgtttagggatatgagcatctcaaacacaacgatggatgaattcaggcaacatctacaggcaactggtgtatctttaggtggtgttgatcttacagtccgggtgctcacgacaggatattggcccactcagtcagccacaccaaagtgcaacatcccaccagcaccaagacatgcttttgagatattcagaaggttctacttagccaaacacagtggtcgacagctcacactccagcatcatatgggttctgcagatctcaatgccacattttatggaccagttaaaaaggaagatggatctgaagttggtgttggaggtgcacaagtaactggctctaatacacggaagcacatattgcaagtttccactttccagatgaccatattaatgctctttaataatagagaaaaatacacatttgaggaaattcagcaagagacagatatccctgaaagagagcttgttagagccctacagtccctcgcctgtggtaaaccaacacagcgggttcttacaaaagaacccaaatcaaaggaaatagaaaatggtcatatatttacagttaatgatcaattcacatccaaactacacagagtcaagattcaaacagttgctgccaaacaaggtgaatccgacccagagaggaaagaaacaaggcagaaagtagacgacgacagaaaacatgagatagaagctgctatagtgcggataatgaaatctagaaagaagatgcagcacaatgttctagtagcggaggtaactcagcagttgaaggcgcgattcttaccaagtccagttgttattaagaaacgtattgaaggacttattgagagagaatatttggcacgaacacctgaggatcgcaaagtatacacatatgtagcataaaatgcgttcagaaatttgatttattcttggactgtactcttcgcatggactgggaagttcttttaaatcattaaatattaagacgaccatctcttctattaaattacagtacatgttctagaccattgagatcaagcctttactccctttgagagtttccaacatcagttgattgagcttcaggctttacaacgtttatccctgtagagatcatctttacagttcctcgggaaaatgtgaatgtgctgcgttttgttttctttactgtatgaaaacaggaaaataaaagagaaatttagaaaatacagctcattacaataaaattgttggatttcatttccccaggtcttcagtgttgatgtaaatgtgttttgtagtgttgcttagcactttgcgcattgtgtaagttgggtaacaaaaatggcaaaagaaatgcagatttcccagttatcttgctctgaagacatttctttagctagtcttatttaattttaaaggtttgataaatatacaaagacccaagcatacaatttgagcatgctgtattctaccacttgcacttactcatcttctagccttatgaccaggaacctttgttttgggctcaagtacacatcctgatttggtttctccctgttgtaatttgagatttcccaaattaagtcttataatgattaggttttgttctgagttatttctagagaaagaaagtattttagtatgtgtaaattgtacaataatttttttgctgttgtactcactgctaatagtggattgtatagggtggtgtttttatttcatttattgtagacaaaaataatgaatttagtatacacatacccactaattcaagtatgtcagagcacaaagttggcagctggttatatttaattcagcccctctgaaaagcacatacagtctatactttgtttataaataccctaggtcctccctgcccctaaatatatattttggtgaagctgtggtgcactattaattttctgtttcaaaatgcaatctaaagatgcaataaatatgatgaccttgatagttttaatgaaatcttcaattcttgcagctgtgttttggaaagtgattaagcaatatttctcaaacctgatgattcttggatatttagctattgtcctccaaagagtcatcgtttcacgttttcaaacatgtgctttgtgctgaagattcttgtcagatatcctgtgcttccagagtatttttatcttcaattttatttaattttgtttcattttgttttcataagacaatgtttcagatatgtaatggggcaaaccactatagatttctgttggatagaaaaatgaaatgttactaataagtttaaattgacccttcgttgactatcagtactgttgatacatttattagaatgtatgtctcagaagatggtttctgtttaaatttatggtcaagttacaacaactgaattctaatatggattaaaaactccacataaatatttttccccatgcgtcttgggttataattttccttttagacttgcaaatatgcttttattgcaattttgtctccatctgtactgtagaattacaagccttgtgctctttatctctacattttccacttctacatgatgcaattaagatgccaatgaaaagtattgtgaacattattctcaggacacttttaccatacttgagtagtactaagtcaggtgtaacatggaaagctaagggtttcaccttctgattttgacataattggaaattttctataatggtaagatgtttataggaaagtaatggtagttcatgtttgagaattttttttattgctttcatttcccagttaaatgatatttaacacctgggaaaacaggacagctcagattgtcgagttagtaaacatgagcgatgtaaaaactttatttgaaatctcctaagtgagacattaaacattttagtgctagtttaagccattaaaagtaaagtttaagtttacgtcattgtctcaagtgtggctgtaaaaatcagatctagagtttagagacatacttgttaactttggagcacaggtttgatatttatgcttctaaatacattaaaacatttctgaattgcagttgaatggttggagattgctggcgatgtgatgctgcactgaaaaaactggtcacacaaaatgtttatatgtttgactgcataagtattattttaggtcataaaggttataacaaaatacatttaacattgctttctttttagcaagaggtcacagatgctattttttctcagtttttaatgctttaatttgaaagaaaaatgcatcctaaccattccatcctgttggtgcagagaaattttggtgatttattagaagacttttaaggagggtggatacatagtttttcaactgcaaaaatcatgtcatctcttcagtaactgttaaagtgtaattctctgccttcattatcaagtccaggacagtgtttattttgaatcgttaacattatttaaagactgaaaattcattgcaattagggaacgcacagcctcacaaaagtggttgtgattgcaaggattctttatgtcagtgaacttaaaaagggaatgggggaagagatgcatgcctttctaaaggtatgctagagtcacctgtgtagcattgtaattatgtactatcaaacccccaagatgctgatgataggccttctctgtaagaatccttctcatagtgaagcactgttgatgttttgttcaccggatatgttgggtagcagaaaaggcctagaaccagttttaagattatgcctacatctctagaagactagtacactggcatcatcttaggtttctaaatattatttaattccttaatttggaaagcagttttaatgtttacagtttaagatactcattttcagtaactagtgttaaagatttttatctttgcctgtctactgtaacttaagactttcatagaataattttttatagagtatatggtatattgtgtcaatcttggaaggaaagctgttgcatatcaattgtaggtcatgtattttactatatgttgcatagtattttgcattctgtaaatacgaatgttaaaacatttcaggtcagcaaaattagaagtcatttctagtcctcaaagcagaaataattagaaatgttaacatttaagtgcttatcatatgccagatactattctgaatattttatgtatattcattcatttagttgtcatattggctttatgtgacataactgtcattataccagtgttgtccaaggttgctagcaggaaatggcagagccaggagttggacctaggtttaatcctatccatattccatgttacaaattgacatgattttccatattaaaaaattttcatttattttgtacctcattcacatgaatagtaatgtgacaaactaaagttaatacatgaagcattgcaatatggaattttgcacatttttgttagctttacattatttgctgataccaacttttggtaggaaggaaaacagggaaggtgattgctgctattctggaatgtgtccattgaaaagaaaataggcgctttgtctcctacaatcttagagaaagttttacatacttaagtgggtaccacagataggcatgtaccttaaattcaaatctacagttttacaaaatgttttcctttgtgtgcctttcctatgtcaaattagccagaaggaagaagagacgttaagaatggcagataaatttaacaggtaatgatacagagattggccattacgctagctctcaggagaaaaacaactaggatgtcttgaaacccgtgcatttaattttagaaatggcaaatttgtaagcgtgtcatttaagtaatttgatgctcagttttagggtctaagttgacctcgagtgagccatgcaaaaatagctttaaaattatacatgagcagctcaaagtaaacgtgtattttttagtaacaatgaaattgtcaaatttcaagattttaataacaggacagttcaactaataaactttattgcatacaagatttattgcaatgtgggaaaattaaaattctcagtctcagaattctttctgcagttgtgattcttgaataaatgcctcagcacgatgtctggtatgtagtggatgtaggcactcagtaaatcttcagatgaatgtgctaaatgatcactcagtgtcttgaaagaaaatctttaaaagaattgaacttcacattaaaatttgtactgcactattggggctatgacagtataaggatatttttataagtagaagttatttgatacttgac

SEQ ID NO: 371893 - DNA, 3015 bp, Homo sapiens
aggagaaggaggaggaggaggacgacgttcggcctgcgcagtgagatgtttgtccggtcgccgccgccgccgccatcgcggaggagcgcgataaagggagccgagccggacgtgagggggaccccgcggagccgccgcgccagcgcagccccccagccgcatcggagtcgccagagtccgagccgccgccgccgccgccgccgcccccgccgccgccgcggctgcccaggggccggccagctccccagccctgcccgggggtcgcgccgccgccgcccccagcgtcgcccctagcctgcctgcccgccttaaatgtgacaccggcgtcgcggagcgcgacctgaagccgccgccggggaggggacgagcaccatgtcgaatctgagcaaaggcacgggcagccggaaggacaccaagatgcggatccgggcctttccgatgaccatggatgaaaaatatgtaaacagcatttgggaccttctgaaaaatgcaattcaagaaatccagcgtaagaataacagtggtcttagttttgaggagctctatagaaatgcatatacaatggttttgcataaacatggagaaaagctctacactggactaagagaagttgttaccgaacatctcataaataaggtgcgagaagatgtactaaattcattgaataacaactttcttcaaacgctaaatcaagcttggaatgatcatcaaacagctatggtgatgattagagacatactaatgtacatggaccgtgtgtatgtacaacaaaataatgtggagaacgtctacaatttgggattaattatttttcgagatcaagttgtacgttatgggtgtattagggatcatctacggcaaactctattggatatgattgcaagagagcggaaaggagaagtcgtagacagaggcgcaataagaaatgcttgccagatgttaatgattttaggtctcgaaggaagatcagtctatgaagaagattttgaggctccttttttggaaatgtctgcagaattttttcagatggaaagccagaaatttttagcagaaaatagtgcttcagtatatataaagaaagtagaagctagaattaatgaagaaatagaacgagtgatgcactgccttgacaaatcaacggaagaaccaattgtaaaggtggttgaaagggaactcatttccaagcacatgaagactatagtagaaatggagaattctgggctagtacatatgttgaaaaatggaaagacagaagaccttggttgcatgtacaagttatttagtcgtgtgccaaatggtttgaaaacaatgtgtgagtgtatgagttcctatttgagggagcaaggtaaagctcttgtttctgaagaaggagaaggaaagaatcctgttgactatatccagggcttattggatctgaagagtaggttcgatcgcttcctcctggaatcattcaacaatgaccgtctctttaaacaaactattgcgggtgactttgagtattttctcaacctcaactccaggtctcctgaatacctctcattatttattgatgataagctgaaaaagggagtcaaagggctaacagaacaagaagtagaaacaatattggataaagcaatggtcctttttaggtttatgcaagaaaaagatgtatttgaacgttattataaacaacacttggcaaggagacttctcacaaataaaagtgtttctgatgactctgaaaaaaacatgatatctaagttaaagactgaatgtggatgtcagttcacgtcaaaactggaaggaatgtttagggatatgagcatctcaaacacaacgatggatgaattcaggcaacatctacaggcaactggtgtatctttaggtggtgttgatcttacagtccgggtgctcacgacaggatattggcccactcagtcagccacaccaaagtgcaacatcccaccagcaccaagacatgcttttgagatattcagaaggttctacttagccaaacacagtggtcgacagctcacactccagcatcatatgggttctgcagatctcaatgccacattttatggaccagttaaaaaggaagatggatctgaagttggtgttggaggtgcacaagtaactggctctaatacacggaagcacatattgcaagtttccactttccagatgaccatattaatgctctttaataatagagaaaaatacacatttgaggaaattcagcaagagacagatatccctgaaagagagcttgttagagccctacagtccctcgcctgtggtaaaccaacacagcgggttcttacaaaagaacccaaatcaaaggaaatagaaaatggtcatatatttacagttaatgatcaattcacatccaaactacacagagtcaagattcaaacagttgctgccaaacaaggtgaatccgacccagagaggaaagaaacaaggcagaaagtagacgacgacagaaaacatgagatagaagctgctatagtgcggataatgaaatctagaaagaagatgcagcacaatgttctagtagcggaggtaactcagcagttgaaggcgcgattcttaccaagtccagttgttattaagaaacgtattgaaggacttattgagagagaatatttggcacgaacacctgaggatcgcaaagtatacacatatgtagcataaaatgcgttcagaaatttgatttattcttggactgtactcttcgcatggactgggaagttcttttaaatcattaaatattaagacgaccatctcttctattaaattacagtacatgttctagaccattgagatcaagcctttactccctttgagagtttccaacatcagttgattgagcttcaggctttacaacgtttatccctgtagagatcatctttacagttcctcgggaaaatgtgaatgtgctgcgttttgttttctttactgtatgaaaacaggaaaataaaagagaaatttagaaaatacagctcattacaataaaattgttggatttca

SEQ ID NO: 371894 - DNA, 2960 bp, Homo sapiens
aggagaaggaggaggaggaggacgacgttcggcctgcgcagtgagatgtttgtccggtcgccgccgccgccgccatcgcggaggagcgcgataaagggagccgagccggacgtgagggggaccccgcggagccgccgcgccagcgcagccccccagccgcatcggagtcgccagagtccgagccgccgccgccgccgccgccgcccccgccgccgccgcggctgcccaggggccggccagctccccagccctgcccgggggtcgcgccgccgccgcccccagcgtcgcccctagcctgcctgcccgccttaaatgtgacaccggcgtcgcggagcgcgacctgaagccgccgccggggaggggacgagcaccatgtcgaatctgagcaaaggcacgggcagccggaaggacaccaagatgcggatccgggcctttccgatgaccatggatgaaaaatatgtaaacagcatttgggaccttctgaaaaatgcaattcaagaaatccagcgtaagaataacagtggtcttagttttgaggagctctatagaaatgcatatacaatggttttgcataaacatggagaaaagctctacactggactaagagaagttgttaccgaacatctcataaataaggtgcgagaagatgtactaaattcattgaataacaactttcttcaaacgctaaatcaagcttggaatgatcatcaaacagctatggtgatgattagagacatactaatgtacatggaccgtgtgtatgtacaacaaaataatgtggagaacgtctacaatttgggattaattatttttcgagatcaagttgtacgttatgggtgtattagggatcatctacggcaaactctattggatatgattgcaagagagcggaaaggagaagtcgtagacagaggcgcaataagaaatgcttgccagatgttaatgattttaggtctcgaaggaagatcagtctatgaagaagattttgaggctccttttttggaaatgtctgcagaattttttcagtagaagctagaattaatgaagaaatagaacgagtgatgcactgccttgacaaatcaacggaagaaccaattgtaaaggtggttgaaagggaactcatttccaagcacatgaagactatagtagaaatggagaattctgggctagtacatatgttgaaaaatggaaagacagaagaccttggttgcatgtacaagttatttagtcgtgtgccaaatggtttgaaaacaatgtgtgagtgtatgagttcctatttgagggagcaaggtaaagctcttgtttctgaagaaggagaaggaaagaatcctgttgactatatccagggcttattggatctgaagagtaggttcgatcgcttcctcctggaatcattcaacaatgaccgtctctttaaacaaactattgcgggtgactttgagtattttctcaacctcaactccaggtctcctgaatacctctcattatttattgatgataagctgaaaaagggagtcaaagggctaacagaacaagaagtagaaacaatattggataaagcaatggtcctttttaggtttatgcaagaaaaagatgtatttgaacgttattataaacaacacttggcaaggagacttctcacaaataaaagtgtttctgatgactctgaaaaaaacatgatatctaagttaaagactgaatgtggatgtcagttcacgtcaaaactggaaggaatgtttagggatatgagcatctcaaacacaacgatggatgaattcaggcaacatctacaggcaactggtgtatctttaggtggtgttgatcttacagtccgggtgctcacgacaggatattggcccactcagtcagccacaccaaagtgcaacatcccaccagcaccaagacatgcttttgagatattcagaaggttctacttagccaaacacagtggtcgacagctcacactccagcatcatatgggttctgcagatctcaatgccacattttatggaccagttaaaaaggaagatggatctgaagttggtgttggaggtgcacaagtaactggctctaatacacggaagcacatattgcaagtttccactttccagatgaccatattaatgctctttaataatagagaaaaatacacatttgaggaaattcagcaagagacagatatccctgaaagagagcttgttagagccctacagtccctcgcctgtggtaaaccaacacagcgggttcttacaaaagaacccaaatcaaaggaaatagaaaatggtcatatatttacagttaatgatcaattcacatccaaactacacagagtcaagattcaaacagttgctgccaaacaaggtgaatccgacccagagaggaaagaaacaaggcagaaagtagacgacgacagaaaacatgagatagaagctgctatagtgcggataatgaaatctagaaagaagatgcagcacaatgttctagtagcggaggtaactcagcagttgaaggcgcgattcttaccaagtccagttgttattaagaaacgtattgaaggacttattgagagagaatatttggcacgaacacctgaggatcgcaaagtatacacatatgtagcataaaatgcgttcagaaatttgatttattcttggactgtactcttcgcatggactgggaagttcttttaaatcattaaatattaagacgaccatctcttctattaaattacagtacatgttctagaccattgagatcaagcctttactccctttgagagtttccaacatcagttgattgagcttcaggctttacaacgtttatccctgtagagatcatctttacagttcctcgggaaaatgtgaatgtgctgcgttttgttttctttactgtatgaaaacaggaaaataaaagagaaatttagaaaatacagctcattacaataaaattgttggatttca

SEQ ID NO: 371895 - DNA, 987 bp, Homo sapiens
gagtactggccatgctgatctcacgccacattttatgcaccagtgtaaaaggaagatggatctgaagttggtgttggaggtgcacaagtaactggctctaatacacggaagcacatattgcaagtttccactttccagatgaccatattaatgctctttaataatagagaaaaatacacatttgaggaaattcagcaagagacagatatccctgaaagagagcttgttagagccctacagtccctcgcctgtggtaaaccaacacagcgggttcttacaaaagaacccaaatcaaaggaaatagaaaatggtcatatatttacagttaatgatcaattcacatccaaactacacagagtcaagattcaaacagttgctgccaaacaaggtgaatccgacccagagaggaaagaaacaaggcagaaagtagacgacgacagaaaacatgagatagaagctgctatagtgcggataatgaaatctagaaagaagatgcagcacaatgttctagtagcggaggtaactcagcagttgaaggcgcgattcttaccaagtccagttgttattaagaaacgtattgaaggacttattgagagagaatatttggcacgaacacctgaggatcgcaaagtatacacatatgtagcataaaatgcgttcagaaatttgatttattcttggactgtactcttcgcatggactgggaagttcttttaaatcattaaatattaagacgaccatctcttctattaaattacagtacatgttctagaccattgagatcaagcctttactccctttgagagtttccaacatcagttgattgagcttcaggctttacaacgtttatccctgtagagatcatctttacagttcctcgggaaaatgtgaatgtgctgcgttttgttttctttactgtatgaaaacaggaaaataaaagagaaatttagaaaatacagctcattacaataaaattgttggatttca

SEQ ID NO: 371896 - DNA, 1010 bp, Homo sapiens
tgaaatccaacaattttattgtaatgagctgtattttctaaatttctcttttattttcctgttttcatacagtaaagaaaacaaaacgcagcacattcacattttcccaagtaactggctctaatacacggaagcacatattgcaagtttccactttccagatgaccatattaatgctctttaataatagagaaaaatacacatttgaggaaattcagcaagagacagatatccctgaaagagagcttgttagagccctacagtccctcgcctgtggtaaaccaacacagcgggttcttacaaaagaacccaaatcaaaggaaatagaaaatggtcatatatttacagttaatgatcaattcacatccaaactacacagagtcaagattcaaacagttgctgccaaacaaggtgaatccgacccagagaggaaagaaacaaggcagaaagtagacgacgacagaaaacatgagatagaagctgctatagtgcggataatgaaatctagaaagaagatgcagcacaatgttctagtagcggaggtaactcagcagttgaaggcgcgattcttaccaagtccagttgttattaagaaacgtattgaaggacttattgagagagaatatttggcacgaacacctgaggatcgcaaagtatacacatatgtagcataaaatgcgttcagaaatttgatttattcttggactgtactcttcgcatggactgggaagttcttttaaatcattaaatattaagacgaccatctcttctattaaattacagtacatgttctagaccattgagatcaagcctttactccctttgagagtttccaacatcagttgattgagcttcaggctttacaacgtttatccctgtagagatcatctttacagttcctcgggaaaatgtgaatgtgctgcgttttgttttctttactgtatgaaaacaggaaaataaaagagaaatttagaaaatacagctcattacaataaaattgttggatttca

SEQ ID NO: 371897 - DNA, 3188 bp, Homo sapiens
aggagaaggaggaggaggaggacgacgttcggcctgcgcagtgagatgtttgtccggtcgccgccgccgccgccatcgcggaggagcgcgataaagggagccgagccggacgtgagggggaccccgcggagccgccgcgccagcgcagccccccagccgcatcggagtcgccagagtccgagccgccgccgccgccgccgccgcccccgccgccgccgcggctgcccaggggccggccagctccccagccctgcccgggggtcgcgccgccgccgcccccagcgtcgcccctagcctgcctgcccgccttaaatgtgacaccggcgtcgcggagcgcgacctgaagccgccgccggggaggggacgagcaccatgtcgaatctgagcaaaggcacgggcagccggaaggacaccaagatgcggatccgggcctttccgatgaccatggatgaaaaatatgtaaacagcatttgggaccttctgaaaaatgcaattcaagaaatccagcgtaagaataacagtggtcttagttttgaggagctctatagaaatgcatatacaatggttttgcataaacatggagaaaagctctacactggactaagagaagttgttaccgaacatctcataaataaggtgcgagaagatgtactaaattcattgaataacaactttcttcaaacgctaaatcaagcttggaatgatcatcaaacagctatggtgatgattagagacatactaatgtacatggaccgtgtgtatgtacaacaaaataatgtggagaacgtctacaatttgggattaattatttttcgagatcaagttgtacgttatgggtgtattagggatcatctacggcaaactctattggatatgattgcaagagagcggaaaggagaagtcgtagacagaggcgcaataagaaatgcttgccagatgttaatgattttaggtctcgaaggaagatcagtctatgaagaagattttgaggctccttttttggaaatgtctgcagaattttttcagatggaaagccagaaatttttagcagaaaatagtgcttcagtatatataaagaaagtagaagctagaattaatgaagaaatagaacgagtgatgcactgccttgacaaatcaacggaagaaccaattgtaaaggtggttgaaagggaactcatttccaagcacatgaagactatagtagaaatggagaattctgggctagtacatatgttgaaaaatggaaagacagaagaccttggttgcatgtacaagttatttagtcgtgtgccaaatggtttgaaaacaatgtgtgagtgtatgagttcctatttgagggagcaaggtaaagctcttgtttctgaagaaggagaaggaaagaatcctgttgactatatccagggcttattggatctgaagagtaggttcgatcgcttcctcctggaatcattcaacaatgaccgtctctttaaacaaactattgcgggtgactttgagtattttctcaacctcaactccaggtctcctgaatacctctcattatttattgatgataagctgaaaaagggagtcaaagggctaacagaacaagaagtagaaacaatattggataaagcaatggtcctttttaggtttatgcaagaaaaagatgtatttgaacgttattataaacaacacttggcaaggagacttctcacaaataaaagtgtttctgatgactctgaaaaaaacatgatatctaagttaaagactgaatgtggatgtcagttcacgtcaaaactggaaggaatgtttagggatatgagcatctcaaacacaacgatggatgaattcaggcaacatctacaggcaactggtgtatctttaggtggtgttgatcttacagtccgggtgctcacgacaggatattggcccactcagtcagccacaccaaagtgcaacatcccaccagcaccaagacatgcttttgagatattcagaaggttctacttagccaaacacagtggtcgacagctcacactccagcatcatatgggttctgcagatctcaatgccacattttatggaccagttaaaaaggaagatggatctgaagttggtgttggaggtgcacaagtaactggctctaatacacggaagcacatattgcaagtttccactttccagatgaccatattaatgctctttaataatagagaaaaatacacatttgaggaaattcagcaagagacagatatccctgaaagagagcttgttagagccctacagtccctcgcctgtggtaaaccaacacagcgggttcttacaaaagaacccaaatcaaaggaaatagaaaatggtcatatatttacagttaatgatcaattcacatccaaactacacagagtcaagattcaaacagttgctgccaaacaaggtgaatccgacccagagaggaaagaaacaaggcagaaagtagacgacgacagaaaacatgagatagaagctgctatagtgcggataatgaaatctagaaagaagatgcagcacaatgttctagtagcggaggtaactcagcagttgaaggcgcgattcttaccaagtccagttgttattaagaaacgtattgaaggacttattgagagagaatatttggcacgaacacctgaggatcgcaaagtatacacatatgtagcataaaatgcgttcagaaatttgatttattcttggactgtactcttcgcatggactgggaagttcttttaaatcattaaatattaagacgaccatctcttctattaaattacagtacatgttctagaccattgagatcaagcctttactccctttgagagtttccaacatcagttgattgagcttcaggctttacaacgtttatccctgtagagatcatctttacagttcctcgggaaaatgtgaatgtgctgcgttttgttttctcaccatagagaaaagagcttgggacttgaccacagtctaaatggtacaactgccagatgtagtcttctggttgccagtcgaggacacttgactccttaattgcattgaattcatccactatgtagcattttcttttgaaaattctgatctaccaatagtgacaaacatttgtatttttcttgaatttaatggaagtccaaccatggtaagtcaacttcctgtggttaggtatgagttgtttcctgatg

SEQ ID NO: 371898 - DNA, 2919 bp, Homo sapiens
aggagaaggaggaggaggaggacgacgttcggcctgcgcagtgagatgtttgtccggtcgccgccgccgccgccatcgcggaggagcgcgataaagggagccgagccggacgtgagggggaccccgcggagccgccgcgccagcgcagccccccagccgcatcggagtcgccagagtccgagccgccgccgccgccgccgccgcccccgccgccgccgcggctgcccaggggccggccagctccccagccctgcccgggggtcgcgccgccgccgcccccagcgtcgcccctagcctgcctgcccgccttaaatgtgacaccggcgtcgcggagcgcgacctgaagccgccgccggggaggggacgagcaccatgtcgaatctgagcaaaggcacgggcagccggaaggacaccaagatgcggatccgggcctttccgatgaccatggatgaaaaatatgtaaacagcatttgggaccttctgaaaaatgcaattcaagaaatccagcgtaagaataacagtggtcttagttttgaggagctctatagaaatgcatatacaatggttttgcataaacatggagaaaagctctacactggactaagagaagttgttaccgaacatctcataaataaggtgcgagaagatgtactaaattcattgaataacaactttcttcaaacgctaaatcaagcttggaatgatcatcaaacagctatggtgatgattagagacatactaatgtacatggaccgtgtgtatgtacaacaaaataatgtggagaacgtctacaatttgggattaattatttttcgagatcaagttgtacgttatgggtgtattagggatcatctacggcaaactctattggatatgattgcaagagagcggaaaggagaagtcgtagacagaggcgcaataagaaatgcttgccagatgttaatgattttaggtctcgaaggaagatcagtctatgaagaagattttgaggctccttttttggaaatgtctgcagaattttttcagatggaaagccagaaatttttagcagaaaatagtgcttcagtatatataaagaaagtagaagctagaattaatgaagaaatagaacgagtgatgcactgccttgacaaatcaacggaagaaccaattgtaaaggtggttgaaagggaactcatttccaagcacatgaagactatagtagaaatggagaattctgggctagtacatatgttgaaaaatggaaagacagaagaccttggttgcatgtacaagttatttagtcgtgtgccaaatggtttgaaaacaatgtgtgagtgtatgagttcctatttgagggagcaaggtaaagctcttgtttctgaagaaggagaaggaaagaatcctgttgactatatccagggcttattggatctgaagagtaggttcgatcgcttcctcctggaatcattcaacaatgaccgtctctttaaacaaactattgcgggtgactttgagtattttctcaacctcaactccaggtctcctgaatacctctcattatttattgatgataagctgaaaaagggagtcaaagggctaacagaacaagaagtagaaacaatattggataaagcaatggtcctttttaggtttatgcaagaaaaagatgtatttgaacgttattataaacaacacttggcaaggagacttctcacaaataaaagtgtttctgatgactctgaaaaaaacatgatatctaagttaaagactgaatgtggatgtcagttcacgtcaaaactggaaggaatgtttagggatatgagcatctcaaacacaacgatggatgaattcaggcaacatctacaggcaactggtgtatctttaggtggtgttgatcttacagtccgggtgctcacgacaggatattggcccactcagtcagccacaccaaagtgcaacatcccaccagcaccaagacatgcttttgagatattcagaaggttctacttagccaaacacagtggtcgacagctcacactccagcatcatatgggttctgcagatctcaatgccacattttatggaccagttaaaaaggaagatggatctgaagttggtgttggaggtgcacaagtaactggctctaatacacggaagcacatattgcaagtttccactttccagatgaccatattaatgctctttaataatagagaaaaatacacatttgaggtatggattgtggttatatacattttaactgtgttgtttctaactctcacttgttacttgagtctttcttatttgaataacctttagagagtctctttgggtacttttagagaaaactgtataaaatggatcatggaactgtatgaacatcatacatgtattgagttatgtcttatttttaaattaactttatagaagtacttttatataaaacataccttatataagtagacaatttgatgagttttaaatgagtgcatctttgtaactaccatcacaagaatattgcccgaaaatacagagcattacctccaaaattgcgttgtaccccttgccagtctattccctcctaccacctccagccccaggcagccagtgacctgctttatatcactataaattagttttgtttttttttagactttcatgtaaatggaatcatacatgttgtctgtatgctttaatcctttgtcagttcacctgcatttgggttgataccggatttaggctaagtagagctatatgtttaacattttaagaaactgccgaactgtatcccaaagcaactataccattttccttatttgccagcagtgcaagacggtccagtcgctctacatcatctgcagtctttagattttgagccgctttagttggtgtgtaatagtgtctcattttggatttaattttcttttttttttttga

SEQ ID NO: 371899 - DNA, 642 bp, Homo sapiens
ggcagagaatattctatgactcagcccacagctgtgttgtacttggggatgacagaattctgcacagagtgacacatctttctgagaaattccttataatcctcttggctgttggggaagtggctgattcatcttaccagtctgggtttaactttcttttctttttcttctgcagtactctggtttccagcagtcggctgacaggtgttttctttgtggacatctgatcatggacatggtgagtaggtcagccaaagaagagaacagcatctcaggtggaggaggaggtgttcagagaaaaaagaaattaataattgaggacagtgtttcttatcttgatttgtggttacagctgggcgcagtggctcatgcctgtaatcccagcactttgggaggccgaggcgggcggatcacgaggtcaggagtttgagaccaaccagcctggccaatatggtgaaaccttgtctctactaaaaatacaaaaattttccgggcgtggtggtgcatgcctgtagtcccagctacttgagaggccaaggcaggagaattgtttgaaccctggaggcggagtttgcagtgagccaagatcacgccactgcactccagcctgggcaacagagtgagactccacctcaaaaaaaa

SEQ ID NO: 371900 - DNA, 452 bp, Homo sapiens
actctgtgtgtgactgctcatgtaatccttaggcctgatgtgttcctctccccttccaccatctcatccttccctataatccccactgagtcttggtctctgctccagatcctgcaagccctggggaagtcctaccaccccggctgtttccgctgtgtcatctgtaatgagtgtttggatggggtgcccttcaccgtggactcagagaacaagatctactgtgtccgagattaccacaagtaagaagggatgggagcagacaggacccattcgtgtaggccaagctgatctcagcagagtgagtggtggaaaccgacaaaactgtgtttgccagccgcccttagatcacagtccagcaaaggcttaatggttttgaggggtacagcagggaccttgggaggttggtcgatgccagtgttgacaggaatgggttaaagaatcatgtttagtga

SEQ ID NO: 371901 - DNA, 6006 bp, Homo sapiens
  misc_feature (715)..(715): n is a, c, g, or t
gcagagccggcgagcgagcagcagggactgcgcctggcgcactcacttccgcgtcccgccgccctccggcccgcgcgcgccgatccgccgccgccatcggacaatgggccgccagccccagctgccgtgaacttcctgccgctgctcggccgcccgtgcgtcccggacggcgttcctgccaggcgccggccgggatcgcagctccggggaagcagcggaggacccagcgcctggaacgtacctgcgcctcagccgccgcgcgtttgctccggcccgactcgcggcctcggcgccctcccggccgattcagcttcacccggcccagtcggctgctgccttgctgtgagtttccgtgtttggttgcctaaggaggatgtgattttacttttttgctgttttctttttccttttataatttgaagaggagaaaagaactccgctgagcaggcccgggacggcgaagtgccaccagctaccccaacaaggacgtctccaggggaaagggagttggaagcaaacttggtccagctggcgttgaggtctcaacttcggctggactcttaaatcctggggtcatgcccttcacgctaggcaggtggaagtctttagttgtactgggccggacttgagccccgacccttcgccagcatctccccgctgccctcaacacacaacacacacacacacacacacacacacacacacgcggcacctnctaggcccggacacctgtctgcagcatggataagtatgacgacctgggcctggaggccagtaaattcatcgaggacctgaacatgtatgaggcctctaaggatgggctcttccgagtggacaagggtgcaggcaacaaccccgagtttgaggaaactcgcagggtgttcgccaccaagatggccaaaatccacctccagcagcagcagcagcagctcctgcaggaggagactctgcccagggggagtagaggccctgtcaatggagggggccgcctgggcccacaggcccgttgggaagttgtgggcagcaagctgactgtggatggtgctgccaagcctcctcttgctgcctcgacaggggcacctggggcagtcaccaccctcgctgctgggcagcccccgtacccaccgcaggagcagagatccaggccatacctgcatggcacgaggcatggcagccaggactgtggttccagggagagcctggcgacttctgagatgtctgctttccaccagccaggcccctgtgaggatccttcctgcctcactcatggagactattatgacaacctctccttggcaagcccaaagtggggtgacaaaccaggagtgtcccccagcatcggcctgagtgtagggagtgggtggcctagctccccggggagtgacccaccactgcccaaaccctgcggggaccatcccctaaatcaccgacagctctccctgagctccagcaggtcttctgagggtagcctcggtggtcagaatagtggcattggtggccgcagcagcgagaagccaacaggcctttggtccactgcctcctcccagcgggtgagccctggcctgccttccccaaacttggagaacggagcaccagctgtggggcctgttcagcccaggactccttctgtgtcagcacccttggccctgagctgccccaggcaaggaggtcttccaagatcaaactcggggctggggggtgaggtttcaggtgtgatgtccaaacccaatgtggacccccaaccctggttccaggatgggcccaaatcttacctttccagttctgccccgtcatcctcgccagctggcctggacggttcacagcagggtgcggtccctgggctggggccgaagcctggctgcacagaccttggcactggtcccaagctcagccccaccagtcttgtccatccagtgatgtccaccctgcctgagttatcttgtaaagagggtcccctgggctggtcttctgatggtagcctgggatctgtgctcctggacagccccagctcccctagggtaaggctgccctgccagcccctcgtcccaggtcctgagctgagaccctctgctgctgagttgaaattagaagccctcacccaacgtctggagcgagagatggatgctcacccgaaggctgattactttggagcctgtgtgaaatgcagcaaaggggtgtttggggctggccaggcctgtcaggccatggggaacctctaccatgacacatgcttcacctgtgcagcttgcagccggaagctgagaggaaaagccttttattttgtcaacggcaaagtgttttgtgaagaagacttcctgtactctggtttccagcagtcggctgacaggtgttttctttgtggacatctgatcatggacatgatcctgcaagccctggggaagtcctaccaccccggctgtttccgctgtgtcatctgtaatgagtgtttggatggggtgcccttcaccgtggactcagagaacaagatctactgtgtccgagattaccacaaggtgctggcccccaagtgtgcagcctgtgggcttcccatccttccacctgagggctcagatgagaccatccgtgtcgtgtccatggacagagactaccacgtggagtgttaccactgcgaggactgtggtctggagctcaatgatgaagatggccaccgctgttatccgctggaggaccacctgttctgtcactcctgccacgtgaagaggctggagaagagaccctcatctacagcccttcaccagcaccacttctagccagagccacttgcagacatcacggcaggggatgaggagccggggttgctgctgctgcttccggtggcccctggggtggaagtggggtaggggaagaggaggggcaggagggagagttcctgtgagcatgtggggggtgcctttcctttaaccagggaggtgaacactacctgcctcctgcgtgtattttccaagtgcttttctctgttgccacattttcctcaggttactcaggaaaatgctccagcatgtgcgagcacatgacctgaggttgcatcatagcaccaaaggaatcctcctgtcccctctgggaacatttcatgcttcagagggagaggtttttattgagcttgtttcacaatatccccttgaagggacagctcagctgccaatacattcaaccctttctcttccttcaggaaaatacctatacccaaatgttccctcccccgacatatatcatggcatgacttaaggcttcttttcacctgagagcttcagttcttctgcagaatggctgcaaatttaattgcattaaggcaagaaggaagctctaatgtgtgctttgtatcctaagataaatttgcttagaaaaccagagtcaagatttgaaataggtgaggcagggtttcctccttagacactgacagcattctccgtaccccttcaaatccttactctcctaaaggcagctgagtccgcgacagaaatttgccctatgtgagtaaaacatactttgggagaagaacttggtgcaggcaccaggatttttttttttgcccacgtgtttgcgctgtttttctctggagttctcaagagttggtgacttggaaggccgcttctgcaaggcaagtctcaggaacccatgcaggtacatcgcttgcacctgtttttagcttatttaatgacgggcttttgggaagagctgcccgcatactgagagacagcttcttataaacaaggagagtttttgtgtgtgcgagatctctaagccagcgtgggagggagcgcctcaggataagttattatattcatttcgttggtttctctcctgcccaattcttggcacaggcattatgtttgaagaaaccaggataaggtacactgcttttgtctgtttaatttttttagttgtttcccttcactttcagtcttccacacacaaaaaatacctcacagagcttcaccaaatcacagattcaggaggaatttggctttcacactggactcagataccttcttcagtgtgttggaaatcactggcttcacacaggcccaactccagctggtcagggcagagtgatcgtaactaaaggtcagtggggaatagatccgattcagtgcttttgccttatgcatttcagcatcctggctccccagggtggcaggagctgagggagggccacacactggcaagatttcaagaccactctctgcactgaagaggtaaaatttgcactgcaagtcacatccctgaggccagaggtcagtaccctttggtatttcgattagaagaagctgcaaaagaaaggcagcccattttaccattgccagccaggccggggacacaggagccggtgtgtgcactctgcctcctcaccttgcacccagagcaagaggactgggtgctgggctgcagaggccggtcagtggagcccctagcacgtgtgaactcaggcttttcattgggcccggctccacttctaggccatgttttgactcatttggtaaccattgcctgtaagcagcacagaattggtgccatggattatcttttccatgttgatggaattcattctgttggaatcctttggccagatgtcacttcagccagggtgtgcatcatcattggttctttttcacaggctgagcctcctgaaaacccatgaacgctggggctggggaagtgaaccctgaggtggggaccctctcttcccatcaaatcatccagctcagtgtggggcgtggcaggggggtaaatgaagccagccaatgtgttaacctgtctctgtcaacctaagaatgttggccttactgacacacctttgctccatgttcaagaccagaagtagctgggatttgtttgcaaattgggtaattagtttaaaaatctgtgattacatttttaaatgaaattttcaaagtggcctagattgaggtgattcagataggtttgcgaatataccattttatattgttgagaaagaacaaaaagggaatttccagatgtcctagaaatcctagcaacagatttctctggttgtcagtttccctggagaaggcgccagataggaatctccaatcagttgtttttctcttcgcttcaggcccttacacaaaagccatgaagagatgttcacctacccggtattttaaatgttctgtaaattattagccaaatagaactgtaatggggttgtatttatgggcgcctagaaagaaaacacaaggacttggtaggccaggaagaaaagattttaaaatttagaatgaatagcccttctgggttttctttttgacaattcttggacttgaggtaaaacaaggaggattgtggccggatttcagatcccaaagccagcctccatcttaggcctttgcctcattgtgccttttaggttttcttacccaccgtctcctgttttgtcttttttttcttttctcctacccctatcttgggacattcagaaactgcctgggtggtttgagaagagacaacccagtttgatctgcaatacaaggatccattcgtaatctctctctcactgatgttattcccccatctgccgtcttggttcatctcaccacagaagggcatttagtcctacccagccatcggctgcgtatgacagcaggatggcacttcccatttctctgtggttagtgctcgagtgaaaacctctttcagctgagtcctctgaggttctgctgttgagtcctgggtggctgatggaatgattgaggaggtctggtcaccctcaagcgccgtcatcgccttgtttccatgggcttctgtcacacaaaatgaagaacagaaatgttaggacttaagagaatgtttggaattcacacctctttgcagtcctttcaaggctgctgctctgtgctgtgtcccatgcatgtgaaagtagagctgtgatggctgctgggatgcttgcaaagatcatgtgtgagaattgagcacaagaccacaaattattactgcttgatgcgcttgttaaaactctatctgcca

SEQ ID NO: 371902 - DNA, 3973 bp, Homo sapiens
tgtctacctgctccatttctcctcctcccagcagccctgcaaagtgcccgccaattttctctcctgttttgaagatgggaaaactaaagcagagagccacaaggtcactcacctggagcctgtgtgaaatgcagcaaaggggtgtttggggctggccaggcctgtcaggccatggggaacctctaccatgacacatgcttcacctgtgcagcttgcagccggaagctgagaggaaaagccttttattttgtcaacggcaaagtgttttgtgaagaagacttcctgtactctggtttccagcagtcggctgacaggtgttttctttgtggacatctgatcatggacatgatcctgcaagccctggggaagtcctaccaccccggctgtttccgctgtgtcatctgtaatgagtgtttggatggggtgcccttcaccgtggactcagagaacaagatctactgtgtccgagattaccacaaggtgctggcccccaagtgtgcagcctgtgggcttcccatccttccacctgagggctcagatgagaccatccgtgtcgtgtccatggacagagactaccacgtggagtgttaccactgcgaggactgtggtctggagctcaatgatgaagatggccaccgctgttatccgctggaggaccacctgttctgtcactcctgccacgtgaagaggctggagaagagaccctcatctacagcccttcaccagcaccacttctagccagagccacttgcagacatcacggcaggggatgaggagccggggttgctgctgctgcttccggtggcccctggggtggaagtggggtaggggaagaggaggggcaggagggagagttcctgtgagcatgtggggggtgcctttcctttaaccagggaggtgaacactacctgcctcctgcgtgtattttccaagtgcttttctctgttgccacattttcctcaggttactcaggaaaatgctccagcatgtgcgagcacatgacctgaggttgcatcatagcaccaaaggaatcctcctgtcccctctgggaacatttcatgcttcagagggagaggtttttattgagcttgtttcacaatatccccttgaagggacagctcagctgccaatacattcaaccctttctcttccttcaggaaaatacctatacccaaatgttccctcccccgacatatatcatggcatgacttaaggcttcttttcacctgagagcttcagttcttctgcagaatggctgcaaatttaattgcattaaggcaagaaggaagctctaatgtgtgctttgtatcctaagataaatttgcttagaaaaccagagtcaagatttgaaataggtgaggcagggtttcctccttagacactgacagcattctccgtaccccttcaaatccttactctcctaaaggcagctgagtccgcgacagaaatttgccctatgtgagtaaaacatactttgggagaagaacttggtgcaggcaccaggatttttttttttgcccacgtgtttgcgctgtttttctctggagttctcaagagttggtgacttggaaggccgcttctgcaaggcaagtctcaggaacccatgcaggtacatcgcttgcacctgtttttagcttatttaatgacgggcttttgggaagagctgcccgcatactgagagacagcttcttataaacaaggagagtttttgtgtgtgcgagatctctaagccagcgtgggagggagcgcctcaggataagttattatattcatttcgttggtttctctcctgcccaattcttggcacaggcattatgtttgaagaaaccaggataaggtacactgcttttgtctgtttaatttttttagttgtttcccttcactttcagtcttccacacacaaaaaatacctcacagagcttcaccaaatcacagattcaggaggaatttggctttcacactggactcagataccttcttcagtgtgttggaaatcactggcttcacacaggcccaactccagctggtcagggcagagtgatcgtaactaaaggtcagtggggaatagatccgattcagtgcttttgccttatgcatttcagcatcctggctccccagggtggcaggagctgagggagggccacacactggcaagatttcaagaccactctctgcactgaagaggtaaaatttgcactgcaagtcacatccctgaggccagaggtcagtaccctttggtatttcgattagaagaagctgcaaaagaaaggcagcccattttaccattgccagccaggccggggacacaggagccggtgtgtgcactctgcctcctcaccttgcacccagagcaagaggactgggtgctgggctgcagaggccggtcagtggagcccctagcacgtgtgaactcaggcttttcattgggcccggctccacttctaggccatgttttgactcatttggtaaccattgcctgtaagcagcacagaattggtgccatggattatcttttccatgttgatggaattcattctgttggaatcctttggccagatgtcacttcagccagggtgtgcatcatcattggttctttttcacaggctgagcctcctgaaaacccatgaacgctggggctggggaagtgaaccctgaggtggggaccctctcttcccatcaaatcatccagctcagtgtggggcgtggcaggggggtaaatgaagccagccaatgtgttaacctgtctctgtcaacctaagaatgttggccttactgacacacctttgctccatgttcaagaccagaagtagctgggatttgtttgcaaattgggtaattagtttaaaaatctgtgattacatttttaaatgaaattttcaaagtggcctagattgaggtgattcagataggtttgcgaatataccattttatattgttgagaaagaacaaaaagggaatttccagatgtcctagaaatcctagcaacagatttctctggttgtcagtttccctggagaaggcgccagataggaatctccaatcagttgtttttctcttcgcttcaggcccttacacaaaagccatgaagagatgttcacctacccggtattttaaatgttctgtaaattattagccaaatagaactgtaatggggttgtatttatgggcgcctagaaagaaaacacaaggacttggtaggccaggaagaaaagattttaaaatttagaatgaatagcccttctgggttttctttttgacaattcttggacttgaggtaaaacaaggaggattgtggccggatttcagatcccaaagccagcctccatcttaggcctttgcctcattgtgccttttaggttttcttacccaccgtctcctgttttgtcttttttttcttttctcctacccctatcttgggacattcagaaactgcctgggtggtttgagaagagacaacccagtttgatctgcaatacaaggatccattcgtaatctctctctcactgatgttattcccccatctgccgtcttggttcatctcaccacagaagggcatttagtcctacccagccatcggctgcgtatgacagcaggatggcacttcccatttctctgtggttagtgctcgagtgaaaacctctttcagctgagtcctctgaggttctgctgttgagtcctgggtggctgatggaatgattgaggaggtctggtcaccctcaagcgccgtcatcgccttgtttccatgggcttctgtcacacaaaatgaagaacagaaatgttaggacttaagagaatgtttggaattcacacctctttgcagtcctttcaaggctgctgctctgtgctgtgtcccatgcatgtgaaagtagagctgtgatggctgctgggatgcttgcaaagatcatgtgtgagaattgagcacaagaccacaaattattactgcttgatgcgcttgttaaaactctatctgcca

SEQ ID NO: 371903 - DNA, 2945 bp, Homo sapiens
  misc_feature (715)..(715): n is a, c, g, or t
gcagagccggcgagcgagcagcagggactgcgcctggcgcactcacttccgcgtcccgccgccctccggcccgcgcgcgccgatccgccgccgccatcggacaatgggccgccagccccagctgccgtgaacttcctgccgctgctcggccgcccgtgcgtcccggacggcgttcctgccaggcgccggccgggatcgcagctccggggaagcagcggaggacccagcgcctggaacgtacctgcgcctcagccgccgcgcgtttgctccggcccgactcgcggcctcggcgccctcccggccgattcagcttcacccggcccagtcggctgctgccttgctgtgagtttccgtgtttggttgcctaaggaggatgtgattttacttttttgctgttttctttttccttttataatttgaagaggagaaaagaactccgctgagcaggcccgggacggcgaagtgccaccagctaccccaacaaggacgtctccaggggaaagggagttggaagcaaacttggtccagctggcgttgaggtctcaacttcggctggactcttaaatcctggggtcatgcccttcacgctaggcaggtggaagtctttagttgtactgggccggacttgagccccgacccttcgccagcatctccccgctgccctcaacacacaacacacacacacacacacacacacacacacacgcggcacctnctaggcccggacacctgtctgcagcatggataagtatgacgacctgggcctggaggccagtaaattcatcgaggacctgaacatgtatgaggcctctaaggatgggctcttccgagtggacaagggtgcaggcaacaaccccgagtttgaggaaactcgcagggtgttcgccaccaagatggccaaaatccacctccagcagcagcagcagcagctcctgcaggaggagactctgcccagggggagtagaggccctgtcaatggagggggccgcctgggcccacaggcccgttgggaagttgtgggcagcaagctgactgtggatggtgctgccaagcctcctcttgctgcctcgacaggggcacctggggcagtcaccaccctcgctgctgggcagcccccgtacccaccgcaggagcagagatccaggccatacctgcatggcacgaggcatggcagccaggactgtggttccagggagagcctggcgacttctgagatgtctgctttccaccagccaggcccctgtgaggatccttcctgcctcactcatggagactattatgacaacctctccttggcaagcccaaagtggggtgacaaaccaggagtgtcccccagcatcggcctgagtgtagggagtgggtggcctagctccccggggagtgacccaccactgcccaaaccctgcggggaccatcccctaaatcaccgacagctctccctgagctccagcaggtcttctgagggtagcctcggtggtcagaatagtggcattggtggccgcagcagcgagaagccaacaggcctttggtccactgcctcctcccagcgggtgagccctggcctgccttccccaaacttggagaacggagcaccagctgtggggcctgttcagcccaggactccttctgtgtcagcacccttggccctgagctgccccaggcaaggaggtcttccaagatcaaactcggggctggggggtgaggtttcaggtgtgatgtccaaacccaatgtggacccccaaccctggttccaggatgggcccaaatcttacctttccagttctgccccgtcatcctcgccagctggcctggacggttcacagcagggtgcggtccctgggctggggccgaagcctggctgcacagaccttggcactggtcccaagctcagccccaccagtcttgtccatccagtgatgtccaccctgcctgagttatcttgtaaagagggtcccctgggctggtcttctgatggtagcctgggatctgtgctcctggacagccccagctcccctagggtaaggctgccctgccagcccctcgtcccaggtcctgagctgagaccctctgctgctgagttgaaattagaagccctcacccaacgtctggagcgagagatggatgctcacccgaaggctgattactttggagcctgtgtgaaatgcagcaaaggggtgtttggggctggccaggcctgtcaggccatggggaacctctaccatgacacatgcttcacctgtgcagcttgcagccggaagctgagaggaaaagccttttattttgtcaacggcaaagtgttttgtgaagaagacttcctgtactctggtttccagcagtcggctgacaggtgttttctttgtggacatctgatcatggacatgatcctgcaagccctggggaagtcctaccaccccggctgtttccgctgtgtcatctgtaatgagtgtttggatggggtgcccttcaccgtggactcagagaacaagatctactgtgtccgagattaccacaaggtgctggcccccaagtgtgcagcctgtgggcttcccatccttccacctgaggtaagatgcccttccagacatgctcccaggggcttctaagacatgaatatctccctgggctcatttacaagatccatgtcctgtccttacagcttttaaggtatccttttaaaaatctcaactctggcctggtgcagtggctcacgcctgtaatcccaccccttttaggaggcccaggcaggaaaattgcttgaggcctggagtttaagaacagcctgggcaacatagcaagacctcatctctacaaaaaattgttaaaaattggccaagtgtggtggcatgtgcctgtagtcctagctgcttgagcccaagagtttgaggctgcagcgagctatgatggtgctactgcattccagcaggtgacagcaagaccttgtctcc

SEQ ID NO: 371904 - DNA, 3690 bp, Homo sapiens
aaggtcgtcggcatctgtgttgtgcgtgtgtctcacgcagctgcgggctggccacctcgtcctggaagagctgctccagcttggcttctcctgctcgatgaagcgctccctgtgtcatctgtaatgagtgtttggatggggtgcccttcaccgtggactcagagaacaagatctactgtgtccgagattaccacaaggtgctggcccccaagtgtgcagcctgtgggcttcccatccttccacctgagggctcagatgagaccatccgtgtcgtgtccatggacagagactaccacgtggagtgttaccactgcgaggactgtggtctggagctcaatgatgaagatggccaccgctgttatccgctggaggaccacctgttctgtcactcctgccacgtgaagaggctggagaagagaccctcatctacagcccttcaccagcaccacttctagccagagccacttgcagacatcacggcaggggatgaggagccggggttgctgctgctgcttccggtggcccctggggtggaagtggggtaggggaagaggaggggcaggagggagagttcctgtgagcatgtggggggtgcctttcctttaaccagggaggtgaacactacctgcctcctgcgtgtattttccaagtgcttttctctgttgccacattttcctcaggttactcaggaaaatgctccagcatgtgcgagcacatgacctgaggttgcatcatagcaccaaaggaatcctcctgtcccctctgggaacatttcatgcttcagagggagaggtttttattgagcttgtttcacaatatccccttgaagggacagctcagctgccaatacattcaaccctttctcttccttcaggaaaatacctatacccaaatgttccctcccccgacatatatcatggcatgacttaaggcttcttttcacctgagagcttcagttcttctgcagaatggctgcaaatttaattgcattaaggcaagaaggaagctctaatgtgtgctttgtatcctaagataaatttgcttagaaaaccagagtcaagatttgaaataggtgaggcagggtttcctccttagacactgacagcattctccgtaccccttcaaatccttactctcctaaaggcagctgagtccgcgacagaaatttgccctatgtgagtaaaacatactttgggagaagaacttggtgcaggcaccaggatttttttttttgcccacgtgtttgcgctgtttttctctggagttctcaagagttggtgacttggaaggccgcttctgcaaggcaagtctcaggaacccatgcaggtacatcgcttgcacctgtttttagcttatttaatgacgggcttttgggaagagctgcccgcatactgagagacagcttcttataaacaaggagagtttttgtgtgtgcgagatctctaagccagcgtgggagggagcgcctcaggataagttattatattcatttcgttggtttctctcctgcccaattcttggcacaggcattatgtttgaagaaaccaggataaggtacactgcttttgtctgtttaatttttttagttgtttcccttcactttcagtcttccacacacaaaaaatacctcacagagcttcaccaaatcacagattcaggaggaatttggctttcacactggactcagataccttcttcagtgtgttggaaatcactggcttcacacaggcccaactccagctggtcagggcagagtgatcgtaactaaaggtcagtggggaatagatccgattcagtgcttttgccttatgcatttcagcatcctggctccccagggtggcaggagctgagggagggccacacactggcaagatttcaagaccactctctgcactgaagaggtaaaatttgcactgcaagtcacatccctgaggccagaggtcagtaccctttggtatttcgattagaagaagctgcaaaagaaaggcagcccattttaccattgccagccaggccggggacacaggagccggtgtgtgcactctgcctcctcaccttgcacccagagcaagaggactgggtgctgggctgcagaggccggtcagtggagcccctagcacgtgtgaactcaggcttttcattgggcccggctccacttctaggccatgttttgactcatttggtaaccattgcctgtaagcagcacagaattggtgccatggattatcttttccatgttgatggaattcattctgttggaatcctttggccagatgtcacttcagccagggtgtgcatcatcattggttctttttcacaggctgagcctcctgaaaacccatgaacgctggggctggggaagtgaaccctgaggtggggaccctctcttcccatcaaatcatccagctcagtgtggggcgtggcaggggggtaaatgaagccagccaatgtgttaacctgtctctgtcaacctaagaatgttggccttactgacacacctttgctccatgttcaagaccagaagtagctgggatttgtttgcaaattgggtaattagtttaaaaatctgtgattacatttttaaatgaaattttcaaagtggcctagattgaggtgattcagataggtttgcgaatataccattttatattgttgagaaagaacaaaaagggaatttccagatgtcctagaaatcctagcaacagatttctctggttgtcagtttccctggagaaggcgccagataggaatctccaatcagttgtttttctcttcgcttcaggcccttacacaaaagccatgaagagatgttcacctacccggtattttaaatgttctgtaaattattagccaaatagaactgtaatggggttgtatttatgggcgcctagaaagaaaacacaaggacttggtaggccaggaagaaaagattttaaaatttagaatgaatagcccttctgggttttctttttgacaattcttggacttgaggtaaaacaaggaggattgtggccggatttcagatcccaaagccagcctccatcttaggcctttgcctcattgtgccttttaggttttcttacccaccgtctcctgttttgtcttttttttcttttctcctacccctatcttgggacattcagaaactgcctgggtggtttgagaagagacaacccagtttgatctgcaatacaaggatccattcgtaatctctctctcactgatgttattcccccatctgccgtcttggttcatctcaccacagaagggcatttagtcctacccagccatcggctgcgtatgacagcaggatggcacttcccatttctctgtggttagtgctcgagtgaaaacctctttcagctgagtcctctgaggttctgctgttgagtcctgggtggctgatggaatgattgaggaggtctggtcaccctcaagcgccgtcatcgccttgtttccatgggcttctgtcacacaaaatgaagaacagaaatgttaggacttaagagaatgtttggaattcacacctctttgcagtcctttcaaggctgctgctctgtgctgtgtcccatgcatgtgaaagtagagctgtgatggctgctgggatgcttgcaaagatcatgtgtgagaattgagcacaagaccacaaattattactgcttgatgcgcttgttaaaactctatctgcca

SEQ ID NO: 371905 - DNA, 1147 bp, Homo sapiens
ctcccccgggacggggttaattgaaatgcggttccctttgagtcccccgcgttgtaaaaaaccccgtgttaggaccctcccgcgaaactccctcctggggattttttccacaaaccctctccgtgtccccccccggcgcgttttttatttggtgggagatccccccccccttgttccctgggcccccggttctccctcttgggaacccccgtttgggcccctttctcaccttccctctccggggcccccgcgcgcccccccgccgatgtggttttaggaaagtcttttcgcgaggggccgcgcgggcgcgcgccgcccaccgttttctttttttttttttttttttttttttttgtttttttcaggagcgaataccaacctttatttgcacttgggttccagttcaaagccaccttagacagtgtggcaaagtgggaaaaagcacagatcctgggaccaaggttcagattccatctcaagcgagcatatgaactgtgtgacaacaggcagacagtacctctgtgtctatgagaaagcggggagagcaacaccccagcttctagcagctctacagctgcctggacctgcaggccctcctaggcccacttcctccccagcacagtgtgtgttcccgggcgtgtgtggctctgggtccagctctgttcagggtgggactccaggtgaattactgaacctctgaggtgtacccccaaccccaaactttcaccaaaagcaataaagaggaactctagaactggagccaggactaagtgagaaaaactgcttataagtgcttaataaatactagttatttacaacttttgctcaagccgagggcagaggcctttgtacgcagctgccgaactctgactctagttctgcggaagaaaaggatgcggtatttgcttttgccatgatccctttccatttgattggcaggttaaataacatggtttttgaagtcacatacttaatattcttcctaaaaaccacccaaacactagatgtgtgtgtgcacacacacagaaaccacgaggtagtttaaatcaccattaaaaatcaacgctttctctgattctgtgtcacagagcgacgcgtgggcggaccgcgtgggtcgacggacgcgatgggtcgacccacgcgtccg

SEQ ID NO: 371906 - DNA, 1826 bp, Homo sapiens
  misc_feature (1410)..(1410): n is a, c, g, or t
ctttctaagttgcgggcgtcagcccggcgcctcgaacctgcagctcctccccgcgggctgcttctgagttcctgtggattccgccttcagggattgcgagcccggttggccctcgcgcgagtcacaacctctgaatcagcccctgaggattccccgagcgcgctgaacgcgcctggcacgggagctgcccctttttggcgttggccaaacccccgctgctccgtagccttgggaccctgggcgccgcgttgcccgtccggcgcgtaagcccgagcccctctcctgggcctcccgcgccctgccccctagcgcgccccccgaacgcctccgcctcccggggtccgctccccgccggggcctcgagaaggaaggtgtcacgttggtggcattcgagccagccggcaagacgaatgtccgggttgtcacttttgagaaatcccagccagccagagcaggtagccaagcagcccttcgatagctgttctgttagtgctgattcgactgttcttggagactcataaatccaatttggcagctgttaggtttgctgggattgacagtgacgcgtgtgaaggcattaaatgtgatgatgtatgtggcaacgctgtgtaaacagcagagctgtccacgattttgagggaattggcagtctgttttcagtggcggggaatgtgtcaacctcggtgcgtggcgttattaaaaactgtttccagcccctagcctttgataaaccaggtaagctggagtggcgagaacattaagtggaagtgtttagacaaacacagacgtttaggagaaataatattctaggttcatggacaatctggaaactaagttcgttttgaaatgaagctgagagcagagcgggtttctcggctttggtggatggcccttgggaaccagagcgggcataggaaggggttgccctgagtaccagtccccggccggtagctgcggggggtgtgcgggaggtgaagcctgctgagactgagaagccaagtcccgctaacgttgtgcccttcccaggagagggcctcgccgaggacggatggggctgggaacgggtgggcctatacatagtttctgcccgttattgtttatacctcttgaaaggatctgtgttgaatgggatttaattttaggacaagtaatgcatttacatggtacagaactccaattctaaaggtgcacaggagtacgtgcagaaaagttggtctcacagtctccaagtgtccttctctagaggcaactactcttcccagtttcttgtgaagccttctagaaataggctgtgcatgcatactatatatactatatattctctaccatacacgtgcgagtagcacacatgttgttttgcacatttttccgttttcatagtgtttcttattagaatgattgttctgagtnggtgcatataagactggcttacttgattttaattactgcttaggccaatgtacatacggttttatgaataaaaccattaacaagtacgtatggatttaaatgtttatgtagatttgaatgttttttaacctatttagacagtccctgttgatgaacatttgggttttcaatcagaaggtttgtgacagcaaagtcattggaataaatctttcttcttgatggagatgaaatatgtggctagtcttcgtgaggcagtcaccaattaatcaacttcagaaaaatagaaccaagcagaatactgaggaggggtgcgttacaggaaataaaaatgctatcagagggcaacccgctctggtccccttccacgctgcggaagctttgttcttttgctcttcacaataaatcttgctgctgct

SEQ ID NO: 371907 - DNA, 825 bp, Homo sapiens
atttgtctaattgtaaaaataccgaagtagtgattccaagttagaaagtagtgatccctaagaacagttggagaaacatatggtttgttctatagctgtaagcggtaattttgaagcaattttgaaagcattctttccctttaagaaaaaaatagtttcttactgaaatgactttttaggatgtcttgaaaaacgtagtgaaattcatctagaaacttacaaggttgatgctagccatcacatgcatgctgcaatttgctgaaatgtcttgatccaggggagctaaacttttacaaaaataggtttgtttagaagtcatatcactacatgaaaaatcaccacttttgaaacttacggttaaaggcagtttctcttttaaaaatgtgctcattgattattcccacccaaatagccagaatattttgtaattacccattaccactcctaccatctgaaacgtgcatgaaaaaaatgaaaaattgacttcatctgaaaagagttgtgtcatgatatatgaaacgttttttgtaacctccaggaaggaacattgcaatttttccatttcagatcgcctttgttttgccattctctacagcagaccaaagagtgcatcaaatgtacattatttcagcatagataatgaacttgaatatgagaagtaagtattgctctttaaaagattttaactttttgtttttgaagaatctaaaggtatggttataaatgggatggcctgggaaaattataaatctattgattgctaattacaggatgcttgtttttcacctgtagtaataaaataaacctttagagcaaaaaaaaaaa

SEQ ID NO: 371908 - DNA, 440 bp, Homo sapiens
aggtacatgtttcaggcagatttgaaatggatttcttcctcccacagtctaacaaaaacaagtagggaaacaaccaaagaataaggcaacttaaggaaaaacgcaggaagaccctgggaggcagggtcatgcaaaagctgccaatggtgtcctgatgggacgcagtcttcgtccatcaggtgtgcagtgcagctccgcggtgctgggaaacagggctctttcaagacagcgcagggaaatcttccgggtcatctgggttgggggcaacatcttgcatcaccacttctgctctgggtccatagttctctgccctcctgatccttccccggcctccccgggtgcctcctctggctccacgcccaggacgagggaggttaccaaaattaatctccagctgggatgtgatgtcattggcgggtttccggaaaacatgggaatcg

SEQ ID NO: 371909 - DNA, 5680 bp, Homo sapiens
cacggaacagccctcctggggtccccacgagccgcgtcctgctgtgccccggcgcctacgcagcagcggccgcggccgcggtgggcacgcacggttaccccgggcagctccggccgccagctgcagccccgtcgcctcggccgcgccagccggctgcgggcacctgggggcgggctgggggcgccggccgcggcaggaggcgctgtagcgagggctgcggcgccggtcctgcggcggccgcgggaggcagcggggcaggcgctgtgggccgggctcctcctccggctcctgcgcgaccgcctcccgccgggctctgccggcgcccgccgtccccgcagcgccgctctgcgcccgccgccccgagcgcccgcgcggggctggcgggagcctcggcgggcgcgcgggcgcgcggggccatggtcgtggccccctgacgggccgcggccgcctccatgaagcggaaaagcgagcggcggtcgagctgggccgccgcgcccccctgctcgcggcgctgctcgtcgacctcgccgggtgtgaagaagatccgcagctccacgcagcaagacccgcgccgccgggacccccaggacgacgtgtacctggacatcaccgatcgcctttgttttgccattctctacagcagaccaaagagtgcatcaaatgtacattatttcagcatagataatgaacttgaatatgagaacttctacgcagattttggaccactcaatctggcaatggtttacagatattgttgcaagatcaataagaaattaaagtccattacaatgttaaggaagaaaattgttcattttactggctctgatcagagaaaacaagcaaatgctgccttccttgttggatgctacatggttatatatttggggagaaccccagaagaagcatatagaatattaatctttggagagacatcctatattcctttcagagatgctgcctatggaagttgcaatttctacattacacttcttgactgttttcatgcagtaaagaaggcaatgcagtatggcttccttaatttcaactcatttaaccttgatgaatatgaacactatgaaaaagcagaaaatggagatttaaattggataataccagaccgatttattgccttctgtggacctcattcaagagccagacttgaaagtggttaccaccaacattctcctgagacttatattcaatattttaagaatcacaatgttactaccattattcgtctgaataaaaggatgtatgatgccaaacgctttacggatgctggcttcgatcaccatgatcttttctttgcggatggcagcacccctactgatgccattgtcaaagaattcctagatatctgtgaaaatgctgagggtgccattgcagtacattgcaaagctggccttggtcgcacgggcactctgatagcctgctacatcatgaagcattacaggatgacagcagccgagaccattgcgtgggtcaggatctgcagacctggctcggtgattgggcctcagcagcagtttttggtgatgaagcaaaccaacctctggctggaaggggactattttcgtcagaagttaaaggggcaggagaatggacaacacagagcagccttctccaaacttctctctggcgttgatgacatttccataaatggggtcgagaatcaagatcagcaagaacccgaaccgtacagtgatgatgacgaaatcaatggagtgacacaaggtgatagacttcgggccttgaaaagcagaagacaatccaaaacaaacgctattcctctcacagtaattcttcaatccagtgttcagagctgtaaaacatctgaacctaacatttctggcagtgcaggcattactaaaagaaccaccagatctgcttcaaggaaaagcagtgttaaaagtctctccatttcaaggactaaaacagtcttgcgttaagtaaaaacctgtgaccagagctgaaggaagactctaggactgaaaactgcaacagaaattagcacaatttgaaaacaaaacaaaattgcaaaagccttagttgctttttccacctaagaagttgatcaatggagaaaatgtccactggagtttgaataatgaactttgagtttgggtgcaagcaaatgactcagagaagggtccagctctcaagctgaatgacaaacatgctgttgtaaatttagtctcaggtgtaaatacccaagccctctggtacccagggagctggctggtctgtggtgcatgtgtgtccctgtgatggcaatcattgtagttgctggccttcagaagaattgaggatctgatggaggttttttatgtatttattttctgttcaccttgtgaccctgtgtcaaaatttataaagatacaaaaggcattactgaaatggtactttctgtaatttgatactatttggcttaatcatcttcacttgactatttgtaatactgttgtaatgttaactctgttaagtacccaagctgcttgtcttccaccaaagagtgctttattaacaagaatctgtgaaaatcacatttaaacactgttgcatgttgtaagaccaggtggtaccttagtaacctaaaacttgcaagagaatattaatggtagctttagaagactcaggaggagaaactgacttcagagttggaagatgttgcaagtcgttcctttttctgtccttcagggactgaagaactgggaggctgcccattgtttggttgccagtcatacaaattaaaatcatatttccttccatgaatggaagaaacacactattggtttttccccttggaaacagcaatcccaaataatgtcggcttacaaaaaaaaaaagttaccacttttttagagtccttccctgtaacattggattttttttttcccttatgagatccacctaaggccattgacgtggcctgcgatctcagtgacaatgatctgcttctggatctcactgttgcctttggttagggaacacaactagtaactctgcagagtgccttctcccgcagccctactggaacacagcagagtctgtgccatgaagcagttacagaaacagaattgatgtgctgctaaaaaaaaaaaaaaaatggggcccgaaataaaagaatatatagtactcacctcagttccttccataagaagtgggtggtttaatgattgttaagccatttttgcctgtgccgggagcatggagggctgagatgtcgacaggcagtgggaaacaaatgccctcctaagccacaaggcgtgcgccagattagtaggcaactccattttaagaagctgcctttttcacaaaactggaagaaataaaagcggttggaataaacaagttaaaagtctttaatgcaaaaagtaattgaaaggcagtgcctccattttggtgtactttcttggaagaaagtataaaattgaccggcatcatgagagacggaagatgccgtgttctcagccaaacaagcaactctttccccgccaggcactgtcgggtggggtcaggccagcttttaaacactggggactggatcacagaaaaacagtggttttctgtccctggaaatgaataggcacaaagacccacttggctgtgggcagactactcttcaataagatttgggtgggaggaggaacattccttttgctattttgagctgagacaatataaatattcaaactgtgccatgcataaagcattgaattctcagggcacctcttcttccccttaccccttttaaggccatcccctccattaataataatccaggtagttgtgaaaatcgtgcttctatctgatcccttcttagtttggcttttcatcccatcagaacaagtaaacgtaggcgccacagctcttgtgagtactgtctccctcacggtgaatgagcctcctggtgtttcgtccaagaaaagaaagggtgtcactggaaccacagccctttttcattttataaactgcctcttcatgttgcctgctcaagtttccacctagaattgctatcactgtggctctttctaaaaatctttctatttaactggttcactgaaattagtcatagaaaacttgtgatttggtgaagaggcattccttgtaataaccaaatgacttgggatggtgtgcatagcaagggcagtgttacacttatgaggactgtctctagcatccaggaagtctctgggtctgagggatggaaagttcttcctgctatgaatgagagtggactcttcccctcacccccaactgaaaccacaaacaaccagaatcttctggaattctgacttagagtcgttgttatagaagaccttgttgctatggaacatgaaactgtgtgtcagatggagagatccccttaacctaagagccttaaatagccctgaaagtacactgggacggtttgcgatggaattaaaattggaagtgaatatttttaggtgctcttgaagctttctggggactcaaaattatcaaaagtcagggacagtccggaggaagagcgtctgcaaaactgggttcctagaagtatagacggacttagctttttgtagaatttggtgaggagcagcgcctcgtgagagcagaatggcctggcgtggccagtgcttcccggcagcacgcagctctgcggcctccagaattcccctgttctgagcttgatgcccctagcctgtcccctacctacttcctcccctcctctctagccctctcacaggggtgattgctacctctctgttttcttgggcctaggcaagttttagaggagttcccaagcattgttatgaggccagtgtgctcgctgggctgggcgggatggcctgggcttgtgtgtggcctgagggctctcctggggccttctcttttcccagtcacctttggagccacagaagcagtgcactcattggatgtctgttcttaacacagcttctctttctacattaaaaaaaatcattattgcattttggaaagcagtgctcatcaaaagcaacttttaaaacctattttattgttcctttaaatgttctctcccgctgaaactgccctggagaggctatctgctgctcttccatttacccacatcaggttattctccatgtcactcagtggagatgactccagatgtgtttaaagactggacaattcacctatactgtgtaggaaattacctccttaattacctggtagaattgtcagcagacatgttcatccgatgatagtactgcagttttctattaataatttgcagacttttatctaacctgcactcatgtacagattattaaaagttttaaaatgtaactgatcagtattgatcaatcattgtcttgatttttttttacagcgtatatttctaatcatattttttaaagccaagagaactggttgaatgaatgtttattttcctgaaggtatttttaagataaagcttcctaatggcgtgtaaactttgcatatgtatgtagtttgatacatattgtcacatttgaaaatcttgtgggttgtaactggttttatacaaaatatcgaatagtggaaattgtataattacaatcatgtaattaaaagtattaacccaaaaaaaaaaagggggggcaaagaatccgagggccattaggaccagtttgtaaagggcccaagggggaaaaaaggggggcgggaaaggaggaac

SEQ ID NO: 371910 - DNA, 5382 bp, Homo sapiens
cacggaacagccctcctggggtccccacgagccgcgtcctgctgtgccccggcgcctacgcagcagcggccgcggccgcggtgggcacgcacggttaccccgggcagctccggccgccagctgcagccccgtcgcctcggccgcgccagccggctgcgggcacctgggggcgggctgggggcgccggccgcggcaggaggcgctgtagcgagggctgcggcgccggtcctgcggcggccgcgggaggcagcggggcaggcgctgtgggccgggctcctcctccggctcctgcgcgaccgcctcccgccgggctctgccggcgcccgccgtccccgcagcgccgctctgcgcccgccgccccgagcgcccgcgcggggctggcgggagcctcggcgggcgcgcgggcgcgcggggccatggtcgtggccccctgacgggccgcggccgcctccatgaagcggaaaagcgagcggcggtcgagctgggccgccgcgcccccctgctcgcggcgctgctcgtcgacctcgccgggtgtgaagaagatccgcagctccacgcagcaagacccgcgccgccgggacccccaggacgacgtgtacctggacatcaccgatcgcctttgttttgccattctctacagcagaccaaagagtgcatcaaatgtacattatttcagcatagataatgaacttgaatatgagaacttctacgcagattttggaccactcaatctggcaatggtttacagatattgttgcaagatcaataagaaattaaagtccattacaatgttaaggaagaaaattgttcattttactggctctgatcagagaaaacaagcaaatgctgccttccttgttggatgctacatggttatatatttggggagaaccccagaagaagcatatagaatattaatctttggagagacatcctatattcctttcagagatgctgcctatggaagttgcaatttctacattacacttcttgactgttttcatgcagtaaagaaggcaatgcagtatggcttccttaatttcaactcatttaaccttgatgaatatgaacactatgaaaaagcagaaaatggagatttaaattggataataccagaccgatttattgccttctgtggacctcattcaagagccagacttgaaagtggttaccaccaacattctcctgagacttatattcaatattttaagaatcacaatgttactaccattattcgtctgaataaaaggatgtatgatgccaaacgctttacggatgctggcttcgatcaccatgatcttttctttgcggatggcagcacccctactgatgccattgtcaaagaattcctagatatctgtgaaaatgctgagggtgccattgcagtacattgcaaagctggccttggtcgcacgggcactctgatagcctgctacatcatgaagcattacaggatgacagcagccgagaccattgcgtgggtcaggatctgcagacctggctcggtgattgggcctcagcagcagtttttggtgatgaagcaaaccaacctctggctggaaggggactattttcgtcagaagttaaaggggcaggagaatggacaacacagagcagccttctccaaacttctctctggcgttgatgacatttccataaatggggtcgagaatcaagatcagcaagaacccgaaccgtacagtgatgatgacgaaatcaatggagtgacacaaggtgatagacttcgggccttgaaaagcagaagacaatccaaaacaaacgctattcctctcaccgatggttggctgtcccaggctgtcacctttctagaccggcttctgatctggctcgggatccacaaggactagacctgcggggaaggtctctcctggacacgcccgttgcccactgcaagttctctccaggtgcaattgaagcctctcagcagcggaggccgccatgtggagagagcaggcaggcccactgctgctgagaacagggcaggcacgggcagctcctgttctgcctttcccagcttcggagacgcaggctcagctgctccgaagcacctgccagcaccgcacagtacagtttcagaggacagcagtctccttcccgtgaagctcccatgtgctggaatggcatggacttgctgatcaacagaaggaaatggtctgaagtctgaccagcacaaggaaggaggctggctggctcagaggggcccaccttgcgtggaatgaaaacgccaaaggctcatgagcaacattaggctagaggggtcttgttcaaagcatccaactctgacttcggaggcattcccagccggcagcagtgtgtccagcctgcctcttcccaggctggtctgacatgcagcttaggctttcatcccaagttaggtactgacccctccctcttgggcagcacctccctttttaaaaaaatttttttttcttccaaagacagagtcttgctcttgttgtccaggctggagtgcagtggcgcgatctaggctcactgcaacctccttctcccaggttcaagcgactctcctgcctcagcctcctgagtagctgggattataggcgtctgccaccacgcccggctaatttctgtatttttagtagagacagggtttcaccatgttggccaggctggtctcgaactcctgacctcaagtgatctgcctgccttggcctcccaaagtgctgggattacaggtgtcagccaccgcacccagccaagcacccctatctctagaggatctggccccccagcccagttactgcagggcagctttccccacctggtgacaggctgtgcgcagcagccccaggacctcaccctgagctgagtcttcaggagccgccctggtggcacaactcagacacccctgaggcctagcagtcaactcctgattcagacatgatccagtccagcctgggcttggctataaccagctcaaacttgcttgacctccacttttcaggagacttggggacgacagccctcatcggcgtctttcatggggttaatctgcttgagtctaagtcgccagccagaaacgtggtgcccagggtgccctgcctcaggacatgtccacacccacgtcacaagcacctgaggagtccggccggggcactgtggtccaaaaggtcctgccgcctccgcatctgactgtcccaacggcatgctggtgacacccccctgcccttcgcttctgtcctccctggcttctctggggcacttggggctatgtacaacctggcacgatccagaaagggtgcaaacaaaatgcctacatccaggcacacgaccaagtcagcgagagctagccctggtaagcaaacatagcccattacaggttcagaacgtgcaccgggttccccaaaactgtcttcaaccacatgactcaacagctctatgggataggaactgtcagtgtttttgcaactgcaacattaaaccaagtgctgtgggcttttcaagtattattcacaacactaaaggaaagtttcttcaaagggctctctggctaatcttcaaagccgcagttaggcaaaatgacagtgtgacagcttcaaagccactgactcatgacacagccctgatgttgtaccggctaggttcagatttcagaaatcagggcacttgcatccattgccttttccaggaaagggaagaaaacactcagttgataaaccttagtactcagataataaataagagaccaaaagtaggctatcacccaaagcaaacatccttaactgaccctaacgtgtatggattcaactttgattattcaacaaaatcatgaccgactgctgtggcctggagtaaccaaaggactgttttctctacacaaagtcaggagcgaataccaacctttatttgcacttgggttccagttcaaagccaccttagacagtgtggcaaagtgggaaaaagcacagatcctgggaccaaggttcagattccatctcaagcgagcatatgaactgtgtgacaacaggcagacagtacctctgtgtctatgagaaagcggggagagcaacaccccagcttctagcagctctacagctgcctggacctgcaggccctcctaggcccacttcctccccagcacagtgtgtgttcccgggcgtgtgtggctctgggtccagctctgttcagggtgggactccaggtgaattactgaacctctgaggtgtacccccaaccccaaactttcaccaaaagcaataaagaggaactctagaactggagccaggactaagtgagaaaaactgcttataagtgcttaataaatactagttatttacaacttttgctcaagccgagggcagaggcctttgtacgcagctgccgaactctgactctagttctgcggaagaaaaggatgcggtatttgcttttgccatgatccctttccatttgattggcaggttaaataacatggtttttgaagtcacatacttaatattcttcctaaaaaccacccaaacactagatgtgtgtgtgcacacacacagaaaccacgaggtagtttaaatcaccattaaaaatcaacgctttctctgattctgtgtcacagagtggtggccagtggctacacaatagcgatttttaaatgattggttaagtgaaaaccagaactcaaaatattccaggagagaagataacatttacaagtaaacagtaagtgcaattgtattttaatttcttggtctccgaaaactcagctgtgactgctttccattaacagttccagctctatgtgtttcctctaacgctaaaggcacagcccccgggaatctactgcttcctaagagtctccatggagtctattttacaacctcctttccctccatgcttccgcggaggagtctatactatctctatatacacattttaaacattattcttcatttgaaattccttcaataaaaacacagtcaccattcttcatcttcttgggaaatggcctgctctcgagcctctggagaagcccctctaacagctcagcccaaaaaagtgcaacaaatttacatgacacgggaaaagcaacatctattgttcttagagtctgactcccttggcccagctggaaaagtctccccacaggtgtgcagtgcagctccgcggtgctgggaaacagggctctttcaagacagcgcagggaaatcttccgggtcatctgggttgggggcaacatcttgcatcaccacttctgctctgggtccatagttctctgccctcctgatccttccccggcctccccgggtgcctcctctggctccacgcccaggacgagggaggttaccaaaattaatctccagctgggatgtgatgtcattggcgggtttccggaaaacatgggaatcg

SEQ ID NO: 371911 - DNA, 5732 bp, Homo sapiens
cacggaacagccctcctggggtccccacgagccgcgtcctgctgtgccccggcgcctacgcagcagcggccgcggccgcggtgggcacgcacggttaccccgggcagctccggccgccagctgcagccccgtcgcctcggccgcgccagccggctgcgggcacctgggggcgggctgggggcgccggccgcggcaggaggcgctgtagcgagggctgcggcgccggtcctgcggcggccgcgggaggcagcggggcaggcgctgtgggccgggctcctcctccggctcctgcgcgaccgcctcccgccgggctctgccggcgcccgccgtccccgcagcgccgctctgcgcccgccgccccgagcgcccgcgcggggctggcgggagcctcggcgggcgcgcgggcgcgcggggccatggtcgtggccccctgacgggccgcggccgcctccatgaagcggaaaagcgagcggcggtcgagctgggccgccgcgcccccctgctcgcggcgctgctcgtcgacctcgccgggtgtgaagaagatccgcagctccacgcagcaagacccgcgccgccgggacccccaggacgacgtgtacctggacatcaccgatcgcctttgttttgccattctctacagcagaccaaagagtgcatcaaatgtacattatttcagcatagataatgaacttgaatatgagaacttctacgcagattttggaccactcaatctggcaatggtttacagatattgttgcaagatcaataagaaattaaagtccattacaatgttaaggaagaaaattgttcattttactggctctgatcagagaaaacaagcaaatgctgccttccttgttggatgctacatggttatatatttggggagaaccccagaagaagcatatagaatattaatctttggagagacatcctatattcctttcagagatgctgcctatggaagttgcaatttctacattacacttcttgactgttttcatgcagtaaagaaggcaatgcagtatggcttccttaatttcaactcatttaaccttgatgaatatgaacactatgaaaaagcagaaaatggagatttaaattggataataccagaccgatttattgccttctgtggacctcattcaagagccagacttgaaagtggttaccaccaacattctcctgagacttatattcaatattttaagaatcacaatgttactaccattattcgtctgaataaaaggatgtatgatgccaaacgctttacggatgctggcttcgatcaccatgatcttttctttgcggatggcagcacccctactgatgccattgtcaaagaattcctagatatctgtgaaaatgctgagggtgccattgcagtacattgcaaagctggccttggtcgcacgggcactctgatagcctgctacatcatgaagcattacaggatgacagcagccgagaccattgcgtgggtcaggatctgcagacctggctcggtgattgggcctcagcagcagtttttggtgatgaagcaaaccaacctctggctggaaggggactattttcgtcagaagttaaaggggcaggagaatggacaacacagagcagccttctccaaacttctctctggcgttgatgacatttccataaatggggtcgagaatcaagatcagcaagaacccgaaccgtacagtgatgatgacgaaatcaatggagtgacacaaggtgatagacttcgggccttgaaaagcagaagacaatccaaaacaaacgctattcctctcacatgtcccctagctgtgctgacctctgcactgtgtagtgttgtcatctggtggattgtttgtgactacattcttcccatcctgctattctgtctcgatggtttcagaacacagtagccatcaggaccccctgacagatagctgctagtaattcttcaatccagtgttcagagctgtaaaacatctgaacctaacatttctggcagtgcaggcattactaaaagaaccaccagatctgcttcaaggaaaagcagtgttaaaagtctctccatttcaaggactaaaacagtcttgcgttaagtaaaaacctgtgaccagagctgaaggaagactctaggactgaaaactgcaacagaaattagcacaatttgaaaacaaaacaaaattgcaaaagccttagttgctttttccacctaagaagttgatcaatggagaaaatgtccactggagtttgaataatgaactttgagtttgggtgcaagcaaatgactcagagaagggtccagctctcaagctgaatgacaaacatgctgttgtaaatttagtctcaggtgtaaatacccaagccctctggtacccagggagctggctggtctgtggtgcatgtgtgtccctgtgatggcaatcattgtagttgctggccttcagaagaattgaggatctgatggaggttttttatgtatttattttctgttcaccttgtgaccctgtgtcaaaatttataaagatacaaaaggcattactgaaatggtactttctgtaatttgatactatttggcttaatcatcttcacttgactatttgtaatactgttgtaatgttaactctgttaagtacccaagctgcttgtcttccaccaaagagtgctttattaacaagaatctgtgaaaatcacatttaaacactgttgcatgttgtaagaccaggtggtaccttagtaacctaaaacttgcaagagaatattaatggtagctttagaagactcaggaggagaaactgacttcagagttggaagatgttgcaagtcgttcctttttctgtccttcagggactgaagaactgggaggctgcccattgtttggttgccagtcatacaaattaaaatcatatttccttccatgaatggaagaaacacactattggtttttccccttggaaacagcaatcccaaataatgtcggcttacaaaaaaaaaaagttaccacttttttagagtccttccctgtaacattggattttttttttcccttatgagatccacctaaggccattgacgtggcctgcgatctcagtgacaatgatctgcttctggatctcactgttgcctttggttagggaacacaactagtaactctgcagagtgccttctcccgcagccctactggaacacagcagagtctgtgccatgaagcagttacagaaacagaattgatgtgctgctaaaaaaaaaaaaaaaatggggcccgaaataaaagaatatatagtactcacctcagttccttccataagaagtgggtggtttaatgattgttaagccatttttgcctgtgccgggagcatggagggctgagatgtcgacaggcagtgggaaacaaatgccctcctaagccacaaggcgtgcgccagattagtaggcaactccattttaagaagctgcctttttcacaaaactggaagaaataaaagcggttggaataaacaagttaaaagtctttaatgcaaaaagtaattgaaaggcagtgcctccattttggtgtactttcttggaagaaagtataaaattgaccggcatcatgagagacggaagatgccgtgttctcagccaaacaagcaactctttccccgccaggcactgtcgggtggggtcaggccagcttttaaacactggggactggatcacagaaaaacagtggttttctgtccctggaaatgaataggcacaaagacccacttggctgtgggcagactactcttcaataagatttgggtgggaggaggaacattccttttgctattttgagctgagacaatataaatattcaaactgtgccatgcataaagcattgaattctcagggcacctcttcttccccttaccccttttaaggccatcccctccattaataataatccaggtagttgtgaaaatcgtgcttctatctgatcccttcttagtttggcttttcatcccatcagaacaagtaaacgtaggcgccacagctcttgtgagtactgtctccctcacggtgaatgagcctcctggtgtttcgtccaagaaaagaaagggtgtcactggaaccacagccctttttcattttataaactgcctcttcatgttgcctgctcaagtttccacctagaattgctatcactgtggctctttctaaaaatctttctatttaactggttcactgaaattagtcatagaaaacttgtgatttggtgaagaggcattccttgtaataaccaaatgacttgggatggtgtgcatagcaagggcagtgttacacttatgaggactgtctctagcatccaggaagtctctgggtctgagggatggaaagttcttcctgctatgaatgagagtggactcttcccctcacccccaactgaaaccacaaacaaccagaatcttctggaattctgacttagagtcgttgttatagaagaccttgttgctatggaacatgaaactgtgtgtcagatggagagatccccttaacctaagagccttaaatagccctgaaagtacactgggacggtttgcgatggaattaaaattggaagtgaatatttttaggtgctcttgaagctttctggggactcaaaattatcaaaagtcagggacagtccggaggaagagcgtctgcaaaactgggttcctagaagtatagacggacttagctttttgtagaatttggtgaggagcagcgcctcgtgagagcagaatggcctggcgtggccagtgcttcccggcagcacgcagctctgcggcctccagaattcccctgttctgagcttgatgcccctagcctgtcccctacctacttcctcccctcctctctagccctctcacaggggtgattgctacctctctgttttcttgggcctaggcaagttttagaggagttcccaagcattgttatgaggccagtgtgctcgctgggctgggcgggatggcctgggcttgtgtgtggcctgagggctctcctggggccttctcttttcccagtcacctttggagccacagaagcagtgcactcattggatgtctgttcttaacacagcttctctttctacattaaaaaaaatcattattgcattttggaaagcagtgctcatcaaaagcaacttttaaaacctattttattgttcctttaaatgttctctcccgctgaaactgccctggagaggctatctgctgctcttccatttacccacatcaggttattctccatgtcactcagtggagatgactccagatgtgtttaaagactggacaattcacctatactgtgtaggaaattacctccttaattacctggtagaattgtcagcagacatgttcatccgatgatagtactgcagttttctattaataatttgcagacttttatctaacctgcactcatgtacagattattaaaagttttaaaatgtaactgatcagtattgatcaatcattgtcttgatttttttttacagcgtatatttctaatcatattttttaaagccaagagaactggttgaatgaatgtttattttcctgaaggtatttttaagataaagcttcctaatggcgtgtaaactttgcatatgtatgtagtttgatacatattgtcacatttgaaaatcttgtgggttgtaactggttttatacaaaatatcgaatagtggaaattgtataattacaatcatgtaattaaaagtattaacccaa

SEQ ID NO: 371912 - DNA, 5552 bp, Homo sapiens
cacggaacagccctcctggggtccccacgagccgcgtcctgctgtgccccggcgcctacgcagcagcggccgcggccgcggtgggcacgcacggttaccccgggcagctccggccgccagctgcagccccgtcgcctcggccgcgccagccggctgcgggcacctgggggcgggctgggggcgccggccgcggcaggaggcgctgtagcgagggctgcggcgccggtcctgcggcggccgcgggaggcagcggggcaggcgctgtgggccgggctcctcctccggctcctgcgcgaccgcctcccgccgggctctgccggcgcccgccgtccccgcagcgccgctctgcgcccgccgccccgagcgcccgcgcggggctggcgggagcctcggcgggcgcgcgggcgcgcggggccatggtcgtggccccctgacgggccgcggccgcctccatgaagcggaaaagcgagcggcggtcgagctgggccgccgcgcccccctgctcgcggcgctgctcgtcgacctcgccgggtgtgaagaagatccgcagctccacgcagcaagacccgcgccgccgggacccccaggacgacgtgtacctggacatcaccgatcgcctttgttttgccattctctacagcagaccaaagagtgcatcaaatgtacattatttcagcatagataatgaacttgaatatgagaacttctacgcagattttggaccactcaatctggcaatggtttacagatattgttgcaagatcaataagaaattaaagtccattacaatgttaaggaagaaaattgttcattttactggctctgatcagagaaaacaagcaaatgctgccttccttgttggatgctacatggttatatatttggggagaaccccagaagaagcatatagaatattaatctttggagagacatcctatattcctttcagagatgctgcctatggaagttgcaatttctacattacacttcttgactgttttcatgcagtaaagaaggcaatgcagtatggcttccttaatttcaactcatttaaccttgatgaatatgaacactatgaaaaagcagaaaatggagatttaaattggataataccagaccgatttattgccttctgtggacctcattcaagagccagacttgaaagtggttaccaccaacattctcctgagacttatattcaatattttaagaatcacaatgttactaccattattcgtctgaataaaaggatgtatgatgccaaacgctttacggatgctggcttcgatcaccatgatcttttctttgcggatggcagcacccctactgatgccattgtcaaagaattcctagatatctgtgaaaatgctgagggtgccattgcagtacattgcaaagctggccttggtcgcacgggcactctgatagcctgctacatcatgaagcattacaggatgacagcagccgagaccattgcgtgggtcaggatctgcagacctggctcggtgattgggcctcagcagcagtttttggtgatgaagcaaaccaacctctggctggaaggggactattttcgtcagaagttaaaggggcaggagaatggacaacacagagcagccttctccaaacttctctctggcgttgatgacatttccataaatggggtcgagaatcaagatcagcaagaacccgaaccgtacagtgatgatgacgaaatcaatggagtgacacaaggtgatagacttcgggccttgaaaagcagaagacaatccaaaacaaacgctattcctctcacatgtcccctagctgtgctgacctctgcactgtgtagtgttgtcatctggtggattgtttgtgactacattcttcccatcctgctattctgtctcgatggtttcagaacacagtagccatcaggaccccctgacagatagctgctagtaattcttcaatccagtgttcagagctgtaaaacatctgaacctaacatttctggcagtgcaggcattactaaaagaaccaccagatctgcttcaaggaaaagcagtgttaaaagtctctccatttcaaggactaaaacagtcttgcgttaagtaaaaacctgtgaccagagctgaaggaagactctaggactgaaaactgcaacagaaattagcacaatttgaaaacaaaacaaaattgcaaaagccttagttgctttttccacctaagaagttgatcaatggagaaaatgtccactggagtttgaataatgaactttgagtttgggtgcaagcaaatgactcagagaagggtccagctctcaagctgaatgacaaacatgctgttgtaaatttagtctcaggtgtaaatacccaagccctctggtacccagggagctggctggtctgtggtgcatgtgtgtccctgtgatggcaatcattgtagttgctggccttcagaagaattgaggatctgatggaggttttttatgtatttattttctgttcaccttgtgaccctgtgtcaaaatttataaagatacaaaaggcattactgaaatggtacttagtaacctaaaacttgcaagagaatattaatggtagctttagaagactcaggaggagaaactgacttcagagttggaagatgttgcaagtcgttcctttttctgtccttcagggactgaagaactgggaggctgcccattgtttggttgccagtcatacaaattaaaatcatatttccttccatgaatggaagaaacacactattggtttttccccttggaaacagcaatcccaaataatgtcggcttacaaaaaaaaaaagttaccacttttttagagtccttccctgtaacattggattttttttttcccttatgagatccacctaaggccattgacgtggcctgcgatctcagtgacaatgatctgcttctggatctcactgttgcctttggttagggaacacaactagtaactctgcagagtgccttctcccgcagccctactggaacacagcagagtctgtgccatgaagcagttacagaaacagaattgatgtgctgctaaaaaaaaaaaaaaaatggggcccgaaataaaagaatatatagtactcacctcagttccttccataagaagtgggtggtttaatgattgttaagccatttttgcctgtgccgggagcatggagggctgagatgtcgacaggcagtgggaaacaaatgccctcctaagccacaaggcgtgcgccagattagtaggcaactccattttaagaagctgcctttttcacaaaactggaagaaataaaagcggttggaataaacaagttaaaagtctttaatgcaaaaagtaattgaaaggcagtgcctccattttggtgtactttcttggaagaaagtataaaattgaccggcatcatgagagacggaagatgccgtgttctcagccaaacaagcaactctttccccgccaggcactgtcgggtggggtcaggccagcttttaaacactggggactggatcacagaaaaacagtggttttctgtccctggaaatgaataggcacaaagacccacttggctgtgggcagactactcttcaataagatttgggtgggaggaggaacattccttttgctattttgagctgagacaatataaatattcaaactgtgccatgcataaagcattgaattctcagggcacctcttcttccccttaccccttttaaggccatcccctccattaataataatccaggtagttgtgaaaatcgtgcttctatctgatcccttcttagtttggcttttcatcccatcagaacaagtaaacgtaggcgccacagctcttgtgagtactgtctccctcacggtgaatgagcctcctggtgtttcgtccaagaaaagaaagggtgtcactggaaccacagccctttttcattttataaactgcctcttcatgttgcctgctcaagtttccacctagaattgctatcactgtggctctttctaaaaatctttctatttaactggttcactgaaattagtcatagaaaacttgtgatttggtgaagaggcattccttgtaataaccaaatgacttgggatggtgtgcatagcaagggcagtgttacacttatgaggactgtctctagcatccaggaagtctctgggtctgagggatggaaagttcttcctgctatgaatgagagtggactcttcccctcacccccaactgaaaccacaaacaaccagaatcttctggaattctgacttagagtcgttgttatagaagaccttgttgctatggaacatgaaactgtgtgtcagatggagagatccccttaacctaagagccttaaatagccctgaaagtacactgggacggtttgcgatggaattaaaattggaagtgaatatttttaggtgctcttgaagctttctggggactcaaaattatcaaaagtcagggacagtccggaggaagagcgtctgcaaaactgggttcctagaagtatagacggacttagctttttgtagaatttggtgaggagcagcgcctcgtgagagcagaatggcctggcgtggccagtgcttcccggcagcacgcagctctgcggcctccagaattcccctgttctgagcttgatgcccctagcctgtcccctacctacttcctcccctcctctctagccctctcacaggggtgattgctacctctctgttttcttgggcctaggcaagttttagaggagttcccaagcattgttatgaggccagtgtgctcgctgggctgggcgggatggcctgggcttgtgtgtggcctgagggctctcctggggccttctcttttcccagtcacctttggagccacagaagcagtgcactcattggatgtctgttcttaacacagcttctctttctacattaaaaaaaatcattattgcattttggaaagcagtgctcatcaaaagcaacttttaaaacctattttattgttcctttaaatgttctctcccgctgaaactgccctggagaggctatctgctgctcttccatttacccacatcaggttattctccatgtcactcagtggagatgactccagatgtgtttaaagactggacaattcacctatactgtgtaggaaattacctccttaattacctggtagaattgtcagcagacatgttcatccgatgatagtactgcagttttctattaataatttgcagacttttatctaacctgcactcatgtacagattattaaaagttttaaaatgtaactgatcagtattgatcaatcattgtcttgatttttttttacagcgtatatttctaatcatattttttaaagccaagagaactggttgaatgaatgtttattttcctgaaggtatttttaagataaagcttcctaatggcgtgtaaactttgcatatgtatgtagtttgatacatattgtcacatttgaaaatcttgtgggttgtaactggttttatacaaaatatcgaatagtggaaattgtataattacaatcatgtaattaaaagtattaacccaa

SEQ ID NO: 371913 - DNA, 5687 bp, Homo sapiens
atttgtctaattgtaaaaataccgaagtagtgattccaagttagaaagtagtgatccctaagaacagttggagaaacatatggtttgttctatagctgtaagcggtaattttgaagcaattttgaaagcattctttccctttaagaaaaaaatagtttcttactgaaatgactttttaggatgtcttgaaaaacgtagtgaaattcatctagaaacttacaaggttgatgctagccatcacatgcatgctgcaatttgctgaaatgtcttgatccaggggagctaaacttttacaaaaataggtttgtttagaagtcatatcactacatgaaaaatcaccacttttgaaacttacggttaaaggcagtttctcttttaaaaatgtgctcattgattattcccacccaaatagccagaatattttgtaattacccattaccactcctaccatctgaaacgtgcatgaaaaaaatgaaaaattgacttcatctgaaaagagttgtgtcatgatatatgaaacgttttttgtaacctccaggaaggaacattgcaatttttccatttcagatcgcctttgttttgccattctctacagcagaccaaagagtgcatcaaatgtacattatttcagcatagataatgaacttgaatatgagaacttctacgcagattttggaccactcaatctggcaatggtttacagatattgttgcaagatcaataagaaattaaagtccattacaatgttaaggaagaaaattgttcattttactggctctgatcagagaaaacaagcaaatgctgccttccttgttggatgctacatggttatatatttggggagaaccccagaagaagcatatagaatattaatctttggagagacatcctatattcctttcagagatgctgcctatggaagttgcaatttctacattacacttcttgactgttttcatgcagtaaagaaggcaatgcagtatggcttccttaatttcaactcatttaaccttgatgaatatgaacactatgaaaaagcagaaaatggagatttaaattggataataccagaccgatttattgccttctgtggacctcattcaagagccagacttgaaagtggttaccaccaacattctcctgagacttatattcaatattttaagaatcacaatgttactaccattattcgtctgaataaaaggatgtatgatgccaaacgctttacggatgctggcttcgatcaccatgatcttttctttgcggatggcagcacccctactgatgccattgtcaaagaattcctagatatctgtgaaaatgctgagggtgccattgcagtacattgcaaagctggccttggtcgcacgggcactctgatagcctgctacatcatgaagcattacaggatgacagcagccgagaccattgcgtgggtcaggatctgcagacctggctcggtgattgggcctcagcagcagtttttggtgatgaagcaaaccaacctctggctggaaggggactattttcgtcagaagttaaaggggcaggagaatggacaacacagagcagccttctccaaacttctctctggcgttgatgacatttccataaatggggtcgagaatcaagatcagcaagaacccgaaccgtacagtgatgatgacgaaatcaatggagtgacacaaggtgatagacttcgggccttgaaaagcagaagacaatccaaaacaaacgctattcctctcacatgtcccctagctgtgctgacctctgcactgtgtagtgttgtcatctggtggattgtttgtgactacattcttcccatcctgctattctgtctcgatggtttcagaacacagtagccatcaggaccccctgacagatagctgctagtaattcttcaatccagtgttcagagctgtaaaacatctgaacctaacatttctggcagtgcaggcattactaaaagaaccaccagatctgcttcaaggaaaagcagtgttaaaagtctctccatttcaaggactaaaacagtcttgcgttaagtaaaaacctgtgaccagagctgaaggaagactctaggactgaaaactgcaacagaaattagcacaatttgaaaacaaaacaaaattgcaaaagccttagttgctttttccacctaagaagttgatcaatggagaaaatgtccactggagtttgaataatgaactttgagtttgggtgcaagcaaatgactcagagaagggtccagctctcaagctgaatgacaaacatgctgttgtaaatttagtctcaggtgtaaatacccaagccctctggtacccagggagctggctggtctgtggtgcatgtgtgtccctgtgatggcaatcattgtagttgctggccttcagaagaattgaggatctgatggaggttttttatgtatttattttctgttcaccttgtgaccctgtgtcaaaatttataaagatacaaaaggcattactgaaatggtactttctgtaatttgatactatttggcttaatcatcttcacttgactatttgtaatactgttgtaatgttaactctgttaagtacccaagctgcttgtcttccaccaaagagtgctttattaacaagaatctgtgaaaatcacatttaaacactgttgcatgttgtaagaccaggtggtaccttagtaacctaaaacttgcaagagaatattaatggtagctttagaagactcaggaggagaaactgacttcagagttggaagatgttgcaagtcgttcctttttctgtccttcagggactgaagaactgggaggctgcccattgtttggttgccagtcatacaaattaaaatcatatttccttccatgaatggaagaaacacactattggtttttccccttggaaacagcaatcccaaataatgtcggcttacaaaaaaaaaaagttaccacttttttagagtccttccctgtaacattggattttttttttcccttatgagatccacctaaggccattgacgtggcctgcgatctcagtgacaatgatctgcttctggatctcactgttgcctttggttagggaacacaactagtaactctgcagagtgccttctcccgcagccctactggaacacagcagagtctgtgccatgaagcagttacagaaacagaattgatgtgctgctaaaaaaaaaaaaaaaatggggcccgaaataaaagaatatatagtactcacctcagttccttccataagaagtgggtggtttaatgattgttaagccatttttgcctgtgccgggagcatggagggctgagatgtcgacaggcagtgggaaacaaatgccctcctaagccacaaggcgtgcgccagattagtaggcaactccattttaagaagctgcctttttcacaaaactggaagaaataaaagcggttggaataaacaagttaaaagtctttaatgcaaaaagtaattgaaaggcagtgcctccattttggtgtactttcttggaagaaagtataaaattgaccggcatcatgagagacggaagatgccgtgttctcagccaaacaagcaactctttccccgccaggcactgtcgggtggggtcaggccagcttttaaacactggggactggatcacagaaaaacagtggttttctgtccctggaaatgaataggcacaaagacccacttggctgtgggcagactactcttcaataagatttgggtgggaggaggaacattccttttgctattttgagctgagacaatataaatattcaaactgtgccatgcataaagcattgaattctcagggcacctcttcttccccttaccccttttaaggccatcccctccattaataataatccaggtagttgtgaaaatcgtgcttctatctgatcccttcttagtttggcttttcatcccatcagaacaagtaaacgtaggcgccacagctcttgtgagtactgtctccctcacggtgaatgagcctcctggtgtttcgtccaagaaaagaaagggtgtcactggaaccacagccctttttcattttataaactgcctcttcatgttgcctgctcaagtttccacctagaattgctatcactgtggctctttctaaaaatctttctatttaactggttcactgaaattagtcatagaaaacttgtgatttggtgaagaggcattccttgtaataaccaaatgacttgggatggtgtgcatagcaagggcagtgttacacttatgaggactgtctctagcatccaggaagtctctgggtctgagggatggaaagttcttcctgctatgaatgagagtggactcttcccctcacccccaactgaaaccacaaacaaccagaatcttctggaattctgacttagagtcgttgttatagaagaccttgttgctatggaacatgaaactgtgtgtcagatggagagatccccttaacctaagagccttaaatagccctgaaagtacactgggacggtttgcgatggaattaaaattggaagtgaatatttttaggtgctcttgaagctttctggggactcaaaattatcaaaagtcagggacagtccggaggaagagcgtctgcaaaactgggttcctagaagtatagacggacttagctttttgtagaatttggtgaggagcagcgcctcgtgagagcagaatggcctggcgtggccagtgcttcccggcagcacgcagctctgcggcctccagaattcccctgttctgagcttgatgcccctagcctgtcccctacctacttcctcccctcctctctagccctctcacaggggtgattgctacctctctgttttcttgggcctaggcaagttttagaggagttcccaagcattgttatgaggccagtgtgctcgctgggctgggcgggatggcctgggcttgtgtgtggcctgagggctctcctggggccttctcttttcccagtcacctttggagccacagaagcagtgcactcattggatgtctgttcttaacacagcttctctttctacattaaaaaaaatcattattgcattttggaaagcagtgctcatcaaaagcaacttttaaaacctattttattgttcctttaaatgttctctcccgctgaaactgccctggagaggctatctgctgctcttccatttacccacatcaggttattctccatgtcactcagtggagatgactccagatgtgtttaaagactggacaattcacctatactgtgtaggaaattacctccttaattacctggtagaattgtcagcagacatgttcatccgatgatagtactgcagttttctattaataatttgcagacttttatctaacctgcactcatgtacagattattaaaagttttaaaatgtaactgatcagtattgatcaatcattgtcttgatttttttttacagcgtatatttctaatcatattttttaaagccaagagaactggttgaatgaatgtttattttcctgaaggtatttttaagataaagcttcctaatggcgtgtaaactttgcatatgtatgtagtttgatacatattgtcacatttgaaaatcttgtgggttgtaactggttttatacaaaatatcgaatagtggaaattgtataattacaatcatgtaattaaaagtattaacccaa

SEQ ID NO: 371914 - DNA, 4686 bp, Homo sapiens
cgccttccagatgctttggagtcatgagccgggagggcgcgggggcagctttggtagccgaggtgatcaaagatcgcctttgttttgccattctctacagcagaccaaagagtgcatcaaatgtacattatttcagcatagataatgaacttgaatatgagaacttctacgcagattttggaccactcaatctggcaatggtttacagatattgttgcaagatcaataagaaattaaagtccattacaatgttaaggaagaaaattgttcattttactggctctgatcagagaaaacaagcaaatgctgccttccttgttggatgctacatggttatatatttggggagaaccccagaagaagcatatagaatattaatctttggagagacatcctatattcctttcagagatgctgcctatggaagttgcaatttctacattacacttcttgactgttttcatgcagtaaagaaggcaatgcagtatggcttccttaatttcaactcatttaaccttgatgaatatgaacactatgaaaaagcagaaaatggagatttaaattggataataccagaccgatttattgccttctgtggacctcattcaagagccagacttgaaagtggttaccaccaacattctcctgagacttatattcaatattttaagaatcacaatgttactaccattattcgtctgaataaaaggatgtatgatgcccaaacttctctctggcgttgatgacatttccataaatggggtcgagaatcaagatcagcaagaacccgaaccgtacagtgatgatgacgaaatcaatggagtgacacaaggtgatagacttcgggccttgaaaagcagaagacaatccaaaacaaacgctattcctctcacagtaattcttcaatccagtgttcagagctgtaaaacatctgaacctaacatttctggcagtgcaggcattactaaaagaaccaccagatctgcttcaaggaaaagcagtgttaaaagtctctccatttcaaggactaaaacagtcttgcgttaagtaaaaacctgtgaccagagctgaaggaagactctaggactgaaaactgcaacagaaattagcacaatttgaaaacaaaacaaaattgcaaaagccttagttgctttttccacctaagaagttgatcaatggagaaaatgtccactggagtttgaataatgaactttgagtttgggtgcaagcaaatgactcagagaagggtccagctctcaagctgaatgacaaacatgctgttgtaaatttagtctcaggtgtaaatacccaagccctctggtacccagggagctggctggtctgtggtgcatgtgtgtccctgtgatggcaatcattgtagttgctggccttcagaagaattgaggatctgatggaggttttttatgtatttattttctgttcaccttgtgaccctgtgtcaaaatttataaagatacaaaaggcattactgaaatggtactttctgtaatttgatactatttggcttaatcatcttcacttgactatttgtaatactgttgtaatgttaactctgttaagtacccaagctgcttgtcttccaccaaagagtgctttattaacaagaatctgtgaaaatcacatttaaacactgttgcatgttgtaagaccaggtggtaccttagtaacctaaaacttgcaagagaatattaatggtagctttagaagactcaggaggagaaactgacttcagagttggaagatgttgcaagtcgttcctttttctgtccttcagggactgaagaactgggaggctgcccattgtttggttgccagtcatacaaattaaaatcatatttccttccatgaatggaagaaacacactattggtttttccccttggaaacagcaatcccaaataatgtcggcttacaaaaaaaaaaagttaccacttttttagagtccttccctgtaacattggattttttttttcccttatgagatccacctaaggccattgacgtggcctgcgatctcagtgacaatgatctgcttctggatctcactgttgcctttggttagggaacacaactagtaactctgcagagtgccttctcccgcagccctactggaacacagcagagtctgtgccatgaagcagttacagaaacagaattgatgtgctgctaaaaaaaaaaaaaaaatggggcccgaaataaaagaatatatagtactcacctcagttccttccataagaagtgggtggtttaatgattgttaagccatttttgcctgtgccgggagcatggagggctgagatgtcgacaggcagtgggaaacaaatgccctcctaagccacaaggcgtgcgccagattagtaggcaactccattttaagaagctgcctttttcacaaaactggaagaaataaaagcggttggaataaacaagttaaaagtctttaatgcaaaaagtaattgaaaggcagtgcctccattttggtgtactttcttggaagaaagtataaaattgaccggcatcatgagagacggaagatgccgtgttctcagccaaacaagcaactctttccccgccaggcactgtcgggtggggtcaggccagcttttaaacactggggactggatcacagaaaaacagtggttttctgtccctggaaatgaataggcacaaagacccacttggctgtgggcagactactcttcaataagatttgggtgggaggaggaacattccttttgctattttgagctgagacaatataaatattcaaactgtgccatgcataaagcattgaattctcagggcacctcttcttccccttaccccttttaaggccatcccctccattaataataatccaggtagttgtgaaaatcgtgcttctatctgatcccttcttagtttggcttttcatcccatcagaacaagtaaacgtaggcgccacagctcttgtgagtactgtctccctcacggtgaatgagcctcctggtgtttcgtccaagaaaagaaagggtgtcactggaaccacagccctttttcattttataaactgcctcttcatgttgcctgctcaagtttccacctagaattgctatcactgtggctctttctaaaaatctttctatttaactggttcactgaaattagtcatagaaaacttgtgatttggtgaagaggcattccttgtaataaccaaatgacttgggatggtgtgcatagcaagggcagtgttacacttatgaggactgtctctagcatccaggaagtctctgggtctgagggatggaaagttcttcctgctatgaatgagagtggactcttcccctcacccccaactgaaaccacaaacaaccagaatcttctggaattctgacttagagtcgttgttatagaagaccttgttgctatggaacatgaaactgtgtgtcagatggagagatccccttaacctaagagccttaaatagccctgaaagtacactgggacggtttgcgatggaattaaaattggaagtgaatatttttaggtgctcttgaagctttctggggactcaaaattatcaaaagtcagggacagtccggaggaagagcgtctgcaaaactgggttcctagaagtatagacggacttagctttttgtagaatttggtgaggagcagcgcctcgtgagagcagaatggcctggcgtggccagtgcttcccggcagcacgcagctctgcggcctccagaattcccctgttctgagcttgatgcccctagcctgtcccctacctacttcctcccctcctctctagccctctcacaggggtgattgctacctctctgttttcttgggcctaggcaagttttagaggagttcccaagcattgttatgaggccagtgtgctcgctgggctgggcgggatggcctgggcttgtgtgtggcctgagggctctcctggggccttctcttttcccagtcacctttggagccacagaagcagtgcactcattggatgtctgttcttaacacagcttctctttctacattaaaaaaaatcattattgcattttggaaagcagtgctcatcaaaagcaacttttaaaacctattttattgttcctttaaatgttctctcccgctgaaactgccctggagaggctatctgctgctcttccatttacccacatcaggttattctccatgtcactcagtggagatgactccagatgtgtttaaagactggacaattcacctatactgtgtaggaaattacctccttaattacctggtagaattgtcagcagacatgttcatccgatgatagtactgcagttttctattaataatttgcagacttttatctaacctgcactcatgtacagattattaaaagttttaaaatgtaactgatcagtattgatcaatcattgtcttgatttttttttacagcgtatatttctaatcatattttttaaagccaagagaactggttgaatgaatgtttattttcctgaaggtatttttaagataaagcttcctaatggcgtgtaaactttgcatatgtatgtagtttgatacatattgtcacatttgaaaatcttgtgggttgtaactggttttatacaaaatatcgaatagtggaaattgtataattacaatcatgtaattaaaagtattaacccaa

SEQ ID NO: 371915 - DNA, 1879 bp, Homo sapiens
ctcccccgggacggggttaattgaaatgcggttccctttgagtcccccgcgttgtaaaaaaccccgtgttaggaccctcccgcgaaactccctcctggggattttttccacaaaccctctccgtgtccccccccggcgcgttttttatttggtgggagatccccccccccttgttccctgggcccccggttctccctcttgggaacccccgtttgggcccctttctcaccttccctctccggggcccccgcgcgcccccccgccgatgtggttttaggaaagtcttttcgcgaggggccgcgcgggcgcgcgccgcccaccgttttctttttttttttttttttttttttttttgtttttttcaggagcgaataccaacctttatttgcacttgggttccagttcaaagccaccttagacagtgtggcaaagtgggaaaaagcacagatcctgggaccaaggttcagattccatctcaagcgagcatatgaactgtgtgacaacaggcagacagtacctctgtgtctatgagaaagcggggagagcaacaccccagcttctagcagctctacagctgcctggacctgcaggccctcctaggcccacttcctccccagcacagtgtgtgttcccgggcgtgtgtggctctgggtccagctctgttcagggtgggactccaggtgaattactgaacctctgaggtgtacccccaaccccaaactttcaccaaaagcaataaagaggaactctagaactggagccaggactaagtgagaaaaactgcttataagtgcttaataaatactagttatttacaacttttgctcaagccgagggcagaggcctttgtacgcagctgccgaactctgactctagttctgcggaagaaaaggatgcggtatttgcttttgccatgatccctttccatttgattggcaggttaaataacatggtttttgaagtcacatacttaatattcttcctaaaaaccacccaaacactagatgtgtgtgtgcacacacacagaaaccacgaggtagtttaaatcaccattaaaaatcaacgctttctctgattctgtgtcacagagtggtggccagtggctacacaatagcgatttttaaatgattggttaagtgaaaaccagaactcaaaatattccaggagagaagataacatttacaagtaaacagtaagtgcaattgtattttaatttcttggtctccgaaaactcagctgtgactgctttccattaacagttccagctctatgtgtttcctctaacgctaaaggcacagcccccgggaatctactgcttcctaagagtctccatggagtctattttacaacctcctttccctccatgcttccgcggaggagtctatactatctctatatacacattttaaacattattcttcatttgaaattccttcaataaaaacacagtcaccattcttcatcttcttgggaaatggcctgctctcgagcctctggagaagcccctctaacagctcagcccaaaaaagtgcaacaaatttacatgacacgggaaaagcaacatctattgttcttagagtctgactcccttggcccagctggaaaagtctccccacaggtgtgcagtgcagctccgcggtgctgggaaacagggctctttcaagacagcgcagggaaatcttccgggtcatctgggttgggggcaacatcttgcatcaccacttctgctctgggtccatagttctctgccctcctgatccttccccggcctccccgggtgcctcctctggctccacgcccaggacgagggaggttaccaaaattaatctccagctgggatgtgatgtcattggcgggtttccggaaaacatgggaatcg

SEQ ID NO: 371916 - DNA, 817 bp, Homo sapiens
  misc_feature (103)..(103): n is a, c, g, or t
  misc_feature (106)..(106): n is a, c, g, or t
gggaccccagatggggaagggggggggggggccccccgacacgaaaaaaagagggagagagaggttaggggaggggaaaagagagaatgtggtaaagggaagnaanactaaagaatttaatattttttttgtaagtgcaattgtattttaatttcttggtctccgaaaactcagctgtgactgctttccattaacagttccagctctatgtgtttcctctaacgctaaaggcacagcccccgggaatctactgcttcctaagagtctccatggagtctattttacaacctcctttccctccatgcttccgcggaggagtctatactatctctatatacacattttaaacattattcttcatttgaaattccttcaataaaaacacagtcaccattcttcatcttcttgggaaatggcctgctctcgagcctctggagaagcccctctaacagctcagcccaaaaaagtgcaacaaatttacatgacacgggaaaagcaacatctattgttcttagagtctgactcccttggcccagctggaaaagtctccccacaggtgtgcagtgcagctccgcggtgctgggaaacagggctctttcaagacagcgcagggaaatcttccgggtcatctgggttgggggcaacatcttgcatcaccacttctgctctgggtccatagttctctgccctcctgatccttccccggcctccccgggtgcctcctctggctccacgcccaggacgagggaggttaccaaaattaatctccagctgggatgtgatgtcattggcgggtttccggaaaacatgggaatcg

SEQ ID NO: 371917 - DNA, 1634 bp, Homo sapiens
cacggaacagccctcctggggtccccacgagccgcgtcctgctgtgccccggcgcctacgcagcagcggccgcggccgcggtgggcacgcacggttaccccgggcagctccggccgccagctgcagccccgtcgcctcggccgcgccagccggctgcgggcacctgggggcgggctgggggcgccggccgcggcaggaggcgctgtagcgagggctgcggcgccggtcctgcggcggccgcgggaggcagcggggcaggcgctgtgggccgggctcctcctccggctcctgcgcgaccgcctcccgccgggctctgccggcgcccgccgtccccgcagcgccgctctgcgcccgccgccccgagcgcccgcgcggggctggcgggagcctcggcgggcgcgcgggcgcgcggggccatggtcgtggccccctgacgggccgcggccgcctccatgaagcggaaaagcgagcggcggtcgagctgggccgccgcgcccccctgctcgcggcgctgctcgtcgacctcgccgggtgtgaagaagatccgcagctccacgcagcaagacccgcgccgccgggacccccaggacgacgtgtacctggacatcaccgatcgcctttgttttgccattctctacagcagaccaaagagtgcatcaaatgtacattatttcagcatagataatgaacttgaatatgagaacttctacgcagattttggaccactcaatctggcaatggtttacagatattgttgcaagatcaataagaaattaaagtccattacaatgttaaggaagaaaattgttcattttactggctctgatcagagaaaacaagcaaatgctgccttccttgttggatgctacatggtaagtatttgttttcctaatgtattcataaaaatgcacacaacagtggttctttacatttgcagttggaattttgaaatcaagataatgtcttgatttctcttcagaaagaacgtgttttgcttttaaaaaattgaccaattcaaggaagctgtgcttatgtggaagtagcaggtagatgagagatctcctgtaccttccacttaattttgctgtgaacctaaaactgctcgggaaaaaagcctatatttttttaaaaagtgcccaactactttggcaaaggtttatgttttatggcactaaaggttggaaaatagtgctccaaagctatttctattcactcgtgatccatttagtgagttgtaaaatcatcttactggggtcaggaccccactattaattttctaaaaatttttttaaaaagtgctttctaaaatttgaatctaggcatttttcccctaattaaggtcatctcctttctcatcaaaacatctagcaggaggccacgggatgtcagtgttgtcagaagatgggttacataccacacggattacatacatatgccatcaagtgctccatttggatcattggaaatgtgctttggaatagcagtatttacataagagttgtgaatttcatttatttgtaaatatgatggaaaagatttattttttgaagagtcacattttgtttggcacccagtggatttgtctgcaggggccctgaaagctgcaatttttccagagccagcttagagctcct

SEQ ID NO: 371918 - DNA, 685 bp, Homo sapiens
cagaagcagcccatgctttaagcatgtgtccattcatgtcccctcccctcttctctaattgtatgttcattctcatcccagaatgtgcctttttatgggaagatatatggtatttgtgggtatcaatgttaatcttttcaaaggtcttgctaataatatgaatggttatgggatttggaattgatcttcatcacaaaatgaaattgtggaagacttgaaattaaaaagaaaatgctaacagttatttatttttatgcagtccattacaatgttaaggaagaaaattgttcattttactggctctgatcagagaaaacaagcaaatgctgccttccttgttggatgctacatggtaagtatttgttttcctaatgtattcataaaaatgcacacaacagtggttctttacatttgcagttggaattttgaaatcaagataatgtcttgatttctcttcagaaagaacgtgttttgcttttaaaaaattgaccaattcaaggaagctgtgcttatgtggaagtagcaggtagatgagagatctcctgtaccttccacttaattttgctgtgaacctaaaactgctcgggaaaaaagcctatatttttttaaaaagtgcccaactactttggcaaaggtttatgttttatggcactaaaggttggaaaatagtgctccaaagctattt

SEQ ID NO: 371919 - DNA, 634 bp, Homo sapiens
aaacacagcatttttttattcaacataaaatggcaaaactccatccttgttgaccacccctttgtatccctgttgctgttggctgggcttttagggtgtctaaaattcacatatggcttgattgattgatgattgcgtaatttattttggcttcccaatttgaacatctgttctttccccttcacccctttccagatgtcccctagctgtgctgacctctgcactgtgtagtgttgtcatctggtggattgtttgtgactacattcttcccatcctgctattctgtctcgatggtttcagaacacagtagccatcaggaccccctgacagatagctgctgtaagtgtcccgttctgtttctctgccgttgcttacttctggtgcctagtgtggttcccacaatgcatgtttttctccttgtcagctcctagctttgttggtttgcctattttcaaaggttctttttctgaatcttttcaattaatgggatggtggtggggagggaaggtgggcttcactgttcctctcatagaaaggatattgaaagtaacatacgttgttttaaagttatgcttatccttaacatatttcaaaatagcagttgataaagacactgaaacagtttttcttcact

SEQ ID NO: 371920 - DNA, 941 bp, Homo sapiens
cacggaacagccctcctggggtccccacgagccgcgtcctgctgtgccccggcgcctacgcagcagcggccgcggccgcggtgggcacgcacggttaccccgggcagctccggccgccagctgcagccccgtcgcctcggccgcgccagccggctgcgggcacctgggggcgggctgggggcgccggccgcggcaggaggcgctgtagcgagggctgcggcgccggtcctgcggcggccgcgggaggcagcggggcaggcgctgtgggccgggctcctcctccggctcctgcgcgaccgcctcccgccgggctctgccggcgcccgccgtccccgcagcgccgctctgcgcccgccgccccgagcgcccgcgcggggctggcgggagcctcggcgggcgcgcgggcgcgcggggccatggtcgtggccccctgacgggccgcggccgcctccatgaagcggaaaagcgagcggcggtcgagctgggccgccgcgcccccctgctcgcggcgctgctcgtcgacctcgccgggtgtgaagaagatccgcagctccacgcagcaagacccgcgccgccgggacccccaggacgacgtgtacctggacatcaccgcgatggttggctgtcccaggctgtcacctttctagaccggcttctgatctggctcgggatccacaaggactagacctgcggggaaggtctctcctggacacgcccgttgcccactgcaagttctctccaggtgcaattgaagcctctcagcaggtgcgtctgcctcattcttccactgggtattgagccatcagcccagggccttcctttaggtgggcctcggcctgactgggttgggaatggccgggctgacacccaccctgggatggtaggaggcccattccaggcgcagcagggcagtgctgctgacactttcttaggctaggagc

SEQ ID NO: 371921 - DNA, 5588 bp, Homo sapiens
cacggaacagccctcctggggtccccacgagccgcgtcctgctgtgccccggcgcctacgcagcagcggccgcggccgcggtgggcacgcacggttaccccgggcagctccggccgccagctgcagccccgtcgcctcggccgcgccagccggctgcgggcacctgggggcgggctgggggcgccggccgcggcaggaggcgctgtagcgagggctgcggcgccggtcctgcggcggccgcgggaggcagcggggcaggcgctgtgggccgggctcctcctccggctcctgcgcgaccgcctcccgccgggctctgccggcgcccgccgtccccgcagcgccgctctgcgcccgccgccccgagcgcccgcgcggggctggcgggagcctcggcgggcgcgcgggcgcgcggggccatggtcgtggccccctgacgggccgcggccgcctccatgaagcggaaaagcgagcggcggtcgagctgggccgccgcgcccccctgctcgcggcgctgctcgtcgacctcgccgggtgtgaagaagatccgcagctccacgcagcaagacccgcgccgccgggacccccaggacgacgtgtacctggacatcaccgatcgcctttgttttgccattctctacagcagaccaaagagtgcatcaaatgtacattatttcagcatagataatgaacttgaatatgagaacttctacgcagattttggaccactcaatctggcaatggtttacagatattgttgcaagatcaataagaaattaaagtccattacaatgttaaggaagaaaattgttcattttactggctctgatcagagaaaacaagcaaatgctgccttccttgttggatgctacatggttatatatttggggagaaccccagaagaagcatatagaatattaatctttggagagacatcctatattcctttcagagatgctgcctatggaagttgcaatttctacattacacttcttgactgttttcatgcagtaaagaaggcaatgcagtatggcttccttaatttcaactcatttaaccttgatgaatatgaacactatgaaaaagcagaaaatggagatttaaattggataataccagaccgatttattgccttctgtggacctcattcaagagccagacttgaaagtggttaccaccaacattctcctgagacttatattcaatattttaagaatcacaatgttactaccattattcgtctgaataaaaggatgtatgatgccaaacgctttacggatgctggcttcgatcaccatgatcttttctttgcggatggcagcacccctactgatgccattgtcaaagaattcctagatatctgtgaaaatgctgagggtgccattgcagtacattgcaaagctggccttggtcgcacgggcactctgatagcctgctacatcatgaagcattacaggatgacagcagccgagaccattgcgtgggtcaggatctgcagacctggctcggtgattgggcctcagcagcagtttttggtgatgaagcaaaccaacctctggctggaaggggactattttcgtcagaagttaaaggggcaggagaatggacaacacagagcagccttctccaaacttctctctggcgttgatgacatttccataaatggggtcgagaatcaagatcagcaagaacccgaaccgtacagtgatgatgacgaaatcaatggagtgacacaaggtgatagacttcgggccttgaaaagcagaagacaatccaaaacaaacgctattcctctcacagtaattcttcaatccagtgttcagagctgtaaaacatctgaacctaacatttctggcagtgcaggcattactaaaagaaccaccagatctgcttcaaggaaaagcagtgttaaaagtctctccatttcaaggactaaaacagtcttgcgttaagtaaaaacctgtgaccagagctgaaggaagactctaggactgaaaactgcaacagaaattagcacaatttgaaaacaaaacaaaattgcaaaagccttagttgctttttccacctaagaagttgatcaatggagaaaatgtccactggagtttgaataatgaactttgagtttgggtgcaagcaaatgactcagagaagggtccagctctcaagctgaatgacaaacatgctgttgtaaatttagtctcaggtgtaaatacccaagccctctggtacccagggagctggctggtctgtggtgcatgtgtgtccctgtgatggcaatcattgtagttgctggccttcagaagaattgaggatctgatggaggttttttatgtatttattttctgttcaccttgtgaccctgtgtcaaaatttataaagatacaaaaggcattactgaaatggtactttctgtaatttgatactatttggcttaatcatcttcacttgactatttgtaatactgttgtaatgttaactctgttaagtacccaagctgcttgtcttccaccaaagagtgctttattaacaagaatctgtgaaaatcacatttaaacactgttgcatgttgtaagaccaggtggtaccttagtaacctaaaacttgcaagagaatattaatggtagctttagaagactcaggaggagaaactgacttcagagttggaagatgttgcaagtcgttcctttttctgtccttcagggactgaagaactgggaggctgcccattgtttggttgccagtcatacaaattaaaatcatatttccttccatgaatggaagaaacacactattggtttttccccttggaaacagcaatcccaaataatgtcggcttacaaaaaaaaaaagttaccacttttttagagtccttccctgtaacattggattttttttttcccttatgagatccacctaaggccattgacgtggcctgcgatctcagtgacaatgatctgcttctggatctcactgttgcctttggttagggaacacaactagtaactctgcagagtgccttctcccgcagccctactggaacacagcagagtctgtgccatgaagcagttacagaaacagaattgatgtgctgctaaaaaaaaaaaaaaaatggggcccgaaataaaagaatatatagtactcacctcagttccttccataagaagtgggtggtttaatgattgttaagccatttttgcctgtgccgggagcatggagggctgagatgtcgacaggcagtgggaaacaaatgccctcctaagccacaaggcgtgcgccagattagtaggcaactccattttaagaagctgcctttttcacaaaactggaagaaataaaagcggttggaataaacaagttaaaagtctttaatgcaaaaagtaattgaaaggcagtgcctccattttggtgtactttcttggaagaaagtataaaattgaccggcatcatgagagacggaagatgccgtgttctcagccaaacaagcaactctttccccgccaggcactgtcgggtggggtcaggccagcttttaaacactggggactggatcacagaaaaacagtggttttctgtccctggaaatgaataggcacaaagacccacttggctgtgggcagactactcttcaataagatttgggtgggaggaggaacattccttttgctattttgagctgagacaatataaatattcaaactgtgccatgcataaagcattgaattctcagggcacctcttcttccccttaccccttttaaggccatcccctccattaataataatccaggtagttgtgaaaatcgtgcttctatctgatcccttcttagtttggcttttcatcccatcagaacaagtaaacgtaggcgccacagctcttgtgagtactgtctccctcacggtgaatgagcctcctggtgtttcgtccaagaaaagaaagggtgtcactggaaccacagccctttttcattttataaactgcctcttcatgttgcctgctcaagtttccacctagaattgctatcactgtggctctttctaaaaatctttctatttaactggttcactgaaattagtcatagaaaacttgtgatttggtgaagaggcattccttgtaataaccaaatgacttgggatggtgtgcatagcaagggcagtgttacacttatgaggactgtctctagcatccaggaagtctctgggtctgagggatggaaagttcttcctgctatgaatgagagtggactcttcccctcacccccaactgaaaccacaaacaaccagaatcttctggaattctgacttagagtcgttgttatagaagaccttgttgctatggaacatgaaactgtgtgtcagatggagagatccccttaacctaagagccttaaatagccctgaaagtacactgggacggtttgcgatggaattaaaattggaagtgaatatttttaggtgctcttgaagctttctggggactcaaaattatcaaaagtcagggacagtccggaggaagagcgtctgcaaaactgggttcctagaagtatagacggacttagctttttgtagaatttggtgaggagcagcgcctcgtgagagcagaatggcctggcgtggccagtgcttcccggcagcacgcagctctgcggcctccagaattcccctgttctgagcttgatgcccctagcctgtcccctacctacttcctcccctcctctctagccctctcacaggggtgattgctacctctctgttttcttgggcctaggcaagttttagaggagttcccaagcattgttatgaggccagtgtgctcgctgggctgggcgggatggcctgggcttgtgtgtggcctgagggctctcctggggccttctcttttcccagtcacctttggagccacagaagcagtgcactcattggatgtctgttcttaacacagcttctctttctacattaaaaaaaatcattattgcattttggaaagcagtgctcatcaaaagcaacttttaaaacctattttattgttcctttaaatgttctctcccgctgaaactgccctggagaggctatctgctgctcttccatttacccacatcaggttattctccatgtcactcagtggagatgactccagatgtgtttaaagactggacaattcacctatactgtgtaggaaattacctccttaattacctggtagaattgtcagcagacatgttcatccgatgatagtactgcagttttctattaataatttgcagacttttatctaacctgcactcatgtacagattattaaaagttttaaaatgtaactgatcagtattgatcaatcattgtcttgatttttttttacagcgtatatttctaatcatattttttaaagccaagagaactggttgaatgaatgtttattttcctgaaggtatttttaagataaagcttcctaatggcgtgtaaactttgcatatgtatgtagtttgatacatattgtcacatttgaaaatcttgtgggttgtaactggttttatacaaaatatcgaatagtggaaattgtataattacaatcatgtaattaaaagtattaacccaa

SEQ ID NO: 371922 - DNA, 5552 bp, Homo sapiens
cacggaacagccctcctggggtccccacgagccgcgtcctgctgtgccccggcgcctacgcagcagcggccgcggccgcggtgggcacgcacggttaccccgggcagctccggccgccagctgcagccccgtcgcctcggccgcgccagccggctgcgggcacctgggggcgggctgggggcgccggccgcggcaggaggcgctgtagcgagggctgcggcgccggtcctgcggcggccgcgggaggcagcggggcaggcgctgtgggccgggctcctcctccggctcctgcgcgaccgcctcccgccgggctctgccggcgcccgccgtccccgcagcgccgctctgcgcccgccgccccgagcgcccgcgcggggctggcgggagcctcggcgggcgcgcgggcgcgcggggccatggtcgtggccccctgacgggccgcggccgcctccatgaagcggaaaagcgagcggcggtcgagctgggccgccgcgcccccctgctcgcggcgctgctcgtcgacctcgccgggtgtgaagaagatccgcagctccacgcagcaagacccgcgccgccgggacccccaggacgacgtgtacctggacatcaccgatcgcctttgttttgccattctctacagcagaccaaagagtgcatcaaatgtacattatttcagcatagataatgaacttgaatatgagaacttctacgcagattttggaccactcaatctggcaatggtttacagatattgttgcaagatcaataagaaattaaagtccattacaatgttaaggaagaaaattgttcattttactggctctgatcagagaaaacaagcaaatgctgccttccttgttggatgctacatggttatatatttggggagaaccccagaagaagcatatagaatattaatctttggagagacatcctatattcctttcagagatgctgcctatggaagttgcaatttctacattacacttcttgactgttttcatgcagtaaagaaggcaatgcagtatggcttccttaatttcaactcatttaaccttgatgaatatgaacactatgaaaaagcagaaaatggagatttaaattggataataccagaccgatttattgccttctgtggacctcattcaagagccagacttgaaagtggttaccaccaacattctcctgagacttatattcaatattttaagaatcacaatgttactaccattattcgtctgaataaaaggatgtatgatgccaaacgctttacggatgctggcttcgatcaccatgatcttttctttgcggatggcagcacccctactgatgccattgtcaaagaattcctagatatctgtgaaaatgctgagggtgccattgcagtacattgcaaagctggccttggtcgcacgggcactctgatagcctgctacatcatgaagcattacaggatgacagcagccgagaccattgcgtgggtcaggatctgcagacctggctcggtgattgggcctcagcagcagtttttggtgatgaagcaaaccaacctctggctggaaggggactattttcgtcagaagttaaaggggcaggagaatggacaacacagagcagccttctccaaacttctctctggcgttgatgacatttccataaatggggtcgagaatcaagatcagcaagaacccgaaccgtacagtgatgatgacgaaatcaatggagtgacacaaggtgatagacttcgggccttgaaaagcagaagacaatccaaaacaaacgctattcctctcacagtaattcttcaatccagtgttcagagctgtaaaacatctgaacctaacatttctggcagtgcaggcattactaaaagaaccaccagatctgcttcaaggaaaagcagtgttaaaagtctctccatttcaaggactaaaacagtcttgcgttaagtaaaaacctgtgaccagagctgaaggaagactctaggactgaaaactgcaacagaaattagcacaatttgaaaacaaaacaaaattgcaaaagccttagttgctttttccacctaagaagttgatcaatggagaaaatgtccactggagtttgaataatgaactttgagtttgggtgcaagcaaatgactcagagaagggtccagctctcaagctgaatgacaaacatgctgttgtaaatttagtctcaggtgtaaatacccaagccctctggtacccagggagctggctggtctgtggtgcatgtgtgtccctgtgatggcaatcattgtagttgctggccttcagaagaattgaggatctgatggaggttttttatgtatttattttctgttcaccttgtgaccctgtgtcaaaatttataaagatacaaaaggcattactgaaatggtactttctgtaatttgatactatttggcttaatcatcttcacttgactatttgtaatactgttgtaatgttaactctgttaagtacccaagctgcttgtcttccaccaaagagtgctttattaacaagaatctgtgaaaatcacatttaaacactgttgcatgttgtaagaccaggtggtaccttagtaacctaaaacttgcaagagaatattaatggtagctttagaagactcaggaggagaaactgacttcagagttggaagatgttgcaagtcgttcctttttctgtccttcagggactgaagaactgggaggctgcccattgtttggttgccagtcatacaaattaaaatcatatttccttccatgaatggaagaaacacactattggtttttccccttggaaacagcaatcccaaataatgtcggcttacaaaaaaaaaaagttaccacttttttagagtccttccctgtaacattggattttttttttcccttatgagatccacctaaggccattgacgtggcctgcgatctcagtgacaatgatctgcttctggatctcactgttgcctttggttagggaacacaactagtaactctgcagagtgccttctcccgcagccctactggaacacagcagagtctgtgccatgaagcagttacagaaacagaattgatgtgctgctaaaaaaaaaaaaaaaatggggcccgaaataaaagaatatatagtactcacctcagttccttccataagaagtgggtggtttaatgattgttaagccatttttgcctgtgccgggagcatggagggctgagatgtcgacaggcagtgggaaacaaatgccctcctaagccacaaggcgtgcgccagattagtaggcaactccattttaagaagctgcctttttcacaaaactggaagaaataaaagcggttggaataaacaagttaaaagtctttaatgcaaaaagtaattgaaaggcagtgcctccattttggtgtactttcttggaagaaagtataaaattgaccggcatcatgagagacggaagatgccgtgttctcagccaaacaagcaactctttccccgccaggcactgtcgggtggggtcaggccagcttttaaacactggggactggatcacagaaaaacagtggttttctgtccctggaaatgaataggcacaaagacccacttggctgtgggcagactactcttcaataagatttgggtgggaggaggaacattccttttgctattttgagctgagacaatataaatattcaaactgtgccatgcataaagcattgaattctcagggcacctcttcttccccttaccccttttaaggccatcccctccattaataataatccaggtagttgtgaaaatcgtgcttctatctgatcccttcttagtttggcttttcatcccatcagaacaagtaaacgtaggcgccacagctcttgtgagtactgtctccctcacggtgaatgagcctcctggtgtttcgtccaagaaaagaaagggtgtcactggaaccacagccctttttcattttataaactgcctcttcatgttgcctgctcaagtttccacctagaattgctatcactgtggctctttctaaaaatctttctatttaactggttcactgaaattagtcatagaaaacttgtgatttggtgaagaggcattccttgtaataaccaaatgacttgggatggtgtgcatagcaagggcagtgttacacttatgaggactgtctctagcatccaggaagtctctgggtctgagggatggaaagttcttcctgctatgaatgagagtggactcttcccctcacccccaactgaaaccacaaacaaccagaatcttctggaattctgacttagagtcgttgttatagaagaccttgttgctatggaacatgaaactgtgtgtcagatggagagatccccttaacctaagagccttaaatagccctgaaagtacactgggacggtttgcgatggaattaaaattggaagtgaatatttttaggtgctcttgaagctttctggggactcaaaattatcaaaagtcagggacagtccggaggaagagcgtctgcaaaactgggttcctagaagtatagacggacttagctttttgtagaatttggtgaggagcagcgcctcgtgagagcagaatggcctggcgtggccagtgcttcccggcagcacgcagctctgcggcctccagaattcccctgttctgagcttgatgcccctagcctgtcccctacctacttcctcccctcctctctagccctctcacaggggtgattgctacctctctgttttcttgggcctaggcaagttttagaggagttcccaagcattgttatgaggccagtgtgctcgctgggctgggcgggatggcctgggcttgtgtgtggcctgagggctctcctggggccttctcttttcccagtcacctttggagccacagaagcagtgcactcattggatgtctgttcttaacacagcttctctttctacattaaaaaaaatcattattgcattttggaaagcagtgctcatcaaaagcaacttttaaaacctattttattgttcctttaaatgttctctcccgctgaaactgccctggagaggctatctgctgctcttccatttacccacatcaggttattctccatgtcactcagtggagatgactccagatgtgtttaaagactggacaattcacctatactgtgtaggaaattacctccttaattacctggtagaattgtcagcagacatgttcatccgatgatagtactgcagttttctattaataatttgcagacttttatctaacctgcatgatcagtattgatcaatcattgtcttgatttttttttacagcgtatatttctaatcatattttttaaagccaagagaactggttgaatgaatgtttattttcctgaaggtatttttaagataaagcttcctaatggcgtgtaaactttgcatatgtatgtagtttgatacatattgtcacatttgaaaatcttgtgggttgtaactggttttatacaaaatatcgaatagtggaaattgtataattacaatcatgtaattaaaagtattaacccaa

SEQ ID NO: 371923 - DNA, 5615 bp, Homo sapiens
cacggaacagccctcctggggtccccacgagccgcgtcctgctgtgccccggcgcctacgcagcagcggccgcggccgcggtgggcacgcacggttaccccgggcagctccggccgccagctgcagccccgtcgcctcggccgcgccagccggctgcgggcacctgggggcgggctgggggcgccggccgcggcaggaggcgctgtagcgagggctgcggcgccggtcctgcggcggccgcgggaggcagcggggcaggcgctgtgggccgggctcctcctccggctcctgcgcgaccgcctcccgccgggctctgccggcgcccgccgtccccgcagcgccgctctgcgcccgccgccccgagcgcccgcgcggggctggcgggagcctcggcgggcgcgcgggcgcgcggggccatggtcgtggccccctgacgggccgcggccgcctccatgaagcggaaaagcgagcggcggtcgagctgggccgccgcgcccccctgctcgcggcgctgctcgtcgacctcgccgggtgtgaagaagatccgcagctccacgcagcaagacccgcgccgccgggacccccaggacgacgtgtacctggacatcaccgatcgcctttgttttgccattctctacagcagaccaaagagtgcatcaaatgtacattatttcagcatagataatgaacttgaatatgagaacttctacgcagattttggaccactcaatctggcaatggtttacagatattgttgcaagatcaataagaaattaaagtccattacaatgttaaggaagaaaattgttcattttactggctctgatcagagaaaacaagcaaatgctgccttccttgttggatgctacatggttatatatttggggagaaccccagaagaagcatatagaatattaatctttggagagacatcctatattcctttcagagatgctgcctatggaagttgcaatttctacattacacttcttgactgttttcatgcagtaaagaaggcaatgcagtatggcttccttaatttcaactcatttaaccttgatgaatatgaacactatgaaaaagcagaaaatggagatttaaattggataataccagaccgatttattgccttctgtggacctcattcaagagccagacttgaaagtggttaccaccaacattctcctgagacttatattcaatattttaagaatcacaatgttactaccattattcgtctgaataaaaggatgtatgatgccaaacgctttacggatgctggcttcgatcaccatgatcttttctttgcggatggcagcacccctactgatgccattgtcaaagaattcctagatatctgtgaaaatgctgagggtgccattgcagtacattgcaaagctggccttggtcgcacgggcactctgatagcctgctacatcatgaagcattacaggatgacagcagccgagaccattgcgtgggtcaggatctgcagacctggctcggtgattgggcctcagcagcagtttttggtgatgaagcaaaccaacctctggctggaaggggactattttcgtcagaagttaaaggggcaggagaatggacaacacagagcagccttctccaaacttctctctggcgttgatgacatttccataaatggggtcgagaatcaagatcagcaagaacccgaaccgtacagtgatgatgacgaaatcaatggagtgacacaaggtgatagacttcgggccttgaaaagcagaagacaatccaaaacaaacgctattcctctcacatgtcccctagctgtgctgacctctgcactgtgtagtgttgtcatctggtggattgtttgtgactacattcttcccatcctgctattctgtctcgatggtttcagaacacagtagccatcaggaccccctgacagatagctgcttctctccatttcaaggactaaaacagtcttgcgttaagtaaaaacctgtgaccagagctgaaggaagactctaggactgaaaactgcaacagaaattagcacaatttgaaaacaaaacaaaattgcaaaagccttagttgctttttccacctaagaagttgatcaatggagaaaatgtccactggagtttgaataatgaactttgagtttgggtgcaagcaaatgactcagagaagggtccagctctcaagctgaatgacaaacatgctgttgtaaatttagtctcaggtgtaaatacccaagccctctggtacccagggagctggctggtctgtggtgcatgtgtgtccctgtgatggcaatcattgtagttgctggccttcagaagaattgaggatctgatggaggttttttatgtatttattttctgttcaccttgtgaccctgtgtcaaaatttataaagatacaaaaggcattactgaaatggtactttctgtaatttgatactatttggcttaatcatcttcacttgactatttgtaatactgttgtaatgttaactctgttaagtacccaagctgcttgtcttccaccaaagagtgctttattaacaagaatctgtgaaaatcacatttaaacactgttgcatgttgtaagaccaggtggtaccttagtaacctaaaacttgcaagagaatattaatggtagctttagaagactcaggaggagaaactgacttcagagttggaagatgttgcaagtcgttcctttttctgtccttcagggactgaagaactgggaggctgcccattgtttggttgccagtcatacaaattaaaatcatatttccttccatgaatggaagaaacacactattggtttttccccttggaaacagcaatcccaaataatgtcggcttacaaaaaaaaaaagttaccacttttttagagtccttccctgtaacattggattttttttttcccttatgagatccacctaaggccattgacgtggcctgcgatctcagtgacaatgatctgcttctggatctcactgttgcctttggttagggaacacaactagtaactctgcagagtgccttctcccgcagccctactggaacacagcagagtctgtgccatgaagcagttacagaaacagaattgatgtgctgctaaaaaaaaaaaaaaaatggggcccgaaataaaagaatatatagtactcacctcagttccttccataagaagtgggtggtttaatgattgttaagccatttttgcctgtgccgggagcatggagggctgagatgtcgacaggcagtgggaaacaaatgccctcctaagccacaaggcgtgcgccagattagtaggcaactccattttaagaagctgcctttttcacaaaactggaagaaataaaagcggttggaataaacaagttaaaagtctttaatgcaaaaagtaattgaaaggcagtgcctccattttggtgtactttcttggaagaaagtataaaattgaccggcatcatgagagacggaagatgccgtgttctcagccaaacaagcaactctttccccgccaggcactgtcgggtggggtcaggccagcttttaaacactggggactggatcacagaaaaacagtggttttctgtccctggaaatgaataggcacaaagacccacttggctgtgggcagactactcttcaataagatttgggtgggaggaggaacattccttttgctattttgagctgagacaatataaatattcaaactgtgccatgcataaagcattgaattctcagggcacctcttcttccccttaccccttttaaggccatcccctccattaataataatccaggtagttgtgaaaatcgtgcttctatctgatcccttcttagtttggcttttcatcccatcagaacaagtaaacgtaggcgccacagctcttgtgagtactgtctccctcacggtgaatgagcctcctggtgtttcgtccaagaaaagaaagggtgtcactggaaccacagccctttttcattttataaactgcctcttcatgttgcctgctcaagtttccacctagaattgctatcactgtggctctttctaaaaatctttctatttaactggttcactgaaattagtcatagaaaacttgtgatttggtgaagaggcattccttgtaataaccaaatgacttgggatggtgtgcatagcaagggcagtgttacacttatgaggactgtctctagcatccaggaagtctctgggtctgagggatggaaagttcttcctgctatgaatgagagtggactcttcccctcacccccaactgaaaccacaaacaaccagaatcttctggaattctgacttagagtcgttgttatagaagaccttgttgctatggaacatgaaactgtgtgtcagatggagagatccccttaacctaagagccttaaatagccctgaaagtacactgggacggtttgcgatggaattaaaattggaagtgaatatttttaggtgctcttgaagctttctggggactcaaaattatcaaaagtcagggacagtccggaggaagagcgtctgcaaaactgggttcctagaagtatagacggacttagctttttgtagaatttggtgaggagcagcgcctcgtgagagcagaatggcctggcgtggccagtgcttcccggcagcacgcagctctgcggcctccagaattcccctgttctgagcttgatgcccctagcctgtcccctacctacttcctcccctcctctctagccctctcacaggggtgattgctacctctctgttttcttgggcctaggcaagttttagaggagttcccaagcattgttatgaggccagtgtgctcgctgggctgggcgggatggcctgggcttgtgtgtggcctgagggctctcctggggccttctcttttcccagtcacctttggagccacagaagcagtgcactcattggatgtctgttcttaacacagcttctctttctacattaaaaaaaatcattattgcattttggaaagcagtgctcatcaaaagcaacttttaaaacctattttattgttcctttaaatgttctctcccgctgaaactgccctggagaggctatctgctgctcttccatttacccacatcaggttattctccatgtcactcagtggagatgactccagatgtgtttaaagactggacaattcacctatactgtgtaggaaattacctccttaattacctggtagaattgtcagcagacatgttcatccgatgatagtactgcagttttctattaataatttgcagacttttatctaacctgcactcatgtacagattattaaaagttttaaaatgtaactgatcagtattgatcaatcattgtcttgatttttttttacagcgtatatttctaatcatattttttaaagccaagagaactggttgaatgaatgtttattttcctgaaggtatttttaagataaagcttcctaatggcgtgtaaactttgcatatgtatgtagtttgatacatattgtcacatttgaaaatcttgtgggttgtaactggttttatacaaaatatcgaatagtggaaattgtataattacaatcatgtaattaaaagtattaacccaa

SEQ ID NO: 371924 - DNA, 5221 bp, Homo sapiens
cgccttccagatgctttggagtcatgagccgggagggcgcgggggcagctttggtagccgaggtgatcaaaggaaggaacattgcaatttttccatttcagatcgcctttgttttgccattctctacagcagaccaaagagtgcatcaaatgtacattatttcagcatagataatgaacttgaatatgagaacttctacgcagattttggaccactcaatctggcaatggtttacagatattgttgcaagatcaataagaaattaaagtccattacaatgttaaggaagaaaattgttcattttactggctctgatcagagaaaacaagcaaatgctgccttccttgttggatgctacatggttatatatttggggagaaccccagaagaagcatatagaatattaatctttggagagacatcctatattcctttcagagatgctgcctatggaagttgcaatttctacattacacttcttgactgttttcatgcagtaaagaaggcaatgcagtatggcttccttaatttcaactcatttaaccttgatgaatatgaacactatgaaaaagcagaaaatggagatttaaattggataataccagaccgatttattgccttctgtggacctcattcaagagccagacttgaaagtggttaccaccaacattctcctgagacttatattcaatattttaagaatcacaatgttactaccattattcgtctgaataaaaggatgtatgatgccaaacgctttacggatgctggcttcgatcaccatgatcttttctttgcggatggcagcacccctactgatgccattgtcaaagaattcctagatatctgtgaaaatgctgagggtgccattgcagtacattgcaaagctggccttggtcgcacgggcactctgatagcctgctacatcatgaagcattacaggatgacagcagccgagaccattgcgtgggtcaggatctgcagacctggctcggtgattgggcctcagcagcagtttttggtgatgaagcaaaccaacctctggctggaaggggactattttcgtcagaagttaaaggggcaggagaatggacaacacagagcagccttctccaaacttctctctggcgttgatgacatttccataaatggggtcgagaatcaagatcagcaagaacccgaaccgtacagtgatgatgacgaaatcaatggagtgacacaaggtgatagacttcgggccttgaaaagcagaagacaatccaaaacaaacgctattcctctcacatgtcccctagctgtgctgacctctgcactgtgtagtgttgtcatctggtggattgtttgtgactacattcttcccatcctgctattctgtctcgatggtttcagaacacagtagccatcaggaccccctgacagatagctgctagtaattcttcaatccagtgttcagagctgtaaaacatctgaacctaacatttctggcagtgcaggcattactaaaagaaccaccagatctgcttcaaggaaaagcagtgttaaaagtctctccatttcaaggactaaaacagtcttgcgttaagtaaaaacctgtgaccagagctgaaggaagactctaggactgaaaactgcaacagaaattagcacaatttgaaaacaaaacaaaattgcaaaagccttagttgctttttccacctaagaagttgatcaatggagaaaatgtccactggagtttgaataatgaactttgagtttgggtgcaagcaaatgactcagagaagggtccagctctcaagctgaatgacaaacatgctgttgtaaatttagtctcaggtgtaaatacccaagccctctggtacccagggagctggctggtctgtggtgcatgtgtgtccctgtgatggcaatcattgtagttgctggccttcagaagaattgaggatctgatggaggttttttatgtatttattttctgttcaccttgtgaccctgtgtcaaaatttataaagatacaaaaggcattactgaaatggtactttctgtaatttgatactatttggcttaatcatcttcacttgactatttgtaatactgttgtaatgttaactctgttaagtacccaagctgcttgtcttccaccaaagagtgctttattaacaagaatctgtgaaaatcacatttaaacactgttgcatgttgtaagaccaggtggtaccttagtaacctaaaacttgcaagagaatattaatggtagctttagaagactcaggaggagaaactgacttcagagttggaagatgttgcaagtcgttcctttttctgtccttcagggactgaagaactgggaggctgcccattgtttggttgccagtcatacaaattaaaatcatatttccttccatgaatggaagaaacacactattggtttttccccttggaaacagcaatcccaaataatgtcggcttacaaaaaaaaaaagttaccacttttttagagtccttccctgtaacattggattttttttttcccttatgagatccacctaaggccattgacgtggcctgcgatctcagtgacaatgatctgcttctggatctcactgttgcctttggttagggaacacaactagtaactctgcagagtgccttctcccgcagccctactggaacacagcagagtctgtgccatgaagcagttacagaaacagaattgatgtgctgctaaaaaaaaaaaaaaaatggggcccgaaataaaagaatatatagtactcacctcagttccttccataagaagtgggtggtttaatgattgttaagccatttttgcctgtgccgggagcatggagggctgagatgtcgacaggcagtgggaaacaaatgccctcctaagccacaaggcgtgcgccagattagtaggcaactccattttaagaagctgcctttttcacaaaactggaagaaataaaagcggttggaataaacaagttaaaagtctttaatgcaaaaagtaattgaaaggcagtgcctccattttggtgtactttcttggaagaaagtataaaattgaccggcatcatgagagacggaagatgccgtgttctcagccaaacaagcaactctttccccgccaggcactgtcgggtggggtcaggccagcttttaaacactggggactggatcacagaaaaacagtggttttctgtccctggaaatgaataggcacaaagacccacttggctgtgggcagactactcttcaataagatttgggtgggaggaggaacattccttttgctattttgagctgagacaatataaatattcaaactgtgccatgcataaagcattgaattctcagggcacctcttcttccccttaccccttttaaggccatcccctccattaataataatccaggtagttgtgaaaatcgtgcttctatctgatcccttcttagtttggcttttcatcccatcagaacaagtaaacgtaggcgccacagctcttgtgagtactgtctccctcacggtgaatgagcctcctggtgtttcgtccaagaaaagaaagggtgtcactggaaccacagccctttttcattttataaactgcctcttcatgttgcctgctcaagtttccacctagaattgctatcactgtggctctttctaaaaatctttctatttaactggttcactgaaattagtcatagaaaacttgtgatttggtgaagaggcattccttgtaataaccaaatgacttgggatggtgtgcatagcaagggcagtgttacacttatgaggactgtctctagcatccaggaagtctctgggtctgagggatggaaagttcttcctgctatgaatgagagtggactcttcccctcacccccaactgaaaccacaaacaaccagaatcttctggaattctgacttagagtcgttgttatagaagaccttgttgctatggaacatgaaactgtgtgtcagatggagagatccccttaacctaagagccttaaatagccctgaaagtacactgggacggtttgcgatggaattaaaattggaagtgaatatttttaggtgctcttgaagctttctggggactcaaaattatcaaaagtcagggacagtccggaggaagagcgtctgcaaaactgggttcctagaagtatagacggacttagctttttgtagaatttggtgaggagcagcgcctcgtgagagcagaatggcctggcgtggccagtgcttcccggcagcacgcagctctgcggcctccagaattcccctgttctgagcttgatgcccctagcctgtcccctacctacttcctcccctcctctctagccctctcacaggggtgattgctacctctctgttttcttgggcctaggcaagttttagaggagttcccaagcattgttatgaggccagtgtgctcgctgggctgggcgggatggcctgggcttgtgtgtggcctgagggctctcctggggccttctcttttcccagtcacctttggagccacagaagcagtgcactcattggatgtctgttcttaacacagcttctctttctacattaaaaaaaatcattattgcattttggaaagcagtgctcatcaaaagcaacttttaaaacctattttattgttcctttaaatgttctctcccgctgaaactgccctggagaggctatctgctgctcttccatttacccacatcaggttattctccatgtcactcagtggagatgactccagatgtgtttaaagactggacaattcacctatactgtgtaggaaattacctccttaattacctggtagaattgtcagcagacatgttcatccgatgatagtactgcagttttctattaataatttgcagacttttatctaacctgcactcatgtacagattattaaaagttttaaaatgtaactgatcagtattgatcaatcattgtcttgatttttttttacagcgtatatttctaatcatattttttaaagccaagagaactggttgaatgaatgtttattttcctgaaggtatttttaagataaagcttcctaatggcgtgtaaactttgcatatgtatgtagtttgatacatattgtcacatttgaaaatcttgtgggttgtaactggttttatacaaaatatcgaatagtggaaattgtataattacaatcatgtaattaaaagtattaacccaa

SEQ ID NO: 371925 - DNA, 5575 bp, Homo sapiens
ctttctaagttgcgggcgtcagcccggcgcctcgaacctgcagctcctccccgcgggctgcttctgagttcctgtggattccgccttcagggattgcgagcccggttggccctcgcgcgagtcacaacctctgaatcagcccctgaggattccccgagcgcgctgaacgcgcctggcacgggagctgcccctttttggcgttggccaaacccccgctgctccgtagccttgggaccctgggcgccgcgttgcccgtccggcgcgtaagcccgagcccctctcctgggcctcccgcgccctgccccctagcgcgccccccgaacgcctccgcctcccggggtccgctccccgccggggcctcgagaaggaaggtgtcacgttggtggcattcgagccagccggcaagacgaatgtccgggttgtcacttttgagaaatcccagccagccagagcagatcgcctttgttttgccattctctacagcagaccaaagagtgcatcaaatgtacattatttcagcatagataatgaacttgaatatgagaacttctacgcagattttggaccactcaatctggcaatggtttacagatattgttgcaagatcaataagaaattaaagtccattacaatgttaaggaagaaaattgttcattttactggctctgatcagagaaaacaagcaaatgctgccttccttgttggatgctacatggttatatatttggggagaaccccagaagaagcatatagaatattaatctttggagagacatcctatattcctttcagagatgctgcctatggaagttgcaatttctacattacacttcttgactgttttcatgcagtaaagaaggcaatgcagtatggcttccttaatttcaactcatttaaccttgatgaatatgaacactatgaaaaagcagaaaatggagatttaaattggataataccagaccgatttattgccttctgtggacctcattcaagagccagacttgaaagtggttaccaccaacattctcctgagacttatattcaatattttaagaatcacaatgttactaccattattcgtctgaataaaaggatgtatgatgccaaacgctttacggatgctggcttcgatcaccatgatcttttctttgcggatggcagcacccctactgatgccattgtcaaagaattcctagatatctgtgaaaatgctgagggtgccattgcagtacattgcaaagctggccttggtcgcacgggcactctgatagcctgctacatcatgaagcattacaggatgacagcagccgagaccattgcgtgggtcaggatctgcagacctggctcggtgattgggcctcagcagcagtttttggtgatgaagcaaaccaacctctggctggaaggggactattttcgtcagaagttaaaggggcaggagaatggacaacacagagcagccttctccaaacttctctctggcgttgatgacatttccataaatggggtcgagaatcaagatcagcaagaacccgaaccgtacagtgatgatgacgaaatcaatggagtgacacaaggtgatagacttcgggccttgaaaagcagaagacaatccaaaacaaacgctattcctctcacatgtcccctagctgtgctgacctctgcactgtgtagtgttgtcatctggtggattgtttgtgactacattcttcccatcctgctattctgtctcgatggtttcagaacacagtagccatcaggaccccctgacagatagctgctagtaattcttcaatccagtgttcagagctgtaaaacatctgaacctaacatttctggcagtgcaggcattactaaaagaaccaccagatctgcttcaaggaaaagcagtgttaaaagtctctccatttcaaggactaaaacagtcttgcgttaagtaaaaacctgtgaccagagctgaaggaagactctaggactgaaaactgcaacagaaattagcacaatttgaaaacaaaacaaaattgcaaaagccttagttgctttttccacctaagaagttgatcaatggagaaaatgtccactggagtttgaataatgaactttgagtttgggtgcaagcaaatgactcagagaagggtccagctctcaagctgaatgacaaacatgctgttgtaaatttagtctcaggtgtaaatacccaagccctctggtacccagggagctggctggtctgtggtgcatgtgtgtccctgtgatggcaatcattgtagttgctggccttcagaagaattgaggatctgatggaggttttttatgtatttattttctgttcaccttgtgaccctgtgtcaaaatttataaagatacaaaaggcattactgaaatggtactttctgtaatttgatactatttggcttaatcatcttcacttgactatttgtaatactgttgtaatgttaactctgttaagtacccaagctgcttgtcttccaccaaagagtgctttattaacaagaatctgtgaaaatcacatttaaacactgttgcatgttgtaagaccaggtggtaccttagtaacctaaaacttgcaagagaatattaatggtagctttagaagactcaggaggagaaactgacttcagagttggaagatgttgcaagtcgttcctttttctgtccttcagggactgaagaactgggaggctgcccattgtttggttgccagtcatacaaattaaaatcatatttccttccatgaatggaagaaacacactattggtttttccccttggaaacagcaatcccaaataatgtcggcttacaaaaaaaaaaagttaccacttttttagagtccttccctgtaacattggattttttttttcccttatgagatccacctaaggccattgacgtggcctgcgatctcagtgacaatgatctgcttctggatctcactgttgcctttggttagggaacacaactagtaactctgcagagtgccttctcccgcagccctactggaacacagcagagtctgtgccatgaagcagttacagaaacagaattgatgtgctgctaaaaaaaaaaaaaaaatggggcccgaaataaaagaatatatagtactcacctcagttccttccataagaagtgggtggtttaatgattgttaagccatttttgcctgtgccgggagcatggagggctgagatgtcgacaggcagtgggaaacaaatgccctcctaagccacaaggcgtgcgccagattagtaggcaactccattttaagaagctgcctttttcacaaaactggaagaaataaaagcggttggaataaacaagttaaaagtctttaatgcaaaaagtaattgaaaggcagtgcctccattttggtgtactttcttggaagaaagtataaaattgaccggcatcatgagagacggaagatgccgtgttctcagccaaacaagcaactctttccccgccaggcactgtcgggtggggtcaggccagcttttaaacactggggactggatcacagaaaaacagtggttttctgtccctggaaatgaataggcacaaagacccacttggctgtgggcagactactcttcaataagatttgggtgggaggaggaacattccttttgctattttgagctgagacaatataaatattcaaactgtgccatgcataaagcattgaattctcagggcacctcttcttccccttaccccttttaaggccatcccctccattaataataatccaggtagttgtgaaaatcgtgcttctatctgatcccttcttagtttggcttttcatcccatcagaacaagtaaacgtaggcgccacagctcttgtgagtactgtctccctcacggtgaatgagcctcctggtgtttcgtccaagaaaagaaagggtgtcactggaaccacagccctttttcattttataaactgcctcttcatgttgcctgctcaagtttccacctagaattgctatcactgtggctctttctaaaaatctttctatttaactggttcactgaaattagtcatagaaaacttgtgatttggtgaagaggcattccttgtaataaccaaatgacttgggatggtgtgcatagcaagggcagtgttacacttatgaggactgtctctagcatccaggaagtctctgggtctgagggatggaaagttcttcctgctatgaatgagagtggactcttcccctcacccccaactgaaaccacaaacaaccagaatcttctggaattctgacttagagtcgttgttatagaagaccttgttgctatggaacatgaaactgtgtgtcagatggagagatccccttaacctaagagccttaaatagccctgaaagtacactgggacggtttgcgatggaattaaaattggaagtgaatatttttaggtgctcttgaagctttctggggactcaaaattatcaaaagtcagggacagtccggaggaagagcgtctgcaaaactgggttcctagaagtatagacggacttagctttttgtagaatttggtgaggagcagcgcctcgtgagagcagaatggcctggcgtggccagtgcttcccggcagcacgcagctctgcggcctccagaattcccctgttctgagcttgatgcccctagcctgtcccctacctacttcctcccctcctctctagccctctcacaggggtgattgctacctctctgttttcttgggcctaggcaagttttagaggagttcccaagcattgttatgaggccagtgtgctcgctgggctgggcgggatggcctgggcttgtgtgtggcctgagggctctcctggggccttctcttttcccagtcacctttggagccacagaagcagtgcactcattggatgtctgttcttaacacagcttctctttctacattaaaaaaaatcattattgcattttggaaagcagtgctcatcaaaagcaacttttaaaacctattttattgttcctttaaatgttctctcccgctgaaactgccctggagaggctatctgctgctcttccatttacccacatcaggttattctccatgtcactcagtggagatgactccagatgtgtttaaagactggacaattcacctatactgtgtaggaaattacctccttaattacctggtagaattgtcagcagacatgttcatccgatgatagtactgcagttttctattaataatttgcagacttttatctaacctgcactcatgtacagattattaaaagttttaaaatgtaactgatcagtattgatcaatcattgtcttgatttttttttacagcgtatatttctaatcatattttttaaagccaagagaactggttgaatgaatgtttattttcctgaaggtatttttaagataaagcttcctaatggcgtgtaaactttgcatatgtatgtagtttgatacatattgtcacatttgaaaatcttgtgggttgtaactggttttatacaaaatatcgaatagtggaaattgtataattacaatcatgtaattaaaagtattaacccaa

SEQ ID NO: 371926 - DNA, 5677 bp, Homo sapiens
cacggaacagccctcctggggtccccacgagccgcgtcctgctgtgccccggcgcctacgcagcagcggccgcggccgcggtgggcacgcacggttaccccgggcagctccggccgccagctgcagccccgtcgcctcggccgcgccagccggctgcgggcacctgggggcgggctgggggcgccggccgcggcaggaggcgctgtagcgagggctgcggcgccggtcctgcggcggccgcgggaggcagcggggcaggcgctgtgggccgggctcctcctccggctcctgcgcgaccgcctcccgccgggctctgccggcgcccgccgtccccgcagcgccgctctgcgcccgccgccccgagcgcccgcgcggggctggcgggagcctcggcgggcgcgcgggcgcgcggggccatggtcgtggccccctgacgggccgcggccgcctccatgaagcggaaaagcgagcggcggtcgagctgggccgccgcgcccccctgctcgcggcgctgctcgtcgacctcgccgggtgtgaagaagatccgcagctccacgcagcaagacccgcgccgccgggacccccaggacgacgtgtacctggacatcaccgatcgcctttgttttgccattctctacagcagaccaaagagtgcatcaaatgtacattatttcagcatagataatgaacttgaatatgagaacttctacgcagattttggaccactcaatctggcaatggtttacagatattgttgcaagatcaataagaaattaaagtccattacaatgttaaggaagaaaattgttcattttactggctctgatcagagaaaacaagcaaatgctgccttccttgttggatgctacatggttatatatttggggagaaccccagaagaagcatatagaatattaatctttggagagacatcctatattcctttcagagatgctgcctatggaagttgcaatttctacattacacttcttgactgttttcatgcagtaaagaaggcaatgcagtatggcttccttaatttcaactcatttaaccttgatgaatatgaacactatgaaaaagcagaaaatggagatttaaattggataataccagaccgatttattgccttctgtggacctcattcaagagccagacttgaaagtggttaccaccaacattctcctgagacttatattcaatattttaagaatcacaatgttactaccattattcgtctgaataaaaggatgtatgatgccaaacgctttacggatgctggcttcgatcaccatgatcttttctttgcggatggcagcacccctactgatgccattgtcaaagaattcctagatatctgtgaaaatgctgagggtgccattgcagtacattgcaaagctggccttggtcgcacgggcactctgatagcctgctacatcatgaagcattacaggatgacagcagccgagaccattgcgtgggtcaggatctgcagacctggctcggtgattgggcctcagcagcagtttttggtgatgaagcaaaccaacctctggctggaaggggactattttcgtcagaagttaaaggggcaggagaatggacaacacagagcagccttctccaaacttctctctggcgttgatgacatttccataaatggggtcgagaatcaagatcagcaagaacccgaaccgtacagtgatgatgacgaaatcaatggagtgacacaaggtgatagacttcgggccttgaaaagcagaagacaatccaaaacaaacgctattcctctcacatgtcccctagctgtgctgacctctgcactgtgtagtgttgtcatctggtggattgtttgtgactacattcttcccatcctgctattctgtctcgatggtttcagaacacagtagccatcaggaccccctgacagatagctgctagtaattcttcaatccagtgttcagagctgtaaaacatctgaacctaacatttctggcagtgcaggcattactaaaagaaccaccagatctgcttcaaggaaaagcagtgttaaaagtctctccatttcaaggactaaaacagtcttgcgttaagtaaaaacctgtgaccagagctgaaggaagactctaggactgaaaactgcaacagaaattagcacaatttgaaaacaaaacaaaattgcaaaagccttagttgctttttccacctaagaagttgatcaatggagaaaatgtccactggagtttgaataatgaactttgagtttgggtgcaagcaaatgactcagagaagggtccagctctcaagctgaatgacaaacatgctgttgtaaatttagtctcaggtgtaaatacccaagccctctggtacccagggagctggctggtctgtggtgcatgtgtgtccctgtgatggcaatcattgtagttgctggccttcagaagaattgaggatctgatggaggttttttatgtatttattttctgttcaccttgtgaccctgtgtcaaaatttataaagatacaaaaggcattactgaaatggtactttctgtaatttgatactatttggcttaatcatcttcacttgactatttgtaatactgttgtaatgttaactctgttaagtacccaagctgcttgtcttccaccaaagagtgctttattaacaagaatctgtgaaaatcacatttaaacactgttgcatgttgtaagaccaggtggtaccttagtaacctaaaacttgcaagagaatattaatggtagctttagaagactcaggaggagaaactgacttcagagttggaagatgttgcaagtcgttcctttttctgtccttcagggactgaagaactgggaggctgcccattgtttggttgccagtcatacaaattaaaatcatatttccttccatgaatggaagaaacacactattggtttttccccttggaaacagcaatcccaaataatgtcggcttacaaaaaaaaaaagttaccacttttttagagtccttccctgtaacattggattttttttttcccttatgagatccacctaaggccattgacgtggcctgcgatctcagtgacaatgatctgcttctggatctcactgttgcctttggttagggaacacaactagtaactctgcagagtgccttctcccgcagccctactggaacacagcagagtctgtgccatgaagcagttacagaaacagaattgatgtgctgctaaaaaaaaaaaaaaaatggggcccgaaataaaagaatatatagtactcacctcagttccttccataagaagtgggtggtttaatgattgttaagccatttttgcctgtgccgggagcatggagggctgagatgtcgacaggcagtgggaaacaaatgccctcctaagccacaaggcgtgcgccagattagtaggcaactccattttaagaagctgcctttttcacaaaactggaagaaataaaagcggttggaataaacaagttaaaagtctttaatgcaaaaagtaattgaaaggcagtgcctccattttggtgtactttcttggaagaaagtataaaattgaccggcatcatgagagacggaagatgccgtgttctcagccaaacaagcaactctttccccgccaggcactgtcgggtggggtcaggccagcttttaaacactggggactggatcacagaaaaacagtggttttctgtccctggaaatgaataggcacaaagacccacttggctgtgggcagactactcttcaataagatttgggtgggaggaggaacattccttttgctattttgagctgagacaatataaatattcaaactgtgccatgcataaagcattgaattctcagggcacctcttcttccccttaccccttttaaggccatcccctccattaataataatccaggtagttgtgaaaatcgtgcttctatctgatcccttcttagtttggcttttcatcccatcagaacaagtaaacgtaggcgccacagctcttgtgagtactgtctccctcacggtgaatgagcctcctggtgtttcgtccaagaaaagaaagggtgtcactggaaccacagccctttttcattttataaactgcctcttcatgttgcctgctcaagtttccacctagaattgctatcactgtggctctttctaaaaatctttctatttaactggttcactgaaattagtcatagaaaacttgtgatttggtgaagaggcattccttgtaataaccaaatgacttgggatggtgtgcatagcaagggcagtgttacacttatgaggactgtctctagcatccaggaagtctctgggtctgagggatggaaagttcttcctgctatgaatgagagtggactcttcccctcacccccaactgaaaccacaaacaaccagaatcttctggaattctgacttagagtcgttgttatagaagaccttgttgctatggaacatgaaactgtgtgtcagatggagagatccccttaacctaagagccttaaatagccctgaaagtacactgggacggtttgcgatggaattaaaattggaagtgaatatttttaggtgctcttgaagctttctggggactcaaaattatcaaaagtcagggacagtccggaggaagagcgtctgcgagcagcgcctcgtgagagcagaatggcctggcgtggccagtgcttcccggcagcacgcagctctgcggcctccagaattcccctgttctgagcttgatgcccctagcctgtcccctacctacttcctcccctcctctctagccctctcacaggggtgattgctacctctctgttttcttgggcctaggcaagttttagaggagttcccaagcattgttatgaggccagtgtgctcgctgggctgggcgggatggcctgggcttgtgtgtggcctgagggctctcctggggccttctcttttcccagtcacctttggagccacagaagcagtgcactcattggatgtctgttcttaacacagcttctctttctacattaaaaaaaatcattattgcattttggaaagcagtgctcatcaaaagcaacttttaaaacctattttattgttcctttaaatgttctctcccgctgaaactgccctggagaggctatctgctgctcttccatttacccacatcaggttattctccatgtcactcagtggagatgactccagatgtgtttaaagactggacaattcacctatactgtgtaggaaattacctccttaattacctggtagaattgtcagcagacatgttcatccgatgatagtactgcagttttctattaataatttgcagacttttatctaacctgcactcatgtacagattattaaaagttttaaaatgtaactgatcagtattgatcaatcattgtcttgatttttttttacagcgtatatttctaatcatattttttaaagccaagagaactggttgaatgaatgtttattttcctgaaggtatttttaagataaagcttcctaatggcgtgtaaactttgcatatgtatgtagtttgatacatattgtcacatttgaaaatcttgtgggttgtaactggttttatacaaaatatcgaatagtggaaattgtataattacaatcatgtaattaaaagtattaacccaa

SEQ ID NO: 371927 - DNA, 5471 bp, Homo sapiens
cacggaacagccctcctggggtccccacgagccgcgtcctgctgtgccccggcgcctacgcagcagcggccgcggccgcggtgggcacgcacggttaccccgggcagctccggccgccagctgcagccccgtcgcctcggccgcgccagccggctgcgggcacctgggggcgggctgggggcgccggccgcggcaggaggcgctgtagcgagggctgcggcgccggtcctgcggcggccgcgggaggcagcggggcaggcgctgtgggccgggctcctcctccggctcctgcgcgaccgcctcccgccgggctctgccggcgcccgccgtccccgcagcgccgctctgcgcccgccgccccgagcgcccgcgcggggctggcgggagcctcggcgggcgcgcgggcgcgcggggccatggtcgtggccccctgacgggccgcggccgcctccatgaagcggaaaagcgagcggcggtcgagctgggccgccgcgcccccctgctcgcggcgctgctcgtcgacctcgccgggtgtgaagaagatccgcagctccacgcagcaagacccgcgccgccgggacccccaggacgacgtgtacctggacatcaccgatcgcctttgttttgccattctctacagcagaccaaagagtgcatcaaatgtacattatttcagcatagataatgaacttgaatatgagaacttctacgcagattttggaccactcaatctggcaatggtttacagatattgttgcaagatcaataagaaattaaagtccattacaatgttaaggaagaaaattgttcattttactggctctgatcagagaaaacaagcaaatgctgccttccttgttggatgctacatggttatatatttggggagaaccccagaagaagcatatagaatattaatctttggagagacatcctatattcctttcagagatgctgcctatggaagttgcaatttctacattacacttcttgactgttttcatgcagtaaagaaggcaatgcagtatggcttccttaatttcaactcatttaaccttgatgaatatgaacactatgaaaaagcagaaaatggagatttaaattggataataccagaccgatttattgccttctgtggacctcattcaagagccagacttgaaagtggttaccaccaacattctcctgagacttatattcaatattttaagaatcacaatgttactaccattattcgtctgaataaaaggatgtatgatgccaaacgctttacggatgctggcttcgatcaccatgatcttttctttgcggatggcagcacccctactgatgccattgtcaaagaattcctagatatctgtgaaaatgctgagggtgccattgcagtacattgcaaagctggccttggtcgcacgggcactctgatagcctgctacatcatgaagcattacaggatgacagcagccgagaccattgcgtgggtcaggatctgcagacctggctcggtgattgggcctcagcagcagtttttggtgatgaagcaaaccaacctctggctggaaggggactattttcgtcagaagttaaaggggcaggagaatggacaacacagagcagccttctccaaacttctctctggcgttgatgacatttccataaatggggtcgagaatcaagatcagcaagaacccgaaccgtacagtgatgatgacgaaatcaatggagtgacacaaggtgatagacttcgggccttgaaaagcagaagacaatccaaaacaaacgctattcctctcaccgatggttggctgtcccaggctgtcacctttctagaccggcttctgatctggctcgggatccacaaggactagacctgcggggaaggtctctcctggacacgcccgttgcccactgcaagttctctccaggtgcaattgaagcctctcagcagcggaggccgccatgtggagagagcaggcaggcccactgctgctgagaacagggcaggcacgggcagctcctgttctgcctttcccagcttcggagacgcaggctcagctgctccgaagcacctgccagcaccgcacagtacagtttcagaggacagcagtctccttcccgtgaagctcccatgtgctggaatggcatggacttgctgatcaacagaaggaaatggtctgaagtctgaccagcacaaggaaggaggctggctggctcagaggggcccaccttgcgtggaatgaaaacgccaaaggctcatgagcaacattaggctagaggggtcttgttcaaagcatccaactctgacttcggaggcattcccagccggcagcagtgtgtccagcctgcctcttcccaggctggtctgacatgcagcttaggctttcatcccaagttaggtactgacccctccctcttgggcagcacctccctttttaaaaaaatttttttttcttccaaagacagagtcttgctcttgttgtccaggctggagtgcagtggcgcgatctaggctcactgcaacctccttctcccaggttcaagcgactctcctgcctcagcctcctgagtagctgggattataggcgtctgccaccacgcccggctaatttctgtatttttagtagagacagggtttcaccatgttggccaggctggtctcgaactcctgacctcaagtgatctgcctgccttggcctcccaaagtgctgggattacaggtgtcagccaccgcacccagccaagcacccctatctctagaggatctggccccccagcccagttactgcagggcagctttccccacctggtgacaggctgtgcgcagcagccccaggacctcaccctgagctgagtcttcaggagccgccctggtggcacaactcagacacccctgaggcctagcagtcaactcctgattcagacatgatccagtccagcctgggcttggctataaccagctcaaacttgcttgacctccacttttcaggagacttggggacgacagccctcatcggcgtctttcatggggttaatctgcttgagtctaagtcgccagccagaaacgtggtgcccagggtgccctgcctcaggacatgtccacacccacgtcacaagcacctgaggagtccggccggggcactgtggtccaaaaggtcctgccgcctccgcatctgactgtcccaacggcatgctggtgacacccccctgcccttcgcttctgtcctccctggcttctctggggcacttggggctatgtacaacctggcacgatccagaaagggtgcaaacaaaatgcctacatccaggcacacgaccaagtcagcgagagctagccctggtaagcaaacatagcccattacaggttcagaacgtgcaccgggttccccaaaactgtcttcaaccacatgactcaacagctctatgggataggaactgtcagtgtttttgcaactgcaacattaaaccaagtgctgtgggcttttcaagtattattcacaacactaaaggaaagtttcttcaaagggctctctggctaatcttcaaagccgcagttaggcaaaatgacagtgtgacagcttcaaagccactgactcatgacacagccctgatgttgtaccggctaggttcagatttcagaaatcagggcacttgcatccattgccttttccaggaaagggaagaaaacactcagttgataaaccttagtactcagataataaataagagaccaaaagtaggctatcacccaaagcaaacatccttaactgaccctaacgtgtatggattcaactttgattattcaacaaaatcatgaccgactgctgtggcctggagtaaccaaaggactgttttctctacacaaagtcaggagcgaataccaacctttatttgcacttgggttccagttcaaagccaccttagacagtgtggcaaagtgggaaaaagcacagatcctgggaccaaggttcagattccatctcaagcgagcatatgaactgtgtgacaacaggcagacagtacctctgtgtctatgagaaagcggggagagcaacaccccagcttctagcagctctacagctgcctggacctgcaggccctcctaggcccacttcctccccagcacagtgtgtgttcccgggcgtgtgtggctctgggtccagctctgttcagggtgggactccaggtgaattactgaacctctgaggtgtacccccaaccccaaactttcaccaaaagcaataaagaggaactctagaactggagccaggactaagtgagaaaaactgcttataagtgcttaataaatactagttatttacaacttttgctcaagccgagggcagaggcctttgtacgcagctgccgaactctgactctagttctgcggaagaaaaggatgcggtatttgcttttgccatgatccctttccatttgattggcaggttaaataacatggtttttgaagtcacatacttaatattcttcctctcggccttctctttcttggctcgctcacggtcgtggctcttcttgggtgaagatgaggagtgtctgtgcctctccttctctttcagcttctcagggaggcaggcgctctccctcggcttgtcgtctccaggtggctccgtgaaagagacctccaggaaggcagtcagccccggctcctgccctcggtccgtgaagctgtcagaggagacctcgctgattttatcgttggagtcttctctgtactcatggagagcctcttcttccaacttttcaagcaggcttttttccgcgtcggcacttctcgaggacttcctctccttggaatgttctttgtccgacttctctttgtgtttgcttttagccttgtcttcggcagcgtgcttcttttcagccttctcggggagcttctgtttatttttcttatcttgcgtggagtccactgaggctctgtccttcctgtccttgtacttttctgtggactctttatccttcttctccttgtgcttttcaaagactttctcctttttgtctctccccgcgtcggcagcccctcggtcctttctcctgtctctgggctccttgtccttctgcctctcagggtgctgcttgtcagaagacttcctgtgtctgtcggaggcataggcctcccgtccttcctccttctcctggaggccgtccgtcctcggcaagtcgctggcctctcccatcttgaacccgctccccatgcagctgtctctgtcgtcctcactctcatctgtgaagatgtctgcgatgtaccagcttttctctttgcctttcttgtcatcttttttttcagagaagtcttctgagatgatcccagggaaagccttctccttcttctctttcccttggtcgagagacgctttcctttctttgtctttgccatgtgtgtctttatgtttttccttggtatcttttttctctttaaaacatttatcaaattctttgtccttctgacattt

SEQ ID NO: 371928 - DNA, 2460 bp, Homo sapiens
cacggaacagccctcctggggtccccacgagccgcgtcctgctgtgccccggcgcctacgcagcagcggccgcggccgcggtgggcacgcacggttaccccgggcagctccggccgccagctgcagccccgtcgcctcggccgcgccagccggctgcgggcacctgggggcgggctgggggcgccggccgcggcaggaggcgctgtagcgagggctgcggcgccggtcctgcggcggccgcgggaggcagcggggcaggcgctgtgggccgggctcctcctccggctcctgcgcgaccgcctcccgccgggctctgccggcgcccgccgtccccgcagcgccgctctgcgcccgccgccccgagcgcccgcgcggggctggcgggagcctcggcgggcgcgcgggcgcgcggggccatggtcgtggccccctgacgggccgcggccgcctccatgaagcggaaaagcgagcggcggtcgagctgggccgccgcgcccccctgctcgcggcgctgctcgtcgacctcgccgggtgtgaagaagatccgcagctccacgcagcaagacccgcgccgccgggacccccaggacgacgtgtacctggacatcaccgatcgcctttgttttgccattctctacagcagaccaaagagtgcatcaaatgtacattatttcagcatagataatgaacttgaatatgagaacttctacgcagattttggaccactcaatctggcaatggtttacagatattgttgcaagatcaataagaaattaaagtccattacaatgttaaggaagaaaattgttcattttactggctctgatcagagaaaacaagcaaatgctgccttccttgttggatgctacatggttatatatttggggagaaccccagaagaagcatatagaatattaatctttggagagacatcctatattcctttcagagatgctgcctatggaagttgcaatttctacattacacttcttgactgttttcatgcagtaaagaaggcaatgcagtatggcttccttaatttcaactcatttaaccttgatgaatatgaacactatgaaaaagcagaaaatggagatttaaattggataataccagaccgatttattgccttctgtggacctcattcaagagccagacttgaaagtggttaccaccaacattctcctgagacttatattcaatattttaagaatcacaatgttactaccattattcgtctgaataaaaggatgtatgatgccaaacgctttacggatgctggcttcgatcaccatgatcttttctttgcggatggcagcacccctactgatgccattgtcaaagaattcctagatatctgtgaaaatgctgagggtgccattgcagtacattgcaaagctggccttggtcgcacgggcactctgatagcctgctacatcatgaagcattacaggatgacagcagccgagaccattgcgtgggtcaggatctgcagacctggctcggtgattgggcctcagcagcagtttttggtgatgaagcaaaccaacctctggctggaaggggactattttcgtcagaagttaaaggggcaggagaatggacaacacagagcagccttctccaaacttctctctggcgttgatgacatttccataaatggggtcgagaatcaagatcagcaagaacccgaaccgtacagtgatgatgacgaaatcaatggagtgacacaaggtgatagacttcgggccttgaaaagcagaagacaatccaaaacaaacgctattcctctcacatgtcccctagctgtgctgacctctgcactgtgtagtgttgtcatctggtggattgtttgtgactacattcttcccatcctgctattctgtctcgatggtttcagaacacagtagccatcaggaccccctgacagatagctgctacatagccagaatgcctttaataggctaatagcagcaaatctgtattctcttgagatctttcatctttgaaatgaagaccttaacagcgaagaggctttatttctgcagaagaatgtacaagaggcccacttgtggaacagcatgttgaagacccccagaaggcgggtgtgtccgtgtcacggggtccaccgccacccttctgtgtctgagctgcgttcttccttctctgaagctttttccttaactcatattttaagaatttcttctcttgtctcctcttggacttggaagttatgaaagaatgcaaaagttccttgcaagatctcttccaaagaaaaattccattgcaaccaactctggtactttgtggtttcactgagtattttcacatagctgagaaagatttaaaaatcaagctgatttcactcttcagaattaggcaaaacctgcttaacttgctcctatttatggcattttcttgaatatcttacaaataaaagcttattgtcgcgcattcaga

SEQ ID NO: 371929 - DNA, 1667 bp, Homo sapiens
gccggcgggccttgtggtctcatcgcgcgcaggatccgggccgggcgggggcgggggcggggcgcgtccgcggaggggggcggttggcggctcccgagcccagcgccgcgctcagtccggaccccgtgaccggcggccgaggccccgcctccgtcagtctgtccttcgggtcctcagcacagccgtgccggtgaggcgggcggcgggggaacgcggctgtcccgggtcaggggtcttgcggcggcagggcggggggccgaggggcggggcctgggaggaaggcgtggcctttggggactggggctcggactgggggcggagccggggctggttggggaccggccgggttccgctcctgctggagcccggtgcgtggaattccacgcgagtgccggggagttcctggggagccgggcttctcttttggcccccagcgtgttgaccgagcccgcttcgcacagcccttcctagggtgtggagagcgggccccgccctgaaggggcaccgtgggctggggggcctgttttggagcaggcaccggtggccgagctccgtgaccatgaaggtcaaggtcatccccgtgctcgaggacaactacatgtacctggtcatcgaggagctcacgcgcgaggcggtggccgtggacgtggctgtgcccaagaggctgctggagatcgtgggccgggagggggtgtctctgaccgctgtgctgaccacccaccatcactgggaccacgcgcggggaaacccggagctggcgcggcttcgtcccgggctggcggtgctgggcgcggacgagcgcatcttctcgctgacgcgcaggctggcgcacggcgaggagctgcggttcggggccatccacgtgcgttgcctcctgacgcccggccacaccgccggccacatgagctacttcctgtgggaggacgattgcccggacccacccgccctgttctcgggcgacgcgctgtcggtggccggctgcggctcgtgcctggagggcagcgcccagcagatgtaccagagcctggccgagctgggtaccctgccccccgagacgaaggtgttctgcggccacgagcacacgcttagcaacctggagtttgcccagaaagtggagccctgcaacgaccacgtgagagccaagctgtcctgggctaagaagagggatgaggatgacgtgcccactgtgccgtcgactctgggcgaggagcgcctctacaaccccttcctgcgggtggcagaggagccggtgcgcaagttcacgggcaaggcggtccccgccgacgtcctggaggcgctatgcaaggagcgggcgcgcttcgaacaggcgggcgagccgcggcagccacaggcgcgggccctccttgcgctgcagtgggggctcctgagtgcagccccacacgactgagccacccagaccctcacagggctggggcctgcgtccctcctcgtgacctcggccagctggacccacatgagggccacctctggaaccttcttcgaggccctggccagccatctgcccagcctcggagggtgggcaacctggtgcttcccgggtggacacacaggaccactcagtggggcctgtgtgggcgccgagacctgggtgtctgggaagtggggcacacggggcctccgaactatgaataaagctttgaaaggcc

SEQ ID NO: 371930 - DNA, 1326 bp, Homo sapiens
gccggcgggccttgtggtctcatcgcgcgcaggatccgggccgggcgggggcgggggcggggcgcgtccgcggaggggggcggttggcggctcccgagcccagcgccgcgctcagtccggaccccgtgaccggcggccgaggccccgcctccgtcagtctgtccttcgggtcctcagcacagccgtgccgcaggcaccggtggccgagctccgtgaccatgaaggtcaaggtcatccccgtgctcgaggacaactacatgtacctggtcatcgaggagctcacgcgcgaggcggtggccgtggacgtggctgtgcccaagaggctgctggagatcgtgggccgggagggggtgtctctgaccgctgtgctgaccacccaccatcactgggaccacgcgcggggaaacccggagctggcgcggcttcgtcccgggctggcggtgctgggcgcggacgagcgcatcttctcgctgacgcgcaggctggcgcacggcgaggagctgcggttcggggccatccacgtgcgttgcctcctgacgcccggccacaccgccggccacatgagctacttcctgtgggaggacgattgcccggacccacccgccctgttctcgggcgacgcgctgtcggtggccggctgcggctcgtgcctggagggcagcgcccagcagatgtaccagagcctggccgagctgggtaccctgccccccgagacgaaggtgttctgcggccacgagcacacgcttagcaacctggagtttgcccagaaagtggagccctgcaacgaccacgtgagagccaagctgtcctgggctaagaagagggatgaggatgacgtgcccactgtgccgtcgactctgggcgaggagcgcctctacaaccccttcctgcgggtggcagaggagccggtgcgcaagttcacgggcaaggcggtccccgccgacgtcctggaggcgctatgcaaggagcgggcgcgcttcgaacaggcgggcgagccgcggcagccacaggcgcgggccctccttgcgctgcagtgggggctcctgagtgcagccccacacgactgagccacccagaccctcacagggctggggcctgcgtccctcctcgtgacctcggccagctggacccacatgagggccacctctggaaccttcttcgaggccctggccagccatctgcccagcctcggagggtgggcaacctggtgcttcccgggtggacacacaggaccactcagtggggcctgtgtgggcgccgagacctgggtgtctgggaagtggggcacacggggcctccgaactatgaataaagctttgaaaggcc

SEQ ID NO: 371931 - DNA, 1786 bp, Homo sapiens
gccggcgggccttgtggtctcatcgcgcgcaggatccgggccgggcgggggcgggggcggggcgcgtccgcggaggggggcggttggcggctcccgagcccagcgccgcgctcagtccggaccccgtgaccggcggccgaggccccgcctccgtcagtctgtccttcgggtcctcagcacagccgtgccgcccttcctagggtgtggagagcgggccccgccctgaaggggcaccgtgggctggggggcctgttttggagcaggcaccggtggccgagctccgtgaccatgaaggtcaaggtcatccccgtgctcgaggacaactacatgtacctggtcatcgaggagctcacgcgcgaggcggtggccgtggacgtggctgtgcccaagaggctgctggagatcgtgggccgggagggggtgtctctgaccgctgtgctgaccacccaccatcactgggaccacgcgcggggaaacccggagctggcgcggcttcgtcccgggctggcggtgctgggcgcggacgagcgcatcttctcgctgacgcgcaggctggcgcacggcgaggagctgcggttcggggccatccacgtgcgttgcctcctgacgcccggccacaccgccggccacatgagctacttcctgtgggaggacgattgcccggacccacccgccctgttctcgggtacccgcagcgcggagcgcgcccaccccgcctcccgccggccccgccccatctgctctgacccgccctcccccgccaggcgacgcgctgtcggtggccggctgcggctcgtgcctggagggcagcgcccagcagatgtaccagagcctggccgagctgggtaccctgccccccgagacgaaggtgttctgcggccacgagcacacgcttagcaacctggagtttgcccagaaagtggagccctgcaacgaccacgtgagagccaagctgtcctgggctaaggcacggccctttcccgccgcggcaagagggtggggggggagggaacaggcttcggggtggggggggctctcagacaaggcctaatggtgaccggggcctgtggtcactccagaagagggatgaggatgacgtgcccactgtgccgtcgactctgggcgaggagcgcctctacaaccccttcctgcgggtggcgtgagtatggctgttgtcccggggcctccaccgttacgtggacccttaggaaggcatctggggactgcgtgttgggctgagtgagcatctctggcttgggggaggctgctcattaagtgcctgcctgcccgcccacccctcggcgccatgctcccgcgtgggcagcgggccctgcgcctcactgcacccctccctgcagagaggagccggtgcgcaagttcacgggcaaggcggtccccgccgacgtcctggaggcgctatgcaaggagcgggcgcgcttcgaacaggcgggcgagccgcggcagccacaggcgcgggccctccttgcgctgcagtgggggctcctgagtgcagccccacacgactgagccacccagaccctcacagggctggggcctgcgtccctcctcgtgacctcggccagctggacccacatgagggccacctctggaaccttcttcgaggccctggccagccatctgcccagcctcggagggtgggcaacctggtgcttcccgggtggacacacaggaccactcagtggggcctgtgtgggcgccgagacctgggtgtctgggaagtggggcacacggggcctccgaactatgaataaagctttgaaaggcc

SEQ ID NO: 371932 - DNA, 1559 bp, Homo sapiens
gccggcgggccttgtggtctcatcgcgcgcaggatccgggccgggcgggggcgggggcggggcgcgtccgcggaggggggcggttggcggctcccgagcccagcgccgcgctcagtccggaccccgtgaccggcggccgaggccccgcctccgtcagtctgtccttcgggtcctcagcacagccgtgccggtgaggcgggcggcgggggaacgcggctgtcccgggtcaggggtcttgcggcggcagggcggggggccgaggggcggggcctgggaggaaggcgtggcctttggggactggggctcggactgggggcggagccggggctggttggggaccggccgggttccgctcctgctggagcccggtgcgtggaattccacgcgagtgccggggagttcctggggagccgggcttctcttttggcccccagcgtgttgaccgagcccgcttcgcacagcccttcctagggtgtggagagcgggccccgccctgaaggggcaccgtgggctggggggcctgttttggagcaggcaccggtggccgagctccgtgaccatgaaggtcaaggtcatccccgtgctcgaggacaactacatgtacctggtcatcgaggagctcacgcgcgaggcggtggccgtggacgtggctgtgcccaagaggctgctggagatcgtgggccgggagggggtgtctctgaccgctgtgctgaccacccaccatcactgggaccacgcgcggggaaacccggagctggcgcggcttcgtcccgggctggcggtgctgggcgcggacgagcgcatcttctcgctgacgcgcaggctggcgcacggcgaggagctgcggttcggggccatccacgtgcgttgcctcctgacgcccggccacaccgccggccacatgagctacttcctgtgggaggacgattgcccggacccacccgccctgttctcgggcgacgcgctgtcggtggccggctgcggctcgtgcctggagggcagcgcccagcagatgtaccagagcctggccgagctgggtaccctgccccccgagacgaaggtgttctgcggccacgagcacacgcttagcaacctggagtttgcccagaaagtggagccctgcaacgaccacgtgagagccaagctgtcctgggctaagaagagggatgaggatgacgtgcccactgtgccgtcgactctgggcgaggagcgcctctacaaccccttcctgcgggtggcagaggagccggtgcgcaagttcacgggcaaggcggtccccgccgacgtcctggaggcgctatgcaaggagcgggcgcgcttcgaacaggcgggcgagccgcggcagccacaggcgcgggccctccttgcgctgcagtgggggctcctgagtgcagccccacacgactgagccacccagaccctcggagggtgggcaacctggtgcttcccgggtggacacacaggaccactcagtggggcctgtgtgggcgccgagacctgggtgtctgggaagtggggcacacggggcctccgaactatgaataaagctttgaaaggcc

SEQ ID NO: 371933 - DNA, 818 bp, Homo sapiens
ttccgctcctgctggagcccggtgcgtggaattccacgcgagtgccggggagttcctggggagccgggcttctcttttggcccccagcgtgttgaccgagcccgcttcgcacagcccttcctagggtgtggagagcgggccccgccctgaaggggcaccgtgggctggggggcctgttttggagcaggcaccggtggccgagctccgtgaccatgaaggtcaaggtcatccccgtgctcgaggacaactacatgtacctggtcatcgaggagctcacgcgcgaggcggtggccgtggacgtggctgtgcccaagagggtgagggcaggccgcgggccgcagggacccggccgtgtcccccgagagcctccccgacccccctggtaggagcgagcccccacgtgctctgctctccggaagtcattggcggctggggttccttgtttatcttggggctccctgaagttacggcacctctggcctccgccctttcgctgctgcctggcggtccctgcacgcgctgggcgcagtcaccgcccgctgggtccccgctccccggcgctccccggggctctggccggcctggggcagtgagcgcggcggatcccgatatggagggagtgggccaccgggaccgtctgtgttaccgtcactcccgtccctttcagctgctggagatcgtgggccgggagggggtgtctctgaccgctgtgctgaccacccaccatcactggtgagcgccggcggggcgcggggaggcacgaggacgccgccttgtcccaacccgacctaacccggcccccgcccgcccgcccgcag

SEQ ID NO: 371934 - DNA, 816 bp, Homo sapiens
gtgagcgggcctgggccctcccctcttctcccgtgggcacagcccccacgctccgcaccctcactgtgctaggggtgcagagtgaatgcccacctgagggcagaccgggcaggggaggccaggcccccggcgcaagcactttccccgcttcctggccgcgtgcgcgctcaccgagcgctcttcctccagaaggtgttctgcggccacgagcacacgcttagcaacctggagtttgcccagaaagtggagccctgcaacgaccacgtgagagccaagctgtcctgggctaaggcacggccctttcccgccgcggcaagagggtggggggggagggaacaggcttcggggtggggggggctctcagacaaggcctaatggtgaccggggcctgtggtcactccagaagagggatgaggatgacgtgcccactgtgccgtcgactctgggcgaggagcgcctctacaaccccttcctgcgggtggcgtgagtatggctgttgtcccggggcctccaccgttacgtggacccttaggaaggcatctggggactgcgtgttgggctgagtgagcatctctggcttgggggaggctgctcattaagtgcctgcctgcccgcccacccctcggcgccatgctcccgcgtgggcagcgggccctgcgcctcactgcacccctccctgcagagaggagccggtgcgcaagttcacgggcaaggcggtccccgccgacgtcctggaggcgctatgcaaggagcgggcgcgcttcgaacaggcgggcgagccgcggcagccacaggcgcgggccctccttgcgctgc

SEQ ID NO: 371935 - DNA, 1749 bp, Homo sapiens
gccggcgggccttgtggtctcatcgcgcgcaggatccgggccgggcgggggcgggggcggggcgcgtccgcggaggggggcggttggcggctcccgagcccagcgccgcgctcagtccggaccccgtgaccggcggccgaggccccgcctccgtcagtctgtccttcgggtcctcagcacagccgtgccggtgaggcgggcggcgggggaacgcggctgtcccgggtcaggggtcttgcggcggcagggcggggggccgaggggcggggcctgggaggaaggcgtggcctttggggactggggctcggactgggggcggagccggggctggttggggaccggccgggttccgctcctgctggagcccggtgcgtggaattccacgcgagtgccggggagttcctggggagccgggcttctcttttggcccccagcgtgttgaccgagcccgcttcgcacagcccttcctagggtgtggagagcgggccccgccctgaaggggcaccgtgggctggggggcctgttttggagcaggcaccggtggccgagctccgtgaccatgaaggtcaaggtcatccccgtgctcgaggacaactacatgtacctggtcatcgaggagctcacgcgcgaggcggtggccgtggacgtggctgtgcccaagaggctgctggagatcgtgggccgggagggggtgtctctgaccgctgtgctgaccacccaccatcactgggaccacgcgcggggaaacccggagctggcgcggcttcgtcccgggctggcggtgctgggcgcggacgagcgcatcttctcgctgacgcgcaggctggcgcacggcgaggagctgcgggtgagcgcgcgctcccgggaggggcggggagggcgccccgggtccacccgccctcacaggtccgcctgctcctccgccgcagttcggggccatccacgtgcgttgcctcctgacgcccggccacaccgccggccacatgagctacttcctgtgggaggacgattgcccggacccacccgccctgttctcgggcgacgcgctgtcggtggccggctgcggctcgtgcctggagggcagcgcccagcagatgtaccagagcctggccgagctgggtaccctgccccccgagacgaaggtgttctgcggccacgagcacacgcttagcaacctggagtttgcccagaaagtggagccctgcaacgaccacgtgagagccaagctgtcctgggctaagaagagggatgaggatgacgtgcccactgtgccgtcgactctgggcgaggagcgcctctacaaccccttcctgcgggtggcagaggagccggtgcgcaagttcacgggcaaggcggtccccgccgacgtcctggaggcgctatgcaaggagcgggcgcgcttcgaacaggcgggcgagccgcggcagccacaggcgcgggccctccttgcgctgcagtgggggctcctgagtgcagccccacacgactgagccacccagaccctcacagggctggggcctgcgtccctcctcgtgacctcggccagctggacccacatgagggccacctctggaaccttcttcgaggccctggccagccatctgcccagcctcggagggtgggcaacctggtgcttcccgggtggacacacaggaccactcagtggggcctgtgtgggcgccgagacctgggtgtctgggaagtggggcacacggggcctccgaactatgaataaagctttgaaaggcc

SEQ ID NO: 371936 - DNA, 1396 bp, Homo sapiens
gccggcgggccttgtggtctcatcgcgcgcaggatccgggccgggcgggggcgggggcggggcgcgtccgcggaggggggcggttggcggctcccgagcccagcgccgcgctcagtccggaccccgtgaccggcggccgaggccccgcctccgtcagtctgtccttcgggtcctcagcacagccgtgccgcccttcctagggtgtggagagcgggccccgccctgaaggggcaccgtgggctggggggcctgttttggagcaggcaccggtggccgagctccgtgaccatgaaggtcaaggtcatccccgtgctcgaggacaactacatgtacctggtcatcgaggagctcacgcgcgaggcggtggccgtggacgtggctgtgcccaagaggctgctggagatcgtgggccgggagggggtgtctctgaccgctgtgctgaccacccaccatcactgggaccacgcgcggggaaacccggagctggcgcggcttcgtcccgggctggcggtgctgggcgcggacgagcgcatcttctcgctgacgcgcaggctggcgcacggcgaggagctgcggttcggggccatccacgtgcgttgcctcctgacgcccggccacaccgccggccacatgagctacttcctgtgggaggacgattgcccggacccacccgccctgttctcgggcgacgcgctgtcggtggccggctgcggctcgtgcctggagggcagcgcccagcagatgtaccagagcctggccgagctgggtaccctgccccccgagacgaaggtgttctgcggccacgagcacacgcttagcaacctggagtttgcccagaaagtggagccctgcaacgaccacgtgagagccaagctgtcctgggctaagaagagggatgaggatgacgtgcccactgtgccgtcgactctgggcgaggagcgcctctacaaccccttcctgcgggtggcagaggagccggtgcgcaagttcacgggcaaggcggtccccgccgacgtcctggaggcgctatgcaaggagcgggcgcgcttcgaacaggcgggcgagccgcggcagccacaggcgcgggccctccttgcgctgcagtgggggctcctgagtgcagccccacacgactgagccacccagaccctcacagggctggggcctgcgtccctcctcgtgacctcggccagctggacccacatgagggccacctctggaaccttcttcgaggccctggccagccatctgcccagcctcggagggtgggcaacctggtgcttcccgggtggacacacaggaccactcagtggggcctgtgtgggcgccgagacctgggtgtctgggaagtggggcacacggggcctccgaactatgaataaagctttgaaaggcc

SEQ ID NO: 371937 - DNA, 1866 bp, Homo sapiens
gccggcgggccttgtggtctcatcgcgcgcaggatccgggccgggcgggggcgggggcggggcgcgtccgcggaggggggcggttggcggctcccgagcccagcgccgcgctcagtccggaccccgtgaccggcggccgaggccccgcctccgtcagtctgtccttcgggtcctcagcacagccgtgccggtgaggcgggcggcgggggaacgcggctgtcccgggtcaggggtcttgcggcggcagggcggggggccgaggggcggggcctgggaggaaggcgtggcctttggggactggggctcggactgggggcggagccggggctggttggggaccggccgggttccgctcctgctggagcccggtgcgtggaattccacgcgagtgccggggagttcctggggagccgggcttctcttttggcccccagcgtgttgaccgagcccgcttcgcacagcccttcctagggtgtggagagcgggccccgccctgaaggggcaccgtgggctggggggcctgttttggagcaggcaccggtggccgagctccgtgaccatgaaggtcaaggtcatccccgtgctcgaggacaactacatgtacctggtcatcgaggagctcacgcgcgaggcggtggccgtggacgtggctgtgcccaagaggctgctggagatcgtgggccgggagggggtgtctctgaccgctgtgctgaccacccaccatcactgggaccacgcgcggggaaacccggagctggcgcggcttcgtcccgggctggcggtgctgggcgcggacgagcgcatcttctcgctgacgcgcaggctggcgcacggcgaggagctgcggttcggggccatccacgtgcgttgcctcctgacgcccggccacaccgccggccacatgagctacttcctgtgggaggacgattgcccggacccacccgccctgttctcgggcgacgcgctgtcggtggccggctgcggctcgtgcctggagggcagcgcccagcagatgtaccagagcctggccgagctgggtaccctgccccccgagacgaaggtgttctgcggccacgagcacacgcttagcaacctggagtttgcccagaaagtggagccctgcaacgaccacgtgagagccaagctgtcctgggctaagaagagggatgaggatgacgtgcccactgtgccgtcgactctgggcgaggagcgcctctacaaccccttcctgcgggtggcgtgagtatggctgttgtcccggggcctccaccgttacgtggacccttaggaaggcatctggggactgcgtgttgggctgagtgagcatctctggcttgggggaggctgctcattaagtgcctgcctgcccgcccacccctcggcgccatgctcccgcgtgggcagcgggccctgcgcctcactgcacccctccctgcagagaggagccggtgcgcaagttcacgggcaaggcggtccccgccgacgtcctggaggcgctatgcaaggagcgggcgcgcttcgaacaggcgggcgagccgcggcagccacaggcgcgggccctccttgcgctgcagtgggggctcctgagtgcagccccacacgactgagccacccagaccctcacagggctggggcctgcgtccctcctcgtgacctcggccagctggacccacatgagggccacctctggaaccttcttcgaggccctggccagccatctgcccagcctcggagggtgggcaacctggtgcttcccgggtggacacacaggaccactcagtggggcctgtgtgggcgccgagacctgggtgtctgggaagtggggcacacggggcctccgaactatgaataaagctttgaaaggcc

SEQ ID NO: 371938 - DNA, 1978 bp, Homo sapiens
gccggcgggccttgtggtctcatcgcgcgcaggatccgggccgggcgggggcgggggcggggcgcgtccgcggaggggggcggttggcggctcccgagcccagcgccgcgctcagtccggaccccgtgaccggcggccgaggccccgcctccgtcagtctgtccttcgggtcctcagcacagccgtgccggtgaggcgggcggcgggggaacgcggctgtcccgggtcaggggtcttgcggcggcagggcggggggccgaggggcggggcctgggaggaaggcgtggcctttggggactggggctcggactgggggcggagccggggctggttggggaccggccgggttccgctcctgctggagcccggtgcgtggaattccacgcgagtgccggggagttcctggggagccgggcttctcttttggcccccagcgtgttgaccgagcccgcttcgcacagcccttcctagggtgtggagagcgggccccgccctgaaggggcaccgtgggctggggggcctgttttggagcaggcaccggtggccgagctccgtgaccatgaaggtcaaggtcatccccgtgctcgaggacaactacatgtacctggtcatcgaggagctcacgcgcgaggcggtggccgtggacgtggctgtgcccaagaggctgctggagatcgtgggccgggagggggtgtctctgaccgctgtgctgaccacccaccatcactgggaccacgcgcggggaaacccggagctggcgcggcttcgtcccgggctggcggtgctgggcgcggacgagcgcatcttctcgctgacgcgcaggctggcgcacggcgaggagctgcggttcggggccatccacgtgcgttgcctcctgacgcccggccacaccgccggccacatgagctacttcctgtgggaggacgattgcccggacccacccgccctgttctcgggcgacgcgctgtcggtggccggctgcggctcgtgcctggagggcagcgcccagcagatgtaccagagcctggccgagctgggtaccctgccccccgagacgaaggtgttctgcggccacgagcacacgcttagcaacctggagtttgcccagaaagtggagccctgcaacgaccacgtgagagccaagctgtcctgggctaaggcacggccctttcccgccgcggcaagagggtggggggggagggaacaggcttcggggtggggggggctctcagacaaggcctaatggtgaccggggcctgtggtcactccagaagagggatgaggatgacgtgcccactgtgccgtcgactctgggcgaggagcgcctctacaaccccttcctgcgggtggcgtgagtatggctgttgtcccggggcctccaccgttacgtggacccttaggaaggcatctggggactgcgtgttgggctgagtgagcatctctggcttgggggaggctgctcattaagtgcctgcctgcccgcccacccctcggcgccatgctcccgcgtgggcagcgggccctgcgcctcactgcacccctccctgcagagaggagccggtgcgcaagttcacgggcaaggcggtccccgccgacgtcctggaggcgctatgcaaggagcgggcgcgcttcgaacaggcgggcgagccgcggcagccacaggcgcgggccctccttgcgctgcagtgggggctcctgagtgcagccccacacgactgagccacccagaccctcacagggctggggcctgcgtccctcctcgtgacctcggccagctggacccacatgagggccacctctggaaccttcttcgaggccctggccagccatctgcccagcctcggagggtgggcaacctggtgcttcccgggtggacacacaggaccactcagtggggcctgtgtgggcgccgagacctgggtgtctgggaagtggggcacacggggcctccgaactatgaataaagctttgaaaggcc

SEQ ID NO: 371939 - DNA, 1841 bp, Homo sapiens
gccggcgggccttgtggtctcatcgcgcgcaggatccgggccgggcgggggcgggggcggggcgcgtccgcggaggggggcggttggcggctcccgagcccagcgccgcgctcagtccggaccccgtgaccggcggccgaggccccgcctccgtcagtctgtccttcgggtcctcagcacagccgtgccggtgaggcgggcggcgggggaacgcggctgtcccgggtcaggggtcttgcggcggcagggcggggggccgaggggcggggcctgggaggaaggcgtggcctttggggactggggctcggactgggggcggagccggggctggttggggaccggccgggttccgctcctgctggagcccggtgcgtggaattccacgcgagtgccggggagttcctggggagccgggcttctcttttggcccccagcgtgttgaccgagcccgcttcgcacagcccttcctagggtgtggagagcgggccccgccctgaaggggcaccgtgggctggggggcctgttttggagcaggcaccggtggccgagctccgtgaccatgaaggtcaaggtcatccccgtgctcgaggacaactacatgtacctggtcatcgaggagctcacgcgcgaggcggtggccgtggacgtggctgtgcccaagaggctgctggagatcgtgggccgggagggggtgtctctgaccgctgtgctgaccacccaccatcactgggaccacgcgcggggaaacccggagctggcgcggcttcgtcccgggctggcggtgctgggcgcggacgagcgcatcttctcgctgacgcgcaggctggcgcacggcgaggagctgcggttcggggccatccacgtgcgttgcctcctgacgcccggccacaccgccggccacatgagctacttcctgtgggaggacgattgcccggacccacccgccctgttctcgggcgacgcgctgtcggtggccggctgcggctcgtgcctggagggcagcgcccagcagatgtaccagagcctggccgagctgggtaccctgccccccgagacgaaggtgttctgcggccacgagcacacgcttagcaacctggagtttgcccagaaagtggagccctgcaacgaccacgtgagagccaagctgtcctgggctaagaagagggatgaggatgacgtgcccactgtgccgtcgactctgggcgaggagcgcctctacaaccccttcctgcgggtggcagaggagccggtgcgcaagttcacgggcaaggcggtccccgccgacgtcctggaggcgctatgcaaggagcgggcgcgcttcgaacaggcgggcgagccgcggcagccacaggcgcgggccctccttgcgctgcagtgggggctcctgagtgcagccccacacgactgagccacccagaccctcacagggctggggcctgcgtccctcctcgtgacctcggccagctggacccacatgagggccacctctggaaccttcttcgaggccctggccagccatctgcccagcctcggagggtgggcaacctggtgcttcccgggtggacacacaggaccactcagtggggcctgtgtgggcgccgagacctgggtgtctgggaagtggggcacacggggcctccgaactatgaataaagctttgaaaggccaaaacaccttcacaaaaacccccagggcccatatcgccggggcgcgggaacaagcggctactgaacgggccaggtgccatacgcggcttccggacccacgacttgtgaccaagggtcacctctcgggtcacaaaggaggcgaatactccgacaccagttactgctaaaactccg

SEQ ID NO: 371940 - DNA, 2900 bp, Homo sapiens
tgattctgaggcattgccgtcgcgcggtgcatagctaaagacgtcgcgcttgcgcaggcgctcggcgcagaggcctgcgggaagccaagatggcgcataggggttctccaggctgcagttggcgccttatcagtatctaagcggagtgttttggaaggagttaaggggctgtggcaaacgccctctccgccgtcatggcccggcatcggaatgttcgaggctataactacgatgaagattttgaagatgatgatctctacggccagtctgtagaggatgattattgtatttcgccgtcaacagctgctcagtttatttattcacggcgtgacaaaccttccgttgagcctgtggaagaatatgattatgaagatctgaaagaatcttccaattctgtttcaaaccatcagctcagtggatttgatcaagctcgtctttattcatgccttgatcacatgagagaggtacttggagatgctgtgccagatgaaatattaattgaagcagttctgaagaacaagtttgatgtgcagaaggctttgtcaggggttctggaacaagatagagtgcagagtttgaaggacaagaatgaggcaacagtatctacaggaaagatagcaaaaggaaaaccagtagattcccagacatcgcgaagtgaatctgaaattgtgccaaaagttgctaaaatgactgtatctggaaagaagcaaactatgggatttgaagtgcctggagtatcttctgaagaaaatggtcatagtttccacacacctcaaaaaggaccgcccattgaagatgccattgcttcttccgatgttcttgagactgcttctaaatctgctaatccaccccacacgattcaagcatcagaagagcagagttcaaccccagcaccggtgaaaaagtctggcaagctgaggcagcaaatagatgtgaaggcggaactggagaagcggcaaggagggaagcagctactcaacttagtggtcattggtcatgttgatgctgggaaaagtactctgatgggccatatgctttatcttctgggtaatataaacaaaagaactatgcataagtatgaacaggagtctaaaaaggctggcaaagcttcgtttgcatatgcatgggtcttggatgaaactggcgaagaaagggaaaggggagtaaccatggatgttggtatgacaaagtttgaaaccacaaccaaagttattacattaatggatgctccaggccataaggacttcattccaaatatgattacaggagcagcccaggcggatgtagctgttttagttgtagatgccagcaggggagagtttgaagctggatttgagactggaggacaaacacgagagcatggactcttggtccgttctctgggagtgacgcagcttgcagttgcagttaataaaatggatcaggttaattggcaacaagaaaggtttcaagagattactggaaaacttgggcactttcttaagcaagcaggttttaaggagagtgatgtaggttttattcctacaagtggtctcagtggtgaaaatctaatcacaagatctcagtcaagtgaactcacaaaatggtataaaggactatgtttattagaacaaattgattcctttaagcctccccagcgatctattgacaaaccttttagattatgtgtgtccgatgttttcaaagatcaaggatctggattttgcataactggtaaaatagaagctggttatatccaaactggtgaccgactactggcaatgcctcctaatgaaacttgtaccgtgaaaggaatcactctgcatgatgaacctgtcgactgggcggcagcaggcgatcatgttagtcttactttggttgggatggatatcatcaaaatcaatgttggctgcatattttgtggccccaaagtacccattaaagcttgcactcgtttcagagcccgaatcctcatctttaatattgaaattcctatcactaaaggatttcctgtgctgttacactaccaaactgtcagtgaacccgccgttattaaacgattgattagtgtcttaaacaaaagcacgggtgaagtcacaaagaaaaagcctaagtttttgactaaaggccagaatgcattggtagagctacagacacaaagaccaatagctcttgagctatataaagactttaaagagctggggaggttcatgctacgttacggtggttctacaatagctgctggtgttgtcactgagataaaagaatgatgggtcagaatttctaccacgtttctggatacagtgaaatagctaacctctgtttcaagaatgcagttattaagtcaaaggaacaatgtgcaattgatatgtttttagatgagagagaaaaattaaagctaaaattagctgcaaagaagtattaataatcacctctgcaaaaattctaagttgccaactggcaaagaaagtctaatgttaaaaacaactttgcctttgaaacgttaataaatggatttactttgctaagatttatggcaagtgtcaaaaatagtatctgaagatactgaatcatcatgaaatgaactctacttctggccaaagcacaatgtatttgcagttttctcttttgattcaattatactgcacatgttttaaggaaaagtaacttaattgggtttttcaggcagttgatatttgacctaagcttttttttttttttttttccagttaatgctaagaaaagatttggggaaggttataataaaagtattttgtggtgaccataagaatgtccctccccaaacaagtaaacttgtgaaagtttaatttggaattagtggaagctgttcctttgaaagccaagatattatttaagttgtaaagccagctaataaaatgccttagtttgagcataataca

SEQ ID NO: 371941 - DNA, 2353 bp, Homo sapiens
ccaaaccttttcactcattctccacacacttgtctaagcactactggacatctctcctgggagagtgttcttttaggggtaccattctcatggaatgtggtgtgattggtccccccggaatgcaacttctgcatgtgtgtgtctcatagacacttcagatttaccaagcctaaaatggatcttgtccttagtttcatatctcacagttaatgcatcatcatctcacattttcccctttctgtcattagtcttcactttccttaccactccaaacttgttattccttattcccgaattcttgagtttattccctttctgtagtaagtttgtgcatttgtatcagcctctactctaagacagaaataccatcaccttacttctccggtcacaatatttactggcttcctattacttaactgcaggatgaaatttaaaccctaagcgtgatttatgagacccctttattatttctcccttgcctatctctgttgcctcctgtcttaccttttcttcattattctatatggtcccctccccatggcccccacaagtgacacatgactcttagcccatcccacatttggttatgcctttgcccacacagtttcctggggcagcagtgtcttcctttttctccctactcatgcatacaagctacctaataaacacttattccttcttcagagtgccagatgtctattctcaccatcatggattctttggtgcacctttgtgtttctattgtatattttacatattatttgtctcaggacaatgtaattgtttccatctttctcttcactagtataatatctttatgggcagggacttacatttttatttttttttatccccagagtttagtataatatctggtactacgtatttattatttctcaataaatatttgagaaaggaatgaacctttctttggtaatatgagtatttttatttgcaaaaaaaaaaagtaaagtgtggtatgccatatttagtagagatgttaattctgaaatgattattatttaatgtccattgaactactagttttatatgactacttgagaactaagtatagttaacggtattaatcatcagataacattgctgtatgaaccataagattttggtatgttttgcagatcaaggatctggattttgcataactggtaaaatagaagctggttatatccaaactggtgaccgactactggcaatgcctcctaatgaaacttgtaccgtgaaaggaatcactctgcatgatgaacctgtcgactgggcggcagcaggcgatcatgttagtcttactttggttgggatggatatcatcaaaatcaatgttggctgcatattttgtggccccaaagtacccattaaagcttgcactcgtttcagagcccgaatcctcatctttaatattgaaattcctatcactaaaggatttcctgtgctgttacactaccaaactgtcagtgaacccgccgttattaaacgattgattagtgtcttaaacaaaagcacgggtgaagtcacaaagaaaaagcctaagtttttgactaaaggccagaatgcattggtagagctacagacacaaagaccaatagctcttgagctatataaagactttaaagagctggggaggttcatgctacgttacggtggttctacaatagctgctggtgttgtcactgagataaaagaatgatgggtcagaatttctaccacgtttctggatacagtgaaatagctaacctctgtttcaagaatgcagttattaagtcaaaggaacaatgtgcaattgatatgtttttagatgagagagaaaaattaaagctaaaattagctgcaaagaagtattaataatcacctctgcaaaaattctaagttgccaactggcaaagaaagtctaatgttaaaaacaactttgcctttgaaacgttaataaatggatttactttgctaagatttatggcaagtgtcaaaaatagtatctgaagatactgaatcatcatgaaatgaactctacttctggccaaagcacaatgtatttgcagttttctcttttgattcaattatactgcacatgttttaaggaaaagtaacttaattgggtttttcaggcagttgatatttgacctaagcttttttttttttttttttccagttaatgctaagaaaagatttggggaaggttataataaaagtattttgtggtgaccataagaatgtccctccccaaacaagtaaacttgtgaaagtttaatttggaattagtggaagctgttcctttgaaagccaagatattatttaagttgtaaagccagctaataaaatgccttagtttgagcataataca

SEQ ID NO: 371942 - DNA, 800 bp, Homo sapiens
tgattctgaggcattgccgtcgcgcggtgcatagctaaagacgtcgcgcttgcgcaggcgctcggcgcagaggcctgcgggaagccaagatggcgcataggggttctccaggctgcagttggcgccttatcagtatctaagcggagtgttttggaaggagttaaggggctgtggcaaacgccctctccgccgtcatggcccggcatcggaatgttcgaggctataactacgatgaagattttgaagatgatgatctctacggccagtctgtagaggatgattattgtatttcgccgtcaacagctgctcagtttatttattcacggcgtgacaaaccttccgttgagcctgtggaagaatatgattatgaagatctgaaagaatcttccaattctgtttcaaaccatcagctcagtggatttgatcaagctcgtctttattcatgccttgatcacatgagagaggtacttggagatgctgtgccagatgaaatattaattgaagcagttctgaagaacaagtttgatgtgcagaaggctttgtcaggggttctggaacaagatagagtgcagagtttgaaggacaagaatgaggcaacagtatctacaggaaagatagcaaaaggagtcttattttcttcttctgaagtttcagctgataatgttcaaagttcttatcctcagtcagcaaatcatttggattatagtagcaaaccctttgattttgctagctcagtaggaaaatacggattatctcataattcttcagttccaactcactgtttactccatagaaaaaaa

SEQ ID NO: 371943 - DNA, 875 bp, Homo sapiens
tgattctgaggcattgccgtcgcgcggtgcatagctaaagacgtcgcgcttgcgcaggcgctcggcgcagaggcctgcgggaagccaagatggcgcataggggttctccaggctgcagttggcgccttatcagtatctaagcggagtgttttggaaggagttaaggggctgtggcaaacgccctctccgccgtcatggcccggcatcggaatgttcgaggctataactacgatgaagattttgaagatgatgatctctacggccagtctgtagaggatgattattgtatttcgccgtcaacagctgctcagtttatttattcacggcgtgacaaaccttccgttgagcctgtggaagaatatgattatgaagatctgaaagaatcttccaattctgtttcaaaccatcagctcagtggatttgatcaagctcgtctttattcatgccttgatcacatgagagaggtacttggagatgctgtgccagatgaaatattaattgaagcagttctgaagaacaagtttgatgtgcagaaggctttgtcaggggttctggaacaagatagagtgcagagtttgaaggacaagaatgaggcaacagtatctacaggaaagatagcaaaaggtcacctggcggtagacccattcataagaggaaaagacagaattcacattgggatccagtttctttaatatctcatgcacttaaacagaaatttgcatttcaagaagatgattcttttgagaaagagaatagatcttgggaatcttccccattttctagtccagaaacttcaaggtttggacatcacatttcacagtcagaaggacagcgaactaaagaagaaatggtcaacacaaaagctgttgaccaag

SEQ ID NO: 371944 - DNA, 756 bp, Homo sapiens
catggcaagcactgtgtctgatcctatttaattttcatcacaacgctataaaagcctacttattttacacttgaggaaactgaggtacagacagaagagaaagagttgagattcaatcccaggttctttccctactactacttgtaataataaaaatgacaacaacatttgttctaaatgacgaattctcttacttaatctttagaacaacactaagatgttgttaccctccatctttacagaggaaaaagctgacaggttatgcactgaactaaagttgatgcagtaattggtggggtagaaatttgaaatgcctctcatgacttttttcctcttagtgagttaagtaaccacctgattagagtggtgggacttagaggaagcaactggagatcctgaaagactccaagcagtagcactgaattgaagataattaagtataagtgccaaaagaaaaggccagagatactgtggtagcagatttttagtgttataattttttgttttaggtgctgttacactaccaaactgtcagtgaacccgccgttattaaacgattgattagtgtcttaaacaaaagcacgggtgaagtcacaaagaaaaagcctaagtgagtgttttaatacagaaatgataaacaagcaatttaagccaattttttaaagattaactcatttgtgtagtatttctctttgtggtaagtgaaacccatttttacttgttccagaaattattttttcaagggctagattaaaa

SEQ ID NO: 371945 - DNA, 6418 bp, Homo sapiens
tgattctgaggcattgccgtcgcgcggtgcatagctaaagacgtcgcgcttgcgcaggcgctcggcgcagaggcctgcgggaagccaagatggcgcataggggttctccaggctgcagttggcgccttatcagtatctaagcggagtgttttggaaggagttaaggggctgtggcaaacgccctctccgccgtcatggcccggcatcggaatgttcgaggctataactacgatgaagattttgaagatgatgatctctacggccagtctgtagaggatgattattgtatttcgccgtcaacagctgctcagtttatttattcacggcgtgacaaaccttccgttgagcctgtggaagaatatgattatgaagatctgaaagaatcttccaattctgtttcaaaccatcagctcagtggatttgatcaagctcgtctttattcatgccttgatcacatgagagaggtacttggagatgctgtgccagatgaaatattaattgaagcagttctgaagaacaagtttgatgtgcagaaggctttgtcaggggttctggaacaagatagagtgcagagtttgaaggacaagaatgaggcaacagtatctacaggaaagatagcaaaaggaaaaccagtagattcccagacatcgcgaagtgaatctgaaattgtgccaaaagttgctaaaatgactgtatctggaaagaagcaaactatgggatttgaagtgcctggagtatcttctgaagaaaatggtcatagtttccacacacctcaaaaaggaccgcccattgaagatgccattgcttcttccgatgttcttgagactgcttctaaatctgctaatccaccccacacgattcaagcatcagaagagcagagttcaaccccagcaccggtgaaaaagtctggcaagctgaggcagcaaatagatgtgaaggcggaactggagaagcggcaaggagggaagcagctactcaacttagtggtcattggtcatgttgatgctgggaaaagtactctgatgggccatatgctttatcttctgggtaatataaacaaaagaactatgcataagtatgaacaggagtctaaaaaggctggcaaagcttcgtttgcatatgcatgggtcttggatgaaactggcgaagaaagggaaaggggagtaaccatggatgttggtatgacaaagtttgaaaccacaaccaaagttattacattaatggatgctccaggccataaggacttcattccaaatatgattacaggagcagcccaggcggatgtagctgttttagttgtagatgccagcaggggagagtttgaagctggatttgagactggaggacaaacacgagagcatggactcttggtccgttctctgggagtgacgcagcttgcagttgcagttaataaaatggatcaggttaattggcaacaagaaaggtttcaagagattactggaaaacttgggcactttcttaagcaagcaggttttaaggagagtgatgtaggttttattcctacaagtggtctcagtggtgaaaatctaatcacaagatctcagtcaagtgaactcacaaaatggtataaaggactatgtttattagaacaaattgattcctttaagcctccccagcgatctattgacaaaccttttagattatgtgtgtccgatgttttcaaagatcaaggatctggattttgcataactggtaaaatagaagctggttatatccaaactggtgaccgactactggcaatgcctcctaatgaaacttgtaccgtgaaaggaatcactctgcatgatgaacctgtcgactgggcggcagcaggcgatcatgttagtcttactttggttgggatggatatcatcaaaatcaatgttggctgcatattttgtggccccaaagtacccattaaagcttgcactcgtttcagagcccgaatcctcatctttaatattgaaattcctatcactaaaggatttcctgtgctgttacactaccaaactgtcagtgaacccgccgttattaaacgattgattagtgtcttaaacaaaagcacgggtgaagtcacaaagaaaaagcctaagtttttgactaaaggccagaatgcattggtagagctacagacacaaagaccaatagctcttgagctatataaagactttaaagagctggggaggttcatgctacgttacggtggttctacaatagctgctggtgttgtcactgagataaaagaatgatgggtcagaatttctaccacgtttctggatacagtgaaatagctaacctctgtttcaagaatgcagttattaagtcaaaggaacaatgtgcaattgatatgtttttagatgagagagaaaaattaaagctaaaattagctgcaaagaagtattaataatcacctctgcaaaaattctaagttgccaactggcaaagaaagtctaatgttaaaaacaactttgcctttgaaacgttaataaatggatttactttgctaagatttatggcaagtgtcaaaaatagtatctgaagatactgaatcatcatgaaatgaactctacttctggccaaagcacaatgtatttgcagttttctcttttgattcaattatactgcacatgttttaaggaaaagtaacttaattgggtttttcaggcagttgatatttgacctaagcttttttttttttttttttccagttaatgctaagaaaagatttggggaaggttataataaaagtattttgtggtgaccataagaatgtccctccccaaacaagtaaacttgtgaaagtttaatttggaattagtggaagctgttcctttgaaagccaagatattatttaagttgtaaagccagctaataaaatgccttagtttgagcataatacaaactgtgttttgttctttagacatttatgagattctctgccactaacagtaaatatgatttaggggttttgtgggatctttttcacctaagagtttcctagctctgtcacatgaattcttttttatcctaatggcagatccaatttcatctcattcatttttttaaccataacttgcttttcccattctcacttttagaattatacctatgatggccctttctttatcttgcttaccttatagattataagtcccctgtgagtaagtaagagtcatgtttttctttaaagtttcaacaacaaaccccaaggtttatttatttaacaacaggtattcgttgaggtgccttctgggtgcaaggagctttagagtagattttgacctcagctgaacctggaactctgatctgatagactgtttatgataagcttttttttttattagcagcgtgatttgtatatcgatggcttaacatatacaacagcatttcttctccctgcaccttttcgtgaacctgacattttgaacataagcaataacatctgtatggtaaagtaggcagattatacatgtgttgcttagtgaatgattaccaagtgaacacacttggtatattgctttaccaaaatacatgtgtagttgtcacttcagattcactgagttaagaaagttttatttaaatattaatattaatcaagaatttaacagatatatgtgacagaaatctaacttcaagtgactgaagcagaaagaaaaatttttgaatgacataactgagaaaattagaggtagctctagctttgattccatttagatcgagcagctcacacaatgttagcaaggactcatctccactctgccttccctggtgctggttttgctctcaaactctatatagaactctcggccgggcgcggtggctcacacctgtaatcaaaacactttgggaggctgagtcgggaggatagcgtgagcccaggagtttgagaccagctaaggcaatatagtgagaccatgtctctacagaaaaaatttaaaaacagatcagctgggtgtggtgccacatgcctgtagtcccagcttctcaggaggctggggtgggaagatcacttgagcccaggaggtcgaggctgcagtgagccatgatcacatcactgcagtccagcctgggtgacagagcaagacctgtcaccctgccacccataaaaaacctcttctgtaatgccaggttcttgacaagatgtgataattccacacttacatcctcagatctcccatccagggcaaggacagactaaaagagcatatcttctccagaagtcctagaaacatctcatcattgactatgattgaattttatttattaatacttccctaggatatcctgtgtttgagtgtgaagttaatatcacacaaagcatgtagctaacagttgtgtgagggttggaaattcagggtgctgttaggaaggggaaatggattggggtttaaggtagggggagtaaaaacaagaaaccatccactctgtatattatataagactgtgatcgaattaagaattttagtttacagtttagcataaacaaatagtagtagaaatgaatgcatttattcattccttccttctccaatagtgtttaagtacaatctttttatttgcattttattgatgattgattgtggttgaaaggagtggtgatattatttcgaggatccactgtgtaagaagactgttggcagtggaaggctcgagttgattaagtgacaaagaggtaaagcagacatgcccaagcttggttatgctctgatttcctaccctgttactttcatccataatttatagtacatccattttgtgtcattttgcttcaggtatttcttgtcctgactgtcttcttttttatgattttactgtttcttcacactaatggctttgtcctctgactttgactctttgtgagattcttctgagcagttaacctctaggataatgtggcttgaacacattacagaactatgttttgacttgttagtattattcacacattcatgacaattgagcctctctactgtgagaaatgttttagaggccagtttctaggcatagctgtttttctcccatgagtatgcaaatcaatagttttaaccattgttaaaatgcaatcatagtgacttcagaaaatttggaaaatacagaaaatatagggaagaataaaattaacccacagttctgtcacctaaaggtaactgctgccaatgttttcatgtatttcttttctgtctctccaatgcatttttttacatagttgtgagcgttagccaagttattttcatgttgttatgtaatcaatatttttcaatagaagtattagaggttttttttattgatataaaaataacaattacagatcctgatatatagaagttattcaaaattatacagttttcaaaaaatcaagacaagtaggcccaatacaaactactgaatcatcttctaatttccctctaaaatatttatagaaatatgtaagtagaaaaacattcatcctttcctcgtctaattatgatcctgccatattccaggcacaagagaaagctctggggcttgagtcttaatagggctgatagtccaaccaggggacagggtatcataaagagataattcaaaactttaagattggagggtaggtgatggtagaaaattctgcggcaaacatttgttgatgctcatcatttgttgatgtcatcaaagatcaccagggcataattataatcaaaattagttttattgatgcttgctgcagcaagagagactgcacaccactggggtctatgggtgcttctcagtgggaaggtgtaaggaggggcttgctaagaatttgagcacatgtagctaattttaaggagggctcaagtgagcaagggtttcttctggattgagtgctgtcagaaagtggattgagtgctgtcagaaagtgggagtgattttgcaactgggtatcttaatttttatgttgtgggtgggaggaaaggaaagaagcaacagtcacccatgttagccacaagaagaggttggctgtttatggtttgcacagtgactttgtttttatctgtgctcaggcatgattacagtatctcattttatccggattacagtgacctcatctgatgttagagatttgagaattgttaaatgttcagcaggagaacgccaccgcctagtgtgaatgctaggtcagaagctgctttttcacactgaaaccatttaagtatgtacaaataagttaatagtgtaaatgtaggtgtaaaatacaatgcaaaacaaaataatgaagtaagtgaattaaattattgcaccaaatatggggatatgaaatagggaaagaaaagcattaagttacttatagtccataaagggactacattattttgttactctgataatcccataaaacaaagttttaagaatgtttacagtaaccatgaatggaattagtgaaactattcatatcaatgca

SEQ ID NO: 371946 - DNA, 6233 bp, Homo sapiens
ttagtcactgttattcaggagacattttattatagtgatttttaaattaacgaaatcgttccttggataagggaagataggtatattgtagataaaaatacgatcattagagataatttttgccaaagagaagggagagttgaatattctagtacagctgtaaattttaaaatcagttttgaagattaaaagttctttcattgcaccatttagtatagcttttgaccattgtcgtcttttctagctcgtctttattcatgccttgatcacatgagagaggtacttggagatgctgtgccagatgaaatattaattgaagcagttctgaagaacaagtttgatgtgcagaaggctttgtcaggggttctggaacaagatagagtgcagagtttgaaggacaagaatgaggcaacagtatctacaggaaagatagcaaaaggaaaaccagtagattcccagacatcgcgaagtgaatctgaaattgtgccaaaagttgctaaaatgactgtatctggaaagaagcaaactatgggatttgaagtgcctggagtatcttctgaagaaaatggtcatagtttccacacacctcaaaaaggaccgcccattgaagatgccattgcttcttccgatgttcttgagactgcttctaaatctgctaatccaccccacacgattcaagcatcagaagagcagagttcaaccccagcaccggtgaaaaagtctggcaagctgaggcagcaaatagatgtgaaggcggaactggagaagcggcaaggagggaagcagctactcaacttagtggtcattggtcatgttgatgctgggaaaagtactctgatgggccatatgctttatcttctgggtaatataaacaaaagaactatgcataagtatgaacaggagtctaaaaaggctggcaaagcttcgtttgcatatgcatgggtcttggatgaaactggcgaagaaagggaaaggggagtaaccatggatgttggtatgacaaagtttgaaaccacaaccaaagttattacattaatggatgctccaggccataaggacttcattccaaatatgattacaggagcagcccaggcggatgtagctgttttagttgtagatgccagcaggggagagtttgaagctggatttgagactggaggacaaacacgagagcatggactcttggtccgttctctgggagtgacgcagcttgcagttgcagttaataaaatggatcaggttaattggcaacaagaaaggtttcaagagattactggaaaacttgggcactttcttaagcaagcaggttttaaggagagtgatgtaggttttattcctacaagtggtctcagtggtgaaaatctaatcacaagatctcagtcaagtgaactcacaaaatggtataaaggactatgtttattagaacaaattgattcctttaagcctccccagcgatctattgacaaaccttttagattatgtgtgtccgatgttttcaaagatcaaggatctggattttgcataactggtaaaatagaagctggttatatccaaactggtgaccgactactggcaatgcctcctaatgaaacttgtaccgtgaaaggaatcactctgcatgatgaacctgtcgactgggcggcagcaggcgatcatgttagtcttactttggttgggatggatatcatcaaaatcaatgttggctgcatattttgtggccccaaagtacccattaaagcttgcactcgtttcagagcccgaatcctcatctttaatattgaaattcctatcactaaaggatttcctgtgctgttacactaccaaactgtcagtgaacccgccgttattaaacgattgattagtgtcttaaacaaaagcacgggtgaagtcacaaagaaaaagcctaagtttttgactaaaggccagaatgcattggtagagctacagacacaaagaccaatagctcttgagctatataaagactttaaagagctggggaggttcatgctacgttacggtggttctacaatagctgctggtgttgtcactgagataaaagaatgatgggtcagaatttctaccacgtttctggatacagtgaaatagctaacctctgtttcaagaatgcagttattaagtcaaaggaacaatgtgcaattgatatgtttttagatgagagagaaaaattaaagctaaaattagctgcaaagaagtattaataatcacctctgcaaaaattctaagttgccaactggcaaagaaagtctaatgttaaaaacaactttgcctttgaaacgttaataaatggatttactttgctaagatttatggcaagtgtcaaaaatagtatctgaagatactgaatcatcatgaaatgaactctacttctggccaaagcacaatgtatttgcagttttctcttttgattcaattatactgcacatgttttaaggaaaagtaacttaattgggtttttcaggcagttgatatttgacctaagcttttttttttttttttttccagttaatgctaagaaaagatttggggaaggttataataaaagtattttgtggtgaccataagaatgtccctccccaaacaagtaaacttgtgaaagtttaatttggaattagtggaagctgttcctttgaaagccaagatattatttaagttgtaaagccagctaataaaatgccttagtttgagcataatacaaactgtgttttgttctttagacatttatgagattctctgccactaacagtaaatatgatttaggggttttgtgggatctttttcacctaagagtttcctagctctgtcacatgaattcttttttatcctaatggcagatccaatttcatctcattcatttttttaaccataacttgcttttcccattctcacttttagaattatacctatgatggccctttctttatcttgcttaccttatagattataagtcccctgtgagtaagtaagagtcatgtttttctttaaagtttcaacaacaaaccccaaggtttatttatttaacaacaggtattcgttgaggtgccttctgggtgcaaggagctttagagtagattttgacctcagctgaacctggaactctgatctgatagactgtttatgataagcttttttttttattagcagcgtgatttgtatatcgatggcttaacatatacaacagcatttcttctccctgcaccttttcgtgaacctgacattttgaacataagcaataacatctgtatggtaaagtaggcagattatacatgtgttgcttagtgaatgattaccaagtgaacacacttggtatattgctttaccaaaatacatgtgtagttgtcacttcagattcactgagttaagaaagttttatttaaatattaatattaatcaagaatttaacagatatatgtgacagaaatctaacttcaagtgactgaagcagaaagaaaaatttttgaatgacataactgagaaaattagaggtagctctagctttgattccatttagatcgagcagctcacacaatgttagcaaggactcatctccactctgccttccctggtgctggttttgctctcaaactctatatagaactctcggccgggcgcggtggctcacacctgtaatcaaaacactttgggaggctgagtcgggaggatagcgtgagcccaggagtttgagaccagctaaggcaatatagtgagaccatgtctctacagaaaaaatttaaaaacagatcagctgggtgtggtgccacatgcctgtagtcccagcttctcaggaggctggggtgggaagatcacttgagcccaggaggtcgaggctgcagtgagccatgatcacatcactgcagtccagcctgggtgacagagcaagacctgtcaccctgccacccataaaaaacctcttctgtaatgccaggttcttgacaagatgtgataattccacacttacatcctcagatctcccatccagggcaaggacagactaaaagagcatatcttctccagaagtcctagaaacatctcatcattgactatgattgaattttatttattaatacttccctaggatatcctgtgtttgagtgtgaagttaatatcacacaaagcatgtagctaacagttgtgtgagggttggaaattcagggtgctgttaggaaggggaaatggattggggtttaaggtagggggagtaaaaacaagaaaccatccactctgtatattatataagactgtgatcgaattaagaattttagtttacagtttagcataaacaaatagtagtagaaatgaatgcatttattcattccttccttctccaatagtgtttaagtacaatctttttatttgcattttattgatgattgattgtggttgaaaggagtggtgatattatttcgaggatccactgtgtaagaagactgttggcagtggaaggctcgagttgattaagtgacaaagaggtaaagcagacatgcccaagcttggttatgctctgatttcctaccctgttactttcatccataatttatagtacatccattttgtgtcattttgcttcaggtatttcttgtcctgactgtcttcttttttatgattttactgtttcttcacactaatggctttgtcctctgactttgactctttgtgagattcttctgagcagttaacctctaggataatgtggcttgaacacattacagaactatgttttgacttgttagtattattcacacattcatgacaattgagcctctctactgtgagaaatgttttagaggccagtttctaggcatagctgtttttctcccatgagtatgcaaatcaatagttttaaccattgttaaaatgcaatcatagtgacttcagaaaatttggaaaatacagaaaatatagggaagaataaaattaacccacagttctgtcacctaaaggtaactgctgccaatgttttcatgtatttcttttctgtctctccaatgcatttttttacatagttgtgagcgttagccaagttattttcatgttgttatgtaatcaatatttttcaatagaagtattagaggttttttttattgatataaaaataacaattacagatcctgatatatagaagttattcaaaattatacagttttcaaaaaatcaagacaagtaggcccaatacaaactactgaatcatcttctaatttccctctaaaatatttatagaaatatgtaagtagaaaaacattcatcctttcctcgtctaattatgatcctgccatattccaggcacaagagaaagctctggggcttgagtcttaatagggctgatagtccaaccaggggacagggtatcataaagagataattcaaaactttaagattggagggtaggtgatggtagaaaattctgcggcaaacatttgttgatgctcatcatttgttgatgtcatcaaagatcaccagggcataattataatcaaaattagttttattgatgcttgctgcagcaagagagactgcacaccactggggtctatgggtgcttctcagtgggaaggtgtaaggaggggcttgctaagaatttgagcacatgtagctaattttaaggagggctcaagtgagcaagggtttcttctggattgagtgctgtcagaaagtggattgagtgctgtcagaaagtgggagtgattttgcaactgggtatcttaatttttatgttgtgggtgggaggaaaggaaagaagcaacagtcacccatgttagccacaagaagaggttggctgtttatggtttgcacagtgactttgtttttatctgtgctcaggcatgattacagtatctcattttatccggattacagtgacctcatctgatgttagagatttgagaattgttaaatgttcagcaggagaacgccaccgcctagtgtgaatgctaggtcagaagctgctttttcacactgaaaccatttaagtatgtacaaataagttaatagtgtaaatgtaggtgtaaaatacaatgcaaaacaaaataatgaagtaagtgaattaaattattgcaccaaatatggggatatgaaatagggaaagaaaagcattaagttacttatagtccataaagggactacattattttgttactctgataatcccataaaacaaagttttaagaatgtttacagtaaccatgaatggaattagtgaaactattcatatcaatgca

SEQ ID NO: 371947 - DNA, 1470 bp, Homo sapiens
aagcagtggtatcaacgcagagtggccattacgtccggggggcactttcttaagcaagcaggttttaaggagagtgatgtaggttttattcctacaagtggtctcagtggtgaaaatctaatcacaagatctcagtcaagtgaactcacaaaatggtataaaggactatgtttattagaacaaattgattcctttaagcctccccagcgatctattgacaaaccttttagattatgtgtgtccgatgttttcaaagatcaaggatctggattttgcataactggtaaaatagaagctggttatatccaaactggtgaccgactactggcaatgcctcctaatgaaacttgtaccgtgaaaggaatcactctgcatgatgaacctgtcgactgggcggcagcaggcgatcatgttagtcttactttggttgggatggatatcatcaaaatcaatgttggctgcatattttgtggccccaaagtacccattaaagcttgcactcgtttcagagcccgaatcctcatctttaatattgaaattcctatcactaaaggatttcctgtgctgttacactaccaaactgtcagtgaacccgccgttattaaacgattgattagtgtcttaaacaaaagcacgggtgaagtcacaaagaaaaagcctaagtttttgactaaaggccagaatgcattggtagagctacagacacaaagaccaatagctcttgagctatataaagactttaaagagctggggaggttcatgctacgttacggtggttctacaatagctgctggtgttgtcactgagataaaagaatgatgggtcagaatttctaccacgtttctggatacagtgaaatagctaacctctgtttcaagaatgcagttattaagtcaaaggaacaatgtgcaattgatatgtttttagatgagagagaaaaattaaagctaaaattagctgcaaagaagtattaataatcacctctgcaaaaattctaagttgccaactggcaaagaaagtctaatgttaaaaacaactttgcctttgaaacgttaataaatggatttactttgctaagatttatggcaagtgtcaaaaatagtatctgaagatactgaatcatcatgaaatgaactctacttctggccaaagcacaatgtatttgcagttttctcttttgattcaattatactgcacatgttttaaggaaaagtaacttaattgggtttttcaggcagttgatatttgacctaagcttttttttttttttttttccagttaatgctaagaaaagatttggggaaggttataataaaagtattttgtggtgaccataagaatgtccctccccaaacaagtaaacttgtgaaagtttaatttggaattagtggaagctgttcctttgaaagccaagatattatttaagttgtaaagccagctaataaaatgccttagtttgagcataataca

SEQ ID NO: 371948 - DNA, 2508 bp, Homo sapiens
tgattctgaggcattgccgtcgcgcggtgcatagctaaagacgtcgcgcttgcgcaggcgctcggcgcagaggcctgcgggaagccaagatggcgcataggggttctccaggctgcagttggcgccttatcagtatctaagcggagtgttttggaaggagttaaggggctgtggcaaacgccctctccgccgtcatggcccggcatcggaatgttcgaggctataactacgatgaagattttgaagatgatgatctctacggccagtctgtagaggatgattattgtatttcgccgtcaacagctgctcagtttatttattcacggcgtgacaaaccttccgttgagcctgtggaagaatatgattatgaagatctgaaagaatcttccaattctgtttcaaaccatcagctcagtggatttgatcaagctcgtctttattcatgccttgatcacatgagagaggtacttggagatgctgtgccagatgaaatattaattgaagcagttctgaagaacaagtttgatgtgcagaaggctttgtcaggggttctggaacaagatagagtgcagagtttgaaggacaagaatgaggcaacagtatctacaggaaagatagcaaaaggaaaaccagtagattcccagacatcgcgaagtgaatctgaaattgtgccaaaagttgctaaaatgactgtatctggaaagaagcaaactatgggatttgaagtgcctggagtatcttctgaagaaaatggtcatagtttccacacacctcaaaaaggaccgcccattgaagatgccattgcttcttccgatgttcttgagactgcttctaaatctgctaatccaccccacacgattcaagcatcagaagagcagagttcaaccccagcaccggtgaaaaagtctggcaagctgaggcagcaaatagatgtgaaggcggaactggagaagcggcaaggagggaagcagctactcaacttagtggtcattggtcatgttgatgctgggaaaagtactctgatgggccatatgctttatcttctgggtaatataaacaaaagaactatgcataagtatgaacaggagtctaaaaaggctggcaaagcttcgtttgcatatgcatgggtcttggatgaaactggcgaagaaagggaaaggggagtaaccatggatgttggtatgacaaagtttgaaaccacaaccaaagttattacattaatggatgctccaggccataaggacttcattccaaatatgattacaggagcagcccaggcggatgtagctgttttagttgtagatgccagcaggggagagtttgaagctggatttgagactggaggacaaacacgagagcatggactcttggtccgttctctgggagtgacgcagcttgcagttgcagttaataaaatggatcaggttaattggcaacaagaaaggtttcaagagattactggaaaacttgggcactttcttaagcaagcaggttttaaggagagtgatgtaggttttattcctacaagtggtctcagtggtgaaaatctaatcacaagatctcagtcaagtgaactcacaaaatggtataaaggactatgtttattagaacaaattgattcctttaagcctccccagcgatctattgacaaaccttttagattatgtgtgtccgatgttttcaaagatcaaggatctggattttgcataactggtaaaatagaagctggttatatccaaactggtgaccgactactggcaatgcctcctaatgaaacttgtaccgtgaaaggaatcactctgcatgatgaacctgtcgactgggcggcagcaggcgatcatgttagtcttactttggttgggatggatatcatcaaaatcaatgttggctgcatattttgtggccccaaagtacccattaaagcttgcactcgtttcagagcccgaatcctcatctttaatattgaaattcctatcactaaaggatttcctgtgctgttacactaccaaactgtcagtgaacccgccgttattaaacgattgattagtgtcttaaacaaaagcacgggtgaagtcacaaagaaaaagcctaagtttttgactaaaggccagaatgcattggtagagctacagacacaaagaccaatagctcttgagctatataaagactttaaagagctggggaggttcatgctacgttacggtggttctacaatagctgctggtgttgtcactgagataaaagaatgatgggtcagaatttctaccacgtttctggatacagtgaaatagctaacctctgtttcaagaatgcagttattaagtcaaaggaacaatgtgcaattgatatgtttttagatgagagagaaaaattaaagctaaaattagctgcaaagaagtattaataatcacctctgcaaaaattctaagttgccaactggcaaagaaagtctaatgttaaaaacaactttgcctttgaaacgttaataaatggatttactttgctaag

SEQ ID NO: 371949 - DNA, 1418 bp, Homo sapiens
catggcaagcactgtgtctgatcctatttaattttcatcacaacgctataaaagcctacttattttacacttgaggaaactgaggtacagacagaagagaaagagttgagattcaatcccaggttctttccctactactacttgtaataataaaaatgacaacaacatttgttctaaatgacgaattctcttacttaatctttagaacaacactaagatgttgttaccctccatctttacagaggaaaaagctgacaggttatgcactgaactaaagttgatgcagtaattggtggggtagaaatttgaaatgcctctcatgacttttttcctcttagtgagttaagtaaccacctgattagagtggtgggacttagaggaagcaactggagatcctgaaagactccaagcagtagcactgaattgaagataattaagtataagtgccaaaagaaaaggccagagatactgtggtagcagatttttagtgttataattttttgttttaggtgctgttacactaccaaactgtcagtgaacccgccgttattaaacgattgattagtgtcttaaacaaaagcacgggtgaagtcacaaagaaaaagcctaagtttttgactaaaggccagaatgcattggtagagctacagacacaaagaccaatagctcttgagctatataaagactttaaagagctggggaggttcatgctacgttacggtggttctacaatagctgctggtgttgtcactgagataaaagaatgatgggtcagaatttctaccacgtttctggatacagtgaaatagctaacctctgtttcaagaatgcagttattaagtcaaaggaacaatgtgcaattgatatgtttttagatgagagagaaaaattaaagctaaaattagctgcaaagaagtattaataatcacctctgcaaaaattctaagttgccaactggcaaagaaagtctaatgttaaaaacaactttgcctttgaaacgttaataaatggatttactttgctaagatttatggcaagtgtcaaaaatagtatctgaagatactgaatcatcatgaaatgaactctacttctggccaaagcacaatgtatttgcagttttctcttttgattcaattatactgcacatgttttaaggaaaagtaacttaattgggtttttcaggcagttgatatttgacctaagcttttttttttttttttttccagttaatgctaagaaaagatttggggaaggttataataaaagtattttgtggtgaccataagaatgtccctccccaaacaagtaaacttgtgaaagtttaatttggaattagtggaagctgttcctttgaaagccaagatattatttaagttgtaaagccagctaataaaatgccttagtttgagcataataca

SEQ ID NO: 371950 - DNA, 2391 bp, Homo sapiens
tgattctgaggcattgccgtcgcgcggtgcatagctaaagacgtcgcgcttgcgcaggcgctcggcgcagaggcctgcgggaagccaagatggcgcataggggttctccaggctgcagttggcgccttatcagtatctaagcggagtgttttggaaggagttaaggggctgtggcaaacgccctctccgccgtcatggcccggcatcggaatgttcgaggctataactacgatgaagattttgaagatgatgatctctacggccagtctgtagaggatgattattgtatttcgccgtcaacagctgctcagtttatttattcacggcgtgacaaaccttccgttgagcctgtggaagaatatgattatgaagatctgaaagaatcttccaattctgtttcaaaccatcagctcagtggatttgatcaagctcgtctttattcatgccttgatcacatgagagaggtacttggagatgctgtgccagatgaaatattaattgaagcagttctgaagaacaagtttgatgtgcagaaggctttgtcaggggttctggaacaagatagagtgcagagtttgaaggacaagaatgaggcaacagtatctacaggaaagatagcaaaaggaaaaccagtagattcccagacatcgcgaagtgaatctgaaattgtgccaaaagttgctaaaatgactgtatctggaaagaagcaaactatgggatttgaagtgcctggagtatcttctgaagaaaatggtcatagtttccacacacctcaaaaaggaccgcccattgaagatgccattgcttcttccgatgttcttgagactgcttctaaatctgctaatccaccccacacgattcaagcatcagaagagcagagttcaaccccagcaccggtgaaaaagtctggcaagctgaggcagcaaatagatgtgaaggcggaactggagaagcggcaaggagggaagcagctactcaacttagtggtcattggtcatgttgatgctgggaaaagtactctgatgggccatatgctttatcttctgggtaatataaacaaaagaactatgcataagtatgaacaggagtctaaaaaggctggcaaagcttcgtttgcatatgcatgggtcttggatgaaactggcgaagaaagggaaaggggagtaaccatggatgttggtatgacaaagtttgaaaccacaaccaaagttattacattaatggatgctccaggccataaggacttcattccaaatatgattacaggagcagcccaggcggatgtagctgttttagttgtagatgccagcaggggagagtttgaagctggatttgagactggaggacaaacacgagagcatggactcttggtccgttctctgggagtgacgcagcttgcagttgcagttaataaaatggatcaggttaattggcaacaagaaaggtttcaagagattactggaaaacttgggcactttcttaagcaagcaggttttaaggagagtgatgtaggttttattcctacaagtggtctcagtggtgaaaatctaatcacaagatctcagtcaagtgaactcacaaaatggtataaaggactatgtttattagaacaaattgattcctttaagcctccccagcgatctattgacaaaccttttagattatgtgtgtccgatgttttcaaagatcaaggatctggattttgcataactggtaaaatagaagctggttatatccaaactggtgaccgactactggcaatgcctcctaatgaaacttgtaccgtgaaaggaatcactctgcatgatgaacctgtcgactgggcggcagcaggcgatcatgttagtcttactttggttgggatggatatcatcaaaatcaatgttggctgcatattttgtggccccaaagtacccattaaagcttgcactcgtttcagagcccgaatcctcatctttaatattgaaattcctatcactaaaggatttcctgtgctgttacactaccaaactgtcagtgaacccgccgttattaaacgattgattagtgtcttaaacaaaagcacgggtgaagtcacaaagaaaaagcctaagtttttgactaaaggccagaatgcattggtagagctacagacacaaagaccaatagctcttgagctatataaagactttaaagagctggggaggttcatgctacgttacggtggttctacaatagctgctggtgttgtcactgagataaaagaatgatgggtcagaatttctaccacgtttctggatacagtgaaatagctaacctctgtttcaagaatgcagttattaagtcaaaggaacaatgtgcaattgatatgtttttagatgagagagaaaaattaaagctaaaattagctgc

SEQ ID NO: 371951 - DNA, 6353 bp, Homo sapiens
cggccggcactcacgggcgagtgtcttcccaacgtagcctaagctaagtatcgagctgcccttatcagtatctaagcggagtgttttggaaggagttaaggggctgtggcaaacgccctctccgccgtcatggcccggcatcggaatgttcgaggctataactacgatgaagattttgaagatgatgatctctacggccagtctgtagaggatgattattgtatttcgccgtcaacagctgctcagtttatttattcacggcgtgacaaaccttccgttgagcctgtggaagaatatgattatgaagatctgaaagaatcttccaattctgtttcaaaccatcagctcagtggatttgatcaagctcgtctttattcatgccttgatcacatgagagaggtacttggagatgctgtgccagatgaaatattaattgaagcagttctgaagaacaagtttgatgtgcagaaggctttgtcaggggttctggaacaagatagagtgcagagtttgaaggacaagaatgaggcaacagtatctacaggaaagatagcaaaaggaaaaccagtagattcccagacatcgcgaagtgaatctgaaattgtgccaaaagttgctaaaatgactgtatctggaaagaagcaaactatgggatttgaagtgcctggagtatcttctgaagaaaatggtcatagtttccacacacctcaaaaaggaccgcccattgaagatgccattgcttcttccgatgttcttgagactgcttctaaatctgctaatccaccccacacgattcaagcatcagaagagcagagttcaaccccagcaccggtgaaaaagtctggcaagctgaggcagcaaatagatgtgaaggcggaactggagaagcggcaaggagggaagcagctactcaacttagtggtcattggtcatgttgatgctgggaaaagtactctgatgggccatatgctttatcttctgggtaatataaacaaaagaactatgcataagtatgaacaggagtctaaaaaggctggcaaagcttcgtttgcatatgcatgggtcttggatgaaactggcgaagaaagggaaaggggagtaaccatggatgttggtatgacaaagtttgaaaccacaaccaaagttattacattaatggatgctccaggccataaggacttcattccaaatatgattacaggagcagcccaggcggatgtagctgttttagttgtagatgccagcaggggagagtttgaagctggatttgagactggaggacaaacacgagagcatggactcttggtccgttctctgggagtgacgcagcttgcagttgcagttaataaaatggatcaggttaattggcaacaagaaaggtttcaagagattactggaaaacttgggcactttcttaagcaagcaggttttaaggagagtgatgtaggttttattcctacaagtggtctcagtggtgaaaatctaatcacaagatctcagtcaagtgaactcacaaaatggtataaaggactatgtttattagaacaaattgattcctttaagcctccccagcgatctattgacaaaccttttagattatgtgtgtccgatgttttcaaagatcaaggatctggattttgcataactggtaaaatagaagctggttatatccaaactggtgaccgactactggcaatgcctcctaatgaaacttgtaccgtgaaaggaatcactctgcatgatgaacctgtcgactgggcggcagcaggcgatcatgttagtcttactttggttgggatggatatcatcaaaatcaatgttggctgcatattttgtggccccaaagtacccattaaagcttgcactcgtttcagagcccgaatcctcatctttaatattgaaattcctatcactaaaggatttcctgtgctgttacactaccaaactgtcagtgaacccgccgttattaaacgattgattagtgtcttaaacaaaagcacgggtgaagtcacaaagaaaaagcctaagtttttgactaaaggccagaatgcattggtagagctacagacacaaagaccaatagctcttgagctatataaagactttaaagagctggggaggttcatgctacgttacggtggttctacaatagctgctggtgttgtcactgagataaaagaatgatgggtcagaatttctaccacgtttctggatacagtgaaatagctaacctctgtttcaagaatgcagttattaagtcaaaggaacaatgtgcaattgatatgtttttagatgagagagaaaaattaaagctaaaattagctgcaaagaagtattaataatcacctctgcaaaaattctaagttgccaactggcaaagaaagtctaatgttaaaaacaactttgcctttgaaacgttaataaatggatttactttgctaagatttatggcaagtgtcaaaaatagtatctgaagatactgaatcatcatgaaatgaactctacttctggccaaagcacaatgtatttgcagttttctcttttgattcaattatactgcacatgttttaaggaaaagtaacttaattgggtttttcaggcagttgatatttgacctaagcttttttttttttttttttccagttaatgctaagaaaagatttggggaaggttataataaaagtattttgtggtgaccataagaatgtccctccccaaacaagtaaacttgtgaaagtttaatttggaattagtggaagctgttcctttgaaagccaagatattatttaagttgtaaagccagctaataaaatgccttagtttgagcataatacaaactgtgttttgttctttagacatttatgagattctctgccactaacagtaaatatgatttaggggttttgtgggatctttttcacctaagagtttcctagctctgtcacatgaattcttttttatcctaatggcagatccaatttcatctcattcatttttttaaccataacttgcttttcccattctcacttttagaattatacctatgatggccctttctttatcttgcttaccttatagattataagtcccctgtgagtaagtaagagtcatgtttttctttaaagtttcaacaacaaaccccaaggtttatttatttaacaacaggtattcgttgaggtgccttctgggtgcaaggagctttagagtagattttgacctcagctgaacctggaactctgatctgatagactgtttatgataagcttttttttttattagcagcgtgatttgtatatcgatggcttaacatatacaacagcatttcttctccctgcaccttttcgtgaacctgacattttgaacataagcaataacatctgtatggtaaagtaggcagattatacatgtgttgcttagtgaatgattaccaagtgaacacacttggtatattgctttaccaaaatacatgtgtagttgtcacttcagattcactgagttaagaaagttttatttaaatattaatattaatcaagaatttaacagatatatgtgacagaaatctaacttcaagtgactgaagcagaaagaaaaatttttgaatgacataactgagaaaattagaggtagctctagctttgattccatttagatcgagcagctcacacaatgttagcaaggactcatctccactctgccttccctggtgctggttttgctctcaaactctatatagaactctcggccgggcgcggtggctcacacctgtaatcaaaacactttgggaggctgagtcgggaggatagcgtgagcccaggagtttgagaccagctaaggcaatatagtgagaccatgtctctacagaaaaaatttaaaaacagatcagctgggtgtggtgccacatgcctgtagtcccagcttctcaggaggctggggtgggaagatcacttgagcccaggaggtcgaggctgcagtgagccatgatcacatcactgcagtccagcctgggtgacagagcaagacctgtcaccctgccacccataaaaaacctcttctgtaatgccaggttcttgacaagatgtgataattccacacttacatcctcagatctcccatccagggcaaggacagactaaaagagcatatcttctccagaagtcctagaaacatctcatcattgactatgattgaattttatttattaatacttccctaggatatcctgtgtttgagtgtgaagttaatatcacacaaagcatgtagctaacagttgtgtgagggttggaaattcagggtgctgttaggaaggggaaatggattggggtttaaggtagggggagtaaaaacaagaaaccatccactctgtatattatataagactgtgatcgaattaagaattttagtttacagtttagcataaacaaatagtagtagaaatgaatgcatttattcattccttccttctccaatagtgtttaagtacaatctttttatttgcattttattgatgattgattgtggttgaaaggagtggtgatattatttcgaggatccactgtgtaagaagactgttggcagtggaaggctcgagttgattaagtgacaaagaggtaaagcagacatgcccaagcttggttatgctctgatttcctaccctgttactttcatccataatttatagtacatccattttgtgtcattttgcttcaggtatttcttgtcctgactgtcttcttttttatgattttactgtttcttcacactaatggctttgtcctctgactttgactctttgtgagattcttctgagcagttaacctctaggataatgtggcttgaacacattacagaactatgttttgacttgttagtattattcacacattcatgacaattgagcctctctactgtgagaaatgttttagaggccagtttctaggcatagctgtttttctcccatgagtatgcaaatcaatagttttaaccattgttaaaatgcaatcatagtgacttcagaaaatttggaaaatacagaaaatatagggaagaataaaattaacccacagttctgtcacctaaaggtaactgctgccaatgttttcatgtatttcttttctgtctctccaatgcatttttttacatagttgtgagcgttagccaagttattttcatgttgttatgtaatcaatatttttcaatagaagtattagaggttttttttattgatataaaaataacaattacagatcctgatatatagaagttattcaaaattatacagttttcaaaaaatcaagacaagtaggcccaatacaaactactgaatcatcttctaatttccctctaaaatatttatagaaatatgtaagtagaaaaacattcatcctttcctcgtctaattatgatcctgccatattccaggcacaagagaaagctctggggcttgagtcttaatagggctgatagtccaaccaggggacagggtatcataaagagataattcaaaactttaagattggagggtaggtgatggtagaaaattctgcggcaaacatttgttgatgctcatcatttgttgatgtcatcaaagatcaccagggcataattataatcaaaattagttttattgatgcttgctgcagcaagagagactgcacaccactggggtctatgggtgcttctcagtgggaaggtgtaaggaggggcttgctaagaatttgagcacatgtagctaattttaaggagggctcaagtgagcaagggtttcttctggattgagtgctgtcagaaagtggattgagtgctgtcagaaagtgggagtgattttgcaactgggtatcttaatttttatgttgtgggtgggaggaaaggaaagaagcaacagtcacccatgttagccacaagaagaggttggctgtttatggtttgcacagtgactttgtttttatctgtgctcaggcatgattacagtatctcattttatccggattacagtgacctcatctgatgttagagatttgagaattgttaaatgttcagcaggagaacgccaccgcctagtgtgaatgctaggtcagaagctgctttttcacactgaaaccatttaagtatgtacaaataagttaatagtgtaaatgtaggtgtaaaatacaatgcaaaacaaaataatgaagtaagtgaattaaattattgcaccaaatatggggatatgaaatagggaaagaaaagcattaagttacttatagtccataaagggactacattattttgttactctgataatcccataaaacaaagttttaagaatgtttacagtaaccatgaatggaattagtgaaactattcatatcaatgca

SEQ ID NO: 371952 - DNA, 5856 bp, Homo sapiens
ttgacgtgtggaaagaaaaatcacaaactgggagacagtatttgtagcattggtagcaaaaggaaaaccagtagattcccagacatcgcgaagtgaatctgaaattgtgccaaaagttgctaaaatgactgtatctggaaagaagcaaactatgggatttgaagtgcctggagtatcttctgaagaaaatggtcatagtttccacacacctcaaaaaggaccgcccattgaagatgccattgcttcttccgatgttcttgagactgcttctaaatctgctaatccaccccacacgattcaagcatcagaagagcagagttcaaccccagcaccggtgaaaaagtctggcaagctgaggcagcaaatagatgtgaaggcggaactggagaagcggcaaggagggaagcagctactcaacttagtggtcattggtcatgttgatgctgggaaaagtactctgatgggccatatgctttatcttctgggtaatataaacaaaagaactatgcataagtatgaacaggagtctaaaaaggctggcaaagcttcgtttgcatatgcatgggtcttggatgaaactggcgaagaaagggaaaggggagtaaccatggatgttggtatgacaaagtttgaaaccacaaccaaagttattacattaatggatgctccaggccataaggacttcattccaaatatgattacaggagcagcccaggcggatgtagctgttttagttgtagatgccagcaggggagagtttgaagctggatttgagactggaggacaaacacgagagcatggactcttggtccgttctctgggagtgacgcagcttgcagttgcagttaataaaatggatcaggttaattggcaacaagaaaggtttcaagagattactggaaaacttgggcactttcttaagcaagcaggttttaaggagagtgatgtaggttttattcctacaagtggtctcagtggtgaaaatctaatcacaagatctcagtcaagtgaactcacaaaatggtataaaggactatgtttattagaacaaattgattcctttaagcctccccagcgatctattgacaaaccttttagattatgtgtgtccgatgttttcaaagatcaaggatctggattttgcataactggtaaaatagaagctggttatatccaaactggtgaccgactactggcaatgcctcctaatgaaacttgtaccgtgaaaggaatcactctgcatgatgaacctgtcgactgggcggcagcaggcgatcatgttagtcttactttggttgggatggatatcatcaaaatcaatgttggctgcatattttgtggccccaaagtacccattaaagcttgcactcgtttcagagcccgaatcctcatctttaatattgaaattcctatcactaaaggatttcctgtgctgttacactaccaaactgtcagtgaacccgccgttattaaacgattgattagtgtcttaaacaaaagcacgggtgaagtcacaaagaaaaagcctaagtttttgactaaaggccagaatgcattggtagagctacagacacaaagaccaatagctcttgagctatataaagactttaaagagctggggaggttcatgctacgttacggtggttctacaatagctgctggtgttgtcactgagataaaagaatgatgggtcagaatttctaccacgtttctggatacagtgaaatagctaacctctgtttcaagaatgcagttattaagtcaaaggaacaatgtgcaattgatatgtttttagatgagagagaaaaattaaagctaaaattagctgcaaagaagtattaataatcacctctgcaaaaattctaagttgccaactggcaaagaaagtctaatgttaaaaacaactttgcctttgaaacgttaataaatggatttactttgctaagatttatggcaagtgtcaaaaatagtatctgaagatactgaatcatcatgaaatgaactctacttctggccaaagcacaatgtatttgcagttttctcttttgattcaattatactgcacatgttttaaggaaaagtaacttaattgggtttttcaggcagttgatatttgacctaagcttttttttttttttttttccagttaatgctaagaaaagatttggggaaggttataataaaagtattttgtggtgaccataagaatgtccctccccaaacaagtaaacttgtgaaagtttaatttggaattagtggaagctgttcctttgaaagccaagatattatttaagttgtaaagccagctaataaaatgccttagtttgagcataatacaaactgtgttttgttctttagacatttatgagattctctgccactaacagtaaatatgatttaggggttttgtgggatctttttcacctaagagtttcctagctctgtcacatgaattcttttttatcctaatggcagatccaatttcatctcattcatttttttaaccataacttgcttttcccattctcacttttagaattatacctatgatggccctttctttatcttgcttaccttatagattataagtcccctgtgagtaagtaagagtcatgtttttctttaaagtttcaacaacaaaccccaaggtttatttatttaacaacaggtattcgttgaggtgccttctgggtgcaaggagctttagagtagattttgacctcagctgaacctggaactctgatctgatagactgtttatgataagcttttttttttattagcagcgtgatttgtatatcgatggcttaacatatacaacagcatttcttctccctgcaccttttcgtgaacctgacattttgaacataagcaataacatctgtatggtaaagtaggcagattatacatgtgttgcttagtgaatgattaccaagtgaacacacttggtatattgctttaccaaaatacatgtgtagttgtcacttcagattcactgagttaagaaagttttatttaaatattaatattaatcaagaatttaacagatatatgtgacagaaatctaacttcaagtgactgaagcagaaagaaaaatttttgaatgacataactgagaaaattagaggtagctctagctttgattccatttagatcgagcagctcacacaatgttagcaaggactcatctccactctgccttccctggtgctggttttgctctcaaactctatatagaactctcggccgggcgcggtggctcacacctgtaatcaaaacactttgggaggctgagtcgggaggatagcgtgagcccaggagtttgagaccagctaaggcaatatagtgagaccatgtctctacagaaaaaatttaaaaacagatcagctgggtgtggtgccacatgcctgtagtcccagcttctcaggaggctggggtgggaagatcacttgagcccaggaggtcgaggctgcagtgagccatgatcacatcactgcagtccagcctgggtgacagagcaagacctgtcaccctgccacccataaaaaacctcttctgtaatgccaggttcttgacaagatgtgataattccacacttacatcctcagatctcccatccagggcaaggacagactaaaagagcatatcttctccagaagtcctagaaacatctcatcattgactatgattgaattttatttattaatacttccctaggatatcctgtgtttgagtgtgaagttaatatcacacaaagcatgtagctaacagttgtgtgagggttggaaattcagggtgctgttaggaaggggaaatggattggggtttaaggtagggggagtaaaaacaagaaaccatccactctgtatattatataagactgtgatcgaattaagaattttagtttacagtttagcataaacaaatagtagtagaaatgaatgcatttattcattccttccttctccaatagtgtttaagtacaatctttttatttgcattttattgatgattgattgtggttgaaaggagtggtgatattatttcgaggatccactgtgtaagaagactgttggcagtggaaggctcgagttgattaagtgacaaagaggtaaagcagacatgcccaagcttggttatgctctgatttcctaccctgttactttcatccataatttatagtacatccattttgtgtcattttgcttcaggtatttcttgtcctgactgtcttcttttttatgattttactgtttcttcacactaatggctttgtcctctgactttgactctttgtgagattcttctgagcagttaacctctaggataatgtggcttgaacacattacagaactatgttttgacttgttagtattattcacacattcatgacaattgagcctctctactgtgagaaatgttttagaggccagtttctaggcatagctgtttttctcccatgagtatgcaaatcaatagttttaaccattgttaaaatgcaatcatagtgacttcagaaaatttggaaaatacagaaaatatagggaagaataaaattaacccacagttctgtcacctaaaggtaactgctgccaatgttttcatgtatttcttttctgtctctccaatgcatttttttacatagttgtgagcgttagccaagttattttcatgttgttatgtaatcaatatttttcaatagaagtattagaggttttttttattgatataaaaataacaattacagatcctgatatatagaagttattcaaaattatacagttttcaaaaaatcaagacaagtaggcccaatacaaactactgaatcatcttctaatttccctctaaaatatttatagaaatatgtaagtagaaaaacattcatcctttcctcgtctaattatgatcctgccatattccaggcacaagagaaagctctggggcttgagtcttaatagggctgatagtccaaccaggggacagggtatcataaagagataattcaaaactttaagattggagggtaggtgatggtagaaaattctgcggcaaacatttgttgatgctcatcatttgttgatgtcatcaaagatcaccagggcataattataatcaaaattagttttattgatgcttgctgcagcaagagagactgcacaccactggggtctatgggtgcttctcagtgggaaggtgtaaggaggggcttgctaagaatttgagcacatgtagctaattttaaggagggctcaagtgagcaagggtttcttctggattgagtgctgtcagaaagtggattgagtgctgtcagaaagtgggagtgattttgcaactgggtatcttaatttttatgttgtgggtgggaggaaaggaaagaagcaacagtcacccatgttagccacaagaagaggttggctgtttatggtttgcacagtgactttgtttttatctgtgctcaggcatgattacagtatctcattttatccggattacagtgacctcatctgatgttagagatttgagaattgttaaatgttcagcaggagaacgccaccgcctagtgtgaatgctaggtcagaagctgctttttcacactgaaaccatttaagtatgtacaaataagttaatagtgtaaatgtaggtgtaaaatacaatgcaaaacaaaataatgaagtaagtgaattaaattattgcaccaaatatggggatatgaaatagggaaagaaaagcattaagttacttatagtccataaagggactacattattttgttactctgataatcccataaaacaaagttttaagaatgtttacagtaaccatgaatggaattagtgaaactattcatatcaatgca

SEQ ID NO: 371953 - DNA, 723 bp, Homo sapiens
tgattctgaggcattgccgtcgcgcggtgcatagctaaagacgtcgcgcttgcgcaggcgctcggcgcagaggcctgcgggaagccaagatggcgcataggggttctccaggctgcagttggcgccttatcagtatctaagcggagtgttttggaaggagttaaggggctgtggcaaacgccctctccgccgtcatggcccggcatcggaatgttcgaggctataactacgatgaagattttgaagatgatgatctctacggccagtctgtagaggatgattattgtatttcgccgtcaacagctgctcagtttatttattcacggcgtgacaaaccttccgttgagcctgtggaagaatatgattatgaagatctgaaagaatcttccaattctgtttcaaaccatcagctcagtggatttgatcaagctcgtctttattcatgccttgatcacatgagagaggtacttggagatgctgtgccagatgaaatattaattgaagcagttctgaagaacaagtttgatgtgcagaaggctttgtcaggggttctggaacaagatagagtgcagagtttgaaggacaagaatgaggcaacagtatctacaggaaagatagcaaaaggcccttgctgctagaccttcagcttttgcctcaacactgtgtcttcgttacccactgaaaagctgcaagcgacgcacccttgacctctataagactttt

SEQ ID NO: 371954 - DNA, 841 bp, Homo sapiens
attcaagctaggtagtcagtatctcagccaggctgtctcctggctccctgaacattatggtgctgaccacaaactttcctgtccacttatacaaacttctagtgagtgtgtgtgattactagcttcatgaatacctgacccctccactctgaaggaggaacaggcctgtctggatcacttctctgtccctaactgagcccatctcatttagggaaactacagagcactgttgctttttttttttagatggagtctcgttctgtcgtccaggctggagtgcggtggcgtgatctcagctcactccagcctccacttcccaggttcaagtgattctcctgcctcagccccccaagtaactgggattacaggcatgcaccaccatgcctggctaattttttgtatttttagtagagacggggctttgccatgttggccaggctggtctcgaactcctgaccttgagtaatccacccgcctcggcctcccaaagtgctgggattacaggtgtgagccactgagcccggccacagtgcagtatttctaaccagtgatcagggtaaagaggatgcgtgtccaccatcccagccctgatcagcctgtctgtgcatcccccatcccagccagggcttggagcagccttgctcaccactgtgtcccctgcattgtaacacatccaggcacaagaatagccgcccagtgactgccaagtgagtgaaccagcctgcttggagcctgcctctttcccaaactgctcattatcctgttaccccacccagcccacgtgtccaaatacactccagatgcaaaataaaaagctctacgacaatggctctgaatgttc

SEQ ID NO: 371955 - DNA, 541 bp, Homo sapiens
attcaagctaggtagtcagtatctcagccaggctgtctcctggctccctgaacattatggtgctgaccacaaactttcctgtccacttatacaaacttctagtgagtgtgtgtgattactagcttcatgaatacctgacccctccactctgaaggaggaacaggcctgtctggatcacttctctgtccctaactgagcccatctcatttagggaaactacagagcactgttgctttttttttttagatggagtctcgttctgtcgtccaggctggagtgcggtggcgtgatctcagctcactccagcctccacttcccagccagggcttggagcagccttgctcaccactgtgtcccctgcattgtaacacatccaggcacaagaatagccgcccagtgactgccaagtgagtgaaccagcctgcttggagcctgcctctttcccaaactgctcattatcctgttaccccacccagcccacgtgtccaaatacactccagatgcaaaataaaaagctctacgacaatggctctgaatgttc

SEQ ID NO: 371956 - DNA, 2532 bp, Homo sapiens
ggaggtgcactttacttcctgactcctttcctttttccagtggttatcgcggcgcccaccggcctctgatctctgagtcttctccaacccacagacgttttttgttgctctggttccaggaccttctccacaactaggccattttccctgccaggtgtcctttttgacctcttgacctctgactcaaaggtcagctcaaaggttccgaactcgggcctgggatgtgagggggtactgaacctaagttctccgaatctttagccctgggtccctaagtcgcatccttaaggcacctcactctagatctgagccttcatatcccaaactcactcatgagtttccacatccagccccaaagaatgagttaactcctactaactctccacctaagactcccgaggtaacccaaccggtaccacagatccggttccggatttaaggaccccaccctgttaaccgtcaggtgccttatgacttgagtcagcctcgcaattcctgctcccgtggtttcaaatattagccctggtcctttcacacccactgctcagtccccagattctggaactcagctcttaaacctttaaaatctccatccctgagaccgttctccgttggaggatccttccctccccgctttctgaacctctcaacacctcctgtagaccccaaaatgacttctccatgctctcctcccctaaaaccaccaatttctcctccaaaaacccctgtaccccaagccagcagcattccatctcctcctctacccccaagtcccctggacttttcagctttaccatcccctccctggagtcagcagacccctgttcccccaccgctcccactgcctcctccacccgctgccacagggcctgctccccctcatgtcttcggcctggagaagagccagctcctgaaggaggcctttgataaggccggcccggtccccaagggcagagaagatgtgaagaggcttctgaaactacacaaggaccggttccgaggtgacctgcggtggatcctcttctgtgcagacctgccgtccctcatccaagaaggccctcaatgcgggctggtggccttgtggatggcaggtactctcctgtcgccccccagtggcgtccccctggagagactcatacgggtggccacggaaagaggctacacggcccagggagagatgttctcagtggccgatatgggcaggctggcccaggaggtgctgggctgccaggccaagctgctctctggtggcctgggcggtcccaacagagacctcgtcctgcagcacctggtcactggacatcccctgctcatccccaccagctacgacgaggacttcaaccatgagccgtgtcagaggaagggccacaaggcacactgggcggtgagtgcaggggtcctgctgggtgttcgggctgtgcccagtctcggctacactgaggaccctgagctgccgggcctgttccacccagtgctgggcacgccctgccaaccaccatccctgccagaggagggctccccgggagctgtctacctgctgtccaagcagggcaagagttggcactatcagctgtgggactacgaccaggtccgggagagcaacctgcagctgacggacttctcgccctcacgggccactgacggccgggtgtacgtggtgcccgtgggtggggtacgggctggcctctgtggccaggccctgctcctcacaccacaggactgcagccattagctgcggctgcggtctcaggctgcagcctagctcgttttaaagcccatctgggagcagttacctgtgccagcccctctacctgtgttagcagatctggcaaccctgtaaggggggtgctagatggacccgatttgacagatggcaagactgaggcctggagaagtggaatcactggcctgaggtcacatgactagcacatggcaagatggagtctcgttctgtcgtccaggctggagtgcggtggcgtgatctcagctcactccagcctccacttcccaggttcaagtgattctcctgcctcagccccccaagtaactgggattacaggcatgcaccaccatgcctggctaattttttgtatttttagtagagacggggctttgccatgttggccaggctggtctcgaactcctgaccttgagtaatccacccgcctcggcctcccaaagtgctgggattacaggtgtgagccactgagcccggccacagtgcagtatttctaaccagtgatcagggtaaagaggatgcgtgtccaccatcccagccctgatcagcctgtctgtgcatcccccatcccagccagggcttggagcagccttgctcaccactgtgtcccctgcattgtaacacatccaggcacaagaatagccgcccagtgactgccaagtgagtgaaccagcctgcttggagcctgcctctttcccaaactgctcattatcctgttaccccacccagcccacgtgtccaaatacactccagatgcaaaataaaaagctctacgacaatggctctgaatgttc

SEQ ID NO: 371957 - DNA, 2402 bp, Homo sapiens
ggaggtgcactttacttcctgactcctttcctttttccagtggttatcgcggcgcccaccggcctctgatctctgagtcttctccaacccacagacgttttttgttgctctggttccaggaccttctccacaactaggccattttccctgccaggtgtcctttttgacctcttgacctctgactcaaaggtcagctcaaaggttccgaactcgggcctgggatgtgagggggtactgaacctaagttctccgaatctttagccctgggtccctaagtcgcatccttaaggcacctcactctagatctgagccttcatatcccaaactcactcatgagtttccacatccagccccaaagaatgagttaactcctactaactctccacctaagactcccgaggtaacccaaccggtaccacagatccggttccggatttaaggaccccaccctgttaaccgtcaggtgccttatgacttgagtcagcctcgcaattcctgctcccgtggtttcaaatattagccctggtcctttcacacccactgctcagtccccagattctggaactcagctcttaaacctttaaaatctccatccctgagaccgttctccgttggaggatccttccctccccgctttctgaacctctcaacacctcctgtagaccccaaaatgacttctccatgctctcctcccctaaaaccaccaatttctcctccaaaaacccctgtaccccaagccagcagcattccatctcctcctctacccccaagtcccctggacttttcagctttaccatcccctccctggagtcagcagacccctgttcccccaccgctcccactgcctcctccacccgctgccacagggcctgctccccctcatgtcttcggcctggagaagagccagctcctgaaggaggcctttgataaggccggcccggtccccaagggcagagaagatgtgaagaggcttctgaaactacacaaggaccggttccgaggtgacctgcggtggatcctcttctgtgcagacctgccgtccctcatccaagaaggccctcaatgcgggctggtggccttgtggatggcaggtactctcctgtcgccccccagtggcgtccccctggagagactcatacgggtggccacggaaagaggctacacggcccagggagagatgttctcagcaccagctacgacgaggacttcaaccatgagccgtgtcagaggaagggccacaaggcacactgggcggtgagtgcaggggtcctgctgggtgttcgggctgtgcccagtctcggctacactgaggaccctgagctgccgggcctgttccacccagtgctgggcacgccctgccaaccaccatccctgccagaggagggctccccgggagctgtctacctgctgtccaagcagggcaagagttggcactatcagctgtgggactacgaccaggtccgggagagcaacctgcagctgacggacttctcgccctcacgggccactgacggccgggtgtacgtggtgcccgtgggtggggtacgggctggcctctgtggccaggccctgctcctcacaccacaggactgcagccattagctgcggctgcggtctcaggctgcagcctagctcgttttaaagcccatctgggagcagttacctgtgccagcccctctacctgtgttagcagatctggcaaccctgtaaggggggtgctagatggacccgatttgacagatggcaagactgaggcctggagaagtggaatcactggcctgaggtcacatgactagcacatggcaagatggagtctcgttctgtcgtccaggctggagtgcggtggcgtgatctcagctcactccagcctccacttcccaggttcaagtgattctcctgcctcagccccccaagtaactgggattacaggcatgcaccaccatgcctggctaattttttgtatttttagtagagacggggctttgccatgttggccaggctggtctcgaactcctgaccttgagtaatccacccgcctcggcctcccaaagtgctgggattacaggtgtgagccactgagcccggccacagtgcagtatttctaaccagtgatcagggtaaagaggatgcgtgtccaccatcccagccctgatcagcctgtctgtgcatcccccatcccagccagggcttggagcagccttgctcaccactgtgtcccctgcattgtaacacatccaggcacaagaatagccgcccagtgactgccaagtgagtgaaccagcctgcttggagcctgcctctttcccaaactgctcattatcctgttaccccacccagcccacgtgtccaaatacactccagatgcaaaataaaaagctctacgacaatggctctgaatgttc

SEQ ID NO: 371958 - DNA, 1855 bp, Homo sapiens
ggaggtgcactttacttcctgactcctttcctttttccagtggttatcgcggcgcccaccggcctctgatctctgagtcttctccaacccacagacgttttttgttgctctggttccaggaccttctccacaactaggccattttccctgccaggtgtcctttttgacctcttgacctctgactcaaagggcctgctccccctcatgtcttcggcctggagaagagccagctcctgaaggaggcctttgataaggccggcccggtccccaagggcagagaagatgtgaagaggcttctgaaactacacaaggaccggttccgaggtgacctgcggtggatcctcttctgtgcagacctgccgtccctcatccaagaaggccctcaatgcgggctggtggccttgtggatggcaggtactctcctgtcgccccccagtggcgtccccctggagagactcatacgggtggccacggaaagaggctacacggcccagggagagatgttctcagtggccgatatgggcaggctggcccaggaggtgctgggctgccaggccaagctgctctctggtggcctgggcggtcccaacagagacctcgtcctgcagcacctggtcactggacatcccctgctcatccccaccagctacgacgaggacttcaaccatgagccgtgtcagaggaagggccacaaggcacactgggcggtgagtgcaggggtcctgctgggtgttcgggctgtgcccagtctcggctacactgaggaccctgagctgccgggcctgttccacccagtgctgggcacgccctgccaaccaccatccctgccagaggagggctccccgggagctgtctacctgctgtccaagcagggcaagagttggcactatcagctgtgggactacgaccaggtccgggagagcaacctgcagctgacggacttctcgccctcacgggccactgacggccgggtgtacgtggtgcccgtgggtggggtacgggctggcctctgtggccaggccctgctcctcacaccacaggactgcagccattagctgcggctgcggtctcaggctgcagcctagctcgttttaaagcccatctgggagcagttacctgtgccagcccctctacctgtgttagcagatctggcaaccctgtaaggggggtgctagatggacccgatttgacagatggcaagactgaggcctggagaagtggaatcactggcctgaggtcacatgactagcacatggcaagatggagtctcgttctgtcgtccaggctggagtgcggtggcgtgatctcagctcactccagcctccacttcccaggttcaagtgattctcctgcctcagccccccaagtaactgggattacaggcatgcaccaccatgcctggctaattttttgtatttttagtagagacggggctttgccatgttggccaggctggtctcgaactcctgaccttgagtaatccacccgcctcggcctcccaaagtgctgggattacaggtgtgagccactgagcccggccacagtgcagtatttctaaccagtgatcagggtaaagaggatgcgtgtccaccatcccagccctgatcagcctgtctgtgcatcccccatcccagccagggcttggagcagccttgctcaccactgtgtcccctgcattgtaacacatccaggcacaagaatagccgcccagtgactgccaagtgagtgaaccagcctgcttggagcctgcctctttcccaaactgctcattatcctgttaccccacccagcccacgtgtccaaatacactccagatgcaaaataaaaagctctacgacaatggctctgaatgttc

SEQ ID NO: 371959 - DNA, 1306 bp, Homo sapiens
ggaggtgcactttacttcctgactcctttcctttttccagtggttatcgcggcgcccaccggcctctgatctctgagtcttctccaacccacagacgttttttgttgctctggttccaggaccttctccacaactaggccattttccctgccaggtgtcctttttgacctcttgacctctgactcaaaggtcagctcaaaggttccgaactcgggcctgggatgtgagggggtactgaacctaagttctccgaatctttagccctgggtccctaagtcgcatccttaaggcacctcactctagatctgagccttcatatcccaaactcactcatgagtttccacatccagccccaaagaatgagttaactcctactaactctccacctaagactcccgaggtaacccaaccggtaccacagatccggttccggatttaaggaccccaccctgttaaccgtcaggtgccttatgacttgagtcagcctcgcaattcctgctcccgtggtttcaaatattagccctggtcctttcacacccactgctcagtccccagattctggaactcagctcttaaacctttaaaatctccatccctgagaccgttctccgttggaggatccttccctccccgctttctgaacctctcaacacctcctgtagaccccaaaatgacttctccatgctctcctcccctaaaaccaccaatttctcctccaaaaacccctgtaccccaagccagcagcattccatctcctcctctacccccaagtcccctggacttttcagctttaccatcccctccctggagtcagcagacccctgttcccccaccgctcccactgcctcctccacccgctgccacagggcctgctccccctcatgtcttcggcctggagaagagccagctcctgaaggaggcctttgataaggccggcccggtccccaagggcagagaagatgtgaagaggcttctgaaactacacaaggaccggttccgaggtgacctgcggtggatcctcttctgtgcagacctgccgtccctcatccaagaaggccctcagtatgtgccctgatgcgggaaccccagcccatctgctgcctttactctgcccttgctgggcttcttaaggactgatctggagaagaggagtggattgtccctgctgggaggaggagggaaggaaagggggaactttccactcaggcttctgagtgcctgcatagtaaacatagttgggacatgcgaaggaatgaacgaatgagcctggtccatctctctaactccaccttggttcctcctccca

SEQ ID NO: 371960 - DNA, 2159 bp, Homo sapiens
ggaggtgcactttacttcctgactcctttcctttttccagtggttatcgcggcgcccaccggcctctgatctctgagtcttctccaacccacagacgttttttgttgctctggttccaggaccttctccacaactaggccattttccctgccaggtgtcctttttgacctcttgacctctgactcaaaggtcagctcaaaggttccgaactcgggcctgggatgtgagggggtactgaacctaagttctccgaatctttagccctgggtccctaagtcgcatccttaaggcacctcactctagatctgagccttcatatcccaaactcactcatgagtttccacatccagccccaaagaatgagttaactcctactaactctccacctaagactcccgaggtaacccaaccggtaccacagatccggttccggatttaaggaccccaccctgttaaccgtcaggtgccttatgacttgagtcagcctcgcaattcctgctcccgtggtttcaaatattagccctggtcctttcacacccactgctcagtccccagattctggaactcagctcttaaacctttaaaatctccatccctgagaccgttctccgttggaggatccttccctccccgctttctgaacctctcaacacctcctgtagaccccaaaatgacttctccatgctctcctcccctaaaaccaccaatttctcctccaaaaacccctgtaccccaagccagcagcattccatctcctcctctacccccaagtcccctggacttttcagctttaccatcccctccctggagtcagcagacccctgttcccccaccgctcccactgcctcctccacccgctgccacagggcctgctccccctcatgtcttcggcctggagaagagccagctcctgaaggaggcctttgataaggccggcccggtccccaagggcagagaagatgtgaagaggcttctgaaactacacaaggaccggttccgaggtgacctgcggtggatcctcttctgtgcagacctgccgtccctcatccaagaaggccctcaatgcgggctggtggccttgtggatggcaggtactctcctgtcgccccccagtggcgtccccctggagagactcatacgggtggccacggaaagaggctacacggcccagggagagatgttctcagcaccagctacgacgaggacttcaaccatgagccgtgtcagaggaagggccacaaggcacactgggcggtgagtgcaggggtcctgctgggtgttcgggctgtgcccagtctcggctacactgaggaccctgagctgccgggcctgttccacccagtgctgggcacgccctgccaaccaccatccctgccagaggagggctccccgggagctgtctacctgctgtccaagcagggcaagagttggcactatcagctgtgggactacgaccaggtccgggagagcaacctgcagctgacggacttctcgccctcacgggccactgacggccgggtgtacgtggtgcccgtgggtggggtacgggctggcctctgtggccaggccctgctcctcacaccacaggactgcagccattagctgcggctgcggtctcaggctgcagcctagctcggtaaccatttgaagtgtgcctacacttctcccactgtgtgatggcgacaagattgaagctaggtctcaggggtctccagtcctccttcatcagggccaccccctgcagtattgagcaccagctggtccctctagggagagattgacaacagcccggaccctgcggcctgcctattccatctgaatgtcgcatcgtctgtttctcactaggggccgcctctgtcatctcactagacatttgaggaacctcctgcctgggccctctgcttctcacaggacagggacactgaactgcgtcagcctcagctcacccctccttagcccaaggtcttcctcatgcttgccacctactagtcatactggccttttagatccctgaagtgttgttcaaatccccggatcattgagtcccacccccagccctctgctgcggatcactccttaacttttccattggggctcaggtatcactacctcagggaagagtcctgcagccccagtcaagacacccctcccccacctca

SEQ ID NO: 371961 - DNA, 1428 bp, Homo sapiens
ggaggtgcactttacttcctgactcctttcctttttccagtggttatcgcggcgcccaccggcctctgatctctgagtcttctccaacccacagacgttttttgttgctctggttccaggaccttctccacaactaggccattttccctgccaggtgtcctttttgacctcttgacctctgactcaaaggtcagctcaaaggttccgaactcgggcctgggatgtgagggggtactgaacctaagttctccgaatctttagccctgggtccctaagtcgcatccttaaggcacctcactctagatctgagccttcatatcccaaactcactcatgagtttccacatccagccccaaagaatgagttaactcctactaactctccacctaagactcccgaggtaacccaaccggtaccacagatccggttccggatttaaggaccccaccctgttaaccgtcaggtgccttatgacttgagtcagcctcgcaattcctgctcccgtggtttcaaatattagccctggtcctttcacacccactgctcagtccccagattctggaactcagctcttaaacctttaaaatctccatccctgagaccgttctccgttggaggatccttccctccccgctttctgaacctctcaacacctcctgtagaccccaaaatgacttctccatgctctcctcccctaaaaccaccaatttctcctccaaaaacccctgtaccccaagccagcagcattccatctcctcctctacccccaagtcccctggacttttcagctttaccatcccctccctggagtcagcagacccctgttcccccaccgctcccactgcctcctccacccgctgccacagggcctgctccccctcatgtcttcggcctggagaagagccagctcctgaaggaggcctttgataaggccggcccggtccccaagggcagagaagatgtgaagaggcttctgaaactacacaaggaccggttccgaggtgacctgcggtggatcctcttctgtgcagacctgccgtccctcatccaagaaggccctcaatgcgggctggtggccttgtggatggcaggtactctcctgtcgccccccagtggcgtccccctggagagactcatacgggtggccacggaaagaggctacacggcccagggagagatgttctcagcaccagctacgacgaggacttcaaccatgagccgtgtcagaggaagggccacaaggcacactgggcggtgagtgcaggcacaagaatagccgcccagtgactgccaagtgagtgaaccagcctgcttggagcctgcctctttcccaaactgctcattatcctgttaccccacccagcccacgtgtccaaatacactccagatgcaaaataaaaagctctacgacaatggctctgaatgttc

SEQ ID NO: 371962 - DNA, 267 bp, Homo sapiens
ggctgccctctttgctgttcctaaacaagccccttcccaccccagccttcattgctcttcttcttcctgagtcccaattcctgagtgagccagctggcttttccctcactttctttgagaacttgctcaagcaccttgtcagtgaggaatcctgtgcccttcctttgtaagtcagtttcccaactgtcctaatatctttatcattctctatttttcaccatagaatgtatctaacatgacgaactatgtatttactcaatacttgtt

SEQ ID NO: 371963 - DNA, 1276 bp, Homo sapiens
tttgtactacaatacaaaaaaaataagtgaatcatttatttcagagaatagccatttgcaaacgttcactgtaaaaatctagaggatagaaaacctaaaaagttttgtttaggtttgtcaatttaagtgggagggatatatttctaaagaatatgtcctaaagctgtgccaagtatgtgcaagtccaagtatggcaagagatgaccctggactctgtggtggttgcagacaaataatacataactttcaaaaccagccccatagtgagtcagagtagtgggcatttgtacagaggaggaagctgacattgtcttttaatccaaacagcaatcctgggtggctctggtggaatgaggtatttaatcacctcaccggtgatccttgttgggtctttcttgttgagtaaatacttggcagccttagtcattagcttgaaaggcagagggaaaagtaaaccttcatgagtgagtacccagctgaggtgtttgtttaggctaatcccaaatgccctttagggcctaactcagtgctgcccctcccctacttcactgtgaagctgcagctgtggagccaacattttatcttatttattctctatgtgcaggttcccaaacataattattggatgaatgaatgaacaagaagatgactatggaggatacttgggatctggctagcaacaagtatatttcccattgttagaggtagttgggtcagaaattagatcagtgcttctcagcatttctctgttcaatgcatactttttggtggcacccataaagaaatcaaaaggggaatatccctttttagcaagaagtatttagaaaatctaaaagaactcttcctcctattcattgggtcacttttcagccctgcatcactgtttacagaaaagtgttaacatcttggactcgtgaagcaatgttttcacacattctagaagaagcttgctggaagggttctgtggaggtctcccacctgtggaagaaggtgatagaaaaattagcctgataatggaactgtcaacccaggtttcccttcagactgagagaattactcagctgaaagaagttttggaggaaaaggaaaggaagattcagcagctggaagctgagcggagtccccatcctccccaagaggtcaaggaccctccaggatgtttaccagaagccccagttttctctactcatgacatcccacctgtggtctctgatgagaatttgtagattcccaataagaaaacaataaaagtttattaagtgtcatccaggtaaaa

SEQ ID NO: 371964 - DNA, 398 bp, Homo sapiens
taatcacaatcataccattatgtcaaaatccctcaaacaacccaaacattttcatagtcactaagaagcttgctggaagggttctgtggaggtctcccacctgtggaagaaggtgatagaaaaattagcctgataatggaactgtcaacccaggtttcccttcagactgagagaattactcagctgaaagaagttttggaggaaaaggaaaggaagattcagcagctggaagctgagcggagtccccatcctccccaagaggtcaaggaccctccaggatgtttaccagaagccccagttttctctactcatgacatcccacctgtggtctctgatgagaatttgtagattcccaataagaaaacaataaaagtttattaagtgtcatccaggtaaaa

SEQ ID NO: 371965 - DNA, 993 bp, Homo sapiens
tttgtactacaatacaaaaaaaataagtgaatcatttatttcagagaatagccatttgcaaacgttcactgtaaaaatctagaggatagaaaacctaaaaagttttgtttaggtttgtcaatttaagtgggagggatatatttctaaagaatatgtcctaaagctgtgccaagtatgtgcaagtccaagtatggcaagagatgaccctggactctgtggtggttgcagacaaataatacataactttcaaaaccagccccatagtgagtcagagtagtgggcatttgtacagaggaggaagctgacattgtcttttaatccaaacagcaatcctgggtggctctggtggaatgaggtatttaatcacctcaccggtgatccttgttgggtctttcttgttgagtaaatacttggcagccttagtcattagcttgaaaggcagagggaaaagtaaaccttcatgagtgagtacccagctgaggtgtttgtttaggctaatcccaaatgccctttagggcctaactcagtgctgcccctcccctacttcactgtgaagctgcagctgtggagccaacattttatcttatttattctctatgtgcaggttcccaaacataattattggatgaatgaatgaacaagaagatgactatggaggatacttgggatctggctagcaacaagtatatttcccattgttagaggtagttgggtcagaaattagatcagtgcttctcagcatttctctgttcaatgcatactttttggtggcacccataaagaaatcaaaaggggaatatccctttttagcaagaagtatttagaaaatctaaaagaactcttcctcctattcattgggtcacttttcagccctgcatcactgtttacagaaaagtgttaacatcttggactcgtgaagcaatgttttcacacattctaggtatgttgacctaatatgaaaccactccttcttgctctgattagcaacaagtg

SEQ ID NO: 371966 - DNA, 274 bp, Homo sapiens
tgggacgcaagcgtgtgccaccatgcccggctaatttgttggtgttgttgttgttgttttttgcttgtttgtttgtttgtttttttgtaggaatgaggttttgccatgttgccccaggagttcgagaccagcctgagcaacatggggagtcccagtctctacaaaaaaataaaaaaattagcagagcgtgacagtgtgtgcttgttatcccagctactgaggagcctgatgtaggacgattgcctgaatctgggagggcaaggctgcagagagc

SEQ ID NO: 371967 - DNA, 421 bp, Homo sapiens
gtcattgtggccagggtgaactgctcattgcagtgatgcgaaaaggtgaggtcacaggacacaaacccatatctgagacctggatgcctccctccacgcactcacccactggctgtcctgagcatcaccctgcacctgttgtcccagcaacaagggaaaaataaggtctattgctcaggctggagtgaagtggtgcaattgtggctcactgcagccttgaatacctcagctcaaacgatcctcccacctcagcctcctgagtagctgggaccacagcatagtggtcaagtccattgtcagcttctgacactgcctcttacaaggaggtgactttggaaatgtcattcagccttcctgtgcccgaaatcacctcacctgtcaaatgggaacaataaagcacttcaaagaattgttgtaaaag

SEQ ID NO: 371968 - DNA, 310 bp, Homo sapiens
gtcattgtggccagggtgaactgctcattgcagtgatgcgaaaaggtgaggtcacaggacacaaacccatatctgagacctggatgcctccctccacgcactcacccactggctgtcctgagcatcaccctgcacctgttgtcccagcaacaagggaaaaataagcatagtggtcaagtccattgtcagcttctgacactgcctcttacaaggaggtgactttggaaatgtcattcagccttcctgtgcccgaaatcacctcacctgtcaaatgggaacaataaagcacttcaaagaattgttgtaaaag

SEQ ID NO: 371969 - DNA, 296 bp, Homo sapiens
tgcaccaccatgtccagctaattttttatttttattttttgtagaggtggggtctcaccatgttatccagactggattttgtctttttaatttcaaatttcaatcgttcattgctggcatataagaaaacaattgactcttgtgtattaatcctgcatcttgtgctcactttggaaacagatttactaaaattggaatgatacagagaagattagcatagcctctgtgcaaggatagagttgtgaagcattctttatgtgtcttcagcttgggcaagagtgacaccctatctctga

SEQ ID NO: 371970 - DNA, 416 bp, Homo sapiens
actgtctgctccaacccctaccccaacaccacactcagatttttccaagtgatgtcacacagatgcctcaaattcgatgagtccagaacaggaccctctatgcccctcaccttctccccacgagccctccatctcaacaaagaccaccaccatccaaccactctgcggctcaggcctctgaatccacttggactcccctctcagccctgtcccgtctgtaggcaaacccatatcccacccctccttgtcctccaggttccacctcccagccccgaaagtaatcactgtcccttaaggattccccctgctcaaggattcctctggcagtccactaccctgacagcaaacacagaggtttgttgtttttttttaaattttagtaacatatacacaacataaaatttgtccaaactatt

SEQ ID NO: 371971 - DNA, 277 bp, Homo sapiens
ataatgcccaaaataacagctgttgttagaattggtgtatttttgtcttttgtaaataagtagtatttctccagtctttaaccagtacagtcatacattgcttaatgatagggatacattctgagaaatgggttcattaggtgatttcattgttgtgcaaacatcatagagtgtagttagaagcctaaatggtataggctttacaaatctatacagcatgttactatactgtaggcaactgtaacacaatggtaagtatctaaacatgtctaaacat

SEQ ID NO: 371972 - DNA, 544 bp, Homo sapiens
ctcagtgagcactactcacagatccacacctgaccctgttgggtcgagtcaggctgggttttggtctgcactgtagcacctgtgttctttcagttcacatcatgaatgtgacttcccagataccatctcaggcttaacctagcacatcctatttcttttcttctatgatatccaaattggactgacctcacttcaaatatcttgtcccattttgtcgtcctatcttacctcggggaaattggggactgatggccagaccaattctgttgaaattcttgcatagagcaaacctgtgctcatttttaagtggcatgggagaggcccccagccatagtaaagcctagtctgtgtcttcacagttttgatagaatgtgcttgtgtgtatagatgtatgatacagatttatttatgttgctatcgccatatattgaaggccaacataactggtggacagggtgggtgacagaaaatgaaagcctttttggtgattgttaaagcaagatgtgtataaagaaataaatagttgttctttcactgctttgtt

SEQ ID NO: 371973 - DNA, 2634 bp, Homo sapiens
aaggaggcggcctccgggaaaagcgaccgcaggactcctgagagcagcctccatgaggccctggaccagtgcatgaccgccctggacctcttcctcaccaaccagttctcagaagcactcagctacctcaagcccagaaccaaggaaagcatgtaccactcactgacatatgccaccatcctggagatgcaggccatgatgacctttgaccctcaggacatcctgcttgccggcaacatgatgaaggaggcacagatgctgtgtcagaggcaccggaggaagtcttctgtaacagattccttcagcagcctggtgaaccgccccacgctgggccaattcactgaagaggaaatccacgctgaggtctgctatgcagagtgcctgctgcagcgagcagccctgaccttcctgcaggacgagaacatggtgagcttcatcaaaggcggcatcaaagttcgaaacagctaccagacctacaaggagctggacagccttgttcagtcctcacaatactgcaagggtgagaaccacccgcactttgaaggaggagtgaagcttggtgtaggggccttcaacctgacactgtccatgcttcctactaggatcctgaggctgttggagtttgtggggttttcaggaaacaaggactatgggctgctgcagctggaggagggagcgtcagggcacagcttccgctctgtgctctgtgtcatgctcctgctgtgctaccacaccttcctcaccttcgtgctcggtactgggaacgtcaacatcgaggaggccgagaagctcttgaagccctacctgaaccggtaccctaagggtgccatcttcctgttctttgcagggaggattgaagtcattaaaggcaacattgatgcagccatccggcgtttcgaggagtgctgtgaggcccagcagcactggaagcagttccaccacatgtgctactgggagctgatgtggtgcttcacctacaagggccagtggaagatgtcctacttctacgccgacctgctcagcaaggagaactgctggtccaaggccacctacatttacatgaaggccgcctacctcagcatgtttgggaaggaggaccacaagccgttcggggacgacgaagtggaattatttcgagctgtgccaggcctgaagctcaagattgctgggaaatctctacccacagagaagtttgccatccggaagtcccggcgctacttctcctccaaccctatctcgctgccagtgcctgctctggaaatgatgtacatctggaacggctacgccgtgattgggaagcagccgaaactcacggatgggatacttgagattatcactaaggctgaagagatgctggagaaaggcccagagaacgagtactcagtggatgacgagtgcttggtgaaattgttgaaaggcctgtgtctgaaatacctgggccgtgtccaggaggccgaggagaattttaggagcatctctgccaatgaaaagaagattaaatatgaccactacttgatcccaaacgccctgctggagctggccctgctgcttatggagcaagacagaaacgaagaggccatcaaacttttggaatctgccaagcaaaactacaagaattactccatggagtcaaggacacactttcgaatccaggcagccacactccaagccaagtcttccctagagaacagcagcagatccatggtctcatcagtgtccttgtagctttgtgcagcagttccgggctggaagacagagacagctggacagagctcctgaaaacatttcaaaataccccctccccctgccctgccctgcctttggggtccaccggcactccagttggatggcacaacatagtgtatccgtgcagaagccgagctggcattttcaccagtgtagccaagggcctttgccaagggcagagcaggtggagccctctgcctgccctatcacacatacgggtacttgcttttcactgtgatgtttaagagaatgtatgaacagtttacattttccttagaaatacattgatgggatcacagttggctttaaaaaccaacaacaatcaaccacctgtaagtctttgtcttcacctattatcatctggaggtaaatctctttatatgatgatgccaaagggcaaattgcttttcaaattcagcaagttctcagcttgtgtgacggaaggtccttcagaggacctgaggaatgcctgggagaggctaagcctcaggcttcaatgcttctggggttgggcatgaggatgtacacagacacccactaccttactactcacacttcatttcactccttttgtaaatttccaatttaaaaatcaagcacgtctttttagtgagataaaatctgagctcttctgtagaaaaatcaatctctaccagtagaaaatgccagggcttgatggaagagctgtgtagccctttctatgccaaagccaggaaatttggggggcaggaggaggttctcagaatccagtctgtatctttgctgtatgccaaactgaaaccactgggaataatttatgaaacataaaaatcttctgtacttcactccaaggtacatttgcttactgacagcatttttgttaaaactgttattcttgaaaattgtgta

SEQ ID NO: 371974 - DNA, 1872 bp, Homo sapiens
acagcgcccggctcggggttgcggcggcagcacctgggccgcgattggcgtccggctggggcagcgccgcccgcgcccctcggcgatgacctcggctggcggcgccccaggagccctgcccgcggggactcctgagagcagcctccatgaggccctggaccagtgcatgaccgccctggacctcttcctcaccaaccagttctcagaagcactcagctacctcaagcccagaaccaaggaaagcatgtaccactcactgacatatgccaccatcctggagatgcaggccatgatgacctttgaccctcaggacatcctgcttgccggcaacatgatgaaggaggcacagatgctgtgtcagaggcaccggaggaagtcttctgtaacagattccttcagcagcctggtgaaccgccccacgctgggccaattcactgaagaggaaatccacgctgaggtctgctatgcagagtgcctgctgcagcgagcagccctgaccttcctgcagggttcctcacacggaggggcagtcaggcccagagccttgcatgatccctctcacgcctgcagctgcccacctgggccaggccgtcagcatcttttcctcctgcgacgagaacatggtgagcttcatcaaaggcggcatcaaagttcgaaacagctaccagacctacaaggagctggacagccttgttcagtcctcacaatactgcaagggtgagaaccacccgcactttgaaggaggagtgaagcttggtgtaggggccttcaacctgacactgtccatgcttcctactaggatcctgaggctgttggagtttgtggggttttcaggaaacaaggactatgggctgctgcagctggaggagggagcgtcagggcacagcttccgctctgtgctctgtgtcatgctcctgctgtgctaccacaccttcctcaccttcgtgctcggtactgggaacgtcaacatcgaggaggccgagaagctcttgaagccctacctgaaccggtaccctaagggtgccatcttcctgttctttgcagggaggattgaagtcattaaaggcaacattgatgcagccatccggcgtttcgaggagtgctgtgaggcccagcagcactggaagcagttccaccacatgtgctactgggagctgatgtggtgcttcacctacaagggccagtggaagatgtcctacttctacgccgacctgctcagcaaggagaactgctggtccaaggccacctacatttacatgaaggccgcctacctcagcatgtttgggaaggaggaccacaagccgttcggggacgacgaagtggaattatttcggtgggtcccacatcgtgctcccactgtgtaggccactcccaccgtgtaggccgctatggacagaccagccaggccaccctgagctgtgggcactggggagggaggagtagggtggctccctgcccccacccgcggactgccccccctgcgtgtcctcccctcccatcaccaccccatgctgctgctgctggtggttggagccctttgactttcttcagaggctttctttcacagaaatggttttgctaatatcgtcttcctccgagtctctttcatgtggacagtaggacagatgtggctccaaggtccagggagggaaggtctttcactctgctgagttaacctgagacactcagagaagcacagtagagagctgacagtcggaatcgaacaaacaagagtaaacccagcctctgcttgttcttagctgtgtcaccttggacaacttcagcatctgtaaaatgggaacaacaacctccacctcgcagcactgttttgcaaatcaactagataataaatgttaagagcctggcgcatag

SEQ ID NO: 371975 - DNA, 7134 bp, Homo sapiens
  misc_feature (2079)..(2079): n is a, c, g, or t
  misc_feature (2811)..(2811): n is a, c, g, or t
  misc_feature (3418)..(3418): n is a, c, g, or t
  misc_feature (3443)..(3443): n is a, c, g, or t
  misc_feature (3464)..(3464): n is a, c, g, or t
  misc_feature (3476)..(3476): n is a, c, g, or t
  misc_feature (3539)..(3539): n is a, c, g, or t
  misc_feature (4002)..(4002): n is a, c, g, or t
  misc_feature (5128)..(5128): n is a, c, g, or t
ccccagtctgggggaggttaccgcagacagcctcatcccagttaagcagaagaggtgccggggctgccgagggaaggactgtgcctgtctgcactgactgtccatccggcctggatctttctctccaggactcctgagagcagcctccatgaggccctggaccagtgcatgaccgccctggacctcttcctcaccaaccagttctcagaagcactcagctacctcaagcccagaaccaaggaaagcatgtaccactcactgacatatgccaccatcctggagatgcaggccatgatgacctttgaccctcaggacatcctgcttgccggcaacatgatgaaggaggcacagatgctgtgtcagaggcaccggaggaagtcttctgtaacagattccttcagcagcctggtgaaccgccccacgctgggccaattcactgaagaggaaatccacgctgaggtctgctatgcagagtgcctgctgcagcgagcagccctgaccttcctgcaggacgagaacatggtgagcttcatcaaaggcggcatcaaagttcgaaacagctaccagacctacaaggagctggacagccttgttcagtcctcacaatactgcaagggtgagaaccacccgcactttgaaggaggagtgaagcttggtgtaggggccttcaacctgacactgtccatgcttcctactaggatcctgaggctgttggagtttgtggggttttcaggaaacaaggactatgggctgctgcagctggaggagggagcgtcagggcacagcttccgctctgtgctctgtgtcatgctcctgctgtgctaccacaccttcctcaccttcgtgctcggtactgggaacgtcaacatcgaggaggccgagaagctcttgaagccctacctgaaccggtaccctaagggtgccatcttcctgttctttgcagggaggattgaagtcattaaaggcaacattgatgcagtgagtgatgggggtccgggccggggctggggatccctcggggtctcccagaccagcaggaagtcaggcacatgtgacatactcagggacaggatagactgggggcggggggggggccaagagagaaccaaccagagagcaggggcaggagaggcccttctggcagagcagcctgggaagacaagggaggaggaggcatttgtggtgcctgggattttgactgggagatataggactgcagcattgcagtggagggaggtggagggaggtgcttgagggaggcagaggttaggaaagcccatctgtttagggcatgacgattaggctggagtctggtacctcccctccattatagctctctcctgctctttcattttgttactaaaaaccagagtcctaggcgggggctgtatttgagcccaacgtcatgtaagacttaggaggtaaaaccaggactggaggccagatctcctggctcctggggccccacctgagcctagcacagggctggaccactatgccctggaggagtcccggtctgctgtggtgttgggaggttcggaggatgcagaggggttggggctgggtgggcacccgtcaggctgaccagaaggtgcctgcaggccatccggcgtttcgaggagtgctgtgaggcccagcagcactggaagcagttccaccacatgtgctactgggagctgatgtggtgcttcacctacaagggccagtggaagatgtcctacttctacgccgacctgctcagcaaggagaactgctggtccaaggtgggctgatgccacgtgttaggggcattgggtgaccagggctgactgtgtgcctccagaccacgggccaaatccctaactgaacacagatgtctcagctggaatctaaacataaccttaaattctaataggactcaggcttggaaggaactaaagaccacaagagaaacttctgaaccacaatgtgtcacaaagagatttctagtcacaaaggacagaaacatggctccctctgtccagtagaactgtttctgtggtagaaatgttctacttatgcactgcccaaatatggtagtcaccagccacatgtgcacantgagcacatgaaatgtgcctagtgcaactgggaaactgattgttttcagttttatttaattttaattaactaaatgttaaatttaaatagccatgtagggcttgtggccactatattggactatgcaggtccaaaacacaaaaggctcatataactgaacattcttggcacatccgacttcaggtagggctggatccaggaattcaaatgatgtcgtctggcttggtctttccatttgtggctgtgctctctcctatgacatctttgtttctgctgcatctttgcaggaaggttctctccatgtgacaggcaaggtggccacgggctgcttctactcatatcctccccttggtttcaaccagagtcccacagtttgagcctcactggtctgacttgtcacctgccaatgcctggaacagaggggtgggaagattcctcatgggctgagagtaggagaggggtggttccacagaagaaaatgatgcacccagaaatagtggagggattaacaagatgccatacaggcaaaacaaagccaaacagatgcccgcctaccaaagatgaaatttatcatggtaagtattgaaataagtgttagcttgtaccatcatagtaatgatagtgcagaaattggaaccaagagtcttacaaccacctagctcagcaaacgtctaatctgttatttgtaaatacacaggacatgtgtcttcatggcttcatcccctgcccatngcagacattgctaatcaatcctctgccatgagcctagctgtgaccttagataccttccctgcaaagctccaggcagccgttagaactgacccacattggcacctgttaggagacctgtcatctgcatctggtccctccccctcctctgcatggaggtctcttccgtagccctgcctggggaccaagctgaaggggaattctctgggtctggggcaggtggggctggggaagggagcaggcttctactgagctctcaacatgtctggcacctgtcatgtcctccacaccacacccagtgaggagaagttattatctccattgggcacatgagggccactgatgctaagcgaggactgtgactttcccacccacatggctgttggtgacagacaccggatttgaggacagtcctgtgtgactcagaggcctctgcttctctcttgctcctagagtcctcctgaggagtcggggcttgccctgagcccaccctgctgttgaaggtgcttcctcaggcccagctcccatggcccccacaccccctcctcatcacctcctactcccaaaaaggacaaagcctcagggaaccttttttctttttttagagacngggtcttgctatgttggtcaggctngtcttgaactcctgggcccangcaatcttcccncctctgcctcctaaagtgctgggattctgggccttagggaacctttttgaactgaaagtgacnctcgaagccttcctgtagagtgaggtgggtggctggggctaaccatatggggaaggagagacctggtgggggcacacagctgctatatagaggaacagaaggtgggccaggcctcccagctgtcaggaaatctggctcagtccccagaccgctgtgtggctttggggtggccagtccctctctctctgcaacactctcctcatgaggacttctgtgaaaaatgggggttgtaaccctctgagttctggggccccacccatttctaatctccagaacttggccaccacagactccaccaacttctagtcctggggcctgggcctctggccattgccataggcaccacctgctctgtgcaggcagcgcccccctctgccaggatcctccgaggtcagctgctgggtctgacccgcagaccctggctgagcgacggatgaacggagtatgcagacacaggcttgcntgtcagcagatgggggacccctgccagagtcagcagcggcccccataagcctgccacgcttgcatttatttagtacagatgtaatgacaaaggcctaaagcaaactccatttgtgggtaattaacattgtcgcccccccagaaagagcagtcctccgcatgatgattaaaggccaggttccgaggcctaagtaaaccaacttatctagatcaattcccttacttcttgttatctactctgagagaattcagctgccttcagccaaatcctttcccgaagcttttgcaaaacctccgagccttccaaggtttgcttctttctgtaatttttctcaccaccctgacctatctcctgcagtcagccctgtggaggcctttgtgtttcccccagtgctggcagcctagaggctgagatggccagaaacaaggtggtgacagtggcgtgctcagggcttgggaaacccaaggagctaaaggcatgcccaggcaaccaaagaggacaggaaggcttctgaggagagacctctgaggtgggtcttggagaggaaggacttagggaggcagagtggaggaagtgagaggacaccccaagccaagagggcggcaggaccaaaggctcagaagccagggcgctgcagaggggctgtgtgccacagggtgaagagtttgtgtggcagaagggcagggggcttgcatcaggggtgacagctgctcttttgtcccagcatagcccctgtacatccctggagagctggggcgtccacaactctaagtcacagcccccatcctaaccctggtggtgcagtgagggtgagctgtctgtgggcaggagggaagactcttggagatgagcctggtgaagggataatggcatcccgggccgaggagcagcacaggcagaggcctggggagagtttaaggagtgtaggggaggaaatggcagaagatgagccagaaaaagaaaggttagggcaggtcctggaggacatgagtggctgtttgggctttatccagcagtgggggagccttggcaggcttgtggcttagataggtgctttagaaagcccaccagcagttgctgggccaccccgctggctgggtcctgttctaaggcaggaaatacaagnatgagcaggaaaagaccccctcaaggctcacgtcctagtggggagacaagaaacacagatgggcaatataacacgatgtctggttccagtaagtgcagtgaagaacaagcgaggctggatgcagggagtgatgggaggggctttgtaaggggaggtcgggggaagcctgtctcagaggacaccagaatggagcgcaggagcagcacgtggcagtcacatggcaggccgttagggcagagggagctgggcagggcacagcagggcaggagtgtgtttgatgtgtcctgggaaccgccctgaggccgtcgtgtggctggagtgctgcaggtgtcaaggaaattgtaggagatgtctcctgagtgtgatggaatataaccagatttccagaaggaactgacatgatctgacttaaaaaggccacctacatttacatgaaggccgcctacctcagcatgtttgggaaggaggaccacaagccgttcggggacgacgaagtggaattatttcgagctgtgccaggcctgaagctcaagattgctgggaaatctctacccacagagaagtttgccatccggaagtcccggcgctacttctcctccaaccctatctcgctgccagtgcctgctctggaaatgatgtacatctggaacggctacgccgtgattgggaagcagccgaaactcacggatgggatacttgagattatcactaaggctgaagagatgctggagaaaggcccagagaacgagtactcagtggatgacgagtgcttggtgaaattgttgaaaggcctgtgtctgaaatacctgggccgtgtccaggaggccgaggagaattttaggagcatctctgccaatgaaaagaagattaaatatgaccactacttgatcccaaacgccctgctggagctggccctgctgcttatggagcaagacagaaacgaagaggccatcaaacttttggaatctgccaagcaaaactacaagaattactccatggagtcaaggacacactttcgaatccaggcagccacactccaagccaagtcttccctagagaacagcagcagatccatggtctcatcagtgtccttgtagctttgtgcagcagttccgggctggaagacagagacagctggacagagctcctgaaaacatttcaaaataccccctccccctgccctgccctgcctttggggtccaccggcactccagttggatggcacaacatagtgtatccgtgcagaagccgagctggcattttcaccagtgtagccaagggcctttgccaagggcagagcaggtggagccctctgcctgccctatcacacatacgggtacttgcttttcactgtgatgtttaagagaatgtatgaacagtttacattttccttagaaatacattgatgggatcacagttggctttaaaaaccaacaacaatcaaccacctgtaagtctttgtcttcacctattatcatctggaggtaaatctctttatatgatgatgccaaagggcaaattgcttttcaaattcagcaagttctcagcttgtgtgacggaaggtccttcagaggacctgaggaatgcctgggagaggctaagcctcaggcttcaatgcttctggggttgggcatgaggatgtacacagacacccactaccttactactcacacttcatttcactccttttgtaaatttccaatttaaaaatcaagcacgtctttttagtgagataaaatctgagctcttctgtagaaaaatcaatctctaccagtagaaaatgccagggcttgatggaagagctgtgtagccctttctatgccaaagccaggaaatttggggggcaggaggaggttctcagaatccagtctgtatctttgctgtatgccaaactgaaaccactgggaataatttatgaaacataaaaatcttctgtacttcactccaaggtacatttgcttactgacagcatttttgttaaaactgttattcttgaaaattgtgta

SEQ ID NO: 371976 - DNA, 7253 bp, Homo sapiens
  misc_feature (2198)..(2198): n is a, c, g, or t
  misc_feature (2930)..(2930): n is a, c, g, or t
  misc_feature (3537)..(3537): n is a, c, g, or t
  misc_feature (3562)..(3562): n is a, c, g, or t
  misc_feature (3583)..(3583): n is a, c, g, or t
  misc_feature (3595)..(3595): n is a, c, g, or t
  misc_feature (3658)..(3658): n is a, c, g, or t
  misc_feature (4121)..(4121): n is a, c, g, or t
  misc_feature (5247)..(5247): n is a, c, g, or t
aggcctgggggagggaggaggccttggagaaggaggagggaaaaaggggctgtgggatttagtggctgggctgcaccccctgggggggcagcagagcccaatgggccagaagggccacaaagactccctttacccttgtggagggactcctgagagcagcctccatgaggccctggaccagtgcatgaccgccctggacctcttcctcaccaaccagttctcagaagcactcagctacctcaagcccagaaccaaggaaagcatgtaccactcactgacatatgccaccatcctggagatgcaggccatgatgacctttgaccctcaggacatcctgcttgccggcaacatgatgaaggaggcacagatgctgtgtcagaggcaccggaggaagtcttctgtaacagattccttcagcagcctggtgaaccgccccacgctgggccaattcactgaagaggaaatccacgctgaggtctgctatgcagagtgcctgctgcagcgagcagccctgaccttcctgcagggttcctcacacggaggggcagtcaggcccagagccttgcatgatccctctcacgcctgcagctgcccacctgggccaggccgtcagcatcttttcctcctgcgacgagaacatggtgagcttcatcaaaggcggcatcaaagttcgaaacagctaccagacctacaaggagctggacagccttgttcagtcctcacaatactgcaagggtgagaaccacccgcactttgaaggaggagtgaagcttggtgtaggggccttcaacctgacactgtccatgcttcctactaggatcctgaggctgttggagtttgtggggttttcaggaaacaaggactatgggctgctgcagctggaggagggagcgtcagggcacagcttccgctctgtgctctgtgtcatgctcctgctgtgctaccacaccttcctcaccttcgtgctcggtactgggaacgtcaacatcgaggaggccgagaagctcttgaagccctacctgaaccggtaccctaagggtgccatcttcctgttctttgcagggaggattgaagtcattaaaggcaacattgatgcagtgagtgatgggggtccgggccggggctggggatccctcggggtctcccagaccagcaggaagtcaggcacatgtgacatactcagggacaggatagactgggggcggggggggggccaagagagaaccaaccagagagcaggggcaggagaggcccttctggcagagcagcctgggaagacaagggaggaggaggcatttgtggtgcctgggattttgactgggagatataggactgcagcattgcagtggagggaggtggagggaggtgcttgagggaggcagaggttaggaaagcccatctgtttagggcatgacgattaggctggagtctggtacctcccctccattatagctctctcctgctctttcattttgttactaaaaaccagagtcctaggcgggggctgtatttgagcccaacgtcatgtaagacttaggaggtaaaaccaggactggaggccagatctcctggctcctggggccccacctgagcctagcacagggctggaccactatgccctggaggagtcccggtctgctgtggtgttgggaggttcggaggatgcagaggggttggggctgggtgggcacccgtcaggctgaccagaaggtgcctgcaggccatccggcgtttcgaggagtgctgtgaggcccagcagcactggaagcagttccaccacatgtgctactgggagctgatgtggtgcttcacctacaagggccagtggaagatgtcctacttctacgccgacctgctcagcaaggagaactgctggtccaaggtgggctgatgccacgtgttaggggcattgggtgaccagggctgactgtgtgcctccagaccacgggccaaatccctaactgaacacagatgtctcagctggaatctaaacataaccttaaattctaataggactcaggcttggaaggaactaaagaccacaagagaaacttctgaaccacaatgtgtcacaaagagatttctagtcacaaaggacagaaacatggctccctctgtccagtagaactgtttctgtggtagaaatgttctacttatgcactgcccaaatatggtagtcaccagccacatgtgcacantgagcacatgaaatgtgcctagtgcaactgggaaactgattgttttcagttttatttaattttaattaactaaatgttaaatttaaatagccatgtagggcttgtggccactatattggactatgcaggtccaaaacacaaaaggctcatataactgaacattcttggcacatccgacttcaggtagggctggatccaggaattcaaatgatgtcgtctggcttggtctttccatttgtggctgtgctctctcctatgacatctttgtttctgctgcatctttgcaggaaggttctctccatgtgacaggcaaggtggccacgggctgcttctactcatatcctccccttggtttcaaccagagtcccacagtttgagcctcactggtctgacttgtcacctgccaatgcctggaacagaggggtgggaagattcctcatgggctgagagtaggagaggggtggttccacagaagaaaatgatgcacccagaaatagtggagggattaacaagatgccatacaggcaaaacaaagccaaacagatgcccgcctaccaaagatgaaatttatcatggtaagtattgaaataagtgttagcttgtaccatcatagtaatgatagtgcagaaattggaaccaagagtcttacaaccacctagctcagcaaacgtctaatctgttatttgtaaatacacaggacatgtgtcttcatggcttcatcccctgcccatngcagacattgctaatcaatcctctgccatgagcctagctgtgaccttagataccttccctgcaaagctccaggcagccgttagaactgacccacattggcacctgttaggagacctgtcatctgcatctggtccctccccctcctctgcatggaggtctcttccgtagccctgcctggggaccaagctgaaggggaattctctgggtctggggcaggtggggctggggaagggagcaggcttctactgagctctcaacatgtctggcacctgtcatgtcctccacaccacacccagtgaggagaagttattatctccattgggcacatgagggccactgatgctaagcgaggactgtgactttcccacccacatggctgttggtgacagacaccggatttgaggacagtcctgtgtgactcagaggcctctgcttctctcttgctcctagagtcctcctgaggagtcggggcttgccctgagcccaccctgctgttgaaggtgcttcctcaggcccagctcccatggcccccacaccccctcctcatcacctcctactcccaaaaaggacaaagcctcagggaaccttttttctttttttagagacngggtcttgctatgttggtcaggctngtcttgaactcctgggcccangcaatcttcccncctctgcctcctaaagtgctgggattctgggccttagggaacctttttgaactgaaagtgacnctcgaagccttcctgtagagtgaggtgggtggctggggctaaccatatggggaaggagagacctggtgggggcacacagctgctatatagaggaacagaaggtgggccaggcctcccagctgtcaggaaatctggctcagtccccagaccgctgtgtggctttggggtggccagtccctctctctctgcaacactctcctcatgaggacttctgtgaaaaatgggggttgtaaccctctgagttctggggccccacccatttctaatctccagaacttggccaccacagactccaccaacttctagtcctggggcctgggcctctggccattgccataggcaccacctgctctgtgcaggcagcgcccccctctgccaggatcctccgaggtcagctgctgggtctgacccgcagaccctggctgagcgacggatgaacggagtatgcagacacaggcttgcntgtcagcagatgggggacccctgccagagtcagcagcggcccccataagcctgccacgcttgcatttatttagtacagatgtaatgacaaaggcctaaagcaaactccatttgtgggtaattaacattgtcgcccccccagaaagagcagtcctccgcatgatgattaaaggccaggttccgaggcctaagtaaaccaacttatctagatcaattcccttacttcttgttatctactctgagagaattcagctgccttcagccaaatcctttcccgaagcttttgcaaaacctccgagccttccaaggtttgcttctttctgtaatttttctcaccaccctgacctatctcctgcagtcagccctgtggaggcctttgtgtttcccccagtgctggcagcctagaggctgagatggccagaaacaaggtggtgacagtggcgtgctcagggcttgggaaacccaaggagctaaaggcatgcccaggcaaccaaagaggacaggaaggcttctgaggagagacctctgaggtgggtcttggagaggaaggacttagggaggcagagtggaggaagtgagaggacaccccaagccaagagggcggcaggaccaaaggctcagaagccagggcgctgcagaggggctgtgtgccacagggtgaagagtttgtgtggcagaagggcagggggcttgcatcaggggtgacagctgctcttttgtcccagcatagcccctgtacatccctggagagctggggcgtccacaactctaagtcacagcccccatcctaaccctggtggtgcagtgagggtgagctgtctgtgggcaggagggaagactcttggagatgagcctggtgaagggataatggcatcccgggccgaggagcagcacaggcagaggcctggggagagtttaaggagtgtaggggaggaaatggcagaagatgagccagaaaaagaaaggttagggcaggtcctggaggacatgagtggctgtttgggctttatccagcagtgggggagccttggcaggcttgtggcttagataggtgctttagaaagcccaccagcagttgctgggccaccccgctggctgggtcctgttctaaggcaggaaatacaagnatgagcaggaaaagaccccctcaaggctcacgtcctagtggggagacaagaaacacagatgggcaatataacacgatgtctggttccagtaagtgcagtgaagaacaagcgaggctggatgcagggagtgatgggaggggctttgtaaggggaggtcgggggaagcctgtctcagaggacaccagaatggagcgcaggagcagcacgtggcagtcacatggcaggccgttagggcagagggagctgggcagggcacagcagggcaggagtgtgtttgatgtgtcctgggaaccgccctgaggccgtcgtgtggctggagtgctgcaggtgtcaaggaaattgtaggagatgtctcctgagtgtgatggaatataaccagatttccagaaggaactgacatgatctgacttaaaaaggccacctacatttacatgaaggccgcctacctcagcatgtttgggaaggaggaccacaagccgttcggggacgacgaagtggaattatttcgagctgtgccaggcctgaagctcaagattgctgggaaatctctacccacagagaagtttgccatccggaagtcccggcgctacttctcctccaaccctatctcgctgccagtgcctgctctggaaatgatgtacatctggaacggctacgccgtgattgggaagcagccgaaactcacggatgggatacttgagattatcactaaggctgaagagatgctggagaaaggcccagagaacgagtactcagtggatgacgagtgcttggtgaaattgttgaaaggcctgtgtctgaaatacctgggccgtgtccaggaggccgaggagaattttaggagcatctctgccaatgaaaagaagattaaatatgaccactacttgatcccaaacgccctgctggagctggccctgctgcttatggagcaagacagaaacgaagaggccatcaaacttttggaatctgccaagcaaaactacaagaattactccatggagtcaaggacacactttcgaatccaggcagccacactccaagccaagtcttccctagagaacagcagcagatccatggtctcatcagtgtccttgtagctttgtgcagcagttccgggctggaagacagagacagctggacagagctcctgaaaacatttcaaaataccccctccccctgccctgccctgcctttggggtccaccggcactccagttggatggcacaacatagtgtatccgtgcagaagccgagctggcattttcaccagtgtagccaagggcctttgccaagggcagagcaggtggagccctctgcctgccctatcacacatacgggtacttgcttttcactgtgatgtttaagagaatgtatgaacagtttacattttccttagaaatacattgatgggatcacagttggctttaaaaaccaacaacaatcaaccacctgtaagtctttgtcttcacctattatcatctggaggtaaatctctttatatgatgatgccaaagggcaaattgcttttcaaattcagcaagttctcagcttgtgtgacggaaggtccttcagaggacctgaggaatgcctgggagaggctaagcctcaggcttcaatgcttctggggttgggcatgaggatgtacacagacacccactaccttactactcacacttcatttcactccttttgtaaatttccaatttaaaaatcaagcacgtctttttagtgagataaaatctgagctcttctgtagaaaaatcaatctctaccagtagaaaatgccagggcttgatggaagagctgtgtagccctttctatgccaaagccaggaaatttggggggcaggaggaggttctcagaatccagtctgtatctttgctgtatgccaaactgaaaccactgggaataatttatgaaacataaaaatcttctgtacttcactccaaggtacatttgcttactgacagcatttttgttaaaactgttattcttgaaaattgtgta

SEQ ID NO: 371977 - DNA, 7273 bp, Homo sapiens
  misc_feature (2218)..(2218): n is a, c, g, or t
  misc_feature (2950)..(2950): n is a, c, g, or t
  misc_feature (3557)..(3557): n is a, c, g, or t
  misc_feature (3582)..(3582): n is a, c, g, or t
  misc_feature (3603)..(3603): n is a, c, g, or t
  misc_feature (3615)..(3615): n is a, c, g, or t
  misc_feature (3678)..(3678): n is a, c, g, or t
  misc_feature (4141)..(4141): n is a, c, g, or t
  misc_feature (5267)..(5267): n is a, c, g, or t
caactttctcacggagctgtagtcacagacacgttcagagcagccttccccacctgcctcgtggcgttcactcctgtggggtgggccctgttactctcatccccattacagatgaggaaactgagacacagcacttaagtgacttgtcatcggtcacccaggaggactcctgagagcagcctccatgaggccctggaccagtgcatgaccgccctggacctcttcctcaccaaccagttctcagaagcactcagctacctcaagcccagaaccaaggaaagcatgtaccactcactgacatatgccaccatcctggagatgcaggccatgatgacctttgaccctcaggacatcctgcttgccggcaacatgatgaaggaggcacagatgctgtgtcagaggcaccggaggaagtcttctgtaacagattccttcagcagcctggtgaaccgccccacgctgggccaattcactgaagaggaaatccacgctgaggtctgctatgcagagtgcctgctgcagcgagcagccctgaccttcctgcagggttcctcacacggaggggcagtcaggcccagagccttgcatgatccctctcacgcctgcagctgcccacctgggccaggccgtcagcatcttttcctcctgcgacgagaacatggtgagcttcatcaaaggcggcatcaaagttcgaaacagctaccagacctacaaggagctggacagccttgttcagtcctcacaatactgcaagggtgagaaccacccgcactttgaaggaggagtgaagcttggtgtaggggccttcaacctgacactgtccatgcttcctactaggatcctgaggctgttggagtttgtggggttttcaggaaacaaggactatgggctgctgcagctggaggagggagcgtcagggcacagcttccgctctgtgctctgtgtcatgctcctgctgtgctaccacaccttcctcaccttcgtgctcggtactgggaacgtcaacatcgaggaggccgagaagctcttgaagccctacctgaaccggtaccctaagggtgccatcttcctgttctttgcagggaggattgaagtcattaaaggcaacattgatgcagtgagtgatgggggtccgggccggggctggggatccctcggggtctcccagaccagcaggaagtcaggcacatgtgacatactcagggacaggatagactgggggcggggggggggccaagagagaaccaaccagagagcaggggcaggagaggcccttctggcagagcagcctgggaagacaagggaggaggaggcatttgtggtgcctgggattttgactgggagatataggactgcagcattgcagtggagggaggtggagggaggtgcttgagggaggcagaggttaggaaagcccatctgtttagggcatgacgattaggctggagtctggtacctcccctccattatagctctctcctgctctttcattttgttactaaaaaccagagtcctaggcgggggctgtatttgagcccaacgtcatgtaagacttaggaggtaaaaccaggactggaggccagatctcctggctcctggggccccacctgagcctagcacagggctggaccactatgccctggaggagtcccggtctgctgtggtgttgggaggttcggaggatgcagaggggttggggctgggtgggcacccgtcaggctgaccagaaggtgcctgcaggccatccggcgtttcgaggagtgctgtgaggcccagcagcactggaagcagttccaccacatgtgctactgggagctgatgtggtgcttcacctacaagggccagtggaagatgtcctacttctacgccgacctgctcagcaaggagaactgctggtccaaggtgggctgatgccacgtgttaggggcattgggtgaccagggctgactgtgtgcctccagaccacgggccaaatccctaactgaacacagatgtctcagctggaatctaaacataaccttaaattctaataggactcaggcttggaaggaactaaagaccacaagagaaacttctgaaccacaatgtgtcacaaagagatttctagtcacaaaggacagaaacatggctccctctgtccagtagaactgtttctgtggtagaaatgttctacttatgcactgcccaaatatggtagtcaccagccacatgtgcacantgagcacatgaaatgtgcctagtgcaactgggaaactgattgttttcagttttatttaattttaattaactaaatgttaaatttaaatagccatgtagggcttgtggccactatattggactatgcaggtccaaaacacaaaaggctcatataactgaacattcttggcacatccgacttcaggtagggctggatccaggaattcaaatgatgtcgtctggcttggtctttccatttgtggctgtgctctctcctatgacatctttgtttctgctgcatctttgcaggaaggttctctccatgtgacaggcaaggtggccacgggctgcttctactcatatcctccccttggtttcaaccagagtcccacagtttgagcctcactggtctgacttgtcacctgccaatgcctggaacagaggggtgggaagattcctcatgggctgagagtaggagaggggtggttccacagaagaaaatgatgcacccagaaatagtggagggattaacaagatgccatacaggcaaaacaaagccaaacagatgcccgcctaccaaagatgaaatttatcatggtaagtattgaaataagtgttagcttgtaccatcatagtaatgatagtgcagaaattggaaccaagagtcttacaaccacctagctcagcaaacgtctaatctgttatttgtaaatacacaggacatgtgtcttcatggcttcatcccctgcccatngcagacattgctaatcaatcctctgccatgagcctagctgtgaccttagataccttccctgcaaagctccaggcagccgttagaactgacccacattggcacctgttaggagacctgtcatctgcatctggtccctccccctcctctgcatggaggtctcttccgtagccctgcctggggaccaagctgaaggggaattctctgggtctggggcaggtggggctggggaagggagcaggcttctactgagctctcaacatgtctggcacctgtcatgtcctccacaccacacccagtgaggagaagttattatctccattgggcacatgagggccactgatgctaagcgaggactgtgactttcccacccacatggctgttggtgacagacaccggatttgaggacagtcctgtgtgactcagaggcctctgcttctctcttgctcctagagtcctcctgaggagtcggggcttgccctgagcccaccctgctgttgaaggtgcttcctcaggcccagctcccatggcccccacaccccctcctcatcacctcctactcccaaaaaggacaaagcctcagggaaccttttttctttttttagagacngggtcttgctatgttggtcaggctngtcttgaactcctgggcccangcaatcttcccncctctgcctcctaaagtgctgggattctgggccttagggaacctttttgaactgaaagtgacnctcgaagccttcctgtagagtgaggtgggtggctggggctaaccatatggggaaggagagacctggtgggggcacacagctgctatatagaggaacagaaggtgggccaggcctcccagctgtcaggaaatctggctcagtccccagaccgctgtgtggctttggggtggccagtccctctctctctgcaacactctcctcatgaggacttctgtgaaaaatgggggttgtaaccctctgagttctggggccccacccatttctaatctccagaacttggccaccacagactccaccaacttctagtcctggggcctgggcctctggccattgccataggcaccacctgctctgtgcaggcagcgcccccctctgccaggatcctccgaggtcagctgctgggtctgacccgcagaccctggctgagcgacggatgaacggagtatgcagacacaggcttgcntgtcagcagatgggggacccctgccagagtcagcagcggcccccataagcctgccacgcttgcatttatttagtacagatgtaatgacaaaggcctaaagcaaactccatttgtgggtaattaacattgtcgcccccccagaaagagcagtcctccgcatgatgattaaaggccaggttccgaggcctaagtaaaccaacttatctagatcaattcccttacttcttgttatctactctgagagaattcagctgccttcagccaaatcctttcccgaagcttttgcaaaacctccgagccttccaaggtttgcttctttctgtaatttttctcaccaccctgacctatctcctgcagtcagccctgtggaggcctttgtgtttcccccagtgctggcagcctagaggctgagatggccagaaacaaggtggtgacagtggcgtgctcagggcttgggaaacccaaggagctaaaggcatgcccaggcaaccaaagaggacaggaaggcttctgaggagagacctctgaggtgggtcttggagaggaaggacttagggaggcagagtggaggaagtgagaggacaccccaagccaagagggcggcaggaccaaaggctcagaagccagggcgctgcagaggggctgtgtgccacagggtgaagagtttgtgtggcagaagggcagggggcttgcatcaggggtgacagctgctcttttgtcccagcatagcccctgtacatccctggagagctggggcgtccacaactctaagtcacagcccccatcctaaccctggtggtgcagtgagggtgagctgtctgtgggcaggagggaagactcttggagatgagcctggtgaagggataatggcatcccgggccgaggagcagcacaggcagaggcctggggagagtttaaggagtgtaggggaggaaatggcagaagatgagccagaaaaagaaaggttagggcaggtcctggaggacatgagtggctgtttgggctttatccagcagtgggggagccttggcaggcttgtggcttagataggtgctttagaaagcccaccagcagttgctgggccaccccgctggctgggtcctgttctaaggcaggaaatacaagnatgagcaggaaaagaccccctcaaggctcacgtcctagtggggagacaagaaacacagatgggcaatataacacgatgtctggttccagtaagtgcagtgaagaacaagcgaggctggatgcagggagtgatgggaggggctttgtaaggggaggtcgggggaagcctgtctcagaggacaccagaatggagcgcaggagcagcacgtggcagtcacatggcaggccgttagggcagagggagctgggcagggcacagcagggcaggagtgtgtttgatgtgtcctgggaaccgccctgaggccgtcgtgtggctggagtgctgcaggtgtcaaggaaattgtaggagatgtctcctgagtgtgatggaatataaccagatttccagaaggaactgacatgatctgacttaaaaaggccacctacatttacatgaaggccgcctacctcagcatgtttgggaaggaggaccacaagccgttcggggacgacgaagtggaattatttcgagctgtgccaggcctgaagctcaagattgctgggaaatctctacccacagagaagtttgccatccggaagtcccggcgctacttctcctccaaccctatctcgctgccagtgcctgctctggaaatgatgtacatctggaacggctacgccgtgattgggaagcagccgaaactcacggatgggatacttgagattatcactaaggctgaagagatgctggagaaaggcccagagaacgagtactcagtggatgacgagtgcttggtgaaattgttgaaaggcctgtgtctgaaatacctgggccgtgtccaggaggccgaggagaattttaggagcatctctgccaatgaaaagaagattaaatatgaccactacttgatcccaaacgccctgctggagctggccctgctgcttatggagcaagacagaaacgaagaggccatcaaacttttggaatctgccaagcaaaactacaagaattactccatggagtcaaggacacactttcgaatccaggcagccacactccaagccaagtcttccctagagaacagcagcagatccatggtctcatcagtgtccttgtagctttgtgcagcagttccgggctggaagacagagacagctggacagagctcctgaaaacatttcaaaataccccctccccctgccctgccctgcctttggggtccaccggcactccagttggatggcacaacatagtgtatccgtgcagaagccgagctggcattttcaccagtgtagccaagggcctttgccaagggcagagcaggtggagccctctgcctgccctatcacacatacgggtacttgcttttcactgtgatgtttaagagaatgtatgaacagtttacattttccttagaaatacattgatgggatcacagttggctttaaaaaccaacaacaatcaaccacctgtaagtctttgtcttcacctattatcatctggaggtaaatctctttatatgatgatgccaaagggcaaattgcttttcaaattcagcaagttctcagcttgtgtgacggaaggtccttcagaggacctgaggaatgcctgggagaggctaagcctcaggcttcaatgcttctggggttgggcatgaggatgtacacagacacccactaccttactactcacacttcatttcactccttttgtaaatttccaatttaaaaatcaagcacgtctttttagtgagataaaatctgagctcttctgtagaaaaatcaatctctaccagtagaaaatgccagggcttgatggaagagctgtgtagccctttctatgccaaagccaggaaatttggggggcaggaggaggttctcagaatccagtctgtatctttgctgtatgccaaactgaaaccactgggaataatttatgaaacataaaaatcttctgtacttcactccaaggtacatttgcttactgacagcatttttgttaaaactgttattcttgaaaattgtgta

SEQ ID NO: 371978 - DNA, 3304 bp, Homo sapiens
aggcctgggggagggaggaggccttggagaaggaggagggaaaaaggggctgtgggatttagtggctgggctgcaccccctgggggggcagcagagcccaatgggccagaagggccacaaagactccctttacccttgtggagggactcctgagagcagcctccatgaggccctggaccagtgcatgaccgccctggacctcttcctcaccaaccagttctcagaagcactcagctacctcaagcccagaaccaaggaaagcatgtaccactcactgacatatgccaccatcctggagatgcaggccatgatgacctttgaccctcaggacatcctgcttgccggcaacatgatgaaggaggcacagatgctgtgtcagaggcaccggaggaagtcttctgtaacagattccttcagcagcctggtgaaccgccccacgctgggccaattcactgaagaggaaatccacgctgaggtctgctatgcagagtgcctgctgcagcgagcagccctgaccttcctgcaggacgagaacatggtgagcttcatcaaaggcggcatcaaagttcgaaacagctaccagacctacaaggagctggacagccttgttcagtcctcacaatactgcaagggtgagaaccacccgcactttgaaggaggagtgaagcttggtgtaggggccttcaacctgacactgtccatgcttcctactaggatcctgaggctgttggagtttgtggggttttcaggaaacaaggactatgggctgctgcagctggaggagggagcgtcagggcacagcttccgctctgtgctctgtgtcatgctcctgctgtgctaccacaccttcctcaccttcgtgctcggtactgggaacgtcaacatcgaggaggccgagaagctcttgaagccctacctgaaccggtaccctaagggtgccatcttcctgttctttgcagggaggattgaagtcattaaaggcaacattgatgcagccatccggcgtttcgaggagtgctgtgaggcccagcagcactggaagcagttccaccacatgtgctactgggagctgatgtggtgcttcacctacaagggccagtggaagatgtcctacttctacgccgacctgctcagcaaggagaactgctggtccaaggccacctacatttacatgaaggccgcctacctcagcatgtttgggaaggaggaccacaagccgttcggggacgacgaagtggaattatttcgagctgtgccaggcctgaagctcaagattgctgggaaatctctacccacagagaagtttgccatccggaagtcccggcgctacttctcctccaaccctatctcgctgccagtgcctgctctggaaatgatgtacatctggaacggctacgccgtgattgggaagcagccgaaactcacggatgggatacttgagattatcactaaggctgaagagatgctggagaaaggcccagagaacgagtactcagtggatgacgagtgcttggtgaaattgttgaaaggcctgtgtctgaaatacctgggccgtgtccaggaggccgaggagaattttaggagcatctctgccaatgaaaagaagattaaatatgaccactacttgatcccaaacgccctgctggagctggccctgctgcttatggagcaagacagaaacgaagaggccatcaaacttttggaatctgccaagtaaggcttgggtaacctcagtctgtcctttgctccctctgaactcagctcaggagctggctggggacagagttgcccagagagcagtgagtggagttgctagcaaggccagtctggcagtctagagggtggacctgtgtccctcggaatccagctctcgcctgtcataggaagacttctttcttaatgtataaatgcgcagttagactcccagaggcaggaagtaagttcccaaggtcacatcagaagccaactgcatggctgtgtgaggacccatgcctcctgccttccagggtaggggtctattccctaaaaccaccccttcaagcttaggaacccaggaggaccaggagtggttccagtggccatgataccagggatgaggggccacaaacccttctggttaactctcccattgggtagggctcaactctctctggacacattaatttctctacaatccttccttggctcgcggggctcatacagctcaaacaggaggaaaagcatctctgggagcaggcagcctcatgtgtctgattcgctgctcaattccaggcaaaactacaagaattactccatggagtcaaggacacactttcgaatccaggcagccacactccaagccaagtcttccctagagaacagcagcagatccatggtctcatcagtgtccttgtagctttgtgcagcagttccgggctggaagacagagacagctggacagagctcctgaaaacatttcaaaataccccctccccctgccctgccctgcctttggggtccaccggcactccagttggatggcacaacatagtgtatccgtgcagaagccgagctggcattttcaccagtgtagccaagggcctttgccaagggcagagcaggtggagccctctgcctgccctatcacacatacgggtacttgcttttcactgtgatgtttaagagaatgtatgaacagtttacattttccttagaaatacattgatgggatcacagttggctttaaaaaccaacaacaatcaaccacctgtaagtctttgtcttcacctattatcatctggaggtaaatctctttatatgatgatgccaaagggcaaattgcttttcaaattcagcaagttctcagcttgtgtgacggaaggtccttcagaggacctgaggaatgcctgggagaggctaagcctcaggcttcaatgcttctggggttgggcatgaggatgtacacagacacccactaccttactactcacacttcatttcactccttttgtaaatttccaatttaaaaatcaagcacgtctttttagtgagataaaatctgagctcttctgtagaaaaatcaatctctaccagtagaaaatgccagggcttgatggaagagctgtgtagccctttctatgccaaagccaggaaatttggggggcaggaggaggttctcagaatccagtctgtatctttgctgtatgccaaactgaaaccactgggaataatttatgaaacataaaaatcttctgtacttcactccaaggtacatttgcttactgacagcatttttgttaaaactgttattcttgaaaattgtgta

SEQ ID NO: 371979 - DNA, 1310 bp, Homo sapiens
agaaatgaacaagtctgtctttttccctcacatccctattttcagagaacgagtactcagtggatgacgagtgcttggtgaaattgttgaaaggcctgtgtctgaaatacctgggccgtgtccaggaggccgaggagaattttaggagcatctctgccaatgaaaagaagattaaatatgaccactacttgatcccaaacgccctgctggagctggccctgctgcttatggagcaagacagaaacgaagaggccatcaaacttttggaatctgccaagcaaaactacaagaattactccatggagtcaaggacacactttcgaatccaggcagccacactccaagccaagtcttccctagagaacagcagcagatccatggtctcatcagtgtccttgtagctttgtgcagcagttccgggctggaagacagagacagctggacagagctcctgaaaacatttcaaaataccccctccccctgccctgccctgcctttggggtccaccggcactccagttggatggcacaacatagtgtatccgtgcagaagccgagctggcattttcaccagtgtagccaagggcctttgccaagggcagagcaggtggagccctctgcctgccctatcacacatacgggtacttgcttttcactgtgatgtttaagagaatgtatgaacagtttacattttccttagaaatacattgatgggatcacagttggctttaaaaaccaacaacaatcaaccacctgtaagtctttgtcttcacctattatcatctggaggtaaatctctttatatgatgatgccaaagggcaaattgcttttcaaattcagcaagttctcagcttgtgtgacggaaggtccttcagaggacctgaggaatgcctgggagaggctaagcctcaggcttcaatgcttctggggttgggcatgaggatgtacacagacacccactaccttactactcacacttcatttcactccttttgtaaatttccaatttaaaaatcaagcacgtctttttagtgagataaaatctgagctcttctgtagaaaaatcaatctctaccagtagaaaatgccagggcttgatggaagagctgtgtagccctttctatgccaaagccaggaaatttggggggcaggaggaggttctcagaatccagtctgtatctttgctgtatgccaaactgaaaccactgggaataatttatgaaacataaaaatcttctgtacttcactccaaggtacatttgcttactgacagcatttttgttaaaactgttattcttgaaaattgtgta

SEQ ID NO: 371980 - DNA, 2066 bp, Homo sapiens
aggcctgggggagggaggaggccttggagaaggaggagggaaaaaggggctgtgggatttagtggctgggctgcaccccctgggggggcagcagagcccaatgggccagaagggccacaaagactccctttacccttgtggagggactcctgagagcagcctccatgaggccctggaccagtgcatgaccgccctggacctcttcctcaccaaccagttctcagaagcactcagctacctcaagcccagaaccaaggaaagcatgtaccactcactgacatatgccaccatcctggagatgcaggccatgatgacctttgaccctcaggacatcctgcttgccggcaacatgatgaaggaggcacagatgctgtgtcagaggcaccggaggaagtcttctgtaacagattccttcagcagcctggtgaaccgccccacgctgggccaattcactgaagaggaaatccacgctgaggtctgctatgcagagtgcctgctgcagcgagcagccctgaccttcctgcaggacgagaacatggtgagcttcatcaaaggcggcatcaaagttcgaaacagctaccagacctacaaggagctggacagccttgttcagtcctcacaatactgcaagggtgagaaccacccgcactttgaaggaggagtgaagcttggtgtaggggccttcaacctgacactgtccatgcttcctactaggatcctgaggctgttggagtttgtggggttttcaggaaacaaggactatgggctgctgcagctggaggagggagcgtcagggcacagcttccgctctgtgctctgtgtcatgctcctgctgtgctaccacaccttcctcaccttcgtgctcggtactgggaacgtcaacatcgaggaggccgagaagctcttgaagccctacctgaaccggtaccctaagggtgccatcttcctgttctttgcagggaggattgaagtcattaaaggcaacattgatgcagccatccggcgtttcgaggagtgctgtgaggcccagcagcactggaagcagttccaccacatgtgctactgggagctgatgtggtgcttcacctacaagggccagtggaagatgtcctacttctacgccgacctgctcagcaaggagaactgctggtccaaggccacctacatttacatgaaggccgcctacctcagcatgtttgggaaggaggaccacaagccgttcggggacgacgaagtggaattatttcgagctgtgccaggcctgaagctcaagattgctgggaaatctctacccacagagaagtttgccatccggaagtcccggcgctacttctcctccaaccctatctcgctgccagtgcctgctctggaaatgatgtacatctggaacggctacgccgtgattgggaagcagccgaaactcacggatgggatacttgagattatcactaaggctgaagagatgctggagaaaggcccagagaacgagtactcagtggatgacgagtgcttggtgaaattgttgaaaggcctgtgtctgaaatacctgggccgtgtccaggaggccgaggagaattttaggagcatctctgccaatgaaaagaagattaaatatgaccactacttgatcccaaacgccctgctggagctggccctgctgcttatggagcaagacagaaacgaagaggccatcaaacttttggaatctgccaagcaaaactacaagaattactccatggagtcaaggacacactttcgaatccaggcagccacactccaagccaagtcttccctagagaacagcagcagatccatggtctcatcagtgtccttgtagctttgtgcagcagttccgggctggaagacagagacagctggacagagctcctgaaaacatttcaaaataccccctccccctgccctgccctgcctttggggtccaccggcactccagttggatggcacaacatatttatgaaacataaaaatcttctgtacttcactccaaggtacatttgcttactgacagcatttttgttaaaactgttattcttgaaaattgtgta

SEQ ID NO: 371981 - DNA, 832 bp, Homo sapiens
  misc_feature (32)..(33): n is a, c, g, or t
  misc_feature (60)..(60): n is a, c, g, or t
  misc_feature (186)..(186): n is a, c, g, or t
  misc_feature (216)..(216): n is a, c, g, or t
  misc_feature (293)..(293): n is a, c, g, or t
cccccccttccccaaacattcttgaggtaggnnggcctcattgtaaattgtaggtggccnttggaccaacaagtctcctttcttgagcaggtcggccgtaagaagtagacaatcttccacttggcccttgtaggtgaagcaccacatcagctcccagtagcaacatgtggtggactgcttccagtnctgctggcctcacaagcactcctcgaaacnccggatggctgcatcaatgtgcctttaatgacttcaatcctccctgcaaagaacaggaagatggcacccccaggganccctgcccgcggggactcctgagagcagcctccatgaggccctggaccagtgcatgaccgccctggacctcttcctcaccaaccagttctcagaagcactcagctacctcaagcccagaaccaaggaaagcatgtaccactcactgacatatgccaccatcctggagatgcaggccatgatgacctttgaccctcaggacatcctgcttgccggcaacatgatgaaggaggcacagatgctgtgtcagaggcaccggaggaagtcttctgtaacagattccttcagcagcctggtgaaccgccccacgctgggccaattcactgaaggtgtggcatccaggacatcctttcaaccatgctaagcccaggtggccagctccaggcccaggaaggggcagttttcttccctgtcatcgcctagggggccaggccctggtgtccatgccaggacacacatgggtcagagctggggccttttgaggcatggctctctagtgagggtgtggggggcaggtgagacccacttatgcgatagcact

SEQ ID NO: 371982 - DNA, 280 bp, Homo sapiens
ctgaagcactgggtgacgaggtaggggacaggagaggtgctgacataggttccctttgcttttggggaagttggggtgtgaggatttgtcccaggcctcctgactagagtcccaggaggccacggggctttggttttctccccacagaggaaatccacgctgaggtctgctatgcagagtgcctgctgcagcgagcagccctgaccttcctgcaggtagggacccccacttgtacaaagaggctgggatttcagaagatcagtttccacgtccaaccatg

SEQ ID NO: 371983 - DNA, 379 bp, Homo sapiens
actgagacctgtcatggatgattagagctagaaggtcctttagtgaacctctgatctgaactgcccattttgtagatgggaaaactgaggccccattagggaagaaacctaggactgacttgcccccctgccttcaggaaatgatgtacatctggaacggctacgccgtgattgggaagcagccgaaactcacggatgggatacttgagattatcactaaggctgaagagatgctggagaaaggcccaggtgacttccctcaggcccttgggcctgccatgctaggtcaggtctttacagctgaagcttccctctgccaaaaatgtccttcctcctttccctaccctggcaactctcctttatctctctagactgagct

SEQ ID NO: 371984 - DNA, 6253 bp, Homo sapiens
  misc_feature (2228)..(2228): n is a, c, g, or t
  misc_feature (2960)..(2960): n is a, c, g, or t
  misc_feature (3567)..(3567): n is a, c, g, or t
  misc_feature (3592)..(3592): n is a, c, g, or t
  misc_feature (3613)..(3613): n is a, c, g, or t
  misc_feature (3625)..(3625): n is a, c, g, or t
  misc_feature (3688)..(3688): n is a, c, g, or t
  misc_feature (4151)..(4151): n is a, c, g, or t
  misc_feature (5277)..(5277): n is a, c, g, or t
  misc_feature (6027)..(6027): n is a, c, g, or t
  misc_feature (6052)..(6052): n is a, c, g, or t
  misc_feature (6155)..(6155): n is a, c, g, or t
ggtggagacaccgcctcagggctcggtgcacagtggacatttggggagcgttgtgggtgacccccacacaggcactgggaatgcaggggagagggggccaagggggaaaggggccagagtgttggctttggattcaggagggatggattccagtcctagcttgccacttattaggactcctgagagcagcctccatgaggccctggaccagtgcatgaccgccctggacctcttcctcaccaaccagttctcagaagcactcagctacctcaagcccagaaccaaggaaagcatgtaccactcactgacatatgccaccatcctggagatgcaggccatgatgacctttgaccctcaggacatcctgcttgccggcaacatgatgaaggaggcacagatgctgtgtcagaggcaccggaggaagtcttctgtaacagattccttcagcagcctggtgaaccgccccacgctgggccaattcactgaagaggaaatccacgctgaggtctgctatgcagagtgcctgctgcagcgagcagccctgaccttcctgcagggttcctcacacggaggggcagtcaggcccagagccttgcatgatccctctcacgcctgcagctgcccacctgggccaggccgtcagcatcttttcctcctgcgacgagaacatggtgagcttcatcaaaggcggcatcaaagttcgaaacagctaccagacctacaaggagctggacagccttgttcagtcctcacaatactgcaagggtgagaaccacccgcactttgaaggaggagtgaagcttggtgtaggggccttcaacctgacactgtccatgcttcctactaggatcctgaggctgttggagtttgtggggttttcaggaaacaaggactatgggctgctgcagctggaggagggagcgtcagggcacagcttccgctctgtgctctgtgtcatgctcctgctgtgctaccacaccttcctcaccttcgtgctcggtactgggaacgtcaacatcgaggaggccgagaagctcttgaagccctacctgaaccggtaccctaagggtgccatcttcctgttctttgcagggaggattgaagtcattaaaggcaacattgatgcagtgagtgatgggggtccgggccggggctggggatccctcggggtctcccagaccagcaggaagtcaggcacatgtgacatactcagggacaggatagactgggggcggggggggggccaagagagaaccaaccagagagcaggggcaggagaggcccttctggcagagcagcctgggaagacaagggaggaggaggcatttgtggtgcctgggattttgactgggagatataggactgcagcattgcagtggagggaggtggagggaggtgcttgagggaggcagaggttaggaaagcccatctgtttagggcatgacgattaggctggagtctggtacctcccctccattatagctctctcctgctctttcattttgttactaaaaaccagagtcctaggcgggggctgtatttgagcccaacgtcatgtaagacttaggaggtaaaaccaggactggaggccagatctcctggctcctggggccccacctgagcctagcacagggctggaccactatgccctggaggagtcccggtctgctgtggtgttgggaggttcggaggatgcagaggggttggggctgggtgggcacccgtcaggctgaccagaaggtgcctgcaggccatccggcgtttcgaggagtgctgtgaggcccagcagcactggaagcagttccaccacatgtgctactgggagctgatgtggtgcttcacctacaagggccagtggaagatgtcctacttctacgccgacctgctcagcaaggagaactgctggtccaaggtgggctgatgccacgtgttaggggcattgggtgaccagggctgactgtgtgcctccagaccacgggccaaatccctaactgaacacagatgtctcagctggaatctaaacataaccttaaattctaataggactcaggcttggaaggaactaaagaccacaagagaaacttctgaaccacaatgtgtcacaaagagatttctagtcacaaaggacagaaacatggctccctctgtccagtagaactgtttctgtggtagaaatgttctacttatgcactgcccaaatatggtagtcaccagccacatgtgcacantgagcacatgaaatgtgcctagtgcaactgggaaactgattgttttcagttttatttaattttaattaactaaatgttaaatttaaatagccatgtagggcttgtggccactatattggactatgcaggtccaaaacacaaaaggctcatataactgaacattcttggcacatccgacttcaggtagggctggatccaggaattcaaatgatgtcgtctggcttggtctttccatttgtggctgtgctctctcctatgacatctttgtttctgctgcatctttgcaggaaggttctctccatgtgacaggcaaggtggccacgggctgcttctactcatatcctccccttggtttcaaccagagtcccacagtttgagcctcactggtctgacttgtcacctgccaatgcctggaacagaggggtgggaagattcctcatgggctgagagtaggagaggggtggttccacagaagaaaatgatgcacccagaaatagtggagggattaacaagatgccatacaggcaaaacaaagccaaacagatgcccgcctaccaaagatgaaatttatcatggtaagtattgaaataagtgttagcttgtaccatcatagtaatgatagtgcagaaattggaaccaagagtcttacaaccacctagctcagcaaacgtctaatctgttatttgtaaatacacaggacatgtgtcttcatggcttcatcccctgcccatngcagacattgctaatcaatcctctgccatgagcctagctgtgaccttagataccttccctgcaaagctccaggcagccgttagaactgacccacattggcacctgttaggagacctgtcatctgcatctggtccctccccctcctctgcatggaggtctcttccgtagccctgcctggggaccaagctgaaggggaattctctgggtctggggcaggtggggctggggaagggagcaggcttctactgagctctcaacatgtctggcacctgtcatgtcctccacaccacacccagtgaggagaagttattatctccattgggcacatgagggccactgatgctaagcgaggactgtgactttcccacccacatggctgttggtgacagacaccggatttgaggacagtcctgtgtgactcagaggcctctgcttctctcttgctcctagagtcctcctgaggagtcggggcttgccctgagcccaccctgctgttgaaggtgcttcctcaggcccagctcccatggcccccacaccccctcctcatcacctcctactcccaaaaaggacaaagcctcagggaaccttttttctttttttagagacngggtcttgctatgttggtcaggctngtcttgaactcctgggcccangcaatcttcccncctctgcctcctaaagtgctgggattctgggccttagggaacctttttgaactgaaagtgacnctcgaagccttcctgtagagtgaggtgggtggctggggctaaccatatggggaaggagagacctggtgggggcacacagctgctatatagaggaacagaaggtgggccaggcctcccagctgtcaggaaatctggctcagtccccagaccgctgtgtggctttggggtggccagtccctctctctctgcaacactctcctcatgaggacttctgtgaaaaatgggggttgtaaccctctgagttctggggccccacccatttctaatctccagaacttggccaccacagactccaccaacttctagtcctggggcctgggcctctggccattgccataggcaccacctgctctgtgcaggcagcgcccccctctgccaggatcctccgaggtcagctgctgggtctgacccgcagaccctggctgagcgacggatgaacggagtatgcagacacaggcttgcntgtcagcagatgggggacccctgccagagtcagcagcggcccccataagcctgccacgcttgcatttatttagtacagatgtaatgacaaaggcctaaagcaaactccatttgtgggtaattaacattgtcgcccccccagaaagagcagtcctccgcatgatgattaaaggccaggttccgaggcctaagtaaaccaacttatctagatcaattcccttacttcttgttatctactctgagagaattcagctgccttcagccaaatcctttcccgaagcttttgcaaaacctccgagccttccaaggtttgcttctttctgtaatttttctcaccaccctgacctatctcctgcagtcagccctgtggaggcctttgtgtttcccccagtgctggcagcctagaggctgagatggccagaaacaaggtggtgacagtggcgtgctcagggcttgggaaacccaaggagctaaaggcatgcccaggcaaccaaagaggacaggaaggcttctgaggagagacctctgaggtgggtcttggagaggaaggacttagggaggcagagtggaggaagtgagaggacaccccaagccaagagggcggcaggaccaaaggctcagaagccagggcgctgcagaggggctgtgtgccacagggtgaagagtttgtgtggcagaagggcagggggcttgcatcaggggtgacagctgctcttttgtcccagcatagcccctgtacatccctggagagctggggcgtccacaactctaagtcacagcccccatcctaaccctggtggtgcagtgagggtgagctgtctgtgggcaggagggaagactcttggagatgagcctggtgaagggataatggcatcccgggccgaggagcagcacaggcagaggcctggggagagtttaaggagtgtaggggaggaaatggcagaagatgagccagaaaaagaaaggttagggcaggtcctggaggacatgagtggctgtttgggctttatccagcagtgggggagccttggcaggcttgtggcttagataggtgctttagaaagcccaccagcagttgctgggccaccccgctggctgggtcctgttctaaggcaggaaatacaagnatgagcaggaaaagaccccctcaaggctcacgtcctagtggggagacaagaaacacagatgggcaatataacacgatgtctggttccagtaagtgcagtgaagaacaagcgaggctggatgcagggagtgatgggaggggctttgtaaggggaggtcgggggaagcctgtctcagaggacaccagaatggagcgcaggagcagcacgtggcagtcacatggcaggccgttagggcagagggagctgggcagggcacagcagggcaggagtgtgtttgatgtgtcctgggaaccgccctgaggccgtcgtgtggctggagtgctgcaggtgtcaaggaaattgtaggagatgtctcctgagtgtgatggaatataaccagatttccagaaggaactgacatgatctgacttaaaaaggtcagtgtgcgaaatggcttgcaggggacaggagtgggagcagggagataggagacaatgtgtaccaggacagcagaaagacatcccgggtagcctggaacagggagacggtgtggagatggtggcagtccgataatgagagccgtagggcaaggccagcaggatcctagagtgagacgggaggtaaagtcaccgggacttggtgtctccacgtcaggggcaggggaaagggagaggacaagggtgacccgggaggttaaagatgggaccggggccagacgcagtggctcatgcctgtaatcctagcactttgggaggctgaggcgggcggatngcttgaggtcaggagtttgaaaccngcctggccaacatggtgaaaccccgtctctactaaaatatacaaaaattagcctggcgtggtggtgcatgcctgcagtcccagctattcaggaggctgaggcnacaagaatcgcttgaacctgggaggcggaggttgcagtgagccgagatcgcgccatagcactccagccttagcctgggcgacagagcgagaccacatc

SEQ ID NO: 371985 - DNA, 7150 bp, Homo sapiens
  misc_feature (2095)..(2095): n is a, c, g, or t
  misc_feature (2827)..(2827): n is a, c, g, or t
  misc_feature (3434)..(3434): n is a, c, g, or t
  misc_feature (3459)..(3459): n is a, c, g, or t
  misc_feature (3480)..(3480): n is a, c, g, or t
  misc_feature (3492)..(3492): n is a, c, g, or t
  misc_feature (3555)..(3555): n is a, c, g, or t
  misc_feature (4018)..(4018): n is a, c, g, or t
  misc_feature (5144)..(5144): n is a, c, g, or t
aggcctgggggagggaggaggccttggagaaggaggagggaaaaaggggctgtgggatttagtggctgggctgcaccccctgggggggcagcagagcccaatgggccagaagggccacaaagactccctttacccttgtggagggactcctgagagcagcctccatgaggccctggaccagtgcatgaccgccctggacctcttcctcaccaaccagttctcagaagcactcagctacctcaagcccagaaccaaggaaagcatgtaccactcactgacatatgccaccatcctggagatgcaggccatgatgacctttgaccctcaggacatcctgcttgccggcaacatgatgaaggaggcacagatgctgtgtcagaggcaccggaggaagtcttctgtaacagattccttcagcagcctggtgaaccgccccacgctgggccaattcactgaagaggaaatccacgctgaggtctgctatgcagagtgcctgctgcagcgagcagccctgaccttcctgcaggacgagaacatggtgagcttcatcaaaggcggcatcaaagttcgaaacagctaccagacctacaaggagctggacagccttgttcagtcctcacaatactgcaagggtgagaaccacccgcactttgaaggaggagtgaagcttggtgtaggggccttcaacctgacactgtccatgcttcctactaggatcctgaggctgttggagtttgtggggttttcaggaaacaaggactatgggctgctgcagctggaggagggagcgtcagggcacagcttccgctctgtgctctgtgtcatgctcctgctgtgctaccacaccttcctcaccttcgtgctcggtactgggaacgtcaacatcgaggaggccgagaagctcttgaagccctacctgaaccggtaccctaagggtgccatcttcctgttctttgcagggaggattgaagtcattaaaggcaacattgatgcagtgagtgatgggggtccgggccggggctggggatccctcggggtctcccagaccagcaggaagtcaggcacatgtgacatactcagggacaggatagactgggggcggggggggggccaagagagaaccaaccagagagcaggggcaggagaggcccttctggcagagcagcctgggaagacaagggaggaggaggcatttgtggtgcctgggattttgactgggagatataggactgcagcattgcagtggagggaggtggagggaggtgcttgagggaggcagaggttaggaaagcccatctgtttagggcatgacgattaggctggagtctggtacctcccctccattatagctctctcctgctctttcattttgttactaaaaaccagagtcctaggcgggggctgtatttgagcccaacgtcatgtaagacttaggaggtaaaaccaggactggaggccagatctcctggctcctggggccccacctgagcctagcacagggctggaccactatgccctggaggagtcccggtctgctgtggtgttgggaggttcggaggatgcagaggggttggggctgggtgggcacccgtcaggctgaccagaaggtgcctgcaggccatccggcgtttcgaggagtgctgtgaggcccagcagcactggaagcagttccaccacatgtgctactgggagctgatgtggtgcttcacctacaagggccagtggaagatgtcctacttctacgccgacctgctcagcaaggagaactgctggtccaaggtgggctgatgccacgtgttaggggcattgggtgaccagggctgactgtgtgcctccagaccacgggccaaatccctaactgaacacagatgtctcagctggaatctaaacataaccttaaattctaataggactcaggcttggaaggaactaaagaccacaagagaaacttctgaaccacaatgtgtcacaaagagatttctagtcacaaaggacagaaacatggctccctctgtccagtagaactgtttctgtggtagaaatgttctacttatgcactgcccaaatatggtagtcaccagccacatgtgcacantgagcacatgaaatgtgcctagtgcaactgggaaactgattgttttcagttttatttaattttaattaactaaatgttaaatttaaatagccatgtagggcttgtggccactatattggactatgcaggtccaaaacacaaaaggctcatataactgaacattcttggcacatccgacttcaggtagggctggatccaggaattcaaatgatgtcgtctggcttggtctttccatttgtggctgtgctctctcctatgacatctttgtttctgctgcatctttgcaggaaggttctctccatgtgacaggcaaggtggccacgggctgcttctactcatatcctccccttggtttcaaccagagtcccacagtttgagcctcactggtctgacttgtcacctgccaatgcctggaacagaggggtgggaagattcctcatgggctgagagtaggagaggggtggttccacagaagaaaatgatgcacccagaaatagtggagggattaacaagatgccatacaggcaaaacaaagccaaacagatgcccgcctaccaaagatgaaatttatcatggtaagtattgaaataagtgttagcttgtaccatcatagtaatgatagtgcagaaattggaaccaagagtcttacaaccacctagctcagcaaacgtctaatctgttatttgtaaatacacaggacatgtgtcttcatggcttcatcccctgcccatngcagacattgctaatcaatcctctgccatgagcctagctgtgaccttagataccttccctgcaaagctccaggcagccgttagaactgacccacattggcacctgttaggagacctgtcatctgcatctggtccctccccctcctctgcatggaggtctcttccgtagccctgcctggggaccaagctgaaggggaattctctgggtctggggcaggtggggctggggaagggagcaggcttctactgagctctcaacatgtctggcacctgtcatgtcctccacaccacacccagtgaggagaagttattatctccattgggcacatgagggccactgatgctaagcgaggactgtgactttcccacccacatggctgttggtgacagacaccggatttgaggacagtcctgtgtgactcagaggcctctgcttctctcttgctcctagagtcctcctgaggagtcggggcttgccctgagcccaccctgctgttgaaggtgcttcctcaggcccagctcccatggcccccacaccccctcctcatcacctcctactcccaaaaaggacaaagcctcagggaaccttttttctttttttagagacngggtcttgctatgttggtcaggctngtcttgaactcctgggcccangcaatcttcccncctctgcctcctaaagtgctgggattctgggccttagggaacctttttgaactgaaagtgacnctcgaagccttcctgtagagtgaggtgggtggctggggctaaccatatggggaaggagagacctggtgggggcacacagctgctatatagaggaacagaaggtgggccaggcctcccagctgtcaggaaatctggctcagtccccagaccgctgtgtggctttggggtggccagtccctctctctctgcaacactctcctcatgaggacttctgtgaaaaatgggggttgtaaccctctgagttctggggccccacccatttctaatctccagaacttggccaccacagactccaccaacttctagtcctggggcctgggcctctggccattgccataggcaccacctgctctgtgcaggcagcgcccccctctgccaggatcctccgaggtcagctgctgggtctgacccgcagaccctggctgagcgacggatgaacggagtatgcagacacaggcttgcntgtcagcagatgggggacccctgccagagtcagcagcggcccccataagcctgccacgcttgcatttatttagtacagatgtaatgacaaaggcctaaagcaaactccatttgtgggtaattaacattgtcgcccccccagaaagagcagtcctccgcatgatgattaaaggccaggttccgaggcctaagtaaaccaacttatctagatcaattcccttacttcttgttatctactctgagagaattcagctgccttcagccaaatcctttcccgaagcttttgcaaaacctccgagccttccaaggtttgcttctttctgtaatttttctcaccaccctgacctatctcctgcagtcagccctgtggaggcctttgtgtttcccccagtgctggcagcctagaggctgagatggccagaaacaaggtggtgacagtggcgtgctcagggcttgggaaacccaaggagctaaaggcatgcccaggcaaccaaagaggacaggaaggcttctgaggagagacctctgaggtgggtcttggagaggaaggacttagggaggcagagtggaggaagtgagaggacaccccaagccaagagggcggcaggaccaaaggctcagaagccagggcgctgcagaggggctgtgtgccacagggtgaagagtttgtgtggcagaagggcagggggcttgcatcaggggtgacagctgctcttttgtcccagcatagcccctgtacatccctggagagctggggcgtccacaactctaagtcacagcccccatcctaaccctggtggtgcagtgagggtgagctgtctgtgggcaggagggaagactcttggagatgagcctggtgaagggataatggcatcccgggccgaggagcagcacaggcagaggcctggggagagtttaaggagtgtaggggaggaaatggcagaagatgagccagaaaaagaaaggttagggcaggtcctggaggacatgagtggctgtttgggctttatccagcagtgggggagccttggcaggcttgtggcttagataggtgctttagaaagcccaccagcagttgctgggccaccccgctggctgggtcctgttctaaggcaggaaatacaagnatgagcaggaaaagaccccctcaaggctcacgtcctagtggggagacaagaaacacagatgggcaatataacacgatgtctggttccagtaagtgcagtgaagaacaagcgaggctggatgcagggagtgatgggaggggctttgtaaggggaggtcgggggaagcctgtctcagaggacaccagaatggagcgcaggagcagcacgtggcagtcacatggcaggccgttagggcagagggagctgggcagggcacagcagggcaggagtgtgtttgatgtgtcctgggaaccgccctgaggccgtcgtgtggctggagtgctgcaggtgtcaaggaaattgtaggagatgtctcctgagtgtgatggaatataaccagatttccagaaggaactgacatgatctgacttaaaaaggccacctacatttacatgaaggccgcctacctcagcatgtttgggaaggaggaccacaagccgttcggggacgacgaagtggaattatttcgagctgtgccaggcctgaagctcaagattgctgggaaatctctacccacagagaagtttgccatccggaagtcccggcgctacttctcctccaaccctatctcgctgccagtgcctgctctggaaatgatgtacatctggaacggctacgccgtgattgggaagcagccgaaactcacggatgggatacttgagattatcactaaggctgaagagatgctggagaaaggcccagagaacgagtactcagtggatgacgagtgcttggtgaaattgttgaaaggcctgtgtctgaaatacctgggccgtgtccaggaggccgaggagaattttaggagcatctctgccaatgaaaagaagattaaatatgaccactacttgatcccaaacgccctgctggagctggccctgctgcttatggagcaagacagaaacgaagaggccatcaaacttttggaatctgccaagcaaaactacaagaattactccatggagtcaaggacacactttcgaatccaggcagccacactccaagccaagtcttccctagagaacagcagcagatccatggtctcatcagtgtccttgtagctttgtgcagcagttccgggctggaagacagagacagctggacagagctcctgaaaacatttcaaaataccccctccccctgccctgccctgcctttggggtccaccggcactccagttggatggcacaacatagtgtatccgtgcagaagccgagctggcattttcaccagtgtagccaagggcctttgccaagggcagagcaggtggagccctctgcctgccctatcacacatacgggtacttgcttttcactgtgatgtttaagagaatgtatgaacagtttacattttccttagaaatacattgatgggatcacagttggctttaaaaaccaacaacaatcaaccacctgtaagtctttgtcttcacctattatcatctggaggtaaatctctttatatgatgatgccaaagggcaaattgcttttcaaattcagcaagttctcagcttgtgtgacggaaggtccttcagaggacctgaggaatgcctgggagaggctaagcctcaggcttcaatgcttctggggttgggcatgaggatgtacacagacacccactaccttactactcacacttcatttcactccttttgtaaatttccaatttaaaaatcaagcacgtctttttagtgagataaaatctgagctcttctgtagaaaaatcaatctctaccagtagaaaatgccagggcttgatggaagagctgtgtagccctttctatgccaaagccaggaaatttggggggcaggaggaggttctcagaatccagtctgtatctttgctgtatgccaaactgaaaccactgggaataatttatgaaacataaaaatcttctgtacttcactccaaggtacatttgcttactgacagcatttttgttaaaactgttattcttgaaaattgtgta

SEQ ID NO: 371986 - DNA, 7312 bp, Homo sapiens
  misc_feature (32)..(33): n is a, c, g, or t
  misc_feature (60)..(60): n is a, c, g, or t
  misc_feature (186)..(186): n is a, c, g, or t
  misc_feature (216)..(216): n is a, c, g, or t
  misc_feature (293)..(293): n is a, c, g, or t
  misc_feature (2257)..(2257): n is a, c, g, or t
  misc_feature (2989)..(2989): n is a, c, g, or t
  misc_feature (3596)..(3596): n is a, c, g, or t
  misc_feature (3621)..(3621): n is a, c, g, or t
  misc_feature (3642)..(3642): n is a, c, g, or t
  misc_feature (3654)..(3654): n is a, c, g, or t
  misc_feature (3717)..(3717): n is a, c, g, or t
  misc_feature (4180)..(4180): n is a, c, g, or t
  misc_feature (5306)..(5306): n is a, c, g, or t
cccccccttccccaaacattcttgaggtaggnnggcctcattgtaaattgtaggtggccnttggaccaacaagtctcctttcttgagcaggtcggccgtaagaagtagacaatcttccacttggcccttgtaggtgaagcaccacatcagctcccagtagcaacatgtggtggactgcttccagtnctgctggcctcacaagcactcctcgaaacnccggatggctgcatcaatgtgcctttaatgacttcaatcctccctgcaaagaacaggaagatggcacccccaggganccctgcccgcggggactcctgagagcagcctccatgaggccctggaccagtgcatgaccgccctggacctcttcctcaccaaccagttctcagaagcactcagctacctcaagcccagaaccaaggaaagcatgtaccactcactgacatatgccaccatcctggagatgcaggccatgatgacctttgaccctcaggacatcctgcttgccggcaacatgatgaaggaggcacagatgctgtgtcagaggcaccggaggaagtcttctgtaacagattccttcagcagcctggtgaaccgccccacgctgggccaattcactgaagaggaaatccacgctgaggtctgctatgcagagtgcctgctgcagcgagcagccctgaccttcctgcaggacgagaacatggtgagcttcatcaaaggcggcatcaaagttcgaaacagctaccagacctacaaggagctggacagccttgttcagtcctcacaatactgcaagggtgagaaccacccgcactttgaaggaggagtgaagcttggtgtaggggccttcaacctgacactgtccatgcttcctactaggatcctgaggctgttggagtttgtggggttttcaggaaacaaggactatgggctgctgcagctggaggagggagcgtcagggcacagcttccgctctgtgctctgtgtcatgctcctgctgtgctaccacaccttcctcaccttcgtgctcggtactgggaacgtcaacatcgaggaggccgagaagctcttgaagccctacctgaaccggtaccctaagggtgccatcttcctgttctttgcagggaggattgaagtcattaaaggcaacattgatgcagtgagtgatgggggtccgggccggggctggggatccctcggggtctcccagaccagcaggaagtcaggcacatgtgacatactcagggacaggatagactgggggcggggggggggccaagagagaaccaaccagagagcaggggcaggagaggcccttctggcagagcagcctgggaagacaagggaggaggaggcatttgtggtgcctgggattttgactgggagatataggactgcagcattgcagtggagggaggtggagggaggtgcttgagggaggcagaggttaggaaagcccatctgtttagggcatgacgattaggctggagtctggtacctcccctccattatagctctctcctgctctttcattttgttactaaaaaccagagtcctaggcgggggctgtatttgagcccaacgtcatgtaagacttaggaggtaaaaccaggactggaggccagatctcctggctcctggggccccacctgagcctagcacagggctggaccactatgccctggaggagtcccggtctgctgtggtgttgggaggttcggaggatgcagaggggttggggctgggtgggcacccgtcaggctgaccagaaggtgcctgcaggccatccggcgtttcgaggagtgctgtgaggcccagcagcactggaagcagttccaccacatgtgctactgggagctgatgtggtgcttcacctacaagggccagtggaagatgtcctacttctacgccgacctgctcagcaaggagaactgctggtccaaggtgggctgatgccacgtgttaggggcattgggtgaccagggctgactgtgtgcctccagaccacgggccaaatccctaactgaacacagatgtctcagctggaatctaaacataaccttaaattctaataggactcaggcttggaaggaactaaagaccacaagagaaacttctgaaccacaatgtgtcacaaagagatttctagtcacaaaggacagaaacatggctccctctgtccagtagaactgtttctgtggtagaaatgttctacttatgcactgcccaaatatggtagtcaccagccacatgtgcacantgagcacatgaaatgtgcctagtgcaactgggaaactgattgttttcagttttatttaattttaattaactaaatgttaaatttaaatagccatgtagggcttgtggccactatattggactatgcaggtccaaaacacaaaaggctcatataactgaacattcttggcacatccgacttcaggtagggctggatccaggaattcaaatgatgtcgtctggcttggtctttccatttgtggctgtgctctctcctatgacatctttgtttctgctgcatctttgcaggaaggttctctccatgtgacaggcaaggtggccacgggctgcttctactcatatcctccccttggtttcaaccagagtcccacagtttgagcctcactggtctgacttgtcacctgccaatgcctggaacagaggggtgggaagattcctcatgggctgagagtaggagaggggtggttccacagaagaaaatgatgcacccagaaatagtggagggattaacaagatgccatacaggcaaaacaaagccaaacagatgcccgcctaccaaagatgaaatttatcatggtaagtattgaaataagtgttagcttgtaccatcatagtaatgatagtgcagaaattggaaccaagagtcttacaaccacctagctcagcaaacgtctaatctgttatttgtaaatacacaggacatgtgtcttcatggcttcatcccctgcccatngcagacattgctaatcaatcctctgccatgagcctagctgtgaccttagataccttccctgcaaagctccaggcagccgttagaactgacccacattggcacctgttaggagacctgtcatctgcatctggtccctccccctcctctgcatggaggtctcttccgtagccctgcctggggaccaagctgaaggggaattctctgggtctggggcaggtggggctggggaagggagcaggcttctactgagctctcaacatgtctggcacctgtcatgtcctccacaccacacccagtgaggagaagttattatctccattgggcacatgagggccactgatgctaagcgaggactgtgactttcccacccacatggctgttggtgacagacaccggatttgaggacagtcctgtgtgactcagaggcctctgcttctctcttgctcctagagtcctcctgaggagtcggggcttgccctgagcccaccctgctgttgaaggtgcttcctcaggcccagctcccatggcccccacaccccctcctcatcacctcctactcccaaaaaggacaaagcctcagggaaccttttttctttttttagagacngggtcttgctatgttggtcaggctngtcttgaactcctgggcccangcaatcttcccncctctgcctcctaaagtgctgggattctgggccttagggaacctttttgaactgaaagtgacnctcgaagccttcctgtagagtgaggtgggtggctggggctaaccatatggggaaggagagacctggtgggggcacacagctgctatatagaggaacagaaggtgggccaggcctcccagctgtcaggaaatctggctcagtccccagaccgctgtgtggctttggggtggccagtccctctctctctgcaacactctcctcatgaggacttctgtgaaaaatgggggttgtaaccctctgagttctggggccccacccatttctaatctccagaacttggccaccacagactccaccaacttctagtcctggggcctgggcctctggccattgccataggcaccacctgctctgtgcaggcagcgcccccctctgccaggatcctccgaggtcagctgctgggtctgacccgcagaccctggctgagcgacggatgaacggagtatgcagacacaggcttgcntgtcagcagatgggggacccctgccagagtcagcagcggcccccataagcctgccacgcttgcatttatttagtacagatgtaatgacaaaggcctaaagcaaactccatttgtgggtaattaacattgtcgcccccccagaaagagcagtcctccgcatgatgattaaaggccaggttccgaggcctaagtaaaccaacttatctagatcaattcccttacttcttgttatctactctgagagaattcagctgccttcagccaaatcctttcccgaagcttttgcaaaacctccgagccttccaaggtttgcttctttctgtaatttttctcaccaccctgacctatctcctgcagtcagccctgtggaggcctttgtgtttcccccagtgctggcagcctagaggctgagatggccagaaacaaggtggtgacagtggcgtgctcagggcttgggaaacccaaggagctaaaggcatgcccaggcaaccaaagaggacaggaaggcttctgaggagagacctctgaggtgggtcttggagaggaaggacttagggaggcagagtggaggaagtgagaggacaccccaagccaagagggcggcaggaccaaaggctcagaagccagggcgctgcagaggggctgtgtgccacagggtgaagagtttgtgtggcagaagggcagggggcttgcatcaggggtgacagctgctcttttgtcccagcatagcccctgtacatccctggagagctggggcgtccacaactctaagtcacagcccccatcctaaccctggtggtgcagtgagggtgagctgtctgtgggcaggagggaagactcttggagatgagcctggtgaagggataatggcatcccgggccgaggagcagcacaggcagaggcctggggagagtttaaggagtgtaggggaggaaatggcagaagatgagccagaaaaagaaaggttagggcaggtcctggaggacatgagtggctgtttgggctttatccagcagtgggggagccttggcaggcttgtggcttagataggtgctttagaaagcccaccagcagttgctgggccaccccgctggctgggtcctgttctaaggcaggaaatacaagnatgagcaggaaaagaccccctcaaggctcacgtcctagtggggagacaagaaacacagatgggcaatataacacgatgtctggttccagtaagtgcagtgaagaacaagcgaggctggatgcagggagtgatgggaggggctttgtaaggggaggtcgggggaagcctgtctcagaggacaccagaatggagcgcaggagcagcacgtggcagtcacatggcaggccgttagggcagagggagctgggcagggcacagcagggcaggagtgtgtttgatgtgtcctgggaaccgccctgaggccgtcgtgtggctggagtgctgcaggtgtcaaggaaattgtaggagatgtctcctgagtgtgatggaatataaccagatttccagaaggaactgacatgatctgacttaaaaaggccacctacatttacatgaaggccgcctacctcagcatgtttgggaaggaggaccacaagccgttcggggacgacgaagtggaattatttcgagctgtgccaggcctgaagctcaagattgctgggaaatctctacccacagagaagtttgccatccggaagtcccggcgctacttctcctccaaccctatctcgctgccagtgcctgctctggaaatgatgtacatctggaacggctacgccgtgattgggaagcagccgaaactcacggatgggatacttgagattatcactaaggctgaagagatgctggagaaaggcccagagaacgagtactcagtggatgacgagtgcttggtgaaattgttgaaaggcctgtgtctgaaatacctgggccgtgtccaggaggccgaggagaattttaggagcatctctgccaatgaaaagaagattaaatatgaccactacttgatcccaaacgccctgctggagctggccctgctgcttatggagcaagacagaaacgaagaggccatcaaacttttggaatctgccaagcaaaactacaagaattactccatggagtcaaggacacactttcgaatccaggcagccacactccaagccaagtcttccctagagaacagcagcagatccatggtctcatcagtgtccttgtagctttgtgcagcagttccgggctggaagacagagacagctggacagagctcctgaaaacatttcaaaataccccctccccctgccctgccctgcctttggggtccaccggcactccagttggatggcacaacatagtgtatccgtgcagaagccgagctggcattttcaccagtgtagccaagggcctttgccaagggcagagcaggtggagccctctgcctgccctatcacacatacgggtacttgcttttcactgtgatgtttaagagaatgtatgaacagtttacattttccttagaaatacattgatgggatcacagttggctttaaaaaccaacaacaatcaaccacctgtaagtctttgtcttcacctattatcatctggaggtaaatctctttatatgatgatgccaaagggcaaattgcttttcaaattcagcaagttctcagcttgtgtgacggaaggtccttcagaggacctgaggaatgcctgggagaggctaagcctcaggcttcaatgcttctggggttgggcatgaggatgtacacagacacccactaccttactactcacacttcatttcactccttttgtaaatttccaatttaaaaatcaagcacgtctttttagtgagataaaatctgagctcttctgtagaaaaatcaatctctaccagtagaaaatgccagggcttgatggaagagctgtgtagccctttctatgccaaagccaggaaatttggggggcaggaggaggttctcagaatccagtctgtatctttgctgtatgccaaactgaaaccactgggaataatttatgaaacataaaaatcttctgtacttcactccaaggtacatttgcttactgacagcatttttgttaaaactgttattcttgaaaattgtgta

SEQ ID NO: 371987 - DNA, 1808 bp, Homo sapiens
aaagggggcaggaactagtactaggtacgagaccggtgttaattcggcagaggggcacagcagggcaggagtgtgtttgatgtgtcctgggaaccgccctgaggccgtcgtgtggctggagtgctgcaggtgtcaaggaaattgtaggagatgtctcctgagtgtgatggaatataaccagatttccagaaggaactgacatgatctgacttaaaaaggccacctacatttacatgaaggccgcctacctcagcatgtttgggaaggaggaccacaagccgttcggggacgacgaagtggaattatttcgagctgtgccaggcctgaagctcaagattgctgggaaatctctacccacagagaagtttgccatccggaagtcccggcgctacttctcctccaaccctatctcgctgccagtgcctgctctggaaatgatgtacatctggaacggctacgccgtgattgggaagcagccgaaactcacggatgggatacttgagattatcactaaggctgaagagatgctggagaaaggcccagagaacgagtactcagtggatgacgagtgcttggtgaaattgttgaaaggcctgtgtctgaaatacctgggccgtgtccaggaggccgaggagaattttaggagcatctctgccaatgaaaagaagattaaatatgaccactacttgatcccaaacgccctgctggagctggccctgctgcttatggagcaagacagaaacgaagaggccatcaaacttttggaatctgccaagcaaaactacaagaattactccatggagtcaaggacacactttcgaatccaggcagccacactccaagccaagtcttccctagagaacagcagcagatccatggtctcatcagtgtccttgtagctttgtgcagcagttccgggctggaagacagagacagctggacagagctcctgaaaacatttcaaaataccccctccccctgccctgccctgcctttggggtccaccggcactccagttggatggcacaacatagtgtatccgtgcagaagccgagctggcattttcaccagtgtagccaagggcctttgccaagggcagagcaggtggagccctctgcctgccctatcacacatacgggtacttgcttttcactgtgatgtttaagagaatgtatgaacagtttacattttccttagaaatacattgatgggatcacagttggctttaaaaaccaacaacaatcaaccacctgtaagtctttgtcttcacctattatcatctggaggtaaatctctttatatgatgatgccaaagggcaaattgcttttcaaattcagcaagttctcagcttgtgtgacggaaggtccttcagaggacctgaggaatgcctgggagaggctaagcctcaggcttcaatgcttctggggttgggcatgaggatgtacacagacacccactaccttactactcacacttcatttcactccttttgtaaatttccaatttaaaaatcaagcacgtctttttagtgagataaaatctgagctcttctgtagaaaaatcaatctctaccagtagaaaatgccagggcttgatggaagagctgtgtagccctttctatgccaaagccaggaaatttggggggcaggaggaggttctcagaatccagtctgtatctttgctgtatgccaaactgaaaccactgggaataatttatgaaacataaaaatcttctgtacttcactccaaggtacatttgcttactgacagcatttttgttaaaactgttattcttgaaaattgtgta

SEQ ID NO: 371988 - DNA, 2124 bp, Homo sapiens
gacttagaggggacagagaactaagtcttgttcctgcatggagtgggggaaggtttcctacgggaggggacactgtccatgcttcctactaggatcctgaggctgttggagtttgtggggttttcaggaaacaaggactatgggctgctgcagctggaggagggagcgtcagggcacagcttccgctctgtgctctgtgtcatgctcctgctgtgctaccacaccttcctcaccttcgtgctcggtactgggaacgtcaacatcgaggaggccgagaagctcttgaagccctacctgaaccggtaccctaagggtgccatcttcctgttctttgcagggaggattgaagtcattaaaggcaacattgatgcagccatccggcgtttcgaggagtgctgtgaggcccagcagcactggaagcagttccaccacatgtgctactgggagctgatgtggtgcttcacctacaagggccagtggaagatgtcctacttctacgccgacctgctcagcaaggagaactgctggtccaaggccacctacatttacatgaaggccgcctacctcagcatgtttgggaaggaggaccacaagccgttcggggacgacgaagtggaattatttcgagctgtgccaggcctgaagctcaagattgctgggaaatctctacccacagagaagtttgccatccggaagtcccggcgctacttctcctccaaccctatctcgctgccagtgcctgctctggaaatgatgtacatctggaacggctacgccgtgattgggaagcagccgaaactcacggatgggatacttgagattatcactaaggctgaagagatgctggagaaaggcccagagaacgagtactcagtggatgacgagtgcttggtgaaattgttgaaaggcctgtgtctgaaatacctgggccgtgtccaggaggccgaggagaattttaggagcatctctgccaatgaaaagaagattaaatatgaccactacttgatcccaaacgccctgctggagctggccctgctgcttatggagcaagacagaaacgaagaggccatcaaacttttggaatctgccaagcaaaactacaagaattactccatggagtcaaggacacactttcgaatccaggcagccacactccaagccaagtcttccctagagaacagcagcagatccatggtctcatcagtgtccttgtagctttgtgcagcagttccgggctggaagacagagacagctggacagagctcctgaaaacatttcaaaataccccctccccctgccctgccctgcctttggggtccaccggcactccagttggatggcacaacatagtgtatccgtgcagaagccgagctggcattttcaccagtgtagccaagggcctttgccaagggcagagcaggtggagccctctgcctgccctatcacacatacgggtacttgcttttcactgtgatgtttaagagaatgtatgaacagtttacattttccttagaaatacattgatgggatcacagttggctttaaaaaccaacaacaatcaaccacctgtaagtctttgtcttcacctattatcatctggaggtaaatctctttatatgatgatgccaaagggcaaattgcttttcaaattcagcaagttctcagcttgtgtgacggaaggtccttcagaggacctgaggaatgcctgggagaggctaagcctcaggcttcaatgcttctggggttgggcatgaggatgtacacagacacccactaccttactactcacacttcatttcactccttttgtaaatttccaatttaaaaatcaagcacgtctttttagtgagataaaatctgagctcttctgtagaaaaatcaatctctaccagtagaaaatgccagggcttgatggaagagctgtgtagccctttctatgccaaagccaggaaatttggggggcaggaggaggttctcagaatccagtctgtatctttgctgtatgccaaactgaaaccactgggaataatttatgaaacataaaaatcttctgtacttcactccaaggtacatttgcttactgacagcatttttgttaaaactgttattcttgaaaattgtgta

SEQ ID NO: 371989 - DNA, 2560 bp, Homo sapiens
  misc_feature (2095)..(2095): n is a, c, g, or t
aggcctgggggagggaggaggccttggagaaggaggagggaaaaaggggctgtgggatttagtggctgggctgcaccccctgggggggcagcagagcccaatgggccagaagggccacaaagactccctttacccttgtggagggactcctgagagcagcctccatgaggccctggaccagtgcatgaccgccctggacctcttcctcaccaaccagttctcagaagcactcagctacctcaagcccagaaccaaggaaagcatgtaccactcactgacatatgccaccatcctggagatgcaggccatgatgacctttgaccctcaggacatcctgcttgccggcaacatgatgaaggaggcacagatgctgtgtcagaggcaccggaggaagtcttctgtaacagattccttcagcagcctggtgaaccgccccacgctgggccaattcactgaagaggaaatccacgctgaggtctgctatgcagagtgcctgctgcagcgagcagccctgaccttcctgcaggacgagaacatggtgagcttcatcaaaggcggcatcaaagttcgaaacagctaccagacctacaaggagctggacagccttgttcagtcctcacaatactgcaagggtgagaaccacccgcactttgaaggaggagtgaagcttggtgtaggggccttcaacctgacactgtccatgcttcctactaggatcctgaggctgttggagtttgtggggttttcaggaaacaaggactatgggctgctgcagctggaggagggagcgtcagggcacagcttccgctctgtgctctgtgtcatgctcctgctgtgctaccacaccttcctcaccttcgtgctcggtactgggaacgtcaacatcgaggaggccgagaagctcttgaagccctacctgaaccggtaccctaagggtgccatcttcctgttctttgcagggaggattgaagtcattaaaggcaacattgatgcagtgagtgatgggggtccgggccggggctggggatccctcggggtctcccagaccagcaggaagtcaggcacatgtgacatactcagggacaggatagactgggggcggggggggggccaagagagaaccaaccagagagcaggggcaggagaggcccttctggcagagcagcctgggaagacaagggaggaggaggcatttgtggtgcctgggattttgactgggagatataggactgcagcattgcagtggagggaggtggagggaggtgcttgagggaggcagaggttaggaaagcccatctgtttagggcatgacgattaggctggagtctggtacctcccctccattatagctctctcctgctctttcattttgttactaaaaaccagagtcctaggcgggggctgtatttgagcccaacgtcatgtaagacttaggaggtaaaaccaggactggaggccagatctcctggctcctggggccccacctgagcctagcacagggctggaccactatgccctggaggagtcccggtctgctgtggtgttgggaggttcggaggatgcagaggggttggggctgggtgggcacccgtcaggctgaccagaaggtgcctgcaggccatccggcgtttcgaggagtgctgtgaggcccagcagcactggaagcagttccaccacatgtgctactgggagctgatgtggtgcttcacctacaagggccagtggaagatgtcctacttctacgccgacctgctcagcaaggagaactgctggtccaaggtgggctgatgccacgtgttaggggcattgggtgaccagggctgactgtgtgcctccagaccacgggccaaatccctaactgaacacagatgtctcagctggaatctaaacataaccttaaattctaataggactcaggcttggaaggaactaaagaccacaagagaaacttctgaaccacaatgtgtcacaaagagatttctagtcacaaaggacagaaacatggctccctctgtccagtagaactgtttctgtggtagaaatgttctacttatgcactgcccaaatatggtagtcaccagccacatgtgcacantgagcacatgaaatgtgcctagtgcaactgggaaactgattgttttcagttttatttaattttaattaactaaatgttaaatttaaatagccatgtagggcttgtggccactatattggactatgcaggtccaaaacacaaaaggctcatataactgaacattcttggcacatccgacttcaggtagggctggatccaggaattcaaatgatgtcgtctggcttggtctttccatttgtggctgtgctctctcctatgacatctttgtttctgctgcatctttgcaggaaggttctctccatgtgacaggcaaggtggccacgggctgcttctactcatatcctccccttggtttcaaccagagtcccacagtttgagcctcactggtctgacttgtcacctggtctaaccccgaagtgcatcctcacgtgccggaactataattttaactacaaccatccacac

SEQ ID NO: 371990 - DNA, 4298 bp, Homo sapiens
gggccggctcgcgggcgctgccagtctcgggcggcggtgtccggcgcgcgggcggcctgctgggcgggctgaagggttagcggagcacgggcaaggcggagagtgacggagtcggcgagcccccgcggcgacaggttctctacttaaaagacaatgactactgatgaaggtgccaagaacaatgaagaaagccccacagccactgttgctgagcagggagaggatattacctccaaaaaagacaggggagtattaaagattgtcaaaagagtggggaatggtgaggaaacgccgatgattggagacaaagtttatgtccattacaaaggaaaattgtcaaatggaaagaagtttgattccagtcatgatagaaatgaaccatttgtctttagtcttggcaaaggccaagtcatcaaggcatgggacattggggtggctaccatgaagaaaggagagatatgccatttactgtgcaaaccagaatatgcatatggctcggctggcagtctccctaaaattccctcgaatgcaactctcttttttgagattgagctccttgatttcaaaggagaggatttatttgaagatggaggcattatccggagaaccaaacggaaaggagagggatattcaaatccaaacgaaggagcaacagtagaaatccacctggaaggccgctgtggtggaaggatgtttgactgcagagatgtggcattcactgtgggcgaaggagaagaccacgacattccaattggaattgacaaagctctggagaaaatgcagcgggaagaacaatgtattttatatcttggaccaagatatggttttggagaggcagggaagcctaaatttggcattgaacctaatgctgagcttatatatgaagttacacttaagagcttcgaaaaggccaaagaatcctgggagatggataccaaagaaaaattggagcaggctgccattgtcaaagagaagggaaccgtatacttcaagggaggcaaatacatgcaggcggtgattcagtatgggaagatagtgtcctggttagagatggaatatggtttatcagaaaaggaatcgaaagcttctgaatcatttctccttgctgcctttctgaacctggccatgtgctacctgaagcttagagaatacaccaaagctgttgaatgctgtgacaaggcccttggactggacagtgccaatgagaaaggcttgtataggaggggtgaagcccagctgctcatgaacgagtttgagtcagccaagggtgactttgagaaagtgctggaagtaaacccccagaataaggctgcaagactgcagatctccatgtgccagaaaaaggccaaggagcacaacgagcgggaccgcaggatatacgccaacatgttcaagaagtttgcagagcaggatgccaaggaagaggccaataaagcaatgggcaagaagacttcagaaggggtcactaatgaaaaaggaacagacagtcaagcaatggaagaagagaaacctgagggccacgtatgacgccacgccaaggagggaagagtcccagtgaactcggcccctcctcaatgggctttcccccaactcaggacagaacagtgtttaatgtaaagtttgttatagtctatgtgattctggaagcaaatggcaaaaccagtagcttcccaaaaacagcccccctgctgctgcccggagggttcactgaggggtggcacgggaccactccaggtggaacaaacagaaatgactgtggtgtggagggagtgagccagcagcttaagtccagctcatttcagtttctatcaaccttcaagtatccaattcagggtccctggagatcatcctaacaatgtggggctgttaggttttacctttgaactttcatagcactgcagaaacctttaaaaaaaaaatgcttcatgaatttctcctttcctacagttgggtagggtaggggaaggaggataagcttttgttttttaaatgactgaagtgctataaatgtagtctgttgcatttttaaccaacagaacccacagtagaggggtctcatgtctccccagttccacagcagtgtcacagacgtgaaagccagaacctcagaggccacttgcttgctgacttagcctcctcccaaagtccccctcctcagccagcctccttgtgagagtggctttctaccacacacagcctgtccctgggggagtaattctgtcattcctaaaacacccttcagcaatgataatgagcagatgagagtttctggattagcttttcctattttcgatgaagttctgagatactgaaatgtgaaaagagcaatcagaattgtgctttttctcccctcctctattccttttagggaataatattcaatacacagtacttcctcccagcattgctactgctcagcttcttctttcattctaatccttgctattaagaatttaagacttgtgcttacaatatttttgacctggagtggatctatttacatagtcatttaggatccatgcagctttttttgtctttttaagattattggctcataagcatatgtatactggtttatggaactttatttacactcctctatcatgcaaaaaaattttgactttttagtactaagcttaatttttaaaaacaaaatctgtagtgttgacaaataaatagttgctcttctacactaggggtttcacctgcaggtttgacacgcagttgctcgcttttcctgccctgtcaagcttctctgttctggcgtgagttgtgaaagagttgaagacagcttcccatgccggtacacagccagtagcctaaatctccagtacttgagctgaccattgaactagggcaagtcttaaatgtgtacatgtagttgaatttcagtccttacgggtaaacagattgagcatggctctctattccctcagcctaagaaacactcatgggaatgcatttggcaacccaaggaaccatttgcttaaacctggaacatctcacctttttaaatcctaaaaaacactggcagttatattttaaattagtttttatttttatgatggttttatcaaaagacttttattattagattgggacccccttcaaacctaaaaatcaagttatttccttttataatacttttcttccccatggaacaaatgggatcaatttgtgagttttttcctttaatgataactaaaatccctctaatttctcatttatgcttttgtcttttttatgaaatatttcttttaaaagccccagtctcacctacgaaatatgaagagcaaaagctgattttgcttacttgctaaactgttgggaaagctctgtagagcatggttccagtgaggccaagattgaaatttgatactaaaaaggccacctagctttttgcagataacaaacaagaaagctattccaagactcagatgatgccagctgtctcccacgtgtgtattatggttcaccagggggaactggcaaaagtgtgtgtggggaggggaagggtgtgtgagtggttctgagcaaataactacagggtgcccattaccactcaagaagacacttcacgtattcttgtatcaaattcaataatcttaaacaatttgtgtagaagtccacagacatctttcaaccaccttttaggctgcatatggattgccaagtcagcatatgaggaattaaagacattgttttttaaaaaaaaaaatcatttagatgcacttttttgtgtgttctttaaataaatccaaaaaaaatgtgaaaaaaaaaaaaaaaaaaaaaaaaaaaaaacaaaaaaaagaacgaaaaaaaaaaaaaaaaaaaaagagagagggggcgagcagcgagatcaaaagaataatccggctaaaggggcggccacaacgaatcgcggccgacacacgagtactgatggagaagaggaggggtggcccataaagtaggcggctaaaattaatgacgtcaagacgacgcgggcccgctgatatattcacaaacctgcttgcgtaagcgaggagagaaaacaacactgtacgtcaatgatggggaaactacttcgggagaaagagcgcccaccatcatacggtgggggggggcaacaacagatagtcgggaacaccactccccccctgacagaaatagaatgctgacgccactcaaggggaataaaatgaaacccatgaccgaggtgtacaactgggggggtacaccacaccaacacgtactatctgctgcgcgacacaaaagatgtcaaccagagagtcattaggaccaaaacatttaagagg

SEQ ID NO: 371991 - DNA, 3772 bp, Homo sapiens
gggccggctcgcgggcgctgccagtctcgggcggcggtgtccggcgcgcgggcggcctgctgggcgggctgaagggttagcggagcacgggcaaggcggagagtgacggagtcggcgagcccccgcggcgacaggttctctacttaaaagacaatgactactgatgaaggtgccaagaacaatgaagaaagccccacagccactgttgctgagcagggagaggatattacctccaaaaaagacaggggagtattaaagattgtcaaaagagtggggaatggtgaggaaacgccgatgattggagacaaagtttatgtccattacaaaggaaaattgtcaaatggaaagaagtttgattccagtcatgatagaaatgaaccatttgtctttagtcttggcaaaggccaagtcatcaaggcatgggacattggggtggctaccatgaagaaaggagagatatgccatttactgtgcaaaccagaatatgcatatggctcggctggcagtctccctaaaattccctcgaatgcaactctcttttttgagattgagctccttgatttcaaaggagaggatttatttgaagatggaggcattatccggagaaccaaacggaaaggagagggatattcaaatccaaacgaaggagcaacagtagaaatccacctggaaggccgctgtggtggaaggatgtttgactgcagagatgtggcattcactgtgggcgaaggagaagaccacgacattccaattggaattgacaaagctctggagaaaatgcagcgggaagaacaatgtattttatatcttggaccaagatatggttttggagaggcagggaagcctaaatttggcattgaacctaatgctgagcttatatatgaagttacacttaagagcttcgaaaaggccaaagaatcctgggagatggataccaaagaaaaattggagcaggctgccattgtcaaagagaagggaaccgtatacttcaagggaggcaaatacatgcaggcggtgattcagtatgggaagatagtgtcctggttagagatggaatatggtttatcagaaaaggaatcgaaagcttctgaatcatttctccttgctgcctttctgaacctggccatgtgctacctgaagcttagagaatacaccaaagctgttgaatgctgtgacaaggcccttggactggacagtgccaatgagaaaggcttgtataggaggggtgaagcccagctgctcatgaacgagtttgagtcagccaagggtgactttgagaaagtgctggaagtaaacccccagaataaggctgcaagactgcagatctccatgtgccagaaaaaggccaaggagcacaacgagcgggaccgcaggatatacgccaacatgttcaagaagtttgcagagcaggatgccaaggaagaggccaataaagcaatgggcaagaagacttcagaaggggtcactaatgaaaaaggaacagacagtcaagcaatggaagaagagaaacctgagggccacgtatgacgccacgccaaggagggaagagtcccagtgaactcggcccctcctcaatgggctttcccccaactcaggacagaacagtgtttaatgtaaagtttgttatagtctatgtgattctggaagcaaatggcaaaaccagtagcttcccaaaaacagcccccctgctgctgcccggagggttcactgaggggtggcacgggaccactccaggtggaacaaacagaaatgactgtggtgtggagggagtgagccagcagcttaagtccagctcatttcagtttctatcaaccttcaagtatccaattcagggtccctggagatcatcctaacaatgtggggctgttaggttttacctttgaactttcatagcactgcagaaacctttaaaaaaaaaatgcttcatgaatttctcctttcctacagttgggtagggtaggggaaggaggataagcttttgttttttaaatgactgaagtgctataaatgtagtctgttgcatttttaaccaacagaacccacagtagaggggtctcatgtctccccagttccacagcagtgtcacagacgtgaaagccagaacctcagaggccacttgcttgctgacttagcctcctcccaaagtccccctcctcagccagcctccttgtgagagtggctttctaccacacacagcctgtccctgggggagtaattctgtcattcctaaaacacccttcagcaatgataatgagcagatgagagtttctggattagcttttcctattttcgatgaagttctgagatactgaaatgtgaaaagagcaatcagaattgtgctttttctcccctcctctattccttttagggaataatattcaatacacagtacttcctcccagcattgctactgctcagcttcttctttcattctaatccttgctattaagaatttaagacttgtgcttacaatatttttgacctggagtggatctatttacatagtcatttaggatccatgcagctttttttgtctttttaagattattggctcataagcatatgtatactggtttatggaactttatttacactcctctatcatgcaaaaaaattttgactttttagtactaagcttaatttttaaaaacaaaatctgtagtgttgacaaataaatagttgctcttctacactaggggtttcacctgcaggtttgacacgcagttgctcgcttttcctgccctgtcaagcttctctgttctggcgtgagttgtgaaagagttgaagacagcttcccatgccggtacacagccagtagcctaaatctccagtacttgagctgaccattgaactagggcaagtcttaaatgtgtacatgtagttgaatttcagtccttacgggtaaacagattgagcatggctctctattccctcagcctaagaaacactcatgggaatgcatttggcaacccaaggaaccatttgcttaaacctggaacatctcacctttttaaatcctaaaaaacactggcagttatattttaaattagtttttatttttatgatggttttatcaaaagacttttattattagattgggacccccttcaaacctaaaaatcaagttatttccttttataatacttttcttccccatggaacaaatgggatcaatttgtgagttttttcctttaatgataactaaaatccctctaatttctcatttatgcttttgtcttttttatgaaatatttcttttaaaagccccagtctcacctacgaaatatgaagagcaaaagctgattttgcttacttgctaaactgttgggaaagctctgtagagcatggttccagtgaggccaagattgaaatttgatactaaaaaggccacctagctttttgcagataacaaacaagaaagctattccaagactcagatgatgccagctgtctcccacgtgtgtattatggttcaccagggggaactggcaaaagtgtgtgtggggaggggaagggtgtgtgagtggttctgagcaaataactacagggtgcccattaccactcaagaagacacttcacgtattcttgtatcaaattcaataatcttaaacaatttgtgtagaagtccacagacatctttcaaccaccttttaggctgcatatggattgccaagtcagcatatgaggaattaaagacattgttttttaaaaaaaaaaatcatttagatgcacttttttgtgtgttctttaaataaatccaaaaaaaatgtga

SEQ ID NO: 371992 - DNA, 3841 bp, Homo sapiens
gggccggctcgcgggcgctgccagtctcgggcggcggtgtccggcgcgcgggcggcctgctgggcgggctgaagggttagcggagcacgggcaaggcggagagtgacggagtcggcgagcccccgcggcgacaggttctctacttaaaagacaatgactactgatgaaggtgccaagaacaatgaagaaagccccacagccactgttgctgagcagggagaggatattacctccaaaaaagacaggggagtattaaagattgtcaaaagagtggggaatggtgaggaaacgccgatgattggagacaaagtttatgtccattacaaaggaaaattgtcaaatggaaagaagtttgattccagtcatgatagaaatgaaccatttgtctttagtcttggcaaaggccaagtcatcaaggcatgggacattggggtggctaccatgaagaaaggagagatatgccatttactgtgcaaaccagaatatgcatatggctcggctggcagtctccctaaaattccctcgaatgcaactctcttttttgagattgagctccttgatttcaaaggagaggatttatttgaagatggaggcattatccggagaaccaaacggaaaggagagggatattcaaatccaaacgaaggagcaacagtagaaatccacctggaaggccgctgtggtggaaggatgtttgactgcagagatgtggcattcactgtgggcgaaggagaagaccacgacattccaattggaattgacaaagctctggagaaaatgcagcgggaagaacaatgtattttatatcttggaccaagatatggttttggagaggcagggaagcctaaatttggcattgaacctaatgctgagcttatatatgaagttacacttaagagcttcgaaaaggccaaagaatcctgggagatggataccaaagaaaaattggagcaggctgccattgtcaaagagaagggaaccgtatacttcaagggaggcaaatacatgcaggcggtgattcagtatgggaagatagtgtcctggttagagatggaatatggtttatcagaaaaggaatcgaaagcttctgaatcatttctccttgctgcctttctgaacctggccatgtgctacctgaagcttagagaatacaccaaagctgttgaatgctgtgacaaggcccttggactggacagtgccaatgagaaaggcttgtataggaggggtgaagcccagctgctcatgaacgagtttgagtcagccaagggtgactttgagaaagtgctggaagtaaacccccagaataaggctgcaagactgcagatctccatgtgccagaaaaaggccaaggagcacaacgagcgggaccgcaggatatacgccaacatgttcaagaagtttgcagagcaggatgccaaggaagaggccaataaagcaatgggcaagaagacttcagaaggggtcactaatgaaaaaggaacagacagtcaagcaatggaagaagagaaacctgagggccacgtatgacgccacgccaaggagggaagagtcccagtgaactcggcccctcctcaatgggctttcccccaactcaggacagaacagtgtttaatgtaaagtttgttatagtctatgtgattctggaagcaaatggcaaaaccagtagcttcccaaaaacagcccccctgctgctgcccggagggttcactgaggggtggcacgggaccactccaggtggaacaaacagaaatgactgtggtgtggagggagtgagccagcagcttaagtccagctcatttcagtttctatcaaccttcaagtatccaattcagggtccctggagatcatcctaacaatgtggggctgttaggttttacctttgaactttcatagcactgcagaaacctttaaaaaaaaaatgcttcatgaatttctcctttcctacagttgggtagggtaggggaaggaggataagcttttgttttttaaatgactgaagtgctataaatgtagtctgttgcatttttaaccaacagaacccacagtagaggggtctcatgtctccccagttccacagcagtgtcacagacgtgaaagccagaacctcagaggccacttgcttgctgacttagcctcctcccaaagtccccctcctcagccagcctccttgtgagagtggctttctaccacacacagcctgtccctgggggagtaattctgtcattcctaaaacacccttcagcaatgataatgagcagatgagagtttctggattagcttttcctattttcgatgaagttctgagatactgaaatgtgaaaagagcaatcagaattgtgctttttctcccctcctctattccttttagggaataatattcaatacacagtacttcctcccagcattgctactgctcagcttcttctttcattctaatccttgctattaagaatttaagacttgtgcttacaatatttttgacctggagtggatctatttacatagtcatttaggatccatgcagctttttttgtctttttaagattattggctcataagcatatgtatactggtttatggaactttatttacactcctctatcatgcaaaaaaattttgactttttagtactaagcttaatttttaaaaacaaaatctgtagtgttgacaaataaatagttgctcttctacactaggggtttcacctgcaggtttgacacgcagttgctcgcttttcctgccctgtcaagcttctctgttctggcgtgagttgtgaaagagttgaagacagcttcccatgccggtacacagccagtagcctaaatctccagtacttgagctgaccattgaactagggcaagtcttaaatgtgtacatgtagttgaatttcagtccttacgggtaaacagattgagcatggctctctattccctcagcctaagaaacactcatgggaatgcatttggcaacccaaggaaccatttgcttaaacctggaacatctcacctttttaaatcctaaaaaacactggcagttatattttaaattagtttttatttttatgatggttttatcaaaagacttttattattagattgggacccccttcaaacctaaaaatcaagttatttccttttataatacttttcttccccatggaacaaatgggatcaatttgtgagttttttcctttaatgataactaaaatccctctaatttctcatttatgcttttgtcttttttatgaaatatttcttttaaaagccccagtctcacctacgaaatatgaagagcaaaagctgattttgcttacttgctaaactgttgggaaagctctgtagagcatggttccagtgaggccaagattgaaatttgatactaaaaaggccacctagctttttgcagataacaaacaagaaagctattccaagactcagatgatgccagctgtctcccacgtgtgtattatggttcaccagggggaactggcaaaagtgtgtgtggggaggggaagggtgtgtgagtggttctgagcaaataactacagggtgcccattaccactcaagaagacacttcacgtattcttgtatcaaattcaataatcttaaacaatttgtgtagaagtccacagacatctttcaaccaccttttaggctgcatatggattgccaagtcagcatatgaggaattaaagacattgttttttaaaaaaaaaaatcatttagatgcacttttttgtgtgttctttaaataaatccaaaaaaaatgtgaaaaaaaaaaatcaaaaatatcatatattattataattttatataaaaaatatttaatataatagggaaa

SEQ ID NO: 371993 - DNA, 3706 bp, Homo sapiens
gggccggctcgcgggcgctgccagtctcgggcggcggtgtccggcgcgcgggcggcctgctgggcgggctgaagggttagcggagcacgggcaaggcggagagtgacggagtcggcgagcccccgcggcgacaggttctctacttaaaagacaatgactactgatgaaggtgccaagaacaatgaagaaagccccacagccactgttgctgagcagggagaggatattacctccaaaaaagacaggggagtattaaagattgtcaaaagagtggggaatggtgaggaaacgccgatgattggagacaaagtttatgtccattacaaaggaaaattgtcaaatggaaagaagtttgattccagtcatgatagaaatgaaccatttgtctttagtcttggcaaaggccaagtcatcaaggcatgggacattggggtggctaccatgaagaaaggagagatatgccatttactgtgcaaaccagaatatgcatatggctcggctggcagtctccctaaaattccctcgaatgcaactctcttttttgagattgagctccttgatttcaaaggagaggatttatttgaagatggaggcattatccggagaaccaaacggaaaggagagggatattcaaatccaaacgaaggagcaacagtagaaatccacctggaaggccgctgtggtggaaggatgtttgactgcagagatgtggcattcactgtgggcgaaggagaagaccacgacattccaattggaattgacaaagctctggagaaaatgcagcgggaagaacaatgtattttatatcttggaccaagatatggttttggagaggcagggaagcctaaatttggcattgaacctaatgctgagcttatatatgaagttacacttaagagcttcgaaaaggccaaagaatcctgggagatggataccaaagaaaaattggagcaggctgccattgtcaaagagaagggaaccgtatacttcaagggaggcaaatacatgcaggcggtgattcagtatgggaagatagtgtcctggttagagatggaatatggtttatcagaaaaggaatcgaaagcttctgaatcatttctccttgctgcctttctgaacctggccatgtgctacctgaagcttagagaatacaccaaagctgttgaatgctgtgacaaggcccttggactggacagtgccaatgagaaaggcttgtataggaggggtgaagcccagctgctcatgaacgagtttgagtcagccaagggtgactttgagaaagtgctggaagtaaacccccagaataaggctgcaagactgcagatctccatgtgccagaaaaaggccaaggagcacaacgagcgggaccgcaggatatacgccaacatgttcaagaagtttgcagagcaggatgccaaggaagaggccaataaagcaatgggcaagaagacttcagaaggggtcactaatgaaaaaggaacagacagtcaagcaatggaagaagagaaacctgagggccacgtatgacgccacgccaaggagggaagagtcccagtgaactcggcccctcctcaatgggctttcccccaactcaggacagaacagtgtttaatgtaaagtttgttatagtctatgtgattctggaagcaaatggcaaaaccagtagcttcccaaaaacagcccccctgctgctgcccggagggttcactgaggggtggcacgggaccactccaggtggaacaaacagaaatgactgtggtgtggagggagtgagccagcagcttaagtccagctcatttcagtttctatcaaccttcaagtatccaattcagggtccctggagatcatcctaacaatgtggggctgttaggttttacctttgaactttcatagcactgcagaaacctttaaaaaaaaaatgcttcatgaatttctcctttcctacagttgggtagggtaggggaaggaggataagcttttgttttttaaatgactgaagtgctataaatgtagtctgttgcatttttaaccaacagaacccacagtagaggggtctcatgtctccccagttccacagcagtgtcacagacgtgaaagccagaacctcagaggccacttgcttgctgacttagcctcctcccaaagtccccctcctcagccagcctccttgtgagagtggctttctaccacacacagcctgtccctgggggagtaattctgtcattcctaaaacacccttcagcaatgataatgagcagatgagagtttctggattagcttttcctattttcgatgaagttctgagatactgaaatgtgaaaagagcaatcagaattgtgctttttctcccctcctctattccttttagggaataatattcaatacacagtacttcctcccagcattgctactgctcagcttcttctttcattctaatccttgctattaagaatttaagacttgtgcttacaatatttttgacctggagtggatctatttacatagtcatttaggatccatgcagctttttttgtctttttaagattattggctcataagcatatgtatactggtttatggaactttatttacactcctctatcatgcaaaaaaattttgactttttagtactaagcttaatttttaaaaacaaaatctgtagtgttgacaaataaatagttgctcttctacactaggggtttcacctgcaggtttgacacgcagttgctcgcttttcctgccctgtcaagcttctctgttctggcgtgagttgtgaaagagttgaagacagcttcccatgccggtacacagccagtagcctaaatctccagtacttgagctgaccattgaactagggcaagtcttaaatgtgtacatgtagttgaatttcagtccttacgggtaaacagattgagcatggctctctattccctcagcctaagaaacactcatgggaatgcatttggcaacccaaggaaccatttgcttaaacctggaacatctcacctttttaaatcctaaaaaacactggcagttatattttaaattagtttttatttttatgatggttttatcaaaagacttttattattagattgggacccccttcaaacctaaaaatcaagttatttccttttataatacttttcttccccatggaacaaatgggatcaatttgtgagttttttcctttaatgataactaaaatccctctaatttctcatttatgcttttgtcttttttatgaaatatttcttttaaaagccccagtctcacctacgaaatatgaagagcaaaagctgattttgcttacttgctaaactgttgggaaagctctgtagagcatggttccagtgaggccaagattgaaatttgatactaaaaaggccacctagctttttgcagataacaaacaagaaagctattccaagactcagatgatgccagctgtctcccacgtgtgtattatggttcaccagggggaactggcaaaagtgtgtgtggggaggggaagggtgtgtgagtggttctgagcaaataactacagggtgcccattaccactcaagaagacacttcacgtattcttgtatcaaattcaataatcttaaacaatttgtgtagaagtccacagacatctttcaaccaccttttaggctgcatatggattgccaagtcagcatatgaggaattaaagacattgttttt

SEQ ID NO: 371994 - DNA, 3366 bp, Homo sapiens
ttgcttttcttttgtaccccctcaagagctgagtacaagtaatgacgcttttttatcctagggaggcaaatacatgcaggcggtgattcagtatgggaagatagtgtcctggttagagatggaatatggtttatcagaaaaggaatcgaaagcttctgaatcatttctccttgctgcctttctgaacctggccatgtgctacctgaagcttagagaatacaccaaagctgttgaatgctgtgacaaggcccttggactggacagtgccaatgagaaaggcttgtataggaggggtgaagcccagctgctcatgaacgagtttgagtcagccaagggtgactttgagaaagtgctggaagtaaacccccagaataaggctgcaagactgcagatctccatgtgccagaaaaaggccaaggagcacaacgagcgggaccgcaggatatacgccaacatgttcaagaagtttgcagagcaggatgccaaggaagaggccaataaagcaatgggcaagaagacttcagaaggggtcactaatgaaaaaggaacagacagtcaagcaatggaagaagagaaacctgagggccacgtatgacgccacgccaaggagggaagagtcccagtgaactcggcccctcctcaatgggctttcccccaactcaggacagaacagtgtttaatgtaaagtttgttatagtctatgtgattctggaagcaaatggcaaaaccagtagcttcccaaaaacagcccccctgctgctgcccggagggttcactgaggggtggcacgggaccactccaggtggaacaaacagaaatgactgtggtgtggagggagtgagccagcagcttaagtccagctcatttcagtttctatcaaccttcaagtatccaattcagggtccctggagatcatcctaacaatgtggggctgttaggttttacctttgaactttcatagcactgcagaaacctttaaaaaaaaaatgcttcatgaatttctcctttcctacagttgggtagggtaggggaaggaggataagcttttgttttttaaatgactgaagtgctataaatgtagtctgttgcatttttaaccaacagaacccacagtagaggggtctcatgtctccccagttccacagcagtgtcacagacgtgaaagccagaacctcagaggccacttgcttgctgacttagcctcctcccaaagtccccctcctcagccagcctccttgtgagagtggctttctaccacacacagcctgtccctgggggagtaattctgtcattcctaaaacacccttcagcaatgataatgagcagatgagagtttctggattagcttttcctattttcgatgaagttctgagatactgaaatgtgaaaagagcaatcagaattgtgctttttctcccctcctctattccttttagggaataatattcaatacacagtacttcctcccagcattgctactgctcagcttcttctttcattctaatccttgctattaagaatttaagacttgtgcttacaatatttttgacctggagtggatctatttacatagtcatttaggatccatgcagctttttttgtctttttaagattattggctcataagcatatgtatactggtttatggaactttatttacactcctctatcatgcaaaaaaattttgactttttagtactaagcttaatttttaaaaacaaaatctgtagtgttgacaaataaatagttgctcttctacactaggggtttcacctgcaggtttgacacgcagttgctcgcttttcctgccctgtcaagcttctctgttctggcgtgagttgtgaaagagttgaagacagcttcccatgccggtacacagccagtagcctaaatctccagtacttgagctgaccattgaactagggcaagtcttaaatgtgtacatgtagttgaatttcagtccttacgggtaaacagattgagcatggctctctattccctcagcctaagaaacactcatgggaatgcatttggcaacccaaggaaccatttgcttaaacctggaacatctcacctttttaaatcctaaaaaacactggcagttatattttaaattagtttttatttttatgatggttttatcaaaagacttttattattagattgggacccccttcaaacctaaaaatcaagttatttccttttataatacttttcttccccatggaacaaatgggatcaatttgtgagttttttcctttaatgataactaaaatccctctaatttctcatttatgcttttgtcttttttatgaaatatttcttttaaaagccccagtctcacctacgaaatatgaagagcaaaagctgattttgcttacttgctaaactgttgggaaagctctgtagagcatggttccagtgaggccaagattgaaatttgatactaaaaaggccacctagctttttgcagataacaaacaagaaagctattccaagactcagatgatgccagctgtctcccacgtgtgtattatggttcaccagggggaactggcaaaagtgtgtgtggggaggggaagggtgtgtgagtggttctgagcaaataactacagggtgcccattaccactcaagaagacacttcacgtattcttgtatcaaattcaataatcttaaacaatttgtgtagaagtccacagacatctttcaaccaccttttaggctgcatatggattgccaagtcagcatatgaggaattaaagacattgttttttaaaaaaaaaaatcatttagatgcacttttttgtgtgttctttaaataaatccaaaaaaaatgtgaaaaaaaaaaaaaaaaaaaaaaaaaaaaaacaaaaaaaagaacgaaaaaaaaaaaaaaaaaaaaagagagagggggcgagcagcgagatcaaaagaataatccggctaaaggggcggccacaacgaatcgcggccgacacacgagtactgatggagaagaggaggggtggcccataaagtaggcggctaaaattaatgacgtcaagacgacgcgggcccgctgatatattcacaaacctgcttgcgtaagcgaggagagaaaacaacactgtacgtcaatgatggggaaactacttcgggagaaagagcgcccaccatcatacggtgggggggggcaacaacagatagtcgggaacaccactccccccctgacagaaatagaatgctgacgccactcaaggggaataaaatgaaacccatgaccgaggtgtacaactgggggggtacaccacaccaacacgtactatctgctgcgcgacacaaaagatgtcaaccagagagtcattaggaccaaaacatttaagagg

SEQ ID NO: 371995 - DNA, 3572 bp, Homo sapiens
gtagggtctggagcaggtataaggatctgggtctgttcatgtctgagaaggcaggatctggcccattaggattatgaggatctgggtctgtcagtagctgaagaggtagtatctgagcatgggtataaggatctggatctgtcaatatctgaggaagtaggatctggccctggtatgaggatctgagtctgtcaatgtcttaggaggtaggctctggtacaggtgagaggctctgggtctgtccatgtctgaggaggtaggatctggcatagatacaaggatctaggtttttcaatgtatgggaagatagtgtcctggttagagatggaatatggtttatcagaaaaggaatcgaaagcttctgaatcatttctccttgctgcctttctgaacctggccatgtgctacctgaagcttagagaatacaccaaagctgttgaatgctgtgacaaggcccttggactggacagtgccaatgagaaaggcttgtataggaggggtgaagcccagctgctcatgaacgagtttgagtcagccaagggtgactttgagaaagtgctggaagtaaacccccagaataaggctgcaagactgcagatctccatgtgccagaaaaaggccaaggagcacaacgagcgggaccgcaggatatacgccaacatgttcaagaagtttgcagagcaggatgccaaggaagaggccaataaagcaatgggcaagaagacttcagaaggggtcactaatgaaaaaggaacagacagtcaagcaatggaagaagagaaacctgagggccacgtatgacgccacgccaaggagggaagagtcccagtgaactcggcccctcctcaatgggctttcccccaactcaggacagaacagtgtttaatgtaaagtttgttatagtctatgtgattctggaagcaaatggcaaaaccagtagcttcccaaaaacagcccccctgctgctgcccggagggttcactgaggggtggcacgggaccactccaggtggaacaaacagaaatgactgtggtgtggagggagtgagccagcagcttaagtccagctcatttcagtttctatcaaccttcaagtatccaattcagggtccctggagatcatcctaacaatgtggggctgttaggttttacctttgaactttcatagcactgcagaaacctttaaaaaaaaaatgcttcatgaatttctcctttcctacagttgggtagggtaggggaaggaggataagcttttgttttttaaatgactgaagtgctataaatgtagtctgttgcatttttaaccaacagaacccacagtagaggggtctcatgtctccccagttccacagcagtgtcacagacgtgaaagccagaacctcagaggccacttgcttgctgacttagcctcctcccaaagtccccctcctcagccagcctccttgtgagagtggctttctaccacacacagcctgtccctgggggagtaattctgtcattcctaaaacacccttcagcaatgataatgagcagatgagagtttctggattagcttttcctattttcgatgaagttctgagatactgaaatgtgaaaagagcaatcagaattgtgctttttctcccctcctctattccttttagggaataatattcaatacacagtacttcctcccagcattgctactgctcagcttcttctttcattctaatccttgctattaagaatttaagacttgtgcttacaatatttttgacctggagtggatctatttacatagtcatttaggatccatgcagctttttttgtctttttaagattattggctcataagcatatgtatactggtttatggaactttatttacactcctctatcatgcaaaaaaattttgactttttagtactaagcttaatttttaaaaacaaaatctgtagtgttgacaaataaatagttgctcttctacactaggggtttcacctgcaggtttgacacgcagttgctcgcttttcctgccctgtcaagcttctctgttctggcgtgagttgtgaaagagttgaagacagcttcccatgccggtacacagccagtagcctaaatctccagtacttgagctgaccattgaactagggcaagtcttaaatgtgtacatgtagttgaatttcagtccttacgggtaaacagattgagcatggctctctattccctcagcctaagaaacactcatgggaatgcatttggcaacccaaggaaccatttgcttaaacctggaacatctcacctttttaaatcctaaaaaacactggcagttatattttaaattagtttttatttttatgatggttttatcaaaagacttttattattagattgggacccccttcaaacctaaaaatcaagttatttccttttataatacttttcttccccatggaacaaatgggatcaatttgtgagttttttcctttaatgataactaaaatccctctaatttctcatttatgcttttgtcttttttatgaaatatttcttttaaaagccccagtctcacctacgaaatatgaagagcaaaagctgattttgcttacttgctaaactgttgggaaagctctgtagagcatggttccagtgaggccaagattgaaatttgatactaaaaaggccacctagctttttgcagataacaaacaagaaagctattccaagactcagatgatgccagctgtctcccacgtgtgtattatggttcaccagggggaactggcaaaagtgtgtgtggggaggggaagggtgtgtgagtggttctgagcaaataactacagggtgcccattaccactcaagaagacacttcacgtattcttgtatcaaattcaataatcttaaacaatttgtgtagaagtccacagacatctttcaaccaccttttaggctgcatatggattgccaagtcagcatatgaggaattaaagacattgttttttaaaaaaaaaaatcatttagatgcacttttttgtgtgttctttaaataaatccaaaaaaaatgtgaaaaaaaaaaaaaaaaaaaaaaaaaaaaaacaaaaaaaagaacgaaaaaaaaaaaaaaaaaaaaagagagagggggcgagcagcgagatcaaaagaataatccggctaaaggggcggccacaacgaatcgcggccgacacacgagtactgatggagaagaggaggggtggcccataaagtaggcggctaaaattaatgacgtcaagacgacgcgggcccgctgatatattcacaaacctgcttgcgtaagcgaggagagaaaacaacactgtacgtcaatgatggggaaactacttcgggagaaagagcgcccaccatcatacggtgggggggggcaacaacagatagtcgggaacaccactccccccctgacagaaatagaatgctgacgccactcaaggggaataaaatgaaacccatgaccgaggtgtacaactgggggggtacaccacaccaacacgtactatctgctgcgcgacacaaaagatgtcaaccagagagtcattaggaccaaaacatttaagagg

SEQ ID NO: 371996 - DNA, 3718 bp, Homo sapiens
gggccggctcgcgggcgctgccagtctcgggcggcggtgtccggcgcgcgggcggcctgctgggcgggctgaagggttagcggagcacgggcaaggcggagagtgacggagtcggcgagcccccgcggcgacaggttctctacttaaaagacaatgactactgatgaaggtgccaagaacaatgaagaaagccccacagccactgttgctgagcagggagaggatattacctccaaaaaagacaggggagtattaaagattgtcaaaagagtggggaatggtgaggaaacgccgatgattggagacaaagtttatgtccattacaaaggaaaattgtcaaatggaaagaagtttgattccagtcatgatagaaatgaaccatttgtctttagtcttggcaaaggccaagtcatcaaggcatgggacattggggtggctaccatgaagaaaggagagatatgccatttactgtgcaaaccagaatatgcatatggctcggctggcagtctccctaaaattccctcgaatgcaactctcttttttgagattgagctccttgatttcaaaggagaggatttatttgaagatggaggcattatccggagaaccaaacggaaaggagagggatattcaaatccaaacgaaggagcaacagtagaaatccacctggaaggccgctgtggtggaaggatgtttgactgcagagatgtggcattcactgtgggcgaaggagaagaccacgacattccaattggaattgacaaagctctggagaaaatgcagcgggaagaacaatgtattttatatcttggaccaagatatggttttggagaggcagggaagcctaaatttggcattgaacctaatgctgagcttatatatgaagttacacttaagagcttcgaaaaggccaaagaatcctgggagatggataccaaagaaaaattggagcaggctgccattgtcaaagagaagggaaccgtatacttcaagggaggcaaatacatgcaggcggtgattcagtatgggaagatagtgtcctggttagagatggaatatggtttatcagaaaaggaatcgaaagcttctgaatcatttctccttgctgcctttctgaacctggccatgtgctacctgaagcttagagaatacaccaaagctgttgaatgctgtgacaaggcccttggactggacagtgccaatgagaaaggcttgtataggaggggtgaagcccagctgctcatgaacgagtttgagtcagccaagggtgactttgagaaagtgctggaagtaaacccccagaataaggctgcaagactgcagatctccatgtgccagaaaaaggccaaggagcacaacgagcgggaccgcaggatatacgccaacatgttcaagaagtttgcagagcaggatgccaaggaagaggccaataaagcaatgggcaagaagacttcagaaggggtcactaatgaaaaaggaacagacagtcaagcaatggaagaagagaaacctgagggccacgtatgacgccacgccaaggagggaagagtcccagtgaactcggcccctcctcaatgggctttcccccaactcaggacagaacagtgtttaatgtaaagtttgttatagtctatgtgattctggaagcaaatggcaaaaccagtagcttcccaaaaacagcccccctgctgctgcccggagggttcactgaggggtggcacgggaccactccaggtggaacaaacagaaatgactgtggtgtggagggagtgagccagcagcttaagtccagctcatttcagtttctatcaaccttcaagtatccaattcagggtccctggagatcatcctaacaatgtggggctgttaggttttacctttgaactttcatagcactgcagaaacctttaaaaaaaaaatgcttcatgaatttctcctttcctacagttgggtagggtaggggaaggaggataagcttttgttttttaaatgactgaagtgctataaatgtagtctgttgcatttttaaccaacagaacccacagtagaggggtctcatgtctccccagttccacagcagtgtcacagacgtgaaagccagaacctcagaggccacttgcttgctgacttagcctcctcccaaagtccccctcctcagccagcctccttgtgagagtggctttctaccacacacagcctgtccctgggggagtaattctgtcattcctaaaacacccttcagcaatgataatgagcagatgagagtttctggattagcttttcctattttcgatgaagttctgagatactgaaatgtgaaaagagcaatcagaattgtgctttttctcccctcctctattccttttagggaataatattcaatacacagtacttcctcccagcattgctactgctcagcttcttctttcattctaatccttgctattaagaatttaagacttgtgcttacaatatttttgacctggagtggatctatttacatagtcatttaggatccatgcagctttttttgtctttttaagattattggctcataagcatatgtatactggtttatggaactttatttacactcctctatcatgcaaaaaaattttgactttttagtactaagcttaatttttaaaaacaaaatctgtagtgttgacaaataaatagttgctcttctacactaggggtttcacctgcaggtttgacacgcagttgctcgcttttcctgccctgtcaagcttctctgttctggcgtgagttgtgaaagagttgaagacagcttcccatgccggtacacagccagtagcctaaatctccagtacttgagctgaccattgaactagggcaagtcttaaatgtgtacatgtagttgaatttcagtccttacgggtaaacagattgagcatggctctctattccctcagcctaagaaacactcatgggaatgcatttggcaacccaaggaaccatttgcttaaacctggaacatctcacctttttaaatcctaaaaaacactggcagttatattttaaattagtttttatttttatgatggttttatcaaaagacttttattattagattgggacccccttcaaacctaaaaatcaagttatttccttttataatacttttcttccccatggaacaaatgggatcaatttgtgagttttttcctttaatgataactaaaatccctctaatttctcatttatgcttttgtcttttttatgaaatatttcttttaaaagccccagtctcacctacgaaatatgaagagcaaaagctgattttgcttacttgctaaactgttgggaaagctctgtagagcatggttccagtgaggccaagattgaaatttgatactaaaatgatgccagctgtctcccacgtgtgtattatggttcaccagggggaactggcaaaagtgtgtgtggggaggggaagggtgtgtgagtggttctgagcaaataactacagggtgcccattaccactcaagaagacacttcacgtattcttgtatcaaattcaataatcttaaacaatttgtgtagaagtccacagacatctttcaaccaccttttaggctgcatatggattgccaagtcagcatatgaggaattaaagacattgttttttaaaaaaaaaaatcatttagatgcacttttttgtgtgttctttaaataaatccaaaaaaaatgtga

SEQ ID NO: 371997 - DNA, 2402 bp, Homo sapiens
gggccggctcgcgggcgctgccagtctcgggcggcggtgtccggcgcgcgggcggcctgctgggcgggctgaagggttagcggagcacgggcaaggcggagagtgacggagtcggcgagcccccgcggcgacaggttctctacttaaaagacaatgactactgatgaaggtgccaagaacaatgaagaaagccccacagccactgttgctgagcagggagaggatattacctccaaaaaagacaggggagtattaaagattgtcaaaagagtggggaatggtgaggaaacgccgatgattggagacaaagtttatgtccattacaaaggaaaattgtcaaatggaaagaagtttgattccagtcatgatagaaatgaaccatttgtctttagtcttggcaaaggccaagtcatcaaggcatgggacattggggtggctaccatgaagaaaggagagatatgccatttactgtgcaaaccagaatatgcatatggctcggctggcagtctccctaaaattccctcgaatgcaactctcttttttgagattgagctccttgatttcaaaggagaggatttatttgaagatggaggcattatccggagaaccaaacggaaaggagagggatattcaaatccaaacgaaggagcaacagtagaaatccacctggaaggccgctgtggtggaaggatgtttgactgcagagatgtggcattcactgtgggcgaaggagaagaccacgacattccaattggaattgacaaagctctggagaaaatgcagcgggaagaacaatgtattttatatcttggaccaagatatggttttggagaggcagggaagcctaaatttggcattgaacctaatgctgagcttatatatgaagttacacttaagagcttcgaaaaggccaaagaatcctgggagatggataccaaagaaaaattggagcaggctgccattgtcaaagagaagggaaccgtatacttcaagggaggcaaatacatgcaggcggtgattcagtatgggaagatagtgtcctggttagagatggaatatggtttatcagaaaaggaatcgaaagcttctgaatcatttctccttgctgcctttctgaacctggccatgtgctacctgaagcttagagaatacaccaaagctgttgaatgctgtgacaaggcccttggactggacagtgccaatgagaaaggcttgtataggaggggtgaagcccagctgctcatgaacgagtttgagtcagccaagggtgactttgagaaagtgctggaagtaaacccccagaataaggctgcaagactgcagatctccatgtgccagaaaaaggccaaggagcacaacgagcgggaccgcaggatatacgccaacatgttcaagaagtttgcagagcaggatgccaaggaagaggccaataaagcaatgggcaagaagacttcagaaggggtcactaatgaaaaaggaacagacagtcaagcaatggaagaagagaaacctgagggccacgtatgacgccacgccaaggagggaagagtcccagtgaactcggcccctcctcaatgggctttcccccaactcaggacagaacagtgtttaatgtaaagtttgttatagtctatgtgattctggaagcaaatggcaaaaccagtagcttcccaaaaacagcccccctgctgctgcccggagggttcactgaggggtggcacgggaccactccaggtggaacaaacagaaatgactgtggtgtggagggagtgagccagcagcttaagtccagctcatttcagtttctatcaaccttcaagtatccaattcagggtccctggagatcatcctaacaatgtggggctgttaggttttacctttgaactttcatagcactgcagaaacctttaaaaaaaaaatgcttcatgaatttctcctttcctacagttgggtagggtaggggaaggaggataagcttttgttttttaaatgactgaagtgctataaatgtagtctgttgcatttttaaccaacagaacccacagtagaggggtctcatgtctccccagttccacagcagtgtcacagacgtgaaagccagaacctcagaggccacttgcttgctgacttagcctcctcccaaagtccccctcctcagccagcctccttgtgagagtggctttctaccacacacagcctgtccctgggggagtaattctgtcattcctaaaacacccttcagcaatgataatgagcagatgagagtttctggattagcttttcctattttcgatgaagttctgagatactgaaatgtgaaaagagcaatcagaattgtgctttttctcccctcctctattccttttagggaataatattcaatacacagtacttcctcccag

SEQ ID NO: 371998 - DNA, 1322 bp, Homo sapiens
actctacatcctcccacaatgatactagacagacacactggcacacctcgaaatttctgggttgtgcacagcccgagagggctcatttaagctgccatgtccactcctccaacaaatccaggcaccatctaaagggaacatgccaagtcacagtctcctttgtgaattccataatggcaagagagctctcattcagatttgcgttcctggcacccagagcacatttaataaaagttgattatacaaaaataatgacttggtcctgaactgcattctacaactgctccttgagttttgtcccatcctacaataaccatcacaagctctgctatttattctaccatttctgccctgggtctagccagtagcctaaatctccagtacttgagctgaccattgaactagggcaagtcttaaatgtgtacatgtagttgaatttcagtccttacgggtaaacagattgagcatggctctctattccctcagcctaagaaacactcatgggaatgcatttggcaacccaaggaaccatttgcttaaacctggaacatctcacctttttaaatcctaaaaaacactggcagttatattttaaattagtttttatttttatgatggttttatcaaaagacttttattattagattgggacccccttcaaacctaaaaatcaagttatttccttttataatacttttcttccccatggaacaaatgggatcaatttgtgagttttttcctttaatgataactaaaatccctctaatttctcatttatgcttttgtcttttttatgaaatatttcttttaaaagccccagtctcacctacgaaatatgaagagcaaaagctgattttgcttacttgctaaactgttgggaaagctctgtagagcatggttccagtgaggccaagattgaaatttgatactaaaaaggccacctagctttttgcagataacaaacaagaaagctattccaagactcagatgatgccagctgtctcccacgtgtgtattatggttcaccagggggaactggcaaaagtgtgtgtggggaggggaagggtgtgtgagtggttctgagcaaataactacagggtgcccattaccactcaagaagacacttcacgtattcttgtatcaaattcaataatcttaaacaatttgtgtagaagtccacagacatctttcaaccaccttttaggctgcatatggattgccaagtcagcatatgaggaattaaagacattgttttttaaaaaaaaaaatcatttagatgcacttttttgtgtgttctttaaataaatccaaaaaaaatgtga

SEQ ID NO: 371999 - DNA, 1482 bp, Homo sapiens
gggccggctcgcgggcgctgccagtctcgggcggcggtgtccggcgcgcgggcggcctgctgggcgggctgaagggttagcggagcacgggcaaggcggagagtgacggagtcggcgagcccccgcggcgacaggttctctacttaaaagacaatgactactgatgaaggtgccaagaacaatgaagaaagccccacagccactgttgctgagcagggagaggatattacctccaaaaaagacaggggagtattaaagattgtcaaaagagtggggaatggtgaggaaacgccgatgattggagacaaagtttatgtccattacaaaggaaaattgtcaaatggaaagaagtttgattccagtcatgatagaaatgaaccatttgtctttagtcttggcaaaggccaagtcatcaaggcatgggacattggggtggctaccatgaagaaaggagagatatgccatttactgtgcaaaccagaatatgcatatggctcggctggcagtctccctaaaattccctcgaatgcaactctcttttttgagattgagctccttgatttcaaaggagaggatttatttgaagatggaggcattatccggagaaccaaacggaaaggagagggatattcaaatccaaacgaaggagcaacagtagaaatccacctggaaggccgctgtggtggaaggatgtttgactgcagagatgtggcattcactgtgggcgaaggagaagaccacgacattccaattggaattgacaaagctctggagaaaatgcagcgggaagaacaatgtattttatatcttggaccaagatatggttttggagaggcagggaagcctaaatttggcattgaacctaatgctgagcttatatatgaagttacacttaagagcttcgaaaaggccaaagaatcctgggagatggataccaaagaaaaattggagcaggctgccattgtcaaagagaagggaaccgtatacttcaagggaggcaaatacatgcaggcggtgattcagtatgggaagatagtgtcctggttagagatggaatatggtttatcagaaaaggaatcgaaagcttctgaatcatttctccttgctgcctttctgaacctggccatgtgctacctgaagcttagagaatacaccaaagctgttgaatgctgtgacaaggcccttggactggacagtgccaatgagaaaggcttgtataggaggggtgaagcccagctgctcatgaacgagtttgagtcagccaagggtgactttgagaaagtgctggaagtaaacccccagaataaggctgcaagactgcagatctccatgtgccagaaaaaggccaaggagcacaacgagcgggaccgcaggatatacgccaacatgttcaagaagtttgcagagcaggatgccaagcgcgtcgaccttctgcttttcgcgaagggagagtcaggtacattggaaggatcattgctgtgg

SEQ ID NO: 372000 - DNA, 970 bp, Homo sapiens
gaacaaactcctacctctgtttgcaactaagagttacatcccccatgccaagaccttccgaggcgtcccaaagggggaaattcctcgctgccggactgcgcccacccttgaggacctcacattctctttgggcagagcggaagccagacagagacagggactacgaagcgacaatccccagccctgtgtgtgcaaggagcccccgaggggcaggcagccacgctgcagaaggctagactctccgacccccagggagcctggtgtgggctgcagggacagaacgcttctcagaggaggttctctacttaaaagacaatgactactgatgaaggtgccaagaacaatgaagaaagccccacagccactgttgctgagcagggagaggatattacctccaaaaaagacaggggagtattaaagattgtcaaaagagtggggaatggtgaggaaacgccgatgattggagacaaagtttatgtccattacaaaggaaaattgtcaaatggaaagaagtttgattccagtcatgatagaaatgaaccatttgtctttagtcttggcaaaggccaagtcatcaaggcatgggacattggggtggctaccatgaagaaaggagagatatgccatttactgtgcaaaccagaatatgcatatggctcggctggcagtctccctaaaattccctcgaatgcaactctcttttttgagattgagctccttgatttcaaaggagaggatttatttgaagatggaggcattatccggagaaccaaacggaaaggagagggatattcaaatccaaacgaaggagcaacagtagaaatccacctggaaggccgctgtggtggaaggatgtttgactgcagagatgtggcattccctcctatacaagcctttctcattggcactgtccagtccaagggccttgtcacagcattcaacagctttggtgtattctctaagcttcagg

SEQ ID NO: 372001 - DNA, 498 bp, Homo sapiens
cggctcctctctcttgagcaacattgttcaagctacagcttggtcatgatggaaagtgagttcttcaaacagtatgaagaagcactggcctagcagtaaattggcactgacacacaatttcaacagccagagtgttttcagtttggagtatcttctagaattagctgctctttgttccaataggcctcaactgatgcttttctctctgttcatctaaccattgtcacaaatttacacacaggccaaagaatcctgggagatggataccaaagaaaaattggagcaggctgccattgtcaaagagaagggaaccgtatacttcaaggtgtgtgagtccctatgcaatcctttccatctcaaagaatttattcaagtgttggtgaattgtgctgatattccctactctgaattttgtcaacactgcttggtaagaataagctgcaatttttataaatctgtcattttcaatatgaaaaatggtgagaaaacaatcatgtg

SEQ ID NO: 372002 - DNA, 583 bp, Homo sapiens
tgtatatcgtatgccatactgccttaaagccaaggggaagtggctagatgtgggggtgcatatgggctctctggctgtgacagatcccctggggacaacttcagtcagctttagtcctataatcggattgcctgacacctgcggtggcatcgataaacacatatggctcggctggcagtctccctaaaattccctcgaatgcaactctcttttttgagattgagctccttgatttcaaaggagaggatttatttgaagatggaggcattatccggagaaccaaacggaaaggagagggatattcaaatccaaacgaaggagcaacagtagaaatccacctggaaggccgctgtggtggaaggatgtttgactgcagagatgtggcattccgataaacaccggtgtttatcgatgccacctgctgagaaaaaacagcagatggctcgagaatacagagagaaaattgagagggagctaagagatatctgcaatgatgtactgtctcttttggaaaagttcttgatccccaatgcttcacaagcagagagcaaagtcttctatttgaaaatgacaggagatacta

SEQ ID NO: 372003 - DNA, 4460 bp, Homo sapiens
gaacaaactcctacctctgtttgcaactaagagttacatcccccatgccaagaccttccgaggcgtcccaaagggggaaattcctcgctgccggactgcgcccacccttgaggacctcacattctctttgggcagagcggaagccagacagagacagggactacgaagcgacaatccccagccctgtgtgtgcaaggagcccccgaggggcaggcagccacgctgcagaaggctagactctccgacccccagggagcctggtgtgggctgcagggacagaacgcttctcagaggaggttctctacttaaaagacaatgactactgatgaaggtgccaagaacaatgaagaaagccccacagccactgttgctgagcagggagaggatattacctccaaaaaagacaggggagtattaaagattgtcaaaagagtggggaatggtgaggaaacgccgatgattggagacaaagtttatgtccattacaaaggaaaattgtcaaatggaaagaagtttgattccagtcatgatagaaatgaaccatttgtctttagtcttggcaaaggccaagtcatcaaggcatgggacattggggtggctaccatgaagaaaggagagatatgccatttactgtgcaaaccagaatatgcatatggctcggctggcagtctccctaaaattccctcgaatgcaactctcttttttgagattgagctccttgatttcaaaggagaggatttatttgaagatggaggcattatccggagaaccaaacggaaaggagagggatattcaaatccaaacgaaggagcaacagtagaaatccacctggaaggccgctgtggtggaaggatgtttgactgcagagatgtggcattcactgtgggcgaaggagaagaccacgacattccaattggaattgacaaagctctggagaaaatgcagcgggaagaacaatgtattttatatcttggaccaagatatggttttggagaggcagggaagcctaaatttggcattgaacctaatgctgagcttatatatgaagttacacttaagagcttcgaaaaggccaaagaatcctgggagatggataccaaagaaaaattggagcaggctgccattgtcaaagagaagggaaccgtatacttcaagggaggcaaatacatgcaggcggtgattcagtatgggaagatagtgtcctggttagagatggaatatggtttatcagaaaaggaatcgaaagcttctgaatcatttctccttgctgcctttctgaacctggccatgtgctacctgaagcttagagaatacaccaaagctgttgaatgctgtgacaaggcccttggactggacagtgccaatgagaaaggcttgtataggaggggtgaagcccagctgctcatgaacgagtttgagtcagccaagggtgactttgagaaagtgctggaagtaaacccccagaataaggctgcaagactgcagatctccatgtgccagaaaaaggccaaggagcacaacgagcgggaccgcaggatatacgccaacatgttcaagaagtttgcagagcaggatgccaaggaagaggccaataaagcaatgggcaagaagacttcagaaggggtcactaatgaaaaaggaacagacagtcaagcaatggaagaagagaaacctgagggccacgtatgacgccacgccaaggagggaagagtcccagtgaactcggcccctcctcaatgggctttcccccaactcaggacagaacagtgtttaatgtaaagtttgttatagtctatgtgattctggaagcaaatggcaaaaccagtagcttcccaaaaacagcccccctgctgctgcccggagggttcactgaggggtggcacgggaccactccaggtggaacaaacagaaatgactgtggtgtggagggagtgagccagcagcttaagtccagctcatttcagtttctatcaaccttcaagtatccaattcagggtccctggagatcatcctaacaatgtggggctgttaggttttacctttgaactttcatagcactgcagaaacctttaaaaaaaaaatgcttcatgaatttctcctttcctacagttgggtagggtaggggaaggaggataagcttttgttttttaaatgactgaagtgctataaatgtagtctgttgcatttttaaccaacagaacccacagtagaggggtctcatgtctccccagttccacagcagtgtcacagacgtgaaagccagaacctcagaggccacttgcttgctgacttagcctcctcccaaagtccccctcctcagccagcctccttgtgagagtggctttctaccacacacagcctgtccctgggggagtaattctgtcattcctaaaacacccttcagcaatgataatgagcagatgagagtttctggattagcttttcctattttcgatgaagttctgagatactgaaatgtgaaaagagcaatcagaattgtgctttttctcccctcctctattccttttagggaataatattcaatacacagtacttcctcccagcattgctactgctcagcttcttctttcattctaatccttgctattaagaatttaagacttgtgcttacaatatttttgacctggagtggatctatttacatagtcatttaggatccatgcagctttttttgtctttttaagattattggctcataagcatatgtatactggtttatggaactttatttacactcctctatcatgcaaaaaaattttgactttttagtactaagcttaatttttaaaaacaaaatctgtagtgttgacaaataaatagttgctcttctacactaggggtttcacctgcaggtttgacacgcagttgctcgcttttcctgccctgtcaagcttctctgttctggcgtgagttgtgaaagagttgaagacagcttcccatgccggtacacagccagtagcctaaatctccagtacttgagctgaccattgaactagggcaagtcttaaatgtgtacatgtagttgaatttcagtccttacgggtaaacagattgagcatggctctctattccctcagcctaagaaacactcatgggaatgcatttggcaacccaaggaaccatttgcttaaacctggaacatctcacctttttaaatcctaaaaaacactggcagttatattttaaattagtttttatttttatgatggttttatcaaaagacttttattattagattgggacccccttcaaacctaaaaatcaagttatttccttttataatacttttcttccccatggaacaaatgggatcaatttgtgagttttttcctttaatgataactaaaatccctctaatttctcatttatgcttttgtcttttttatgaaatatttcttttaaaagccccagtctcacctacgaaatatgaagagcaaaagctgattttgcttacttgctaaactgttgggaaagctctgtagagcatggttccagtgaggccaagattgaaatttgatactaaaaaggccacctagctttttgcagataacaaacaagaaagctattccaagactcagatgatgccagctgtctcccacgtgtgtattatggttcaccagggggaactggcaaaagtgtgtgtggggaggggaagggtgtgtgagtggttctgagcaaataactacagggtgcccattaccactcaagaagacacttcacgtattcttgtatcaaattcaataatcttaaacaatttgtgtagaagtccacagacatctttcaaccaccttttaggctgcatatggattgccaagtcagcatatgaggaattaaagacattgttttttaaaaaaaaaaatcatttagatgcacttttttgtgtgttctttaaataaatccaaaaaaaatgtgaaaaaaaaaaaaaaaaaaaaaaaaaaaaaacaaaaaaaagaacgaaaaaaaaaaaaaaaaaaaaagagagagggggcgagcagcgagatcaaaagaataatccggctaaaggggcggccacaacgaatcgcggccgacacacgagtactgatggagaagaggaggggtggcccataaagtaggcggctaaaattaatgacgtcaagacgacgcgggcccgctgatatattcacaaacctgcttgcgtaagcgaggagagaaaacaacactgtacgtcaatgatggggaaactacttcgggagaaagagcgcccaccatcatacggtgggggggggcaacaacagatagtcgggaacaccactccccccctgacagaaatagaatgctgacgccactcaaggggaataaaatgaaacccatgaccgaggtgtacaactgggggggtacaccacaccaacacgtactatctgctgcgcgacacaaaagatgtcaaccagagagtcattaggaccaaaacatttaagagg

SEQ ID NO: 372004 - DNA, 3992 bp, Homo sapiens
gggccggctcgcgggcgctgccagtctcgggcggcggtgtccggcgcgcgggcggcctgctgggcgggctgaagggttagcggagcacgggcaaggcggagagtgacggagtcggcgagcccccgcggcgacaggttctctacttaaaagacaatgactactgatgaaggtgccaagaacaatgaagaaagccccacagccactgttgctgagcagggagaggatattacctccaaaaaagacaggggagtattaaagattgtcaaaagagtggggaatggtgaggaaacgccgatgattggagacaaagtttatgtccattacaaaggaaaattgtcaaatggaaagaagtttgattccagtcatgatagaaatgaaccatttgtctttagtcttggcaaaggccaagtcatcaaggcatgggacattggggtggctaccatgaagaaaggagagatatgccatttactgtgcaaaccagaatatgcatatggctcggctggcagtctccctaaaattccctcgaatgcaactctcttttttgagattgagctccttgatttcaaaggagaggatttatttgaagatggaggcattatccggagaaccaaacggaaaggagagggatattcaaatccaaacgaaggagcaacagtagaaatccacctggaaggccgctgtggtggaaggatgtttgactgcagagatgtggcattcactgtgggcgaaggagaagaccacgacattccaattggaattgacaaagctctggagaaaatgcagcgggaagaacaatgtattttatatcttggaccaagatatggttttggagaggcagggaagcctaaatttggcattgaacctaatgctgagcttatatatgaagttacacttaagagcttcgaaaaggccaaagaatcctgggagatggataccaaagaaaaattggagcaggctgccattgtcaaagagaagggaaccgtatacttcaagggaggcaaatacatgcaggcggtgattcagtatgggaagatagtgtcctggttagagatggaatatggtttatcagaaaaggaatcgaaagcttctgaatcatttctccttgctgcctttctgaacctggccatgtgctacctgaagcttagagaatacaccaaagctgttgaatgctgtgacaaggcccttggactggacagtgccaatgagaaaggcttgtataggaggggtgaagcccagctgctcatgaacgagtttgagtcagccaagggtgactttgagaaagtgctggaagtaaacccccagaataaggctgcaagactgcagatctccatgtgccagaaaaaggccaaggagcacaacgagcgggaccgcaggatatacgccaacatgttcaagaagtttgcagagcaggatgccaaggaagaggccaataaagcaatgggcaagaagacttcagaaggggtcactaatgaaaaaggaacagacagtcaagcaatggaagaagagaaacctgagggccacgtatgacgccacgccaaggagggaagagtcccagtgaactcggcccctcctcaatgggctttcccccaactcaggacagaacagtgtttaatgtaaagtttgttatagtctatgtgattctggaagcaaatggcaaaaccagtagcttcccaaaaacagcccccctgctgctgcccggagggttcactgaggggtggcacgggaccactccaggtggaacaaacagaaatgactgtggtgtggagggagtgagccagcagcttaagtccagctcatttcagtttctatcaaccttcaagtatccaattcagggtccctggagatcatcctaacaatgtggggctgttaggttttacctttgaactttcatagcactgcagaaacctttaaaaaaaaaatgcttcatgaatttctcctttcctacagttgggtagggtaggggaaggaggataagcttttgttttttaaatgactgaagtgctataaatgtagtctgttgcatttttaaccaacagaacccacagtagaggggtctcatgtctccccagttccacagcagtgtcacagacgtgaaagccagaacctcagaggccacttgcttgctgacttagcctcctcccaaagtccccctcctcagccagcctccttgtgagagtggctttctaccacacacagcctgtccctgggggagtaattctgtcattcctaaaacacccttcagcaatgataatgagcagatgagagtttctggattagcttttcctattttcgatgaagttctgagatactgaaatgtgaaaagagcaatcagaattgtgctttttctcccctcctctattccttttagggaataatattcaatacacagtacttcctcccagcattgctactgctcagcttcttctttcattctaatccttgctattaagaatttaagacttgtgcttacaatatttttgacctggagtggatctatttacatagtcatttaggatccatgcagctttttttgtctttttaagattattggctcataagcatatgtatactggtttatggaactttatttacactcctctatcatgcaaaaaaattttgactttttagtactaagcttaatttttaaaaacaaaatctgtagtgttgacaaataaatagttgctcttctacactaggggtttcacctgcaggtttgacacgcagttgctcgcttttcctgccctgtcaagcttctctgttctggcgtgagttgtgaaagagttgaagacagcttcccatgccggtacacagccagtagcctaaatctccagtacttgagctgaccattgaactagggcaagtcttaaatgtgtacatgtagttgaatttcagtccttacgggtaaacagattgagcatggctctctattccctcagcctaagaaacactcatgggaatgcatttggcaacccaaggaaccatttgcttaaacctggaacatctcacctttttaaatcctaaaaaacactggcagttatattttaaattagtttttatttttatgatggttttatcaaaagacttttattattagattgggacccccttcaaacctaaaaatcaagttatttccttttataatacttttcttccccatggaacaaatgggatcaatttgtgagttttttcctttaatgataactaaaatccctctaatttctcatttatgcttttgtcttttttatgaaatatttcttttaaaagccccagtctcacctacgaaatatgaagagcaaaagctgattttgcttacttgctaaactgttgggaaagctctgtagagcatggttccagtgaggccaagattgaaatttgatactaaaaaggccacctagctttttgcagataacaaacaagaaagctattccaagactcagatgatgccagctgtctcccacgtgtgtattatggttcaccagggggaactggcaaaagtgtgtgtggggaggggaagggtgtgtgagtggttctgagcaaataactacagggtgcccattaccactcaagaagacacttcacgtattcttgtatcaaattcaataatcttaaacaatttgtgtagaagtccacagacatctttcaaccaccttttaggctgcatatggattgccaagtcagcatatgaggaattaaagacattgttttttaaaaaaaaaaatcatttagatgcacttttttgtgtgttctttaaataaatccaaaaaaaatgtgacttcccattgtttttggttttgcttaagtgattttcagggaaagctatattggttaaaaaaccatggtgggggccaacttgaagaaattagacatcagagaggtcaggcgtagtggctcatgcctgtaatcccagcactttgggaggccaaggcaggtgcatcacctgaggtcaggagtttgagaccagcctggccaatgtggtaaaaccctgtctctac

SEQ ID NO: 372005 - DNA, 1315 bp, Homo sapiens
gggccggctcgcgggcgctgccagtctcgggcggcggtgtccggcgcgcgggcggcctgctgggcgggctgaagggttagcggagcacgggcaaggcggagagtgacggagtcggcgagcccccgcggcgacaggttctctacttaaaagacaatgactactgatgaaggtgccaagaacaatgaagaaagccccacagccactgttgctgagcagggagaggatattacctccaaaaaagacaggggagtattaaagattgtcaaaagagtggggaatggtgaggaaacgccgatgattggagacaaagtttatgtccattacaaaggaaaattgtcaaatggaaagaagtttgattccagtcatgatagaaatgaaccatttgtctttagtcttggcaaaggccaagtcatcaaggcatgggacattggggtggctaccatgaagaaaggagagatatgccatttactgtgcaaaccagaatatgcatatggctcggctggcagtctccctaaaattccctcgaatgcaactctcttttttgagattgagctccttgatttcaaaggagaggatttatttgaagatggaggcattatccggagaaccaaacggaaaggagagggatattcaaatccaaacgaaggagcaacagtagaaatccacctggaaggccgctgtggtggaaggatgtttgactgcagagatgtggcattcactgtgggcgaaggagaagaccacgacattccaattggaattgacaaagctctggagaaaatgcagcgggaagaacaatgtattttatatcttggaccaagatatggttttggagaggcagggaagcctaaatttggcattgaacctaatgctgagcttatatatgaagttacacttaagagcttcgaaaaggccaaagaatcctgggagatggataccaaagaaaaattggagcaggctgccattgtcaaagagaagggaaccgtatacttcaagggaggcaaatacatgcaggcggtgattcagtatgggaagatagtgtcctggttagagatggaatatggtttatcagaaaaggaatcgaaagcttctgaatcatttctccttgctgcctttctgaacctggccatgtgctacctgaagcttagagaatacaccaaagctgttgaatgctgtgacaaggcccttggctgactcaaactcgttcatgagcagctgggcttcacccctcctatacaagcctttctcattggcactgtccagtccaagggccttgtcacagcattcaacagctttggtgtattctctaagcttcagg

SEQ ID NO: 372006 - DNA, 632 bp, Homo sapiens
gaacaaactcctacctctgtttgcaactaagagttacatcccccatgccaagaccttccgaggcgtcccaaagggggaaattcctcgctgccggactgcgcccacccttgaggacctcacattctctttgggcagagcggaagccagacagagacagggactacgaagcgacaatccccagccctgtgtgtgcaaggagcccccgaggggcaggcagccacgctgcagaaggctagactctccgacccccagggagcctggtgtgggctgcagggacagaacgcttctcagaggaggttctctacttaaaagacaatgactactgatgaaggtgccaagaacaatgaagaaagccccacagccactgttgctgagcagggagaggatattacctccaaaaaagacaggggagtattaaagattgtcaaaagagtggggaatggtgattatcctgatcttgtcccaattcctgccaggtatggaggagggtaaccacatgacaaaaaaataaactgctgagaatgacgaatatcaggtattcggaggattaggaagttaaggatacagaaagagagagaggatcaaacaaacatggcatcaggcaggtccacaagaaagaaagctgtgagaaa

SEQ ID NO: 372007 - DNA, 3178 bp, Homo sapiens
cgaagcgctatgtcaaaccgccagggctttaaacgacggcagtactataacgggcccgcccaggcggctgcccgtgacctgcctgggcgcggggaactgaaagccggaaggggcaagacgggttcagttcgtcatggggctgtttggaaagacccaggagaagccgcccaaagaactggtcaatgagtggtcattgaagataagaaaggaaatgagagttgttgacaggcaaataagggatatccaaagagaagaagaaaaagtgaaacgatctgtgaaagatgctgccaagaagggccagaaggatgtctgcatagttctggccaaggagatgatcaggtcaaggaaggctgtgagcaagctgtatgcatccaaagcacacatgaactcagtgctcatggggatgaagaaccagctcgcggtcttgcgagtggctggttccctgcagaagagcacagaagtgatgaaggccatgcaaagtcttgtgaagattccagagattcaggccaccatgagggagttgtccaaagaaatgatgaaggctgggatcatagaggagatgttagaggacacttttgaaagcatggacgatcaggaagaaatggaggaagaagcagaaatggaaattgacagaattctctttgaaattacagcaggggccttgggcaaagcacccagtaaagtgactgatgcccttccagagccagaacctccaggagcgatggctgcctcagaggatgaggaggaggaggaagaggctctggaggccatgcagtcccggctggccacactccgcagctaggggctgcctaccccgctgggtgtgcacacactcctctcaagagctgccattttatgtgtctcttgcactacacctctgttgtgaggactaccattttggagaaggttctgtttgtctcttttcattctctgcccaggttttgggatcgcaaagggattgttcttataaaagtggcataaataaatgcatcatttttaggagtatagacagatatatcttattgtggggaggggaaagaaatccatctgctcatgaagcacttctgaaaatataggtgattgcctgaatgtcgaagactctacttttgtctataaaacactatataaatgaattttaataaatttttgctttagcacttggccccattgtagattgccctgtgcagtaaactttcaaggtgtcggctgccccagattgcttcatttgctgggtgtggaaagagttgctatggccaggcatatgggatttggaagctcagcagaagtgacttctgctctgtggttgctgctccccggctttcacagacatggtatggcagccattcttttatctatttaaccaagaggatgctggggaattgtgctgcttgtcctgttggctggtggctgcattatgtcctggggtgtgcatgtgggtctatttagagcttctgtcccttccttcccattgcaagttgcacccagatgagacagctgtagtactaggtctctttcacctctcattgcctgtccctgcttcgagctggttgtcttgtgcgtgggacatgggccttcctatctgtgttttctcaaagtcaggagctgaccaggagcacactaaggtgtggtcatgcatcataaccaacattcactcatctgggacattcttaagatacatttataaatcatttcagcagtagtactttgtatgtgttgagagtttacagagctctttgacatacgcgatcttagtctttacaaataaggaaaacagctcagtttgggaagtatcagagatgggattcaaacccagatcctctggtccaagttgtatgtgcactgaactaatcaggcaggaaaaaagcccagccactgtctcacagattgttttttgtatattgtagcaaaatcctgaaacaatggggtccttccagtctcatcatacaaaatggcaatcttggctgggtgcggtggttcatgcctataatcccagtgctttacaaggctgaggcaggaggctctcttgagaataggagttcaagaccagcctgggcaacatagcaagatcctgtctctccaaaaaaaaaaaaaaaaaaaaaaaaaaatttcatttttgagtccagaggaccctcctattactcttgatttcatcttcagagtgtagttaaaaaattattttaaataattatttttttaaatcagttgtaggttcacagcaaaagtggacaaaaagaaatttctcatatatcccctgccctcacacatgcatagcctcccaccactatcagtatcccacaccagagtggtacatttgttacaatcaataaacctccattgacacatcattatcacccaaagtccatagtttacatgaagattcactctggtgttgtacattgtatgggcttagacaaatgtatgatgatatctacaattatagaatcatacagaatagtttcactgccctaaaacttctctatgcttcacctgttcatccctttcttccctaatcccctggcaaccactttaaaaaaaaaattaggttcagggggtacatgtgcaggtaaactcgtgacaagggggtttgttatacagattatttagtgacccaggtactaagcctagtacccaatagttacttttctggtcctgtcccttttcccaccctccaccctcaggtaggccccagtatgttattcctttgtgtccatgttatttcactcccacttgtgagaacatggaatatttggtttcctgttcctatgttagtttgttaaggataatggcctccagccccatccatgttcctgcaaaggacatgatctttctttggcaaccactttttactgtcgccatagttcttccttttctagaatgtcatattggaatcatatagtatgtagccttttcagactggcttctttcacttaataatatgcaattaaggttcctccatgtcatttcatggcttaatagtgcatttatttttagcactgaataatactccattgtctagatgaatagtttatccattcacctattgaaagacttcttggtggtttccaagttttggcaattatgaataaagctgttgtaaacatctttgtgcaggtttttctatgggcatgtttttaattcatttgaataaataccaagagcttcagtgctggatcataaa

SEQ ID NO: 372008 - DNA, 3186 bp, Homo sapiens
atcccctagtgccgccgctccctactctgggggttgggactacctccttttccgcgggcgggcccgcccaggcggctgcccgtgacctgcctgggcgcggggaactgaaagccggaaggggcaagacgggttcagttcgtcatggggctgtttggaaagacccaggagaagccgcccaaagaactggtcaatgagtggtcattgaagataagaaaggaaatgagagttgttgacaggcaaataagggatatccaaagagaagaagaaaaagtgaaacgatctgtgaaagatgctgccaagaagggccagaaggatgtctgcatagttctggccaaggagatgatcaggtcaaggaaggctgtgagcaagctgtatgcatccaaagcacacatgaactcagtgctcatggggatgaagaaccagctcgcggtcttgcgagtggctggttccctgcagaagagcacagaagtgatgaaggccatgcaaagtcttgtgaagattccagagattcaggccaccatgagggagttgtccaaagaaatgatgaaggctgggatcatagaggagatgttagaggacacttttgaaagcatggacgatcaggaagaaatggaggaagaagcagaaatggaaattgacagaattctctttgaaattacagcaggggccttgggcaaagcacccagtaaagtgactgatgcccttccagagccagaacctccaggagcgatggctgcctcagaggatgaggaggaggaggaagaggctctggaggccatgcagtcccggctggccacactccgcagctaggggctgcctaccccgctgggtgtgcacacactcctctcaagagctgccattttatgtgtctcttgcactacacctctgttgtgaggactaccattttggagaaggttctgtttgtctcttttcattctctgcccaggttttgggatcgcaaagggattgttcttataaaagtggcataaataaatgcatcatttttaggagtatagacagatatatcttattgtggggaggggaaagaaatccatctgctcatgaagcacttctgaaaatataggtgattgcctgaatgtcgaagactctacttttgtctataaaacactatataaatgaattttaataaatttttgctttagcacttggccccattgtagattgccctgtgcagtaaactttcaaggtgtcggctgccccagattgcttcatttgctgggtgtggaaagagttgctatggccaggcatatgggatttggaagctcagcagaagtgacttctgctctgtggttgctgctccccggctttcacagacatggtatggcagccattcttttatctatttaaccaagaggatgctggggaattgtgctgcttgtcctgttggctggtggctgcattatgtcctggggtgtgcatgtgggtctatttagagcttctgtcccttccttcccattgcaagttgcacccagatgagacagctgtagtactaggtctctttcacctctcattgcctgtccctgcttcgagctggttgtcttgtgcgtgggacatgggccttcctatctgtgttttctcaaagtcaggagctgaccaggagcacactaaggtgtggtcatgcatcataaccaacattcactcatctgggacattcttaagatacatttataaatcatttcagcagtagtactttgtatgtgttgagagtttacagagctctttgacatacgcgatcttagtctttacaaataaggaaaacagctcagtttgggaagtatcagagatgggattcaaacccagatcctctggtccaagttgtatgtgcactgaactaatcaggcaggaaaaaagcccagccactgtctcacagattgttttttgtatattgtagcaaaatcctgaaacaatggggtccttccagtctcatcatacaaaatggcaatcttggctgggtgcggtggttcatgcctataatcccagtgctttacaaggctgaggcaggaggctctcttgagaataggagttcaagaccagcctgggcaacatagcaagatcctgtctctccaaaaaaaaaaaaaaaaaaaaaaaaaaatttcatttttgagtccagaggaccctcctattactcttgatttcatcttcagagtgtagttaaaaaattattttaaataattatttttttaaatcagttgtaggttcacagcaaaagtggacaaaaagaaatttctcatatatcccctgccctcacacatgcatagcctcccaccactatcagtatcccacaccagagtggtacatttgttacaatcaataaacctccattgacacatcattatcacccaaagtccatagtttacatgaagattcactctggtgttgtacattgtatgggcttagacaaatgtatgatgatatctacaattatagaatcatacagaatagtttcactgccctaaaacttctctatgcttcacctgttcatccctttcttccctaatcccctggcaaccactttaaaaaaaaaattaggttcagggggtacatgtgcaggtaaactcgtgacaagggggtttgttatacagattatttagtgacccaggtactaagcctagtacccaatagttacttttctggtcctgtcccttttcccaccctccaccctcaggtaggccccagtatgttattcctttgtgtccatgttatttcactcccacttgtgagaacatggaatatttggtttcctgttcctatgttagtttgttaaggataatggcctccagccccatccatgttcctgcaaaggacatgatctttctttggcaaccactttttactgtcgccatagttcttccttttctagaatgtcatattggaatcatatagtatgtagccttttcagactggcttctttcacttaataatatgcaattaaggttcctccatgtcatttcatggcttaatagtgcatttatttttagcactgaataatactccattgtctagatgaatagtttatccattcacctattgaaagacttcttggtggtttccaagttttggcaattatgaataaagctgttgtaaacatctttgtgcaggtttttctatgggcatgtttttaattcatttgaataaataccaagagcttcagtgctggatcataaa

SEQ ID NO: 372009 - DNA, 2807 bp, Homo sapiens
agcggggaacaatcacttctgtgctcttctgcagggaaccagccactcgcaagaccgcgagctggttcatcatccccatgagcacagaagtgatgaaggccatgcaaagtcttgtgaagattccagagattcaggccaccatgagggagttgtccaaagaaatgatgaaggctgggatcatagaggagatgttagaggacacttttgaaagcatggacgatcaggaagaaatggaggaagaagcagaaatggaaattgacagaattctctttgaaattacagcaggggccttgggcaaagcacccagtaaagtgactgatgcccttccagagccagaacctccaggagcgatggctgcctcagaggatgaggaggaggaggaagaggctctggaggccatgcagtcccggctggccacactccgcagctaggggctgcctaccccgctgggtgtgcacacactcctctcaagagctgccattttatgtgtctcttgcactacacctctgttgtgaggactaccattttggagaaggttctgtttgtctcttttcattctctgcccaggttttgggatcgcaaagggattgttcttataaaagtggcataaataaatgcatcatttttaggagtatagacagatatatcttattgtggggaggggaaagaaatccatctgctcatgaagcacttctgaaaatataggtgattgcctgaatgtcgaagactctacttttgtctataaaacactatataaatgaattttaataaatttttgctttagcacttggccccattgtagattgccctgtgcagtaaactttcaaggtgtcggctgccccagattgcttcatttgctgggtgtggaaagagttgctatggccaggcatatgggatttggaagctcagcagaagtgacttctgctctgtggttgctgctccccggctttcacagacatggtatggcagccattcttttatctatttaaccaagaggatgctggggaattgtgctgcttgtcctgttggctggtggctgcattatgtcctggggtgtgcatgtgggtctatttagagcttctgtcccttccttcccattgcaagttgcacccagatgagacagctgtagtactaggtctctttcacctctcattgcctgtccctgcttcgagctggttgtcttgtgcgtgggacatgggccttcctatctgtgttttctcaaagtcaggagctgaccaggagcacactaaggtgtggtcatgcatcataaccaacattcactcatctgggacattcttaagatacatttataaatcatttcagcagtagtactttgtatgtgttgagagtttacagagctctttgacatacgcgatcttagtctttacaaataaggaaaacagctcagtttgggaagtatcagagatgggattcaaacccagatcctctggtccaagttgtatgtgcactgaactaatcaggcaggaaaaaagcccagccactgtctcacagattgttttttgtatattgtagcaaaatcctgaaacaatggggtccttccagtctcatcatacaaaatggcaatcttggctgggtgcggtggttcatgcctataatcccagtgctttacaaggctgaggcaggaggctctcttgagaataggagttcaagaccagcctgggcaacatagcaagatcctgtctctccaaaaaaaaaaaaaaaaaaaaaaaaaaatttcatttttgagtccagaggaccctcctattactcttgatttcatcttcagagtgtagttaaaaaattattttaaataattatttttttaaatcagttgtaggttcacagcaaaagtggacaaaaagaaatttctcatatatcccctgccctcacacatgcatagcctcccaccactatcagtatcccacaccagagtggtacatttgttacaatcaataaacctccattgacacatcattatcacccaaagtccatagtttacatgaagattcactctggtgttgtacattgtatgggcttagacaaatgtatgatgatatctacaattatagaatcatacagaatagtttcactgccctaaaacttctctatgcttcacctgttcatccctttcttccctaatcccctggcaaccactttaaaaaaaaaattaggttcagggggtacatgtgcaggtaaactcgtgacaagggggtttgttatacagattatttagtgacccaggtactaagcctagtacccaatagttacttttctggtcctgtcccttttcccaccctccaccctcaggtaggccccagtatgttattcctttgtgtccatgttatttcactcccacttgtgagaacatggaatatttggtttcctgttcctatgttagtttgttaaggataatggcctccagccccatccatgttcctgcaaaggacatgatctttctttggcaaccactttttactgtcgccatagttcttccttttctagaatgtcatattggaatcatatagtatgtagccttttcagactggcttctttcacttaataatatgcaattaaggttcctccatgtcatttcatggcttaatagtgcatttatttttagcactgaataatactccattgtctagatgaatagtttatccattcacctattgaaagacttcttggtggtttccaagttttggcaattatgaataaagctgttgtaaacatctttgtgcaggtttttctatgggcatgtttttaattcatttgaataaataccaagagcttcagtgctggatcataaa

SEQ ID NO: 372010 - DNA, 3124 bp, Homo sapiens
cgaagcgctatgtcaaaccgccagggctttaaacgacggcagtactataacgggcccgcccaggcggctgcccgtgacctgcctgggcgcggggaactgaaagccggaaggggcaagacgggttcagttcgtcatggggctgtttggaaagacccaggagaagccgcccaaagaactggtcaatgagtggtcattgaagataagaaaggaaatgagagttgttgacaggcaaataagggatatccaaagagaagaagaaaaagtgaaacgatctgtgaaagatgctgccaagaagggccagaaggatgtctgcatagttctggccaaggagatgatcaggtcaaggaaggctgtgagcaagctgtatgcatccaaagcacacatgaactcagtgctcatggggatgaagaaccagctcgcggtcttgcgagtggctggttccctgcagaagagcacagaagtgatgaaggccatgcaaagtcttgtgaagattccagagattcaggccaccatgagggagttgtccaaagaaatgatgaaggctgggatcatagaggagatgttagaggacacttttgaaagcatggacgatcaggaagaaatggaggaagaagcagaaatggaaattgacagaattctctttgaaattacagcaggggccttgggcaaagcacccagtaaagtgactgatgcccttccagagccagaacctccaggagcgatggctgcctcagaggatgaggaggaggaggaagaggctctggaggccatgcagtcccggctggccacactccgcagctaggggctgcctaccccgctgggtgtgcacacactcctctcaagagctgccattttatgtgtctcttgcactacacctctgttgtgaggactaccattttggagaaggttctgtttgtctcttttcattctctgcccaggttttgggatcgcaaagggattgttcttataaaagtggcataaataaatgcatcatttttaggagtatagacagatatatcttattgtggggaggggaaagaaatccatctgctcatgaagcacttctgaaaatataggtgattgcctgaatgtcgaagactctacttttgtctataaaacactatataaatgaattttaataaatttttgctttagcacttggccccattgtagattgccctgtgcagtaaactttcaaggtgtcggctgccccagattgcttcatttgctgggtgtggaaagagttgctatggccaggcatatgggatttggaagctcagcagaagtgacttctgctctgtggttgctgctccccggctttcacagacatggtatggcagccattcttttatctatttaaccaagaggatgctggggaattgtgctgcttgtcctgttggctggtggctgcattatgtcctggggtgtgcatgtgggtctatttagagcttctgtcccttccttcccattgcaagttgcacccagatgagacagctgtagtactaggtctctttcacctctcattgcctgtccctgcttcgagctggttgtcttgtgcgtgggacatgggccttcctatctgtgttttctcaaagtcaggagctgaccaggagcacactaaggtgtggtcatgcatcataaccaacattcactcatctgggacattcttaagatacatttataaatcatttcagcagtagtactttgtatgtgttgagagtttacagagctctttgacatacgcgatcttagtctttacaaataaggaaaacagctcagtttgggaagtatcagagatgggattcaaacccagatcctctggtccaagttgtatgtgcactgaactaatcaggcaggaaaaaagcccagccactgtctcacagattgttttttgtatattgtagcaaaatcctgaaacaatggggtccttccagtctcatcatacaaaaggctgaggcaggaggctctcttgagaataggagttcaagaccagcctgggcaacatagcaagatcctgtctctccaaaaaaaaaaaaaaaaaaaaaaaaaaatttcatttttgagtccagaggaccctcctattactcttgatttcatcttcagagtgtagttaaaaaattattttaaataattatttttttaaatcagttgtaggttcacagcaaaagtggacaaaaagaaatttctcatatatcccctgccctcacacatgcatagcctcccaccactatcagtatcccacaccagagtggtacatttgttacaatcaataaacctccattgacacatcattatcacccaaagtccatagtttacatgaagattcactctggtgttgtacattgtatgggcttagacaaatgtatgatgatatctacaattatagaatcatacagaatagtttcactgccctaaaacttctctatgcttcacctgttcatccctttcttccctaatcccctggcaaccactttaaaaaaaaaattaggttcagggggtacatgtgcaggtaaactcgtgacaagggggtttgttatacagattatttagtgacccaggtactaagcctagtacccaatagttacttttctggtcctgtcccttttcccaccctccaccctcaggtaggccccagtatgttattcctttgtgtccatgttatttcactcccacttgtgagaacatggaatatttggtttcctgttcctatgttagtttgttaaggataatggcctccagccccatccatgttcctgcaaaggacatgatctttctttggcaaccactttttactgtcgccatagttcttccttttctagaatgtcatattggaatcatatagtatgtagccttttcagactggcttctttcacttaataatatgcaattaaggttcctccatgtcatttcatggcttaatagtgcatttatttttagcactgaataatactccattgtctagatgaatagtttatccattcacctattgaaagacttcttggtggtttccaagttttggcaattatgaataaagctgttgtaaacatctttgtgcaggtttttctatgggcatgtttttaattcatttgaataaataccaagagcttcagtgctggatcataaa

SEQ ID NO: 372011 - DNA, 2259 bp, Homo sapiens
gtctggcgctcggttttacaagccagttcgatgactgatagaaccctgtgcgagtggcataaataaatgcatcatttttaggagtatagacagatatatcttattgtggggaggggaaagaaatccatctgctcatgaagcacttctgaaaatataggtgattgcctgaatgtcgaagactctacttttgtctataaaacactatataaatgaattttaataaatttttgctttagcacttggccccattgtagattgccctgtgcagtaaactttcaaggtgtcggctgccccagattgcttcatttgctgggtgtggaaagagttgctatggccaggcatatgggatttggaagctcagcagaagtgacttctgctctgtggttgctgctccccggctttcacagacatggtatggcagccattcttttatctatttaaccaagaggatgctggggaattgtgctgcttgtcctgttggctggtggctgcattatgtcctggggtgtgcatgtgggtctatttagagcttctgtcccttccttcccattgcaagttgcacccagatgagacagctgtagtactaggtctctttcacctctcattgcctgtccctgcttcgagctggttgtcttgtgcgtgggacatgggccttcctatctgtgttttctcaaagtcaggagctgaccaggagcacactaaggtgtggtcatgcatcataaccaacattcactcatctgggacattcttaagatacatttataaatcatttcagcagtagtactttgtatgtgttgagagtttacagagctctttgacatacgcgatcttagtctttacaaataaggaaaacagctcagtttgggaagtatcagagatgggattcaaacccagatcctctggtccaagttgtatgtgcactgaactaatcaggcaggaaaaaagcccagccactgtctcacagattgttttttgtatattgtagcaaaatcctgaaacaatggggtccttccagtctcatcatacaaaatggcaatcttggctgggtgcggtggttcatgcctataatcccagtgctttacaaggctgaggcaggaggctctcttgagaataggagttcaagaccagcctgggcaacatagcaagatcctgtctctccaaaaaaaaaaaaaaaaaaaaaaaaaaatttcatttttgagtccagaggaccctcctattactcttgatttcatcttcagagtgtagttaaaaaattattttaaataattatttttttaaatcagttgtaggttcacagcaaaagtggacaaaaagaaatttctcatatatcccctgccctcacacatgcatagcctcccaccactatcagtatcccacaccagagtggtacatttgttacaatcaataaacctccattgacacatcattatcacccaaagtccatagtttacatgaagattcactctggtgttgtacattgtatgggcttagacaaatgtatgatgatatctacaattatagaatcatacagaatagtttcactgccctaaaacttctctatgcttcacctgttcatccctttcttccctaatcccctggcaaccactttaaaaaaaaaattaggttcagggggtacatgtgcaggtaaactcgtgacaagggggtttgttatacagattatttagtgacccaggtactaagcctagtacccaatagttacttttctggtcctgtcccttttcccaccctccaccctcaggtaggccccagtatgttattcctttgtgtccatgttatttcactcccacttgtgagaacatggaatatttggtttcctgttcctatgttagtttgttaaggataatggcctccagccccatccatgttcctgcaaaggacatgatctttctttggcaaccactttttactgtcgccatagttcttccttttctagaatgtcatattggaatcatatagtatgtagccttttcagactggcttctttcacttaataatatgcaattaaggttcctccatgtcatttcatggcttaatagtgcatttatttttagcactgaataatactccattgtctagatgaatagtttatccattcacctattgaaagacttcttggtggtttccaagttttggcaattatgaataaagctgttgtaaacatctttgtgcaggtttttctatgggcatgtttttaattcatttgaataaataccaagagcttcagtgctggatcataaa

SEQ ID NO: 372012 - DNA, 1005 bp, Homo sapiens
cgaagcgctatgtcaaaccgccagggctttaaacgacggcagtactataacgggcccgcccaggcggctgcccgtgacctgcctgggcgcggggaactgaaagccggaaggggcaagacgggttcagttcgtcatggggctgtttggaaagacccaggagaagccgcccaaagaactggtcaatgagtggtcattgaagataagaaaggaaatgagagttgttgacaggcaaataagggatatccaaagagaagaagaaaaagtgaaacgatctgtgaaagatgctgccaagaagggccagaaggatgtctgcatagttctggccaaggagatgatcaggtcaaggaaggctgtgagcaagctgtatgcatccaaagcacacatgaactcagtgctcatggggatgaagaaccagctcgcggtcttgcgagtggctggttccctgcagaagagcacagaagtgatgaaggccatgcaaagtcttgtgaagattccagagattcaggccaccatgagggagttgtccaaagaaatgatgaaggctgggatcatagaggagatgttagaggacacttttgaaagcatggacgatcaggaagaaatggaggaagaagcagaaatggaaattgacagaattctctttgaaattacagcaggggccttgggcaaagcacccagtaaagtgactgatgcccttccagagccagaacctccaggagcgatggctgcctcagaggatgaggaggaggaggaagaggctctggaggccatgcagtcccggctggccacactccgcagctaggggctgcctaccccgctgggtgtgcacacactcctctcaagagctgccattttatgtgtctcttgcactacacctctgttgtgaggactaccattttggagaaggttctgtttgtctcttttcattctctgcccaggttttgggatcgcaaagggattgttcttataaaagtggcataaataaatgcatcatttttaggagta

SEQ ID NO: 372013 - DNA, 980 bp, Homo sapiens
atcccctagtgccgccgctccctactctgggggttgggactacctccttttccgcgggcgggcccgcccaggcggctgcccgtgacctgcctgggcgcggggaactgaaagccggaaggggcaagacgggttcagttcgtcatggggctgtttggaaagacccaggagaagccgcccaaagaactggtcaatgagtggtcattgaagataagaaaggaaatgagagttgttgacaggcaaataagggatatccaaagagaagaagaaaaagtgaaacgatctgtgaaagatgctgccaagaagggccagaaggatgtctgcatagttctggccaaggagatgatcaggtcaaggaaggctgtgagcaagctgtatgcatccaaagcacacatgaactcagtgctcatggggatgaagaaccagctcgcggtcttgcgagtggctggttccctgcagaagagcacagaagtgatgaaggccatgcaaagtcttgtgaagattccagagattcaggccaccatgagggagttgtccaaagaaatgatgaaggctgggatcatagaggagatgttagaggacacttttgaaagcatggacgatcaggaagaaatggaggaagaagcagaaatggaaattgacagaattctctttgaaattacagcaggggccttgggcaaagcacccagtaaagtgactgatgcccttccagagccagaacctccaggagcgatggctgcctcagaggatgaggaggaggaggaagaggctctggaggccatgcagtcccggctggccacactccgcagctaggggtgctaccggtggtggagcaatccctcaaatgcaagtagtgcctgacaaccctgtggggcactcgggagcggaggactaccgcggaggggcggagcaaaggaaaaggcaaggcagaattgggagaaacggagccaaggacgagaggaaacaaaaagggcaaaagacaa

SEQ ID NO: 372014 - DNA, 755 bp, Homo sapiens
atcccctagtgccgccgctccctactctgggggttgggactacctccttttccgcgggcgggcccgcccaggcggctgcccgtgacctgcctgggcgcggggaactgaaagccggaaggggcaagacgggttcagttcgtcatggggctgtttggaaagacccaggagaagccgcccaaagaactggtcaatgagtggtcattgaagataagaaaggaaatgagagttgttgacaggcaaataagggatatccaaagagaagaagaaaaagtgaaacgatctgtgaaagatgctgccaagaagggccagaaggatgtctgcatagttctggccaaggagatgatcaggtcaaggaaggctgtgagcaagctgtatgcatccaaagcacacatgaactcagtgctcatggggatgaagaaccagctcgcggtcttgcgagtggctggttccctgcagaagagcacagaagtgatgaaggccatgcaaagtcttgtgaagattccagagattcaggccaccatgagggagttgtccaaagaaatgatgaaggctgggatcatagaggagatgttagaggacacttttgaaagcatggacgatcaggaagaaatggtagtcctcacaacagaggtgtagtgcgagagacacataaaatggcagctcttgagaggagtgtgtgcacacccagcggggtagcagcccctagctgcggaggtggccagccgggactgcatgcctccagagcctctcatcat

SEQ ID NO: 372015 - DNA, 627 bp, Homo sapiens
atcccctagtgccgccgctccctactctgggggttgggactacctccttttccgcgggcgggcccgcccaggcggctgcccgtgacctgcctgggcgcggggaactgaaagccggaaggggcaagacgggttcagttcgtcatggggctgtttggaaagacccaggagaagccgcccaaagaactggtcaatgagtggtcattgaagataagaaaggaaatgagagttgttgacaggcaaataagggatatccaaagagaagaagaaaaagtgaaacgatctgtgaaagatgctgccaagaagggccagaaggatgtctgcatagttctggccaaggagatgatcaggtcaaggaaggctgtgagcaagctgtatgcatccaaagcacacatgaactcagtgctcatggggatgaagaaccagctcgagacggggttttaccatgttgcccaggatggtcttgaactgctgagctcaagtgatccactgcctcagtcttccaaagtgctgggattatagttgtgagccgctgcacctggcccagaactaatacaatttaacgttttgttgtatttgcctgcttctatattatatatatataaaaaaagcattattacaaaagttgaa

SEQ ID NO: 372016 - DNA, 484 bp, Homo sapiens
cgaagcgctatgtcaaaccgccagggctttaaacgacggcagtactataacgggcccgcccaggcggctgcccgtgacctgcctgggcgcggggaactgaaagccggaaggggcaagacgggttcagttcgtcatggggctgtttggaaagacccaggagaagccgcccaaagaactggctggagtgcagtggcgtgatctcagctcgctgcaacctccaccttccagccacctgccttggcctcccaaagtgctaagattacagcctctgcccggccgccaccccgtctgggaagtgaggagcgtatcagcccagccgcccattgtctgggaagtgagaagcgcctctgcccggccgccccgtctgggaggcgaggagcgcctctgcccggctgccccatctgggaggcgaggagcgcctcttcccggccaccccgcctgggaggcgaggagcacctctgcccggccgccccgtctgggaggc

SEQ ID NO: 372017 - DNA, 503 bp, Homo sapiens
cacatttttaaagactgttctagtatttttaacttatgtgttacagactttgatatgatttggctctgtgtctgcacctaaatctcatgttgaattgtgatcctgagtgttgaaggtggtcctggtgggaggtgattggatcatgggggtggtttctaatggtttagcaccatccccctagtggtgtctcatgatagaattctcatgatctggttgtttgaaagtgtatagcacctcccctatctctctctctctctctgtctcctgccggccagtggagatgtgcctgcttcccctttgccttccaccatggtgtaagtttactgaggcctccccagaagcagaagcctgtacagcccacagaactgtgagctgattaaacctcttttctttataaacaacccagtctcaggtatgtctttacagcagtgtgagaatggactaatattgacattgcttttaaaaatgctacagaaatatataaaataaaagtaattgttcac

SEQ ID NO: 372018 - DNA, 501 bp, Homo sapiens
  misc_feature (443)..(443): n is a, c, g, or t
agaattagttgcccaggtggtatgtggcgcgggaactgagcggaaggcagacgggtatccatggctggagacaaacgccagaacgtctgagtggtcatgaagataaaggaaatgagagttgtgacaggcaaataagggatatccaaagagaagaagaaaaagtgaaacgatctgtgaaagatgctgccaagaagggccagaaggatgtctgcatagttctggccaaggagatgatcaggtcaaggaaggctgtgagcaagctgtatgcatccaaagcacacatgaactcagtgctcatggggatgaagaaccagctcgcggtcttgcgagtggctggttccctgcagaagagcacagaagtgatgaaggccatgcaaagtcttgtgaagattccagagattcaggccaccatgagggagttgtccaaagaaatgatgaaggcngggatcataaggagatgttagaggacacgaagttacaggtactgagctgaattgtata

SEQ ID NO: 372019 - DNA, 3074 bp, Homo sapiens
ggggggccggaggaagagtctttaggagtcggctgtgggacgcgagagctcctggtgccatggctctcgaacaggtcaatgagtggtcattgaagataagaaaggaaatgagagttgttgacaggcaaataagggatatccaaagagaagaagaaaaagtgaaacgatctgtgaaagatgctgccaagaagggccagaaggatgtctgcatagttctggccaaggagatgatcaggtcaaggaaggctgtgagcaagctgtatgcatccaaagcacacatgaactcagtgctcatggggatgaagaaccagctcgcggtcttgcgagtggctggttccctgcagaagagcacagaagtgatgaaggccatgcaaagtcttgtgaagattccagagattcaggccaccatgagggagttgtccaaagaaatgatgaaggctgggatcatagaggagatgttagaggacacttttgaaagcatggacgatcaggaagaaatggaggaagaagcagaaatggaaattgacagaattctctttgaaattacagcaggggccttgggcaaagcacccagtaaagtgactgatgcccttccagagccagaacctccaggagcgatggctgcctcagaggatgaggaggaggaggaagaggctctggaggccatgcagtcccggctggccacactccgcagctaggggctgcctaccccgctgggtgtgcacacactcctctcaagagctgccattttatgtgtctcttgcactacacctctgttgtgaggactaccattttggagaaggttctgtttgtctcttttcattctctgcccaggttttgggatcgcaaagggattgttcttataaaagtggcataaataaatgcatcatttttaggagtatagacagatatatcttattgtggggaggggaaagaaatccatctgctcatgaagcacttctgaaaatataggtgattgcctgaatgtcgaagactctacttttgtctataaaacactatataaatgaattttaataaatttttgctttagcacttggccccattgtagattgccctgtgcagtaaactttcaaggtgtcggctgccccagattgcttcatttgctgggtgtggaaagagttgctatggccaggcatatgggatttggaagctcagcagaagtgacttctgctctgtggttgctgctccccggctttcacagacatggtatggcagccattcttttatctatttaaccaagaggatgctggggaattgtgctgcttgtcctgttggctggtggctgcattatgtcctggggtgtgcatgtgggtctatttagagcttctgtcccttccttcccattgcaagttgcacccagatgagacagctgtagtactaggtctctttcacctctcattgcctgtccctgcttcgagctggttgtcttgtgcgtgggacatgggccttcctatctgtgttttctcaaagtcaggagctgaccaggagcacactaaggtgtggtcatgcatcataaccaacattcactcatctgggacattcttaagatacatttataaatcatttcagcagtagtactttgtatgtgttgagagtttacagagctctttgacatacgcgatcttagtctttacaaataaggaaaacagctcagtttgggaagtatcagagatgggattcaaacccagatcctctggtccaagttgtatgtgcactgaactaatcaggcaggaaaaaagcccagccactgtctcacagattgttttttgtatattgtagcaaaatcctgaaacaatggggtccttccagtctcatcatacaaaatggcaatcttggctgggtgcggtggttcatgcctataatcccagtgctttacaaggctgaggcaggaggctctcttgagaataggagttcaagaccagcctgggcaacatagcaagatcctgtctctccaaaaaaaaaaaaaaaaaaaaaaaaaaatttcatttttgagtccagaggaccctcctattactcttgatttcatcttcagagtgtagttaaaaaattattttaaataattatttttttaaatcagttgtaggttcacagcaaaagtggacaaaaagaaatttctcatatatcccctgccctcacacatgcatagcctcccaccactatcagtatcccacaccagagtggtacatttgttacaatcaataaacctccattgacacatcattatcacccaaagtccatagtttacatgaagattcactctggtgttgtacattgtatgggcttagacaaatgtatgatgatatctacaattatagaatcatacagaatagtttcactgccctaaaacttctctatgcttcacctgttcatccctttcttccctaatcccctggcaaccactttaaaaaaaaaattaggttcagggggtacatgtgcaggtaaactcgtgacaagggggtttgttatacagattatttagtgacccaggtactaagcctagtacccaatagttacttttctggtcctgtcccttttcccaccctccaccctcaggtaggccccagtatgttattcctttgtgtccatgttatttcactcccacttgtgagaacatggaatatttggtttcctgttcctatgttagtttgttaaggataatggcctccagccccatccatgttcctgcaaaggacatgatctttctttggcaaccactttttactgtcgccatagttcttccttttctagaatgtcatattggaatcatatagtatgtagccttttcagactggcttctttcacttaataatatgcaattaaggttcctccatgtcatttcatggcttaatagtgcatttatttttagcactgaataatactccattgtctagatgaatagtttatccattcacctattgaaagacttcttggtggtttccaagttttggcaattatgaataaagctgttgtaaacatctttgtgcaggtttttctatgggcatgtttttaattcatttgaataaataccaagagcttcagtgctggatcataaa

SEQ ID NO: 372020 - DNA, 3312 bp, Homo sapiens
agattatttgttgtcttcagtgtttggccttggcattgccattcgtaaattgagataagattatggagaagcaaaaaagatgctggggaaatggttgctttattgtttaaactagtctctagtatatgtactactatactactctagtatattgtacacttagattgtttttaaatgataaattgctaagaacacgatattggtacactcttcagtagggtaatctacctgagaaagctgattgacactggaaaatggcagggttgatgcatgagattggtttttaaaactatgcttgccagagccgaacaggtcaatgagtggtcattgaagataagaaaggaaatgagagttgttgacaggcaaataagggatatccaaagagaagaagaaaaagtgaaacgatctgtgaaagatgctgccaagaagggccagaaggatgtctgcatagttctggccaaggagatgatcaggtcaaggaaggctgtgagcaagctgtatgcatccaaagcacacatgaactcagtgctcatggggatgaagaaccagctcgcggtcttgcgagtggctggttccctgcagaagagcacagaagtgatgaaggccatgcaaagtcttgtgaagattccagagattcaggccaccatgagggagttgtccaaagaaatgatgaaggctgggatcatagaggagatgttagaggacacttttgaaagcatggacgatcaggaagaaatggaggaagaagcagaaatggaaattgacagaattctctttgaaattacagcaggggccttgggcaaagcacccagtaaagtgactgatgcccttccagagccagaacctccaggagcgatggctgcctcagaggatgaggaggaggaggaagaggctctggaggccatgcagtcccggctggccacactccgcagctaggggctgcctaccccgctgggtgtgcacacactcctctcaagagctgccattttatgtgtctcttgcactacacctctgttgtgaggactaccattttggagaaggttctgtttgtctcttttcattctctgcccaggttttgggatcgcaaagggattgttcttataaaagtggcataaataaatgcatcatttttaggagtatagacagatatatcttattgtggggaggggaaagaaatccatctgctcatgaagcacttctgaaaatataggtgattgcctgaatgtcgaagactctacttttgtctataaaacactatataaatgaattttaataaatttttgctttagcacttggccccattgtagattgccctgtgcagtaaactttcaaggtgtcggctgccccagattgcttcatttgctgggtgtggaaagagttgctatggccaggcatatgggatttggaagctcagcagaagtgacttctgctctgtggttgctgctccccggctttcacagacatggtatggcagccattcttttatctatttaaccaagaggatgctggggaattgtgctgcttgtcctgttggctggtggctgcattatgtcctggggtgtgcatgtgggtctatttagagcttctgtcccttccttcccattgcaagttgcacccagatgagacagctgtagtactaggtctctttcacctctcattgcctgtccctgcttcgagctggttgtcttgtgcgtgggacatgggccttcctatctgtgttttctcaaagtcaggagctgaccaggagcacactaaggtgtggtcatgcatcataaccaacattcactcatctgggacattcttaagatacatttataaatcatttcagcagtagtactttgtatgtgttgagagtttacagagctctttgacatacgcgatcttagtctttacaaataaggaaaacagctcagtttgggaagtatcagagatgggattcaaacccagatcctctggtccaagttgtatgtgcactgaactaatcaggcaggaaaaaagcccagccactgtctcacagattgttttttgtatattgtagcaaaatcctgaaacaatggggtccttccagtctcatcatacaaaatggcaatcttggctgggtgcggtggttcatgcctataatcccagtgctttacaaggctgaggcaggaggctctcttgagaataggagttcaagaccagcctgggcaacatagcaagatcctgtctctccaaaaaaaaaaaaaaaaaaaaaaaaaaatttcatttttgagtccagaggaccctcctattactcttgatttcatcttcagagtgtagttaaaaaattattttaaataattatttttttaaatcagttgtaggttcacagcaaaagtggacaaaaagaaatttctcatatatcccctgccctcacacatgcatagcctcccaccactatcagtatcccacaccagagtggtacatttgttacaatcaataaacctccattgacacatcattatcacccaaagtccatagtttacatgaagattcactctggtgttgtacattgtatgggcttagacaaatgtatgatgatatctacaattatagaatcatacagaatagtttcactgccctaaaacttctctatgcttcacctgttcatccctttcttccctaatcccctggcaaccactttaaaaaaaaaattaggttcagggggtacatgtgcaggtaaactcgtgacaagggggtttgttatacagattatttagtgacccaggtactaagcctagtacccaatagttacttttctggtcctgtcccttttcccaccctccaccctcaggtaggccccagtatgttattcctttgtgtccatgttatttcactcccacttgtgagaacatggaatatttggtttcctgttcctatgttagtttgttaaggataatggcctccagccccatccatgttcctgcaaaggacatgatctttctttggcaaccactttttactgtcgccatagttcttccttttctagaatgtcatattggaatcatatagtatgtagccttttcagactggcttctttcacttaataatatgcaattaaggttcctccatgtcatttcatggcttaatagtgcatttatttttagcactgaataatactccattgtctagatgaatagtttatccattcacctattgaaagacttcttggtggtttccaagttttggcaattatgaataaagctgttgtaaacatctttgtgcaggtttttctatgggcatgtttttaattcatttgaataaataccaagagcttcagtgctggatcataaa

SEQ ID NO: 372021 - DNA, 3117 bp, Homo sapiens
cgaagcgctatgtcaaaccgccagggctttaaacgacggcagtactataacgggcccgcccaggcggctgcccgtgacctgcctgggcgcggggaactgaaagccggaaggggcaagacgggttcagttcgtcatggggctgtttggaaagacccaggagaagccgcccaaagaactgatatccaaagagaagaagaaaaagtgaaacgatctgtgaaagatgctgccaagaagggccagaaggatgtctgcatagttctggccaaggagatgatcaggtcaaggaaggctgtgagcaagctgtatgcatccaaagcacacatgaactcagtgctcatggggatgaagaaccagctcgcggtcttgcgagtggctggttccctgcagaagagcacagaagtgatgaaggccatgcaaagtcttgtgaagattccagagattcaggccaccatgagggagttgtccaaagaaatgatgaaggctgggatcatagaggagatgttagaggacacttttgaaagcatggacgatcaggaagaaatggaggaagaagcagaaatggaaattgacagaattctctttgaaattacagcaggggccttgggcaaagcacccagtaaagtgactgatgcccttccagagccagaacctccaggagcgatggctgcctcagaggatgaggaggaggaggaagaggctctggaggccatgcagtcccggctggccacactccgcagctaggggctgcctaccccgctgggtgtgcacacactcctctcaagagctgccattttatgtgtctcttgcactacacctctgttgtgaggactaccattttggagaaggttctgtttgtctcttttcattctctgcccaggttttgggatcgcaaagggattgttcttataaaagtggcataaataaatgcatcatttttaggagtatagacagatatatcttattgtggggaggggaaagaaatccatctgctcatgaagcacttctgaaaatataggtgattgcctgaatgtcgaagactctacttttgtctataaaacactatataaatgaattttaataaatttttgctttagcacttggccccattgtagattgccctgtgcagtaaactttcaaggtgtcggctgccccagattgcttcatttgctgggtgtggaaagagttgctatggccaggcatatgggatttggaagctcagcagaagtgacttctgctctgtggttgctgctccccggctttcacagacatggtatggcagccattcttttatctatttaaccaagaggatgctggggaattgtgctgcttgtcctgttggctggtggctgcattatgtcctggggtgtgcatgtgggtctatttagagcttctgtcccttccttcccattgcaagttgcacccagatgagacagctgtagtactaggtctctttcacctctcattgcctgtccctgcttcgagctggttgtcttgtgcgtgggacatgggccttcctatctgtgttttctcaaagtcaggagctgaccaggagcacactaaggtgtggtcatgcatcataaccaacattcactcatctgggacattcttaagatacatttataaatcatttcagcagtagtactttgtatgtgttgagagtttacagagctctttgacatacgcgatcttagtctttacaaataaggaaaacagctcagtttgggaagtatcagagatgggattcaaacccagatcctctggtccaagttgtatgtgcactgaactaatcaggcaggaaaaaagcccagccactgtctcacagattgttttttgtatattgtagcaaaatcctgaaacaatggggtccttccagtctcatcatacaaaatggcaatcttggctgggtgcggtggttcatgcctataatcccagtgctttacaaggctgaggcaggaggctctcttgagaataggagttcaagaccagcctgggcaacatagcaagatcctgtctctccaaaaaaaaaaaaaaaaaaaaaaaaaaatttcatttttgagtccagaggaccctcctattactcttgatttcatcttcagagtgtagttaaaaaattattttaaataattatttttttaaatcagttgtaggttcacagcaaaagtggacaaaaagaaatttctcatatatcccctgccctcacacatgcatagcctcccaccactatcagtatcccacaccagagtggtacatttgttacaatcaataaacctccattgacacatcattatcacccaaagtccatagtttacatgaagattcactctggtgttgtacattgtatgggcttagacaaatgtatgatgatatctacaattatagaatcatacagaatagtttcactgccctaaaacttctctatgcttcacctgttcatccctttcttccctaatcccctggcaaccactttaaaaaaaaaattaggttcagggggtacatgtgcaggtaaactcgtgacaagggggtttgttatacagattatttagtgacccaggtactaagcctagtacccaatagttacttttctggtcctgtcccttttcccaccctccaccctcaggtaggccccagtatgttattcctttgtgtccatgttatttcactcccacttgtgagaacatggaatatttggtttcctgttcctatgttagtttgttaaggataatggcctccagccccatccatgttcctgcaaaggacatgatctttctttggcaaccactttttactgtcgccatagttcttccttttctagaatgtcatattggaatcatatagtatgtagccttttcagactggcttctttcacttaataatatgcaattaaggttcctccatgtcatttcatggcttaatagtgcatttatttttagcactgaataatactccattgtctagatgaatagtttatccattcacctattgaaagacttcttggtggtttccaagttttggcaattatgaataaagctgttgtaaacatctttgtgcaggtttttctatgggcatgtttttaattcatttgaataaataccaagagcttcagtgctggatcataaa

SEQ ID NO: 372022 - DNA, 2937 bp, Homo sapiens
cgaagcgctatgtcaaaccgccagggctttaaacgacggcagtactataacgggcccgcccaggcggctgcccgtgacctgcctgggcgcggggaactgaaagccggaaggggcaagacgggttcagttcgtcatggggctgtttggaaagacccaggagaagccgcccaaagaactgcggtcttgcgagtggctggttccctgcagaagagcacagaagtgatgaaggccatgcaaagtcttgtgaagattccagagattcaggccaccatgagggagttgtccaaagaaatgatgaaggctgggatcatagaggagatgttagaggacacttttgaaagcatggacgatcaggaagaaatggaggaagaagcagaaatggaaattgacagaattctctttgaaattacagcaggggccttgggcaaagcacccagtaaagtgactgatgcccttccagagccagaacctccaggagcgatggctgcctcagaggatgaggaggaggaggaagaggctctggaggccatgcagtcccggctggccacactccgcagctaggggctgcctaccccgctgggtgtgcacacactcctctcaagagctgccattttatgtgtctcttgcactacacctctgttgtgaggactaccattttggagaaggttctgtttgtctcttttcattctctgcccaggttttgggatcgcaaagggattgttcttataaaagtggcataaataaatgcatcatttttaggagtatagacagatatatcttattgtggggaggggaaagaaatccatctgctcatgaagcacttctgaaaatataggtgattgcctgaatgtcgaagactctacttttgtctataaaacactatataaatgaattttaataaatttttgctttagcacttggccccattgtagattgccctgtgcagtaaactttcaaggtgtcggctgccccagattgcttcatttgctgggtgtggaaagagttgctatggccaggcatatgggatttggaagctcagcagaagtgacttctgctctgtggttgctgctccccggctttcacagacatggtatggcagccattcttttatctatttaaccaagaggatgctggggaattgtgctgcttgtcctgttggctggtggctgcattatgtcctggggtgtgcatgtgggtctatttagagcttctgtcccttccttcccattgcaagttgcacccagatgagacagctgtagtactaggtctctttcacctctcattgcctgtccctgcttcgagctggttgtcttgtgcgtgggacatgggccttcctatctgtgttttctcaaagtcaggagctgaccaggagcacactaaggtgtggtcatgcatcataaccaacattcactcatctgggacattcttaagatacatttataaatcatttcagcagtagtactttgtatgtgttgagagtttacagagctctttgacatacgcgatcttagtctttacaaataaggaaaacagctcagtttgggaagtatcagagatgggattcaaacccagatcctctggtccaagttgtatgtgcactgaactaatcaggcaggaaaaaagcccagccactgtctcacagattgttttttgtatattgtagcaaaatcctgaaacaatggggtccttccagtctcatcatacaaaatggcaatcttggctgggtgcggtggttcatgcctataatcccagtgctttacaaggctgaggcaggaggctctcttgagaataggagttcaagaccagcctgggcaacatagcaagatcctgtctctccaaaaaaaaaaaaaaaaaaaaaaaaaaatttcatttttgagtccagaggaccctcctattactcttgatttcatcttcagagtgtagttaaaaaattattttaaataattatttttttaaatcagttgtaggttcacagcaaaagtggacaaaaagaaatttctcatatatcccctgccctcacacatgcatagcctcccaccactatcagtatcccacaccagagtggtacatttgttacaatcaataaacctccattgacacatcattatcacccaaagtccatagtttacatgaagattcactctggtgttgtacattgtatgggcttagacaaatgtatgatgatatctacaattatagaatcatacagaatagtttcactgccctaaaacttctctatgcttcacctgttcatccctttcttccctaatcccctggcaaccactttaaaaaaaaaattaggttcagggggtacatgtgcaggtaaactcgtgacaagggggtttgttatacagattatttagtgacccaggtactaagcctagtacccaatagttacttttctggtcctgtcccttttcccaccctccaccctcaggtaggccccagtatgttattcctttgtgtccatgttatttcactcccacttgtgagaacatggaatatttggtttcctgttcctatgttagtttgttaaggataatggcctccagccccatccatgttcctgcaaaggacatgatctttctttggcaaccactttttactgtcgccatagttcttccttttctagaatgtcatattggaatcatatagtatgtagccttttcagactggcttctttcacttaataatatgcaattaaggttcctccatgtcatttcatggcttaatagtgcatttatttttagcactgaataatactccattgtctagatgaatagtttatccattcacctattgaaagacttcttggtggtttccaagttttggcaattatgaataaagctgttgtaaacatctttgtgcaggtttttctatgggcatgtttttaattcatttgaataaataccaagagcttcagtgctggatcataaa

SEQ ID NO: 372023 - DNA, 3074 bp, Homo sapiens
cgaagcgctatgtcaaaccgccagggctttaaacgacggcagtactataacgggcccgcccaggcggctgcccgtgacctgcctgggcgcggggaactgaaagccggaaggggcaagacgggttcagttcgtcatggggctgtttggaaagacccaggagaagccgcccaaagaactgtggagatgtgcctgcttcccctttgccttccaccatggtgtaagtttactgaggcctccccagaagcagaagcctgtacagcccacagaactgtgagctgattaaacctcttttctttataaacaacccagtctcagcggtcttgcgagtggctggttccctgcagaagagcacagaagtgatgaaggccatgcaaagtcttgtgaagattccagagattcaggccaccatgagggagttgtccaaagaaatgatgaaggctgggatcatagaggagatgttagaggacacttttgaaagcatggacgatcaggaagaaatggaggaagaagcagaaatggaaattgacagaattctctttgaaattacagcaggggccttgggcaaagcacccagtaaagtgactgatgcccttccagagccagaacctccaggagcgatggctgcctcagaggatgaggaggaggaggaagaggctctggaggccatgcagtcccggctggccacactccgcagctaggggctgcctaccccgctgggtgtgcacacactcctctcaagagctgccattttatgtgtctcttgcactacacctctgttgtgaggactaccattttggagaaggttctgtttgtctcttttcattctctgcccaggttttgggatcgcaaagggattgttcttataaaagtggcataaataaatgcatcatttttaggagtatagacagatatatcttattgtggggaggggaaagaaatccatctgctcatgaagcacttctgaaaatataggtgattgcctgaatgtcgaagactctacttttgtctataaaacactatataaatgaattttaataaatttttgctttagcacttggccccattgtagattgccctgtgcagtaaactttcaaggtgtcggctgccccagattgcttcatttgctgggtgtggaaagagttgctatggccaggcatatgggatttggaagctcagcagaagtgacttctgctctgtggttgctgctccccggctttcacagacatggtatggcagccattcttttatctatttaaccaagaggatgctggggaattgtgctgcttgtcctgttggctggtggctgcattatgtcctggggtgtgcatgtgggtctatttagagcttctgtcccttccttcccattgcaagttgcacccagatgagacagctgtagtactaggtctctttcacctctcattgcctgtccctgcttcgagctggttgtcttgtgcgtgggacatgggccttcctatctgtgttttctcaaagtcaggagctgaccaggagcacactaaggtgtggtcatgcatcataaccaacattcactcatctgggacattcttaagatacatttataaatcatttcagcagtagtactttgtatgtgttgagagtttacagagctctttgacatacgcgatcttagtctttacaaataaggaaaacagctcagtttgggaagtatcagagatgggattcaaacccagatcctctggtccaagttgtatgtgcactgaactaatcaggcaggaaaaaagcccagccactgtctcacagattgttttttgtatattgtagcaaaatcctgaaacaatggggtccttccagtctcatcatacaaaatggcaatcttggctgggtgcggtggttcatgcctataatcccagtgctttacaaggctgaggcaggaggctctcttgagaataggagttcaagaccagcctgggcaacatagcaagatcctgtctctccaaaaaaaaaaaaaaaaaaaaaaaaaaatttcatttttgagtccagaggaccctcctattactcttgatttcatcttcagagtgtagttaaaaaattattttaaataattatttttttaaatcagttgtaggttcacagcaaaagtggacaaaaagaaatttctcatatatcccctgccctcacacatgcatagcctcccaccactatcagtatcccacaccagagtggtacatttgttacaatcaataaacctccattgacacatcattatcacccaaagtccatagtttacatgaagattcactctggtgttgtacattgtatgggcttagacaaatgtatgatgatatctacaattatagaatcatacagaatagtttcactgccctaaaacttctctatgcttcacctgttcatccctttcttccctaatcccctggcaaccactttaaaaaaaaaattaggttcagggggtacatgtgcaggtaaactcgtgacaagggggtttgttatacagattatttagtgacccaggtactaagcctagtacccaatagttacttttctggtcctgtcccttttcccaccctccaccctcaggtaggccccagtatgttattcctttgtgtccatgttatttcactcccacttgtgagaacatggaatatttggtttcctgttcctatgttagtttgttaaggataatggcctccagccccatccatgttcctgcaaaggacatgatctttctttggcaaccactttttactgtcgccatagttcttccttttctagaatgtcatattggaatcatatagtatgtagccttttcagactggcttctttcacttaataatatgcaattaaggttcctccatgtcatttcatggcttaatagtgcatttatttttagcactgaataatactccattgtctagatgaatagtttatccattcacctattgaaagacttcttggtggtttccaagttttggcaattatgaataaagctgttgtaaacatctttgtgcaggtttttctatgggcatgtttttaattcatttgaataaataccaagagcttcagtgctggatcataaa

SEQ ID NO: 372024 - DNA, 2695 bp, Homo sapiens
taggctaggtagaggcggggtcaatcggacgagggagttgtccaaagaaatgatgaaggctgggatcatagaggagatgttagaggacacttttgaaagcatggacgatcaggaagaaatggaggaagaagcagaaatggaaattgacagaattctctttgaaattacagcaggggccttgggcaaagcacccagtaaagtgactgatgcccttccagagccagaacctccaggagcgatggctgcctcagaggatgaggaggaggaggaagaggctctggaggccatgcagtcccggctggccacactccgcagctaggggctgcctaccccgctgggtgtgcacacactcctctcaagagctgccattttatgtgtctcttgcactacacctctgttgtgaggactaccattttggagaaggttctgtttgtctcttttcattctctgcccaggttttgggatcgcaaagggattgttcttataaaagtggcataaataaatgcatcatttttaggagtatagacagatatatcttattgtggggaggggaaagaaatccatctgctcatgaagcacttctgaaaatataggtgattgcctgaatgtcgaagactctacttttgtctataaaacactatataaatgaattttaataaatttttgctttagcacttggccccattgtagattgccctgtgcagtaaactttcaaggtgtcggctgccccagattgcttcatttgctgggtgtggaaagagttgctatggccaggcatatgggatttggaagctcagcagaagtgacttctgctctgtggttgctgctccccggctttcacagacatggtatggcagccattcttttatctatttaaccaagaggatgctggggaattgtgctgcttgtcctgttggctggtggctgcattatgtcctggggtgtgcatgtgggtctatttagagcttctgtcccttccttcccattgcaagttgcacccagatgagacagctgtagtactaggtctctttcacctctcattgcctgtccctgcttcgagctggttgtcttgtgcgtgggacatgggccttcctatctgtgttttctcaaagtcaggagctgaccaggagcacactaaggtgtggtcatgcatcataaccaacattcactcatctgggacattcttaagatacatttataaatcatttcagcagtagtactttgtatgtgttgagagtttacagagctctttgacatacgcgatcttagtctttacaaataaggaaaacagctcagtttgggaagtatcagagatgggattcaaacccagatcctctggtccaagttgtatgtgcactgaactaatcaggcaggaaaaaagcccagccactgtctcacagattgttttttgtatattgtagcaaaatcctgaaacaatggggtccttccagtctcatcatacaaaatggcaatcttggctgggtgcggtggttcatgcctataatcccagtgctttacaaggctgaggcaggaggctctcttgagaataggagttcaagaccagcctgggcaacatagcaagatcctgtctctccaaaaaaaaaaaaaaaaaaaaaaaaaaatttcatttttgagtccagaggaccctcctattactcttgatttcatcttcagagtgtagttaaaaaattattttaaataattatttttttaaatcagttgtaggttcacagcaaaagtggacaaaaagaaatttctcatatatcccctgccctcacacatgcatagcctcccaccactatcagtatcccacaccagagtggtacatttgttacaatcaataaacctccattgacacatcattatcacccaaagtccatagtttacatgaagattcactctggtgttgtacattgtatgggcttagacaaatgtatgatgatatctacaattatagaatcatacagaatagtttcactgccctaaaacttctctatgcttcacctgttcatccctttcttccctaatcccctggcaaccactttaaaaaaaaaattaggttcagggggtacatgtgcaggtaaactcgtgacaagggggtttgttatacagattatttagtgacccaggtactaagcctagtacccaatagttacttttctggtcctgtcccttttcccaccctccaccctcaggtaggccccagtatgttattcctttgtgtccatgttatttcactcccacttgtgagaacatggaatatttggtttcctgttcctatgttagtttgttaaggataatggcctccagccccatccatgttcctgcaaaggacatgatctttctttggcaaccactttttactgtcgccatagttcttccttttctagaatgtcatattggaatcatatagtatgtagccttttcagactggcttctttcacttaataatatgcaattaaggttcctccatgtcatttcatggcttaatagtgcatttatttttagcactgaataatactccattgtctagatgaatagtttatccattcacctattgaaagacttcttggtggtttccaagttttggcaattatgaataaagctgttgtaaacatctttgtgcaggtttttctatgggcatgtttttaattcatttgaataaataccaagagcttcagtgctggatcataaa

SEQ ID NO: 372025 - DNA, 1364 bp, Homo sapiens
cgaagcgctatgtcaaaccgccagggctttaaacgacggcagtactataacgggcccgcccaggcggctgcccgtgacctgcctgggcgcggggaactgaaagccggaaggggcaagacgggttcagttcgtcatggggctgtttggaaagacccaggagaagccgcccaaagaactggtcaatgagtggtcattgaagataagaaaggaaatgagagttgttgacaggcaaataagggatatccaaagagaagaagaaaaagtgaaacgatctgtgaaagatgctgccaagaagggccagaaggatgtctgcatagttctggccaaggagatgatcaggtcaaggaaggctgtgagcaagctgtatgcatccaaagcacacatgaactcagtgctcatggggatgaagaaccagctcgcggtcttgcgagtggctggttccctgcagaagagcacagaagtgatgaaggccatgcaaagtcttgtgaagattccagagattcaggccaccatgagggagttgtccaaagaaatgatgaaggctgggatcatagaggagatgttagaggacacttttgaaagcatggacgatcaggaagaaatggaggaagaagcagaaatggaaattgacagaattctctttgaaattacagcaggggccttgggcaaagcacccagtaaagtgactgatgcccttccagagccagaacctccaggagcgatggctgcctcagaggatgaggaggaggaggaagaggctctggaggccatgcagtcccggctggccacactccgcagctaggggctgcctaccccgctgggtgtgcacacactcctctcaagagctgccattttatgtgtctcttgcactacacctctgttgtgaggactaccattttggagaaggttctgtttgtctcttttcattctctgcccaggttttgggatcgcaaagggattgttcttataaaagtggcataaataaatgcatcatttttaggagtaaaaaaaaaaaaaaaaaaaaaaaaaaaaaaaaaaaaaaaaaaaaaaaaaaaaaaaaaaaatgaaaagaaaacaaacaaaaaaacagcgaggggggggcaccccaataagacacccccgagcgggcgaccataacagaggcgagcacacacataatgcacacaaggggcccccacagagagaggcggcgattatataacacacgggcggacggcggcgggaaaacaaacacgcgaaggggggggaaacgacggtgcaccggaggcgacctgtggagagacgcgaccacgaccaccagggggggtgcgacaacatgagggccacgccgcagccgagagagagacgacccgcgcgggcgcacc

SEQ ID NO: 372026 - DNA, 1014 bp, Homo sapiens
atcccctagtgccgccgctccctactctgggggttgggactacctccttttccgcgggcgggcccgcccaggcggctgcccgtgacctgcctgggcgcggggaactgaaagccggaaggggcaagacgggttcagttcgtcatggggctgtttggaaagacccaggagaagccgcccaaagaactggtcaatgagtggtcattgaagataagaaaggaaatgagagttgttgacaggcaaataagggatatccaaagagaagaagaaaaagtgaaacgatctgtgaaagatgctgccaagaagggccagaaggatgtctgcatagttctggccaaggagatgatcaggtcaaggaaggctgtgagcaagctgtatgcatccaaagcacacatgaactcagtgctcatggggatgaagaaccagctcgcggtcttgcgagtggctggttccctgcagaagagcacagaagtgatgaaggccatgcaaagtcttgtgaagattccagagattcaggccaccatgagggagttgtccaaagaaatgatgaaggctgggatcatagaggagatgttagaggacacttttgaaagcatggacgatcaggaagaaatggaggaagaagcagaaatggaaattgacagaattctctttgaaattacagcaggggccttgggcaaagcacccagtaaagtgactgatgcccttccagagccagaacctccaggagcgatggctgcctcagaggatgaggaggaggaggaagaggctctggaggccatgcagtcccggctggcaagtcgagtaggggtgctaccgtgggtgtgaaaatctctcagagtgcatttatgtggttttgataactctttggagatacattggaaagtcgtgtctttaattctggcaggtggggtgaagggtgttataatgggtataatgattttgggaaaaaaaaggggttgtgggggaaagtgaagaggtaggttgacatttgaaggagggcatgggaagaagtgg

SEQ ID NO: 372027 - DNA, 610 bp, Homo sapiens
  misc_feature (552)..(552): n is a, c, g, or t
atcccctagtgccgccgctccctactctgggggttgggactacctccttttccgcgggcgggcccgcccaggcggctgcccgtgacctgcctgggcgcggggaactgaaagccggaaggggcaagacgggttcagttcgtcatggggctgtttggaaagacccaggagaagccgcccaaagaactggtcaatgagtggtcattgaagataagaaaggaaatgagagttgttgacaggcaaataagggatatccaaagagaagaagaaaaagtgaaacgatctgtgaaagatgctgccaagaagggccagaaggatgtctgcatagttctggccaaggagatgatcaggtcaaggaaggctgtgagcaagctgtatgcatccaaagcacacatgaactcagtgctcatggggatgaagaaccagctcgcggtcttgcgagtggctggttccctgcagaagagcacagaagtgatgaaggccatgcaaagtcttgtgaagattccagagattcaggccaccatgagggagttgtccaaagaaatgatgaaggcngggatcataaggagatgttagaggacacgaagttacaggtactgagctgaattgtata

SEQ ID NO: 372028 - DNA, 193 bp, Homo sapiens
tagggcaccggcaacagttttccgtttgtgcctactccacctgctgtctttgttgggtcagcgaacatcgcctccctctaccgctcaatcagcaaaagggaccgcccttgaggacctcacccgccgctcactcccctcccaacttcgcgggcatcgcctccggtcgcctcttccgaaggcctaacgagcatgt

SEQ ID NO: 372029 - DNA, 266 bp, Homo sapiens
aaatcttggctcacttgtaacctccacctccaggctcaagtgattctcctgcttcagggaggacgcttgagcccaggaggttgaggttgcagtgagctatgatcaaactactgccctcttggctgggtgacagagcaagatcttttctctaaaaataaataagaatttaaaaagcaagcaaaatatataaatagacattttactaaagaaggaacatccacttataaaaaagggtaaaaatttaaaagactatccatattctctgc

SEQ ID NO: 372030 - DNA, 288 bp, Homo sapiens
gaggtggagtttcgctctttgttgtccaggctggagcgcaatggtgcgatctggctcaccgcaacctctgtctcccaggggaggacgcttgagcccaggaggttgaggttgcagtgagctatgatcaaactactgccctcttggctgggtgacagagcaagatcttttctctaaaaataaataagaatttaaaaagcaagcaaaatatataaatagacattttactaaagaaggaacatccacttataaaaaagggtaaaaatttaaaagactatccatattctctgc

SEQ ID NO: 372031 - DNA, 2000 bp, Homo sapiens
cggcggcgcggtcggagggggccggcgcgcagagccagacgccgccgcttgttttggttggggctctcggcaactctccgaggaggaggaggaggagggaggaggggagaagtaactgcagcggcagcgccctcccgaggaacaggcgtcttccccgaacccttcccaaacctcccccatcccctctcgcccttgtcccctcccctcctccccagccgcctggagcgaggggcagggatgagtctgtccctccggccggtccccagctgcagtggctgcccggtatcgtttcgcatggaaaagccactttctccacccgccgagatgggcccggatgggggctgcagaggacgcgcccgcgggcggcggcagcagcagcagcagcagcagcagcaacagcaacagccgcagcgccgcggtctctgcgactgagctggtatttgggcggctggtggcggctgggacggttggggggtgggaggaggcgaaggaggagggagaaccccgtgcaacgttgggacttggcaacccgcctccccctgcccaaggatatttaatttgcctcgggaatcgctgcttccagaggggaactcaggagggaaggcgcgcgcgcgcgcgcgctcctggaggggcaccgcagggacccccgactgtcgcctccctgtgccggactccagccggggcgacgagagatgcatcttcgctccttcctggtggcggcggcggctgagaggagacttggctctcggaggatcggggctgccctcaccccggacgcactgcctccccgccggcgtgaagcgcccgaaaactccggtcgggctctctcctgggctcagcagctgcgtcctccttcagctgcccctccccggcgcggggggcggcgtggatttcagagtcggggtttctgctgcctccagccctgtttgcatgtgccgggccgcggcgaggagcctccgccccccacccggttgtttttcggagcctccctctgctcagcgttggtggtggcggtggcagcatggcgagccctccggagagcgatggcttctcggacgtgcgcaaggtgggctacctgcgcaaacccaagagcatgcacaaacgcttcttcgtactgcgcgcggccagcgaggctgggggcccggcgcgcctcgagtactacgagaacgagaagaagtggcggcacaagtcgagcgcccccaaacgctcgatcccccttgagagctgcttcaacatcaacaagcgggctgactccaagaacaagcacctggtggctctctacacccgggacgagcactttgccatcgcggcggacagcgaggccgagcaagacagctggtaccaggctctcctacagctgcacaaccgtgctaagggccaccacgacggagctgcggccctcggggcgggaggtggtgggggcagctgcagcggcagctccggccttggtgaggctggggaggacttgagctacggtgacgtgcccccaggacccgcattcaaagaggtctggcaagtgatcctgaagcccaagggcctgggtcagacaaagaacctgattggtatctaccgcctttgcctgaccagcaagaccatcagcttcgtgaagctgaactcggaggcagcggccgtggtgctgcagctgatgaacatcaggcgctgtggccactcggaaaacttcttcttcatcgaggtgggccgttctgccgtgacggggcccggggagttctggatgcaggtggatgactctgtggtggcccagaacatgcacgagaccatcctggaggccatgcgggccatgagtgatgagttccgccctcgcagcaagagccagtcctcgtccaactgctctaaccccatcagcgtccccctggcaaatgcacacacctcatgctagcctcacgaaactggaataagccttcgaaaagaaattgtccttgaagcttgtatctgatatcagcactgtattgtagaacttgttgctgattttgaccttgtat

SEQ ID NO: 372032 - DNA, 5862 bp, Homo sapiens
  misc_feature (5805)..(5805): n is a, c, g, or t
cggcggcgcggtcggagggggccggcgcgcagagccagacgccgccgcttgttttggttggggctctcggcaactctccgaggaggaggaggaggagggaggaggggagaagtaactgcagcggcagcgccctcccgaggaacaggcgtcttccccgaacccttcccaaacctcccccatcccctctcgcccttgtcccctcccctcctccccagccgcctggagcgaggggcagggatgagtctgtccctccggccggtccccagctgcagtggctgcccggtatcgtttcgcatggaaaagccactttctccacccgccgagatgggcccggatgggggctgcagaggacgcgcccgcgggcggcggcagcagcagcagcagcagcagcagcaacagcaacagccgcagcgccgcggtctctgcgactgagctggtatttgggcggctggtggcggctgggacggttggggggtgggaggaggcgaaggaggagggagaaccccgtgcaacgttgggacttggcaacccgcctccccctgcccaaggatatttaatttgcctcgggaatcgctgcttccagaggggaactcaggagggaaggcgcgcgcgcgcgcgcgctcctggaggggcaccgcagggacccccgactgtcgcctccctgtgccggactccagccggggcgacgagagatgcatcttcgctccttcctggtggcggcggcggctgagaggagacttggctctcggaggatcggggctgccctcaccccggacgcactgcctccccgccggcgtgaagcgcccgaaaactccggtcgggctctctcctgggctcagcagctgcgtcctccttcagctgcccctccccggcgcggggggcggcgtggatttcagagtcggggtttctgctgcctccagccctgtttgcatgtgccgggccgcggcgaggagcctccgccccccacccggttgtttttcggagcctccctctgctcagcgttggtggtggcggtggcagcatggcgagccctccggagagcgatggcttctcggacgtgcgcaaggtgggctacctgcgcaaacccaagagcatgcacaaacgcttcttcgtactgcgcgcggccagcgaggctgggggcccggcgcgcctcgagtactacgagaacgagaagaagtggcggcacaagtcgagcgcccccaaacgctcgatcccccttgagagctgcttcaacatcaacaagcgggctgactccaagaacaagcacctggtggctctctacacccgggacgagcactttgccatcgcggcggacagcgaggccgagcaagacagctggtaccaggctctcctacagctgcacaaccgtgctaagggccaccacgacggagctgcggccctcggggcgggaggtggtgggggcagctgcagcggcagctccggccttggtgaggctggggaggacttgagctacggtgacgtgcccccaggacccgcattcaaagaggtctggcaagtgatcctgaagcccaagggcctgggtcagacaaagaacctgattggtatctaccgcctttgcctgaccagcaagaccatcagcttcgtgaagctgaactcggaggcagcggccgtggtgctgcagctgatgaacatcaggcgctgtggccactcggaaaacttcttcttcatcgaggtgggccgttctgccgtgacggggcccggggagttctggatgcaggtggatgactctgtggtggcccagaacatgcacgagaccatcctggaggccatgcgggccatgagtgatgagttccgccctcgcagcaagagccagtcctcgtccaactgctctaaccccatcagcgtccccctgcgccggcaccatctcaacaatcccccgcccagccaggtggggctgacccgccgatcacgcactgagagcatcaccgccacctccccggccagcatggtgggcgggaagccaggctccttccgtgtccgcgcctccagtgacggcgaaggcaccatgtcccgcccagcctcggtggacggcagccctgtgagtcccagcaccaacagaacccacgcccaccggcatcggggcagcgcccggctgcaccccccgctcaaccacagccgctccatccccatgccggcttcccgctgctcgccttcggccaccagcccggtcagtctgtcgtccagtagcaccagtggccatggctccacctcggattgtctcttcccacggcgatctagtgcttcggtgtctggttcccccagcgatggcggtttcatctcctcggatgagtatggctccagtccctgcgatttccggagttccttccgcagtgtcactccggattccctgggccacaccccaccagcccgcggtgaggaggagctaagcaactatatctgcatgggtggcaaggggccctccaccctgaccgcccccaacggtcactacattttgtctcggggtggcaatggccaccgctgcaccccaggaacaggcttgggcacgagtccagccttggctggggatgaagcagccagtgctgcagatctggataatcggttccgaaagagaactcactcggcaggcacatcccctaccattacccaccagaagaccccgtcccagtcctcagtggcttccattgaggagtacacagagatgatgcctgcctacccaccaggaggtggcagtggaggccgactgccgggacacaggcactccgccttcgtgcccacccgctcctacccagaggagggtctggaaatgcaccccttggagcgtcggggggggcaccaccgcccagacagctccaccctccacacggatgatggctacatgcccatgtccccaggggtggccccagtgcccagtggccgaaagggcagtggagactatatgcccatgagccccaagagcgtatctgccccacagcagatcatcaatcccatcagacgccatccccagagagtggaccccaatggctacatgatgatgtcccccagcggtggctgctctcctgacattggaggtggccccagcagcagcagcagcagcagcaacgccgtcccttccgggaccagctatggaaagctgtggacaaacggggtagggggccaccactctcatgtcttgcctcaccccaaacccccagtggagagcagcggtggtaagctcttaccttgcacaggtgactacatgaacatgtcaccagtgggggactccaacaccagcagcccctccgactgctactacggccctgaggacccccagcacaagccagtcctctcctactactcattgccaagatcctttaagcacacccagcgccccggggagccggaggagggtgcccggcatcagcacctccgcctttccactagctctggtcgccttctctatgctgcaacagcagatgattcttcctcttccaccagcagcgacagcctgggtgggggatactgcggggctaggctggagcccagccttccacatccccaccatcaggttctgcagccccatctgcctcgaaaggtggacacagctgctcagaccaatagccgcctggcccggcccacgaggctgtccctgggggatcccaaggccagcaccttacctcgggcccgagagcagcagcagcagcagcagcccttgctgcaccctccagagcccaagagcccgggggaatatgtcaatattgaatttgggagtgatcagtctggctacttgtctggcccggtggctttccacagctcaccttctgtcaggtgtccatcccagctccagccagctcccagagaggaagagactggcactgaggagtacatgaagatggacctggggccgggccggagggcagcctggcaggagagcactggggtcgagatgggcagactgggccctgcacctcccggggctgctagcatttgcaggcctacccgggcagtgcccagcagccggggtgactacatgaccatgcagatgagttgtccccgtcagagctacgtggacacctcgccagctgcccctgtaagctatgctgacatgcgaacaggcattgctgcagaggaggtgagcctgcccagggccaccatggctgctgcctcctcatcctcagcagcctctgcttccccgactgggcctcaaggggcagcagagctggctgcccactcgtccctgctggggggcccacaaggacctgggggcatgagcgccttcacccgggtgaacctcagtcctaaccgcaaccagagtgccaaagtgatccgtgcagacccacaagggtgccggcggaggcatagctccgagactttctcctcaacacccagtgccacccgggtgggcaacacagtgccctttggagcgggggcagcagtagggggcggtggcggtagcagcagcagcagcgaggatgtgaaacgccacagctctgcttcctttgagaatgtgtggctgaggcctggggagcttgggggagcccccaaggagccagccaaactgtgtggggctgctgggggtttggagaatggtcttaactacatagacctggatttggtcaaggacttcaaacagtgccctcaggagtgcacccctgaaccgcagcctcccccacccccaccccctcatcaacccctgggcagcggtgagagcagctccacccgccgctcaagtgaggatttaagcgcctatgccagcatcagtttccagaagcagccagaggaccgtcagtagctcaactggacatcacagcagaatgaagacctaaatgacctcagcaaatcctcttctaactcatgggtacccagactctaaatatttcatgattcacaactaggacctcatatcttcctcatcagtagatggtacgatgcatccatttcagtttgtttactttatccaatcctcaggatttcattgactgaactgcacgttctatattgtgccaagcgaaaaaaaaaaatgcactgtgacaccagaataatgagtctgcataaacttcatcttcaaccttaaggacttagctggccacagtgagctgatgtgcccaccaccgtgtcatgagagaatgggtttactctcaatgcattttcaagatacatttcatctgctgctgaaactgtgtacgacaaagcatcattgtaaattatttcatacaaaactgttcacgttgggtggagagagtattaaatatttaacataggttttgatttatatgtgtaattttttaaatgaaaatgtaacttttcttacagcacatcttttttttggatgtgggatggaggtatacaatgttctgttgtaaagagtggagcaaatgcttaaaacaaggcttaaaagagtagaatagggtatgatccttgttttaagattgtaattcagaaaacataatataagaatcatagtgccatagatggttctcaattgtatagttatatttgctgatactatctcttgtcatataaacctgatgttgagctgagttccttataagaattaatcttaattttgtattttttcctgtaagacaataggccatgttaattaaactgaagaaggatatatttggctgggtgttttcaaatgtcagcttaaaattggtaattgaatggaagcaaaattataagaagaggaaattaaagtcttccattgcatgtattgtaaacagaaggagatgggtgattccttcaattcaaaagctctctttggaatgaacaatgtgggcgtttgtaaattctggaaatgtctttctattcataataacttttgaaacagagatgcgtccaggnttttttttttttttaaatttttctctttttattctcctctctcttttcttctcttct

SEQ ID NO: 372033 - DNA, 1243 bp, Homo sapiens
  misc_feature (6)..(6): n is a, c, g, or t
  misc_feature (10)..(10): n is a, c, g, or t
  misc_feature (18)..(18): n is a, c, g, or t
ccctgngggncactgacntctctaattaccaccgctacagaatgaagacctaaatgacctcagcaaatcctcttctaactcatgggtacccagactctaaatatttcatgattcacaactaggacctcatatcttcctcatcagtagatggtacgatgcatccatttcagtttgtttactttatccaatcctcaggatttcattgactgaactgcacgttctatattgtgccaagcgaaaaaaaaaaatgcactgtgacaccagaataatgagtctgcataaacttcatcttcaaccttaaggacttagctggccacagtgagctgatgtgcccaccaccgtgtcatgagagaatgggtttactctcaatgcattttcaagatacatttcatctgctgctgaaactgtgtacgacaaagcatcattgtaaattatttcatacaaaactgttcacgttgggtggagagagtattaaatatttaacataggttttgatttatatgtgtaattttttaaatgaaaatgtaacttttcttacagcacatcttttttttggatgtgggatggaggtatacaatgttctgttgtaaagagtggagcaaatgcttaaaacaaggcttaaaagagtagaatagggtatgatccttgttttaagattgtaattcagaaaacataatataagaatcatagtgccatagatggttctcaattgtatagttatatttgctgatactatctcttgtcatataaacctgatgttgagctgagttccttataagaattaatcttaattttgtattttttcctgtaagacaataggccatgttaattaaactgaagaaggatatatttggctgggtgttttcaaatgtcagcttaaaattggtaattgaatggaagcaaaattataagaagaggaaattaaagtcttccattgcatgtattgtaaacagaaggagatgggtgattccttcaattcaaaagctctctttggaatgaacaatgtgggcgtttgtaaattctggaaatgtctttctattcataataaactagatactgttgatcttttcttctgtcccctccccccaccacttctgtaagtttcctgctctattcccaccatttttttctgtgcacacattatgatatatttcatttcctgcattgtcttgagaaagatggtaaggcaagtgagctgttgctaaccagaaattaaaattccagtaagtgtttttcattatga

SEQ ID NO: 372034 - DNA, 1272 bp, Homo sapiens
tgcctatttggttccaagtcttctggtgacagcaaaagatagcactttggacttcagacagctttgatgaatgaagacctaaatgacctcagcaaatcctcttctaactcatgggtacccagactctaaatatttcatgattcacaactaggacctcatatcttcctcatcagtagatggtacgatgcatccatttcagtttgtttactttatccaatcctcaggatttcattgactgaactgcacgttctatattgtgccaagcgaaaaaaaaaaatgcactgtgacaccagaataatgagtctgcataaacttcatcttcaaccttaaggacttagctggccacagtgagctgatgtgcccaccaccgtgtcatgagagaatgggtttactctcaatgcattttcaagatacatttcatctgctgctgaaactgtgtacgacaaagcatcattgtaaattatttcatacaaaactgttcacgttgggtggagagagtattaaatatttaacataggttttgatttatatgtgtaattttttaaatgaaaatgtaacttttcttacagcacatcttttttttggatgtgggatggaggtatacaatgttctgttgtaaagagtggagcaaatgcttaaaacaaggcttaaaagagtagaatagggtatgatccttgttttaagattgtaattcagaaaacataatataagaatcatagtgccatagatggttctcaattgtatagttatatttgctgatactatctcttgtcatataaacctgatgttgagctgagttccttataagaattaatcttaattttgtattttttcctgtaagacaataggccatgttaattaaactgaagaaggatatatttggctgggtgttttcaaatgtcagcttaaaattggtaattgaatggaagcaaaattataagaagaggaaattaaagtcttccattgcatgtattgtaaacagaaggagatgggtgattccttcaattcaaaagctctctttggaatgaacaatgtgggcgtttgtaaattctggaaatgtctttctattcataataaactagatactgttgatcttttcttctgtcccctccccccaccacttctgtaagtttcctgctctattcccaccatttttttctgtgcacacattatgatatatttcatttcctgcattgtcttgagaaagatggtaaggcaagtgagctgttgctaaccagaaattaaaattccagtaagtgtttttcattatga

SEQ ID NO: 372035 - DNA, 7779 bp, Homo sapiens
cggcggcgcggtcggagggggccggcgcgcagagccagacgccgccgcttgttttggttggggctctcggcaactctccgaggaggaggaggaggagggaggaggggagaagtaactgcagcggcagcgccctcccgaggaacaggcgtcttccccgaacccttcccaaacctcccccatcccctctcgcccttgtcccctcccctcctccccagccgcctggagcgaggggcagggatgagtctgtccctccggccggtccccagctgcagtggctgcccggtatcgtttcgcatggaaaagccactttctccacccgccgagatgggcccggatgggggctgcagaggacgcgcccgcgggcggcggcagcagcagcagcagcagcagcagcaacagcaacagccgcagcgccgcggtctctgcgactgagctggtatttgggcggctggtggcggctgggacggttggggggtgggaggaggcgaaggaggagggagaaccccgtgcaacgttgggacttggcaacccgcctccccctgcccaaggatatttaatttgcctcgggaatcgctgcttccagaggggaactcaggagggaaggcgcgcgcgcgcgcgcgctcctggaggggcaccgcagggacccccgactgtcgcctccctgtgccggactccagccggggcgacgagagatgcatcttcgctccttcctggtggcggcggcggctgagaggagacttggctctcggaggatcggggctgccctcaccccggacgcactgcctccccgccggcgtgaagcgcccgaaaactccggtcgggctctctcctgggctcagcagctgcgtcctccttcagctgcccctccccggcgcggggggcggcgtggatttcagagtcggggtttctgctgcctccagccctgtttgcatgtgccgggccgcggcgaggagcctccgccccccacccggttgtttttcggagcctccctctgctcagcgttggtggtggcggtggcagcatggcgagccctccggagagcgatggcttctcggacgtgcgcaaggtgggctacctgcgcaaacccaagagcatgcacaaacgcttcttcgtactgcgcgcggccagcgaggctgggggcccggcgcgcctcgagtactacgagaacgagaagaagtggcggcacaagtcgagcgcccccaaacgctcgatcccccttgagagctgcttcaacatcaacaagcgggctgactccaagaacaagcacctggtggctctctacacccgggacgagcactttgccatcgcggcggacagcgaggccgagcaagacagctggtaccaggctctcctacagctgcacaaccgtgctaagggccaccacgacggagctgcggccctcggggcgggaggtggtgggggcagctgcagcggcagctccggccttggtgaggctggggaggacttgagctacggtgacgtgcccccaggacccgcattcaaagaggtctggcaagtgatcctgaagcccaagggcctgggtcagacaaagaacctgattggtatctaccgcctttgcctgaccagcaagaccatcagcttcgtgaagctgaactcggaggcagcggccgtggtgctgcagctgatgaacatcaggcgctgtggccactcggaaaacttcttcttcatcgaggtgggccgttctgccgtgacggggcccggggagttctggatgcaggtggatgactctgtggtggcccagaacatgcacgagaccatcctggaggccatgcgggccatgagtgatgagttccgccctcgcagcaagagccagtcctcgtccaactgctctaaccccatcagcgtccccctgcgccggcaccatctcaacaatcccccgcccagccaggtggggctgacccgccgatcacgcactgagagcatcaccgccacctccccggccagcatggtgggcgggaagccaggctccttccgtgtccgcgcctccagtgacggcgaaggcaccatgtcccgcccagcctcggtggacggcagccctgtgagtcccagcaccaacagaacccacgcccaccggcatcggggcagcgcccggctgcaccccccgctcaaccacagccgctccatccccatgccggcttcccgctgctcgccttcggccaccagcccggtcagtctgtcgtccagtagcaccagtggccatggctccacctcggattgtctcttcccacggcgatctagtgcttcggtgtctggttcccccagcgatggcggtttcatctcctcggatgagtatggctccagtccctgcgatttccggagttccttccgcagtgtcactccggattccctgggccacaccccaccagcccgcggtgaggaggagctaagcaactatatctgcatgggtggcaaggggccctccaccctgaccgcccccaacggtcactacattttgtctcggggtggcaatggccaccgctgcaccccaggaacaggcttgggcacgagtccagccttggctggggatgaagcagccagtgctgcagatctggataatcggttccgaaagagaactcactcggcaggcacatcccctaccattacccaccagaagaccccgtcccagtcctcagtggcttccattgaggagtacacagagatgatgcctgcctacccaccaggaggtggcagtggaggccgactgccgggacacaggcactccgccttcgtgcccacccgctcctacccagaggagggtctggaaatgcaccccttggagcgtcggggggggcaccaccgcccagacagctccaccctccacacggatgatggctacatgcccatgtccccaggggtggccccagtgcccagtggccgaaagggcagtggagactatatgcccatgagccccaagagcgtatctgccccacagcagatcatcaatcccatcagacgccatccccagagagtggaccccaatggctacatgatgatgtcccccagcggtggctgctctcctgacattggaggtggccccagcagcagcagcagcagcagcaacgccgtcccttccgggaccagctatggaaagctgtggacaaacggggtagggggccaccactctcatgtcttgcctcaccccaaacccccagtggagagcagcggtggtaagctcttaccttgcacaggtgactacatgaacatgtcaccagtgggggactccaacaccagcagcccctccgactgctactacggccctgaggacccccagcacaagccagtcctctcctactactcattgccaagatcctttaagcacacccagcgccccggggagccggaggagggtgcccggcatcagcacctccgcctttccactagctctggtcgccttctctatgctgcaacagcagatgattcttcctcttccaccagcagcgacagcctgggtgggggatactgcggggctaggctggagcccagccttccacatccccaccatcaggttctgcagccccatctgcctcgaaaggtggacacagctgctcagaccaatagccgcctggcccggcccacgaggctgtccctgggggatcccaaggccagcaccttacctcgggcccgagagcagcagcagcagcagcagcccttgctgcaccctccagagcccaagagcccgggggaatatgtcaatattgaatttgggagtgatcagtctggctacttgtctggcccggtggctttccacagctcaccttctgtcaggtgtccatcccagctccagccagctcccagagaggaagagactggcactgaggagtacatgaagatggacctggggccgggccggagggcagcctggcaggagagcactggggtcgagatgggcagactgggccctgcacctcccggggctgctagcatttgcaggcctacccgggcagtgcccagcagccggggtgactacatgaccatgcagatgagttgtccccgtcagagctacgtggacacctcgccagctgcccctgtaagctatgctgacatgcgaacaggcattgctgcagaggaggtgagcctgcccagggccaccatggctgctgcctcctcatcctcagcagcctctgcttccccgactgggcctcaaggggcagcagagctggctgcccactcgtccctgctggggggcccacaaggacctgggggcatgagcgccttcacccgggtgaacctcagtcctaaccgcaaccagagtgccaaagtgatccgtgcagacccacaagggtgccggcggaggcatagctccgagactttctcctcaacacccagtgccacccgggtgggcaacacagtgccctttggagcgggggcagcagtagggggcggtggcggtagcagcagcagcagcgaggatgtgaaacgccacagctctgcttcctttgagaatgtgtggctgaggcctggggagcttgggggagcccccaaggagccagccaaactgtgtggggctgctgggggtttggagaatggtcttaactacatagacctggatttggtcaaggacttcaaacagtgccctcaggagtgcacccctgaaccgcagcctcccccacccccaccccctcatcaacccctgggcagcggtgagagcagctccacccgccgctcaagtgaggatttaagcgcctatgccagcatcagtttccagaagcagccagaggaccgtcagtagctcaactggacatcacagcaggtgcgtttcatggtgacaaagtcagaagacaaaactgcttttaaccttgtccttgaattctgttcttcgcctctgccccttcctgttctttcccactgcttcctcagggagaatgcacttacattctcagggcacacaagatgctcaccccacactgacatctggcagagagtcaaacaaacatgtaggagcagccacaggagggctttttcgtttgagaattcccaagtgaagtagttactgcagtatttttaaaacatatatcctatgccagttctgcgttttgtagagttcctccgtaagaagcttgatttgtttgttgaagttttcttttcactatatatttaggtcagcccctggaagggacagttctacaaaaaatatttgttaacacaggggctaaacccttccttatcttaaactatcttaatagtttctgggagcccttaagggtgatcttatcaagttgttctctgtacttttgttctgtgatttcataatactagggcaacataaacagcagcgggaagcattgatttctattcatcctgccctaaaaagatcaggagtaagagctttttagaaatatgtatttagagagaagtacctatctattttgtgatctctcaagaaagtaattatgggtgacgttctccttttgttcatgtaccaggatttgtgaaatattattcacacaccgacccaccatcccacgggcctggcctctcttgtacaggatatgcaggaaactctgtatgtgtctgggacccattattaagagttatgggagttcatcctaggatgtctgccttatagttatctcttcttgcactgagacattacagatatcatttgggggctactatatatcttctgtaaaattacttttatttgttgagaagaatgcatactaagtcaggaacatgccttaatttgtttgttttgcattgagtagaagggctaaactgtataccctccacttttagggttatttgctgtgtgcctttaagttcaaaagtagacaccacagtaaatgctgaaagttggctttaggtcttctgtggctaatgccgtattaaaaatgaaaaacatttgtaataggaaattagcctgcccttcgttctgttgatcctgttttctggtggtcataattgtgggtagaagagagtacagtttgcaaataatgtgatgagttggcaatgcagaagtttccagcatttggaaacactttactctgacaaactgattatcttgtgaattttatctatgctccacagaatgagcttttaaaagcactgatttttcttaatttgtgtccattcataagaaattaatctgtgccctggtttcctattgacaggtatttatttatcatgtgttcatagtcttcttaattctgtttccaatatttgatccatataattctctattttatagaacaagaaaaaggtatatgaacactcaaatgaagattttgggtgatatgttacaaaaagcatttatttgatcagtatttacttcaacatttattttcatcattcactagaagaaagatttaattgtgtatatcaacatcagtagtacaaatcttgttatatcaaatgatgtttttgggagtcagaatccctcaacactttaagcatttgtattataaagtgcctcattggtaaaataatgagaatttgaagaaaaccagcccagcagaactaaaattttggttttaaaggagataaagagaataagtttttcttacttgtcatcttaatttgtttaggtttctttttatagagtagaataaatgatgtttgctctgaagagaattgatgaccaactagaattttcatttttaaaaagggctttaaaataaaattctcctatgtgttggatgcattaaaaaaacaaaaactctacaaaattctatccttaaccttctttgggaaaataaaatattctggaataatcatataatcctatttctaataattctggagtaacaatcgaccatgctttgcacagtgccaggaaaattctacaatgcgtatttgagatgtttgtgttggtgtttaaagtgaggcaccaaatgctacctggcacatttacatcctcaattctgcttgcttgcctgtgccctgttgagtccaaagatgttattctatagctatctgaaacagacagaagtcagacctgtgagtggcaaacagcttctgctccgaatgtgtgtgcaaacattattttcctcacttcctcagcaattgctgtctttgcttcttttcctcatttctcaggtaaaacctgagactcggtgaaaggaatagaggtatgatgaggcgtgggctctgttgaaacatctcggcttgtttaaaatttttcattgtctgttaagaggagaacacttgtgaagcactgagctcaggagctctacttgttggaagcctgtctgctttacctgtagtccagtgaccttttctgcctgccctttctcttgcatagcctcttagttctggcttgctcgttttctagtactatcccctgccatccctttgtttccacctcttatttcatgttcctgacattatcctttttttcttttgctccttttcagaatttcgcagtacttgtggcccactctctgcagagagtaaattgagagcccaagaagcagggcaaaaagagcctctcagactcggtcatagcagccctgccacctttacctggcatcaaatttatcttttagttttgaaactgcagctgacaaagacacagaccccagccatgccttttgggttcagtttttttgtttttgtcattctttgttatgccctccccctttaaaagaaaaaagaaaaagaaaaaaaacagaaaaagactctttccatttctttttcattcagtttccttttttgtgatgtcaaggattccgtacctccaaggttgcctcccctccctcccctttccccagccctgtggcctttttggctggcgcaaaccctctcggccctggcactttc

SEQ ID NO: 372036 - DNA, 5177 bp, Homo sapiens
cggcggcgcggtcggagggggccggcgcgcagagccagacgccgccgcttgttttggttggggctctcggcaactctccgaggaggaggaggaggagggaggaggggagaagtaactgcagcggcagcgccctcccgaggaacaggcgtcttccccgaacccttcccaaacctcccccatcccctctcgcccttgtcccctcccctcctccccagccgcctggagcgaggggcagggatgagtctgtccctccggccggtccccagctgcagtggctgcccggtatcgtttcgcatggaaaagccactttctccacccgccgagatgggcccggatgggggctgcagaggacgcgcccgcgggcggcggcagcagcagcagcagcagcagcagcaacagcaacagccgcagcgccgcggtctctgcgactgagctggtatttgggcggctggtggcggctgggacggttggggggtgggaggaggcgaaggaggagggagaaccccgtgcaacgttgggacttggcaacccgcctccccctgcccaaggatatttaatttgcctcgggaatcgctgcttccagaggggaactcaggagggaaggcgcgcgcgcgcgcgcgctcctggaggggcaccgcagggacccccgactgtcgcctccctgtgccggactccagccggggcgacgagagatgcatcttcgctccttcctggtggcggcggcggctgagaggagacttggctctcggaggatcggggctgccctcaccccggacgcactgcctccccgccggcgtgaagcgcccgaaaactccggtcgggctctctcctgggctcagcagctgcgtcctccttcagctgcccctccccggcgcggggggcggcgtggatttcagagtcggggtttctgctgcctccagccctgtttgcatgtgccgggccgcggcgaggagcctccgccccccacccggttgtttttcggagcctccctctgctcagcgttggtggtggcggtggcagcatggcgagccctccggagagcgatggcttctcggacgtgcgcaaggtgggctacctgcgcaaacccaagagcatgcacaaacgcttcttcgtactgcgcgcggccagcgaggctgggggcccggcgcgcctcgagtactacgagaacgagaagaagtggcggcacaagtcgagcgcccccaaacgctcgatcccccttgagagctgcttcaacatcaacaagcgggctgactccaagaacaagcacctggtggctctctacacccgggacgagcactttgccatcgcggcggacagcgaggccgagcaagacagctggtaccaggctctcctacagctgcacaaccgtgctaagggccaccacgacggagctgcggccctcggggcgggaggtggtgggggcagctgcagcggcagctccggccttggtgaggctggggaggacttgagctacggtgacgtgcccccaggacccgcattcaaagaggtctggcaagtgatcctgaagcccaagggcctgggtcagacaaagaacctgattggtatctaccgcctttgcctgaccagcaagaccatcagcttcgtgaagctgaactcggaggcagcggccgtggtgctgcagctgatgaacatcaggcgctgtggccactcggaaaacttcttcttcatcgaggtgggccgttctgccgtgacggggcccggggagttctggatgcaggtggatgactctgtggtggcccagaacatgcacgagaccatcctggaggccatgcgggccatgagtgatgagttccgccctcgcagcaagagccagtcctcgtccaactgctctaaccccatcagcgtccccctgcgccggcaccatctcaacaatcccccgcccagccaggtggggctgacccgccgatcacgcactgagagcatcaccgccacctccccggccagcatggtgggcgggaagccaggctccttccgtgtccgcgcctccagtgacggcgaaggcaccatgtcccgcccagcctcggtggacggcagccctgtgagtcccagcaccaacagaacccacgcccaccggcatcggggcagcgcccggctgcaccccccgctcaaccacagccgctccatccccatgccggcttcccgctgctcgccttcggccaccagcccggtcagtctgtcgtccagtagcaccagtggccatggctccacctcggattgtctcttcccacggcgatctagtgcttcggtgtctggttcccccagcgatggcggtttcatctcctcggatgagtatggctccagtccctgcgatttccggagttccttccgcagtgtcactccggattccctgggccacaccccaccagcccgcggtgaggaggagctaagcaactatatctgcatgggtggcaaggggccctccaccctgaccgcccccaacggtcactacattttgtctcggggtggcaatggccaccgctgcaccccaggaacaggcttgggcacgagtccagccttggctggggatgaagcagccagtgctgcagatctggataatcggttccgaaagagaactcactcggcaggcacatcccctaccattacccaccagaagaccccgtcccagtcctcagtggcttccattgaggagtacacagagatgatgcctgcctacccaccaggaggtggcagtggaggccgactgccgggacacaggcactccgccttcgtgcccacccgctcctacccagaggagggtctggaaatgcaccccttggagcgtcggggggggcaccaccgcccagacagctccaccctccacacggatgatggctacatgcccatgtccccaggggtggccccagtgcccagtggccgaaagggcagtggagactatatgcccatgagccccaagagcgtatctgccccacagcagatcatcaatcccatcagacgccatccccagagagtggaccccaatggctacatgatgatgtcccccagcggtggctgctctcctgacattggaggtggccccagcagcagcagcagcagcagcaacgccgtcccttccgggaccagctatggaaagctgtggacaaacggggtagggggccaccactctcatgtcttgcctcaccccaaacccccagtggagagcagcggtggtaagctcttaccttgcacaggtgactacatgaacatgtcaccagtgggggactccaacaccagcagcccctccgactgctactacggccctgaggacccccagcacaagccagtcctctcctactactcattgccaagatcctttaagcacacccagcgccccggggagccggaggagggtgcccggcatcagcacctccgcctttccactagctctggtcgccttctctatgctgcaacagcagatgattcttcctcttccaccagcagcgacagcctgggtgggggatactgcggggctaggctggagcccagccttccacatccccaccatcaggttctgcagccccatctgcctcgaaaggtggacacagctgctcagaccaatagccgcctggcccggcccacgaggctgtccctgggggatcccaaggccagcaccttacctcgggcccgagagcagcagcagcagcagcagcccttgctgcaccctccagagcccaagagcccgggggaatatgtcaatattgaatttgggagtgatcagtctggctacttgtctggcccggtggctttccacagctcaccttctgtcaggtgtccatcccagctccagccagctcccagagaggaagagactggcactgaggagtacatgaagatggacctggggccgggccggagggcagcctggcaggagagcactggggtcgagatgggcagactgggccctgcacctcccggggctgctagcatttgcaggcctacccgggcagtgcccagcagccggggtgactacatgaccatgcagatgagttgtccccgtcagagctacgtggacacctcgccagctgcccctgtaagctatgctgacatgcgaacaggcattgctgcagaggaggtgagcctgcccagggccaccatggctgctgcctcctcatcctcagcagcctctgcttccccgactgggcctcaaggggcagcagagctggctgcccactcgtccctgctggggggcccacaaggacctgggggcatgagcgccttcacccgggtgaacctcagtcctaaccgcaaccagagtgccaaagtgatccgtgcagacccacaagggtgccggcggaggcatagctccgagactttctcctcaacacccagtgccacccgggtgggcaacacagtgccctttggagcgggggcagcagtagggggcggtggcggtagcagcagcagcagcgaggatgtgaaacgccacagctctgcttcctttgagaatgtgtggctgaggcctggggagcttgggggagcccccaaggagccagccaaactgtgtggggctgctgggggtttggagaatggtcttaactacatagacctggatttggtcaaggacttcaaacagtgccctcaggagtgcacccctgaaccgcagcctcccccacccccaccccctcatcaacccctgggcagcggtgagagcagctccacccgccgctcaagtgaggatttaagcgcctatgccagcatcagtttccagaagcagccagaggaccgtcagtagctcaactggacatcacagcagaatttcgcagtacttgtggcccactctctgcagagagtaaattgagagcccaagaagcagggcaaaaagagcctctcagactcggtcatagcagccctgccacctttacctggcatcaaatttatcttttagttttgaaactgcagctgacaaagacacagaccccagccatgccttttgggttcagtttttttgtttttgtcattctttgttatgccctccccctttaaaagaaaaaagaaaaagaaaaaaaacagaaaaagactctttccatttctttttcattcagtttccttttttgtgatgtcaaggattccgtacctccaaggttgcctcccctccctcccctttccccagccctgtggcctttttggctggcgcaaaccctctcggccctggcactttc

SEQ ID NO: 372037 - DNA, 5974 bp, Homo sapiens
cggcggcgcggtcggagggggccggcgcgcagagccagacgccgccgcttgttttggttggggctctcggcaactctccgaggaggaggaggaggagggaggaggggagaagtaactgcagcggcagcgccctcccgaggaacaggcgtcttccccgaacccttcccaaacctcccccatcccctctcgcccttgtcccctcccctcctccccagccgcctggagcgaggggcagggatgagtctgtccctccggccggtccccagctgcagtggctgcccggtatcgtttcgcatggaaaagccactttctccacccgccgagatgggcccggatgggggctgcagaggacgcgcccgcgggcggcggcagcagcagcagcagcagcagcagcaacagcaacagccgcagcgccgcggtctctgcgactgagctggtatttgggcggctggtggcggctgggacggttggggggtgggaggaggcgaaggaggagggagaaccccgtgcaacgttgggacttggcaacccgcctccccctgcccaaggatatttaatttgcctcgggaatcgctgcttccagaggggaactcaggagggaaggcgcgcgcgcgcgcgcgctcctggaggggcaccgcagggacccccgactgtcgcctccctgtgccggactccagccggggcgacgagagatgcatcttcgctccttcctggtggcggcggcggctgagaggagacttggctctcggaggatcggggctgccctcaccccggacgcactgcctccccgccggcgtgaagcgcccgaaaactccggtcgggctctctcctgggctcagcagctgcgtcctccttcagctgcccctccccggcgcggggggcggcgtggatttcagagtcggggtttctgctgcctccagccctgtttgcatgtgccgggccgcggcgaggagcctccgccccccacccggttgtttttcggagcctccctctgctcagcgttggtggtggcggtggcagcatggcgagccctccggagagcgatggcttctcggacgtgcgcaaggtgggctacctgcgcaaacccaagagcatgcacaaacgcttcttcgtactgcgcgcggccagcgaggctgggggcccggcgcgcctcgagtactacgagaacgagaagaagtggcggcacaagtcgagcgcccccaaacgctcgatcccccttgagagctgcttcaacatcaacaagcgggctgactccaagaacaagcacctggtggctctctacacccgggacgagcactttgccatcgcggcggacagcgaggccgagcaagacagctggtaccaggctctcctacagctgcacaaccgtgctaagggccaccacgacggagctgcggccctcggggcgggaggtggtgggggcagctgcagcggcagctccggccttggtgaggctggggaggacttgagctacggtgacgtgcccccaggacccgcattcaaagaggtctggcaagtgatcctgaagcccaagggcctgggtcagacaaagaacctgattggtatctaccgcctttgcctgaccagcaagaccatcagcttcgtgaagctgaactcggaggcagcggccgtggtgctgcagctgatgaacatcaggcgctgtggccactcggaaaacttcttcttcatcgaggtgggccgttctgccgtgacggggcccggggagttctggatgcaggtggatgactctgtggtggcccagaacatgcacgagaccatcctggaggccatgcgggccatgagtgatgagttccgccctcgcagcaagagccagtcctcgtccaactgctctaaccccatcagcgtccccctgcgccggcaccatctcaacaatcccccgcccagccaggtggggctgacccgccgatcacgcactgagagcatcaccgccacctccccggccagcatggtgggcgggaagccaggctccttccgtgtccgcgcctccagtgacggcgaaggcaccatgtcccgcccagcctcggtggacggcagccctgtgagtcccagcaccaacagaacccacgcccaccggcatcggggcagcgcccggctgcaccccccgctcaaccacagccgctccatccccatgccggcttcccgctgctcgccttcggccaccagcccggtcagtctgtcgtccagtagcaccagtggccatggctccacctcggattgtctcttcccacggcgatctagtgcttcggtgtctggttcccccagcgatggcggtttcatctcctcggatgagtatggctccagtccctgcgatttccggagttccttccgcagtgtcactccggattccctgggccacaccccaccagcccgcggtgaggaggagctaagcaactatatctgcatgggtggcaaggggccctccaccctgaccgcccccaacggtcactacattttgtctcggggtggcaatggccaccgctgcaccccaggaacaggcttgggcacgagtccagccttggctggggatgaagcagccagtgctgcagatctggataatcggttccgaaagagaactcactcggcaggcacatcccctaccattacccaccagaagaccccgtcccagtcctcagtggcttccattgaggagtacacagagatgatgcctgcctacccaccaggaggtggcagtggaggccgactgccgggacacaggcactccgccttcgtgcccacccgctcctacccagaggagggtctggaaatgcaccccttggagcgtcggggggggcaccaccgcccagacagctccaccctccacacggatgatggctacatgcccatgtccccaggggtggccccagtgcccagtggccgaaagggcagtggagactatatgcccatgagccccaagagcgtatctgccccacagcagatcatcaatcccatcagacgccatccccagagagtggaccccaatggctacatgatgatgtcccccagcggtggctgctctcctgacattggaggtggccccagcagcagcagcagcagcagcaacgccgtcccttccgggaccagctatggaaagctgtggacaaacggggtagggggccaccactctcatgtcttgcctcaccccaaacccccagtggagagcagcggtggtaagctcttaccttgcacaggtgactacatgaacatgtcaccagtgggggactccaacaccagcagcccctccgactgctactacggccctgaggacccccagcacaagccagtcctctcctactactcattgccaagatcctttaagcacacccagcgccccggggagccggaggagggtgcccggcatcagcacctccgcctttccactagctctggtcgccttctctatgctgcaacagcagatgattcttcctcttccaccagcagcgacagcctgggtgggggatactgcggggctaggctggagcccagccttccacatccccaccatcaggttctgcagccccatctgcctcgaaaggtggacacagctgctcagaccaatagccgcctggcccggcccacgaggctgtccctgggggatcccaaggccagcaccttacctcgggcccgagagcagcagcagcagcagcagcccttgctgcaccctccagagcccaagagcccgggggaatatgtcaatattgaatttgggagtgatcagtctggctacttgtctggcccggtggctttccacagctcaccttctgtcaggtgtccatcccagctccagccagctcccagagaggaagagactggcactgaggagtacatgaagatggacctggggccgggccggagggcagcctggcaggagagcactggggtcgagatgggcagactgggccctgcacctcccggggctgctagcatttgcaggcctacccgggcagtgcccagcagccggggtgactacatgaccatgcagatgagttgtccccgtcagagctacgtggacacctcgccagctgcccctgtaagctatgctgacatgcgaacaggcattgctgcagaggaggtgagcctgcccagggccaccatggctgctgcctcctcatcctcagcagcctctgcttccccgactgggcctcaaggggcagcagagctggctgcccactcgtccctgctggggggcccacaaggacctgggggcatgagcgccttcacccgggtgaacctcagtcctaaccgcaaccagagtgccaaagtgatccgtgcagacccacaagggtgccggcggaggcatagctccgagactttctcctcaacacccagtgccacccgggtgggcaacacagtgccctttggagcgggggcagcagtagggggcggtggcggtagcagcagcagcagcgaggatgtgaaacgccacagctctgcttcctttgagaatgtgtggctgaggcctggggagcttgggggagcccccaaggagccagccaaactgtgtggggctgctgggggtttggagaatggtcttaactacatagacctggatttggtcaaggacttcaaacagtgccctcaggagtgcacccctgaaccgcagcctcccccacccccaccccctcatcaacccctgggcagcggtgagagcagctccacccgccgctcaagtgaggatttaagcgcctatgccagcatcagtttccagaagcagccagaggaccgtcagtagctcaactggacatcacagcagaatgaagacctaaatgacctcagcaaatcctcttctaactcatgggtacccagactctaaatatttcatgattcacaactaggacctcatatcttcctcatcagtagatggtacgatgcatccatttcagtttgtttactttatccaatcctcaggatttcattgactgaactgcacgttctatattgtgccaagcgaaaaaaaaaaatgcactgtgacaccagaataatgagtctgcataaacttcatcttcaaccttaaggacttagctggccacagtgagctgatgtgcccaccaccgtgtcatgagagaatgggtttactctcaatgcattttcaagatacatttcatctgctgctgaaactgtgtacgacaaagcatcattgtaaattatttcatacaaaactgttcacgttgggtggagagagtattaaatatttaacataggttttgatttatatgtgtaattttttaaatgaaaatgtaacttttcttacagcacatcttttttttggatgtgggatggaggtatacaatgttctgttgtaaagagtggagcaaatgcttaaaacaaggcttaaaagagtagaatagggtatgatccttgttttaagattgtaattcagaaaacataatataagaatcatagtgccatagatggttctcaattgtatagttatatttgctgatactatctcttgtcatataaacctgatgttgagctgagttccttataagaattaatcttaattttgtattttttcctgtaagacaataggccatgttaattaaactgaagaaggatatatttggctgggtgttttcaaatgtcagcttaaaattggtaattgaatggaagcaaaattataagaagaggaaattaaagtcttccattgcatgtattgtaaacagaaggagatgggtgattccttcaattcaaaagctctctttggaatgaacaatgtgggcgtttgtaaattctggaaatgtctttctattcataataaactagatactgttgatcttttcttctgtcccctccccccaccacttctgtaagtttcctgctctattcccaccatttttttctgtgcacacattatgatatatttcatttcctgcattgtcttgagaaagatggtaaggcaagtgagctgttgctaaccagaaattaaaattccagtaagtgtttttcattatga

SEQ ID NO: 372038 - DNA, 5820 bp, Homo sapiens
cggcggcgcggtcggagggggccggcgcgcagagccagacgccgccgcttgttttggttggggctctcggcaactctccgaggaggaggaggaggagggaggaggggagaagtaactgcagcggcagcgccctcccgaggaacaggcgtcttccccgaacccttcccaaacctcccccatcccctctcgcccttgtcccctcccctcctccccagccgcctggagcgaggggcagggatgagtctgtccctccggccggtccccagctgcagtggctgcccggtatcgtttcgcatggaaaagccactttctccacccgccgagatgggcccggatgggggctgcagaggacgcgcccgcgggcggcggcagcagcagcagcagcagcagcagcaacagcaacagccgcagcgccgcggtctctgcgactgagctggtatttgggcggctggtggcggctgggacggttggggggtgggaggaggcgaaggaggagggagaaccccgtgcaacgttgggacttggcaacccgcctccccctgcccaaggatatttaatttgcctcgggaatcgctgcttccagaggggaactcaggagggaaggcgcgcgcgcgcgcgcgctcctggaggggcaccgcagggacccccgactgtcgcctccctgtgccggactccagccggggcgacgagagatgcatcttcgctccttcctggtggcggcggcggctgagaggagacttggctctcggaggatcggggctgccctcaccccggacgcactgcctccccgccggcgtgaagcgcccgaaaactccggtcgggctctctcctgggctcagcagctgcgtcctccttcagctgcccctccccggcgcggggggcggcgtggatttcagagtcggggtttctgctgcctccagccctgtttgcatgtgccgggccgcggcgaggagcctccgccccccacccggttgtttttcggagcctccctctgctcagcgttggtggtggcggtggcagcatggcgagccctccggagagcgatggcttctcggacgtgcgcaaggtgggctacctgcgcaaacccaagagcatgcacaaacgcttcttcgtactgcgcgcggccagcgaggctgggggcccggcgcgcctcgagtactacgagaacgagaagaagtggcggcacaagtcgagcgcccccaaacgctcgatcccccttgagagctgcttcaacatcaacaagcgggctgactccaagaacaagcacctggtggctctctacacccgggacgagcactttgccatcgcggcggacagcgaggccgagcaagacagctggtaccaggctctcctacagctgcacaaccgtgctaagggccaccacgacggagctgcggccctcggggcgggaggtggtgggggcagctgcagcggcagctccggccttggtgaggctggggaggacttgagctacggtgacgtgcccccaggacccgcattcaaagaggtctggcaagtgatcctgaagcccaagggcctgggtcagacaaagaacctgattggtatctaccgcctttgcctgaccagcaagaccatcagcttcgtgaagctgaactcggaggcagcggccgtggtgctgcagctgatgaacatcaggcgctgtggccactcggaaaacttcttcttcatcgaggtgggccgttctgccgtgacggggcccggggagttctggatgcaggtggatgactctgtggtggcccagaacatgcacgagaccatcctggaggccatgcgggccatgagtgatgagttccgccctcgcagcaagagccagtcctcgtccaactgctctaaccccatcagcgtccccctgcgccggcaccatctcaacaatcccccgcccagccaggtggggctgacccgccgatcacgcactgagagcatcaccgccacctccccggccagcatggtgggcgggaagccaggctccttccgtgtccgcgcctccagtgacggcgaaggcaccatgtcccgcccagcctcggtggacggcagccctgtgagtcccagcaccaacagaacccacgcccaccggcatcggggcagcgcccggctgcaccccccgctcaaccacagccgctccatccccatgccggcttcccgctgctcgccttcggccaccagcccggtcagtctgtcgtccagtagcaccagtggccatggctccacctcggattgtctcttcccacggcgatctagtgcttcggtgtctggttcccccagcgatggcggtttcatctcctcggatgagtatggctccagtccctgcgatttccggagttccttccgcagtgtcactccggattccctgggccacaccccaccagcccgcggtgaggaggagctaagcaactatatctgcatgggtggcaaggggccctccaccctgaccgcccccaacggtcactacattttgtctcggggtggcaatggccaccgctgcaccccaggaacaggcttgggcacgagtccagccttggctggggatgaagcagccagtgctgcagatctggataatcggttccgaaagagaactcactcggcaggcacatcccctaccattacccaccagaagaccccgtcccagtcctcagtggcttccattgaggagtacacagagatgatgcctgcctacccaccaggaggtggcagtggaggccgactgccgggacacaggcactccgccttcgtgcccacccgctcctacccagaggagggtctggaaatgcaccccttggagcgtcggggggggcaccaccgcccagacagctccaccctccacacggatgatggctacatgcccatgtccccaggggtggccccagtgcccagtggccgaaagggcagtggagactatatgcccatgagccccaagagcgtatctgccccacagcagatcatcaatcccatcagacgccatccccagagagtggaccccaatggctacatgatgatgtcccccagcggtggctgctctcctgacattggaggtggccccagcagcagcagcagcagcagcaacgccgtcccttccgggaccagctatggaaagctgtggacaaacggggtagggggccaccactctcatgtcttgcctcaccccaaacccccagtggagagcagcggtggtaagctcttaccttgcacaggtgactacatgaacatgtcaccagtgggggactccaacaccagcagcccctccgactgctactacggccctgaggacccccagcacaagccagtcctctcctactactcattgccaagatcctttaagcacacccagcgccccggggagccggaggagggtgcccggcatcagcacctccgcctttccactagctctggtcgccttctctatgctgcaacagcagatgattcttcctcttccaccagcagcgacagcctgggtgggggatactgcggggctaggctggagcccagccttccacatccccaccatcaggttctgcagccccatctgcctcgaaaggtggacacagctgctcagaccaatagccgcctggcccggcccacgaggctgtccctgggggatcccaaggccagcaccttacctcgggcccgagagcagcagcagcagcagcagcccttgctgcaccctccagagcccaagagcccgggggaatatgtcaatattgaatttgggagtgatcagtctggctacttgtctggcccggtggctttccacagctcaccttctgtcaggtgtccatcccagctccagccagctcccagagaggaagagactggcactgaggagtacatgaagatggacctggggccgggccggagggcagcctggcaggagagcactggggtcgagatgggcagactgggccctgcacctcccggggctgctagcatttgcaggcctacccgggcagtgcccagcagccggggtgactacatgaccatgcagatgagttgtccccgtcagagctacgtggacacctcgccagctgcccctgtaagctatgctgacatgcgaacaggcattgctgcagaggaggtgagcctgcccagggccaccatggctgctgcctcctcatcctcagcagcctctgcttccccgactgggcctcaaggggcagcagagctggctgcccactcgtccctgctggggggcccacaaggacctgggggcatgagcgccttcacccgggtgaacctcagtcctaaccgcaaccagagtgccaaagtgatccgtgcagacccacaagggtgccggcggaggcatagctccgagactttctcctcaacacccagtgccacccgggtgggcaacacagtgccctttggagcgggggcagcagtagggggcggtggcggtagcagcagcagcagcgaggatgtgaaacgccacagctctgcttcctttgagaatgtgtggctgaggcctggggagcttgggggagcccccaaggagccagccaaactgtgtggggctgctgggggtttggagaatggtcttaactacatagacctggatttggtcaaggacttcaaacagtgccctcaggagtgcacccctgaaccgcagcctcccccacccccaccccctcatcaacccctgggcagcggtgagagcagctccacccgccgctcaagtgaggatttaagcgcctatgccagcatcagtttccagaagcagccagaggaccgtcagtagctcaactggacatcacagcagaatgaagacctaaatgacctcagcaaatcctcttctaactcatgggtacccagactctaaatatttcatgattcacaactaggacctcatatcttcctcatcagtagatggtacgatgcatccatttcagtttgtttactttatccaatcctcaggatttcattgactgaactgcacgttctatattgtgccaagcgaaaaaaaaaaatgcactgtgacaccagaataatgagtctgcataaacttcatcttcaaccttaaggacttagctggccacagtgagctgatgtgcccaccaccgtgtcatgagagaatgggtttactctcaatgcattttcaagatacatttcatctgctgctgaaactgtgtacgacaaagcatcattgtaaattatttcatacaaaactgttcacgttgggtggagagagtattaaatatttaacataggttttgatttatatgtgtaattttttaaatgaaaatgtaacttttcttacagcacatcttttttttggatgtgggatggaggtatacaatgttctgttgtaaagagtggagcaaatgcttaaaacaaggcttaaaagagtagaatagggtatgatccttgttttaagattgtaattcagaaaacataatataagaatcatagtgccatagatggttctcaattgtatagttatatttgctgatactatctcttgtcatataaacctgatgttgagctgagttccttataagaattaatcttaattttgtattttttcctgtaagacaataggccatgttaattaaactgaagaaggatatatttggctgggtgttttcaaatgtcagcttaaaattggtaattgaatggaagcaaaattataagaagaggaaattaaagtcttccattgcatgtattgtaaacagaaggagatgggtgattccttcaattcaaaagctctctttggaatgaacaatgtgggcgtttgtaaattctggaaatgtctttctattcataatgcggccgggtttttttttgtattatatttttgttcattccgtc

SEQ ID NO: 372039 - DNA, 7725 bp, Homo sapiens
cggcggcgcggtcggagggggccggcgcgcagagccagacgccgccgcttgttttggttggggctctcggcaactctccgaggaggaggaggaggagggaggaggggagaagtaactgcagcggcagcgccctcccgaggaacaggcgtcttccccgaacccttcccaaacctcccccatcccctctcgcccttgtcccctcccctcctccccagccgcctggagcgaggggcagggatgagtctgtccctccggccggtccccagctgcagtggctgcccggtatcgtttcgcatggaaaagccactttctccacccgccgagatgggcccggatgggggctgcagaggacgcgcccgcgggcggcggcagcagcagcagcagcagcagcagcaacagcaacagccgcagcgccgcggtctctgcgactgagctggtatttgggcggctggtggcggctgggacggttggggggtgggaggaggcgaaggaggagggagaaccccgtgcaacgttgggacttggcaacccgcctccccctgcccaaggatatttaatttgcctcgggaatcgctgcttccagaggggaactcaggagggaaggcgcgcgcgcgcgcgcgctcctggaggggcaccgcagggacccccgactgtcgcctccctgtgccggactccagccggggcgacgagagatgcatcttcgctccttcctggtggcggcggcggctgagaggagacttggctctcggaggatcggggctgccctcaccccggacgcactgcctccccgccggcgtgaagcgcccgaaaactccggtcgggctctctcctgggctcagcagctgcgtcctccttcagctgcccctccccggcgcggggggcggcgtggatttcagagtcggggtttctgctgcctccagccctgtttgcatgtgccgggccgcggcgaggagcctccgccccccacccggttgtttttcggagcctccctctgctcagcgttggtggtggcggtggcagcatggcgagccctccggagagcgatggcttctcggacgtgcgcaaggtgggctacctgcgcaaacccaagagcatgcacaaacgcttcttcgtactgcgcgcggccagcgaggctgggggcccggcgcgcctcgagtactacgagaacgagaagaagtggcggcacaagtcgagcgcccccaaacgctcgatcccccttgagagctgcttcaacatcaacaagcgggctgactccaagaacaagcacctggtggctctctacacccgggacgagcactttgccatcgcggcggacagcgaggccgagcaagacagctggtaccaggctctcctacagctgcacaaccgtgctaagggccaccacgacggagctgcggccctcggggcgggaggtggtgggggcagctgcagcggcagctccggccttggtgaggctggggaggacttgagctacggtgacgtgcccccaggacccgcattcaaagaggtctggcaagtgatcctgaagcccaagggcctgggtcagacaaagaacctgattggtatctaccgcctttgcctgaccagcaagaccatcagcttcgtgaagctgaactcggaggcagcggccgtggtgctgcagctgatgaacatcaggcgctgtggccactcggaaaacttcttcttcatcgaggtgggccgttctgccgtgacggggcccggggagttctggatgcaggtggatgactctgtggtggcccagaacatgcacgagaccatcctggaggccatgcgggccatgagtgatgagttccgccctcgcagcaagagccagtcctcgtccaactgctctaaccccatcagcgtccccctgcgccggcaccatctcaacaatcccccgcccagccaggtggggctgacccgccgatcacgcactgagagcatcaccgccacctccccggccagcatggtgggcgggaagccaggctccttccgtgtccgcgcctccagtgacggcgaaggcaccatgtcccgcccagcctcggtggacggcagccctgtgagtcccagcaccaacagaacccacgcccaccggcatcggggcagcgcccggctgcaccccccgctcaaccacagccgctccatccccatgccggcttcccgctgctcgccttcggccaccagcccggtcagtctgtcgtccagtagcaccagtggccatggctccacctcggattgtctcttcccacggcgatctagtgcttcggtgtctggttcccccagcgatggcggtttcatctcctcggatgagtatggctccagtccctgcgatttccggagttccttccgcagtgtcactccggattccctgggccacaccccaccagcccgcggtgaggaggagctaagcaactatatctgcatgggtggcaaggggccctccaccctgaccgcccccaacggtcactacattttgtctcggggtggcaatggccaccgctgcaccccaggaacaggcttgggcacgagtccagccttggctggggatgaagcagccagtgctgcagatctggataatcggttccgaaagagaactcactcggcaggcacatcccctaccattacccaccagaagaccccgtcccagtcctcagtggcttccattgaggagtacacagagatgatgcctgcctacccaccaggaggtggcagtggaggccgactgccgggacacaggcactccgccttcgtgcccacccgctcctacccagaggagggtctggaaatgcaccccttggagcgtcggggggggcaccaccgcccagacagctccaccctccacacggatgatggctacatgcccatgtccccaggggtggccccagtgcccagtggccgaaagggcagtggagactatatgcccatgagccccaagagcgtatctgccccacagcagatcatcaatcccatcagacgccatccccagagagtggaccccaatggctacatgatgatgtcccccagcggtggctgctctcctgacattggaggtggccccagcagcagcagcagcagcagcaacgccgtcccttccgggaccagctatggaaagctgtggacaaacggggtagggggccaccactctcatgtcttgcctcaccccaaacccccagtggagagcagcggtggtaagctcttaccttgcacaggtgactacatgaacatgtcaccagtgggggactccaacaccagcagcccctccgactgctactacggccctgaggacccccagcacaagccagtcctctcctactactcattgccaagatcctttaagcacacccagcgccccggggagccggaggagggtgcccggcatcagcacctccgcctttccactagctctggtcgccttctctatgctgcaacagcagatgattcttcctcttccaccagcagcgacagcctgggtgggggatactgcggggctaggctggagcccagccttccacatccccaccatcaggttctgcagccccatctgcctcgaaaggtggacacagctgctcagaccaatagccgcctggcccggcccacgaggctgtccctgggggatcccaaggccagcaccttacctcgggcccgagagcagcagcagcagcagcagcccttgctgcaccctccagagcccaagagcccgggggaatatgtcaatattgaatttgggagtgatcagtctggctacttgtctggcccggtggctttccacagctcaccttctgtcaggtgtccatcccagctccagccagctcccagagaggaagagactggcactgaggagtacatgaagatggacctggggccgggccggagggcagcctggcaggagagcactggggtcgagatgggcagactgggccctgcacctcccggggctgctagcatttgcaggcctacccgggcagtgcccagcagccggggtgactacatgaccatgcagatgagttgtccccgtcagagctacgtggacacctcgccagctgcccctgtaagctatgctgacatgcgaacaggcattgctgcagaggaggtgagcctgcccagggccaccatggctgctgcctcctcatcctcagcagcctctgcttccccgactgggcctcaaggggcagcagagctggctgcccactcgtccctgctggggggcccacaaggacctgggggcatgagcgccttcacccgggtgaacctcagtcctaaccgcaaccagagtgccaaagtgatccgtgcagacccacaagggtgccggcggaggcatagctccgagactttctcctcaacacccagtgccacccgggtgggcaacacagtgccctttggagcgggggcagcagtagggggcggtggcggtagcagcagcagcagcgaggatgtgaaacgccacagctctgcttcctttgagaatgtgtggctgaggcctggggagcttgggggagcccccaaggagccagccaaactgtgtggggctgctgggggtttggagaatggtcttaactacatagacctggatttggtcaaggacttcaaacagtgccctcaggagtgcacccctgaaccgcagcctcccccacccccaccccctcatcaacccctgggcagcggtgagagcagctccacccgccgctcaagtgaggatttaagcgcctatgccagcatcagtttccagaagcagccagaggaccgtcagtagctcaactggacatcacagcaggtgcgtttcatggtgacaaagtcagaagacaaaactgcttttaaccttgtccttgaattctgttcttcgcctctgccccttcctgttctttcccactgcttcctcagggagaatgcacttacattctcagggcacacaagatgctcaccccacactgacatctggcagagagtcaaacaaacatgtaggagcagccacaggagggctttttcgtttgagaattcccaagtgaagtagttactgcagtatttttaaaacatatatcctatgccagttctgcgttttgtagagttcctccgtaagaagcttgatttgtttgttgaagttttcttttcactatatatttaggtcagcccctggaagggacagttctacaaaaaatatttgttaacacaggggctaaacccttccttatcttaaactatcttaatagtttctgggagcccttaagggtgatcttatcaagttgttctctgtacttttgttctgtgatttcataatactagggcaacataaacagcagcgggaagcattgatttctattcatcctgccctaaaaagatcaggagtaagagctttttagaaatatgtatttagagagaagtacctatctattttgtgatctctcaagaaagtaattatgggtgacgttctccttttgttcatgtaccaggatttgtgaaatattattcacacaccgacccaccatcccacgggcctggcctctcttgtacaggatatgcaggaaactctgtatgtgtctgggacccattattaagagttatgggagttcatcctaggatgtctgccttatagttatctcttcttgcactgagacattacagatatcatttgggggctactatatatcttcttaatttgtttgttttgcattgagtagaagggctaaactgtataccctccacttttagggttatttgctgtgtgcctttaagttcaaaagtagacaccacagtaaatgctgaaagttggctttaggtcttctgtggctaatgccgtattaaaaatgaaaaacatttgtaataggaaattagcctgcccttcgttctgttgatcctgttttctggtggtcataattgtgggtagaagagagtacagtttgcaaataatgtgatgagttggcaatgcagaagtttccagcatttggaaacactttactctgacaaactgattatcttgtgaattttatctatgctccacagaatgagcttttaaaagcactgatttttcttaatttgtgtccattcataagaaattaatctgtgccctggtttcctattgacaggtatttatttatcatgtgttcatagtcttcttaattctgtttccaatatttgatccatataattctctattttatagaacaagaaaaaggtatatgaacactcaaatgaagattttgggtgatatgttacaaaaagcatttatttgatcagtatttacttcaacatttattttcatcattcactagaagaaagatttaattgtgtatatcaacatcagtagtacaaatcttgttatatcaaatgatgtttttgggagtcagaatccctcaacactttaagcatttgtattataaagtgcctcattggtaaaataatgagaatttgaagaaaaccagcccagcagaactaaaattttggttttaaaggagataaagagaataagtttttcttacttgtcatcttaatttgtttaggtttctttttatagagtagaataaatgatgtttgctctgaagagaattgatgaccaactagaattttcatttttaaaaagggctttaaaataaaattctcctatgtgttggatgcattaaaaaaacaaaaactctacaaaattctatccttaaccttctttgggaaaataaaatattctggaataatcatataatcctatttctaataattctggagtaacaatcgaccatgctttgcacagtgccaggaaaattctacaatgcgtatttgagatgtttgtgttggtgtttaaagtgaggcaccaaatgctacctggcacatttacatcctcaattctgcttgcttgcctgtgccctgttgagtccaaagatgttattctatagctatctgaaacagacagaagtcagacctgtgagtggcaaacagcttctgctccgaatgtgtgtgcaaacattattttcctcacttcctcagcaattgctgtctttgcttcttttcctcatttctcaggtaaaacctgagactcggtgaaaggaatagaggtatgatgaggcgtgggctctgttgaaacatctcggcttgtttaaaatttttcattgtctgttaagaggagaacacttgtgaagcactgagctcaggagctctacttgttggaagcctgtctgctttacctgtagtccagtgaccttttctgcctgccctttctcttgcatagcctcttagttctggcttgctcgttttctagtactatcccctgccatccctttgtttccacctcttatttcatgttcctgacattatcctttttttcttttgctccttttcagaatttcgcagtacttgtggcccactctctgcagagagtaaattgagagcccaagaagcagggcaaaaagagcctctcagactcggtcatagcagccctgccacctttacctggcatcaaatttatcttttagttttgaaactgcagctgacaaagacacagaccccagccatgccttttgggttcagtttttttgtttttgtcattctttgttatgccctccccctttaaaagaaaaaagaaaaagaaaaaaaacagaaaaagactctttccatttctttttcattcagtttccttttttgtgatgtcaaggattccgtacctccaaggttgcctcccctccctcccctttccccagccctgtggcctttttggctggcgcaaaccctctcggccctggcactttc

SEQ ID NO: 372040 - DNA, 1175 bp, Homo sapiens
atcgactctagaggtcccccacgccgcaccgccgaaagctgcatttgcctagaaagtggattgctgcgtatgaaccaagtgttgggctatataactccactgtcctaagctatttggggttggaaggaagaggggtgaagtagaaaggcaagaagctaatacaagaggagaaaaagtagatgagacacatcaagaaattctcacgagaaacagatgaagaggtggaaatgagtcagtccagcagcttaccaagtatcactgacaagaggagaggatgcatcctgtgtaaatactggggttcttgtctcagaagcacagggtatcatggaaatggagttgaaagctggggaactgatggaacgtctccatgaggagcaactaactggagccatgggttggtaccaagatgttccctctgccttctactttcgatagaaactaagccagtatggcatggggctctgaaaatgggctgaggggaacatcggcagcctccactaaccccctgcccctaccctgttcctgaagtcccaggcagttaagacgtccacagtgaacggcacttaatcaaaacaaaagttcagacacagtgaaaattcaggaatataagacaatgtaaaacactatcagaaaaatgaggcaaagaatgatataaaaaaggtaataggatgttcaagtctttgaggaagatttccaggttgaaaccaagccatagcttttagtatattttcattttaggttaggcaagaaagttagcgaactttgtcctcaaacctaggaccatttaaaaaagtgacaataaagaagactaagaaatcatgaagagagtataaatttatgaaaatataacatttggccaggcgtggtggctcatgcctgtaatcccaacactttgggaggctgaggcaggcagatcacgaggtcaggagattgagaccatcctggccaacatggtgaaaccatgcctctagtaaaataaaaaaaattagccgggcatggtggtgcgtgcctgcagtcccagctactcgggaggctgaggcaggggaatcgcttgaacctgggaggcggagattgcagtgagctgagattgcaccactgcactccaaacctggagacagagcgagactctatctcaaaaaaaaaaagtcgacgcggccgcgaatttagtagtagta

SEQ ID NO: 372041 - DNA, 1257 bp, Homo sapiens
gaaggaattcagttaactacagcagctgcatgtgaagcatttcaaaggagtttatgacatcaccgtataaaatccatttgacatgaaaaccggaactccaactatgagatagtttcaaagctgcatttgcctagaaagtggattgctgcgtatgaaccaagtgttgggctatataactccactgtcctaagctatttggggttggaaggaagaggggtgaagtagaaaggcaagaagctaatacaagaggagaaaaagtagatgagacacatcaagaaattctcacgagaaacagatgaagaggtggaaatgagtcagtccagcagcttaccaagtatcactgacaagaggagaggatgcatcctgtgtaaatactggggttcttgtctcagaagcacagggtatcatggaaatggagttgaaagctggggaactgatggaacgtctccatgaggagcaactaactggagccatgggttggtaccaagatgttccctctgccttctactttcgatagaaactaagccagtatggcatggggctctgaaaatgggctgaggggaacatcggcagcctccactaaccccctgcccctaccctgttcctgaagtcccaggcagttaagacgtccacagtgaacggcacttaatcaaaacaaaagttcagacacagtgaaaattcaggaatataagacaatgtaaaacactatcagaaaaatgaggcaaagaatgatataaaaaaggtaataggatgttcaagtctttgaggaagatttccaggttgaaaccaagccatagcttttagtatattttcattttaggttaggcaagaaagttagcgaactttgtcctcaaacctaggaccatttaaaaaagtgacaataaagaagactaagaaatcatgaagagagtataaatttatgaaaatataacatttggccaggcgtggtggctcatgcctgtaatcccaacactttgggaggctgaggcaggcagatcacgaggtcaggagattgagaccatcctggccaacatggtgaaaccatgcctctagtaaaataaaaaaaattagccgggcatggtggtgcgtgcctgcagtcccagctactcgggaggctgaggcaggggaatcgcttgaacctgggaggcggagattgcagtgagctgagattgcaccactgcactccaaacctggagacagagcgagactctatctcaaaaaaaaaaagtcgacgcggccgcgaatttagtagtagta

SEQ ID NO: 372042 - DNA, 2227 bp, Homo sapiens
atcgccagcctccagtcctgcctccacgacgcgcccttccccaaggctggccgggtctggatgtcgccatcccctattcggagctacagacctcgcagctgaactcttaaaaagaacctcgcttcttcctcacggtgctccagctccacacaccgtactgagcctcgccagccaccgtacgcgaggtcgcggcgcgtccgtgacgtcactgatgtgcgcttctcccgcactaagggaaacatggctctagcgcggccggtgcggctcttttccctcgtgactcggttgctcctggcgccgcgacggggcctcacggtccgcagtcccgacgaacccctgccggtggtgcgcatcccagtggctctacagcggcagttggaacagcggcagagcaggcggcggaacctcccgaggccggtgctggttcgacccggaccgctgctggtttcggcgcggcggccggagttgaaccagccggcgcgcctcacactgggccgttgggagcgcgcgccgctagcctctcaaggctggaagagtcgacgcgcgcgtcgggaccacttctccatcgagcgcgcgcaacaggaggcgccagcggtgcgaaagctctcgtctaagggcagctttgctgacctgggcctggagccccgtgtgctgcacgcactacaggaggctgcgcctgaagtcgttcagcccacaaccgtgcagtctagcaccatcccctcactacttcgcggccgccatgtcgtttgcgccgcagaaaccggcagtggcaagactctcagctacctcctgccgctgcttcaacggctcttgggccagccaagcctggactcccttcctatccccgcgccccgaggcctggtccttgttccttcccgagaattggcccaacaggtgcgggctgtggcccaacccttgggccgctccttgggcctgctggtgcgggacctggagggaggccacggcatgcgtaggatcaggctgcagctgtccagacagccttcagcagatgtgcttgtggccactccaggggctctgtggaaggccctgaaaagtcgactgatcagtctggagcaactctccttcttggtgttggatgaggcagacacactgctggatgaaagcttcctggaactggtggactacatcttagagaagagccacatagcagaaggcccagctgacttggaagaccccttcaatcccaaagctcagttagtgctggtaggagccacatttcccgaaggtgtaggccagttgctgaataaagtcgccagcccagatgctgtcaccaccatcaccagctccaagctccactgtatcatgcctcatgtgaaacagacatttctgagactgaagggagcagataaggtggccgagctggtgcacatcctcaagcatcgtgacagagcagaaaggactggtccctcaggaactgttctggtgttctgtaatagctccagcactgtgaactggctgggatatattctggatgaccacaaaatccaacacctaaggttgcaggggcaaatgccagccttgatgagggtaggaatcttccagtccttccagaagagctcccgagacatacttctctgcacagacatagcctctcggggcctggacagcactggtgtggagctggttgtcaattatgatttccccccaacgctgcaagattacatccacagagcagggagagtgggccgtgtggggagcgaggtgccaggcaccgtcatcagttttgtgacccatccctgggatgtgagcctggttcagaagattgagctggcggctcgccgaaggagaagtcttccaggactagcatcctcggtgaaagagcctttgccccaagcaacctgattttgacaaatctgattaaaatgtgatgctagaacagggatctttcccagtatcttgagtgggtgaccacacttgtcagtgggaggctctgggctgccctgtcggctccttgagggcgggatgaactgctttgtgacttggaaaggtacgctgctggccagcattggagaagaagctgctgagcatggctttctgtagtctttagcaagacacaagtggattttgactttgtatcatgtcatgatttctaacaataaatgatgtttttatgtgcaaaaaacacaacacaaaaaaacccgggcacataagcggggcggaaaaggtataaggggcaatgccaagcgttccgacccctttttgcaag

SEQ ID NO: 372043 - DNA, 1901 bp, Homo sapiens
atcgccagcctccagtcctgcctccacgacgcgcccttccccaaggctggccgggtctggatgtcgccatcccctattcggagctacagacctcgcagctgaactcttaaaaagaacctcgcttcttcctcacggtgctccagctccacacaccgtactgagcctcgccagccaccgtacgcgaggtcgcggcgcgtccgtgacgtcactgatgtgcgcttctcccgcactaagggaaacatggctctagcgcggccggtgcggctcttttccctcgtgactcggttgctcctggcgccgcgacggggcctcacggtccgcagtcccgacgaacccctgccggtggtgcgcatcccagtggctctacagcggcagttggaacagcggcagagcaggcggcggaacctcccgaggccggtgctggttcgacccggaccgctgctggtttcggcgcggcggccggagttgaaccagccggcgcgcctcacactgggccgttgggagcgcgcgccgctagcctctcaaggctggaagagtcgacgcgcgcgtcgggaccacttctccatcgagcgcgcgcaacaggaggcgccagcggtgcgaaagctctcgtctaagggcagctttgctgacctgggcctggagccccgtgtgctgcacgcactacaggaggctgcgcctgaagtcgttcagcccacaaccgtgcagtctagcaccatcccctcactacttcgcggccgccatgtcgtttgcgccgcagaaaccggcagtggcaagactctcagctacctcctgccgctgcttcaacggctcttgggccagccaagcctggactcccttcctatccccgcgccccgaggcctggtccttgttccttcccgagaattggcccaacaggtgcgggctgtggcccaacccttgggccgctccttgggcctgctggtgcgggacctggagggaggccacggcatgcgtaggatcaggctgcagctgtccagacagccttcagcagatgtgcttgtggccactccaggggctctgtggaaggccctgaaaagtcgactgatcagtctggagcaactctccttcttggtgttggatgaggcagacacactgctggatgaaagcttcctggaactggtggactacatcttagagaagagccacatagcagaaggcccagctgacttggaagaccccttcaatcccaaagctcagttagtgctggtaggagccacatttcccgaaggtgtaggccagttgctgaataaagtcgccagcccagatgctgtcaccaccatcaccagctccaagctccactgtatcatgcctcatgtgaaacagacatttctgagactgaagggagcagataaggtggccgagctggtgcacatcctcaagcatcgtgacagagcagaaaggactggtccctcaggaactgttctggtgttctgtaatagctccagcactgtgaactggctgggatatattctggatgaccacaaaatccaacacctaaggttgcaggggcaaatgccagccttgatgagggtaggaatcttccagtccttccagaagagctcccgagacatacttctctgcacagacatagcctctcggggcctggacagcactggtgtggagctggttgtcaattatgatttccccccaacgctgcaagattacatccacagagcagggagagtgggccgtgtggggagcgaggtgccaggcaccgtcatcagttttgtgacccatccctgggatgtgagcctggttcagaagattgagctggcggctcgccgaaggagaagtcttccaggactagcatcctcggtgaaagagcctttgccccaagcaacctgattttgacaaatctgattaaaatgtgatgctagaacagg

SEQ ID NO: 372044 - DNA, 1938 bp, Homo sapiens
  misc_feature (17)..(17): n is a, c, g, or t
  misc_feature (20)..(20): n is a, c, g, or t
tcacctgtgttcagtanccngggttattacgagggtgggtggcgcccctagcgcggccggtgcggctcttttccctcgtgactcggttgctcctggcgccgcgacggggcctcacggtccgcagtcccgacgaacccctgccggtggtgcgcatcccagtggctctacagcggcagttggaacagcggcagagcaggcggcggaacctcccgaggccggtgctggttcgacccggaccgctgctggtttcggcgcggcggccggagttgaaccagccggcgcgcctcacactgggccgttgggagcgcgcgccgctagcctctcaaggctggaagagtcgacgcgcgcgtcgggaccacttctccatcgagcgcgcgcaacaggaggcgccagcggtgcgaaagctctcgtctaagggcagctttgctgacctgggcctggagccccgtgtgctgcacgcactacaggaggctgcgcctgaagtcgttcagcccacaaccgtgcagtctagcaccatcccctcactacttcgcggccgccatgtcgtttgcgccgcagaaaccggcagtggcaagactctcagctacctcctgccgctgcttcaacggctcttgggccagccaagcctggactcccttcctatccccgcgccccgaggcctggtccttgttccttcccgagaattggcccaacaggtgcgggctgtggcccaacccttgggccgctccttgggcctgctggtgcgggacctggagggaggccacggcatgcgtaggatcaggctgcagctgtccagacagccttcagcagatgtgcttgtggccactccaggggctctgtggaaggccctgaaaagtcgactgatcagtctggagcaactctccttcttggtgttggatgaggcagacacactgctggatgaaagcttcctggaactggtggactacatcttagagaagagccacatagcagaaggcccagctgacttggaagaccccttcaatcccaaagctcagttagtgctggtaggagccacatttcccgaaggtgtaggccagttgctgaataaagtcgccagcccagatgctgtcaccaccatcaccagctccaagctccactgtatcatgcctcatgtgaaacagacatttctgagactgaagggagcagataaggtggccgagctggtgcacatcctcaagcatcgtgacagagcagaaaggactggtccctcaggaactgttctggtgttctgtaatagctccagcactgtgaactggctgggatatattctggatgaccacaaaatccaacacctaaggttgcaggggcaaatgccagccttgatgagggtaggaatcttccagtccttccagaagagctcccgagacatacttctctgcacagacatagcctctcggggcctggacagcactggtgtggagctggttgtcaattatgatttccccccaacgctgcaagattacatccacagagcagggagagtgggccgtgtggggagcgaggtgccaggcaccgtcatcagttttgtgacccatccctgggatgtgagcctggttcagaagattgagctggcggctcgccgaaggagaagtcttccaggactagcatcctcggtgaaagagcctttgccccaagcaacctgattttgacaaatctgattaaaatgtgatgctagaacagggatctttcccagtatcttgagtgggtgaccacacttgtcagtgggaggctctgggctgccctgtcggctccttgagggcgggatgaactgctttgtgacttggaaaggtacgctgctggccagcattggagaagaagctgctgagcatggctttctgtagtctttagcaagacacaagtggattttgactttgtatcatgtcatgatttctaacaataaatgatgtttttatgtgc

SEQ ID NO: 372045 - DNA, 320 bp, Homo sapiens
agtctttagcaagacacaagtggattttgactttgtatcatgtcatgatttctaacaataaatgatgtttttatgtgcctcccctaagaataattagcaccggggcggaattcagtagtttctgaggattcatacaccaaacctccacatctaggacaaaggctctttcagttgatgttttcatttataaacatttagtttgtatttcctgcccccaaaaaggtatccattaagcccccagggaaaggaaaggaaaggaaatgtgactagcagtagacagagttactctctaacaatgcccaagacaaacgggcgtcttg

SEQ ID NO: 372046 - DNA, 2137 bp, Homo sapiens
atcgccagcctccagtcctgcctccacgacgcgcccttccccaaggctggccgggtctggatgtcgccatcccctattcggagctacagacctcgcagctgaactcttaaaaagaacctcgcttcttcctcacggtgctccagctccacacaccgtactgagcctcgccagccaccgtacgcgaggtcgcggcgcgtccgtgacgtcactgatgtgcgcttctcccgcactaagggaaacatggctctagcgcggccggtgcggctcttttccctcgtgactcggttgctcctggcgccgcgacggggcctcacggtccgcagtcccgacgaacccctgccggtggtgcgcatcccagtggctctacagcggcagttggaacagcggcagagcaggcggcggaacctcccgaggccggtgctggttcgacccggaccgctgctggtttcggcgcggcggccggagttgaaccagccggcgcgcctcacactgggccgttgggagcgcgcgccgctagcctctcaaggctggaagagtcgacgcgcgcgtcgggaccacttctccatcgagcgcgcgcaacaggaggcgccagcggtgcgaaagctctcgtctaagggcagctttgctgacctgggcctggagccccgtgtgctgcacgcactacaggaggctgcgcctgaagtcgttcagcccacaaccgtgcagtctagcaccatcccctcactacttcgcggccgccatgtcgtttgcgccgcagaaaccggcagtggcaagactctcagctacctcctgccgctgcttcaacggctcttgggccagccaagcctggactcccttcctatccccgcgccccgaggcctggtccttgttccttcccgagaattggcccaacaggtgcgggctgtggcccaacccttgggccgctccttgggcctgctggtgcgggacctggagggaggccacggcatgcgtaggatcaggctgcagctgtccagacagccttcagcagatgtgcttgtggccactccaggggctctgtggaaggccctgaaaagtcgactgatcagtctggagcaactctccttcttggtgttggatgaggcagacacactgctggatgaaagcttcctggaactggtggactacatcttagagaagagccacatagcagaaggcccagctgacttggaagaccccttcaatcccaaagctcagttagtgctggtaggagccacatttcccgaaggtgtaggccagttgctgaataaagtcgccagcccagatgctgtcaccaccatcaccagctccaagctccactgtatcatgcctcatgtgaaacagacatttctgagactgaagggagcagataaggtggccgagctggtgcacatcctcaagcatcgtgacagagcagaaaggactggtccctcaggaactgttctggtgttctgtaatagctccagcactgtgaactggctgggatatattctggatgaccacaaaatccaacacctaaggttgcaggggcaaatgccagccttgatgagggtaggaatcttccagtccttccagaagagctcccgagacatacttctctgcacagacatagcctctcggggcctggacagcactggtgtggagctggttgtcaattatgatttccccccaacgctgcaagattacatccacagagcagggagagtgggccgtgtggggagcgaggtgccaggcaccgtcatcagttttgtgacccatccctgggatgtgagcctggttcagaagattgagctggcggctcgccgaaggagaagtcttccaggactagcatcctcggtgaaagagcctttgccccaagcaacctgattttgacaaatctgattaaaatgtgatgctagaacagggatctttcccagtatcttgagtgggtgaccacacttgtcagtgggaggctctgggctgccctgtcggctccttgagggcgggatgaactgctttgtgacttggaaaggtacgctgctggccagcattggagaagaagctgctgagcatggctttctgtagtctttagcaagacacaagtggattttgactttgtatcatgtcatgatttctaacaataaatgatgtttttatgtgc

SEQ ID NO: 372047 - DNA, 2681 bp, Homo sapiens
atcgccagcctccagtcctgcctccacgacgcgcccttccccaaggctggccgggtctggatgtcgccatcccctattcggagctacagacctcgcagctgaactcttaaaaagaacctcgcttcttcctcacggtgctccagctccacacaccgtactgagcctcgccagccaccgtacgcgaggtcgcggcgcgtccgtgacgtcactgatgtgcgcttctcccgcactaagggaaacatggctctagcgcggccggtgcggctcttttccctcgtgactcggttgctcctggcgccgcgacggggcctcacggtccgcagtcccgacgaacccctgccggtggtgcgcatcccagtggctctacagcggcagttggaacagcggcagagcaggcggcggaacctcccgaggccggtgctggttcgacccggaccgctgctggtttcggcgcggcggccggagttgaaccagccggcgcgcctcacactgggccgttgggagcgcgcgccgctagcctctcaaggctggaagagtcgacgcgcgcgtcgggaccacttctccatcgagcgcgcgcaacaggaggcgccagcggtgcgaaagctctcgtctaagggcagctttgctgacctgggcctggagccccgtgtgctgcacgcactacaggaggctgcgcctgaagtcgttcagcccacaaccgtgcagtctagcaccatcccctcactacttcgcggccgccatgtcgtttgcgccgcagaaaccggcagtggcaagactctcagctacctcctgccgctgcttcaacggctcttgggccagccaagcctggactcccttcctatccccgcgccccgaggcctggtccttgttccttcccgagaattggcccaacaggtgcgggctgtggcccaacccttgggccgctccttgggcctgctggtgcgggacctggagggaggccacggcatgcgtaggatcaggctgcagctgtccagacagccttcagcagatgtgcttgtggccactccaggggctctgtggaaggccctgaaaagtcgactgatcagtctggagcaactctccttcttggtgttggatgaggcagacacactgctggatgaaagcttcctggaactggtggactacatcttagagaagagccacatagcagaaggcccagctgacttggaagaccccttcaatcccaaagctcagttagtgctggtaggagccacatttcccgaaggtgtaggccagttgctgaataaagtcgccagcccagatgctgtcaccaccatcaccagctccaagctccactgtatcatgcctcatgtgaaacagacatttctgagactgaagggagcagataaggtggccgagctggtgcacatcctcaagcatcgtgacagagcagaaaggactggtccctcaggaactgttctggtgttctgtaatagctccagcactgtgaactggctgggatatattctggatgaccacaaaatccaacacctaaggttgcaggggcaaatgccagccttgatgagggtaggaatcttccagtccttccagaagagctcccgagacatacttctctgcacagacatagcctctcggggcctggacagcactggtgtggagctggttgtcaattatgatttccccccaacgctgcaagattacatccacagagcagggagagtgggccgtgtggggagcgaggtgccaggcaccgtcatcagttttgtgacccatccctgggatgtgagcctggttcagaagattgagctggcggctcgccgaaggagaagtcttccaggactagcatcctcggtgaaagagcctttgccccaagcaacctgattttgacaaatctgattaaaatgtgatgctagaacagggatctttcccagtatcttgagtgggtgaccacacttgtcagtgggaggctctgggctgccctgtcggctccttgagggcgggatgaactgctttgtgacttggaaaggtacgctgctggccagcattggagaagaagctgctgagcatggctttctgtagtctttagcaagacacaagtggattttgactttgtatcatgtcatgatttctaacaataaatgatgtttttatgtgcaaaaaaaaaaaaaaaaaaaaaaaaaaaaaaaaaaaaaaaaaaaaaaaaaaaaaaaaaaaaaaaaaaaaaaaacaaagagagggggcggcgcgcggcacaaaaagaatcctcccccggagggagggccacaataaacgggccaaccacgaacattggagaacaaaggggcgccccaaagggggggcgcgatataaaaaccgagggcggagggggcgcgcggtataaaaaccacggggtggcagaggtggcgaaaacatcactggccgcacggggaaaacagtggtgggggagagagacacccacatacggcgcgggggggggggacaacaaagggtggcgaccaaactattactcatcagagggagagatatatatactaagccccaaaggagggggggagatatattaaaaaaaattatagaggggcgatgatagtgggtgggtggtaaaaaacacgggaggataatatatgtggcgggggcgtaaaaaaaagagtgtggggatataagaagagaaattagtgtgagaagaaaattttatacgg

SEQ ID NO: 372048 - DNA, 2577 bp, Homo sapiens
atcgccagcctccagtcctgcctccacgacgcgcccttccccaaggctggccgggtctggatgtcgccatcccctattcggagctacagacctcgcagctgaactcttaaaaagaacctcgcttcttcctcacggtgctccagctccacacaccgtactgagcctcgccagccaccgtacgcgaggtcgcggcgcgtccgtgacgtcactgatgtgcgcttctcccgcactaagggaaacatggctctagcgcggccggtgcggctcttttccctcgtgactcggttgctcctggcgccgcgacggggcctcacggtccgcagtcccgacgaacccctgccggtggtgcgcatcccagtggctctacagcggcagttggaacagcggcagagcaggcggcggaacctcccgaggccggtgctggttcgacccggaccgctgctggtttcggcgcggcggccggagttgaaccagccggcgcgcctcacactgggccgttgggagcgcgcgccgctagcctctcaaggctggaagagtcgacgcgcgcgtcgggaccacttctccatcgagcgcgcgcaacaggaggcgccagcggtgcgaaagctctcgtctaagggcagctttgctgacctgggcctggagccccgtgtgctgcacgcactacaggaggctgcgcctgaagtcgttcagcccacaaccgtgcagtctagcaccatcccctcactacttcgcggccgccatgtcgtttgcgccgcagaaaccggcagtggcaagactctcagctacctcctgccgctgcttcaacggctcttgggccagccaagcctggactcccttcctatccccgcgccccgaggcctggtccttgttccttcccgagaattggcccaacaggtgcgggctgtggcccaacccttgggccgctccttgggcctgctggtgcgggacctggagggaggccacggcatgcgtaggatcaggctgcagctgtccagacagccttcagcagatgtgcttgtggccactccaggggctctgtggaaggccctgaaaagtcgactgatcagtctggagcaactctccttcttggtgttggatgaggcagacacactgctggatgaaagcttcctggaactggtggactacatcttagagaagagccacatagcagaaggcccagctgacttggaagaccccttcaatcccaaagctcagttagtgctggtaggagccacatttcccgaaggtgtaggccagttgctgaataaagtcgccagcccagatgctgtcaccaccatcaccagctccaagctccactgtatcatgcctcatgtgaaacagacatttctgagactgaagggagcagataaggtggccgagctggtgcacatcctcaagcatcgtgacagagcagaaaggactggtccctcaggaactgttctggtgttctgtaatagctccagcactgtgaactggctgggatatattctggatgaccacaaaatccaacacctaaggttgcaggggcaaatgccagccttgatgagggtaggaatcttccagtccttccagaagagctcccgagacatacttctctgcacagacatagcctctcggggcctggacagcactggtgtggagctggttgtcaattatgatttccccccaacgctgcaagattgagctggcggctcgccgaaggagaagtcttccaggactagcatcctcggtgaaagagcctttgccccaagcaacctgattttgacaaatctgattaaaatgtgatgctagaacagggatctttcccagtatcttgagtgggtgaccacacttgtcagtgggaggctctgggctgccctgtcggctccttgagggcgggatgaactgctttgtgacttggaaaggtacgctgctggccagcattggagaagaagctgctgagcatggctttctgtagtctttagcaagacacaagtggattttgactttgtatcatgtcatgatttctaacaataaatgatgtttttatgtgcaaaaaaaaaaaaaaaaaaaaaaaaaaaaaaaaaaaaaaaaaaaaaaaaaaaaaaaaaaaaaaaaaaaaaaaacaaagagagggggcggcgcgcggcacaaaaagaatcctcccccggagggagggccacaataaacgggccaaccacgaacattggagaacaaaggggcgccccaaagggggggcgcgatataaaaaccgagggcggagggggcgcgcggtataaaaaccacggggtggcagaggtggcgaaaacatcactggccgcacggggaaaacagtggtgggggagagagacacccacatacggcgcgggggggggggacaacaaagggtggcgaccaaactattactcatcagagggagagatatatatactaagccccaaaggagggggggagatatattaaaaaaaattatagaggggcgatgatagtgggtgggtggtaaaaaacacgggaggataatatatgtggcgggggcgtaaaaaaaagagtgtggggatataagaagagaaattagtgtgagaagaaaattttatacgg

SEQ ID NO: 372049 - DNA, 1296 bp, Homo sapiens
atcgccagcctccagtcctgcctccacgacgcgcccttccccaaggctggccgggtctggatgtcgccatcccctattcggagctacagacctcgcagctgaactcttaaaaagaacctcgcttcttcctcacggtgctccagctccacacaccgtactgagcctcgccagccaccgtacgcgaggtcgcggcgcgtccgtgacgtcactgatgtgcgcttctcccgcactaagggaaacatggctctagcgcggccggtgcggctcttttccctcgtgactcggttgctcctggcgccgcgacggggcctcacggtccgcagtcccgacgaacccctgccggtggtgcgcatcccagtggctctacagcggcagttggaacagcggcagagcaggcggcggaacctcccgaggccggtgctggttcgacccggaccgctgctggtttcggcgcggcggccggagttgaaccagccggcgcgcctcacactgggccgttgggagcgcgcgccgctagcctctcaaggctggaagagtcgacgcgcgcgtcgggaccacttctccatcgagcgcgcgcaacaggaggcgccagcggtgcgaaagctctcgtctaagggcagctttgctgacctgggcctggagccccgtgtgctgcacgcactacaggaggctgcgcctgaagtcgttcagcccacaaccgtgcagtctagcaccatcccctcactacttcgcggccgccatgtcgtttgcgccgcagaaaccggcagtggcaagactctcagctacctcctgccgctgcttcaacggctcttgggccagccaagcctggactcccttcctatccccgcgccccgaggcctggtccttgttccttcccgagaattggcccaacaggtgcgggctgtggcccaacccttgggccgctccttgggcctgctggtgcgggacctggagggaggccacggcatgcgtaggatcaggctgcagctgtccagacagccttcagcagatgtgcttgtggccactccaggggctctgtggaaggccctgaaaagtcgactgatcagtctggagcaactctccttcttggtgttggatgaggcagacacactgctggatgaaagcttcctggaactggtggactacatcttagagaagagccacatagcagaaggcccagctgaattggagaagaagctgctgagcatggctttctgtagtctttagcaagacacaagtggattttgactttgtatcatgtcatgatttctaacaataaatgatgtttttatgtgc

SEQ ID NO: 372050 - DNA, 1292 bp, Homo sapiens
ggcgcgccgcaggcagcactggcgggggcctttcctgccgccgacgccggggtcctccctcaggtctcattctgtgcctgtgaacatggcggcgcccgttgtcacggccccgggcagagctctgctgcgggcgggcgctggacggctgcttcggggaggcgtccaggagctactgcggccgcgacatgaagggaacgcccctgacctggcctgcaacttcagcctttctcaaaatcggggcacggtcatcgtggagcgctggtggaaggtaccgctggccggggagggccggaagccgcgcctgcaccggcgacatcgcgtctataagctggtggaggacacgaagcatcggcccaaagaaaacctggagctcatcctgacgcagtcggtggagaatgttggagtccggggtgacctggtctcagtgaagaaatctttaggccggaatcgactccttcctcagggactggctgtatatgcatcccctgaaaacaagaagctgtttgaagaggagaaattgctgagacaagaaggaaaattagagaagatccagaccaaggcaggtgaggcgacagtgaaatttctaaaaagctgtcgcctggaggtagggatgaagaacaatgtcaaatgggagctgaaccctgaaatagttgcccgccacttctttaagaatcttggtgttgtggttgccccacatacattaaagttaccagcagagcctatcacacggtggggcgagtattggtgtgaggtgacggtaaatgggcttgatactgtgagagtgcctatgtctgtcgtgaactttgagaagcccaagaccaaaagatataagtactggttagcccagcaagctgccaaggctatggcccccaccagcccccagatctaaatctactctccctccaaggcagcaaagcagaatcgggagcagtggagcagaaatgtgcaagcaccctgatctcactcccagctctgaccaaatacagaattttagagaacatctgaagacatcagactgcactgcgtatacatgttgaattcttcatttttgccatctttaactgtcatcactggggcagggaagtcctgttccagaagtaccaggctgtagatttgataagctagatgcagtagaccgaaaccatccaaaacctgtttagcttcttcctccattggagtttattgggacaaacaggagagccagccattgtctccagtacttgcctcattctcatcatccaaactgaacatttgtatcccaagcagaaataaagagaatatgttctttttaa

SEQ ID NO: 372051 - DNA, 1717 bp, Homo sapiens
ttcggctaggtacgaggctgggtttgaatcggccgaggactgtgaacatggcggcgcccgttgtcacggccccgggcagagctctgctgcgggcgggcgctggacggctgcttcggggaggcgtccaggagctactgcggccgcgacatgaagggaacgcccctgacctggcctgcaacttcagcctttctcaaaatcggggcacggtcatcgtggagcgctggtggaaggtaccgctggccggggagggccggaagccgcgcctgcaccggcgacatcgcgtctataagctggtggaggacacgaagcatcggcccaaagaaaacctggagctcatcctgacgcagtcggtggagaatgttggagtccggggtgacctggtctcagtgaagaaatctttaggccggaatcgactccttcctcagggactggctgtatatgcatcccctgaaaacaagaagctgtttgaagaggagaaattgctgagacaagaaggaaaattagagaagatccagaccaaggcaggtgaggcgacagtgaaatttctaaaaagctgtcgcctggaggtagggatgaagaacaatgtcaaatgggagctgaaccctgaaatagttgcccgccacttctttaagaatcttggtgttgtggttgccccacatacattaaagttaccagcagagcctatcacacggtggggcgagtattggtgtgaggtgacggtaaatgggcttgatactgtgagagtgcctatgtctgtcgtgaactttgagaagcccaagaccaaaagatataagtactggttagcccagcaagctgccaaggctatggcccccaccagcccccagatctaaatctactctccctccaaggcagcaaagcagaatcgggagcagtggagcagaaatgtgcaagcaccctgatctcactcccagctctgaccaaatacagaattttagagaacatctgaagacatcagactgcactgcgtatacatgttgaattcttcatttttgccatctttaactgtcatcactggggcagggaagtcctgttccagaagtaccaggctgtagatttgataagctagatgcagtagaccgaaaccatccaaaacctgtttagcttcttcctccattggagtttattgggacaaacaggagagccagccattgtctccagtacttgcctcattctcatcatccaaactgaacatttgtatcccaagcagaaataaagagaatatgttctttttaagtaaaaaaaacaaaaaaaaaaaaaaaaaaaaacaaaaaacacaaacacgaaaccaacaaacaacacaaacaacaccacagaacaacaaaaacaaagacaaaccaaaatcaacgcacccaacggaccccacatccaaccccccataaactacaaacagcatgccccgatccactgctgcctgtagaccacgcccataccaagagccaaaaaagcgtgaatatcgaacaccacaagccaaagggcccaccaccatactcgagcacgacccacaacccgacagcaactcacacgaacagacacaccaacgcccacagacgaataccaaccgccacagcccaacaacaagccataaaaaactacgagcgcccgacccgacagcaacgccacgtgccccacaaaacactagcactacgccgaaacgtacacggcgcaacccagaactccactacctaaaccagctcgc

SEQ ID NO: 372052 - DNA, 1141 bp, Homo sapiens
ggcgcgccgcaggcagcactggcgggggcctttcctgccgccgacgccggggtcctccctcaggtctcattctgtgcctgtgaacatggcggcgcccgttgtcacggccccgggcagagctctgctgcgggcgggcgctggacggctgcttcggggaggcgtccaggagctactgcggccgcgacatgaagggaacgcccctgacctggcctgcaacttcagcctttctcaaaatcggggcacggtcatcgtggagcgctggtggaaggtaccgctggccggggagggccggaagccgcgcctgcaccggcgacatcgcgtctataagctggtggaggacacgaagcatcggcccaaagaaaacctggagctcatcctgacgcagtcggtggagaatgttggagtccggggtgacctggtctcagtgaagaaatctttaggccggaatcgactccttcctcagggactggctgtatatgcatcccctgaaaacaagaagctgtttgaagaggagaaattgctgagacaagaaggaaaattagagaagatccagaccaaggcaggtgaggcgacagtgaaatttctaaaaagctgtcgcctggaggtagggatgaagaacaatgtcaaatgggagctgaaccctgaaatagttgcccgccacttctttaagaatcttggtgttgtggttgccccacatacattaaagttaccagcagagcctatcacacggtggggcgagtattggtgtgaggtgacgcagcaaagcagaatcgggagcagtggagcagaaatgtgcaagcaccctgatctcactcccagctctgaccaaatacagaattttagagaacatctgaagacatcagactgcactgcgtatacatgttgaattcttcatttttgccatctttaactgtcatcactggggcagggaagtcctgttccagaagtaccaggctgtagatttgataagctagatgcagtagaccgaaaccatccaaaacctgtttagcttcttcctccattggagtttattgggacaaacaggagagccagccattgtctccagtacttgcctcattctcatcatccaaactgaacatttgtatcccaagcagaaataaagagaatatgttctttttaa

SEQ ID NO: 372053 - DNA, 1313 bp, Homo sapiens
ttcggctaggtacgaggctgggtttgaatcggccgaggactgtgaacatggcggcgcccgttgtcacggccccgggcagagctctgctgcgggcgggcgctggacggctgcttcggggaggcgtccaggagctactgcggccgcgacatgaagggaacgcccctgacctggcctgcaacttcagcctttctcaaaatcggggcacggtcatcgtggagcgctggtggaaggtaccgctggccggggagggccggaagccgcgcctgcaccggcgacatcgcgtctataagctggtggaggacacgaagcatcggcccaaagaaaacctggagctcatcctgacgcagtcggtggagaatgttggagtccggggtgacctggtctcagtgaagaaatctttaggccggaatcgactccttcctcagggactggctgtatatgcatcccctgaaaacaagaagctgtttgaagaggagaaattgctgagacaagaaggaaaattagagaagatccagaccaaggcaggtgaggcggtgattgcagacccaagagtgggagaaaggggaagtgttgtggctgccccacaaaacagacagtgaaatttctaaaaagctgtcgcctggaggtagggatgaagaacaatgtcaaatgggagctgaaccctgaaatagttgcccgccacttctttaagaatcttggtgttgtggttgccccacatacattaaagttaccagcagagcctatcacacggtggggcgagtattggtgtgaggtgacggtaaatgggcttgatactgtgagagtgcctatgtctgtcgtgaactttgagaagcccaagaccaaaagatataagtactggttagcccagcaagctgccaaggctatggcccccaccagcccccagatctaaatctactctccctccaaggcagcaaagcagaatcgggagcagtggagcagaaatgtgcaagcaccctgatctcactcccagctctgaccaaatacagaattttagagaacatctgaagacatcagactgcactgcgtatacatgttgaattcttcatttttgccatctttaactgtcatcactggggcagggaagtcctgttccagaagtaccaggctgtagatttgataagctagatgcagtagaccgaaaccatccaaaacctgtttagcttcttcctccattggagtttattgggacaaacaggagagccagccattgtctccagtacttgcctcattctcatcatccaaactgaacatttgtatcccaagcagaaataaagagaatatgttctttttaa

SEQ ID NO: 372054 - DNA, 1152 bp, Homo sapiens
ttcggctaggtacgaggctgggtttgaatcggccgaggactgtgaacatggcggcgcccgttgtcacggccccgggcagagctctgctgcgggcgggcgctggacggctgcttcggggaggcgtccaggagctactgcggccgcgacatgaagggaacgcccctgacctggcctgcaacttcagcctttctcaaaatcggggcacggtcatcgtggagcgctggtggaaggtaccgctggccggggagggccggaagccgcgcctgcaccggcgacatcgcgtctataagctggtggaggacacgaagcatcggcccaaagaaaacctggagctcatcctgacgcagtcggtggagaatgttggagtccggggtgacctggtctcagtgaagaaatctttaggccggaatcgactccttcctcagggactggctgtatatgcatcccctgaaaacaagaagctgtttgaagaggagaaattgctgagacaagaaggaaaattagagaagatccagaccaaggcaggtgaggcgcttggtgttgtggttgccccacatacattaaagttaccagcagagcctatcacacggtggggcgagtattggtgtgaggtgacggtaaatgggcttgatactgtgagagtgcctatgtctgtcgtgaactttgagaagcccaagaccaaaagatataagtactggttagcccagcaagctgccaaggctatggcccccaccagcccccagatctaaatctactctccctccaaggcagcaaagcagaatcgggagcagtggagcagaaatgtgcaagcaccctgatctcactcccagctctgaccaaatacagaattttagagaacatctgaagacatcagactgcactgcgtatacatgttgaattcttcatttttgccatctttaactgtcatcactggggcagggaagtcctgttccagaagtaccaggctgtagatttgataagctagatgcagtagaccgaaaccatccaaaacctgtttagcttcttcctccattggagtttattgggacaaacaggagagccagccattgtctccagtacttgcctcattctcatcatccaaactgaacatttgtatcccaagcagaaataaagagaatatgttctttttaa

SEQ ID NO: 372055 - DNA, 795 bp, Homo sapiens
ctgtcgtctagctgtcaggtatcacggggcagtgatgctgagacatgaagtcattgtagcagatgtagacgagaacagtgaaatttctaaaaagctgtcgcctggaggtagggatgaagaacaatgtcaaatgggagctgaaccctgaaatagttgcccgccacttctttaagaatcttggtgttgtggttgccccacatacattaaagttaccagcagagcctatcacacggtggggcgagtattggtgtgaggtgacggtaaatgggcttgatactgtgagagtgcctatgtctgtcgtgaactttgagaagcccaagaccaaaagatataagtactggttagcccagcaagctgccaaggctatggcccccaccagcccccagatctaaatctactctccctccaaggcagcaaagcagaatcgggagcagtggagcagaaatgtgcaagcaccctgatctcactcccagctctgaccaaatacagaattttagagaacatctgaagacatcagactgcactgcgtatacatgttgaattcttcatttttgccatctttaactgtcatcactggggcagggaagtcctgttccagaagtaccaggctgtagatttgataagctagatgcagtagaccgaaaccatccaaaacctgtttagcttcttcctccattggagtttattgggacaaacaggagagccagccattgtctccagtacttgcctcattctcatcatccaaactgaacatttgtatcccaagcagaaataaagagaatatgttctttttaa

SEQ ID NO: 372056 - DNA, 853 bp, Homo sapiens
cgagctcggcacccaatgtattgatatgagtggagggactggttctttatttcaaaaagacacttgtcaatattcagtatcaaaacagttgcactattgatttctctttctcccaatcggccccaatgagaccacataaaaggagagtacattttaagccaataagctgcaggatgtacacctaacagacctcctagaaaccttaccagaaaatggggactgggtagggaaggaaacttaaaagatcaacaaactgccagcccacggactgcagaggctgtcacagccagatggggcgagtattggtgtgaggtgacggtaaatgggcttgatactgtgagagtgcctatgtctgtcgtgaactttgagaagcccaagaccaaaagatataagtactggttagcccagcaagctgccaaggctatggcccccaccagcccccagatctaaatctactctccctccaaggcagcaaagcagaatcgggagcagtggagcagaaatgtgcaagcaccctgatctcactcccagctctgaccaaatacagaattttagagaacatctgaagacatcagactgcactgcgtatacatgttgaattcttcatttttgccatctttaactgtcatcactggggcagggaagtcctgttccagaagtaccaggctgtagatttgataagctagatgcagtagaccgaaaccatccaaaacctgtttagcttcttcctccattggagtttattgggacaaacaggagagccagccattgtctccagtacttgcctcattctcatcatccaaactgaacatttgtatcccaagcagaaataaagagaatatgttctttttaa

SEQ ID NO: 372057 - DNA, 721 bp, Homo sapiens
ttcggctaggtacgaggctgggtttgaatcggccgaggactgtgaacatggcggcgcccgttgtcacggccccgggcagagctctgctgcgggcgggcgctggacggctgcttcggggaggcgtccaggagctactgcggccgcgacatgaagggaacgcccctgacctggcctgcaacttcagcctttctcaaaatcggggcacggtcatcgtggagcgctggtggaaggtaccgctggccggggagggccggaagccgcgcctgcaccggcgacatcgcgtctataagctggtggaggacacgaagcatcggcccaaagaaaacctggagctcatcctgacgcagtcggtggagagtaaggcccgggccgaggcgcttcctctcaggctggtccggtttggcatcagctttttctagcccgtccccctcaactatttgccttgctttttctttgtggaaacaatccaactctatatgtgagaagaggaagccataaaaactattgtgattgtgacactggcctccagcattgaaaattaaaacataaaggcagcaacatcattaacagtgtgtggggagaggagcctgacaatttgtgccacagatactgaaatcctccatgggacgacaactccctctatacaggggatattaaatttatacatcaagttctaaagaaactaattagcagtctcttaaatcttgttcctagtgaatat

SEQ ID NO: 372058 - DNA, 540 bp, Homo sapiens
ttcggctaggtacgaggctgggtttgaatcggccgaggactgtgaacatggcggcgcccgttgtcacggccccgggcagagctctgctgcgggcgggcgctggacggctgcttcggggaggcgtccaggagctactgcggccgcgacatgaagggaacgcccctgacctggcctgcaacttcagcctttctcaaaatcggggcacggtcatcgtggagcgctggtggaaggtaccgctggccggggagggccggaagccgcgcctgcaccggcgacatcgcgtctataagctggtggaggacacgaagcatcggcccaaagaaaacctggagctcatcctgacgcagtcggtggagaatgttggagtccggggtgacctggtctcagtgaagaaatctttaggccggaatcgactccttcctcagggactggctgtatatgcatcccctgaaaacaagaagctgtttgaagaggagaaattggtgagctcaaaggaaggacagagagacttggggagataaaacttcttttctcttgcag

SEQ ID NO: 372059 - DNA, 1254 bp, Homo sapiens
ttcggctaggtacgaggctgggtttgaatcggccgaggactgtgaacatggcggcgcccgttgtcacggccccgggcagagctctgctgcgggcgggcgctggacggctgcttcggggaggcgtccaggagctactgcggccgcgacatgaagggaacgcccctgacctggcctgcaacttcagcctttctcaaaatcggggcacggtcatcgtggagcgctggtggaaggtaccgctggccggggagggccggaagccgcgcctgcaccggcgacatcgcgtctataagctggtggaggacacgaagcatcggcccaaagaaaacctggagctcatcctgacgcagtcggtggagaatgttggagtccggggtgacctggtctcagtgaagaaatctttaggccggaatcgactccttcctcagggactggctgtatatgcatcccctgaaaacaagaagctgtttgaagaggagaaattgctgagacaagaaggaaaattagagaagatccagaccaaggcaggtgaggcgacagtgaaatttctaaaaagctgtcgcctggaggtagggatgaagaacaatgtcaaatgggagctgaaccctgaaatagttgcccgccacttctttaagaatcttggtgttgtggttgccccacatacattaaagttaccagcagagcctatcacacggtggggcgagtattggtgtgaggtgacggtaaatgggcttgatactgtgagagtgcctatgtctgtcgtgaactttgagaagcccaagaccaaaagatataagtactggttagcccagcaagctgccaaggctatggcccccaccagcccccagatctaaatctactctccctccaaggcagcaaagcagaatcgggagcagtggagcagaaatgtgcaagcaccctgatctcactcccagctctgaccaaatacagaattttagagaacatctgaagacatcagactgcactgcgtatacatgttgaattcttcatttttgccatctttaactgtcatcactggggcagggaagtcctgttccagaagtaccaggctgtagatttgataagctagatgcagtagaccgaaaccatccaaaacctgtttagcttcttcctccattggagtttattgggacaaacaggagagccagccattgtctccagtacttgcctcattctcatcatccaaactgaacatttgtatcccaagcagaaataaagagaatatgttctttttaa

SEQ ID NO: 372060 - DNA, 1283 bp, Homo sapiens
ttcggctaggtacgaggctgggtttgaatcggccgaggactgtgaacatggcggcgcccgttgtcacggccccgggcagagctctgctgcgggcgggcgctggacggctgcttcggggaggcgtccaggagctactgcggccgcgacatgaagggaacgcccctgacctggcctgcaacttcagcctttctcaaaatcggggcacggtcatcgtggagcgctggtggaaggtaccgctggccggggagggccggaagccgcgcctgcaccggcgacatcgcgtctataagctggtggaggacacgaagcatcggcccaaagaaaacctggagctcatcctgacgcagtcggtggagaatgttggagtccggggtgacctggtctcagtgaagaaatctttaggccggaatcgactccttcctcagggactggctgtatatgcatcccctgaaaacaagaagctgtttgaagaggagaaattgctgagacaagaaggaaaattagagaagatccagaccaaggcaggtgaggcgacagtgaaatttctaaaaagctgtcgcctggaggtagggatgaagaacaatgtcaaatgggagctgaaccctgaaatagttgcccgccacttctttaagaatcttggtgttgtggttgccccacatacattaaagttaccagcagagcctatcacacggtggggcgagtattggtgtgaggtgacggtaaatgggcttgatactgtgagagtgcctatgtctgtcgtgaactttgagaagcccaagaccaaaagatataagtactggttagcccagcaagctgccaaggctatggcccccaccagcccccagatctaaatctactctccctccaaggcagcaaagcagaatcgggagcagtggagcagaaatgtgcaagcaccctgatctcactcccagctctgaccaaatacagaattttagagaacatctgaagacatcagactgcactgcgtatacatgttgaattcttcatttttgccatctttaactgtcatcactggggcagggaagtcctgttccagaagtaccaggctgtagatttgataagctagatgcagtagaccgaaaccatccaaaacctgtttagcttcttcctccattggagtttattgggacaaacaggagagccagccattgtctccagtacttgcctcattctcatcatccaaactgaacatttgtatcccaagcagaaataaagagaatatgttctttttaaaaaaaaacacaccacacaccaaacaccag

SEQ ID NO: 372061 - DNA, 1112 bp, Homo sapiens
ccacttgtgtgctcatcccacctgtgtgctcatcccactgtgtgctcctgtgtgctatggcacggtcatcgtggagcgctggtggaaggtaccgctggccggggagggccggaagccgcgcctgcaccggcgacatcgcgtctataagctggtggaggacacgaagcatcggcccaaagaaaacctggagctcatcctgacgcagtcggtggagaatgttggagtccggggtgacctggtctcagtgaagaaatctttaggccggaatcgactccttcctcagggactggctgtatatgcatcccctgaaaacaagaagctgtttgaagaggagaaattgctgagacaagaaggaaaattagagaagatccagaccaaggcaggtgaggcgacagtgaaatttctaaaaagctgtcgcctggaggtagggatgaagaacaatgtcaaatgggagctgaaccctgaaatagttgcccgccacttctttaagaatcttggtgttgtggttgccccacatacattaaagttaccagcagagcctatcacacggtggggcgagtattggtgtgaggtgacggtaaatgggcttgatactgtgagagtgcctatgtctgtcgtgaactttgagaagcccaagaccaaaagatataagtactggttagcccagcaagctgccaaggctatggcccccaccagcccccagatctaaatctactctccctccaaggcagcaaagcagaatcgggagcagtggagcagaaatgtgcaagcaccctgatctcactcccagctctgaccaaatacagaattttagagaacatctgaagacatcagactgcactgcgtatacatgttgaattcttcatttttgccatctttaactgtcatcactggggcagggaagtcctgttccagaagtaccaggctgtagatttgataagctagatgcagtagaccgaaaccatccaaaacctgtttagcttcttcctccattggagtttattgggacaaacaggagagccagccattgtctccagtacttgcctcattctcatcatccaaactgaacatttgtatcccaagcagaaataaagagaatatgttctttttaa

SEQ ID NO: 372062 - DNA, 1291 bp, Homo sapiens
ttcggctaggtacgaggctgggtttgaatcggccgaggactgtgaacatggcggcgcccgttgtcacggccccgggcagagctctgctgcgggcgggcgctggacggctgcttcggggaggcgtccaggagctactgcggccgcgacatgaagggaacgcccctgacctggcctgcaacttcagcctttctcaaaatcggggcacggtcatcgtggagcgctggtggaaggtaccgctggccggggagggccggaagccgcgcctgcaccggcgacatcgcgtctataagctggtggaggacacgaagcatcggcccaaagaaaacctggagctcatcctgacgcagtcggtggagagtaaggcccgggccgaggcgcttcctctcaggctggtatgttggagtccggggtgacctggtctcagtgaagaaatctttaggccggaatcgactccttcctcagggactggctgtatatgcatcccctgaaaacaagaagctgtttgaagaggagaaattgctgagacaagaaggaaaattagagaagatccagaccaaggcaggtgaggcgacagtgaaatttctaaaaagctgtcgcctggaggtagggatgaagaacaatgtcaaatgggagctgaaccctgaaatagttgcccgccacttctttaagaatcttggtgttgtggttgccccacatacattaaagttaccagcagagcctatcacacggtggggcgagtattggtgtgaggtgacggtaaatgggcttgatactgtgagagtgcctatgtctgtcgtgaactttgagaagcccaagaccaaaagatataagtactggttagcccagcaagctgccaaggctatggcccccaccagcccccagatctaaatctactctccctccaaggcagcaaagcagaatcgggagcagtggagcagaaatgtgcaagcaccctgatctcactcccagctctgaccaaatacagaattttagagaacatctgaagacatcagactgcactgcgtatacatgttgaattcttcatttttgccatctttaactgtcatcactggggcagggaagtcctgttccagaagtaccaggctgtagatttgataagctagatgcagtagaccgaaaccatccaaaacctgtttagcttcttcctccattggagtttattgggacaaacaggagagccagccattgtctccagtacttgcctcattctcatcatccaaactgaacatttgtatcccaagcagaaataaagagaatatgttctttttaa

SEQ ID NO: 372063 - DNA, 1350 bp, Homo sapiens
ttcggctaggtacgaggctgggtttgaatcggccgaggactgtgaacatggcggcgcccgttgtcacggccccgggcagagctctgctgcgggcgggcgctggacggctgcttcggggaggcgtccaggagctactgcggccgcgacatgaagggaacgcccctgacctggcctgcaacttcagcctttctcaaaatcggggcacggtcatcgtggagcgctggtggaaggtaccgctggccggggagggccggaagccgcgcctgcaccggcgacatcgcgtctataagctggtggaggacacgaagcatcggcccaaagaaaacctggagctcatcctgacgcagtcggtggagagtaaggcccgggccgaggcgcttcctctcaggctggtatgttggagtccggggtgacctggtctcagtgaagaaatctttaggccggaatcgactccttcctcagggactggctgtatatgcatcccctgaaaacaagaagctgtttgaagaggagaaattgctgagacaagaaggaaaattagagaagatccagaccaaggcaggtgaggcggtgattgcagacccaagagtgggagaaaggggaagtgttgtggctgccccacaaaacagacagtgaaatttctaaaaagctgtcgcctggaggtagggatgaagaacaatgtcaaatgggagctgaaccctgaaatagttgcccgccacttctttaagaatcttggtgttgtggttgccccacatacattaaagttaccagcagagcctatcacacggtggggcgagtattggtgtgaggtgacggtaaatgggcttgatactgtgagagtgcctatgtctgtcgtgaactttgagaagcccaagaccaaaagatataagtactggttagcccagcaagctgccaaggctatggcccccaccagcccccagatctaaatctactctccctccaaggcagcaaagcagaatcgggagcagtggagcagaaatgtgcaagcaccctgatctcactcccagctctgaccaaatacagaattttagagaacatctgaagacatcagactgcactgcgtatacatgttgaattcttcatttttgccatctttaactgtcatcactggggcagggaagtcctgttccagaagtaccaggctgtagatttgataagctagatgcagtagaccgaaaccatccaaaacctgtttagcttcttcctccattggagtttattgggacaaacaggagagccagccattgtctccagtacttgcctcattctcatcatccaaactgaacatttgtatcccaagcagaaataaagagaatatgttctttttaa

SEQ ID NO: 372064 - DNA, 1068 bp, Homo sapiens
ttcggctaggtacgaggctgggtttgaatcggccgaggactgtgaacatggcggcgcccgttgtcacggccccgggcagagctctgctgcgggcgggcgctggacggctgcttcggggaggcgtccaggagctactgcggccgcgacatgaagggaacgcccctgacctggcctgcaacttcagcctttctcaaaatcggggcacggtcatcgtggagcgctggtggaaggtaccgctggccggggagggccggaagccgcgcctgcaccggcgacatcgcgtctataagctggtggaggacacgaagcatcggcccaaagaaaacctggagctcatcctgacgcagtcggtggagaatgttggagtccggggtgacctggtctcagtgaagaaatctttaggccggaatcgactccttcctcagggactggctgtatatgcatcccctgaaaacaagaagctgtttgaagaggagaaattgctgagacaagaaggaaaattagagaagatccagaccaaggcaggtgaggcggtaaatgggcttgatactgtgagagtgcctatgtctgtcgtgaactttgagaagcccaagaccaaaagatataagtactggttagcccagcaagctgccaaggctatggcccccaccagcccccagatctaaatctactctccctccaaggcagcaaagcagaatcgggagcagtggagcagaaatgtgcaagcaccctgatctcactcccagctctgaccaaatacagaattttagagaacatctgaagacatcagactgcactgcgtatacatgttgaattcttcatttttgccatctttaactgtcatcactggggcagggaagtcctgttccagaagtaccaggctgtagatttgataagctagatgcagtagaccgaaaccatccaaaacctgtttagcttcttcctccattggagtttattgggacaaacaggagagccagccattgtctccagtacttgcctcattctcatcatccaaactgaacatttgtatcccaagcagaaataaagagaatatgttctttttaa

SEQ ID NO: 372065 - DNA, 655 bp, Homo sapiens
ttcggctaggtacgaggctgggtttgaatcggccgaggactgtgaacatggcggcgcccgttgtcacggccccgggcagagctctgctgcgggcgggcgctggacggctgcttcggggaggcgtccaggagctactgcggccgcgacatgaagggaacgcccctgacctggcctgcaacttcagcctttctcaaaatcggggcacggtcatcgtggagcgctggtggaaggtaccgctggccggggagggccggaagccgcgcctgcaccggcgacatcgcgtctataagctggtggaggacacgaagcatcggcccaaagaaaacctggagctcatcctgacgcagtcggtggagaatgttggagtccggggtgacctggtctcagtgaagaaatctttaggccggaatcgactccttcctcagggactggctgtatatgcatcccctgaaaacaagaagctgtttgaagaggagaaattgctgagacaagaaggaaaattagagaagacccagcattctgtacttcgggggccttctctcttgttataaaactttttaccaagtgaaacatcgataccacctttgtttccattctcactggtgtaaatactgagtactaactgagaattttgactttgcattctgtcggaata

SEQ ID NO: 372066 - DNA, 1638 bp, Homo sapiens
cgcccgagcctgcgtctgccaatgatccaggagccgctcctttccactcgggaaaccttcagaggagtctcagaaaggacacggctggctgcttttctcagcgccgaagccgcgccatgctcgtcctcagaagcgccctgactcgggcgctggcctcacggacgctggcgcctcagatgtgctcatcttttgctacgggacccagacaatacgatggaatattctatgaatttcgttcttattaccttaagccctcaaagatgaatgagttcctggaaaattttgagaaaaacgctcatcttcggacagctcactctgaattggttggatactggagtgtagaatttggaggcagaatgaatacagtgtttcatatttggaagtatgataattttgctcatcgaactgaagttcggaaagccttggccaaagataaggaatggcaagaacaattcctcattccaaatttggctctcattgataaacaagagagtgagattacttatctggtaccatggtgcaaattagaaaaacctccaaaagaaggagtctatgaactggccacttttcagatgaaacctggtgggccagctctgtggggtgatgcatttaaaagggcagttcatgctcatgtcaatctaggctacacaaaactagttggagtgttccacacagagtacggagcactcaacagagttcatgttctttggtggaatgagagtgcagatagtcgtgcagctgggagacataagtcccatgaggatcccagagttgtggcagctgttcgggaaagtgtcaactacctagtatctcagcagaatatgcttctgattcctacatcgttttcaccactgaaatagttttctactgaaatacaaaacatttcattaactgctataggatctgtctgctaatggtgcttaaattctcccaagaggttctcacttttatttgaaggaggtggtaagttaatttgctatgtttcttgcattatgaaggctacatctgtgctttgtaagtaccacttcaaaaaatagttctgtttactttctgcatggtatttcagtgtctgtcatacattaaaaatacttgtcactgttttaagatcttgactcttcatttgtttcagaatagctcttctactgtattctgacaactctttgctttatagcattttgttgtattcaaatgataatggtagcatttccatgcttgtgacagcatttttaagttattaatatattttatcaacctttccatcatgtctgttttcctggttttttttggttgttttttgaccagtaaaatttattttgtaataccaaataggatttaagaaaattaacgtatttctttactatggaaaaccacattgtcatttgtgacatcatctatattaaatatggttttcacattagttatttgtcacttacttggaaaatgatgctgttaggtcctggtattaaaaatctagaaaagacttgttggtttatgtgctgaaatgtctttatttataattaattttaactactatttacttcatttcggatcctgtttaacaaagatacttgagacatccatttgttttaatgaaatctgtatggatatggaaatgcttgccctaataaaagcctacat

SEQ ID NO: 372067 - DNA, 1100 bp, Homo sapiens
cgcccgagcctgcgtctgccaatgatccaggagccgctcctttccactcgggaaaccttcagaggagtctcagaaaggacacggctggctgcttttctcagcgccgaagccgcgccatgctcgtcctcagaagcgccctgactcgggcgctggcctcacggacgctggcgcctcagatgtgctcatcttttgctacgggacccagacaatacgatggaatattctatgaatttcgttcttattaccttaagccctcaaagatgaatgagttcctggaaaattttgagaaaaacgctcatcttcggacagctcactctgaattggttggatactggagtgtagaatttggaggcagaatgaatacagtgtttcatatttggaagtatgataattttgctcatcgaactgaagttcggaaagccttggccaaagataaggaatggcaagaacaattcctcattccaaatttggctctcattgataaacaagagagtgagattacttatctggtaccatggtgcaaattagaaaaacctccaaaagaaggagtctatgaactggccacttttcagatgaaacctggtgggccagctctgtggggtgatgcatttaaaagggcagttcatgctcatgtcaatctaggctacacaaaactagttggagtgttccacacagagtacggagcactcaacagagttcatgttctttggtggaatgagagtgcagatagtcgtgcagctgggagacataagtcccatgaggatcccagagttgtggcagctgttcgggaaagtgtcaactacctagtatctcagcagaatatgcttctgattcctacatcgttttcaccactgaaatagttttctactgaaatacaaaacatttcattaactgctataggatctgtctgctaatggtgcttaaattctcccaagaggttctcacttttatttgaaggaggtggtaagttaatttgctatgtttcttgcattatgaaggctacatctgtgctttgtaagtaccacttcaaaaaatagttctgtttactttctgcatggtatttcagtgtctgtcatacattaaaaatacttgtcactgtt

SEQ ID NO: 372068 - DNA, 720 bp, Homo sapiens
cgcccgagcctgcgtctgccaatgatccaggagccgctcctttccactcgggaaaccttcagaggagtctcagaaaggacacggctggctgcttttctcagcgccgaagccgcgccatgctcgtcctcagaagcgccctgactcgggcgctggcctcacggacgctggcgcctcagatgtgctcatcttttgctacgggacccagacaatacgatggaatattctatgaatttcgttcttattaccttaagccctcaaagatgaatgagttcctggaaaattttgagaaaaacgctcatcttcggacagctcactctgaattggttggatactggagtgtagaatttggaggcagaatgaatacagtgtttcatatttggaagtatgataattttgctcatcgagctgaagttcggaaagccttagccaactgtaaggaatggcaagaacaatctatcattccaaatttggctcgcattgataaacaagagacggaaattacttacctgataccatggtccaaattagaaaagcctccaaaagaagttcatgttctttggtggaatgagagtgcagatagtcgtgcagctgggagacataagtcccatgaggatcccagagttgtggcggctgttcgggaaagtgtcaactacctagtttctcagcagaatatgcttctgattcctgcatcattttcaccattgaaatagttttctactg

SEQ ID NO: 372069 - DNA, 1592 bp, Homo sapiens
cgcccgagcctgcgtctgccaatgatccaggagccgctcctttccactcgggaaaccttcagaggagtctcagaaaggacacggctggctgcttttctcagcgccgaagccgcgccatgctcgtcctcagatgtgctcatcttttgctacgggacccagacaatacgatggaatattctatgaatttcgttcttattaccttaagccctcaaagatgaatgagttcctggaaaattttgagaaaaacgctcatcttcggacagctcactctgaattggttggatactggagtgtagaatttggaggcagaatgaatacagtgtttcatatttggaagtatgataattttgctcatcgaactgaagttcggaaagccttggccaaagataaggaatggcaagaacaattcctcattccaaatttggctctcattgataaacaagagagtgagattacttatctggtaccatggtgcaaattagaaaaacctccaaaagaaggagtctatgaactggccacttttcagatgaaacctggtgggccagctctgtggggtgatgcatttaaaagggcagttcatgctcatgtcaatctaggctacacaaaactagttggagtgttccacacagagtacggagcactcaacagagttcatgttctttggtggaatgagagtgcagatagtcgtgcagctgggagacataagtcccatgaggatcccagagttgtggcagctgttcgggaaagtgtcaactacctagtatctcagcagaatatgcttctgattcctacatcgttttcaccactgaaatagttttctactgaaatacaaaacatttcattaactgctataggatctgtctgctaatggtgcttaaattctcccaagaggttctcacttttatttgaaggaggtggtaagttaatttgctatgtttcttgcattatgaaggctacatctgtgctttgtaagtaccacttcaaaaaatagttctgtttactttctgcatggtatttcagtgtctgtcatacattaaaaatacttgtcactgttttaagatcttgactcttcatttgtttcagaatagctcttctactgtattctgacaactctttgctttatagcattttgttgtattcaaatgataatggtagcatttccatgcttgtgacagcatttttaagttattaatatattttatcaacctttccatcatgtctgttttcctggttttttttggttgttttttgaccagtaaaatttattttgtaataccaaataggatttaagaaaattaacgtatttctttactatggaaaaccacattgtcatttgtgacatcatctatattaaatatggttttcacattagttatttgtcacttacttggaaaatgatgctgttaggtcctggtattaaaaatctagaaaagacttgttggtttatgtgctgaaatgtctttatttataattaattttaactactatttacttcatttcggatcctgtttaacaaagatacttgagacatccatttgttttaatgaaatctgtatggatatggaaatgcttgccctaataaaagcctacat

SEQ ID NO: 372070 - DNA, 1315 bp, Homo sapiens
gtcatctgtatgattaagcataacaactcactcttaaacatgggcaaggactttctaagcataaaagcagagagtgcaaatataataaacatgtctacataatatgtatgcatgtctgatcctccaaatctgtgtgtgtagatagtgaaagactattcactgagaaacgtgattggatattgcttgaatgttttctgaaaaattctttttctccctattccaggagtctatgaactggccacttttcagatgaaacctggtgggccagctctgtggggtgatgcatttaaaagggcagttcatgctcatgtcaatctaggctacacaaaactagttggagtgttccacacagagtacggagcactcaacagagttcatgttctttggtggaatgagagtgcagatagtcgtgcagctgggagacataagtcccatgaggatcccagagttgtggcagctgttcgggaaagtgtcaactacctagtatctcagcagaatatgcttctgattcctacatcgttttcaccactgaaatagttttctactgaaatacaaaacatttcattaactgctataggatctgtctgctaatggtgcttaaattctcccaagaggttctcacttttatttgaaggaggtggtaagttaatttgctatgtttcttgcattatgaaggctacatctgtgctttgtaagtaccacttcaaaaaatagttctgtttactttctgcatggtatttcagtgtctgtcatacattaaaaatacttgtcactgttttaagatcttgactcttcatttgtttcagaatagctcttctactgtattctgacaactctttgctttatagcattttgttgtattcaaatgataatggtagcatttccatgcttgtgacagcatttttaagttattaatatattttatcaacctttccatcatgtctgttttcctggttttttttggttgttttttgaccagtaaaatttattttgtaataccaaataggatttaagaaaattaacgtatttctttactatggaaaaccacattgtcatttgtgacatcatctatattaaatatggttttcacattagttatttgtcacttacttggaaaatgatgctgttaggtcctggtattaaaaatctagaaaagacttgttggtttatgtgctgaaatgtctttatttataattaattttaactactatttacttcatttcggatcctgtttaacaaagatacttgagacatccatttgttttaatgaaatctgtatggatatggaaatgcttgccctaataaaagcctacat

SEQ ID NO: 372071 - DNA, 1111 bp, Homo sapiens
  misc_feature (2)..(2): n is a, c, g, or t
gnggttggcgcactagacctgtggatcccccgggctgttggaattcggcactaggaaaaacctttaaaagaaggagtctatgaactggccacttttcagatgaaacctggtgggccagctctgtggggtgatgcatttaaaagggcagttcatgctcatgtcaatctaggctacacaaaactagttggagtgttccacacagagtacggagcactcaacagagttcatgttctttggtggaatgagagtgcagatagtcgtgcagctgggagacataagtcccatgaggatcccagagttgtggcagctgttcgggaaagtgtcaactacctagtatctcagcagaatatgcttctgattcctacatcgttttcaccactgaaatagttttctactgaaatacccaagaggttctcacttttatttgaaggaggtggtaagttaatttgctatgtttcttgcattatgaaggctacatctgtgctttgtaagtaccacttcaaaaaatagttctgtttactttctgcatggtatttcagtgtctgtcatacattaaaaatacttgtcactgttttaagatcttgactcttcatttgtttcagaatagctcttctactgtattctgacaactctttgctttatagcattttgttgtattcaaatgataatggtagcatttccatgcttgtgacagcatttttaagttattaatatattttatcaacctttccatcatgtctgttttcctggttttttttggttgttttttgaccagtaaaatttattttgtaataccaaataggatttaagaaaattaacgtatttctttactatggaaaaccacattgtcatttgtgacatcatctatattaaatatggttttcacattagttatttgtcacttacttggaaaatgatgctgttaggtcctggtattaaaaatctagaaaagacttgttggtttatgtgctgaaatgtctttatttataattaattttaactactatttacttcatttcggatcctgtttaacaaagatacttgagacatccatttgttttaatgaaatctgtatggatatggaaatgcttgccctaataaaagcctacat

SEQ ID NO: 372072 - DNA, 1481 bp, Homo sapiens
cgcccgagcctgcgtctgccaatgatccaggagccgctcctttccactcgggaaaccttcagaggagtctcagaaaggacacggctggctgcttttctcagcgccgaagccgcgccatgctcgtcctcagaagcgccctgactcgggcgctggcctcacggacgctggcgcctcagatgtgctcatcttttgctacgggacccagacaatacgatggaatattctatgaatttcgttcttattaccttaagccctcaaagatgaatgagttcctggaaaattttgagaaaaacgctcatcttcggacagctcactctgaattggttggatactggagtgtagaatttggaggcagaatgaatacagtgtttcatatttggaagtatgataattttgctcatcgaactgaagttcggaaagccttggccaaagataaggaatggcaagaacaattcctcattccaaatttggctctcattgataaacaagagagtgagattacttatctggtaccatggtgcaaattagaaaaacctccaaaagaaggagtctatgaactggccacttttcagatgaaacctggtgggccagctctgtggggtgatgcatttaaaagggcagttcatgctcatgtcaatctaggctacacaaaactagttggagtgttccacacagagtacggagcactcaacagagttcatgttctttggtggaatgagagtgcagatagtcgtgcagctgggagacataagtcccatgaggatcccagagttgtggcagctgttcgggaaagtgtcaactacctagtatctcagcagaatatgcttctgattcctacatcgttttcaccactgaaatagttttctactgaaatacaaaacatttcattaactgctataggatctgtctgctaatggtgcttaaattctcccaagaggttctcacttttatttgaaggaggtggtaagttaatttgctatgtttcttgcattatgaaggctacatctgtgctttgtaagtaccacttcaaaaaatagttctgtttactttctgcatggtatttcagtgtctgtcatacattaaaaatacttgtcactgttttaagatcttgactcttcatttgtttcagaatagctcttctactgtattctgacaactctttgctttatagcattttgttgtattcaaatgataatggtagcatttccatgcttgtgacagcatttttaagttattaatatattttatcaacctttccatcatgtctgttttcctggttttttttggttgttttttgaccagtaaaatttattttgtaataccaaataggatttaagaaaattaacgtatttctttactatggaaaaccacattgtcatttgtgacatcatctatattaaatatggttttcacattagttatttgtcacttacttggaaaatgatgctgttaggtcctggtattaaaaatctagaaaagac

SEQ ID NO: 372073 - DNA, 1728 bp, Homo sapiens
cgcccgagcctgcgtctgccaatgatccaggagccgctcctttccactcgggaaaccttcagaggagtctcagaaaggacacggctggctgcttttctcagcgccgaagccgcgccatgctcgtcctcagaagcgccctgactcgggcgctggcctcacggacgctggcgcctcagatgtgctcatcttttgctacgggacccagacaatacgatggaatattctatgaatttcgttcttattaccttaagccctcaaagatgaatgagttcctggaaaattttgagaaaaacgctcatcttcggacagctcactctgaattggttggatactggagtgtagaatttggaggcagaatgaatacagtgtttcatatttggaagtatgataattttgctcatcgaactgaagttcggaaagccttggccaaagataaggaatggcaagaacaattcctcattccaaatttggctctcattgataaacaagagagtgagattacttatctggtaccatggtgcaaattagaaaaacctccaaaagaaggagtctatgaactggccacttttcagatgaaacctggtgggccagctctgtggggtgatgcatttaaaagggcagttcatgctcatgtcaatctaggctacacaaaactagttggagtgttccacacagagtacggagcactcaacagagttcatgttctttggtggaatgagagtgcagatagtcgtgcagctgggagacataagtcccatgaggatcccagagttgtggcagctggtaagctgtttgactaggcatgaattatttttagaacaaatgtgtttcagtcagtaactctatatgcctttctatgaaatgtttttccagttcgggaaagtgtcaactacctagtatctcagcagaatatgcttctgattcctacatcgttttcaccactgaaatagttttctactgaaatacaaaacatttcattaactgctataggatctgtctgctaatggtgcttaaattctcccaagaggttctcacttttatttgaaggaggtggtaagttaatttgctatgtttcttgcattatgaaggctacatctgtgctttgtaagtaccacttcaaaaaatagttctgtttactttctgcatggtatttcagtgtctgtcatacattaaaaatacttgtcactgttttaagatcttgactcttcatttgtttcagaatagctcttctactgtattctgacaactctttgctttatagcattttgttgtattcaaatgataatggtagcatttccatgcttgtgacagcatttttaagttattaatatattttatcaacctttccatcatgtctgttttcctggttttttttggttgttttttgaccagtaaaatttattttgtaataccaaataggatttaagaaaattaacgtatttctttactatggaaaaccacattgtcatttgtgacatcatctatattaaatatggttttcacattagttatttgtcacttacttggaaaatgatgctgttaggtcctggtattaaaaatctagaaaagacttgttggtttatgtgctgaaatgtctttatttataattaattttaactactatttacttcatttcggatcctgtttaacaaagatacttgagacatccatttgttttaatgaaatctgtatggatatggaaatgcttgccctaataaaagcctacat

SEQ ID NO: 372074 - DNA, 3619 bp, Homo sapiens
tcctttgcgtgggctcccgatgggctgcctgagcgggtgcgcgggcaacttccggtgtgggtgacgagtggtggccgaagcagggggacagcaagggacgctcaggcggggaccatggcggacggcggctcggagcgggctgacgggcgcatcgtcaagatggaggtggactacagcgccacggtggatcagcgcctacccgagtgtgcgaagctagccaaggaaggaagacttcaagaagtcattgaaacccttctctctctggaaaagcagactcgtactgcttccgatatggtatcgacatcccgtatcttagttgcagtagtgaagatgtgctatgaggctaaagaatgggatttacttaatgaaaatattatgcttttgtccaaaaggcggagtcagttaaaacaagctgttgccaaaatggttcaacagtgctgtacttatgttgaggaaatcacagaccttcctatcaaacttcgattaattgatactctacgaatggttaccgaaggcaagatttatgttgaaattgagcgtgcgcgactgactaaaacattagcaactataaaagaacaaaatggtgatgtgaaagaggcagcctccattttacaggagttacaggtggaaacctacgggtcaatggaaaagaaagagcgagtggaatttattttggagcaaatgaggctctgcctagctgtgaaggattacattcgaacacaaatcatcagcaagaaaattaacaccaaatttttccaggaagaaaatacagagaaattaaagttgaagtactataatttaatgattcagctggatcaacatgagggatcctatttgtctatttgtaagcactacagagcaatatatgatactccctgtatacaggcagaaagtgaaaaatggcagcaggctctgaagagtgttgtactctatgttatcctggctccttttgacaatgaacagtcagatttggttcaccgaataagtggtgacaagaagttagaagaaattcccaaatacaaggatcttttaaagctttttaccacaatggagttgatgcgttggtccacacttgttgaggactatggaatggaattaagaaaaggttcccttgagagtcctgcaacggatgtttttggttctacagaggaaggtgaaaaaaggtggaaagacttgaagaacagagttgttgaacataatattagaataatggccaagtattatactcggataacaatgaaaaggatggcacagcttctggatctatctgttgatgagtccgaagcctttctctcaaatctagtagttaacaagaccatctttgctaaagtagacagattagcaggaattatcaacttccagagacccaaggatccaaataatttattaaatgactggtctcagaaactgaactcattaatgtctctggttaacaaaactacgcatctcatagccaaagaggagatgatacataatctacaataagggtcttagtgctttagaaaaaagttaaaattggaagtcattaaaaaaagactgttataatggtgtatatgttggggttttttttctaagcttctttgtcttaaattttaaaatagtgaatatgtttgagactccctttgacctttcagttccccaagttcattgttaactttgcatttgcaattggtgcaaaaatacagatttctgtcgtctgaatacacaaaaagttgtgtcataacttacccagatatgtttttctatcatttgaaacctttttagctactgtttgttttcattcaactaacaaacatattccaataataaaagcagtatatacatatttcctttctacagttacctctgattctcaacattttgtggggtagtgatttggcaagtgttttttaaataaaacaaatctcattgtaaagttatcagtcatttagtagaatagaaaagcaacatagagcatacaagaacatttgggatagagttgtgatttgtgaagaatttgtactttgatattgtggcggaaagtctagactgagtgtgtatgctggtaaactgtagacttttttttttttttttgagtccggctggttccaatcacagtagcttgattgctttcagccctcatcctctcacttgatcagttgttcaacagaatcagctgacataattgacacagtttattgggtgttaagtccgctctatagggatagtgactacttttttttttttttttttttttgctcttcttcctctcccctttctttatatgggtttaaatttaacataaagttgtttttataaggcttatttgtggctttaacttgtaagtctgattacatcattattgttccaaattcattatctctgtaggaacttttagttccattatatgaacactggataacctaattttttttaatgctttaaaaaaatggcaaaaagacgtcaggccaccctcatagtaagtggtgtagtattaaaatattttcacggaattaaaagtagcttgctgtcaaagaaacacctgagatgaattggtgtgaacgaattttgcaagtttaatttgatttatttcagagaaaatagaaaaaacaatgttagaaggttatttaaaatgatacttaaataaagaaagtgtgaggtctactttaaaaaaattcaaatgaagagaaaaagaaaaacagcattctagaaatggcatttctcctaattaattttccacttaatggaagattatcaattgtcctattttatgatcccaggactgaagacagttgtgggatatctgtcatatttatcctgtgagtcattgtgaataatgacatacagtactgaagtaatctgattttattctttggaaattcaatgcattggtcacactaataacatcaacatctgctatcacttatctttttaaaactaaccaaaaaaggctgggattacaggcatgagccactgcacccaactcctctttcgtctttctttaacacacactaggctctttgtgtattatgattcagtgctatttgtaactgtgtcccagtgaccaaattgcactcgactcgatcagctgttcatccatttcgtgttttttcctgtcaaacattaatccagcaaatatatgaggtatttaccaatttattttcttagtattacaaaataattcattagcataaagtacaatagtgaaatatttgagttgttcggaacctcaattaatcctgttttacatttcagacctaaagctggcaatcaggagaagaagcactttgttttaaatgtggagaagataacacttgattccatttcattgtcattagtgtattaaccagcaggagaggtgatgagccatttttcaaatgaaataccttttatttccatataatttttttattttagagttcaatagctgtttctatgattatcctcaatttccatatgttactgaatctgaaaaacatctttaaaattcaaacagttccattttctctcttgtaagtgttaaatgtgataaaagtacatattttaaattgttttcagctcttggatatagcagcaataaaaacactaatttgtgggtatttaagaaaacctggagaataaactcatactttaaaagatc

SEQ ID NO: 372075 - DNA, 562 bp, Homo sapiens
tcctttgcgtgggctcccgatgggctgcctgagcgggtgcgcgggcaacttccggtgtgggtgacgagtggtggccgaagcagggggacagcaagggacgctcaggcggggaccatggcggacggcggctcggagcgggctgacgggcgcatcgtcaagatggaggtggactacagcgccacggtggatcagcgcctacccgagtgtgcgaagctagccaaggaaggaagacttcaagaagtcattgaaacccttctctctctggaaaagcagactcgtactgcttccgatatggtatcgacatcccgtatcttagttgcagtagtgaagatgtgctatgaggctaaagaatgggatttacttaatgaaaatattatgcttttgtccaaaaggcggagtcagttaaaacaagtgagttcatgatcatgtctgctccaaacacaaaagcatttgtatttcagaacttttcacaagctcttctataagtctgtttaaaatgtgttaagtcaacgttgtaacatcctagagggtgttttaaaattcagtctacattctcacaatg

SEQ ID NO: 372076 - DNA, 2746 bp, Homo sapiens
ggctgttctagaggatccctcataggtcgcaggcaggctctgaagagtgttgtactctatgttatcctggctccttttgacaatgaacagtcagatttggttcaccgaataagtggtgacaagaagttagaagaaattcccaaatacaaggatcttttaaagctttttaccacaatggagttgatgcgttggtccacacttgttgaggactatggaatggaattaagaaaaggttcccttgagagtcctgcaacggatgtttttggttctacagaggaaggtgaaaaaaggtggaaagacttgaagaacagagttgttgaacataatattagaataatggccaagtattatactcggataacaatgaaaaggatggcacagcttctggatctatctgttgatgagtccgaagcctttctctcaaatctagtagttaacaagaccatctttgctaaagtagacagattagcaggaattatcaacttccagagacccaaggatccaaataatttattaaatgactggtctcagaaactgaactcattaatgtctctggttaacaaaactacgcatctcatagccaaagaggagatgatacataatctacaataagggtcttagtgctttagaaaaaagttaaaattggaagtcattaaaaaaagactgttataatggtgtatatgttggggttttttttctaagcttctttgtcttaaattttaaaatagtgaatatgtttgagactccctttgacctttcagttccccaagttcattgttaactttgcatttgcaattggtgcaaaaatacagatttctgtcgtctgaatacacaaaaagttgtgtcataacttacccagatatgtttttctatcatttgaaacctttttagctactgtttgttttcattcaactaacaaacatattccaataataaaagcagtatatacatatttcctttctacagttacctctgattctcaacattttgtggggtagtgatttggcaagtgttttttaaataaaacaaatctcattgtaaagttatcagtcatttagtagaatagaaaagcaacatagagcatacaagaacatttgggatagagttgtgatttgtgaagaatttgtactttgatattgtggcggaaagtctagactgagtgtgtatgctggtaaactgtagacttttttttttttttttgagtccggctggttccaatcacagtagcttgattgctttcagccctcatcctctcacttgatcagttgttcaacagaatcagctgacataattgacacagtttattgggtgttaagtccgctctatagggatagtgactacttttttttttttttttttttttgctcttcttcctctcccctttctttatatgggtttaaatttaacataaagttgtttttataaggcttatttgtggctttaacttgtaagtctgattacatcattattgttccaaattcattatctctgtaggaacttttagttccattatatgaacactggataacctaattttttttaatgctttaaaaaaatggcaaaaagacgtcaggccaccctcatagtaagtggtgtagtattaaaatattttcacggaattaaaagtagcttgctgtcaaagaaacacctgagatgaattggtgtgaacgaattttgcaagtttaatttgatttatttcagagaaaatagaaaaaacaatgttagaaggttatttaaaatgatacttaaataaagaaagtgtgaggtctactttaaaaaaattcaaatgaagagaaaaagaaaaacagcattctagaaatggcatttctcctaattaattttccacttaatggaagattatcaattgtcctattttatgatcccaggactgaagacagttgtgggatatctgtcatatttatcctgtgagtcattgtgaataatgacatacagtactgaagtaatctgattttattctttggaaattcaatgcattggtcacactaataacatcaacatctgctatcacttatctttttaaaactaaccaaaaaaggctgggattacaggcatgagccactgcacccaactcctctttcgtctttctttaacacacactaggctctttgtgtattatgattcagtgctatttgtaactgtgtcccagtgaccaaattgcactcgactcgatcagctgttcatccatttcgtgttttttcctgtcaaacattaatccagcaaatatatgaggtatttaccaatttattttcttagtattacaaaataattcattagcataaagtacaatagtgaaatatttgagttgttcggaacctcaattaatcctgttttacatttcagacctaaagctggcaatcaggagaagaagcactttgttttaaatgtggagaagataacacttgattccatttcattgtcattagtgtattaaccagcaggagaggtgatgagccatttttcaaatgaaataccttttatttccatataatttttttattttagagttcaatagctgtttctatgattatcctcaatttccatatgttactgaatctgaaaaacatctttaaaattcaaacagttccattttctctcttgtaagtgttaaatgtgataaaagtacatattttaaattgttttcagctcttggatatagcagcaataaaaacactaatttgtgggtatttaagaaaacctggagaataaactcatactttaaaagatc

SEQ ID NO: 372077 - DNA, 246 bp, Homo sapiens
gaaggattacattcgaacacaaatcatcagcaagaaaattaacaccaaatttttccaggaagaaaatacagaggtgagcatatctgtgaccacatgtttactttaaaagtatgaataaaacccataaaccccaatttgttttgtcaacttttttgcagaaattaaagttgaagtactataatttaatgattcagctggatcaacatgagggatcctatttgtctatttgtaagcactacagagcaa

SEQ ID NO: 372078 - DNA, 543 bp, Homo sapiens
ttttttatttttgtatttttagtagagatggggtttcactgtgttagccaggatagcctcgatctgacctcaggagatctgcccaccttggcctcccaaagtgctgggattacagacgtgagccactgcgcccggccaagactttaaaatttgaaatggatatatagttattccatgattgttcagtttttgtcaaagtttccattatgtccagtcttgcatataacttgttgtacaactctttcaggctctgaagagtgttgtactctatgttatcctggctccttttgacaatgaacagtcagatttggttcaccgaataagtggtgacaagaagttagaagaaattcccaaatacaagtaagtacttttgaaattagcatgatatatctcagtcgaaacaccattttgaaagaaaattggctaacctaagtgtatacttctgtgtatgcttctttttttgagatggagttttactattgttgcccacactggagtgtaatggtgtaatctcagctcactgcaacttctgcctcctgggtt

SEQ ID NO: 372079 - DNA, 535 bp, Homo sapiens
tttgagacagtctcactctgttgttgaggctagagtgcagtggcctgatcatggctcactgtagccttgaactctggggctcaagtgatcctcctgtggcaccctcccaagtagctgggactaaaggtgcatgccaccacactcagctaatgttttgatttttagtagagacgggctcaacatgtttcccaggctggtctcaaactcctggactcaagcgatcctcctgcctcagccttccaaaatgtcaggattacaggtgtgagccaacatacccagcctactttttaaattttaacacgtttccatggaattttgattgtgtaaatttctcatttgtagatttatgttgaaattgagcgtgcgcgactgactaaaacattagcaactataaaagaacaaaatggtgatgtgaaagaggcagcctccattttacaggagttacaggtaaggtattgcattttagagttggtaaaactttgttttgtcagcagcattttctaatggaaatataggttgagtatcccttatccaa

SEQ ID NO: 372080 - DNA, 3651 bp, Homo sapiens
tcctttgcgtgggctcccgatgggctgcctgagcgggtgcgcgggcaacttccggtgtgggtgacgagtggtggccgaagcagggggacagcaagggacgctcaggcggggaccatggcggacggcggctcggagcgggctgacgggcgcatcgtcaagatggaggtggactacagcgccacggtggatcagcgcctacccgagtgtgcgaagctagccaaggaaggaagacttcaagaagtcattgaaacccttctctctctggaaaagcagactcgtactgcttccgatatggtatcgacatcccgtatcttagttgcagtagtgaagatgtgctatgaggctaaagaatgggatttacttaatgaaaatattatgcttttgtccaaaaggcggagtcagttaaaacaagctgttgccaaaatggttcaacagtgctgtacttatgttgaggaaatcacagaccttcctatcaaacttcgattaattgatactctacgaatggttaccgaaggcaagatttatgttgaaattgagcgtgcgcgactgactaaaacattagcaactataaaagaacaaaatggtgatgtgaaagaggcagcctccattttacaggagttacaggtggaaacctacgggtcaatggaaaagaaagagcgagtggaatttattttggagcaaatgaggctctgcctagctgtgaaggattacattcgaacacaaatcatcagcaagaaaattaacaccaaatttttccaggaagaaaatacagagaaattaaagttgaagtactataatttaatgattcagctggatcaacatgagggatcctatttgtctatttgtaagcactacagagcaatatatgatactccctgtatacaggcagaaagtgaaaaatggcagcaggctctgaagagtgttgtactctatgttatcctggctccttttgacaatgaacagtcagatttggttcaccgaataagtggtgacaagaagttagaagaaattcccaaatacaaatttggaatattaagatgtatacaattttcagggatcttttaaagctttttaccacaatggagttgatgcgttggtccacacttgttgaggactatggaatggaattaagaaaaggttcccttgagagtcctgcaacggatgtttttggttctacagaggaaggtgaaaaaaggtggaaagacttgaagaacagagttgttgaacataatattagaataatggccaagtattatactcggataacaatgaaaaggatggcacagcttctggatctatctgttgatgagtccgaagcctttctctcaaatctagtagttaacaagaccatctttgctaaagtagacagattagcaggaattatcaacttccagagacccaaggatccaaataatttattaaatgactggtctcagaaactgaactcattaatgtctctggttaacaaaactacgcatctcatagccaaagaggagatgatacataatctacaataagggtcttagtgctttagaaaaaagttaaaattggaagtcattaaaaaaagactgttataatggtgtatatgttggggttttttttctaagcttctttgtcttaaattttaaaatagtgaatatgtttgagactccctttgacctttcagttccccaagttcattgttaactttgcatttgcaattggtgcaaaaatacagatttctgtcgtctgaatacacaaaaagttgtgtcataacttacccagatatgtttttctatcatttgaaacctttttagctactgtttgttttcattcaactaacaaacatattccaataataaaagcagtatatacatatttcctttctacagttacctctgattctcaacattttgtggggtagtgatttggcaagtgttttttaaataaaacaaatctcattgtaaagttatcagtcatttagtagaatagaaaagcaacatagagcatacaagaacatttgggatagagttgtgatttgtgaagaatttgtactttgatattgtggcggaaagtctagactgagtgtgtatgctggtaaactgtagacttttttttttttttttgagtccggctggttccaatcacagtagcttgattgctttcagccctcatcctctcacttgatcagttgttcaacagaatcagctgacataattgacacagtttattgggtgttaagtccgctctatagggatagtgactacttttttttttttttttttttttgctcttcttcctctcccctttctttatatgggtttaaatttaacataaagttgtttttataaggcttatttgtggctttaacttgtaagtctgattacatcattattgttccaaattcattatctctgtaggaacttttagttccattatatgaacactggataacctaattttttttaatgctttaaaaaaatggcaaaaagacgtcaggccaccctcatagtaagtggtgtagtattaaaatattttcacggaattaaaagtagcttgctgtcaaagaaacacctgagatgaattggtgtgaacgaattttgcaagtttaatttgatttatttcagagaaaatagaaaaaacaatgttagaaggttatttaaaatgatacttaaataaagaaagtgtgaggtctactttaaaaaaattcaaatgaagagaaaaagaaaaacagcattctagaaatggcatttctcctaattaattttccacttaatggaagattatcaattgtcctattttatgatcccaggactgaagacagttgtgggatatctgtcatatttatcctgtgagtcattgtgaataatgacatacagtactgaagtaatctgattttattctttggaaattcaatgcattggtcacactaataacatcaacatctgctatcacttatctttttaaaactaaccaaaaaaggctgggattacaggcatgagccactgcacccaactcctctttcgtctttctttaacacacactaggctctttgtgtattatgattcagtgctatttgtaactgtgtcccagtgaccaaattgcactcgactcgatcagctgttcatccatttcgtgttttttcctgtcaaacattaatccagcaaatatatgaggtatttaccaatttattttcttagtattacaaaataattcattagcataaagtacaatagtgaaatatttgagttgttcggaacctcaattaatcctgttttacatttcagacctaaagctggcaatcaggagaagaagcactttgttttaaatgtggagaagataacacttgattccatttcattgtcattagtgtattaaccagcaggagaggtgatgagccatttttcaaatgaaataccttttatttccatataatttttttattttagagttcaatagctgtttctatgattatcctcaatttccatatgttactgaatctgaaaaacatctttaaaattcaaacagttccattttctctcttgtaagtgttaaatgtgataaaagtacatattttaaattgttttcagctcttggatatagcagcaataaaaacactaatttgtgggtatttaagaaaacctggagaataaactcatactttaaaagatc

SEQ ID NO: 372081 - DNA, 3427 bp, Homo sapiens
agctcggtaccccctgatatttctggccaggaaggaagacttcaagaagtcattgaaacccttctctctctggaaaagcagactcgtactgcttccgatatggtatcgacatcccgtatcttagttgcagtagtgaagatgtgctatgaggctaaagaatgggatttacttaatgaaaatattatgcttttgtccaaaaggcggagtcagttaaaacaagctgttgccaaaatggttcaacagtgctgtacttatgttgaggaaatcacagaccttcctatcaaacttcgattaattgatactctacgaatggttaccgaaggcaagatttatgttgaaattgagcgtgcgcgactgactaaaacattagcaactataaaagaacaaaatggtgatgtgaaagaggcagcctccattttacaggagttacaggtggaaacctacgggtcaatggaaaagaaagagcgagtggaatttattttggagcaaatgaggctctgcctagctgtgaaggattacattcgaacacaaatcatcagcaagaaaattaacaccaaatttttccaggaagaaaatacagagaaattaaagttgaagtactataatttaatgattcagctggatcaacatgagggatcctatttgtctatttgtaagcactacagagcaatatatgatactccctgtatacaggcagaaagtgaaaaatggcagcaggctctgaagagtgttgtactctatgttatcctggctccttttgacaatgaacagtcagatttggttcaccgaataagtggtgacaagaagttagaagaaattcccaaatacaaggatcttttaaagctttttaccacaatggagttgatgcgttggtccacacttgttgaggactatggaatggaattaagaaaaggttcccttgagagtcctgcaacggatgtttttggttctacagaggaaggtgaaaaaaggtggaaagacttgaagaacagagttgttgaacataatattagaataatggccaagtattatactcggataacaatgaaaaggatggcacagcttctggatctatctgttgatgagtccgaagcctttctctcaaatctagtagttaacaagaccatctttgctaaagtagacagattagcaggaattatcaacttccagagacccaaggatccaaataatttattaaatgactggtctcagaaactgaactcattaatgtctctggttaacaaaactacgcatctcatagccaaagaggagatgatacataatctacaataagggtcttagtgctttagaaaaaagttaaaattggaagtcattaaaaaaagactgttataatggtgtatatgttggggttttttttctaagcttctttgtcttaaattttaaaatagtgaatatgtttgagactccctttgacctttcagttccccaagttcattgttaactttgcatttgcaattggtgcaaaaatacagatttctgtcgtctgaatacacaaaaagttgtgtcataacttacccagatatgtttttctatcatttgaaacctttttagctactgtttgttttcattcaactaacaaacatattccaataataaaagcagtatatacatatttcctttctacagttacctctgattctcaacattttgtggggtagtgatttggcaagtgttttttaaataaaacaaatctcattgtaaagttatcagtcatttagtagaatagaaaagcaacatagagcatacaagaacatttgggatagagttgtgatttgtgaagaatttgtactttgatattgtggcggaaagtctagactgagtgtgtatgctggtaaactgtagacttttttttttttttttgagtccggctggttccaatcacagtagcttgattgctttcagccctcatcctctcacttgatcagttgttcaacagaatcagctgacataattgacacagtttattgggtgttaagtccgctctatagggatagtgactacttttttttttttttttttttttgctcttcttcctctcccctttctttatatgggtttaaatttaacataaagttgtttttataaggcttatttgtggctttaacttgtaagtctgattacatcattattgttccaaattcattatctctgtaggaacttttagttccattatatgaacactggataacctaattttttttaatgctttaaaaaaatggcaaaaagacgtcaggccaccctcatagtaagtggtgtagtattaaaatattttcacggaattaaaagtagcttgctgtcaaagaaacacctgagatgaattggtgtgaacgaattttgcaagtttaatttgatttatttcagagaaaatagaaaaaacaatgttagaaggttatttaaaatgatacttaaataaagaaagtgtgaggtctactttaaaaaaattcaaatgaagagaaaaagaaaaacagcattctagaaatggcatttctcctaattaattttccacttaatggaagattatcaattgtcctattttatgatcccaggactgaagacagttgtgggatatctgtcatatttatcctgtgagtcattgtgaataatgacatacagtactgaagtaatctgattttattctttggaaattcaatgcattggtcacactaataacatcaacatctgctatcacttatctttttaaaactaaccaaaaaaggctgggattacaggcatgagccactgcacccaactcctctttcgtctttctttaacacacactaggctctttgtgtattatgattcagtgctatttgtaactgtgtcccagtgaccaaattgcactcgactcgatcagctgttcatccatttcgtgttttttcctgtcaaacattaatccagcaaatatatgaggtatttaccaatttattttcttagtattacaaaataattcattagcataaagtacaatagtgaaatatttgagttgttcggaacctcaattaatcctgttttacatttcagacctaaagctggcaatcaggagaagaagcactttgttttaaatgtggagaagataacacttgattccatttcattgtcattagtgtattaaccagcaggagaggtgatgagccatttttcaaatgaaataccttttatttccatataatttttttattttagagttcaatagctgtttctatgattatcctcaatttccatatgttactgaatctgaaaaacatctttaaaattcaaacagttccattttctctcttgtaagtgttaaatgtgataaaagtacatattttaaattgttttcagctcttggatatagcagcaataaaaacactaatttgtgggtatttaagaaaacctggagaataaactcatactttaaaagatc

SEQ ID NO: 372082 - DNA, 307 bp, Homo sapiens
gcaatgagggagagtcaattccacccaagtcctatggaaagggctccccacagcagaggggttctgtccaccagtactggggggaaagggaaactacatgaacaaaaattgtaactactagagtctgtttccattctgctcatagaaaccagaattattttatttcatccttttgaagttaaatctgatggtatatcattctcctgcttcaaatcatttaatggctttctattgcttttaggataatattcaaactctctcagatggctcaaagtcctttatgctccaagccttgcctacatcccca

SEQ ID NO: 372083 - DNA, 127 bp, Homo sapiens
ctgcagagcgagcgggagcaggggcaatgccagctcagggcccagcaggagctgctgcagagcctgcagagggagaagcaaggcctggagcaggcgactacggacctgcggctaaccatcctggagc

SEQ ID NO: 372084 - DNA, 381 bp, Homo sapiens
gccacttctacctccattcctctttttccaaagatgttgcgattcctgcgacatgggaacacgcagctgctggtgaggaagaggtggcttcttaccacttaggtcaatgacagccacttcctccctttttaacaagcaggtacatctcctccccatcccccagcattgagtctagattcgcacaaattgttttgttactgttgcttgcacacaccagagaagaaaacagaagaaagaaggaacacagtgacccaggccccacctgtgctgaggggctgctggcctctgcgggtgagttcctggtgtgtctccttcccccaaatccctcccgggtctggctgctctaagcacgtgtgtgctcacaggcaggtacttgtgggc

SEQ ID NO: 372085 - DNA, 2509 bp, Homo sapiens
ggcacgaggctgcggccgccagctcccgcgaccgcctctcctgcccctcgccggtacctcagcaaggtgccactagaagcgccaggctggggccgcctctgagcgccccgcgggggccatggatggtgaaacagcagaggagcaggggggccctgtgcccccgccagttgcacccggcggacccggcttgggcggtgctccgggggggcggcgggagcccaagaagtacgcagtgaccgacgactaccagttgtccaagcaggtgctgggcctgggtgtgaacggcaaagtgctggagtgcttccatcggcgcactggacagaagtgtgccctgaagctcctgtatgacagccccaaggcccggcaggaggtagaccatcactggcaggcttctggcggcccccatattgtctgcatcctggatgtgtatgagaacatgcaccatggcaagcgctgtctcctcatcatcatggaatgcatggaaggtggtgagttgttcagcaggattcaggagcgtggcgaccaggctttcactgagagagaagctgcagagataatgcgggatattggcactgccatccagtttctgcacagccataacattgcccaccgagatgtcaagcctgaaaacctactctacacatctaaggagaaagacgcagtgcttaagctcaccgattttggctttgctaaggagaccacccaaaatgccctgcagacaccctgctatactccctattatgtggcccctgaggtcctgggtccagagaagtatgacaagtcatgtgacatgtggtccctgggtgtcatcatgtacatcctcctttgtggcttcccacccttctactccaacacgggccaggccatctccccggggatgaagaggaggattcgcctgggccagtacggcttccccaatcctgagtggtcagaagtctctgaggatgccaagcagctgatccgcctcctgttgaagacagaccccacagagaggctgaccatcactcagttcatgaaccacccctggatcaaccaatcgatggtagtgccacagaccccactccacacggcccgagtgctgcaggaggacaaagaccactgggacgaagtcaaggaggagatgaccagtgccttggccactatgcgggtagactacgaccaggtgaagatcaaggacctgaagacctctaacaaccggctcctcaacaagaggagaaaaaagcaggcaggcagctcctctgcctcacagggctgcaacaaccagtagctcatggggccttggaggagcctggcctctcagcctgcataacagactgaaatgtgctcaggccctggccaggagggcccagggtcattcttttaacaaaaggattattttgttgtgttttaatttgtcactcggaacttcaggatggaggaccctgaccctaagcctccttcagatctctggcccaggctcaagccctagagatgggcagggcctaggggctgggagctgcctgctgccatagcagcacctttagctaggttggcccgagtgaggcctctgtgctgtcctgccctggtgcatggccttagctttctaggccactgggagttgtggctgggcttcccatcttccacagagacatctccctgtgggatgggcagatgggcctggccttgagaaaggcattggccattggttgccatggtgaccagggaccacgttgctgcctgtgaatgctgagtgagcgagtaagggaggaggggcgattgagggttcacctctgccttggggaggctgatttctcacacactggctggccctctcattctcactcctccttgggccctgaggctgctggatccagtctgcctgcctccctgtgcagtccagccctgccttgctgcagccccagcccagatggcactcagcgctctcccctgagggagtccctgggcctagccatcccctcactattcccgacccaaagggtgacttttcatctgaacttaaggtgggagatatttttaacttttttccactttggaaaatgtcactgtgacaaaagccagcatactttccctgcacccatctgctcaccagatctcaggcaggaaagcccctctctgttgaagtcaggggctatcttttggtatacttgtgtgaaagtggctggttgggagcagagctaagtggcttcccattaacctgaggtctctttctttactctgggtcagacctgaggttggggaaggcgactgagccatgctcagaatgtctggtcctggcttgggcctgagtagggcagagagggcctttcatggctgatcagagcttaccagccccaccccaccatggtagccttagggtgctgagtgcctgatactgcctgacaagtgcctgacacgcagcctagttccttcctggcccctctctcactggctgggaaaccctagaccatgtcagataggacaacactgctgggttttacatccagatagtaataaacaccatttcatcatt

SEQ ID NO: 372086 - DNA, 2518 bp, Homo sapiens
ccggctggtacggcccgagatttatggatagctcccgcgaccgcctctcctgcccctcgccggtacctcagcaaggtgccactagaagcgccaggctggggccgcctctgagcgccccgcgggggccatggatggtgaaacagcagaggagcaggggggccctgtgcccccgccagttgcacccggcggacccggcttgggcggtgctccgggggggcggcgggagcccaagaagtacgcagtgaccgacgactaccagttgtccaagcaggtgctgggcctgggtgtgaacggcaaagtgctggagtgcttccatcggcgcactggacagaagtgtgccctgaagctcctgtatgacagccccaaggcccggcaggaggtagaccatcactggcaggcttctggcggcccccatattgtctgcatcctggatgtgtatgagaacatgcaccatggcaagcgctgtctcctcatcatcatggaatgcatggaaggtggtgagttgttcagcaggattcaggagcgtggcgaccaggctttcactgagagagaagctgcagagataatgcgggatattggcactgccatccagtttctgcacagccataacattgcccaccgagatgtcaagcctgaaaacctactctacacatctaaggagaaagacgcagtgcttaagctcaccgattttggctttgctaaggagaccacccaaaatgccctgcagacaccctgctatactccctattatgtggcccctgaggtcctgggtccagagaagtatgacaagtcatgtgacatgtggtccctgggtgtcatcatgtacatcctcctttgtggcttcccacccttctactccaacacgggccaggccatctccccggggatgaagaggaggattcgcctgggccagtacggcttccccaatcctgagtggtcagaagtctctgaggatgccaagcagctgatccgcctcctgttgaagacagaccccacagagaggctgaccatcactcagttcatgaaccacccctggatcaaccaatcgatggtagtgccacagaccccactccacacggcccgagtgctgcaggaggacaaagaccactgggacgaagtcaaggaggagatgaccagtgccttggccactatgcgggtagactacgaccaggtgaagatcaaggacctgaagacctctaacaaccggctcctcaacaagaggagaaaaaagcaggcaggcagctcctctgcctcacagggctgcaacaaccagtagctcatggggccttggaggagcctggcctctcagcctgcataacagactgaaatgtgctcaggccctggccaggagggcccagggtcattcttttaacaaaaggattattttgttgtgttttaatttgtcactcggaacttcaggatggaggaccctgaccctaagcctccttcagatctctggcccaggctcaagccctagagatgggcagggcctaggggctgggagctgcctgctgccatagcagcacctttagctaggttggcccgagtgaggcctctgtgctgtcctgccctggtgcatggccttagctttctaggccactgggagttgtggctgggcttcccatcttccacagagacatctccctgtgggatgggcagatgggcctggccttgagaaaggcattggccattggttgccatggtgaccagggaccacgttgctgcctgtgaatgctgagtgagcgagtaagggaggaggggcgattgagggttcacctctgccttggggaggctgatttctcacacactggctggccctctcattctcactcctccttgggccctgaggctgctggatccagtctgcctgcctccctgtgcagtccagccctgccttgctgcagccccagcccagatggcactcagcgctctcccctgagggagtccctgggcctagccatcccctcactattcccgacccaaagggtgacttttcatctgaacttaaggtgggagatatttttaacttttttccactttggaaaatgtcactgtgacaaaagccagcatactttccctgcacccatctgctcaccagatctcaggcaggaaagcccctctctgttgaagtcaggggctatcttttggtatacttgtgtgaaagtggctggttgggagcagagctaagtggcttcccattaacctgaggtctctttctttactctgggtcagacctgaggttggggaaggcgactgagccatgctcagaatgtctggtcctggcttgggcctgagtagggcagagagggcctttcatggctgatcagagcttaccagccccaccccaccatggtagccttagggtgctgagtgcctgatactgcctgacaagtgcctgacacgcagcctagttccttcctggcccctctctcactggctgggaaaccctagaccatgtcagataggacaacactgctgggttttacatccagatagtaataaacaccatttcatcatt

SEQ ID NO: 372087 - DNA, 2910 bp, Homo sapiens
ggcacgaggctgcggccgccagctcccgcgaccgcctctcctgcccctcgccggtacctcagcaaggtgccactagaagcgccaggctggggccgcctctgagcgccccgcgggggccatggatggtgaaacagcagaggagcaggggggccctgtgcccccgccagttgcacccggcggacccggcttgggcggtgctccgggggggcggcgggagcccaagaagtacgcagtgaccgacgactaccagttgtccaagcaggtgctgggcctgggtgtgaacggcaaagtgctggagtgcttccatcggcgcactggacagaagtgtgccctgaagctcctgtatgacagccccaaggcccggcaggaggtagaccatcactggcaggcttctggcggcccccatattgtctgcatcctggatgtgtatgagaacatgcaccatggcaagcgctgtctcctcatcatcatggaatgcatggaaggtggtgagttgttcagcaggattcaggagcgtggcgaccaggctttcactgagagagaagctgcagagataatgcgggatattggcactgccatccagtttctgcacagccataacattgcccaccgagatgtcaagcctgaaaacctactctacacatctaaggagaaagacgcagtgcttaagctcaccgattttggctttgctaaggagaccacccaaaatgccctgcagacaccctgctatactccctattatgtggcccctgaggtcctgggtccagagaagtatgacaagtcatgtgacatgtggtccctgggtgtcatcatgtacatcctcctttgtggcttcccacccttctactccaacacgggccaggccatctccccggggatgaagaggaggattcgcctgggccagtacggcttccccaatcctgagtggtcagaagtctctgaggatgccaagcagctgatccgcctcctgttgaagacagaccccacagagaggctgaccatcactcagttcatgaaccacccctggatcaaccaatcgatggtagtgccacagaccccactccacacggcccgagtgctgcaggaggacaaagaccactgggacgaagtcaaggaggagatgaccagtgccttggccactatgcgggtagactacgaccaggtgaagatcaaggacctgaagacctctaacaaccggctcctcaacaagaggagaaaaaagcaggcaggcagctcctctgcctcacagggctgcaacaaccagtagctcatggggccttggaggagcctggcctctcagcctgcataacagactgaaatgtgctcaggccctggccaggagggcccagggtcattcttttaacaaaaggattattttgttgtgttttaatttgtcactcggaacttcaggatggaggaccctgaccctaagcctccttcagatctctggcccaggctcaagccctagagatgggcagggcctaggggctgggagctgcctgctgccatagcagcacctttagctaggttggcccgagtgaggcctctgtgctgtcctgccctggtgcatggccttagctttctaggccactgggagttgtggctgggcttcccatcttccacagagacatctccctgtgggatgggcagatgggcctggccttgagaaaggcattggccattggttgccatggtgaccagggaccacgttgctgcctgtgaatgctgagtgagcgagtaagggaggaggggcgattgagggttcacctctgccttggggaggctgatttctcacacactggctggccctctcattctcactcctccttgggccctgaggctgctggatccagtctgcctgcctccctgtgcagtccagccctgccttgctgcagccccagcccagatggcactcagcgctctcccctgagggagtccctgggcctagccatcccctcactattcccgacccaaagggtgacttttcatctgaacttaaggtgggagatatttttaacttttttccactttggaaaatgtcactgtgacaaaagccagcatactttccctgcacccatctgctcaccagatctcaggcaggaaagcccctctctgttgaagtcaggggctatcttttggtatacttgtgtgaaagtggctggttgggagcagagctaagtggcttcccattaacctgaggtctctttctttactctgggtcagacctgaggttggggaaggcgactgagccatgctcagaatgtctggtcctggcttgggcctgagtagggcagagagggcctttcatggctgatcagagcttaccagccccaccccaccatggtagccttagggtgctgagtgcctgatactgcctgacaagtgcctgacacgcagcctagttccttcctggcccctctctcactggctgggaaaccctagaccatgtcagataggacaacactgctgggttttacatccagatagtaataaacaccatttcatcattttctcttggctcctgggtttactctttgtctacaggggtggacaaaggtggcccaagggcagcttctcagacccactagtgatttcaccccagctggagggggtgcctcaggcctgataagcatgccatgctaactccaaggccagagtcctcgccaggcctagaaaggtcagaagagctgagggatggcagctgccacatgcccccagctctgtgctgcccctgtgcagtgtgtgtgacacctacccccggtcctgtgtgtgccagcatctgcccagagtggccacccccagctgtgtgccagcctgctgaagggcgggcagagtgcctgctgcagcgctgagctattttcagaaactgccagatttcatttggcagtgagaatatcgaggaggggaggg

SEQ ID NO: 372088 - DNA, 2555 bp, Homo sapiens
cctacccctctcccccccccctccccccactacagtctgtatgtcggggttctggccgagggcggcgcagctcttagacgcctctctgcccctcgccggtacctcagcaatggtgccactagaagcgccaggctggggccgcctctgagcgccccgcgggggccatggatggtgaaacagcagaggagcaggggggccctgtgcccccgccagttgcacccggcggacccggcttgggcggtgctccgggggggcggcgggagcccaagaagtacgcagtgaccgacgactaccagttgtccaagcaggtgctgggcctgggtgtgaacggcaaagtgctggagtgcttccatcggcgcactggacagaagtgtgccctgaagctcctgtatgacagccccaaggcccggcaggaggtagaccatcactggcaggcttctggcggcccccatattgtctgcatcctggatgtgtatgagaacatgcaccatggcaagcgctgtctcctcatcatcatggaatgcatggaaggtggtgagttgttcagcaggattcaggagcgtggcgaccaggctttcactgagagagaagctgcagagataatgcgggatattggcactgccatccagtttctgcacagccataacattgcccaccgagatgtcaagcctgaaaacctactctacacatctaaggagaaagacgcagtgcttaagctcaccgattttggctttgctaaggagaccacccaaaatgccctgcagacaccctgctatactccctattatgtggcccctgaggtcctgggtccagagaagtatgacaagtcatgtgacatgtggtccctgggtgtcatcatgtacatcctcctttgtggcttcccacccttctactccaacacgggccaggccatctccccggggatgaagaggaggattcgcctgggccagtacggcttccccaatcctgagtggtcagaagtctctgaggatgccaagcagctgatccgcctcctgttgaagacagaccccacagagaggctgaccatcactcagttcatgaaccacccctggatcaaccaatcgatggtagtgccacagaccccactccacacggcccgagtgctgcaggaggacaaagaccactgggacgaagtcaaggaggagatgaccagtgccttggccactatgcgggtagactacgaccaggtgaagatcaaggacctgaagacctctaacaaccggctcctcaacaagaggagaaaaaagcaggcaggcagctcctctgcctcacagggctgcaacaaccagtagctcatggggccttggaggagcctggcctctcagcctgcataacagactgaaatgtgctcaggccctggccaggagggcccagggtcattcttttaacaaaaggattattttgttgtgttttaatttgtcactcggaacttcaggatggaggaccctgaccctaagcctccttcagatctctggcccaggctcaagccctagagatgggcagggcctaggggctgggagctgcctgctgccatagcagcacctttagctaggttggcccgagtgaggcctctgtgctgtcctgccctggtgcatggccttagctttctaggccactgggagttgtggctgggcttcccatcttccacagagacatctccctgtgggatgggcagatgggcctggccttgagaaaggcattggccattggttgccatggtgaccagggaccacgttgctgcctgtgaatgctgagtgagcgagtaagggaggaggggcgattgagggttcacctctgccttggggaggctgatttctcacacactggctggccctctcattctcactcctccttgggccctgaggctgctggatccagtctgcctgcctccctgtgcagtccagccctgccttgctgcagccccagcccagatggcactcagcgctctcccctgagggagtccctgggcctagccatcccctcactattcccgacccaaagggtgacttttcatctgaacttaaggtgggagatatttttaacttttttccactttggaaaatgtcactgtgacaaaagccagcatactttccctgcacccatctgctcaccagatctcaggcaggaaagcccctctctgttgaagtcaggggctatcttttggtatacttgtgtgaaagtggctggttgggagcagagctaagtggcttcccattaacctgaggtctctttctttactctgggtcagacctgaggttggggaaggcgactgagccatgctcagaatgtctggtcctggcttgggcctgagtagggcagagagggcctttcatggctgatcagagcttaccagccccaccccaccatggtagccttagggtgctgagtgcctgatactgcctgacaagtgcctgacacgcagcctagttccttcctggcccctctctcactggctgggaaaccctagaccatgtcagataggacaacactgctgggttttacatccagatagtaataaacaccatttcatcatt

SEQ ID NO: 372089 - DNA, 2992 bp, Homo sapiens
accgcgggctgagcggtggggcccgggcggggtgcgggggccccgtcgccgggtctggggccctgagcagtgaaaggaaatactttgacagatttccaagaactttccaggaaaacggggcggggccccgcgagctgaccaatcgcgacgctgaaggtggagccgtgcggtcggggagggccaatagcagcgcgtggacccggggctgaagctacccagaggggcagggagtacttgctgcatttgatcctctacaactggtgttgctcccgttatgcggacagaagacagccccagggaacaaatgctaggaaatggcagggtgagaaaactgaggcatggagaggttacaatataacttagatctcccagctggcaagtaatggtttaagccaggagcctacacacttcctcctacttcctctatgggtgctggtgatctgccgactcctagacatccagctttaaggtcctcagtgaagcttctctgcccccaggcctgtccatgtcagagcaccatgggtgtccctttgaaagtatctcctacaggtgccactagaagcgccaggctggggccgcctctgagcgccccgcgggggccatggatggtgaaacagcagaggagcaggggggccctgtgcccccgccagttgcacccggcggacccggcttgggcggtgctccgggggggcggcgggagcccaagaagtacgcagtgaccgacgactaccagttgtccaagcaggtgctgggcctgggtgtgaacggcaaagtgctggagtgcttccatcggcgcactggacagaagtgtgccctgaagctcctgtatgacagccccaaggcccggcaggaggtagaccatcactggcaggcttctggcggcccccatattgtctgcatcctggatgtgtatgagaacatgcaccatggcaagcgctgtctcctcatcatcatggaatgcatggaaggtggtgagttgttcagcaggattcaggagcgtggcgaccaggctttcactgagagagaagctgcagagataatgcgggatattggcactgccatccagtttctgcacagccataacattgcccaccgagatgtcaagcctgaaaacctactctacacatctaaggagaaagacgcagtgcttaagctcaccgattttggctttgctaaggagaccacccaaaatgccctgcagacaccctgctatactccctattatgtggcccctgaggtcctgggtccagagaagtatgacaagtcatgtgacatgtggtccctgggtgtcatcatgtacatcctcctttgtggcttcccacccttctactccaacacgggccaggccatctccccggggatgaagaggaggattcgcctgggccagtacggcttccccaatcctgagtggtcagaagtctctgaggatgccaagcagctgatccgcctcctgttgaagacagaccccacagagaggctgaccatcactcagttcatgaaccacccctggatcaaccaatcgatggtagtgccacagaccccactccacacggcccgagtgctgcaggaggacaaagaccactgggacgaagtcaaggaggagatgaccagtgccttggccactatgcgggtagactacgaccaggtgaagatcaaggacctgaagacctctaacaaccggctcctcaacaagaggagaaaaaagcaggcaggcagctcctctgcctcacagggctgcaacaaccagtagctcatggggccttggaggagcctggcctctcagcctgcataacagactgaaatgtgctcaggccctggccaggagggcccagggtcattcttttaacaaaaggattattttgttgtgttttaatttgtcactcggaacttcaggatggaggaccctgaccctaagcctccttcagatctctggcccaggctcaagccctagagatgggcagggcctaggggctgggagctgcctgctgccatagcagcacctttagctaggttggcccgagtgaggcctctgtgctgtcctgccctggtgcatggccttagctttctaggccactgggagttgtggctgggcttcccatcttccacagagacatctccctgtgggatgggcagatgggcctggccttgagaaaggcattggccattggttgccatggtgaccagggaccacgttgctgcctgtgaatgctgagtgagcgagtaagggaggaggggcgattgagggttcacctctgccttggggaggctgatttctcacacactggctggccctctcattctcactcctccttgggccctgaggctgctggatccagtctgcctgcctccctgtgcagtccagccctgccttgctgcagccccagcccagatggcactcagcgctctcccctgagggagtccctgggcctagccatcccctcactattcccgacccaaagggtgacttttcatctgaacttaaggtgggagatatttttaacttttttccactttggaaaatgtcactgtgacaaaagccagcatactttccctgcacccatctgctcaccagatctcaggcaggaaagcccctctctgttgaagtcaggggctatcttttggtatacttgtgtgaaagtggctggttgggagcagagctaagtggcttcccattaacctgaggtctctttctttactctgggtcagacctgaggttggggaaggcgactgagccatgctcagaatgtctggtcctggcttgggcctgagtagggcagagagggcctttcatggctgatcagagcttaccagccccaccccaccatggtagccttagggtgctgagtgcctgatactgcctgacaagtgcctgacacgcagcctagttccttcctggcccctctctcactggctgggaaaccctagaccatgtcagataggacaacactgctgggttttacatccagatagtaataaacaccatttcatcatt

SEQ ID NO: 372090 - DNA, 2428 bp, Homo sapiens
ggcacgaggctgcggccgccagctcccgcgaccgcctctcctgcccctcgccggtacctcagcaaggtgccactagaagcgccaggctggggccgcctctgagcgccccgcgggggccatggatggtgaaacagcagaggagcaggggggccctgtgcccccgccagttgcacccggcggacccggcttgggcggtgctccgggggggcggcgggagcccaagaagtacgcagtgaccgacgactaccagttgtccaagcaggtgctgggcctgggtgtgaacggcaaagtgctggagtgcttccatcggcgcactggacagaagtgtgccctgaagctcctgtatgacagccccaaggcccggcaggaggtagaccatcactggcaggcttctggcggcccccatattgtctgcatcctggatgtgtatgagaacatgcaccatggcaagcgctgtctcctcatcatcatggaatgcatggaaggtggtgagttgttcagcaggattcaggagcgtggcgaccaggctttcactgagagagaagctgcagagataatgcgggatattggcactgccatccagtttctgcacagccataacattgcccaccgagatgtcaagcctgaaaacctactctacacatctaaggagaaagacgcagtgcttaagctcaccgattttggctttgctaaggagaccacccaaaatgccctgcagacaccctgctatactccctattatgtggcccctgaggtcctgggtccagagaagtatgacaagtcatgtgacatgtggtccctgggtgtcatcatgtacatcctcctttgtggcttcccacccttctactccaacacgggccaggccatctccccggggatgaagaggaggattcgcctgggccagtacggcttccccaatcctgagtggtcagaagtctctgaggatgccaagcagctgatccgcctcctgttgaagacagaccccacagagaggctgaccatcactcagttcatgaaccacccctggatcaacgaggagatgaccagtgccttggccactatgcgggtagactacgaccaggtgaagatcaaggacctgaagacctctaacaaccggctcctcaacaagaggagaaaaaagcaggcaggcagctcctctgcctcacagggctgcaacaaccagtagctcatggggccttggaggagcctggcctctcagcctgcataacagactgaaatgtgctcaggccctggccaggagggcccagggtcattcttttaacaaaaggattattttgttgtgttttaatttgtcactcggaacttcaggatggaggaccctgaccctaagcctccttcagatctctggcccaggctcaagccctagagatgggcagggcctaggggctgggagctgcctgctgccatagcagcacctttagctaggttggcccgagtgaggcctctgtgctgtcctgccctggtgcatggccttagctttctaggccactgggagttgtggctgggcttcccatcttccacagagacatctccctgtgggatgggcagatgggcctggccttgagaaaggcattggccattggttgccatggtgaccagggaccacgttgctgcctgtgaatgctgagtgagcgagtaagggaggaggggcgattgagggttcacctctgccttggggaggctgatttctcacacactggctggccctctcattctcactcctccttgggccctgaggctgctggatccagtctgcctgcctccctgtgcagtccagccctgccttgctgcagccccagcccagatggcactcagcgctctcccctgagggagtccctgggcctagccatcccctcactattcccgacccaaagggtgacttttcatctgaacttaaggtgggagatatttttaacttttttccactttggaaaatgtcactgtgacaaaagccagcatactttccctgcacccatctgctcaccagatctcaggcaggaaagcccctctctgttgaagtcaggggctatcttttggtatacttgtgtgaaagtggctggttgggagcagagctaagtggcttcccattaacctgaggtctctttctttactctgggtcagacctgaggttggggaaggcgactgagccatgctcagaatgtctggtcctggcttgggcctgagtagggcagagagggcctttcatggctgatcagagcttaccagccccaccccaccatggtagccttagggtgctgagtgcctgatactgcctgacaagtgcctgacacgcagcctagttccttcctggcccctctctcactggctgggaaaccctagaccatgtcagataggacaacactgctgggttttacatccagatagtaataaacaccatttcatcatt

SEQ ID NO: 372091 - DNA, 2050 bp, Homo sapiens
gtcatagctgactctagaggatacacccgcggcgagttcatgcaggattcaggagcgtggcgaccaggctttcactgagagagaagctgcagagataatgcgggatattggcactgccatccagtttctgcacagccataacattgcccaccgagatgtcaagcctgaaaacctactctacacatctaaggagaaagacgcagtgcttaagctcaccgattttggctttgctaaggagaccacccaaaatgccctgcagacaccctgctatactccctattatgtggcccctgaggtcctgggtccagagaagtatgacaagtcatgtgacatgtggtccctgggtgtcatcatgtacatcctcctttgtggcttcccacccttctactccaacacgggccaggccatctccccggggatgaagaggaggattcgcctgggccagtacggcttccccaatcctgagtggtcagaagtctctgaggatgccaagcagctgatccgcctcctgttgaagacagaccccacagagaggctgaccatcactcagttcatgaaccacccctggatcaaccaatcgatggtagtgccacagaccccactccacacggcccgagtgctgcaggaggacaaagaccactgggacgaagtcaaggaggagatgaccagtgccttggccactatgcgggtagactacgaccaggtgaagatcaaggacctgaagacctctaacaaccggctcctcaacaagaggagaaaaaagcaggcaggcagctcctctgcctcacagggctgcaacaaccagtagctcatggggccttggaggagcctggcctctcagcctgcataacagactgaaatgtgctcaggccctggccaggagggcccagggtcattcttttaacaaaaggattattttgttgtgttttaatttgtcactcggaacttcaggatggaggaccctgaccctaagcctccttcagatctctggcccaggctcaagccctagagatgggcagggcctaggggctgggagctgcctgctgccatagcagcacctttagctaggttggcccgagtgaggcctctgtgctgtcctgccctggtgcatggccttagctttctaggccactgggagttgtggctgggcttcccatcttccacagagacatctccctgtgggatgggcagatgggcctggccttgagaaaggcattggccattggttgccatggtgaccagggaccacgttgctgcctgtgaatgctgagtgagcgagtaagggaggaggggcgattgagggttcacctctgccttggggaggctgatttctcacacactggctggccctctcattctcactcctccttgggccctgaggctgctggatccagtctgcctgcctccctgtgcagtccagccctgccttgctgcagccccagcccagatggcactcagcgctctcccctgagggagtccctgggcctagccatcccctcactattcccgacccaaagggtgacttttcatctgaacttaaggtgggagatatttttaacttttttccactttggaaaatgtcactgtgacaaaagccagcatactttccctgcacccatctgctcaccagatctcaggcaggaaagcccctctctgttgaagtcaggggctatcttttggtatacttgtgtgaaagtggctggttgggagcagagctaagtggcttcccattaacctgaggtctctttctttactctgggtcagacctgaggttggggaaggcgactgagccatgctcagaatgtctggtcctggcttgggcctgagtagggcagagagggcctttcatggctgatcagagcttaccagccccaccccaccatggtagccttagggtgctgagtgcctgatactgcctgacaagtgcctgacacgcagcctagttccttcctggcccctctctcactggctgggaaaccctagaccatgtcagataggacaacactgctgggttttacatccagatagtaataaacaccatttcatcatt

SEQ ID NO: 372092 - DNA, 1818 bp, Homo sapiens
ggactaggcagatcagtctgctgctccctgtgcagtcagcctgcctattatgtggcccctgaggtcctgggtccagagaagtatgacaagtcatgtgacatgtggtccctgggtgtcatcatgtacatcctcctttgtggcttcccacccttctactccaacacgggccaggccatctccccggggatgaagaggaggattcgcctgggccagtacggcttccccaatcctgagtggtcagaagtctctgaggatgccaagcagctgatccgcctcctgttgaagacagaccccacagagaggctgaccatcactcagttcatgaaccacccctggatcaaccaatcgatggtagtgccacagaccccactccacacggcccgagtgctgcaggaggacaaagaccactgggacgaagtcaaggaggagatgaccagtgccttggccactatgcgggtagactacgaccaggtgaagatcaaggacctgaagacctctaacaaccggctcctcaacaagaggagaaaaaagcaggcaggcagctcctctgcctcacagggctgcaacaaccagtagctcatggggccttggaggagcctggcctctcagcctgcataacagactgaaatgtgctcaggccctggccaggagggcccagggtcattcttttaacaaaaggattattttgttgtgttttaatttgtcactcggaacttcaggatggaggaccctgaccctaagcctccttcagatctctggcccaggctcaagccctagagatgggcagggcctaggggctgggagctgcctgctgccatagcagcacctttagctaggttggcccgagtgaggcctctgtgctgtcctgccctggtgcatggccttagctttctaggccactgggagttgtggctgggcttcccatcttccacagagacatctccctgtgggatgggcagatgggcctggccttgagaaaggcattggccattggttgccatggtgaccagggaccacgttgctgcctgtgaatgctgagtgagcgagtaagggaggaggggcgattgagggttcacctctgccttggggaggctgatttctcacacactggctggccctctcattctcactcctccttgggccctgaggctgctggatccagtctgcctgcctccctgtgcagtccagccctgccttgctgcagccccagcccagatggcactcagcgctctcccctgagggagtccctgggcctagccatcccctcactattcccgacccaaagggtgacttttcatctgaacttaaggtgggagatatttttaacttttttccactttggaaaatgtcactgtgacaaaagccagcatactttccctgcacccatctgctcaccagatctcaggcaggaaagcccctctctgttgaagtcaggggctatcttttggtatacttgtgtgaaagtggctggttgggagcagagctaagtggcttcccattaacctgaggtctctttctttactctgggtcagacctgaggttggggaaggcgactgagccatgctcagaatgtctggtcctggcttgggcctgagtagggcagagagggcctttcatggctgatcagagcttaccagccccaccccaccatggtagccttagggtgctgagtgcctgatactgcctgacaagtgcctgacacgcagcctagttccttcctggcccctctctcactggctgggaaaccctagaccatgtcagataggacaacactgctgggttttacatccagatagtaataaacaccatttcatcatt

SEQ ID NO: 372093 - DNA, 988 bp, Homo sapiens
ggcacgaggctgcggccgccagctcccgcgaccgcctctcctgcccctcgccggtacctcagcaaggtgccactagaagcgccaggctggggccgcctctgagcgccccgcgggggccatggatggtgaaacagcagaggagcaggggggccctgtgcccccgccagttgcacccggcggacccggcttgggcggtgctccgggggggcggcgggagcccaagaagtacgcagtgaccgacgactaccagttgtccaagcaggtgctgggcctgggtgtgaacggcaaagtgctggagtgcttccatcggcgcactggacagaagtgtgccctgaagctcctgtatgacagccccaaggcccggcaggaggtagaccatcactggcaggcttctggcggcccccatattgtctgcatcctggatgtgtatgagaacatgcaccatggcaagcgctgtctcctcatcatcatggaatgcatggaaggtggtgagttgttcagcaggattcaggagcgtggcgaccaggctttcactgagagagaagctgcagagataatgcgggatattggcactgccatccagtttctgcacagccataacattgcccaccgagatgtcaagcctgaaaacctactctacacatctaaggagaaagacgcagtgcttaagctcaccgattttggctttgctaaggagaccacccaaaatgccctgcagacaccctgctatactccctattatgtggcccctgaggtcctgggtccagagaagtatgacaagtcatgtgacatgtggtccctgggtgtcatcatgtacatcctcctttgtggcttcccacccttctactccaacacgggccaggccatctccccggggatgaagaggaggattcgcctgggccagtacggcttccccaatcctgagtggtcagaagtctctgaggatgtgcctgagtgaacctctctgtcccagcctgactcacctggc

SEQ ID NO: 372094 - DNA, 1017 bp, Homo sapiens
ggcacgaggctgcggccgccagctcccgcgaccgcctctcctgcccctcgccggtacctcagcaaggtgccactagaagcgccaggctggggccgcctctgagcgccccgcgggggccatggatggtgaaacagcagaggagcaggggggccctgtgcccccgccagttgcacccggcggacccggcttgggcggtgctccgggggggcggcgggagcccaagaagtacgcagtgaccgacgactaccagttgtccaagcaggtgctgggcctgggtgtgaacggcaaagtgctggagtgcttccatcggcgcactggacagaagtgtgccctgaagctcctgtatgacagccccaaggcccggcaggaggtagaccatcactggcaggcttctggcggcccccatattgtctgcatcctggatgtgtatgagaacatgcaccatggcaagcgctgtctcctcatcatcatggaatgcatggaaggtggtgagttgttcagcaggattcaggagcgtggcgaccaggctttcactgagagagaagctgcagagataatgcgggatattggcactgccatccagtttctgcacagccataacattgcccaccgagatgtcaagcctgaaaacctactctacacatctaaggagaaagacgcagtgcttaagctcaccgattttggctttgctaaggagaccacccaaaatgccctgcagacaccctgctatactccctattatgtggcccctgaggtcctgggtccagagaagtatgacaagtcatgtgacatgtggtccctgggtgtcatcatgtacatcctcctttgtggcttcccacccttctactccaacacgggccaggccatctccccggggatgaagaggaggattcgcctgggccagtacggcttccccaatcctgagtggtcagaagtctctgaggatgccagtcgcgccgtggtagatgtactgcgtagcgggctgcgcgggacgcttgcagaatgtcgacgtcgcta

SEQ ID NO: 372095 - DNA, 1000 bp, Homo sapiens
ggcacgaggctgcggccgccagctcccgcgaccgcctctcctgcccctcgccggtacctcagcaaggtgccactagaagcgccaggctggggccgcctctgagcgccccgcgggggccatggatggtgaaacagcagaggagcaggggggccctgtgcccccgccagttgcacccggcggacccggcttgggcggtgctccgggggggcggcgggagcccaagaagtacgcagtgaccgacgactaccagttgtccaagcaggtgctgggcctgggtgtgaacggcaaagtgctggagtgcttccatcggcgcactggacagaagtgtgccctgaagctcctgtatgacagccccaaggcccggcaggaggtagaccatcactggcaggcttctggcggcccccatattgtctgcatcctggatgtgtatgagaacatgcaccatggcaagcgctgtctcctcatcatcatggaatgcatggaaggtggtgagttgttcagcaggattcaggagcgtggcgaccaggctttcactgagagagaagctgcagagataatgcgggatattggcactgccatccagtttctgcacagccataacattgcccaccgagatgtcaagcctgaaaacctactctacacatctaaggagaaagacgcagtgcttaagctcaccgattttggctttgctaaggagaccacccaaaatgccctgcagacaccctgctatactccctattatgtggcccctgaggtcctgggtccagagaagtatgacaagtcatgtgacatgtggtccctgggtgtcatcatgtacatcctcctttgtggcttcccacccttctactccaacacgggccaggccatctccccggggatgaagaggaggattcgcctgggccagtacggcttgactaattcgatgattgctatgtcgtctttgtcgaatcccaatcacgtgctccaactccatcgttcagagaacacacgccaagcagag

SEQ ID NO: 372096 - DNA, 1340 bp, Homo sapiens
ggcacgaggctgcggccgccagctcccgcgaccgcctctcctgcccctcgccggtacctcagcaaggtgccactagaagcgccaggctggggccgcctctgagcgccccgcgggggccatggatggtgaaacagcagaggagcaggggggccctgtgcccccgccagttgcacccggcggacccggcttgggcggtgctccgggggggcggcgggagcccaagaagtacgcagtgaccgacgactaccagttgtccaagcaggtgctgggcctgggtgtgaacggcaaagtgctggagtgcttccatcggcgcactggacagaagtgtgccctgaagctcctgtatgacagccccaaggcccggcaggaggtagaccatcactggcaggcttctggcggcccccatattgtctgcatcctggatgtgtatgagaacatgcaccatggcaagcgctgtctcctcatcatcatggaatgcatggaaggtggtgagttgttcagcaggattcaggagcgtggcgaccaggctttcactgagagagaagctgcagagataatgcgggatattggcactgccatccagtttctgcacagccataacattgcccaccgagatgtcaagcctgaaaacctactctacacatctaaggagaaagacgcagtgcttaagctcaccgattcaggctattgcatacggcaaacacaaccaaaaatgaccccagcaagaaccaccctagaaatactaccctaattaatagttgaaccgccataggagggttcaatggaggaaccaacagcaaaagtatatgacaaaggtaattggtgaccactcgtgagacacctgcgagctagtaaacaacttgatacactaccatcctataggtggcatacacacagcatattaatccccacgaaggggacacagggcagactcacacgagaaatgaaaacgcaggattaccgaccgcggggccaacagcgggagttagcgcaagactcgaccgtgcgcacaaccgcctcgcagaagcgcccgcaccgacagacgcgcaagaaccgggtgcgaaacgaggaacaacaaaacaagtagagaaatataaaaggaacagagacagcaacaggagagacaacgcagagtacgaagatcacgaacgcaatactcacgagcatagtaggcagaaggaaaacgaagcacagcacaaccaagaaaagacgagttcaataagcaacaccgaagagaagtaggcaataagacccgcggaacaggcgggacggcacgtcggactgaagacgcgcggacaggagccttgctccaccgctgtcctaaatgactgtcgtgacaa

SEQ ID NO: 372097 - DNA, 2525 bp, Homo sapiens
gctagtagaggctggtttaatcggcagagggcggcgagctcccgcgaccgcctctcctgcccctcgccggtacctcagcaaggtgccactagaagcgccaggctggggccgcctctgagcgccccgcgggggccatggatggtgaaacagcagaggagcaggggggccctgtgcccccgccagttgcacccggcggacccggcttgggcggtgctccgggggggcggcgggagcccaagaagtacgcagtgaccgacgactaccagttgtccaagcaggtgctgggcctgggtgtgaacggcaaagtgctggagtgcttccatcggcgcactggacagaagtgtgccctgaagctcctgtatgacagccccaaggcccggcaggaggtagaccatcactggcaggcttctggcggcccccatattgtctgcatcctggatgtgtatgagaacatgcaccatggcaagcgctgtctcctcatcatcatggaatgcatggaaggtggtgagttgttcagcaggattcaggagcgtggcgaccaggctttcactgagagagaagctgcagagataatgcgggatattggcactgccatccagtttctgcacagccataacattgcccaccgagatgtcaagcctgaaaacctactctacacatctaaggagaaagacgcagtgcttaagctcaccgattttggctttgctaaggagaccacccaaaatgccctgcagacaccctgctatactccctattatgtggcccctgaggtcctgggtccagagaagtatgacaagtcatgtgacatgtggtccctgggtgtcatcatgtacatcctcctttgtggcttcccacccttctactccaacacgggccaggccatctccccggggatgaagaggaggattcgcctgggccagtacggcttccccaatcctgagtggtcagaagtctctgaggatgccaagcagctgatccgcctcctgttgaagacagaccccacagagaggctgaccatcactcagttcatgaaccacccctggatcaaccaatcgatggtagtgccacagaccccactccacacggcccgagtgctgcaggaggacaaagaccactgggacgaagtcaaggaggagatgaccagtgccttggccactatgcgggtagactacgaccaggtgaagatcaaggacctgaagacctctaacaaccggctcctcaacaagaggagaaaaaagcaggcaggcagctcctctgcctcacagggctgcaacaaccagtagctcatggggccttggaggagcctggcctctcagcctgcataacagactgaaatgtgctcaggccctggccaggagggcccagggtcattcttttaacaaaaggattattttgttgtgttttaatttgtcactcggaacttcaggatggaggaccctgaccctaagcctccttcagatctctggcccaggctcaagccctagagatgggcagggcctaggggctgggagctgcctgctgccatagcagcacctttagctaggttggcccgagtgaggcctctgtgctgtcctgccctggtgcatggccttagctttctaggccactgggagttgtggctgggcttcccatcttccacagagacatctccctgtgggatgggcagatgggcctggccttgagaaaggcattggccattggttgccatggtgaccagggaccacgttgctgcctgtgaatgctgagtgagcgagtaagggaggaggggcgattgagggttcacctctgccttggggaggctgatttctcacacactggctggccctctcattctcactcctccttgggccctgaggctgctggatccagtctgcctgcctccctgtgcagtccagccctgccttgctgcagccccagcccagatggcactcagcgctctcccctgagggagtccctgggcctagccatcccctcactattcccgacccaaagggtgacttttcatctgaacttaaggtgggagatatttttaacttttttccactttggaaaatgtcactgtgacaaaagccagcatactttccctgcacccatctgctcaccagatctcaggcaggaaagcccctctctgttgaagtcaggggctatcttttggtatacttgtgtgaaagtggctggttgggagcagagctaagtggcttcccattaacctgaggtctctttctttactctgggtcagacctgaggttggggaaggcgactgagccatgctcagaatgtctggtcctggcttgggcctgagtagggcagagagggcctttcatggctgatcagagcttaccagccccaccccaccatggtagccttagggtgctgagtgcctgatactgcctgacaagtgcctgacacgcagcctagttccttcctggcccctctctcactggctgggaaaccctagaccatgtcagataggacaacactgctgggttttacatccagatagtaataaacaccatttcatcatt

SEQ ID NO: 372098 - DNA, 2568 bp, Homo sapiens
tctcaggccgttcgtcccgcactcccagcttgccccgggctcgcagcccagcccagttcagaggctccaaggctggggtgtgttggaaaagtctgggcgggactcactcttcccctttcccccaggtgccactagaagcgccaggctggggccgcctctgagcgccccgcgggggccatggatggtgaaacagcagaggagcaggggggccctgtgcccccgccagttgcacccggcggacccggcttgggcggtgctccgggggggcggcgggagcccaagaagtacgcagtgaccgacgactaccagttgtccaagcaggtgctgggcctgggtgtgaacggcaaagtgctggagtgcttccatcggcgcactggacagaagtgtgccctgaagctcctgtatgacagccccaaggcccggcaggaggtagaccatcactggcaggcttctggcggcccccatattgtctgcatcctggatgtgtatgagaacatgcaccatggcaagcgctgtctcctcatcatcatggaatgcatggaaggtggtgagttgttcagcaggattcaggagcgtggcgaccaggctttcactgagagagaagctgcagagataatgcgggatattggcactgccatccagtttctgcacagccataacattgcccaccgagatgtcaagcctgaaaacctactctacacatctaaggagaaagacgcagtgcttaagctcaccgattttggctttgctaaggagaccacccaaaatgccctgcagacaccctgctatactccctattatgtggcccctgaggtcctgggtccagagaagtatgacaagtcatgtgacatgtggtccctgggtgtcatcatgtacatcctcctttgtggcttcccacccttctactccaacacgggccaggccatctccccggggatgaagaggaggattcgcctgggccagtacggcttccccaatcctgagtggtcagaagtctctgaggatgccaagcagctgatccgcctcctgttgaagacagaccccacagagaggctgaccatcactcagttcatgaaccacccctggatcaaccaatcgatggtagtgccacagaccccactccacacggcccgagtgctgcaggaggacaaagaccactgggacgaagtcaaggaggagatgaccagtgccttggccactatgcgggtagactacgaccaggtgaagatcaaggacctgaagacctctaacaaccggctcctcaacaagaggagaaaaaagcaggcaggcagctcctctgcctcacagggctgcaacaaccagtagctcatggggccttggaggagcctggcctctcagcctgcataacagactgaaatgtgctcaggccctggccaggagggcccagggtcattcttttaacaaaaggattattttgttgtgttttaatttgtcactcggaacttcaggatggaggaccctgaccctaagcctccttcagatctctggcccaggctcaagccctagagatgggcagggcctaggggctgggagctgcctgctgccatagcagcacctttagctaggttggcccgagtgaggcctctgtgctgtcctgccctggtgcatggccttagctttctaggccactgggagttgtggctgggcttcccatcttccacagagacatctccctgtgggatgggcagatgggcctggccttgagaaaggcattggccattggttgccatggtgaccagggaccacgttgctgcctgtgaatgctgagtgagcgagtaagggaggaggggcgattgagggttcacctctgccttggggaggctgatttctcacacactggctggccctctcattctcactcctccttgggccctgaggctgctggatccagtctgcctgcctccctgtgcagtccagccctgccttgctgcagccccagcccagatggcactcagcgctctcccctgagggagtccctgggcctagccatcccctcactattcccgacccaaagggtgacttttcatctgaacttaaggtgggagatatttttaacttttttccactttggaaaatgtcactgtgacaaaagccagcatactttccctgcacccatctgctcaccagatctcaggcaggaaagcccctctctgttgaagtcaggggctatcttttggtatacttgtgtgaaagtggctggttgggagcagagctaagtggcttcccattaacctgaggtctctttctttactctgggtcagacctgaggttggggaaggcgactgagccatgctcagaatgtctggtcctggcttgggcctgagtagggcagagagggcctttcatggctgatcagagcttaccagccccaccccaccatggtagccttagggtgctgagtgcctgatactgcctgacaagtgcctgacacgcagcctagttccttcctggcccctctctcactggctgggaaaccctagaccatgtcagataggacaacactgctgggttttacatccagatagtaataaacaccatttcatcatt

SEQ ID NO: 372099 - DNA, 2504 bp, Homo sapiens
ctggccgcttaagctttattactggcgtcttcggcctccctcgctccggtacctcagcaaggtgccactagaagcgccaggctggggccgcctctgagcgccccgcgggggccatggatggtgaaacagcagaggagcaggggggccctgtgcccccgccagttgcacccggcggacccggcttgggcggtgctccgggggggcggcgggagcccaagaagtacgcagtgaccgacgactaccagttgtccaagcaggtgctgggcctgggtgtgaacggcaaagtgctggagtgcttccatcggcgcactggacagaagtgtgccctgaagctcctgtatgacagccccaaggcccggcaggaggtagaccatcactggcaggcttctggcggcccccatattgtctgcatcctggatgtgtatgagaacatgcaccatggcaagcgctgtctcctcatcatcatggaatgcatggaaggtggtgagttgttcagcaggattcaggagcgtggcgaccaggctttcactgagagagaagctgcagagataatgcgggatattggcactgccatccagtttctgcacagccataacattgcccaccgagatgtcaagcctgaaaacctactctacacatctaaggagaaagacgcagtgcttaagctcaccgattttggctttgctaaggagaccacccaaaatgccctgcagacaccctgctatactccctattatgtggcccctgaggtcctgggtccagagaagtatgacaagtcatgtgacatgtggtccctgggtgtcatcatgtacatcctcctttgtggcttcccacccttctactccaacacgggccaggccatctccccggggatgaagaggaggattcgcctgggccagtacggcttccccaatcctgagtggtcagaagtctctgaggatgccaagcagctgatccgcctcctgttgaagacagaccccacagagaggctgaccatcactcagttcatgaaccacccctggatcaaccaatcgatggtagtgccacagaccccactccacacggcccgagtgctgcaggaggacaaagaccactgggacgaagtcaaggaggagatgaccagtgccttggccactatgcgggtagactacgaccaggtgaagatcaaggacctgaagacctctaacaaccggctcctcaacaagaggagaaaaaagcaggcaggcagctcctctgcctcacagggctgcaacaaccagtagctcatggggccttggaggagcctggcctctcagcctgcataacagactgaaatgtgctcaggccctggccaggagggcccagggtcattcttttaacaaaaggattattttgttgtgttttaatttgtcactcggaacttcaggatggaggaccctgaccctaagcctccttcagatctctggcccaggctcaagccctagagatgggcagggcctaggggctgggagctgcctgctgccatagcagcacctttagctaggttggcccgagtgaggcctctgtgctgtcctgccctggtgcatggccttagctttctaggccactgggagttgtggctgggcttcccatcttccacagagacatctccctgtgggatgggcagatgggcctggccttgagaaaggcattggccattggttgccatggtgaccagggaccacgttgctgcctgtgaatgctgagtgagcgagtaagggaggaggggcgattgagggttcacctctgccttggggaggctgatttctcacacactggctggccctctcattctcactcctccttgggccctgaggctgctggatccagtctgcctgcctccctgtgcagtccagccctgccttgctgcagccccagcccagatggcactcagcgctctcccctgagggagtccctgggcctagccatcccctcactattcccgacccaaagggtgacttttcatctgaacttaaggtgggagatatttttaacttttttccactttggaaaatgtcactgtgacaaaagccagcatactttccctgcacccatctgctcaccagatctcaggcaggaaagcccctctctgttgaagtcaggggctatcttttggtatacttgtgtgaaagtggctggttgggagcagagctaagtggcttcccattaacctgaggtctctttctttactctgggtcagacctgaggttggggaaggcgactgagccatgctcagaatgtctggtcctggcttgggcctgagtagggcagagagggcctttcatggctgatcagagcttaccagccccaccccaccatggtagccttagggtgctgagtgcctgatactgcctgacaagtgcctgacacgcagcctagttccttcctggcccctctctcactggctgggaaaccctagaccatgtcagataggacaacactgctgggttttacatccagatagtaataaacaccatttcatcatt

SEQ ID NO: 372100 - DNA, 2664 bp, Homo sapiens
ggcacgaggctgcggccgccagctcccgcgaccgcctctcctgcccctcgccggtacctcagcaaggtgccactagaagcgccaggctggggccgcctctgagcgccccgcgggggccatggatggtgaaacagcagaggagcaggggggccctgtgcccccgccagttgcacccggcggacccggcttgggcggtgctccgggggggcggcgggagcccaagaagtacgcagtgaccgacgactaccagttgtccaagcaggtgctgggcctgggtgtgaacggcaaagtgctggagtgcttccatcggcgcactggacagaagtgtgccctgaagctcctgtatgacagccccaaggcccggcaggaggtagaccatcactggcaggcttctggcggcccccatattgtctgcatcctggatgtgtatgagaacatgcaccatggcaagcgctgtctcctcatcatcatggaatgcatggaaggtggtgagttgttcagcaggattcaggagcgtggcgaccaggctttcactgagagagaagctgcagagataatgcgggatattggcactgccatccagtttctgcacagccataacattgcccaccgagatgtcaagcctgaaaacctactctacacatctaaggagaaagacgcagtgcttaagctcaccgattttggctttgctaaggagaccacccaaaatgccctgcagacaccctgctatactccctattatgtggcccctgaggtcctgggtccagagaagtatgacaagtcatgtgacatgtggtccctgggtgtcatcatgtacatcctcctttgtggcttcccacccttctactccaacacgggccaggccatctccccggggatgaagaggaggattcgcctgggccagtacggcttccccaatcctgagtggtcagaagtctctgaggatgccaagcagctgatccgcctcctgttgaagacagaccccacagagaggctgaccatcactcagttcatgaaccacccctggatcaacgtgagcccctcctcctcccatggcagtgaggctccttccccaccctgagccttggtttttccatctgagtctgggagaagaggatggagtggggggaaccagtgctgtcccaggtgcctccagtttctaatccacgggcgtggggctccttccagcaatcgatggtagtgccacagaccccactccacacggcccgagtgctgcaggaggacaaagaccactgggacgaagtcaaggaggagatgaccagtgccttggccactatgcgggtagactacgaccaggtgaagatcaaggacctgaagacctctaacaaccggctcctcaacaagaggagaaaaaagcaggcaggcagctcctctgcctcacagggctgcaacaaccagtagctcatggggccttggaggagcctggcctctcagcctgcataacagactgaaatgtgctcaggccctggccaggagggcccagggtcattcttttaacaaaaggattattttgttgtgttttaatttgtcactcggaacttcaggatggaggaccctgaccctaagcctccttcagatctctggcccaggctcaagccctagagatgggcagggcctaggggctgggagctgcctgctgccatagcagcacctttagctaggttggcccgagtgaggcctctgtgctgtcctgccctggtgcatggccttagctttctaggccactgggagttgtggctgggcttcccatcttccacagagacatctccctgtgggatgggcagatgggcctggccttgagaaaggcattggccattggttgccatggtgaccagggaccacgttgctgcctgtgaatgctgagtgagcgagtaagggaggaggggcgattgagggttcacctctgccttggggaggctgatttctcacacactggctggccctctcattctcactcctccttgggccctgaggctgctggatccagtctgcctgcctccctgtgcagtccagccctgccttgctgcagccccagcccagatggcactcagcgctctcccctgagggagtccctgggcctagccatcccctcactattcccgacccaaagggtgacttttcatctgaacttaaggtgggagatatttttaacttttttccactttggaaaatgtcactgtgacaaaagccagcatactttccctgcacccatctgctcaccagatctcaggcaggaaagcccctctctgttgaagtcaggggctatcttttggtatacttgtgtgaaagtggctggttgggagcagagctaagtggcttcccattaacctgaggtctctttctttactctgggtcagacctgaggttggggaaggcgactgagccatgctcagaatgtctggtcctggcttgggcctgagtagggcagagagggcctttcatggctgatcagagcttaccagccccaccccaccatggtagccttagggtgctgagtgcctgatactgcctgacaagtgcctgacacgcagcctagttccttcctggcccctctctcactggctgggaaaccctagaccatgtcagataggacaacactgctgggttttacatccagatagtaataaacaccatttcatcatt

SEQ ID NO: 372101 - DNA, 2423 bp, Homo sapiens
ggcacgaggctgcggccgccagctcccgcgaccgcctctcctgcccctcgccggtacctcagcaaggtgccactagaagcgccaggctggggccgcctctgagcgccccgcgggggccatggatggtgaaacagcagaggagcaggggggccctgtgcccccgccagttgcacccggcggacccggcttgggcggtgctccgggggggcggcgggagcccaagaagtacgcagtgaccgacgactaccagttgtccaagcaggtgctgggcctgggtgtgaacggcaaagtgctggagtgcttccatcggcgcactggacagaagtgtgccctgaagctcctgtatgacagccccaaggcccggcaggaggtagaccatcactggcaggcttctggcggcccccatattgtctgcatcctggatgtgtatgagaacatgcaccatggcaagcgctgtctcctcatcatcatggaatgcatggaaggtggtgagttgttcagcaggattcaggagcgtggcgaccaggctttcactgagagagaagctgcagagataatgcgggatattggcactgccatccagtttctgcacagccataacattgcccaccgagatgtcaagcctgaaaacctactctacacatctaaggagaaagacgcagtgcttaagctcaccgattttggctttgctaaggagaccacccaaaatgccctgcagacaccctgctatactccctattatgtggcccctgaggtcctgggtccagagaagtatgacaagtcatgtgacatgtggtccctgggtgtcatcatgtacatcctcctttgtggcttcccacccttctactccaacacgggccaggccatctccccggggatgaagaggaggattcgcctgggccagtacggcttccccaatcctgagtggtcagaagtctctgaggatgcaatcgatggtagtgccacagaccccactccacacggcccgagtgctgcaggaggacaaagaccactgggacgaagtcaaggaggagatgaccagtgccttggccactatgcgggtagactacgaccaggtgaagatcaaggacctgaagacctctaacaaccggctcctcaacaagaggagaaaaaagcaggcaggcagctcctctgcctcacagggctgcaacaaccagtagctcatggggccttggaggagcctggcctctcagcctgcataacagactgaaatgtgctcaggccctggccaggagggcccagggtcattcttttaacaaaaggattattttgttgtgttttaatttgtcactcggaacttcaggatggaggaccctgaccctaagcctccttcagatctctggcccaggctcaagccctagagatgggcagggcctaggggctgggagctgcctgctgccatagcagcacctttagctaggttggcccgagtgaggcctctgtgctgtcctgccctggtgcatggccttagctttctaggccactgggagttgtggctgggcttcccatcttccacagagacatctccctgtgggatgggcagatgggcctggccttgagaaaggcattggccattggttgccatggtgaccagggaccacgttgctgcctgtgaatgctgagtgagcgagtaagggaggaggggcgattgagggttcacctctgccttggggaggctgatttctcacacactggctggccctctcattctcactcctccttgggccctgaggctgctggatccagtctgcctgcctccctgtgcagtccagccctgccttgctgcagccccagcccagatggcactcagcgctctcccctgagggagtccctgggcctagccatcccctcactattcccgacccaaagggtgacttttcatctgaacttaaggtgggagatatttttaacttttttccactttggaaaatgtcactgtgacaaaagccagcatactttccctgcacccatctgctcaccagatctcaggcaggaaagcccctctctgttgaagtcaggggctatcttttggtatacttgtgtgaaagtggctggttgggagcagagctaagtggcttcccattaacctgaggtctctttctttactctgggtcagacctgaggttggggaaggcgactgagccatgctcagaatgtctggtcctggcttgggcctgagtagggcagagagggcctttcatggctgatcagagcttaccagccccaccccaccatggtagccttagggtgctgagtgcctgatactgcctgacaagtgcctgacacgcagcctagttccttcctggcccctctctcactggctgggaaaccctagaccatgtcagataggacaacactgctgggttttacatccagatagtaataaacaccatttcatcatt

SEQ ID NO: 372102 - DNA, 1683 bp, Homo sapiens
ggacgcgtgggtcgacccacgcgtcgcacgggccaggccatctccccggggatgaagaggaggattcgcctgggccagtacggcttccccaatcctgagtggtcagaagtctctgaggatgccaagcagctgatccgcctcctgttgaagacagaccccacagagaggctgaccatcactcagttcatgaaccacccctggatcaaccaatcgatggtagtgccacagaccccactccacacggcccgagtgctgcaggaggacaaagaccactgggacgaagtcaaggaggagatgaccagtgccttggccactatgcgggtagactacgaccaggtgaagatcaaggacctgaagacctctaacaaccggctcctcaacaagaggagaaaaaagcaggcaggcagctcctctgcctcacagggctgcaacaaccagtagctcatggggccttggaggagcctggcctctcagcctgcataacagactgaaatgtgctcaggccctggccaggagggcccagggtcattcttttaacaaaaggattattttgttgtgttttaatttgtcactcggaacttcaggatggaggaccctgaccctaagcctccttcagatctctggcccaggctcaagccctagagatgggcagggcctaggggctgggagctgcctgctgccatagcagcacctttagctaggttggcccgagtgaggcctctgtgctgtcctgccctggtgcatggccttagctttctaggccactgggagttgtggctgggcttcccatcttccacagagacatctccctgtgggatgggcagatgggcctggccttgagaaaggcattggccattggttgccatggtgaccagggaccacgttgctgcctgtgaatgctgagtgagcgagtaagggaggaggggcgattgagggttcacctctgccttggggaggctgatttctcacacactggctggccctctcattctcactcctccttgggccctgaggctgctggatccagtctgcctgcctccctgtgcagtccagccctgccttgctgcagccccagcccagatggcactcagcgctctcccctgagggagtccctgggcctagccatcccctcactattcccgacccaaagggtgacttttcatctgaacttaaggtgggagatatttttaacttttttccactttggaaaatgtcactgtgacaaaagccagcatactttccctgcacccatctgctcaccagatctcaggcaggaaagcccctctctgttgaagtcaggggctatcttttggtatacttgtgtgaaagtggctggttgggagcagagctaagtggcttcccattaacctgaggtctctttctttactctgggtcagacctgaggttggggaaggcgactgagccatgctcagaatgtctggtcctggcttgggcctgagtagggcagagagggcctttcatggctgatcagagcttaccagccccaccccaccatggtagccttagggtgctgagtgcctgatactgcctgacaagtgcctgacacgcagcctagttccttcctggcccctctctcactggctgggaaaccctagaccatgtcagataggacaacactgctgggttttacatccagatagtaataaacaccatttcatcatt

SEQ ID NO: 372103 - DNA, 1027 bp, Homo sapiens
ggcacgaggctgcggccgccagctcccgcgaccgcctctcctgcccctcgccggtacctcagcaaggtgccactagaagcgccaggctggggccgcctctgagcgccccgcgggggccatggatggtgaaacagcagaggagcaggggggccctgtgcccccgccagttgcacccggcggacccggcttgggcggtgctccgggggggcggcgggagcccaagaagtacgcagtgaccgacgactaccagttgtccaagcaggtgctgggcctgggtgtgaacggcaaagtgctggagtgcttccatcggcgcactggacagaagtgtgccctgaagctcctgtatgacagccccaaggcccggcaggaggtagaccatcactggcaggcttctggcggcccccatattgtctgcatcctggatgtgtatgagaacatgcaccatggcaagcgctgtctcctcatcatcatggaatgcatggaaggtggtgagttgttcagcaggattcaggagcgtggcgaccaggctttcactgagagagaagctgcagagataatgcgggatattggcactgccatccagtttctgcacagccataacattgcccaccgagatgtcaagcctgaaaacctactctacacatctaaggagaaagacgcagtgcttaagctcaccgattttggctttgctaaggagaccacccaaaatgccctgcagacaccctgctatactccctattatgtggcccctgaggtcctgggtccagagaagtatgacaagtcatgtgacatgtggtccctgggtgtcatcatgtacatcctcctttgtggcttcccacccttctactccaacacgggccaggccatctccccggggatgaagaggaggattcgcctgggccagtacggcttccccaatcctgagtggtcagaagtctctgaggatgcattataacacacgacggccagtccccatcctgcagtaccccagcctcgactgatagagatcccctcctcaccgcacggc

SEQ ID NO: 372104 - DNA, 868 bp, Homo sapiens
ggcacgaggctgcggccgccagctcccgcgaccgcctctcctgcccctcgccggtacctcagcaaggtgccactagaagcgccaggctggggccgcctctgagcgccccgcgggggccatggatggtgaaacagcagaggagcaggggggccctgtgcccccgccagttgcacccggcggacccggcttgggcggtgctccgggggggcggcgggagcccaagaagtacgcagtgaccgacgactaccagttgtccaagcaggtgctgggcctgggtgtgaacggcaaagtgctggagtgcttccatcggcgcactggacagaagtgtgccctgaagctcctgtatgacagccccaaggcccggcaggaggtagaccatcactggcaggcttctggcggcccccatattgtctgcatcctggatgtgtatgagaacatgcaccatggcaagcgctgtctcctcatcatcatggaatgcatggaaggtggtgagttgttcagcaggattcaggagcgtggcgaccaggctttcactgagagagaagctgcagagataatgcgggatattggcactgccatccagtttctgcacagccataacattgcccaccgagatgtcaagcctgaaaacctactctacacatctaaggagaaagacgcagtgcttaagctcaccgattttggctttgctaaggagaccacccaaaatgccctgcagacaccctgctatactccctattatgtggcccctgaggtcctgggtccagagaagtatgacaagtcatgtgacatgtggtccctgggtgtcatcatgtacatcctaaaaaataaagccctcctggggacttggaatcagtcggcagtcata

SEQ ID NO: 372105 - DNA, 289 bp, Homo sapiens
atgtaccgggtggggcttgaccttagactggcatcactgaccccctcctcctctgtttctgcagaagctgcagagataatgcgggatattggcactgccatccagtttctgcacagccataacattgcccaccgagatgtcaaggtgaggctccaggattcaggttgggggcccggggaagaggatattgtcccactccacaatccctgatggcatccaggacccactggatggaggccatgttccctagtcacattcaaagcctctgctctgtgtcccagactgcttt

SEQ ID NO: 372106 - DNA, 414 bp, Homo sapiens
  misc_feature (393)..(393): n is a, c, g, or t
  misc_feature (414)..(414): n is a, c, g, or t
ttctgccgcgtcgactggacacggtctttcttattcagtacctgttcctgacttttccacggattgtcttcatgctgggctttgtcgtggttctgagcttcctcctgggtggctacctgttgtttgtcctgtatctggcggccaccaaccagactactaacgagtggtacagaggtgactgggcctggtgccagcgttgtccccttgtggcctggcctccgtcagcagagccccaagtccaccggaacattcactcccatgggcttcggagcaaccttcaagagatctttctacctgcctttccatgtcatgagaggaagaaacaagaatgacaagtgtatgaaataaacgggaactacagctcaaaggcagtcatacacttggtcgaccggnagcgaatttagtagtagtagn

SEQ ID NO: 372107 - DNA, 2498 bp, Homo sapiens
aggggcgccgtgctgatgtcacgagcccgcaggaagtctcgtatcgcgcccgggaggcgccggagcccagcggctggcgggccgccgtcccacccccacctcgccggagtccggggcggccccggtgtcccctccgagcctgctgcactccacgtccccctaccagggctccagcccccagggaaatctccgaccaggcccgcccaggagccagatccaggctcctggaagaaccatgtccggcagctactggtcatgccaggcacacactgctgcccaagaggagctgctgtttgaattatctgtgaatgttgggaagaggaatgccagagctgccggctgaaaattacccaaccaagagaaatctgcaggatggactttctggtcctcttcttgttctacctggcttcggtgctgatgggtcttgttcttatctgcgtctgctcgaaaacccatagcttgaaaggcctggccaggggaggagcacagatattttcctgtataattccagaatgtcttcagagagccgtgcatggattgcttcattaccttttccatacgagaaaccacaccttcattgtcctgcacctggtcttgcaagggatggtttatactgagtacacctgggaagtatttggctactgtcaggagctggagttgtccttgcattaccttcttctgccctatctgctgctaggtgtaaacctgttttttttcaccctgacttgtggaaccaatcctggcattataacaaaagcaaatgaattattatttcttcatgtttatgaatttgatgaagtgatgtttccaaagaacgtgaggtgctctacttgtgatttaaggaaaccagctcgatccaagcactgcagtgtgtgtaactggtgtgtgcaccgtttcgaccatcactgtgtttgggtgaacaactgcatcggggcctggaacatcaggtacttcctcatctacgtcttgaccttgacggcctcggctgccaccgtcgccattgtgagcaccacttttctggtccacttggtggtgatgtcagatttataccaggagacttacatcgatgaccttggacacctccatgttatggacacggtctttcttattcagtacctgttcctgacttttccacggattgtcttcatgctgggctttgtcgtggttctgagcttcctcctgggtggctacctgttgtttgtcctgtatctggcggccaccaaccagactactaacgagtggtacagaggtgactgggcctggtgccagcgttgtccccttgtggcctggcctccgtcagcagagccccaagtccaccggaacattcactcccatgggcttcggagcaaccttcaagagatctttctacctgcctttccatgtcatgagaggaagaaacaagaatgacaagtgtatgactgcctttgagctgtagttcccgtttatttacacatgtggatcctcgttttccaagcatggcttgtttgttttgatttctgctgtgcttataaatcactttcggtgggcaagggagagaggggaaaattgggtgttgactgaggaatcccccttgcttgtcttcttttgaaaccgggcatctctgaagtcctggtgtcaaggggatcaagagatgacttctcagaggttctaggtgatgctgagaccttggtgtctctaaactctgggcatgtggacaggaggggcttgcggccgtgtctctgacctgtgtgatgtgcaggagggtctcattgactcagcgcctgcgcgttgtgcctggctgtgctctcttttatgccccctctattctcctctctcccccaggggattttcatctcaacaacagagtgtcctcacccaggcctgccttccggccagtatgggcttgtacatcaggcaccttcctgcatgtgtggcctccggcctgccctcctctagccacattcaagtcctttctcaccagtttaaaaattgtgaaagtgaactgccacctatttcagaggagagatgactgccagaaacgaggtcttggtgcggaaggtctttggagtgggagggctctcaggtgcaggtggcaggtgttctgcaccttgctaggccaaggagcccgcagtcagagaggctgggaagtgggagtcaggggcagggggccttccagccatcttcccccgtaccccccagctgagaacagatggaaacgtgaagacgggtagctggggcggccagggaacccaagtccgctggccgaagccaaagcccggcaccacccccaattcttgctggtggaaagcaccgtgaaatcaaccagcggcagctctgaacgcgacgcacagcccgcgagggagcctgggcaaggacggagcgggcctgcaccggcggttgggcgggctccgggggcggggtccacctgggaccgcggcgcgcccctcaccgctcgcgccgccagggggcgccctccggagagcgcgcctaggccgcggcctgcgcttggcccctgcggg

SEQ ID NO: 372108 - DNA, 1348 bp, Homo sapiens
aaagaccgtgtccataacatggaggtgtccaaggtcatcgatgtaagtctcctggtataaatctgacatcaccaccaagtggaccagaaaagtggtgctcacaatgggcctggtgccagcgttgtccccttgtggcctggcctccgtcagcagagccccaagtccaccggaacattcactcccatgggcttcggagcaaccttcaagagatctttctacctgcctttccatgtcatgagaggaagaaacaagaatgacaagtgtatgactgcctttgagctgtagttcccgtttatttacacatgtggatcctcgttttccaagcatggcttgtttgttttgatttctgctgtgcttataaatcactttcggtgggcaagggagagaggggaaaattgggtgttgactgaggaatcccccttgcttgtcttcttttgaaaccgggcatctctgaagtcctggtgtcaaggggatcaagagatgacttctcagaggttctaggtgatgctgagaccttggtgtctctaaactctgggcatgtggacaggaggggcttgcggccgtgtctctgacctgtgtgatgtgcaggagggtctcattgactcagcgcctgcgcgttgtgcctggctgtgctctcttttatgccccctctattctcctctctcccccaggggattttcatctcaacaacagagtgtcctcacccaggcctgccttccggccagtatgggcttgtacatcaggcaccttcctgcatgtgtggcctccggcctgccctcctctagccacattcaagtcctttctcaccagtttaaaaattgtgaaagtgaactgccacctatttcagaggagagatgactgccagaaacgaggtcttggtgcggaaggtctttggagtgggagggctctcaggtgcaggtggcaggtgttctgcaccttgctaggccaaggagcccgcagtcagagaggctgggaagtgggagtcaggggcagggggccttccagccatcttcccccgtaccccccagctgagaacagatggaaacgtgaagacgggtagctggggcggccagggaacccaagtccgctggccgaagccaaagcccggcaccacccccaattcttgctggtggaaagcaccgtgaaatcaaccagcggcagctctgaacgcgacgcacagcccgcgagggagcctgggcaaggacggagcgggcctgcaccggcggttgggcgggctccgggggcggggtccacctgggaccgcggcgcgcccctcaccgctcgcgccgccagggggcgccctccggagagcgcgcctaggccgcggcctgcgcttggcccctgcggg

SEQ ID NO: 372109 - DNA, 2654 bp, Homo sapiens
aggggcgccgtgctgatgtcacgagcccgcaggaagtctcgtatcgcgcccgggaggcgccggagcccagcggctggcggtaaggccgcctccgcggggctgtgggaagcttgggctgtcccaggaccgtcagtctcctcctctgaccctccctttccccttgtgtgtagggccgccgtcccacccccacctcgccggagtccggggcggccccggtgtcccctccgagcctgctgcactccacgtccccctaccagggctccagcccccagggaaatctccgaccaggcccgcccaggaggtattctgcctttgactgcaactcttgtcgtcttatgtgggtgttgaattgatctgtctctgcagccagatccaggctcctggaagaaccatgtccggcagctactggtcatgccaggcacacactgctgcccaagaggagctgctgtttgaattatctgtgaatgttgggaagaggaatgccagagctgccggctgaaaattacccaaccaagagaaatctgcaggatggactttctggtcctcttcttgttctacctggcttcggtgctgatgggtcttgttcttatctgcgtctgctcgaaaacccatagcttgaaaggcctggccaggggaggagcacagatattttcctgtataattccagaatgtcttcagagagccgtgcatggattgcttcattaccttttccatacgagaaaccacaccttcattgtcctgcacctggtcttgcaagggatggtttatactgagtacacctgggaagtatttggctactgtcaggagctggagttgtccttgcattaccttcttctgccctatctgctgctaggtgtaaacctgttttttttcaccctgacttgtggaaccaatcctggcattataacaaaagcaaatgaattattatttcttcatgtttatgaatttgatgaagtgatgtttccaaagaacgtgaggtgctctacttgtgatttaaggaaaccagctcgatccaagcactgcagtgtgtgtaactggtgtgtgcaccgtttcgaccatcactgtgtttgggtgaacaactgcatcggggcctggaacatcaggtacttcctcatctacgtcttgaccttgacggcctcggctgccaccgtcgccattgtgagcaccacttttctggtccacttggtggtgatgtcagatttataccaggagacttacatcgatgaccttggacacctccatgttatggacacggtctttcttattcagtacctgttcctgacttttccacggattgtcttcatgctgggctttgtcgtggttctgagcttcctcctgggtggctacctgttgtttgtcctgtatctggcggccaccaaccagactactaacgagtggtacagaggtgactgggcctggtgccagcgttgtccccttgtggcctggcctccgtcagcagagccccaagtccaccggaacattcactcccatgggcttcggagcaaccttcaagagatctttctacctgcctttccatgtcatgagaggaagaaacaagaatgacaagtgtatgactgcctttgagctgtagttcccgtttatttacacatgtggatcctcgttttccaagcatggcttgtttgttttgatttctgctgtgcttataaatcactttcggtgggcaagggagagaggggaaaattgggtgttgactgaggaatcccccttgcttgtcttcttttgaaaccgggcatctctgaagtcctggtgtcaaggggatcaagagatgacttctcagaggttctaggtgatgctgagaccttggtgtctctaaactctgggcatgtggacaggaggggcttgcggccgtgtctctgacctgtgtgatgtgcaggagggtctcattgactcagcgcctgcgcgttgtgcctggctgtgctctcttttatgccccctctattctcctctctcccccaggggattttcatctcaacaacagagtgtcctcacccaggcctgccttccggccagtatgggcttgtacatcaggcaccttcctgcatgtgtggcctccggcctgccctcctctagccacattcaagtcctttctcaccagtttaaaaattgtgaaagtgaactgccacctatttcagaggagagatgactgccagaaacgaggtcttggtgcggaaggtctttggagtgggagggctctcaggtgcaggtggcaggtgttctgcaccttgctaggccaaggagcccgcagtcagagaggctgggaagtgggagtcaggggcagggggccttccagccatcttcccccgtaccccccagctgagaacagatggaaacgtgaagacgggtagctggggcggccagggaacccaagtccgctggccgaagccaaagcccggcaccacccccaattcttgctggtggaaagcaccgtgaaatcaaccagcggcagctctgaacgcgacgcacagcccgcgagggagcctgggcaaggacggagcgggcctgcaccggcggttgggcgggctccgggggcggggtccacctgggaccgcggcgcgcccctcaccgctcgcgccgccagggggcgccctccggagagcgcgcctaggccgcggcctgcgcttggcccctgcggg

SEQ ID NO: 372110 - DNA, 2432 bp, Homo sapiens
aggggcgccgtgctgatgtcacgagcccgcaggaagtctcgtatcgcgcccgggaggcgccggagcccagcggctggcggtattctgcctttgactgcaactcttgtcgtcttatgtgggtgttgaattgatctgtctctgcagccagatccaggctcctggaagaaccatgtccggcagctactggtcatgccaggcacacactgctgcccaagaggagctgctgtttgaattatctgtgaatgttgggaagaggaatgccagagctgccggctgaaaattacccaaccaagagaaatctgcaggatggactttctggtcctcttcttgttctacctggcttcggtgctgatgggtcttgttcttatctgcgtctgctcgaaaacccatagcttgaaaggcctggccaggggaggagcacagatattttcctgtataattccagaatgtcttcagagagccgtgcatggattgcttcattaccttttccatacgagaaaccacaccttcattgtcctgcacctggtcttgcaagggatggtttatactgagtacacctgggaagtatttggctactgtcaggagctggagttgtccttgcattaccttcttctgccctatctgctgctaggtgtaaacctgttttttttcaccctgacttgtggaaccaatcctggcattataacaaaagcaaatgaattattatttcttcatgtttatgaatttgatgaagtgatgtttccaaagaacgtgaggtgctctacttgtgatttaaggaaaccagctcgatccaagcactgcagtgtgtgtaactggtgtgtgcaccgtttcgaccatcactgtgtttgggtgaacaactgcatcggggcctggaacatcaggtacttcctcatctacgtcttgaccttgacggcctcggctgccaccgtcgccattgtgagcaccacttttctggtccacttggtggtgatgtcagatttataccaggagacttacatcgatgaccttggacacctccatgttatggacacggtctttcttattcagtacctgttcctgacttttccacggattgtcttcatgctgggctttgtcgtggttctgagcttcctcctgggtggctacctgttgtttgtcctgtatctggcggccaccaaccagactactaacgagtggtacagaggtgactgggcctggtgccagcgttgtccccttgtggcctggcctccgtcagcagagccccaagtccaccggaacattcactcccatgggcttcggagcaaccttcaagagatctttctacctgcctttccatgtcatgagaggaagaaacaagaatgacaagtgtatgactgcctttgagctgtagttcccgtttatttacacatgtggatcctcgttttccaagcatggcttgtttgttttgatttctgctgtgcttataaatcactttcggtgggcaagggagagaggggaaaattgggtgttgactgaggaatcccccttgcttgtcttcttttgaaaccgggcatctctgaagtcctggtgtcaaggggatcaagagatgacttctcagaggttctaggtgatgctgagaccttggtgtctctaaactctgggcatgtggacaggaggggcttgcggccgtgtctctgacctgtgtgatgtgcaggagggtctcattgactcagcgcctgcgcgttgtgcctggctgtgctctcttttatgccccctctattctcctctctcccccaggggattttcatctcaacaacagagtgtcctcacccaggcctgccttccggccagtatgggcttgtacatcaggcaccttcctgcatgtgtggcctccggcctgccctcctctagccacattcaagtcctttctcaccagtttaaaaattgtgaaagtgaactgccacctatttcagaggagagatgactgccagaaacgaggtcttggtgcggaaggtctttggagtgggagggctctcaggtgcaggtggcaggtgttctgcaccttgctaggccaaggagcccgcagtcagagaggctgggaagtgggagtcaggggcagggggccttccagccatcttcccccgtaccccccagctgagaacagatggaaacgtgaagacgggtagctggggcggccagggaacccaagtccgctggccgaagccaaagcccggcaccacccccaattcttgctggtggaaagcaccgtgaaatcaaccagcggcagctctgaacgcgacgcacagcccgcgagggagcctgggcaaggacggagcgggcctgcaccggcggttgggcgggctccgggggcggggtccacctgggaccgcggcgcgcccctcaccgctcgcgccgccagggggcgccctccggagagcgcgcctaggccgcggcctgcgcttggcccctgcggg

SEQ ID NO: 372111 - DNA, 2589 bp, Homo sapiens
aggggcgccgtgctgatgtcacgagcccgcaggaagtctcgtatcgcgcccgggaggcgccggagcccagcggctggcggtaaggccgcctccgcggggctgtgggaagcttgggctgtcccaggaccgtcagtctcctcctctgaccctccctttccccttgtgtgtagggccgccgtcccacccccacctcgccggagtccggggcggccccggtgtcccctccgagcctgctgcactccacgtccccctaccagggctccagcccccagggaaatctccgaccaggcccgcccaggagccagatccaggctcctggaagaaccatgtccggcagctactggtcatgccaggcacacactgctgcccaagaggagctgctgtttgaattatctgtgaatgttgggaagaggaatgccagagctgccggctgaaaattacccaaccaagagaaatctgcaggatggactttctggtcctcttcttgttctacctggcttcggtgctgatgggtcttgttcttatctgcgtctgctcgaaaacccatagcttgaaaggcctggccaggggaggagcacagatattttcctgtataattccagaatgtcttcagagagccgtgcatggattgcttcattaccttttccatacgagaaaccacaccttcattgtcctgcacctggtcttgcaagggatggtttatactgagtacacctgggaagtatttggctactgtcaggagctggagttgtccttgcattaccttcttctgccctatctgctgctaggtgtaaacctgttttttttcaccctgacttgtggaaccaatcctggcattataacaaaagcaaatgaattattatttcttcatgtttatgaatttgatgaagtgatgtttccaaagaacgtgaggtgctctacttgtgatttaaggaaaccagctcgatccaagcactgcagtgtgtgtaactggtgtgtgcaccgtttcgaccatcactgtgtttgggtgaacaactgcatcggggcctggaacatcaggtacttcctcatctacgtcttgaccttgacggcctcggctgccaccgtcgccattgtgagcaccacttttctggtccacttggtggtgatgtcagatttataccaggagacttacatcgatgaccttggacacctccatgttatggacacggtctttcttattcagtacctgttcctgacttttccacggattgtcttcatgctgggctttgtcgtggttctgagcttcctcctgggtggctacctgttgtttgtcctgtatctggcggccaccaaccagactactaacgagtggtacagaggtgactgggcctggtgccagcgttgtccccttgtggcctggcctccgtcagcagagccccaagtccaccggaacattcactcccatgggcttcggagcaaccttcaagagatctttctacctgcctttccatgtcatgagaggaagaaacaagaatgacaagtgtatgactgcctttgagctgtagttcccgtttatttacacatgtggatcctcgttttccaagcatggcttgtttgttttgatttctgctgtgcttataaatcactttcggtgggcaagggagagaggggaaaattgggtgttgactgaggaatcccccttgcttgtcttcttttgaaaccgggcatctctgaagtcctggtgtcaaggggatcaagagatgacttctcagaggttctaggtgatgctgagaccttggtgtctctaaactctgggcatgtggacaggaggggcttgcggccgtgtctctgacctgtgtgatgtgcaggagggtctcattgactcagcgcctgcgcgttgtgcctggctgtgctctcttttatgccccctctattctcctctctcccccaggggattttcatctcaacaacagagtgtcctcacccaggcctgccttccggccagtatgggcttgtacatcaggcaccttcctgcatgtgtggcctccggcctgccctcctctagccacattcaagtcctttctcaccagtttaaaaattgtgaaagtgaactgccacctatttcagaggagagatgactgccagaaacgaggtcttggtgcggaaggtctttggagtgggagggctctcaggtgcaggtggcaggtgttctgcaccttgctaggccaaggagcccgcagtcagagaggctgggaagtgggagtcaggggcagggggccttccagccatcttcccccgtaccccccagctgagaacagatggaaacgtgaagacgggtagctggggcggccagggaacccaagtccgctggccgaagccaaagcccggcaccacccccaattcttgctggtggaaagcaccgtgaaatcaaccagcggcagctctgaacgcgacgcacagcccgcgagggagcctgggcaaggacggagcgggcctgcaccggcggttgggcgggctccgggggcggggtccacctgggaccgcggcgcgcccctcaccgctcgcgccgccagggggcgccctccggagagcgcgcctaggccgcggcctgcgcttggcccctgcggg

SEQ ID NO: 372112 - DNA, 2615 bp, Homo sapiens
aggggcgccgtgctgatgtcacgagcccgcaggaagtctcgtatcgcgcccgggaggcgccggagcccagcggctggcggtaaggccgcctccgcggggctgtgggaagcttgggctgtcccaggaccgtcagtctcctcctctgaccctccctttccccttgtgtgtagggccgccgtcccacccccacctcgccggagtccggggcggccccggtgtcccctccgagcctgctgcactccacgtccccctaccagggctccagcccccagggaaatctccgaccaggcccgcccaggagccagatccaggctcctggaagaaccatgtccggcagctactggtcatgccaggcacacactgctgcccaagaggagctgctgtttgaattatctgtgaatgttgggaagaggaatgccagagctgccggctgaaaattacccaaccaagagaaatgtaggctgggtaccctgaatcaccccctgcaggatggactttctggtcctcttcttgttctacctggcttcggtgctgatgggtcttgttcttatctgcgtctgctcgaaaacccatagcttgaaaggcctggccaggggaggagcacagatattttcctgtataattccagaatgtcttcagagagccgtgcatggattgcttcattaccttttccatacgagaaaccacaccttcattgtcctgcacctggtcttgcaagggatggtttatactgagtacacctgggaagtatttggctactgtcaggagctggagttgtccttgcattaccttcttctgccctatctgctgctaggtgtaaacctgttttttttcaccctgacttgtggaaccaatcctggcattataacaaaagcaaatgaattattatttcttcatgtttatgaatttgatgaagtgatgtttccaaagaacgtgaggtgctctacttgtgatttaaggaaaccagctcgatccaagcactgcagtgtgtgtaactggtgtgtgcaccgtttcgaccatcactgtgtttgggtgaacaactgcatcggggcctggaacatcaggtacttcctcatctacgtcttgaccttgacggcctcggctgccaccgtcgccattgtgagcaccacttttctggtccacttggtggtgatgtcagatttataccaggagacttacatcgatgaccttggacacctccatgttatggacacggtctttcttattcagtacctgttcctgacttttccacggattgtcttcatgctgggctttgtcgtggttctgagcttcctcctgggtggctacctgttgtttgtcctgtatctggcggccaccaaccagactactaacgagtggtacagaggtgactgggcctggtgccagcgttgtccccttgtggcctggcctccgtcagcagagccccaagtccaccggaacattcactcccatgggcttcggagcaaccttcaagagatctttctacctgcctttccatgtcatgagaggaagaaacaagaatgacaagtgtatgactgcctttgagctgtagttcccgtttatttacacatgtggatcctcgttttccaagcatggcttgtttgttttgatttctgctgtgcttataaatcactttcggtgggcaagggagagaggggaaaattgggtgttgactgaggaatcccccttgcttgtcttcttttgaaaccgggcatctctgaagtcctggtgtcaaggggatcaagagatgacttctcagaggttctaggtgatgctgagaccttggtgtctctaaactctgggcatgtggacaggaggggcttgcggccgtgtctctgacctgtgtgatgtgcaggagggtctcattgactcagcgcctgcgcgttgtgcctggctgtgctctcttttatgccccctctattctcctctctcccccaggggattttcatctcaacaacagagtgtcctcacccaggcctgccttccggccagtatgggcttgtacatcaggcaccttcctgcatgtgtggcctccggcctgccctcctctagccacattcaagtcctttctcaccagtttaaaaattgtgaaagtgaactgccacctatttcagaggagagatgactgccagaaacgaggtcttggtgcggaaggtctttggagtgggagggctctcaggtgcaggtggcaggtgttctgcaccttgctaggccaaggagcccgcagtcagagaggctgggaagtgggagtcaggggcagggggccttccagccatcttcccccgtaccccccagctgagaacagatggaaacgtgaagacgggtagctggggcggccagggaacccaagtccgctggccgaagccaaagcccggcaccacccccaattcttgctggtggaaagcaccgtgaaatcaaccagcggcagctctgaacgcgacgcacagcccgcgagggagcctgggcaaggacggagcgggcctgcaccggcggttgggcgggctccgggggcggggtccacctgggaccgcggcgcgcccctcaccgctcgcgccgccagggggcgccctccggagagcgcgcctaggccgcggcctgcgcttggcccctgcggg

SEQ ID NO: 372113 - DNA, 2458 bp, Homo sapiens
aggggcgccgtgctgatgtcacgagcccgcaggaagtctcgtatcgcgcccgggaggcgccggagcccagcggctggcggtattctgcctttgactgcaactcttgtcgtcttatgtgggtgttgaattgatctgtctctgcagccagatccaggctcctggaagaaccatgtccggcagctactggtcatgccaggcacacactgctgcccaagaggagctgctgtttgaattatctgtgaatgttgggaagaggaatgccagagctgccggctgaaaattacccaaccaagagaaatgtaggctgggtaccctgaatcaccccctgcaggatggactttctggtcctcttcttgttctacctggcttcggtgctgatgggtcttgttcttatctgcgtctgctcgaaaacccatagcttgaaaggcctggccaggggaggagcacagatattttcctgtataattccagaatgtcttcagagagccgtgcatggattgcttcattaccttttccatacgagaaaccacaccttcattgtcctgcacctggtcttgcaagggatggtttatactgagtacacctgggaagtatttggctactgtcaggagctggagttgtccttgcattaccttcttctgccctatctgctgctaggtgtaaacctgttttttttcaccctgacttgtggaaccaatcctggcattataacaaaagcaaatgaattattatttcttcatgtttatgaatttgatgaagtgatgtttccaaagaacgtgaggtgctctacttgtgatttaaggaaaccagctcgatccaagcactgcagtgtgtgtaactggtgtgtgcaccgtttcgaccatcactgtgtttgggtgaacaactgcatcggggcctggaacatcaggtacttcctcatctacgtcttgaccttgacggcctcggctgccaccgtcgccattgtgagcaccacttttctggtccacttggtggtgatgtcagatttataccaggagacttacatcgatgaccttggacacctccatgttatggacacggtctttcttattcagtacctgttcctgacttttccacggattgtcttcatgctgggctttgtcgtggttctgagcttcctcctgggtggctacctgttgtttgtcctgtatctggcggccaccaaccagactactaacgagtggtacagaggtgactgggcctggtgccagcgttgtccccttgtggcctggcctccgtcagcagagccccaagtccaccggaacattcactcccatgggcttcggagcaaccttcaagagatctttctacctgcctttccatgtcatgagaggaagaaacaagaatgacaagtgtatgactgcctttgagctgtagttcccgtttatttacacatgtggatcctcgttttccaagcatggcttgtttgttttgatttctgctgtgcttataaatcactttcggtgggcaagggagagaggggaaaattgggtgttgactgaggaatcccccttgcttgtcttcttttgaaaccgggcatctctgaagtcctggtgtcaaggggatcaagagatgacttctcagaggttctaggtgatgctgagaccttggtgtctctaaactctgggcatgtggacaggaggggcttgcggccgtgtctctgacctgtgtgatgtgcaggagggtctcattgactcagcgcctgcgcgttgtgcctggctgtgctctcttttatgccccctctattctcctctctcccccaggggattttcatctcaacaacagagtgtcctcacccaggcctgccttccggccagtatgggcttgtacatcaggcaccttcctgcatgtgtggcctccggcctgccctcctctagccacattcaagtcctttctcaccagtttaaaaattgtgaaagtgaactgccacctatttcagaggagagatgactgccagaaacgaggtcttggtgcggaaggtctttggagtgggagggctctcaggtgcaggtggcaggtgttctgcaccttgctaggccaaggagcccgcagtcagagaggctgggaagtgggagtcaggggcagggggccttccagccatcttcccccgtaccccccagctgagaacagatggaaacgtgaagacgggtagctggggcggccagggaacccaagtccgctggccgaagccaaagcccggcaccacccccaattcttgctggtggaaagcaccgtgaaatcaaccagcggcagctctgaacgcgacgcacagcccgcgagggagcctgggcaaggacggagcgggcctgcaccggcggttgggcgggctccgggggcggggtccacctgggaccgcggcgcgcccctcaccgctcgcgccgccagggggcgccctccggagagcgcgcctaggccgcggcctgcgcttggcccctgcggg

SEQ ID NO: 372114 - DNA, 1358 bp, Homo sapiens
  misc_feature (1337)..(1337): n is a, c, g, or t
  misc_feature (1358)..(1358): n is a, c, g, or t
aggggcgccgtgctgatgtcacgagcccgcaggaagtctcgtatcgcgcccgggaggcgccggagcccagcggctggcgccagatccaggctcctggaagaaccatgtccggcagctactggtcatgccaggcacacactgctgcccaagaggagctgctgtttgaattatctgtgaatgttgggaagaggaatgccagagctgccggctgaaaattacccaaccaagagaaatctgcaggatggactttctggtcctcttcttgttctacctggcttcggtgctgatgggtcttgttcttatctgcgtctgctcgaaaacccatagcttgaaaggcctggccaggggaggagcacagatattttcctgtataattccagaatgtcttcagagagccgtgcatggattgcttcattaccttttccatacgagaaaccacaccttcattgtcctgcacctggtcttgcaagggatggtttatactgagtacacctgggaagtatttggctactgtcaggagctggagttgtccttgcattaccttcttctgccctatctgctgctaggtgtaaacctgttttttttcaccctgacttgtggaaccaatcctggcattataacaaaagcaaatgaattattatttcttcatgtttatgaatttgatgaagtgatgtttccaaagaacgtgaggtgctctacttgtgatttaaggaaaccagctcgatccaagcactgcagtgtgtgtaactggtgtgtgcaccgtttcgaccatcactgtgtttgggtgaacaactgcatcggggcctggaacatcaggtacttcctcatctacgtcttgaccttgacggcctcggctgccaccgtcgccattgtgagcaccacttttctggtccacttggtggtgatgtcagatttataccaggagacttacatcgatgaccttggacacctccatgttatggacacggtctttcttattcagtacctgttcctgacttttccacggattgtcttcatgctgggctttgtcgtggttctgagcttcctcctgggtggctacctgttgtttgtcctgtatctggcggccaccaaccagactactaacgagtggtacagaggtgactgggcctggtgccagcgttgtccccttgtggcctggcctccgtcagcagagccccaagtccaccggaacattcactcccatgggcttcggagcaaccttcaagagatctttctacctgcctttccatgtcatgagaggaagaaacaagaatgacaagtgtatgaaataaacgggaactacagctcaaaggcagtcatacacttggtcgaccggnagcgaatttagtagtagtagn

SEQ ID NO: 372115 - DNA, 1713 bp, Homo sapiens
tcttttgtccatctggattttatattgatgaatgaagtctgcatttattttataaatagctaactggaatagcacatttcctaagtaaactttcccttttccttcagtgtgaacacttcattcatcccacaggaaactcttgtatgtactgggattattctgggctgcttctcagtgctgtttatgttcagtttgtcacatctggacacaagtaggtgggctgaggaagcagcgctggtggctgtggcaggcccagggttggccagtgttcactctcatggatgtcacagtccagctgcctaaagcactaccttttctctgctcctagtacctgttcctgacttttccacggattgtcttcatgctgggctttgtcgtggttctgagcttcctcctgggtggctacctgttgtttgtcctgtatctggcggccaccaaccagactactaacgagtggtacagaggtgactgggcctggtgccagcgttgtccccttgtggcctggcctccgtcagcagagccccaagtccaccggaacattcactcccatgggcttcggagcaaccttcaagagatctttctacctgcctttccatgtcatgagaggaagaaacaagaatgacaagtgtatgactgcctttgagctgtagttcccgtttatttacacatgtggatcctcgttttccaagcatggcttgtttgttttgatttctgctgtgcttataaatcactttcggtgggcaagggagagaggggaaaattgggtgttgactgaggaatcccccttgcttgtcttcttttgaaaccgggcatctctgaagtcctggtgtcaaggggatcaagagatgacttctcagaggttctaggtgatgctgagaccttggtgtctctaaactctgggcatgtggacaggaggggcttgcggccgtgtctctgacctgtgtgatgtgcaggagggtctcattgactcagcgcctgcgcgttgtgcctggctgtgctctcttttatgccccctctattctcctctctcccccaggggattttcatctcaacaacagagtgtcctcacccaggcctgccttccggccagtatgggcttgtacatcaggcaccttcctgcatgtgtggcctccggcctgccctcctctagccacattcaagtcctttctcaccagtttaaaaattgtgaaagtgaactgccacctatttcagaggagagatgactgccagaaacgaggtcttggtgcggaaggtctttggagtgggagggctctcaggtgcaggtggcaggtgttctgcaccttgctaggccaaggagcccgcagtcagagaggctgggaagtgggagtcaggggcagggggccttccagccatcttcccccgtaccccccagctgagaacagatggaaacgtgaagacgggtagctggggcggccagggaacccaagtccgctggccgaagccaaagcccggcaccacccccaattcttgctggtggaaagcaccgtgaaatcaaccagcggcagctctgaacgcgacgcacagcccgcgagggagcctgggcaaggacggagcgggcctgcaccggcggttgggcgggctccgggggcggggtccacctgggaccgcggcgcgcccctcaccgctcgcgccgccagggggcgccctccggagagcgcgcctaggccgcggcctgcgcttggcccctgcggg

SEQ ID NO: 372116 - DNA, 1808 bp, Homo sapiens
aggggcgccgtgctgatgtcacgagcccgcaggaagtctcgtatcgcgcccgggaggcgccggagcccagcggctggcggtaaggccgcctccgcggggctgtgggaagcttgggctgtcccaggaccgtcagtctcctcctctgaccctccctttccccttgtgtgtagggccgccgtcccacccccacctcgccggagtccggggcggccccggtgtcccctccgagcctgctgcactccacgtccccctaccagggctccagcccccagggaaatctccgaccaggcccgcccaggagccagatccaggctcctggaagaaccatgtccggcagctactggtcatgccaggcacacactgctgcccaagaggagctgctgtttgaattatctgtgaatgttgggaagaggaatgccagagctgccggctgaaaattacccaaccaagagaaatctgcaggatggactttctggtcctcttcttgttctacctggcttcggtgctgatgggtcttgttcttatctgcgtctgctcgaaaacccatagcttgaaaggcctggccaggggaggagcacagatattttcctgtataattccagaatgtcttcagagagccgtgcatggattgcttcattaccttttccatacgagaaaccacaccttcattgtcctgcacctggtcttgcaagggatggtttatactgagtacacctgggaagtatttggctactgtcaggagctggagttgtccttgcattaccttcttctgccctatctgctgctaggtgtaaacctgttttttttcaccctgacttgtggaaccaatcctggcattataacaaaagcaaatgaattattatttcttcatgtttatgaatttgatgaagtgatgtttccaaagaacgtgaggtgctctacttgtgatttaaggaaaccagctcgatccaagcactgcagtgagtgtggctctcgtgactccagcggcacctccaacagcacatgtgtgggcttcgtctgtgagggaatgtttcctgaatccgaaagcagagccagttcacccccagatatggtgtggccactacttgtagagttgagataatggtttctttcagatgagtgagggtcaggtcttgtgttcctgtgtagtagacagtcctcatctctgggcataacagcccttccctcgccacgtggcaggacatgctccccacaagttgtttctgcggatgttgtgtttgcagatttcagtcctacaaagcctagtcttctggggagggcccaagattctagacccgtgctgtctaacaaaaatagaatgtggctgggcgcagcggttcatgccaggaattccagtactttgggaggcaggcagatctcttgagcctaggagttcaagaccagcttgggcaccatggggaaaccccacctctacaaaaaatacaaaagatgtagtcctggctactcaggaggctgaggcgggaggatcacttgagcccaggagatcgaggctgcagtgagctatgattaaaccactgcactccagcctcagcaacagagcaagaccctgttctcagaaaaaaaaaaaaaggccatgaatagaaagtttttaaaaatgtttttcaaaatgtggctgtgcttggagacagttttaatcaggatgttatttaacctacatatgtaaaatatcattttaacatgtaatcaatgtaaaaaattcttcatgagatagtttatattctttttttcatactaagcctttgaaatctggtgtgtatcttacatttatagcacatcttgatttggac

SEQ ID NO: 372117 - DNA, 1873 bp, Homo sapiens
aggggcgccgtgctgatgtcacgagcccgcaggaagtctcgtatcgcgcccgggaggcgccggagcccagcggctggcggtaaggccgcctccgcggggctgtgggaagcttgggctgtcccaggaccgtcagtctcctcctctgaccctccctttccccttgtgtgtagggccgccgtcccacccccacctcgccggagtccggggcggccccggtgtcccctccgagcctgctgcactccacgtccccctaccagggctccagcccccagggaaatctccgaccaggcccgcccaggaggtattctgcctttgactgcaactcttgtcgtcttatgtgggtgttgaattgatctgtctctgcagccagatccaggctcctggaagaaccatgtccggcagctactggtcatgccaggcacacactgctgcccaagaggagctgctgtttgaattatctgtgaatgttgggaagaggaatgccagagctgccggctgaaaattacccaaccaagagaaatctgcaggatggactttctggtcctcttcttgttctacctggcttcggtgctgatgggtcttgttcttatctgcgtctgctcgaaaacccatagcttgaaaggcctggccaggggaggagcacagatattttcctgtataattccagaatgtcttcagagagccgtgcatggattgcttcattaccttttccatacgagaaaccacaccttcattgtcctgcacctggtcttgcaagggatggtttatactgagtacacctgggaagtatttggctactgtcaggagctggagttgtccttgcattaccttcttctgccctatctgctgctaggtgtaaacctgttttttttcaccctgacttgtggaaccaatcctggcattataacaaaagcaaatgaattattatttcttcatgtttatgaatttgatgaagtgatgtttccaaagaacgtgaggtgctctacttgtgatttaaggaaaccagctcgatccaagcactgcagtgagtgtggctctcgtgactccagcggcacctccaacagcacatgtgtgggcttcgtctgtgagggaatgtttcctgaatccgaaagcagagccagttcacccccagatatggtgtggccactacttgtagagttgagataatggtttctttcagatgagtgagggtcaggtcttgtgttcctgtgtagtagacagtcctcatctctgggcataacagcccttccctcgccacgtggcaggacatgctccccacaagttgtttctgcggatgttgtgtttgcagatttcagtcctacaaagcctagtcttctggggagggcccaagattctagacccgtgctgtctaacaaaaatagaatgtggctgggcgcagcggttcatgccaggaattccagtactttgggaggcaggcagatctcttgagcctaggagttcaagaccagcttgggcaccatggggaaaccccacctctacaaaaaatacaaaagatgtagtcctggctactcaggaggctgaggcgggaggatcacttgagcccaggagatcgaggctgcagtgagctatgattaaaccactgcactccagcctcagcaacagagcaagaccctgttctcagaaaaaaaaaaaaaggccatgaatagaaagtttttaaaaatgtttttcaaaatgtggctgtgcttggagacagttttaatcaggatgttatttaacctacatatgtaaaatatcattttaacatgtaatcaatgtaaaaaattcttcatgagatagtttatattctttttttcatactaagcctttgaaatctggtgtgtatcttacatttatagcacatcttgatttggac

SEQ ID NO: 372118 - DNA, 1281 bp, Homo sapiens
aggggcgccgtgctgatgtcacgagcccgcaggaagtctcgtatcgcgcccgggaggcgccggagcccagcggctggcggtaaggccgcctccgcggggctgtgggaagcttgggctgtcccaggaccgtcagtctcctcctctgaccctccctttccccttgtgtgtagggccgccgtcccacccccacctcgccggagtccggggcggccccggtgtcccctccgagcctgctgcactccacgtccccctaccagggctccagcccccagggaaatctccgaccaggcccgcccaggagccagatccaggctcctggaagaaccatgtccggcagctactggtcatgccaggcacacactgctgcccaagaggagctgctgtttgaattatctgtgaatgttgggaagaggaatgccagagctgccggctgaaaattacccaaccaagagaaatctgcaggatggactttctggtcctcttcttgttctacctggcttcggtgctgatgggtcttgttcttatctgcgtctgctcgaaaacccatagcttgaaaggcctggccaggggaggagcacagatattttcctgtataattccagaatgtcttcagagagccgtgcatggattgcttcattaccttttccatacgagaaaccacaccttcattgtcctgcacctggtcttgcaagggatggtttatactgagtacacctgggaagtatttggctactgtcaggagctggagttgtccttgcattaccttcttctgccctatctgctgctaggtgtaaacctgttttttttcaccctgacttgtggaaccaatcctggcattataacaaaagcaaatgaattattatttcttcatgtttatgaatttgatgaagtgatgtttccaaagaacgtgaggtgctctacttgtgatttaaggaaaccagctcgatccaagcactgcagtgagtgtggctctcgtgactccagcggcacctccaacagcacatgtgtgggcttcgtctgtgagggaatgtttcctgaatccgaaagcagagccagttcacccccagatatggtgtggccactacttgtagagttgagataatggtttctttcagatgagtgagggtcaggtcttgtgttcctgtgtagtagacagtcctcatctctgggcataacagcccttccctcgccacgtggcaggacatgctccccacaagttgtttctgcggatgttgttgatcctcccgcctagcctctgagtagctgggaccatgggtgcat

SEQ ID NO: 372119 - DNA, 548 bp, Homo sapiens
gctcaggaccattttggaggccccactgagaggcagcaggcctctgttatgtgtgcctaagaattggtgaattctgttctgtttgtctttctgctttttgctttgagatgtcattaaagtctagatgaattctgttttggtagccatttgggagttgatgtctgagaatgtgtgccatggaagaaacctttcagtagcagatagtcacactctttctgttcctttgtagctgcaggatggactttctggtcctcttcttgttctacctggcttcggtgctgatgggtcttgttcttatctgcgtctgctcgaaaacccatagcttgaaaggcctggccaggggaggagcacaggtaaggatgatccttggatggcactggaatttgaatactgtgttagtctaagagactcacaggttttgctacaggacaaaaaagagatgccaggccgggtgcagtgcctcacacctgtaatcccgctactcaggaagctgaggcaggaggatcccttgagccaggagtctgaagttgccatgagctatgatcacg

SEQ ID NO: 372120 - DNA, 1407 bp, Homo sapiens
ggcacgaggagcccatgcgtggcgccagatccaggctcctggaagaaccatgtccggcagctactggtcatgccaggcacacactgctgcccaagaggagctgttgtttgtcctgtatctggcggccaccaaccagactactaacgagtggtacagaggtgactgggcctggtgccagcgttgtccccttgtggcctggcctccgtcagcagagccccaagtccaccggaacattcactcccatgggcttcggagcaaccttcaagagatctttctacctgcctttccatgtcatgagaggaagaaacaagaatgacaagtgtatgactgcctttgagctgtagttcccgtttatttacacatgtggatcctcgttttccaagcatggcttgtttgttttgatttctgctgtgcttataaatcactttcggtgggcaagggagagaggggaaaattgggtgttgactgaggaatcccccttgcttgtcttcttttgaaaccgggcatctctgaagtcctggtgtcaaggggatcaagagatgacttctcagaggttctaggtgatgctgagaccttggtgtctctaaactctgggcatgtggacaggaggggcttgcggccgtgtctctgacctgtgtgatgtgcaggagggtctcattgactcagcgcctgcgcgttgtgcctggctgtgctctcttttatgccccctctattctcctctctcccccaggggattttcatctcaacaacagagtgtcctcacccaggcctgccttccggccagtatgggcttgtacatcaggcaccttcctgcatgtgtggcctccggcctgccctcctctagccacattcaagtcctttctcaccagtttaaaaattgtgaaagtgaactgccacctatttcagaggagagatgactgccagaaacgaggtcttggtgcggaaggtctttggagtgggagggctctcaggtgcaggtggcaggtgttctgcaccttgctaggccaaggagcccgcagtcagagaggctgggaagtgggagtcaggggcagggggccttccagccatcttcccccgtaccccccagctgagaacagatggaaacgtgaagacgggtagctggggcggccagggaacccaagtccgctggccgaagccaaagcccggcaccacccccaattcttgctggtggaaagcaccgtgaaatcaaccagcggcagctctgaacgcgacgcacagcccgcgagggagcctgggcaaggacggagcgggcctgcaccggcggttgggcgggctccgggggcggggtccacctgggaccgcggcgcgcccctcaccgctcgcgccgccagggggcgccctccggagagcgcgcctaggccgcggcctgcgcttggcccctgcggg

SEQ ID NO: 372121 - DNA, 2367 bp, Homo sapiens
aggggcgccgtgctgatgtcacgagcccgcaggaagtctcgtatcgcgcccgggaggcgccggagcccagcggctggcgccagatccaggctcctggaagaaccatgtccggcagctactggtcatgccaggcacacactgctgcccaagaggagctgctgtttgaattatctgtgaatgttgggaagaggaatgccagagctgccggctgaaaattacccaaccaagagaaatctgcaggatggactttctggtcctcttcttgttctacctggcttcggtgctgatgggtcttgttcttatctgcgtctgctcgaaaacccatagcttgaaaggcctggccaggggaggagcacagatattttcctgtataattccagaatgtcttcagagagccgtgcatggattgcttcattaccttttccatacgagaaaccacaccttcattgtcctgcacctggtcttgcaagggatggtttatactgagtacacctgggaagtatttggctactgtcaggagctggagttgtccttgcattaccttcttctgccctatctgctgctaggtgtaaacctgttttttttcaccctgacttgtggaaccaatcctggcattataacaaaagcaaatgaattattatttcttcatgtttatgaatttgatgaagtgatgtttccaaagaacgtgaggtgctctacttgtgatttaaggaaaccagctcgatccaagcactgcagtgtgtgtaactggtgtgtgcaccgtttcgaccatcactgtgtttgggtgaacaactgcatcggggcctggaacatcaggtacttcctcatctacgtcttgaccttgacggcctcggctgccaccgtcgccattgtgagcaccacttttctggtccacttggtggtgatgtcagatttataccaggagacttacatcgatgaccttggacacctccatgttatggacacggtctttcttattcagtacctgttcctgacttttccacggattgtcttcatgctgggctttgtcgtggttctgagcttcctcctgggtggctacctgttgtttgtcctgtatctggcggccaccaaccagactactaacgagtggtacagaggtgactgggcctggtgccagcgttgtccccttgtggcctggcctccgtcagcagagccccaagtccaccggaacattcactcccatgggcttcggagcaaccttcaagagatctttctacctgcctttccatgtcatgagaggaagaaacaagaatgacaagtgtatgactgcctttgagctgtagttcccgtttatttacacatgtggatcctcgttttccaagcatggcttgtttgttttgatttctgctgtgcttataaatcactttcggtgggcaagggagagaggggaaaattgggtgttgactgaggaatcccccttgcttgtcttcttttgaaaccgggcatctctgaagtcctggtgtcaaggggatcaagagatgacttctcagaggttctaggtgatgctgagaccttggtgtctctaaactctgggcatgtggacaggaggggcttgcggccgtgtctctgacctgtgtgatgtgcaggagggtctcattgactcagcgcctgcgcgttgtgcctggctgtgctctcttttatgccccctctattctcctctctcccccaggggattttcatctcaacaacagagtgtcctcacccaggcctgccttccggccagtatgggcttgtacatcaggcaccttcctgcatgtgtggcctccggcctgccctcctctagccacattcaagtcctttctcaccagtttaaaaattgtgaaagtgaactgccacctatttcagaggagagatgactgccagaaacgaggtcttggtgcggaaggtctttggagtgggagggctctcaggtgcaggtggcaggtgttctgcaccttgctaggccaaggagcccgcagtcagagaggctgggaagtgggagtcaggggcagggggccttccagccatcttcccccgtaccccccagctgagaacagatggaaacgtgaagacgggtagctggggcggccagggaacccaagtccgctggccgaagccaaagcccggcaccacccccaattcttgctggtggaaagcaccgtgaaatcaaccagcggcagctctgaacgcgacgcacagcccgcgagggagcctgggcaaggacggagcgggcctgcaccggcggttgggcgggctccgggggcggggtccacctgggaccgcggcgcgcccctcaccgctcgcgccgccagggggcgccctccggagagcgcgcctaggccgcggcctgcgcttggcccctgcggg

SEQ ID NO: 372122 - DNA, 1473 bp, Homo sapiens
aggggcgccgtgctgatgtcacgagcccgcaggaagtctcgtatcgcgcccgggaggcgccggagcccagcggctggcgccagatccaggctcctggaagaaccatgtccggcagctactggtcatgccaggcacacactgctgcccaagaggagctgctgtttgaattatctgtgaatgttgggaagaggaatgccagagctgccggctgaaaattacccaaccaagagaaatctgcaggatggactttctggtcctcttcttgttctacctggcttcggtgctgatgggtcttgttcttatctgcgtctgctcgaaaacccatagcttgaaaggcctggccaggggaggagcacagatattttcctgtataattccagaatgtcttcagagagccgtgcatggattgcttcattaccttttccatacgagaaaccacaccttcattgtcctgcacctggtcttgcaagggatggtttatactgagtacacctgggaagtatttggctactgtcaggagctggagttgtccttgcattaccttcttctgccctatctgctgctaggtgtaaacctgttttttttcaccctgacttgtggaaccaatcctggcattataacaaaagcaaatgaattattatttcttcatgtttatgaatttgatgaagtgatgtttccaaagaacgtgaggtgctctacttgtgatttaaggaaaccagctcgatccaagcactgcagtgtgtgtaactggtgtgtgcaccgtttcgaccatcactgtgtttgggtgaacaactgcatcggggcctggaacatcaggtacttcctcatctacgtcttgaccttgacggcctcggctgccaccgtcgccattgtgagcaccacttttctggtccacttggtggtgatgtcagatttataccaggagacttacatcgatgaccttggacacctccatgttatggacacggtctttcttattcagtacctgttcctgacttttccacggattgtcttcatgctgggctttgtcgtggttctgagcttcctcctgggtggctacctgttgtttgtcctgtatctggcggccaccaaccagactactaacgagtggtacagaggtgactgggcctggtgccagcgttgtccccttgtggcctggcctccgtcagcagagccccaagtccaccggaacattcactcccatgggcttcggagcaaccttcaagagatctttctacctgcctttccatgtcatgagaggaagaaacaagaatgacaagtgtatgagcaaaaaaaaaaaggggcgtctaaattccctcgagggccaaggttcgggtacccgttttgtccaagtggccttagggggataaagaaggcgccgcttcaagtcgccggaaggcccggtttgtaggcccccggtgccctggacccccgtagcgaatatatttggaacgcttgggatgtgttacacca

SEQ ID NO: 372123 - DNA, 2588 bp, Homo sapiens
aggggcgccgtgctgatgtcacgagcccgcaggaagtctcgtatcgcgcccgggaggcgccggagcccagcggctggcgccagatccaggctcctggaagaaccatgtccggcagctactggtcatgccaggcacacactgctgcccaagaggagctgctgtttgaattatctgtgaatgttgggaagaggaatgccagagctgccggctgaaaattacccaaccaagagaaatctgcaggatggactttctggtcctcttcttgttctacctggcttcggtgctgatgggtcttgttcttatctgcgtctgctcgaaaacccatagcttgaaaggcctggccaggggaggagcacagatattttcctgtataattccagaatgtcttcagagagccgtgcatggattgcttcattaccttttccatacgagaaaccacaccttcattgtcctgcacctggtcttgcaagggatggtttatactgagtacacctgggaagtatttggctactgtcaggagctggagttgtccttgcattaccttcttctgccctatctgctgctaggtgtaaacctgttttttttcaccctgacttgtggaaccaatcctggcattataacaaaagcaaatgaattattatttcttcatgtttatgaatttgatgaagtgatgtttccaaagaacgtgaggtgctctacttgtgatttaaggaaaccagctcgatccaagcactgcagtgtgtgtaactggtgtgtgcaccgtttcgaccatcactgtgtttgggtgaacaactgcatcggggcctggaacatcaggtacttcctcatctacgtcttgaccttgacggcctcggctgccaccgtcgccattgtgagcaccacttttctggtccacttggtggtgatgtcagatttataccaggagacttacatcgatgaccttggacacctccatgttatggacacggtctttcttattcagtgtgaacacttcattcatcccacaggaaactcttgtatgtactgggattattctgggctgcttctcagtgctgtttatgttcagtttgtcacatctggacacaagtaggtgggctgaggaagcagcgctggtggctgtggcaggcccagggttggccagtgttcactctcatggatgtcacagtccagctgcctaaagcactaccttttctctgctcctagtacctgttcctgacttttccacggattgtcttcatgctgggctttgtcgtggttctgagcttcctcctgggtggctacctgttgtttgtcctgtatctggcggccaccaaccagactactaacgagtggtacagaggtgactgggcctggtgccagcgttgtccccttgtggcctggcctccgtcagcagagccccaagtccaccggaacattcactcccatgggcttcggagcaaccttcaagagatctttctacctgcctttccatgtcatgagaggaagaaacaagaatgacaagtgtatgactgcctttgagctgtagttcccgtttatttacacatgtggatcctcgttttccaagcatggcttgtttgttttgatttctgctgtgcttataaatcactttcggtgggcaagggagagaggggaaaattgggtgttgactgaggaatcccccttgcttgtcttcttttgaaaccgggcatctctgaagtcctggtgtcaaggggatcaagagatgacttctcagaggttctaggtgatgctgagaccttggtgtctctaaactctgggcatgtggacaggaggggcttgcggccgtgtctctgacctgtgtgatgtgcaggagggtctcattgactcagcgcctgcgcgttgtgcctggctgtgctctcttttatgccccctctattctcctctctcccccaggggattttcatctcaacaacagagtgtcctcacccaggcctgccttccggccagtatgggcttgtacatcaggcaccttcctgcatgtgtggcctccggcctgccctcctctagccacattcaagtcctttctcaccagtttaaaaattgtgaaagtgaactgccacctatttcagaggagagatgactgccagaaacgaggtcttggtgcggaaggtctttggagtgggagggctctcaggtgcaggtggcaggtgttctgcaccttgctaggccaaggagcccgcagtcagagaggctgggaagtgggagtcaggggcagggggccttccagccatcttcccccgtaccccccagctgagaacagatggaaacgtgaagacgggtagctggggcggccagggaacccaagtccgctggccgaagccaaagcccggcaccacccccaattcttgctggtggaaagcaccgtgaaatcaaccagcggcagctctgaacgcgacgcacagcccgcgagggagcctgggcaaggacggagcgggcctgcaccggcggttgggcgggctccgggggcggggtccacctgggaccgcggcgcgcccctcaccgctcgcgccgccagggggcgccctccggagagcgcgcctaggccgcggcctgcgcttggcccctgcggg

SEQ ID NO: 372124 - DNA, 1651 bp, Homo sapiens
aggggcgccgtgctgatgtcacgagcccgcaggaagtctcgtatcgcgcccgggaggcgccggagcccagcggctggcggtattctgcctttgactgcaactcttgtcgtcttatgtgggtgttgaattgatctgtctctgcagccagatccaggctcctggaagaaccatgtccggcagctactggtcatgccaggcacacactgctgcccaagaggagctgctgtttgaattatctgtgaatgttgggaagaggaatgccagagctgccggctgaaaattacccaaccaagagaaatctgcaggatggactttctggtcctcttcttgttctacctggcttcggtgctgatgggtcttgttcttatctgcgtctgctcgaaaacccatagcttgaaaggcctggccaggggaggagcacagatattttcctgtataattccagaatgtcttcagagagccgtgcatggattgcttcattaccttttccatacgagaaaccacaccttcattgtcctgcacctggtcttgcaagggatggtttatactgagtacacctgggaagtatttggctactgtcaggagctggagttgtccttgcattaccttcttctgccctatctgctgctaggtgtaaacctgttttttttcaccctgacttgtggaaccaatcctggcattataacaaaagcaaatgaattattatttcttcatgtttatgaatttgatgaagtgatgtttccaaagaacgtgaggtgctctacttgtgatttaaggaaaccagctcgatccaagcactgcagtgagtgtggctctcgtgactccagcggcacctccaacagcacatgtgtgggcttcgtctgtgagggaatgtttcctgaatccgaaagcagagccagttcacccccagatatggtgtggccactacttgtagagttgagataatggtttctttcagatgagtgagggtcaggtcttgtgttcctgtgtagtagacagtcctcatctctgggcataacagcccttccctcgccacgtggcaggacatgctccccacaagttgtttctgcggatgttgtgtttgcagatttcagtcctacaaagcctagtcttctggggagggcccaagattctagacccgtgctgtctaacaaaaatagaatgtggctgggcgcagcggttcatgccaggaattccagtactttgggaggcaggcagatctcttgagcctaggagttcaagaccagcttgggcaccatggggaaaccccacctctacaaaaaatacaaaagatgtagtcctggctactcaggaggctgaggcgggaggatcacttgagcccaggagatcgaggctgcagtgagctatgattaaaccactgcactccagcctcagcaacagagcaagaccctgttctcagaaaaaaaaaaaaaggccatgaatagaaagtttttaaaaatgtttttcaaaatgtggctgtgcttggagacagttttaatcaggatgttatttaacctacatatgtaaaatatcattttaacatgtaatcaatgtaaaaaattcttcatgagatagtttatattctttttttcatactaagcctttgaaatctggtgtgtatcttacatttatagcacatcttgatttggac

SEQ ID NO: 372125 - DNA, 1677 bp, Homo sapiens
aggggcgccgtgctgatgtcacgagcccgcaggaagtctcgtatcgcgcccgggaggcgccggagcccagcggctggcggtattctgcctttgactgcaactcttgtcgtcttatgtgggtgttgaattgatctgtctctgcagccagatccaggctcctggaagaaccatgtccggcagctactggtcatgccaggcacacactgctgcccaagaggagctgctgtttgaattatctgtgaatgttgggaagaggaatgccagagctgccggctgaaaattacccaaccaagagaaatgtaggctgggtaccctgaatcaccccctgcaggatggactttctggtcctcttcttgttctacctggcttcggtgctgatgggtcttgttcttatctgcgtctgctcgaaaacccatagcttgaaaggcctggccaggggaggagcacagatattttcctgtataattccagaatgtcttcagagagccgtgcatggattgcttcattaccttttccatacgagaaaccacaccttcattgtcctgcacctggtcttgcaagggatggtttatactgagtacacctgggaagtatttggctactgtcaggagctggagttgtccttgcattaccttcttctgccctatctgctgctaggtgtaaacctgttttttttcaccctgacttgtggaaccaatcctggcattataacaaaagcaaatgaattattatttcttcatgtttatgaatttgatgaagtgatgtttccaaagaacgtgaggtgctctacttgtgatttaaggaaaccagctcgatccaagcactgcagtgagtgtggctctcgtgactccagcggcacctccaacagcacatgtgtgggcttcgtctgtgagggaatgtttcctgaatccgaaagcagagccagttcacccccagatatggtgtggccactacttgtagagttgagataatggtttctttcagatgagtgagggtcaggtcttgtgttcctgtgtagtagacagtcctcatctctgggcataacagcccttccctcgccacgtggcaggacatgctccccacaagttgtttctgcggatgttgtgtttgcagatttcagtcctacaaagcctagtcttctggggagggcccaagattctagacccgtgctgtctaacaaaaatagaatgtggctgggcgcagcggttcatgccaggaattccagtactttgggaggcaggcagatctcttgagcctaggagttcaagaccagcttgggcaccatggggaaaccccacctctacaaaaaatacaaaagatgtagtcctggctactcaggaggctgaggcgggaggatcacttgagcccaggagatcgaggctgcagtgagctatgattaaaccactgcactccagcctcagcaacagagcaagaccctgttctcagaaaaaaaaaaaaaggccatgaatagaaagtttttaaaaatgtttttcaaaatgtggctgtgcttggagacagttttaatcaggatgttatttaacctacatatgtaaaatatcattttaacatgtaatcaatgtaaaaaattcttcatgagatagtttatattctttttttcatactaagcctttgaaatctggtgtgtatcttacatttatagcacatcttgatttggac

SEQ ID NO: 372126 - DNA, 481 bp, Homo sapiens
ttgagggatactttgtccacccaccactgccaaggagaccttagtctatacgccaggttgcaatgtctgaagctttgctgtccaatatggtagccattggccacatgtggctattgaatgcttgtaaaggtaggtggtacagctgaggaatggaattttaaatttgtttaatttaaaatttaagacagagattcgattcagttattggaaaatgttttatgtttgaaaaaacttagatgtgtgaatccactttctcaacagtgacctgtatgaaatatagatttttctggtgaaaatttagtaactgaattgcgatgttgagatgtactgtaagtgtaaaatatacactggattttaaagacctaatatgaaaaaatgttaaatattttatgattgatttttatattgataatatattgaaatgataatagtttgggtatattgggttaaataaagtaagtatttaaatgtatccgtttca

SEQ ID NO: 372127 - DNA, 722 bp, Homo sapiens
cattgcccctgtaacctgtcaaagaagagctaagggagctttcggggttggcttcttggaggctgctttctcctttacttggaaggcttcgctagtgatggacccatacatgattcagatgagcagcaaaggcaacctcccctcaattctggacgtgcatgtcaacgttggtgggagaagctctgtgccgggaaaaatgaaaggcagaaaggccaggtggtctgtgaggccctcagacatggccaagaaaactttcaaccccatccgagccattgtggacaacatgaaggtgaaaccaaatccaaacaaaaccatgatttccctgtccattggggaccctactgtgtttggaaacctgcctacagaccctgaagttacccaggcaatgaaagatgccctggactcgggcaaatataatggctatgccccatccatcggtaagctcctcctgagactccatacctggtgactgccaaatctttagtgctcttataacaggactaaatgtctagcaatcctcttcactttcctgatgcacaattcctaaggagaggctaagattacatggtcctttggatttgggaaccgggtctcgggatgcttaaatacaaggcatcaaggtccaacttctttcctggctttctttgacatatgggcacttcccctctagggtcccaaacatacttatttgtcaagtaaagctcctatcctatcattactaa

SEQ ID NO: 372128 - DNA, 3098 bp, Homo sapiens
  misc_feature (577)..(577): n is a, c, g, or t
cattgcccctgtaacctgtcaaagaagagctaagggagctttcggggttggcttcttggaggctgctttctcctttacttggaaggcttcgctagtgatggacccatacatgattcagatgagcagcaaaggcaacctcccctcaattctggacgtgcatgtcaacgttggtgggagaagctctgtgccgggaaaaatgaaaggcagaaaggccaggtggtctgtgaggccctcagacatggccaagaaaactttcaaccccatccgagccattgtggacaacatgaaggtgaaaccaaatccaaacaaaaccatgatttccctgtccattggggaccctactgtgtttggaaacctgcctacagaccctgaagttacccaggcaatgaaagatgccctggactcgggcaaatataatggctatgccccatccatcggcttcctatccagtcgggaggagattgcttcttattaccactgtcctgaggcacccctagaagctaaggacgtcattctgacaagtggctgcagccaagctattgacctttgtttagctgtgttggccaacccagggcanaacatcctggttccaagacctggtttctctctctacaagactctggctgagtctatgggaattgaggtcaaactctacaatttgttgccagagaaatcttgggaaattgacctgaaacaactggaatatctaattgatgaaaagacagcttgtctcattgtcaataatccatcaaacccctgtgggtcagtgttcagcaaacgtcatcttcagaagattctggcagtggctgcacggcagtgtgtccccatcttagctgatgagatctatggagacatggtgttttcggattgcaaatatgaaccactggccaccctcagcaccgatgtccccatcctgtcctgtggagggctggccaagcgctggctggttcctggctggaggttgggctggatcctcattcatgaccgaagagacatttttggcaatgagatccgagatgggctggtgaagctgagtcagcgcattttgggaccctgtaccattgtccagggagctctgctcaagcatcctatgtcgcaccccgggagagttttaccacaacactctgagcttcctcaagtccaatgctgatctctgttatggggcgttggctgccatccctggactccggccagtccgcccttctggggctatgtacctcatggttggaattgagatggaacatttcccagaatttgagaacgatgtggagttcacggagcggttagttgctgagcagtctgtccactgcctcccagcaacgtgctttgagtacccgaatttcatccgagtggtcatcacagtccccgaggtgatgatgctggaggcgtgcagccggatccaggagttctgtgagcagcactaccattgtgctgaaggcagccaggaggagtgtgataaataggcctgcatccattctcctgaggatgtgtcccatctagggaaggctggactaggccttgcggctcctcagggactcaggtggccctactgggagaggggcctcaaatgcaccatgtcaagggttcaagattgttcctgcttttccccaagtacaaccacacccacactcagatcctcctcattcacatcgcagattctcccttgctctgcgctgctagagtgactcactaattcattaatctgcctccctctcgtaagatttccttctttttttcttgaaagtaccaggtgaacaaagtttaccagaaagcagttgagacaagaaaataagagctcaggatgagggaaaagaaaaagattgagagaatttgtgcccccaaccatttcctcagactctaagaaagaacacgctctctccaggcaggtctgaagctcaactctcttattgcctcacttcaggtatacctcactttacacaatagaattataactggaaagaagttggggacacatgtatttggtgattacattttaaacacattaggaaaagttgctatttgaactttttattgatttttggggggagtaaagaattattttgtgatgcaaataaatatcctttaattgatcgacttgccaaatttagatttgtgtgcatcaggctttcttttttttctttttttagagaagttcaatataagcttttcttttctttgtttctttctttctttattttgagatggagtcttgctctgtcgcccatgctggagtgcagtggcgcgatctcggctcactgcaacctccacctcctgggttcaagcgattctcttgcctcaacctcccaagcagttgggactacaggcgtgagccaccatgcccggctaatttttgtatttttagtagagacagggtttcaccatgttagccaggctggtctcaaactcctgacctcaggcaatctgcccgcctgggtctcctaaagtactgggattacaggcgtgagccacctcgcccagcggcatcaggctttcttaaagtgagagcacgcctgtactagagcaagcaggaatcagagaccttccagaaatactactgtgtaagggccagaaatatcttcacttgtcattgttatataatcattattacttttgctgtaatgttaatattgatttattaatatatattatcttttcatacattttctaagaaacatttatattgataagatcttttattttgccaagggcataaattattgtttttctttttttttttttaataaatttcaccaagtatggctcgtgccaaaaaaaaaacagaaaaacacaaaacaacaaaacttgtggtggggccgcgcctgggcgacccagaaaagaagttttctacaacacctcccgtggggggggcgcgccgagcacccgagaggttagtggcgacacagtggggccaacagacgtggggtgccaaagaggaaacactccggcccacgaacagatggtcgcgtggtgtttcccccccaaataaaaaaaagcggcgggggcaacccggacgcggttggggacccacctccacagagggcggttcggagggccaagcgggggcctcacagcgagggcgcccagggagcgaaaaaata

SEQ ID NO: 372129 - DNA, 2416 bp, Homo sapiens
ccgtctgggagacagagtgagaccccatccgaaaagaaaaaaaaaaaagatttaatttttcagtacagagaatcattttatatatgtagatacagggaagatttaaaacacaaataagaggcttttcataccattgtaattctcaactgggagtgatactggttccctaagggtatctgggaatgtatgggaattttgtttgttttcagaatgactaggggctgccattttgtgggtcagggatgttaaatatcctgcaaggggtgggctagtctcatgccataaagagttgcctggccctaatgccagtagtgtctcttttgagacatactagcattctatttccagcttttatttatcagcatcagggaaggaactctttaatatttattaataaaaatatatcctgtcttccctgagaaaaatatcttttaaagtagcccctaccttaatttctggcacaggaaattggcctgttctccctccttctgataagttggcctctccctcctgttggtataggttggaattgagatggaacatttcccagaatttgagaacgatgtggagttcacggagcggttagttgctgagcagtctgtccactgcctcccagcaacgtgctttgagtacccgaatttcatccgagtggtcatcacagtccccgaggtgatgatgctggaggcgtgcagccggatccaggagttctgtgagcagcactaccattgtgctgaaggcagccaggaggagtgtgataaataggcctgcatccattctcctgaggatgtgtcccatctagggaaggctggactaggccttgcggctcctcagggactcaggtggccctactgggagaggggcctcaaatgcaccatgtcaagggttcaagattgttcctgcttttccccaagtacaaccacacccacactcagatcctcctcattcacatcgcagattctcccttgctctgcgctgctagagtgactcactaattcattaatctgcctccctctcgtaagatttccttctttttttcttgaaagtaccaggtgaacaaagtttaccagaaagcagttgagacaagaaaataagagctcaggatgagggaaaagaaaaagattgagagaatttgtgcccccaaccatttcctcagactctaagaaagaacacgctctctccaggcaggtctgaagctcaactctcttattgcctcacttcaggtatacctcactttacacaatagaattataactggaaagaagttggggacacatgtatttggtgattacattttaaacacattaggaaaagttgctatttgaactttttattgatttttggggggagtaaagaattattttgtgatgcaaataaatatcctttaattgatcgacttgccaaatttagatttgtgtgcatcaggctttcttttttttctttttttagagaagttcaatataagcttttcttttctttgtttctttctttctttattttgagatggagtcttgctctgtcgcccatgctggagtgcagtggcgcgatctcggctcactgcaacctccacctcctgggttcaagcgattctcttgcctcaacctcccaagcagttgggactacaggcgtgagccaccatgcccggctaatttttgtatttttagtagagacagggtttcaccatgttagccaggctggtctcaaactcctgacctcaggcaatctgcccgcctgggtctcctaaagtactgggattacaggcgtgagccacctcgcccagcggcatcaggctttcttaaagtgagagcacgcctgtactagagcaagcaggaatcagagaccttccagaaatactactgtgtaagggccagaaatatcttcacttgtcattgttatataatcattattacttttgctgtaatgttaatattgatttattaatatatattatcttttcatacattttctaagaaacatttatattgataagatcttttattttgccaagggcataaattattgtttttctttttttttttttaataaatttcaccaagtatggctcttctgtgatgtgtttttttctccgtttgggaatttctaatcccaggcactcctcagtctcattgttccattacctatgaggtttcatttacttctttgtaaatgtactgactttgggagttacttaagaaccacagttcctaaaacatttattggggagctcaacttctggcttcctacttaccaagaggcagtaagttataacctctggcctttgtcttatacatttccaactttctggatccctaacctctggtcccaagttactacgcttgcctatatccactaaccactcactaggtcacaaagttgatggctctggcttgacccagtgaatgagaagtgtcctagatgt

SEQ ID NO: 372130 - DNA, 2146 bp, Homo sapiens
cctgatcttttctcctcaaacaaaatgtcttctcatttgataagattcaaactgatgtgtctcatggatcctatttaaaatttgcttctcccccccatcataatcccatccatactgggaagaaaagttgtaaacaaacgttctaggtgagaggaaattgatcctgtcccacaagtcattttaagatgaatgaactcagttgctgacttagcatcccagtcatgggagctgaatgaactgatggccctgatgaaatggtaccacttcttgtggatcagggtcctgaccattttagggtggtccagtaccagactcaattgctctgaaagtaacagactcttctttttgcagtgctttgagtacccgaatttcatccgagtggtcatcacagtccccgaggtgatgatgctggaggcgtgcagccggatccaggagttctgtgagcagcactaccattgtgctgaaggcagccaggaggagtgtgataaataggcctgcatccattctcctgaggatgtgtcccatctagggaaggctggactaggccttgcggctcctcagggactcaggtggccctactgggagaggggcctcaaatgcaccatgtcaagggttcaagattgttcctgcttttccccaagtacaaccacacccacactcagatcctcctcattcacatcgcagattctcccttgctctgcgctgctagagtgactcactaattcattaatctgcctccctctcgtaagatttccttctttttttcttgaaagtaccaggtgaacaaagtttaccagaaagcagttgagacaagaaaataagagctcaggatgagggaaaagaaaaagattgagagaatttgtgcccccaaccatttcctcagactctaagaaagaacacgctctctccaggcaggtctgaagctcaactctcttattgcctcacttcaggtatacctcactttacacaatagaattataactggaaagaagttggggacacatgtatttggtgattacattttaaacacattaggaaaagttgctatttgaactttttattgatttttggggggagtaaagaattattttgtgatgcaaataaatatcctttaattgatcgacttgccaaatttagatttgtgtgcatcaggctttcttttttttctttttttagagaagttcaatataagcttttcttttctttgtttctttctttctttattttgagatggagtcttgctctgtcgcccatgctggagtgcagtggcgcgatctcggctcactgcaacctccacctcctgggttcaagcgattctcttgcctcaacctcccaagcagttgggactacaggcgtgagccaccatgcccggctaatttttgtatttttagtagagacagggtttcaccatgttagccaggctggtctcaaactcctgacctcaggcaatctgcccgcctgggtctcctaaagtactgggattacaggcgtgagccacctcgcccagcggcatcaggctttcttaaagtgagagcacgcctgtactagagcaagcaggaatcagagaccttccagaaatactactgtgtaagggccagaaatatcttcacttgtcattgttatataatcattattacttttgctgtaatgttaatattgatttattaatatatattatcttttcatacattttctaagaaacatttatattgataagatcttttattttgccaagggcataaattattgtttttctttttttttttttaataaatttcaccaagtatggctcttctgtgatgtgtttttttctccgtttgggaatttctaatcccaggcactcctcagtctcattgttccattacctatgaggtttcatttacttctttgtaaatgtactgactttgggagttacttaagaaccacagttcctaaaacatttattggggagctcaacttctggcttcctacttaccaagaggcagtaagttataacctctggcctttgtcttatacatttccaactttctggatccctaacctctggtcccaagttactacgcttgcctatatccactaaccactcactaggtcacaaagttgatggctctggcttgacccagtgaatgagaagtgtcctagatgt

SEQ ID NO: 372131 - DNA, 2413 bp, Homo sapiens
ccgtctgggagacagagtgagaccccatccgaaaagaaaaaaaaaaaagatttaatttttcagtacagagaatcattttatatatgtagatacagggaagatttaaaacacaaataagaggcttttcataccattgtaattctcaactgggagtgatactggttccctaagggtatctgggaatgtatgggaattttgtttgttttcagaatgactaggggctgccattttgtgggtcagggatgttaaatatcctgcaaggggtgggctagtctcatgccataaagagttgcctggccctaatgccagtagtgtctcttttgagacatactagcattctatttccagcttttatttatcagcatcataatcccatccatactgggaagaaaagttgtaaacaaacgttctaggtgagaggaaattgatcctgtcccacaagtcattttaagatgaatgaactcagttgctgacttagcatcccagtcatgggagctgaatgaactgatggccctgatgaaatggtaccacttcttgtggatcagggtcctgaccattttagggtggtccagtaccagactcaattgctctgaaagtaacagactcttctttttgcagtgctttgagtacccgaatttcatccgagtggtcatcacagtccccgaggtgatgatgctggaggcgtgcagccggatccaggagttctgtgagcagcactaccattgtgctgaaggcagccaggaggagtgtgataaataggcctgcatccattctcctgaggatgtgtcccatctagggaaggctggactaggccttgcggctcctcagggactcaggtggccctactgggagaggggcctcaaatgcaccatgtcaagggttcaagattgttcctgcttttccccaagtacaaccacacccacactcagatcctcctcattcacatcgcagattctcccttgctctgcgctgctagagtgactcactaattcattaatctgcctccctctcgtaagatttccttctttttttcttgaaagtaccaggtgaacaaagtttaccagaaagcagttgagacaagaaaataagagctcaggatgagggaaaagaaaaagattgagagaatttgtgcccccaaccatttcctcagactctaagaaagaacacgctctctccaggcaggtctgaagctcaactctcttattgcctcacttcaggtatacctcactttacacaatagaattataactggaaagaagttggggacacatgtatttggtgattacattttaaacacattaggaaaagttgctatttgaactttttattgatttttggggggagtaaagaattattttgtgatgcaaataaatatcctttaattgatcgacttgccaaatttagatttgtgtgcatcaggctttcttttttttctttttttagagaagttcaatataagcttttcttttctttgtttctttctttctttattttgagatggagtcttgctctgtcgcccatgctggagtgcagtggcgcgatctcggctcactgcaacctccacctcctgggttcaagcgattctcttgcctcaacctcccaagcagttgggactacaggcgtgagccaccatgcccggctaatttttgtatttttagtagagacagggtttcaccatgttagccaggctggtctcaaactcctgacctcaggcaatctgcccgcctgggtctcctaaagtactgggattacaggcgtgagccacctcgcccagcggcatcaggctttcttaaagtgagagcacgcctgtactagagcaagcaggaatcagagaccttccagaaatactactgtgtaagggccagaaatatcttcacttgtcattgttatataatcattattacttttgctgtaatgttaatattgatttattaatatatattatcttttcatacattttctaagaaacatttatattgataagatcttttattttgccaagggcataaattattgtttttctttttttttttttaataaatttcaccaagtatggctcttctgtgatgtgtttttttctccgtttgggaatttctaatcccaggcactcctcagtctcattgttccattacctatgaggtttcatttacttctttgtaaatgtactgactttgggagttacttaagaaccacagttcctaaaacatttattggggagctcaacttctggcttcctacttaccaagaggcagtaagttataacctctggcctttgtcttatacatttccaactttctggatccctaacctctggtcccaagttactacgcttgcctatatccactaaccactcactaggtcacaaagttgatggctctggcttgacccagtgaatgagaagtgtcctagatgt

SEQ ID NO: 372132 - DNA, 1775 bp, Homo sapiens
  misc_feature (731)..(731): n is a, c, g, or t
  misc_feature (1705)..(1705): n is a, c, g, or t
cattgcccctgtaacctgtcaaagaagagctaagggagctttcggggttggcttcttggaggctgctttctcctttacttggaaggcttcgctagtgatggacccatacatgattcagatgagcagcaaaggcaacctcccctcaattctggacgtgcatgtcaacgttggtgggagaagctctgtgccgggaaaaatgaaaggcagaaaggccaggtggtctgtgaggccctcagacatggccaagaaaactttcaaccccatccgagccattgtggacaacatgaaggtgaaaccaaatccaaacaaaaccatgatttccctgtccattggtgagttggggacactactgaggggctgtcattgtcctcctctactctcatgttcacaggctggttggagaagatggcagttgggggtgagtctgagtactgaacatgggagaataacctcttggctccttttgtgttttcctcccataaaaaggggaccctactgtgtttggaaacctgcctacagaccctgaagttacccaggcaatgaaagatgccctggactcgggcaaatataatggctatgccccatccatcggcttcctatccagtcgggaggagattgcttcttattaccactgtcctgaggcacccctagaagctaaggacgtcattctgacaagtggctgcagccaagctattgacctttgtttagctgtgttggccaacccagggcanaacatcctggttccaagacctggtttctctctctacaagactctggctgagtctatgggaattgaggtcaaactctacaatttgttgccagagaaatcttgggaaattgacctgaaacaactggaatatctaattgatgaaaagacagcttgtctcattgtcaataatccatcaaacccctgtgggtcagtgttcagcaaacgtcatcttcagaagattctggcagtggctgcacggcagtgtgtccccatcttagctgatgagatctatggagacatggtgttttcggattgcaaatatgaaccactggccaccctcagcaccgatgtccccatcctgtcctgtggagggctggccaagcgctggctggttcctggctggaggttgggctggatcctcattcatgaccgaagagacatttttggcaatgagatccgagatgggctggtgaagctgagtcagcgcattttgggaccctgtaccattgtccagggagctctgctcaagtccaatgctgatctctgttatggggcgttggctgccatccctggactccggccagtccgcccttctggggctatgtacctcatggttggaattgagatggaacatttcccagaatttgagaacgatgtggagttcacggagcggttagttgctgagcagtctgtccactgcctcccagcaacgtgctttgagtacccgaatttcatccgagtggtcatcacagtccccgaggtgatgatgctggaggcgtgcagccggatccaggagttctgtgagcagcactaccattgtgctgaaggcagccaggaggagtgtgataaataggcctgcatccattctcctgaggatgtgtcccatctagggaaggctggactaggccttgcggctcctcagggactcaggtggccctactggtaataagggccccctctgccaccattcgtcaagggattctaaggattgggtcnctggcttttataccccaagcgactctcatcacttctcctacgatctccagattctctccgttttccctcc

SEQ ID NO: 372133 - DNA, 736 bp, Homo sapiens
atcaatactgtgccataggagtggtaggcctggcctaaaagaagaaaaagaagaaatacttgtctcttcatcactcccaggagaaaaagaaatagtacttgcctcttcatcactcccatcacgttgaagatagggtctgaaatatctagttacttaaatggtgaattcaggctctgcactctggaagagtatgttaagaatttacagttcttaaataggaagacaaaacacacaaacatgaaatgcaaatcacactttgcttgtgctttttgtctttctctttaagaattgtaacttcttaatattacgggatagggaaattacatgatattatgtgactattacatgataaagcaattcacattaaaactgatttcagcatgttttattttcagtggctgcacggcagtgtgtccccatcttagctgatgagatctatggagacatggtgagtcttgatcaggatatatcactacagtaatctcaaattattttatgggaactttagaagtggaataatcagaaacaactcctaatcgtttcattacagcaaatcagcatccctgcactttttacaaatatatagacccacaactccttagccagttttctgaaacccaaagaactttggaaatccaaagattcctggaattcatttggttacaaaacctgatttgacctgatatttgtagatttttatttttcccacttgtggatctatatatttgttaagagt

SEQ ID NO: 372134 - DNA, 876 bp, Homo sapiens
cattgcccctgtaacctgtcaaagaagagctaagggagctttcggggttggcttcttggaggctgctttctcctttacttggaaggcttcgctagtgatggacccatacatgattcagatgagcagcaaaggcaacctcccctcaattctggacgtgcatgtcaacgttggtgggagaagctctgtgccgggaaaaatgaaaggcagaaaggccaggtggtctgtgaggccctcagacatggccaagaaaactttcaaccccatccgagccattgtggacaacatgaaggtgaaaccaaatccaaacaaaaccatgatttccctgtccattggtgagttggggacactactgaggggctgtcattgtcctcctctactctcatgttcacaggctggttggagaagatggcagttgggggtgagtctgagtactgaacatgggagaataacctcttggctccttttgtgttttcctcccataaaaaggggaccctactgtgtttggaaacctgcctacagaccctgaagttacccaggcaatgaaagatgccctggactcgggcaaatataatggctatgccccatccatcggtaagctcctcctgagactccatacctggtgactgccaaatctttagtgctcttataacaggactaaatgtctagcaatcctcttcactttcctgatgcacaattcctaaggagaggctaagattacatggtcctttggatttgggaaccgggtctcgggatgcttaaatacaaggcatcaaggtccaacttctttcctggctttctttgacatatgggcacttcccctctagggtcccaaacatacttatttgtcaagtaaagctcctatcctatcattactaa

SEQ ID NO: 372135 - DNA, 3117 bp, Homo sapiens
  misc_feature (577)..(577): n is a, c, g, or t
cattgcccctgtaacctgtcaaagaagagctaagggagctttcggggttggcttcttggaggctgctttctcctttacttggaaggcttcgctagtgatggacccatacatgattcagatgagcagcaaaggcaacctcccctcaattctggacgtgcatgtcaacgttggtgggagaagctctgtgccgggaaaaatgaaaggcagaaaggccaggtggtctgtgaggccctcagacatggccaagaaaactttcaaccccatccgagccattgtggacaacatgaaggtgaaaccaaatccaaacaaaaccatgatttccctgtccattggggaccctactgtgtttggaaacctgcctacagaccctgaagttacccaggcaatgaaagatgccctggactcgggcaaatataatggctatgccccatccatcggcttcctatccagtcgggaggagattgcttcttattaccactgtcctgaggcacccctagaagctaaggacgtcattctgacaagtggctgcagccaagctattgacctttgtttagctgtgttggccaacccagggcanaacatcctggttccaagacctggtttctctctctacaagactctggctgagtctatgggaattgaggtcaaactctacaatttgttgccagagaaatcttgggaaattgacctgaaacaactggaatatctaattgatgaaaagacagcttgtctcattgtcaataatccatcaaacccctgtgggtcagtgttcagcaaacgtcatcttcagaagattctggcagtggctgcacggcagtgtgtccccatcttagctgatgagatctatggagacatggtgttttcggattgcaaatatgaaccactggccaccctcagcaccgatgtccccatcctgtcctgtggagggctggccaagcgctggctggttcctggctggaggttgggctggatcctcattcatgaccgaagagacatttttggcaatgagatccgagatgggctggtgaagctgagtcagcgcattttgggaccctgtaccattgtccagggagctctgctcaagcatcctatgtcgcaccccgggagagttttaccacaacactctgagcttcctcaagtccaatgctgatctctgttatggggcgttggctgccatccctggactccggccagtccgcccttctggggctatgtacctcatggttggaattgagatggaacatttcccagaatttgagaacgatgtggagttcacggagcggttagttgctgagcagtctgtccactgcctcccagcaacgtgctttgagtacccgaatttcatccgagtggtcatcacagtccccgaggtgatgatgctggaggcgtgcagccggatccaggagttctgtgagcagcactaccattgtgctgaaggcagccaggaggagtgtgataaataggcctgcatccattctcctgaggatgtgtcccatctagggaaggctggactaggccttgcggctcctcagggactcaggtggccctactgggagaggggcctcaaatgcaccatgtcaagggttcaagattgttcctgcttttccccaagtacaaccacacccacactcagatcctcctcattcacatcgcagattctcccttgctctgcgctgctagagtgactcactaattcattaatctgcctccctctcgtaagatttccttctttttttcttgaaagtaccaggtgaacaaagtttaccagaaagcagttgagacaagaaaataagagctcaggatgagggaaaagaaaaagattgagagaatttgtgcccccaaccatttcctcagactctaagaaagaacacgctctctccaggcaggtctgaagctcaactctcttattgcctcacttcaggtatacctcactttacacaatagaattataactggaaagaagttggggacacatgtatttggtgattacattttaaacacattaggaaaagttgctatttgaactttttattgatttttggggggagtaaagaattattttgtgatgcaaataaatatcctttaattgatcgacttgccaaatttagatttgtgtgcatcaggctttcttttttttctttttttagagaagttcaatataagcttttcttttctttgtttctttctttctttattttgagatggagtcttgctctgtcgcccatgctggagtgcagtggcgcgatctcggctcactgcaacctccacctcctgggttcaagcgattctcttgcctcaacctcccaagcagttgggactacaggcgtgagccaccatgcccggctaatttttgtatttttagtagagacagggtttcaccatgttagccaggctggtctcaaactcctgacctcaggcaatctgcccgcctgggtctcctaaagtactgggattacaggcgtgagccacctcgcccagcggcatcaggctttcttaaagtgagagcacgcctgtactagagcaagcaggaatcagagaccttccagaaatactactgtgtaagggccagaaatatcttcacttgtcattgttatataatcattattacttttgctgtaatgttaatattgatttattaatatatattatcttttcatacattttctaagaaacatttatattgataagatcttttattttgccaagggcataaattattgtttttctttttttttttttaataaatttcaccaagtatggctcttctgtgatgtgtttttttctccgtttgggaatttctaatcccaggcactcctcagtctcattgttccattacctatgaggtttcatttacttctttgtaaatgtactgactttgggagttacttaagaaccacagttcctaaaacatttattggggagctcaacttctggcttcctacttaccaagaggcagtaagttataacctctggcctttgtcttatacatttccaactttctggatccctaacctctggtcccaagttactacgcttgcctatatccactaaccactcactaggtcacaaagttgatggctctggcttgacccagtgaatgagaagtgtcctagatgt

SEQ ID NO: 372136 - DNA, 3216 bp, Homo sapiens
  misc_feature (731)..(731): n is a, c, g, or t
cattgcccctgtaacctgtcaaagaagagctaagggagctttcggggttggcttcttggaggctgctttctcctttacttggaaggcttcgctagtgatggacccatacatgattcagatgagcagcaaaggcaacctcccctcaattctggacgtgcatgtcaacgttggtgggagaagctctgtgccgggaaaaatgaaaggcagaaaggccaggtggtctgtgaggccctcagacatggccaagaaaactttcaaccccatccgagccattgtggacaacatgaaggtgaaaccaaatccaaacaaaaccatgatttccctgtccattggtgagttggggacactactgaggggctgtcattgtcctcctctactctcatgttcacaggctggttggagaagatggcagttgggggtgagtctgagtactgaacatgggagaataacctcttggctccttttgtgttttcctcccataaaaaggggaccctactgtgtttggaaacctgcctacagaccctgaagttacccaggcaatgaaagatgccctggactcgggcaaatataatggctatgccccatccatcggcttcctatccagtcgggaggagattgcttcttattaccactgtcctgaggcacccctagaagctaaggacgtcattctgacaagtggctgcagccaagctattgacctttgtttagctgtgttggccaacccagggcanaacatcctggttccaagacctggtttctctctctacaagactctggctgagtctatgggaattgaggtcaaactctacaatttgttgccagagaaatcttgggaaattgacctgaaacaactggaatatctaattgatgaaaagacagcttgtctcattgtcaataatccatcaaacccctgtgggtcagtgttcagcaaacgtcatcttcagaagattctggcagtggctgcacggcagtgtgtccccatcttagctgatgagatctatggagacatggtgttttcggattgcaaatatgaaccactggccaccctcagcaccgatgtccccatcctgtcctgtggagggctggccaagcgctggctggttcctggctggaggttgggctggatcctcattcatgaccgaagagacatttttggcaatgagatccgagatgggctggtgaagctgagtcagcgcattttgggaccctgtaccattgtccagggagctctgctcaagtccaatgctgatctctgttatggggcgttggctgccatccctggactccggccagtccgcccttctggggctatgtacctcatggttggaattgagatggaacatttcccagaatttgagaacgatgtggagttcacggagcggttagttgctgagcagtctgtccactgcctcccagcaacgtgctttgagtacccgaatttcatccgagtggtcatcacagtccccgaggtgatgatgctggaggcgtgcagccggatccaggagttctgtgagcagcactaccattgtgctgaaggcagccaggaggagtgtgataaataggcctgcatccattctcctgaggatgtgtcccatctagggaaggctggactaggccttgcggctcctcagggactcaggtggccctactgggagaggggcctcaaatgcaccatgtcaagggttcaagattgttcctgcttttccccaagtacaaccacacccacactcagatcctcctcattcacatcgcagattctcccttgctctgcgctgctagagtgactcactaattcattaatctgcctccctctcgtaagatttccttctttttttcttgaaagtaccaggtgaacaaagtttaccagaaagcagttgagacaagaaaataagagctcaggatgagggaaaagaaaaagattgagagaatttgtgcccccaaccatttcctcagactctaagaaagaacacgctctctccaggcaggtctgaagctcaactctcttattgcctcacttcaggtatacctcactttacacaatagaattataactggaaagaagttggggacacatgtatttggtgattacattttaaacacattaggaaaagttgctatttgaactttttattgatttttggggggagtaaagaattattttgtgatgcaaataaatatcctttaattgatcgacttgccaaatttagatttgtgtgcatcaggctttcttttttttctttttttagagaagttcaatataagcttttcttttctttgtttctttctttctttattttgagatggagtcttgctctgtcgcccatgctggagtgcagtggcgcgatctcggctcactgcaacctccacctcctgggttcaagcgattctcttgcctcaacctcccaagcagttgggactacaggcgtgagccaccatgcccggctaatttttgtatttttagtagagacagggtttcaccatgttagccaggctggtctcaaactcctgacctcaggcaatctgcccgcctgggtctcctaaagtactgggattacaggcgtgagccacctcgcccagcggcatcaggctttcttaaagtgagagcacgcctgtactagagcaagcaggaatcagagaccttccagaaatactactgtgtaagggccagaaatatcttcacttgtcattgttatataatcattattacttttgctgtaatgttaatattgatttattaatatatattatcttttcatacattttctaagaaacatttatattgataagatcttttattttgccaagggcataaattattgtttttctttttttttttttaataaatttcaccaagtatggctcttctgtgatgtgtttttttctccgtttgggaatttctaatcccaggcactcctcagtctcattgttccattacctatgaggtttcatttacttctttgtaaatgtactgactttgggagttacttaagaaccacagttcctaaaacatttattggggagctcaacttctggcttcctacttaccaagaggcagtaagttataacctctggcctttgtcttatacatttccaactttctggatccctaacctctggtcccaagttactacgcttgcctatatccactaaccactcactaggtcacaaagttgatggctctggcttgacccagtgaatgagaagtgtcctagatgt

SEQ ID NO: 372137 - DNA, 3162 bp, Homo sapiens
  misc_feature (731)..(731): n is a, c, g, or t
cattgcccctgtaacctgtcaaagaagagctaagggagctttcggggttggcttcttggaggctgctttctcctttacttggaaggcttcgctagtgatggacccatacatgattcagatgagcagcaaaggcaacctcccctcaattctggacgtgcatgtcaacgttggtgggagaagctctgtgccgggaaaaatgaaaggcagaaaggccaggtggtctgtgaggccctcagacatggccaagaaaactttcaaccccatccgagccattgtggacaacatgaaggtgaaaccaaatccaaacaaaaccatgatttccctgtccattggtgagttggggacactactgaggggctgtcattgtcctcctctactctcatgttcacaggctggttggagaagatggcagttgggggtgagtctgagtactgaacatgggagaataacctcttggctccttttgtgttttcctcccataaaaaggggaccctactgtgtttggaaacctgcctacagaccctgaagttacccaggcaatgaaagatgccctggactcgggcaaatataatggctatgccccatccatcggcttcctatccagtcgggaggagattgcttcttattaccactgtcctgaggcacccctagaagctaaggacgtcattctgacaagtggctgcagccaagctattgacctttgtttagctgtgttggccaacccagggcanaacatcctggttccaagacctggtttctctctctacaagactctggctgagtctatgggaattgaggtcaaactctacaatttgttgccagagaaatcttgggaaattgacctgaaacaactggaatatctaattgatgaaaagacagcttgtctcattgtcaataatccatcaaacccctgtgggtcagtgttcagcaaacgtcatcttcagaagattctggcagtggctgcacggcagtgtgtccccatcttagctgatgagatctatggagacatggtgttttcggattgcaaatatgaaccactggccaccctcagcaccgatgtccccatcctgtcctgtggagggctggccaagcgctggctggttcctggctggaggttgggctggatcctcattcatgaccgaagagacatttttggcaatgagatccgagatgggctggtgaagctgagtcagcgcattttgggaccctgtaccattgtccagggagctctgctcaagtccaatgctgatctctgttatggggcgttggctgccatccctggactccggccagtccgcccttctggggctatgtacctcatggttggaattgagatggaacatttcccagaatttgagaacgatgtggagttcacggagcggttagttgctgagcagtctgtccactgcctcccagcaacgtgctttgagtacccgaatttcatccgagtggtcatcacagtccccgaggtgatgatgctggaggcgtgcagccggatccaggagttctgtgagcagcactaccattgtgctgaaggcagccaggaggagtgtgataaataggcctgcatccattctcctgaggatgtgtcccatctagggaaggctggactaggccttgcggctcctcagggactcaggtggccctactgggagaggggcctcaaatgcaccatgtcaagggttcaagattgttcctgcttttccccaagtacaaccacacccacactcagatcctcctcattcacatcgcagattctcccttgctctgcgctgctagagtgactcactaattcattaatctgcctccctctcgtaagatttccttctttttttcttgaaagtaccaggtgaacaaagtttaccagaaagcagttgagacaagaaaataagagctcaggatgagggaaaagacacgctctctccaggcaggtctgaagctcaactctcttattgcctcacttcaggtatacctcactttacacaatagaattataactggaaagaagttggggacacatgtatttggtgattacattttaaacacattaggaaaagttgctatttgaactttttattgatttttggggggagtaaagaattattttgtgatgcaaataaatatcctttaattgatcgacttgccaaatttagatttgtgtgcatcaggctttcttttttttctttttttagagaagttcaatataagcttttcttttctttgtttctttctttctttattttgagatggagtcttgctctgtcgcccatgctggagtgcagtggcgcgatctcggctcactgcaacctccacctcctgggttcaagcgattctcttgcctcaacctcccaagcagttgggactacaggcgtgagccaccatgcccggctaatttttgtatttttagtagagacagggtttcaccatgttagccaggctggtctcaaactcctgacctcaggcaatctgcccgcctgggtctcctaaagtactgggattacaggcgtgagccacctcgcccagcggcatcaggctttcttaaagtgagagcacgcctgtactagagcaagcaggaatcagagaccttccagaaatactactgtgtaagggccagaaatatcttcacttgtcattgttatataatcattattacttttgctgtaatgttaatattgatttattaatatatattatcttttcatacattttctaagaaacatttatattgataagatcttttattttgccaagggcataaattattgtttttctttttttttttttaataaatttcaccaagtatggctcttctgtgatgtgtttttttctccgtttgggaatttctaatcccaggcactcctcagtctcattgttccattacctatgaggtttcatttacttctttgtaaatgtactgactttgggagttacttaagaaccacagttcctaaaacatttattggggagctcaacttctggcttcctacttaccaagaggcagtaagttataacctctggcctttgtcttatacatttccaactttctggatccctaacctctggtcccaagttactacgcttgcctatatccactaaccactcactaggtcacaaagttgatggctctggcttgacccagtgaatgagaagtgtcctagatgt

SEQ ID NO: 372138 - DNA, 1486 bp, Homo sapiens
  misc_feature (731)..(731): n is a, c, g, or t
  misc_feature (1465)..(1465): n is a, c, g, or t
  misc_feature (1472)..(1472): n is a, c, g, or t
cattgcccctgtaacctgtcaaagaagagctaagggagctttcggggttggcttcttggaggctgctttctcctttacttggaaggcttcgctagtgatggacccatacatgattcagatgagcagcaaaggcaacctcccctcaattctggacgtgcatgtcaacgttggtgggagaagctctgtgccgggaaaaatgaaaggcagaaaggccaggtggtctgtgaggccctcagacatggccaagaaaactttcaaccccatccgagccattgtggacaacatgaaggtgaaaccaaatccaaacaaaaccatgatttccctgtccattggtgagttggggacactactgaggggctgtcattgtcctcctctactctcatgttcacaggctggttggagaagatggcagttgggggtgagtctgagtactgaacatgggagaataacctcttggctccttttgtgttttcctcccataaaaaggggaccctactgtgtttggaaacctgcctacagaccctgaagttacccaggcaatgaaagatgccctggactcgggcaaatataatggctatgccccatccatcggcttcctatccagtcgggaggagattgcttcttattaccactgtcctgaggcacccctagaagctaaggacgtcattctgacaagtggctgcagccaagctattgacctttgtttagctgtgttggccaacccagggcanaacatcctggttccaagacctggtttctctctctacaagactctggctgagtctatgggaattgaggtcaaactctacaatttgttgccagagaaatcttgggaaattgacctgaaacaactggaatatctaattgatgaaaagacagcttgtctcattgtcaataatccatcaaacccctgtgggtcagtgttcagcaaacgtcatcttcagaagattctggcagtggctgcacggcagtgtgtccccatcttagctgatgagatctatggagacatggtgttttcggattgcaaatatgaaccactggccaccctcagcaccgatgtccccatcctgtcctgtggagggctggccaagcgctggctggttcctggctggaggttgggctggatcctcattcatgaccgaagagacatttttggcaatgagatccgagatgggctggtgaagctgagtcagcgcattttgggaccctgtaccattgtccagggagctctgctcaagcatcctatgtcgcaccccgggagagttttaccacaacactctgagcttcctcaagtccaatgctgatctctgttatggggcgttggctgccatccctggactccggccagtccgcccttctggggctatgtacctcatggttggaattgagatggaacatttcccagaatttgagaacgatgtggagttcacggagcggcacatcggttgggtgatccaaagagtcngctcatncaagagtcatcagg

SEQ ID NO: 372139 - DNA, 2427 bp, Homo sapiens
  misc_feature (338)..(338): n is a, c, g, or t
cggatggacatggacacaccccattgtctcacgtgcccccagcagagcactgctgagtctgagggggccaccatctgtacctgtgagagcggccattacagagctcccggggagggcccccaggtggcatgcacaggtcccccctcggccccccgaaacctgagcttctctgcctcagggactcagctctccctgcgttgggaacccccagcagatacggggggacgccaggatgtcagatacagtgtgaggtgttcccagtgtcagggcacagcacaggacggggggccctgccagccctgtggggtgggcgtgcacttctcgccgggggcccgggngctcaccacacctgcagtgcatgtcaatggccttgaaccttatgccaactacacctttaatgtggaagcccaaaatggagtgtcagggctgggcagctctggccatgccagcacctcagtcagcatcagcatggggcatgcagagtcactgtcaggcctgtctctgagactggtgaagaaagaaccgaggcaactagagctgacctgggcggggtcccggccccgaagccctggggcgaacctgacctatgagctgcacgtgctgaaccaggatgaagaacggtaccagatggttctagaacccagggtcttgctgacagagctgcagcctgacaccacatacatcgtcagagtccgaatgctgaccccactgggtcctggccctttctcccctgatcatgagtttcggaccagcccaccagtgtccaggggcctgactggaggagagattgtagccgtcatctttgggctgctgcttggtgcagccttgctgcttgggattctcgttttccggtccaggagagcccagcggcagaggcagcagaggcagcgtgaccgcgccaccgatgtggatcgagaggacaagctgtggctgaagccttatgtggacctccaggcatacgaggaccctgcacagggagccttggactttacccgggagcttgatccagcgtggctgatggtggacactgtcataggagaaggagagtttggggaagtgtatcgagggaccctgaggctccccagccaggactgcaagactgtggccattaagaccttaaaagacacatccccaggtggccagtggtggaacttccttcgagaggcaactatcatgggccagtttagccacccgcatattctgcatctggaaggcgtcgtcacaaagcgaaagccgatcatgatcatcacagaatttatggagaatggagccctggatgccttcctgagggagcgggaggaccagctggtccctgggcagctagtggccatgctgcagggcatagcatctggcatgaactacctcagtaatcacaattatgtccaccgggacctggctgccagaaacatcttggtgaatcaaaacctgtgctgcaaggtgtctgactttggcctgactcgcctcctggatgactttgatggcacatacgaaacccagggaggaaagatccctatccgttggacagcccctgaagccattgcccatcggatcttcaccacagccagcgatgtgtggagctttgggattgtgatgtgggaggtgctgagctttggggacaagccttatggggagatgagcaatcaggaggttatgaagagcattgaggatgggtaccggttgccccctcctgtggactgccctgcccctctgtatgagctcatgaagaactgctgggcatatgaccgtgcccgccggccacacttccagaagcttcaggcacatctggagcaactgcttgccaacccccactccctgcggaccattgccaactttgaccccagggtgactcttcgcctgcccagcctgagtggctcagatgggatcccgtatcgaaccgtctctgagtggctcgagtccatacgcatgaaacgctacatcctgcacttccactcggctgggctggacaccatggagtgtgtgctggagctgaccgctgaggacctgacgcagatgggaatcacactgcccgggcaccagaagcgcattctttgcagtattcagggattcaaggactgatccctcctctcaccccatgcccaatcagggtgcaaggagcaaggacggggccaaggtcgctcatggtcactccctgcgccccttcccacaacctgccagactaggctatcggtgctgcttctgcccactttcaggagaaccctgctctgcaccccagaaaacctctttgttttaaaagggaggtgggggtagaagtaaaaggatgatcatgggagggagctgaggggttaatatatatacatacatacacatatatatatttttgtaaataaacaggaactgattttctgcctccatcccacccatgagggctgcaggcactacaaaagagctgactactgagaattctgg

SEQ ID NO: 372140 - DNA, 2128 bp, Homo sapiens
  misc_feature (338)..(338): n is a, c, g, or t
cggatggacatggacacaccccattgtctcacgtgcccccagcagagcactgctgagtctgagggggccaccatctgtacctgtgagagcggccattacagagctcccggggagggcccccaggtggcatgcacaggtcccccctcggccccccgaaacctgagcttctctgcctcagggactcagctctccctgcgttgggaacccccagcagatacggggggacgccaggatgtcagatacagtgtgaggtgttcccagtgtcagggcacagcacaggacggggggccctgccagccctgtggggtgggcgtgcacttctcgccgggggcccgggngctcaccacacctgcagtgcatgtcaatggccttgaaccttatgccaactacacctttaatgtggaagcccaaaatggagtgtcagggctgggcagctctggccatgccagcacctcagtcagcatcagcatggggcatgcagagtcactgtcaggcctgtctctgagactggtgaagaaagaaccgaggcaactagagctgacctgggcggggtcccggccccgaagccctggggcgaacctgacctatgagctgcacgtgctgaaccaggatgaagaacggtaccagatggttctagaacccagggtcttgctgacagagctgcagcctgacaccacatacatcgtcagagtccgaatgctgaccccactgggtcctggccctttctcccctgatcatgagtttcggaccagcccaccagtgtccaggggcctgactggaggagagattgtagccgtcatctttgggctgctgcttggtgcagccttgctgcttgggattctcgttttccggtccaggagagcccagcggcagaggcagcagaggcagcgtgaccgcgccaccgatgtggatcgagaggacaagctgtggctgaagccttatgtggacctccaggcatacgaggaccctgcacagggagccttggactttacccgggagcttgatccagcgtggctgatggtggacactgtcataggagaaggagagtttggggaagtgtatcgagggaccctgaggctccccagccaggactgcaagactgtggccattaagaccttaaaagacacatccccaggtggccagtggtggaacttccttcgagaggcaactatcatgggccagtttagccacccgcatattctgcatctggaaggcgtcgtcacaaagcgaaagccgatcatgatcatcacagaatttatggagaatggagccctggatgccttcctgagggagcgggaggaccagctggtccctgggcagctagtggccatgctgcagggcatagcatctggcatgaactacctcagtaatcacaattatgtccaccgggacctggctgccagaaacatcttggtgaatcaaaacctgtgctgcaaggtgtctgactttggcctgactcgcctcctggatgactttgatggcacatacgaaacccagggaggaaagatccctatccgttggacagcccctgaagccattgcccatcggatcttcaccacagccagcgatgtgtggagctttgggattgtgatgtgggaggtgctgagctttggggacaagccttatggggagatgagcaatcaggaggttatgaagagcattgaggatgggtaccggttgccccctcctgtggactgccctgcccctctgtatgagctcatgaagaactgctgggcatatgaccgtgcccgccggccacacttccagaagcttcaggcacatctggagcaactgcttgccaacccccactccctgcggaccattgccaactttgaccccagggtgactcttcgcctgcccagcctgagtggctcagatgggatcccgtatcgaaccgtctctgagtggctcgagtccatacgcatgaaacgctacatcacaatcccaaagctccacacatcgctggctgtggtgaagatccgatgggcaatggcttcaggggctgtccaacggatagggatctttcctccctgggtttcgtatgtgccatcaaagtcatccaggaggcgagtcaggccaaagtcagacaccttgcagcacaggttttgactcaccaagatgtttctgg

SEQ ID NO: 372141 - DNA, 200 bp, Homo sapiens
agtcagcatcagcatggggcatgcaggtgagaggctgagaggggctgggacagggacctggtggagacagaagggcttaagaccacagaacaaactgatgggcaggaagccatagaaaagttactaaggttatttcctttttccttacatatccaaccttatccctctggacccccagagtcactgtcaggcctgtctct

SEQ ID NO: 372142 - DNA, 317 bp, Homo sapiens
gtcccgctccacagggttcattcaccctgcagttgccgagcgcctattgtgagccaagaactgtgcaaacactgggagacagtggtgaataggtcacggcattgcactccagctccagactctgaccttccccaggaaggacagcccacgccctgtcccaggaagggcactccacgcttctgattctccagaaaagaaaagggccggaggactggaggggttgctgcctgtcccctggaggagccctgcagtgcatcgggccacagcctgttttctttctacccaggagagtttggggaagtgtatcgagggaccct

SEQ ID NO: 372143 - DNA, 393 bp, Homo sapiens
tgcttgccaacccccactccctgcggaccattgccaactttgaccccaggtaaccatgcaggggaaggactagggaacccagaggcagcgctaggagagtggaaatgggcattcagccaatcttctttgagcgctgggcctggggagctctggaccaagtccagtgtatgaggcaagacgtgcccttggggagagtccaagaggtcagctttagattatgcatatttgcagaaaatcagttatggctgggccccagttccctcacttcacctgggcttgggggtggggggcccatcttttctcttctcaggcagcctcacctaagacactcccggagccatccttgccaatcccactgtgttgtactgtggcccattcttgggatgcatcccc

SEQ ID NO: 372144 - DNA, 426 bp, Homo sapiens
ccgccccggaccttgtggagtgaggacagcggagcttggagcatagacagggagaagaaaggcctagttgctaaatggagactttctcccacctcagcccaaacaggagtcaccttgggaaacagggaggtgtggagaagtgtgtggtccgctgctggcccttctcctgacccccatactcctgagccctgatgttggtactccccaacctcatgttctgcccatagaggacaagctgtggctgaagccttatgtggacctccaggcatacgaggaccctgcacagggagccttggactttacccgggagcttgatccagcgtggctgatggtggacactgtcataggagaaggtgagtcctgctgtgcaccgcagcaggccccccgccatgtggggcagcacagagccaccagcaggccccttcc

SEQ ID NO: 372145 - DNA, 771 bp, Homo sapiens
gaaaggcctagttgctaaatggagactttctcccacctcagcccaaacaggagtcaccttgggaaacagggaggtgtggagaagtgtgtggtccgctgctggcccttctcctgacccccatactcctgagccctgatgttggtactccccaacctcatgttctgcccatagaggacaagctgtggctgaagccttatgtggacctccaggcatacgaggaccctgcacagggagccttggactttacccgggagcttgatccagcgtggctgatggtggacactgtcataggagaaggagagtttggggaagtgtatcgagggaccctgaggctccccagccaggactgcaagactgtggccattaagaccttaaaagacacatccccaggtggccagtggtggaacttccttcgagaggcaactatcatgggccagtttagccacccgcatattctgcatctggaaggcgtcgtcacaaagcgaaagccgatcatgatcatcacagaatttatggagaatggagccctggatgccttcctgagggagcgggaggaccagctggtccctgggcagctagtggccatgctgcagggcatagcatctggcatgaactacctcagtaatcacaattatgtccaccgggacctggctgccagaaacatcttggtgaatcaaaacctgtgctgcaaggtgtctgactttggcctgactcgcctcctggatgactttgatggcacatacgaaacccaggttagaggccggtacaaac

SEQ ID NO: 372146 - DNA, 442 bp, Homo sapiens
ggatagggctcggcgtgggcaggtcatttgatcaatgtggtggctggaacattcaatatgacttctccattcacatgtctggagtcacagctgggaagctaaaatttctgtgggctggctaagcatctctctgtccacatgatattgccaataaggtagacagatctcctgacaatggcggctcagggctccagcaacatcccacaagaacaagccccagcacacaagtgctttatcaaacctctgcctgcatcacactttctaatgtactgctagccaaagcaaggacacatgtgcaagccagctgtcatggaaaagttctgtctacatagaacatgaatcctgggagctaccaagtaatagtctaccaaggatttttcaagtttatccactttttatagagagagaaggaaacaggaattgttgcttttccaaatttgtt

SEQ ID NO: 372147 - DNA, 1023 bp, Homo sapiens
  misc_feature (24)..(24): n is a, c, g, or t
  misc_feature (31)..(31): n is a, c, g, or t
aagcagtggtatcaaccagagtgnccattanggcggagccctcaggaacgagatggcggttctctggaggctgagtgccgtttgcggtgccctaggaggccgagctctgttgcttcgaactccagtggtcagacctgctcatatctcagcatttcttcaggaccgacctatcccagaatggtgtggagtgcagcacatacacttgtcaccgagccaccattctggctccaaggctgcatctctccactggactagcgagagggttgtcagtgttttgctcctgggtctgcttccggctgcttatttgaatccttgctctgcgatggactattccctggctgcagccctcactcttcatggtcactggggccttggacaagttgttactgactatgttcatggggatgccttgcagaaagctgccaaggcagggcttttggcactttcagctttaacctttgctgggctttgctatttcaactatcacgatgtgggcatctgcaaagctgttgccatgctgtggaagctctgacctttttgacttcatactttgaagaattgatgtatgcctctttgcctctgctttgtcatgccattaagctcacaataaggaagaaataacagataagtccattggtggacagccttcttctcttaatcacaagattattttcagaatttaatctttgaggaaaaggtttgagaggaattatatctaagttgtgagactgagttctatattctggtgagttaatggggttgcctcccagcttcttataagactcacagtataactaaacatgatatatcagcttttgcctttcaatttatcaatctcttaaagagaatccaactttattacgattagtatatgatcaaacttccatatttgccttgggaataatggacaaagggaaatactgaatctaatagatgagaaacattgtggaactagcagcggagagatggagaatgcgttaagagagaaacaaaagagggtaataaagggagtaaaggaaggag

SEQ ID NO: 372148 - DNA, 2390 bp, Homo sapiens
acagtccaggcagttctgtgcgtgttcactgtttagtagtactcaaaactgccagtgtgagaggatttggaaatcactggatctgctcaatacaaaaatgttttttcgagtctttctccattttatcaggagtcattctgccactgcagtggatttccttcctgtgatggtgcaccggctcccagttttcaaaaggtacatgggaaatactcctcagaaaaaagccgtctttgggcagtgtcggggtctgccatgtgttgcaccgctgctgaccacagtggaagaggctccacggggcatctctgctcgagtctggggacattttcctaagtggctcaatggctctctacttcgaattggacctgggaaattcgagtttgggaaggataagtacaatcattggtttgatgggatggcgctgcttcaccagttcagaatggcaaagggcacagtgacatacaggagcaagtttctacagagtgatacatataaggccaacagtgctaaaaaccgaattgtgatctcagaatttggcacactggctctcccggatccatgcaagaatgtttttgaacgtttcatgtccaggtttgagctgcctggtaaagctgcagccatgactgacaatactaatgtcaactatgtgcggtacaagggtgattactacctctgcactgagaccaactttatgaataaagtggacattgaaactctggaaaaaacagaaaaggtagattggagcaaatttattgctgtgaatggagcaactgcacatcctcattatgacccggatggaacagcatacaatatggggaactcctttgggccatatggtttctcctataaggttattcgggttcctccagagaaggtggaccttggggagacaatccatggagtccaggtgatatgttctattgcttctacagagaaagggaaaccttcttactaccatagctttggaatgacaaggaactatataattttcattgaacaacctctaaagatgaacctgtggaaaattgccacttctaaaattcggggaaaggccttttcagatgggataagctgggaaccccagtgtaatacgcggtttcatgtggtggaaaaacgcactggacagctccttccagggagatactacagcaaaccttttgttacatttcatcaaatcaatgcctttgaggaccagggctgtgttataattgatttgtgctgtcaagataatggaagaaccctagaagtttaccagttacagaatctcaggaaggctggggaagggcttgatcaggtccataattcagcagccaaatctttccctcgaaggtttgttttgcctttaaatgtcagtttgaatgcccctgagggagacaacctgagtccattgtcctatacttcagccagtgctgtgaaacaggctgatggaacgatctggtgctctcatgaaaatctacatcaggaggacctagaaaaggaaggaggcattgaatttcctcagatctactatgatcgattcagtggcaaaaagtatcatttcttttatggctgtggctttcggcatttagtgggggattctctgatcaaggttgatgtggtgaataagacactgaaggtttggagagaagatggcttttatccctcagaacctgtttttgttccagcaccaggaaccaatgaagaagatggtggggttattctttctgtggtgatcactcccaaccagaatgaaagcaattttctcctagttttggatgccaagaactttgaagagctgggccgagcagaggtacctgtgcagatgccttatgggttccatggtaccttcatacccatctgatgggacaaccacaaggtctggaaactaggtttaaaataagtgtgcacttggacataaagactggagaaataaacactgaggactccaaaaggggggcaaggaggaagaggggcaggggttaaaaagctacctattgaatactatgttccctatttgggtgatgggttcgttagaagtccaaacctcagcagcacacaatatactcatgtaacaagcctgcacatgtaccccagaatctaaaataaaaataaaaagaaaaacaaagaatgtactctatacaaaagacagagcataaagggcaccgtacctcccaaaccaatgtcccaaatagacatttagtttaaaaatttctgttaaaaacagaattcactatttccttgccactgccaagtcacgccatggcagaggctcgagtgcatacaagcttcggttttacccttaatacaccatcatgaccaatggaggcattgctgctggaggtgtcatggccattaacactactttataagaggtgcggaagactgccctcactcatcatggcctagcatgtgca

SEQ ID NO: 372149 - DNA, 2889 bp, Homo sapiens
gcctctttcctgaaggttgctgggagcttctgaagctttgtgtcctgtgtggctcagatgagatagcaattccgcagagtcctggaagttaaagaaggctgagttaggattgtttcctcatggtcagggaaacagccttcacatttgtatattttatgcaatatttaaggcaggattcagggacttggtattctttgggatttgcaataagaagaatattcaatatttaggcttttctaaattgaaaaatcactgccacacgttctaatgtaattgtttggtttctctatttgcattttgcggggactgccttaaaactcatttatgttttatagccttctattatagttaccattgttacatgattttatgtatagaaattggctgatctagagctttcagaaatcatactaatatgcactataaatttaaaattacttaatgtagtaatttaatgtttgcagtatgcaagggaatgtattacgtactggaaggagagaggagacaaacaccagaccctgtactcaaggagtactggtagtatcatttatcatacaagacagataagataaggtccatatgagagctataaacagatgctgtgagttcagactaaggagaatcagttcttgctgtaggtaaggggaatgctgtgtttataaagcaaatgacatggcaactggatcttgaaggatgagttagttttcaaaaggtacatgggaaatactcctcagaaaaaagccgtctttgggcagtgtcggggtctgccatgtgttgcaccgctgctgaccacagtggaagaggctccacggggcatctctgctcgagtctggggacattttcctaagtggctcaatggctctctacttcgaattggacctgggaaattcgagtttgggaaggataagtacaatcattggtttgatgggatggcgctgcttcaccagttcagaatggcaaagggcacagtgacatacaggagcaagtttctacagagtgatacatataaggccaacagtgctaaaaaccgaattgtgatctcagaatttggcacactggctctcccggatccatgcaagaatgtttttgaacgtttcatgtccaggtttgagctgcctggtaaagctgcagccatgactgacaatactaatgtcaactatgtgcggtacaagggtgattactacctctgcactgagaccaactttatgaataaagtggacattgaaactctggaaaaaacagaaaaggtagattggagcaaatttattgctgtgaatggagcaactgcacatcctcattatgacccggatggaacagcatacaatatggggaactcctttgggccatatggtttctcctataaggttattcgggttcctccagagaaggtggaccttggggagacaatccatggagtccaggtgatatgttctattgcttctacagagaaagggaaaccttcttactaccatagctttggaatgacaaggaactatataattttcattgaacaacctctaaagatgaacctgtggaaaattgccacttctaaaattcggggaaaggccttttcagatgggataagctgggaaccccagtgtaatacgcggtttcatgtggtggaaaaacgcactggacagctccttccagggagatactacagcaaaccttttgttacatttcatcaaatcaatgcctttgaggaccagggctgtgttataattgatttgtgctgtcaagataatggaagaaccctagaagtttaccagttacagaatctcaggaaggctggggaagggcttgatcaggtccataattcagcagccaaatctttccctcgaaggtttgttttgcctttaaatgtcagtttgaatgcccctgagggagacaacctgagtccattgtcctatacttcagccagtgctgtgaaacaggctgatggaacgatctggtgctctcatgaaaatctacatcaggaggacctagaaaaggaaggaggcattgaatttcctcagatctactatgatcgattcagtggcaaaaagtatcatttcttttatggctgtggctttcggcatttagtgggggattctctgatcaaggttgatgtggtttggagagaagatggcttttatccctcagaacctgtttttgttccagcaccaggaaccaatgaagaagatggtggggttattctttctgtggtgatcactcccaaccagaatgaaagcaattttctcctagttttggatgccaagaactttgaagagctgggccgagcagaggtacctgtgcagatgccttatgggttccatggtaccttcatacccatctgatgggacaaccacaaggtctggaaactaggtttaaaataagtgtgcacttggacataaagactggagaaataaacactgaggactccaaaaggggggcaaggaggaagaggggcaggggttaaaaagctacctattgaatactatgttccctatttgggtgatgggttcgttagaagtccaaacctcagcagcacacaatatactcatgtaacaagcctgcacatgtaccccagaatctaaaataaaaataaaaagaaaaacaaagaatgtactctatacaaaagacagagcataaagggcaccgtacctcccaaaccaatgtcccaaatagacatttagtttaaaaatttctgttaaaaacagaattcactatttccttgccactgccaagtcacgccatggcagaggctcgagtgcatacaagcttcggttttacccttaatacaccatcatgaccaatggaggcattgctgctggaggtgtcatggccattaacactactttataagaggtgcggaagactgccctcactcatcatggcctagcatgtgca

SEQ ID NO: 372150 - DNA, 893 bp, Homo sapiens
tttgaaatctcttttagatctggtgctctcatgaaaatctacatcaggaggacctagaaaaggaaggaggcattgaatttcctcagatctactatgatcgattcagtggcaaaaagtttggagagaagatggcttttatccctcagaacctgtttttgttccagcaccaggaaccaatgaagaagatggtggggttattctttctgtggtgatcactcccaaccagaatgaaagcaattttctcctagttttggatgccaagaactttgaagagctgggccgagcagaggtacctgtgcagatgccttatgggttccatggtaccttcatacccatctgatgggacaaccacaaggtctggaaactaggtttaaaataagtgtgcacttggacataaagactggagaaataaacactgaggactccaaaaggggggcaaggaggaagaggggcaggggttaaaaagctacctattgaatactatgttccctatttgggtgatgggttcgttagaagtccaaacctcagcagcacacaatatactcatgtaacaagcctgcacatgtaccccagaatctaaaataaaaataaaaagaaaaacaaagaatgtactctatacaaaagacagagcataaagggcaccgtacctcccaaaccaatgtcccaaatagacatttagtttaaaaatttctgttaaaaacagaattcactatttccttgccactgccaagtcacgccatggcagaggctcgagtgcatacaagcttcggttttacccttaatacaccatcatgaccaatggaggcattgctgctggaggtgtcatggccattaacactactttataagaggtgcggaagactgccctcactcatcatggcctagcatgtgca

SEQ ID NO: 372151 - DNA, 1523 bp, Homo sapiens
  misc_feature (1423)..(1423): n is a, c, g, or t
gcgacgggtgtgcaccgcctctcgacttccggttcacccagcatttcctcttccctgttttctttcgtcgtcgtgggtgggaatgtcgcctaagtggttccgggttggtggatgaccttgagccctcaggaacgagatggcggttctctggaggctgagtgccgtttgcggtgccctaggaggccgagctctgttgcttcgaactccagtggtcagacctgctcatatctcagcatttcttcaggaccgacctatcccagaatggtgtggagtgcagcacatacacttgtcaccgagccaccattctggctccaaggctgcatctctccactggactagcgagagggttgtcagtgttttgctcctgggtctgcttccggctgcttatttgaatccttgctctgcgatggactattccctggctgcagccctcactcttcatggtcactggggccttggacaagttgttactgactatgttcatggggatgccttgcagaaagctgccaaggcagggcttttggcactttcagctttaacctttgctgggctttgctatttcaactatcacgatgtgggcatctgcaaagctgttgccatgctgtggaagctctgacctttttgacttcatactttgaagaattgatgtatgcctctttgcctctgctttgtcatgccattaagctcacaataaggaagaaataacagataagtccattggtggacagccttcttctcttaatcacaagattattttcagaatttaatctttgaggaaaaggtttgagaggaattatatctaagttgtgagactgagttctatattctggtgagttaatggggttgcctcccagcttcttataagactcacagtataactaaacatgatatatcagcttttgcctttcaatttatcaatctcttaaagagaatccaactttattacgattagtatatgatcaaacttccatatttgccttgggaataatggacaaagggaaatactcttaattcatgaataaaaactttgcagaaaattagacagtgtttaattttcgaaaacttccctctctagacagtagataccacctactgatggttacatatactagggaaattttaaaattaggaaatgctgatagctcatattataaatttctaaatcctaggaagaaacgcttggagtgcttctgaatatacagaagttccatttaagggcaagtttccctgtagatgtatcaaaatactaccaactgtaaattgagatttaattcccaaatgtattctacttgttctaaaacaatctgtccacaaatataaaactataagtaataaattgttattttcgcacaatgggaatctctaatgtgaaaatgtattctatgaaaataatttttttaaataaaaggtgtttcttcccccnaagaaagttatccctccaactttcccccatggaggcggtccgcgggtgttatccccggagagagggagatcaaaaaaccttccgggggagaggaaaacaa

SEQ ID NO: 372152 - DNA, 1107 bp, Homo sapiens
gcgacgggtgtgcaccgcctctcgacttccggttcacccagcatttcctcttccctgttttctttcgtcgtcgtgggtgggaatgtcgcctaagtggttccgggttggtggatgaccttgagccctcaggaacgagatggcggttctctggaggctgagtgccgtttgcggtgccctaggaggccgagctctgttgcttcgaactccagtggtcagacctgctcatatctcagcatttcttcaggaccgacctatcccagaatggtgtggagtgcagcacatacacttgtcaccgagccaccattctggctccaaggctgcatctctccactggactagcgagagggttgtcagtgttttgctcctgggtctgcttccggctgcttatttgaatccttgctctgcgatggactattccctggctgcagccctcactcttcatggtcactggggccttggacaagttgttactgactatgttcatggggatgccttgcagaaagctgccaaggcagggcttttggcactttcagctttaacctttgctgggctttgctatttcaactatcacgatgtgggcatctgcaaagctgttgccatgctgtggaagctctgacctttttgacttcatactttgaagaattgatgtatgcctctttgcctctgctttgtcatgccattaagctcacaataaggaagaaataacagataagtccattggtggacagccttcttctcttaatcacaagattattttcagaatttaatctttgaggaaaaggtttgagaggaattatatctaagttgtgagactgagttctatattctggtgagttaatggggttgcctcccagcttcttataagactcacagtataactaaacatgatatatcagcttttgcctttcaatttatcaatctcttaaagagaatccaactttattacgattagtatatgatcaaacttccatatttgccttgggaataatggacaaagggaaatactgaatctaatagatgagaaacattgtggaactagcagcggagagatggagaatgcgttaagagagaaacaaaagagggtaataaagggagtaaaggaaggag

SEQ ID NO: 372153 - DNA, 1439 bp, Homo sapiens
  misc_feature (24)..(24): n is a, c, g, or t
  misc_feature (31)..(31): n is a, c, g, or t
  misc_feature (1339)..(1339): n is a, c, g, or t
aagcagtggtatcaaccagagtgnccattanggcggagccctcaggaacgagatggcggttctctggaggctgagtgccgtttgcggtgccctaggaggccgagctctgttgcttcgaactccagtggtcagacctgctcatatctcagcatttcttcaggaccgacctatcccagaatggtgtggagtgcagcacatacacttgtcaccgagccaccattctggctccaaggctgcatctctccactggactagcgagagggttgtcagtgttttgctcctgggtctgcttccggctgcttatttgaatccttgctctgcgatggactattccctggctgcagccctcactcttcatggtcactggggccttggacaagttgttactgactatgttcatggggatgccttgcagaaagctgccaaggcagggcttttggcactttcagctttaacctttgctgggctttgctatttcaactatcacgatgtgggcatctgcaaagctgttgccatgctgtggaagctctgacctttttgacttcatactttgaagaattgatgtatgcctctttgcctctgctttgtcatgccattaagctcacaataaggaagaaataacagataagtccattggtggacagccttcttctcttaatcacaagattattttcagaatttaatctttgaggaaaaggtttgagaggaattatatctaagttgtgagactgagttctatattctggtgagttaatggggttgcctcccagcttcttataagactcacagtataactaaacatgatatatcagcttttgcctttcaatttatcaatctcttaaagagaatccaactttattacgattagtatatgatcaaacttccatatttgccttgggaataatggacaaagggaaatactcttaattcatgaataaaaactttgcagaaaattagacagtgtttaattttcgaaaacttccctctctagacagtagataccacctactgatggttacatatactagggaaattttaaaattaggaaatgctgatagctcatattataaatttctaaatcctaggaagaaacgcttggagtgcttctgaatatacagaagttccatttaagggcaagtttccctgtagatgtatcaaaatactaccaactgtaaattgagatttaattcccaaatgtattctacttgttctaaaacaatctgtccacaaatataaaactataagtaataaattgttattttcgcacaatgggaatctctaatgtgaaaatgtattctatgaaaataatttttttaaataaaaggtgtttcttcccccnaagaaagttatccctccaactttcccccatggaggcggtccgcgggtgttatccccggagagagggagatcaaaaaaccttccgggggagaggaaaacaa

SEQ ID NO: 372154 - DNA, 1390 bp, Homo sapiens
  misc_feature (10)..(10): n is a, c, g, or t
  misc_feature (29)..(29): n is a, c, g, or t
  misc_feature (46)..(46): n is a, c, g, or t
  misc_feature (1290)..(1290): n is a, c, g, or t
caagaattcngcacgaatggaggcttgantgccgttgggtgcctangaggccgagctctgttgcttcgaactccagtggtcagacctgctcatatctcagcatttcttcaggaccgacctatcccagaatggtgtggagtgcagcacatacacttgtcaccgagccaccattctggctccaaggctgcatctctccactggactagcgagagggttgtcagtgttttgctcctgggtctgcttccggctgcttatttgaatccttgctctgcgatggactattccctggctgcagccctcactcttcatggtcactggggccttggacaagttgttactgactatgttcatggggatgccttgcagaaagctgccaaggcagggcttttggcactttcagctttaacctttgctgggctttgctatttcaactatcacgatgtgggcatctgcaaagctgttgccatgctgtggaagctctgacctttttgacttcatactttgaagaattgatgtatgcctctttgcctctgctttgtcatgccattaagctcacaataaggaagaaataacagataagtccattggtggacagccttcttctcttaatcacaagattattttcagaatttaatctttgaggaaaaggtttgagaggaattatatctaagttgtgagactgagttctatattctggtgagttaatggggttgcctcccagcttcttataagactcacagtataactaaacatgatatatcagcttttgcctttcaatttatcaatctcttaaagagaatccaactttattacgattagtatatgatcaaacttccatatttgccttgggaataatggacaaagggaaatactcttaattcatgaataaaaactttgcagaaaattagacagtgtttaattttcgaaaacttccctctctagacagtagataccacctactgatggttacatatactagggaaattttaaaattaggaaatgctgatagctcatattataaatttctaaatcctaggaagaaacgcttggagtgcttctgaatatacagaagttccatttaagggcaagtttccctgtagatgtatcaaaatactaccaactgtaaattgagatttaattcccaaatgtattctacttgttctaaaacaatctgtccacaaatataaaactataagtaataaattgttattttcgcacaatgggaatctctaatgtgaaaatgtattctatgaaaataatttttttaaataaaaggtgtttcttcccccnaagaaagttatccctccaactttcccccatggaggcggtccgcgggtgttatccccggagagagggagatcaaaaaaccttccgggggagaggaaaacaa

SEQ ID NO: 372155 - DNA, 1322 bp, Homo sapiens
  misc_feature (24)..(24): n is a, c, g, or t
  misc_feature (31)..(31): n is a, c, g, or t
  misc_feature (1222)..(1222): n is a, c, g, or t
aagcagtggtatcaaccagagtgnccattanggcggagccctcaggaacgagatggcggttctctggaggctgagtgccgtttgcggtgccctaggaggccgagctggctccaaggctgcatctctccactggactagcgagagggttgtcagtgttttgctcctgggtctgcttccggctgcttatttgaatccttgctctgcgatggactattccctggctgcagccctcactcttcatggtcactggggccttggacaagttgttactgactatgttcatggggatgccttgcagaaagctgccaaggcagggcttttggcactttcagctttaacctttgctgggctttgctatttcaactatcacgatgtgggcatctgcaaagctgttgccatgctgtggaagctctgacctttttgacttcatactttgaagaattgatgtatgcctctttgcctctgctttgtcatgccattaagctcacaataaggaagaaataacagataagtccattggtggacagccttcttctcttaatcacaagattattttcagaatttaatctttgaggaaaaggtttgagaggaattatatctaagttgtgagactgagttctatattctggtgagttaatggggttgcctcccagcttcttataagactcacagtataactaaacatgatatatcagcttttgcctttcaatttatcaatctcttaaagagaatccaactttattacgattagtatatgatcaaacttccatatttgccttgggaataatggacaaagggaaatactcttaattcatgaataaaaactttgcagaaaattagacagtgtttaattttcgaaaacttccctctctagacagtagataccacctactgatggttacatatactagggaaattttaaaattaggaaatgctgatagctcatattataaatttctaaatcctaggaagaaacgcttggagtgcttctgaatatacagaagttccatttaagggcaagtttccctgtagatgtatcaaaatactaccaactgtaaattgagatttaattcccaaatgtattctacttgttctaaaacaatctgtccacaaatataaaactataagtaataaattgttattttcgcacaatgggaatctctaatgtgaaaatgtattctatgaaaataatttttttaaataaaaggtgtttcttcccccnaagaaagttatccctccaactttcccccatggaggcggtccgcgggtgttatccccggagagagggagatcaaaaaaccttccgggggagaggaaaacaa

SEQ ID NO: 372156 - DNA, 1499 bp, Homo sapiens
  misc_feature (1399)..(1399): n is a, c, g, or t
ggaccttgaaccctccaaggaaggagagggcggccctctgctagctgaggctgtcgtcatgacggtgccctatagaggcctgcactcgtctgtttgattcgagctccaatggtcagacctagctcatatctcgagcgagttttacctcttggcaggatctccgtagaccattaaataccctcacgaagaatgggtagttgggcatggttgcatgcaatcatcatcggctttgtactacacagaggcgcagccacttacgtggacgtccagaaggacttgaactggctccaaggctgcatctctccactggactagcgagagggttgtcagtgttttgctcctgggtctgcttccggctgcttatttgaatccttgctctgcgatggactattccctggctgcagccctcactcttcatggtcactggggccttggacaagttgttactgactatgttcatggggatgccttgcagaaagctgccaaggcagggcttttggcactttcagctttaacctttgctgggctttgctatttcaactatcacgatgtgggcatctgcaaagctgttgccatgctgtggaagctctgacctttttgacttcatactttgaagaattgatgtatgcctctttgcctctgctttgtcatgccattaagctcacaataaggaagaaataacagataagtccattggtggacagccttcttctcttaatcacaagattattttcagaatttaatctttgaggaaaaggtttgagaggaattatatctaagttgtgagactgagttctatattctggtgagttaatggggttgcctcccagcttcttataagactcacagtataactaaacatgatatatcagcttttgcctttcaatttatcaatctcttaaagagaatccaactttattacgattagtatatgatcaaacttccatatttgccttgggaataatggacaaagggaaatactcttaattcatgaataaaaactttgcagaaaattagacagtgtttaattttcgaaaacttccctctctagacagtagataccacctactgatggttacatatactagggaaattttaaaattaggaaatgctgatagctcatattataaatttctaaatcctaggaagaaacgcttggagtgcttctgaatatacagaagttccatttaagggcaagtttccctgtagatgtatcaaaatactaccaactgtaaattgagatttaattcccaaatgtattctacttgttctaaaacaatctgtccacaaatataaaactataagtaataaattgttattttcgcacaatgggaatctctaatgtgaaaatgtattctatgaaaataatttttttaaataaaaggtgtttcttcccccnaagaaagttatccctccaactttcccccatggaggcggtccgcgggtgttatccccggagagagggagatcaaaaaaccttccgggggagaggaaaacaa

SEQ ID NO: 372157 - DNA, 1480 bp, Homo sapiens
  misc_feature (1380)..(1380): n is a, c, g, or t
gccctctggaatcattcctagagcgtccattagggcgcggcaggcccgagtatggtagagtgcatcctgtgagtccatgaagctgcttgtccttgacggatgatcctgggtagagtgcagtacgtgtgttggctttcgtaacctccaataaggatcacgacctgcgtgatatctcaaccgttttcgttccaagatccgaaactatcctcctaatggtcgatgacatgtgcatctatatacaggtagtccacgagacctcattctggctccaaggctgcatctctccactggactagcgagagggttgtcagtgttttgctcctgggtctgcttccggctgcttatttgaatccttgctctgcgatggactattccctggctgcagccctcactcttcatggtcactggggccttggacaagttgttactgactatgttcatggggatgccttgcagaaagctgccaaggcagggcttttggcactttcagctttaacctttgctgggctttgctatttcaactatcacgatgtgggcatctgcaaagctgttgccatgctgtggaagctctgacctttttgacttcatactttgaagaattgatgtatgcctctttgcctctgctttgtcatgccattaagctcacaataaggaagaaataacagataagtccattggtggacagccttcttctcttaatcacaagattattttcagaatttaatctttgaggaaaaggtttgagaggaattatatctaagttgtgagactgagttctatattctggtgagttaatggggttgcctcccagcttcttataagactcacagtataactaaacatgatatatcagcttttgcctttcaatttatcaatctcttaaagagaatccaactttattacgattagtatatgatcaaacttccatatttgccttgggaataatggacaaagggaaatactcttaattcatgaataaaaactttgcagaaaattagacagtgtttaattttcgaaaacttccctctctagacagtagataccacctactgatggttacatatactagggaaattttaaaattaggaaatgctgatagctcatattataaatttctaaatcctaggaagaaacgcttggagtgcttctgaatatacagaagttccatttaagggcaagtttccctgtagatgtatcaaaatactaccaactgtaaattgagatttaattcccaaatgtattctacttgttctaaaacaatctgtccacaaatataaaactataagtaataaattgttattttcgcacaatgggaatctctaatgtgaaaatgtattctatgaaaataatttttttaaataaaaggtgtttcttcccccnaagaaagttatccctccaactttcccccatggaggcggtccgcgggtgttatccccggagagagggagatcaaaaaaccttccgggggagaggaaaacaa

SEQ ID NO: 372158 - DNA, 1577 bp, Homo sapiens
  misc_feature (1477)..(1477): n is a, c, g, or t
gcgacgggtgtgcaccgcctctcgacttccggttcacccagcatttcctcttccctgttttctttcgtcgtcgtgggtgggaatgtcgcctaagtggttccgggttggtggatgaccttgagccctcaggaacgagatggcggttctctggaggctgagtgccgtttgcggtgccctaggaggccgagctctgttgcttcgaactccagtggtcagacctgctcatatctcagcatttcttcaggaccgacctatcccagaatggtgtggagtgcagcacatacacttgtcaccgagccaccattctggctccaaggctgcatctctccactggactagcgagagggttgtcagtgttttgctcctgggtctgcttccggctgcttatttgaatccttgctctgcgatggactattccctggctgcagccctcactcttcatggtcactgacctttccaaataaaagattccagttgcatatgaaatattagatcacaagtacagggccttggacaagttgttactgactatgttcatggggatgccttgcagaaagctgccaaggcagggcttttggcactttcagctttaacctttgctgggctttgctatttcaactatcacgatgtgggcatctgcaaagctgttgccatgctgtggaagctctgacctttttgacttcatactttgaagaattgatgtatgcctctttgcctctgctttgtcatgccattaagctcacaataaggaagaaataacagataagtccattggtggacagccttcttctcttaatcacaagattattttcagaatttaatctttgaggaaaaggtttgagaggaattatatctaagttgtgagactgagttctatattctggtgagttaatggggttgcctcccagcttcttataagactcacagtataactaaacatgatatatcagcttttgcctttcaatttatcaatctcttaaagagaatccaactttattacgattagtatatgatcaaacttccatatttgccttgggaataatggacaaagggaaatactcttaattcatgaataaaaactttgcagaaaattagacagtgtttaattttcgaaaacttccctctctagacagtagataccacctactgatggttacatatactagggaaattttaaaattaggaaatgctgatagctcatattataaatttctaaatcctaggaagaaacgcttggagtgcttctgaatatacagaagttccatttaagggcaagtttccctgtagatgtatcaaaatactaccaactgtaaattgagatttaattcccaaatgtattctacttgttctaaaacaatctgtccacaaatataaaactataagtaataaattgttattttcgcacaatgggaatctctaatgtgaaaatgtattctatgaaaataatttttttaaataaaaggtgtttcttcccccnaagaaagttatccctccaactttcccccatggaggcggtccgcgggtgttatccccggagagagggagatcaaaaaaccttccgggggagaggaaaacaa

SEQ ID NO: 372159 - DNA, 1378 bp, Homo sapiens
  misc_feature (1278)..(1278): n is a, c, g, or t
gcgacgggtgtgcaccgcctctcgacttccggttcacccagcatttcctcttccctgttttctttcgtcgtcgtgggtgggaatgtcgcctaagtggttccgggttggtggatgaccttgagccctcaggaacgagatggcggttctctggaggctgagtgccgtttgcggtgccctaggaggccgagctctgttgcttcgaactccagtggtcagacctgctcatatctcagcatttcttcaggaccgacctatcccagaatggtgtggagtgcagcacatacacttgtcaccgagccaccattgggccttggacaagttgttactgactatgttcatggggatgccttgcagaaagctgccaaggcagggcttttggcactttcagctttaacctttgctgggctttgctatttcaactatcacgatgtgggcatctgcaaagctgttgccatgctgtggaagctctgacctttttgacttcatactttgaagaattgatgtatgcctctttgcctctgctttgtcatgccattaagctcacaataaggaagaaataacagataagtccattggtggacagccttcttctcttaatcacaagattattttcagaatttaatctttgaggaaaaggtttgagaggaattatatctaagttgtgagactgagttctatattctggtgagttaatggggttgcctcccagcttcttataagactcacagtataactaaacatgatatatcagcttttgcctttcaatttatcaatctcttaaagagaatccaactttattacgattagtatatgatcaaacttccatatttgccttgggaataatggacaaagggaaatactcttaattcatgaataaaaactttgcagaaaattagacagtgtttaattttcgaaaacttccctctctagacagtagataccacctactgatggttacatatactagggaaattttaaaattaggaaatgctgatagctcatattataaatttctaaatcctaggaagaaacgcttggagtgcttctgaatatacagaagttccatttaagggcaagtttccctgtagatgtatcaaaatactaccaactgtaaattgagatttaattcccaaatgtattctacttgttctaaaacaatctgtccacaaatataaaactataagtaataaattgttattttcgcacaatgggaatctctaatgtgaaaatgtattctatgaaaataatttttttaaataaaaggtgtttcttcccccnaagaaagttatccctccaactttcccccatggaggcggtccgcgggtgttatccccggagagagggagatcaaaaaaccttccgggggagaggaaaacaa

SEQ ID NO: 372160 - DNA, 1294 bp, Homo sapiens
  misc_feature (1194)..(1194): n is a, c, g, or t
ctttgtctctaaagaaaagtcactagaaatagacttactgacatacacacgcaaaaggctatacagaatcccctaaagaagcaaacagtgacagtggagtggcaaatggagacattgcatttgaacttgacagattgtttttttgcagccaagttatctgtatagtcttctaatttcactgtggttttttattgatgttatgattttttctttttctttaggggccttggacaagttgttactgactatgttcatggggatgccttgcagaaagctgccaaggcagggcttttggcactttcagctttaacctttgctgggctttgctatttcaactatcacgatgtgggcatctgcaaagctgttgccatgctgtggaagctctgacctttttgacttcatactttgaagaattgatgtatgcctctttgcctctgctttgtcatgccattaagctcacaataaggaagaaataacagataagtccattggtggacagccttcttctcttaatcacaagattattttcagaatttaatctttgaggaaaaggtttgagaggaattatatctaagttgtgagactgagttctatattctggtgagttaatggggttgcctcccagcttcttataagactcacagtataactaaacatgatatatcagcttttgcctttcaatttatcaatctcttaaagagaatccaactttattacgattagtatatgatcaaacttccatatttgccttgggaataatggacaaagggaaatactcttaattcatgaataaaaactttgcagaaaattagacagtgtttaattttcgaaaacttccctctctagacagtagataccacctactgatggttacatatactagggaaattttaaaattaggaaatgctgatagctcatattataaatttctaaatcctaggaagaaacgcttggagtgcttctgaatatacagaagttccatttaagggcaagtttccctgtagatgtatcaaaatactaccaactgtaaattgagatttaattcccaaatgtattctacttgttctaaaacaatctgtccacaaatataaaactataagtaataaattgttattttcgcacaatgggaatctctaatgtgaaaatgtattctatgaaaataatttttttaaataaaaggtgtttcttcccccnaagaaagttatccctccaactttcccccatggaggcggtccgcgggtgttatccccggagagagggagatcaaaaaaccttccgggggagaggaaaacaa

SEQ ID NO: 372161 - DNA, 768 bp, Homo sapiens
gcgacgggtgtgcaccgcctctcgacttccggttcacccagcatttcctcttccctgttttctttcgtcgtcgtgggtgggaatgtcgcctaagtggttccgggttggtggatgaccttgagccctcaggaacgagatggcggttctctggaggctgagtgccgtttgcggtgccctaggaggccgagctctgttgcttcgaactccagtggtcagacctgctcatatctcagcatttcttcaggaccgacctatcccagaatggtgtggagtgcagcacatacacttgtcaccgagccaccattctggctccaaggctgcatctctccactggactagcgagagggttgtcagtgttttgctcctgggtctgcttccggctgcttatttgaatccttgctctgcgatggactattccctggctgcagccctcactcttcatggtcactggaagatcaaaaataatgagtaatgtgtcatctaagagagaacactggaatccaacagagaacttacagaaaacaccagtagcaaggaaggagaaggaagcgaggaagtctgctcagctggggtcatctgggaacctatagaggctcccttaatgcggagaaaggagatgggcttgcaccatgctgtgtcggccattacccaactcctgggcttaagtgatccacctgcctcagcctcccaaagtgctgggattacaagcctgagccaccgcgcccagctgttaatcgtgacttaatacatgtgcatcttcccctgaaa

SEQ ID NO: 372162 - DNA, 1154 bp, Homo sapiens
gcgacgggtgtgcaccgcctctcgacttccggttcacccagcatttcctcttccctgttttctttcgtcgtcgtgggtgggaatgtcgcctaagtggttccgggttggtggatgaccttgagccctcaggaacgagatggcggttctctggaggctgagtgccgtttgcggtgccctaggaggccgagctctgttgcttcgaactccagtggtcagacctgctcatatctcagcatttcttcaggaccgacctatcccagaatggtgtggagtgcagcacatacacttgtcaccgagccaccattctggctccaaggctgcatctctccactggactagcgagagggttgtcagtgttttgctcctgggtctgcttccggctgcttatttgaatccttgctctgcgatggactattccctggctgcagccctcactcttcatggtcactgtctccagtgccagatagtccacagctgtcctctcttggaaaatcagattcatctttctctgaaatttccggactattttataaagatgaagccttggagaaagatttaaatgttttcaaaaggtacatgggaaatactcctcagaaaaaagccgtctttgggcagtgtcggggtctgccatgtgttgcaccgctgctgaccacagtggaagaggctccacggggcatctctgctcgagtctggggacattttcctaagtggctcaatggctctctacttcgaattggacctgggaaattcgagtttgggaaggataagtacaatcattggtttgatgggatggcgctgcttcaccagttcagaatggcaaagggcacagtgacatacaggagcaagtttctacagagtgatacatataaggccaacagtgctaaaaaccgaattgtgatctcagaatttggcacactggctctcccggatccatgcaagaatgtttttgaacgtttcatgtccaggtttgagctgcctggtaaagctgcaggtgatagtgacgattatttaaactattacgatatataaccatctatacaaacataaatcttgaaaatagatttttttgtactgtgagaggatgttgaaactgctttctccctttgagtgtgtgcttagcgtcgtctacagtaagctgtggtacttaaataact

SEQ ID NO: 372163 - DNA, 524 bp, Homo sapiens
  misc_feature (496)..(496): n is a, c, g, or t
  misc_feature (515)..(515): n is a, c, g, or t
gcgacgggtgtgcaccgcctctcgacttccggttcacccagcatttcctcttccctgttttctttcgtcgtcgtgggtgggaatgtcgcctaagtggttccgggttggtggatgaccttgagccctcaggaacgagatggcggttctctggaggctgagtgccgtttgcggtgccctaggaggccgagctctgttgcttcgaactccagtggtcagacctgctcatatctcagcatttcttcaggaccgacctatcccagaatggtgtggagtgcagcacatacacttgtcaccgagccaccattctggctccaaggctgcatctctccactggactagcgagagggttgtcagtgttttgctcctgggtctgcttccggctgcttatttgaatccttgctctgcgatggactattccctggctgcagccctcactcttcatggtcactgtgggggcttggacaattgttatgaccagttcaggggatgcctgccngccaaggcaggctttgcanttcgctttc

SEQ ID NO: 372164 - DNA, 1069 bp, Homo sapiens
gcgacgggtgtgcaccgcctctcgacttccggttcacccagcatttcctcttccctgttttctttcgtcgtcgtgggtgggaatgtcgcctaagtggttccgggttggtggatgaccttgagccctcaggaacgagatggcggttctctggaggctgagtgccgtttgcggtgccctaggaggccgagctctgttgcttcgaactccagtggtcagacctgctcatatctcagcatttcttcaggaccgacctatcccagaatggtgtggagtgcagcacatacacttgtcaccgagccaccattctggctccaaggctgcatctctccactggactagcgagagggttgtcagtgttttgctcctgggtctgcttccggctgcttatttgaatccttgctctgcgatggactattccctggctgcagccctcactcttcatggtcactgtctccagtgccagatagtccacagctgtcctctcttggaaaatcagattcatctttctctgaaatttccggactattttataaagatgaagccttggagaaagatttaaatgttttcaaaaggtacatgggaaatactcctcagaaaaaagccgtctttgggcagtgtcggggtctgccatgtgttgcaccgctgctgaccacagtggaagaggctccacggggcatctctgctcgagtctggggacattttcctaagtggctcaatggctctctacttcgaattggacctgggaaattcgagtttgggaaggataagtacaatcattggtttgatgggatggcgctgcttcaccagttcagaatggcaaagggcacagtgacatacaggagcaagtttctacagagtgatacatataaggccaacagtgctaaaaaccgaattgtgatctcagaatttggcacactggctctcccggatccatgcaagaatgtttttgaagtcgacgttgccgcccacgtcgggggggaaggccgcccacatgttcttgatctcctcctgggagaagcggtcacactgcgtggtcagcagctcctccaggaacttcttcttgatggtg

SEQ ID NO: 372165 - DNA, 2336 bp, Homo sapiens
acagtccaggcagttctgtgcgtgttcactgtttagtagtactcaaaactgccagtgtgagaggatttggaaatcactggatctgctcaatacaaaaatgttttttcgagtctttctccattttatcaggagtcattctgccactgcagtggatttccttcctgtgatggtgcaccggctcccagttttcaaaaggtacatgggaaatactcctcagaacacagtggaagaggctccacggggcatctctgctcgagtctggggacattttcctaagtggctcaatggctctctacttcgaattggacctgggaaattcgagtttgggaaggataagtacaatcattggtttgatgggatggcgctgcttcaccagttcagaatggcaaagggcacagtgacatacaggagcaagtttctacagagtgatacatataaggccaacagtgctaaaaaccgaattgtgatctcagaatttggcacactggctctcccggatccatgcaagaatgtttttgaacgtttcatgtccaggtttgagctgcctggtaaagctgcagccatgactgacaatactaatgtcaactatgtgcggtacaagggtgattactacctctgcactgagaccaactttatgaataaagtggacattgaaactctggaaaaaacagaaaaggtagattggagcaaatttattgctgtgaatggagcaactgcacatcctcattatgacccggatggaacagcatacaatatggggaactcctttgggccatatggtttctcctataaggttattcgggttcctccagagaaggtggaccttggggagacaatccatggagtccaggtgatatgttctattgcttctacagagaaagggaaaccttcttactaccatagctttggaatgacaaggaactatataattttcattgaacaacctctaaagatgaacctgtggaaaattgccacttctaaaattcggggaaaggccttttcagatgggataagctgggaaccccagtgtaatacgcggtttcatgtggtggaaaaacgcactggacagctccttccagggagatactacagcaaaccttttgttacatttcatcaaatcaatgcctttgaggaccagggctgtgttataattgatttgtgctgtcaagataatggaagaaccctagaagtttaccagttacagaatctcaggaaggctggggaagggcttgatcaggtccataattcagcagccaaatctttccctcgaaggtttgttttgcctttaaatgtcagtttgaatgcccctgagggagacaacctgagtccattgtcctatacttcagccagtgctgtgaaacaggctgatggaacgatctggtgctctcatgaaaatctacatcaggaggacctagaaaaggaaggaggcattgaatttcctcagatctactatgatcgattcagtggcaaaaagtatcatttcttttatggctgtggctttcggcatttagtgggggattctctgatcaaggttgatgtggtgaataagacactgaaggtttggagagaagatggcttttatccctcagaacctgtttttgttccagcaccaggaaccaatgaagaagatggtggggttattctttctgtggtgatcactcccaaccagaatgaaagcaattttctcctagttttggatgccaagaactttgaagagctgggccgagcagaggtacctgtgcagatgccttatgggttccatggtaccttcatacccatctgatgggacaaccacaaggtctggaaactaggtttaaaataagtgtgcacttggacataaagactggagaaataaacactgaggactccaaaaggggggcaaggaggaagaggggcaggggttaaaaagctacctattgaatactatgttccctatttgggtgatgggttcgttagaagtccaaacctcagcagcacacaatatactcatgtaacaagcctgcacatgtaccccagaatctaaaataaaaataaaaagaaaaacaaagaatgtactctatacaaaagacagagcataaagggcaccgtacctcccaaaccaatgtcccaaatagacatttagtttaaaaatttctgttaaaaacagaattcactatttccttgccactgccaagtcacgccatggcagaggctcgagtgcatacaagcttcggttttacccttaatacaccatcatgaccaatggaggcattgctgctggaggtgtcatggccattaacactactttataagaggtgcggaagactgccctcactcatcatggcctagcatgtgca

SEQ ID NO: 372166 - DNA, 1666 bp, Homo sapiens
agataaaaagcaagctgagaacatgcaacccaagctattctaagcagttcccttttttataaaggaacaggaaatacgtatagtaaagctgggagacagtaaacatgtatttctggctggcatttgtttagggcatcagtaacgtgtccaggcattcagacaagtccccataactggcacatttcagacaactctagtttgccaaataacatttttattgtttgctggaaccttttaggaatgacaaggaactatataattttcattgaacaacctctaaagatgaacctgtggaaaattgccacttctaaaattcggggaaaggccttttcagatgggataagctgggaaccccagtgtaatacgcggtttcatgtggtggaaaaacgcactggacagctccttccagggagatactacagcaaaccttttgttacatttcatcaaatcaatgcctttgaggaccagggctgtgttataattgatttgtgctgtcaagataatggaagaaccctagaagtttaccagttacagaatctcaggaaggctggggaagggcttgatcaggtccataattcagcagccaaatctttccctcgaaggtttgttttgcctttaaatgtcagtttgaatgcccctgagggagacaacctgagtccattgtcctatacttcagccagtgctgtgaaacaggctgatggaacgatctggtgctctcatgaaaatctacatcaggaggacctagaaaaggaaggaggcattgaatttcctcagatctactatgatcgattcagtggcaaaaagtatcatttcttttatggctgtggctttcggcatttagtgggggattctctgatcaaggttgatgtggtgaataagacactgaaggtttggagagaagatggcttttatccctcagaacctgtttttgttccagcaccaggaaccaatgaagaagatggtggggttattctttctgtggtgatcactcccaaccagaatgaaagcaattttctcctagttttggatgccaagaactttgaagagctgggccgagcagaggtacctgtgcagatgccttatgggttccatggtaccttcatacccatctgatgggacaaccacaaggtctggaaactaggtttaaaataagtgtgcacttggacataaagactggagaaataaacactgaggactccaaaaggggggcaaggaggaagaggggcaggggttaaaaagctacctattgaatactatgttccctatttgggtgatgggttcgttagaagtccaaacctcagcagcacacaatatactcatgtaacaagcctgcacatgtaccccagaatctaaaataaaaataaaaagaaaaacaaagaatgtactctatacaaaagacagagcataaagggcaccgtacctcccaaaccaatgtcccaaatagacatttagtttaaaaatttctgttaaaaacagaattcactatttccttgccactgccaagtcacgccatggcagaggctcgagtgcatacaagcttcggttttacccttaatacaccatcatgaccaatggaggcattgctgctggaggtgtcatggccattaacactactttataagaggtgcggaagactgccctcactcatcatggcctagcatgtgca

SEQ ID NO: 372167 - DNA, 1240 bp, Homo sapiens
  misc_feature (1140)..(1140): n is a, c, g, or t
ctttgtctctaaagaaaagtcactagaaatagacttactgacatacacacgcaaaaggctatacagaatcccctaaagaagcaaacagtgacagtggagtggcaaatggagacattgcatttgaacttgacagattgtttttttgcagccaagttatctgtatagtcttctaatttcactgtggttttttattgatgttatgattttttctttttctttaggggccttggacaagttgttactgactatgttcatggggatgccttgcagaaagctgccaaggcagggcttttggcactttcagctttaacctttgctgggctttgctatttcaactatcacgatgtgggcatctgcaaagctgttgccatgctgtggaagctctgacctttttgacttcatactttgaagaattgatgtatgcctctttgcctctgctttgtcatgccattaagctcacaataaggaagaaataacagataagtccattggtggacagccttcttctcttaatcacaagattattttcagaatttaatctttgaggtgagttaatggggttgcctcccagcttcttataagactcacagtataactaaacatgatatatcagcttttgcctttcaatttatcaatctcttaaagagaatccaactttattacgattagtatatgatcaaacttccatatttgccttgggaataatggacaaagggaaatactcttaattcatgaataaaaactttgcagaaaattagacagtgtttaattttcgaaaacttccctctctagacagtagataccacctactgatggttacatatactagggaaattttaaaattaggaaatgctgatagctcatattataaatttctaaatcctaggaagaaacgcttggagtgcttctgaatatacagaagttccatttaagggcaagtttccctgtagatgtatcaaaatactaccaactgtaaattgagatttaattcccaaatgtattctacttgttctaaaacaatctgtccacaaatataaaactataagtaataaattgttattttcgcacaatgggaatctctaatgtgaaaatgtattctatgaaaataatttttttaaataaaaggtgtttcttcccccnaagaaagttatccctccaactttcccccatggaggcggtccgcgggtgttatccccggagagagggagatcaaaaaaccttccgggggagaggaaaacaa

SEQ ID NO: 372168 - DNA, 300 bp, Homo sapiens
cccaccttggcctcccaaagtgctgggattataggtgtgaaccaccgtgcccagcctaaaggggttttaattatctggttttgtaggactggttaggagaatgagttgttgttgttgatgttgttttttaaccacacagacctttccaaataaaagattccagttgcatatgaaatattagatcacaagtacagtaagtaatatttctctaacatgtcatccctcttgaaggagctgtctataatgtgctccacttcctcaacactgagtctcttttagcctgtattaattggggtctta

SEQ ID NO: 372169 - DNA, 964 bp, Homo sapiens
  misc_feature (956)..(956): n is a, c, g, or t
gcgacgggtgtgcaccgcctctcgacttccggttcacccagcatttcctcttccctgttttctttcgtcgtcgtgggtgggaatgtcgcctaagtggttccgggttggtggatgaccttgagccctcaggaacgagatggcggttctctggaggctgagtgccgtttgcggtgccctaggaggccgagctctgttgcttcgaactccagtggtcagacctgctcatatctcagcatttcttcaggaccgacctatcccagaatggtgtggagtgcagcacatacacttgtcaccgagccaccattctggctccaaggctgcatctctccactggactagcgagagggttgtcagtgttttgctcctgggtctgcttccggctgcttatttgaatccttgctctgcgatggactattccctggctgcagccctcactcttcatggtcactggggccttggacaagttgttactgactatgttcatggggatgccttgcagaaagctgccaaggcagggcttttggcactttcagctttaacctttgctgggctttgctatttcaactatcacgatgtgggcatctgcaaagctgttgccatgctgtggaagctctgacctttttgacttcatactttgaagaattgatgtatgcctctttgcctctgctttgtcatgccattaagctcacaataaggaagaaataacagataagtccattggtggacagccttcttctcttaatcacaagattattttcagaatttaatctttgaggaaacgttgcgaggatatattctaagtggaacgggtcaaatcggggtaggggggcccagttttagaccgtataaggattcgtgctcaattaactaagaacacttagagtttgtaaccatgcggagggggaccctgaatgaaaggtgacccgaaacggttggaaagagctaatagggaaggnagcaactg

SEQ ID NO: 372170 - DNA, 2907 bp, Homo sapiens
gcctctttcctgaaggttgctgggagcttctgaagctttgtgtcctgtgtggctcagatgagatagcaattccgcagagtcctggaagttaaagaaggctgagttaggattgtttcctcatggtcagggaaacagccttcacatttgtatattttatgcaatatttaaggcaggattcagggacttggtattctttgggatttgcaataagaagaatattcaatatttaggcttttctaaattgaaaaatcactgccacacgttctaatgtaattgtttggtttctctatttgcattttgcggggactgccttaaaactcatttatgttttatagccttctattatagttaccattgttacatgattttatgtatagaaattggctgatctagagctttcagaaatcatactaatatgcactataaatttaaaattacttaatgtagtaatttaatgtttgcagtatgcaagggaatgtattacgtactggaaggagagaggagacaaacaccagaccctgtactcaaggagtactggtagtatcatttatcatacaagacagataagataaggtccatatgagagctataaacagatgctgtgagttcagactaaggagaatcagttcttgctgtaggtaaggggaatgctgtgtttataaagcaaatgacatggcaactggatcttgaaggatgagttagttttcaaaaggtacatgggaaatactcctcagaaaaaagccgtctttgggcagtgtcggggtctgccatgtgttgcaccgctgctgaccacagtggaagaggctccacggggcatctctgctcgagtctggggacattttcctaagtggctcaatggctctctacttcgaattggacctgggaaattcgagtttgggaaggataagtacaatcattggtttgatgggatggcgctgcttcaccagttcagaatggcaaagggcacagtgacatacaggagcaagtttctacagagtgatacatataaggccaacagtgctaaaaaccgaattgtgatctcagaatttggcacactggctctcccggatccatgcaagaatgtttttgaacgtttcatgtccaggtttgagctgcctggtaaagctgcagccatgactgacaatactaatgtcaactatgtgcggtacaagggtgattactacctctgcactgagaccaactttatgaataaagtggacattgaaactctggaaaaaacagaaaaggtagattggagcaaatttattgctgtgaatggagcaactgcacatcctcattatgacccggatggaacagcatacaatatggggaactcctttgggccatatggtttctcctataaggttattcgggttcctccagagaaggtggaccttggggagacaatccatggagtccaggtgatatgttctattgcttctacagagaaagggaaaccttcttactaccatagctttggaatgacaaggaactatataattttcattgaacaacctctaaagatgaacctgtggaaaattgccacttctaaaattcggggaaaggccttttcagatgggataagctgggaaccccagtgtaatacgcggtttcatgtggtggaaaaacgcactggacagctccttccagggagatactacagcaaaccttttgttacatttcatcaaatcaatgcctttgaggaccagggctgtgttataattgatttgtgctgtcaagataatggaagaaccctagaagtttaccagttacagaatctcaggaaggctggggaagggcttgatcaggtccataattcagcagccaaatctttccctcgaaggtttgttttgcctttaaatgtcagtttgaatgcccctgagggagacaacctgagtccattgtcctatacttcagccagtgctgtgaaacaggctgatggaacgatctggtgctctcatgaaaatctacatcaggaggacctagaaaaggaaggaggcattgaatttcctcagatctactatgatcgattcagtggcaaaaagtatcatttcttttatggctgtggctttcggcatttagtgggggattctctgatcaaggttgatgtggtgaataagacactgaaggtttggagagaagatggcttttatccctcagaacctgtttttgttccagcaccaggaaccaatgaagaagatggtggggttattctttctgtggtgatcactcccaaccagaatgaaagcaattttctcctagttttggatgccaagaactttgaagagctgggccgagcagaggtacctgtgcagatgccttatgggttccatggtaccttcatacccatctgatgggacaaccacaaggtctggaaactaggtttaaaataagtgtgcacttggacataaagactggagaaataaacactgaggactccaaaaggggggcaaggaggaagaggggcaggggttaaaaagctacctattgaatactatgttccctatttgggtgatgggttcgttagaagtccaaacctcagcagcacacaatatactcatgtaacaagcctgcacatgtaccccagaatctaaaataaaaataaaaagaaaaacaaagaatgtactctatacaaaagacagagcataaagggcaccgtacctcccaaaccaatgtcccaaatagacatttagtttaaaaatttctgttaaaaacagaattcactatttccttgccactgccaagtcacgccatggcagaggctcgagtgcatacaagcttcggttttacccttaatacaccatcatgaccaatggaggcattgctgctggaggtgtcatggccattaacactactttataagaggtgcggaagactgccctcactcatcatggcctagcatgtgca

SEQ ID NO: 372171 - DNA, 777 bp, Homo sapiens
acagtccaggcagttctgtgcgtgttcactgtttagtagtactcaaaactgccagtgtgagaggatttggaaatcactggatctgctcaatacaaaaatgttttttcgagtctttctccattttatcaggagtcattctgccactgcagtggatttccttcctgtgatggtgcaccggctcccagttttcaaaaggtacatgggaaatactcctcagaaaaaagccgtctttgggcagtgtcggggtctgccatgtgttgcaccgctgctgaccacagtggaagaggctccacggggcatctctgctcgagtctggggacattttcctaagtggctcaatggctctctacttcgaattggacctgggaaattcgagtttgggaaggataagtacaatcattggtttgatgggatggcgctgcttcaccagttcagaatggcaaagggcacagtgacatacaggagcaagtttctacagagtgatacatataaggccaacagtgctaaaaaccgaattgtgatctcagaatttggcacactggctctcccggatccatgcaagaatgtttttgaacgtttcatgtccaggtttgagctgcctggtaaagctgcaggtgatagtgacgattatttaaactattacgatatataaccatctatacaaacataaatcttgaaaatagatttttttgtactgtgagaggatgttgaaactgctttctccctttgagtgtgtgcttagcgtcgtctacagtaagctgtggtacttaaataact

SEQ ID NO: 372172 - DNA, 1197 bp, Homo sapiens
gcgacgggtgtgcaccgcctctcgacttccggttcacccagcatttcctcttccctgttttctttcgtcgtcgtgggtgggaatgtcgcctaagtggttccgggttggtggatgaccttgagccctcaggaacgagatggcggttctctggaggctgagtgccgtttgcggtgccctaggaggccgagctctgttgcttcgaactccagtggtcagacctgctcatatctcagcatttcttcaggaccgacctatcccagaatggtgtggagtgcagcacatacacttgtcaccgagccaccattctggctccaaggctgcatctctccactggactagcgagagggttgtcagtgttttgctcctgggtctgcttccggctgcttatttgaatccttgctctgcgatggactattccctggctgcagccctcactcttcatggtcactggggccttggacaagttgttactgactatgttcatggggatgccttgcagaaagctgccaaggcagggcttttggcactttcagctttaacctttgctgggctttgctatttcaactatcacgatgtgggcatctgcaaagctgttgccatgctgtggaagctctgacctttttgacttcatactttgaagaattgatgtatgcctctttgcctctgctttgtcatgccattaagctcacaataaggaagaaataacagataagtccattggtggacagccttcttctcttaatcacaagattattttcagaatttaatctttgaggaaaaggtttgagaggaattatatctaagttgtgagactgagttctatattctggtgagttaatggggttgcctcccagcttcttataagactcacagtataactaaacatgatatatcagcttttgcctttcaatttatcaatctcttaaagagaatccaactttattacgattagtatatgatcaaacttccatatttgccttgggaataatggacaaagggaaatacttacaacttgcgaatagacggttatttcgaaaatccttttaaagtgttcacctatgtgggtcttttcgggaacttacatggaagggggccttaattaaaccgcgaaacgggggtggaaaaacctaggggcgattaaaaacggggttccatctttccgcaaaaatagggcgggatattttataaacgcccggt

SEQ ID NO: 372173 - DNA, 1013 bp, Homo sapiens
  misc_feature (911)..(911): n is a, c, g, or t
  misc_feature (923)..(923): n is a, c, g, or t
  misc_feature (951)..(951): n is a, c, g, or t
gcgacgggtgtgcaccgcctctcgacttccggttcacccagcatttcctcttccctgttttctttcgtcgtcgtgggtgggaatgtcgcctaagtggttccgggttggtggatgaccttgagccctcaggaacgagatggcggttctctggaggctgagtgccgtttgcggtgccctaggaggccgagctctgttgcttcgaactccagtggtcagacctgctcatatctcagcatttcttcaggaccgacctatcccagaatggtgtggagtgcagcacatacacttgtcaccgagccaccattctggctccaaggctgcatctctccactggactagcgagagggttgtcagtgttttgctcctgggtctgcttccggctgcttatttgaatccttgctctgcgatggactattccctggctgcagccctcactcttcatggtcactggggccttggacaagttgttactgactatgttcatggggatgccttgcagaaagctgccaaggcagggcttttggcactttcagctttaacctttgctgggctttgctatttcaactatcacgatgtgggcatctgcaaagctgttgccatgctgtggaagctctgacctttttgacttcatactttgaagaattgatgtatgcctctttgcctctgctttgtcatgccattaagctcacaataaggaagaaataacagataagtccattggtggacagccttcttctcttaatcacaagattattttcagaatttaatctttgaggaaaaggtttgagaggaattatatctaagttgtgagactgagttctatattctgggagtaaggggtgctccaagtttatagaatccaggttaataaatgttttagtttgcttcaatttaatttagagaacactttngatgtttgtcancacttgggggaagggaagagatttttgnaactggaaaaggtgtgaacgctaagaacggggtatgagaaggggttaaaaaggggagggggg

SEQ ID NO: 372174 - DNA, 1420 bp, Homo sapiens
  misc_feature (24)..(24): n is a, c, g, or t
  misc_feature (31)..(31): n is a, c, g, or t
  misc_feature (1320)..(1320): n is a, c, g, or t
aagcagtggtatcaaccagagtgnccattanggcggagccctcaggaacgagatggcggttctctggaggctgagtgccgtttgcggtgccctaggaggccgagctctgttgcttcgaactccagtggtcagacctgctcatatctcagcatttcagaatggtgtggagtgcagcacatacacttgtcaccgagccaccattctggctccaaggctgcatctctccactggactagcgagagggttgtcagtgttttgctcctgggtctgcttccggctgcttatttgaatccttgctctgcgatggactattccctggctgcagccctcactcttcatggtcactggggccttggacaagttgttactgactatgttcatggggatgccttgcagaaagctgccaaggcagggcttttggcactttcagctttaacctttgctgggctttgctatttcaactatcacgatgtgggcatctgcaaagctgttgccatgctgtggaagctctgacctttttgacttcatactttgaagaattgatgtatgcctctttgcctctgctttgtcatgccattaagctcacaataaggaagaaataacagataagtccattggtggacagccttcttctcttaatcacaagattattttcagaatttaatctttgaggaaaaggtttgagaggaattatatctaagttgtgagactgagttctatattctggtgagttaatggggttgcctcccagcttcttataagactcacagtataactaaacatgatatatcagcttttgcctttcaatttatcaatctcttaaagagaatccaactttattacgattagtatatgatcaaacttccatatttgccttgggaataatggacaaagggaaatactcttaattcatgaataaaaactttgcagaaaattagacagtgtttaattttcgaaaacttccctctctagacagtagataccacctactgatggttacatatactagggaaattttaaaattaggaaatgctgatagctcatattataaatttctaaatcctaggaagaaacgcttggagtgcttctgaatatacagaagttccatttaagggcaagtttccctgtagatgtatcaaaatactaccaactgtaaattgagatttaattcccaaatgtattctacttgttctaaaacaatctgtccacaaatataaaactataagtaataaattgttattttcgcacaatgggaatctctaatgtgaaaatgtattctatgaaaataatttttttaaataaaaggtgtttcttcccccnaagaaagttatccctccaactttcccccatggaggcggtccgcgggtgttatccccggagagagggagatcaaaaaaccttccgggggagaggaaaacaa

SEQ ID NO: 372175 - DNA, 1583 bp, Homo sapiens
  misc_feature (1483)..(1483): n is a, c, g, or t
caactatactggacctacttggggctggggtttcgacgacgacgcggagtagtgagcaggaagggcgatactcttagcatcaatcaatatagcgagtccgaattgccggatcgctacgcggactgggctgcggacgccggacagtggtaagtgctgtggcatacggtgtcgagagatcagtgcatgaatagctggttgggttctcaaatcccagttagatacagcacctggtgcatatctgcagcgttctctaacacgaagatccgagactggtacgctcactagaatggtgttgtgacgtgacatgctatacaacaactgtgttcaccacggacgcacgactccagtttcttggaatactcaagctggctccaaggctgcatctctccactggactagcgagagggttgtcagtgttttgctcctgggtctgcttccggctgcttatttgaatccttgctctgcgatggactattccctggctgcagccctcactcttcatggtcactggggccttggacaagttgttactgactatgttcatggggatgccttgcagaaagctgccaaggcagggcttttggcactttcagctttaacctttgctgggctttgctatttcaactatcacgatgtgggcatctgcaaagctgttgccatgctgtggaagctctgacctttttgacttcatactttgaagaattgatgtatgcctctttgcctctgctttgtcatgccattaagctcacaataaggaagaaataacagataagtccattggtggacagccttcttctcttaatcacaagattattttcagaatttaatctttgaggaaaaggtttgagaggaattatatctaagttgtgagactgagttctatattctggtgagttaatggggttgcctcccagcttcttataagactcacagtataactaaacatgatatatcagcttttgcctttcaatttatcaatctcttaaagagaatccaactttattacgattagtatatgatcaaacttccatatttgccttgggaataatggacaaagggaaatactcttaattcatgaataaaaactttgcagaaaattagacagtgtttaattttcgaaaacttccctctctagacagtagataccacctactgatggttacatatactagggaaattttaaaattaggaaatgctgatagctcatattataaatttctaaatcctaggaagaaacgcttggagtgcttctgaatatacagaagttccatttaagggcaagtttccctgtagatgtatcaaaatactaccaactgtaaattgagatttaattcccaaatgtattctacttgttctaaaacaatctgtccacaaatataaaactataagtaataaattgttattttcgcacaatgggaatctctaatgtgaaaatgtattctatgaaaataatttttttaaataaaaggtgtttcttcccccnaagaaagttatccctccaactttcccccatggaggcggtccgcgggtgttatccccggagagagggagatcaaaaaaccttccgggggagaggaaaacaa

SEQ ID NO: 372176 - DNA, 1637 bp, Homo sapiens
  misc_feature (1537)..(1537): n is a, c, g, or t
gcgacgggtgtgcaccgcctctcgacttccggttcacccagcatttcctcttccctgttttctttcgtcgtcgtgggtgggaatgtcgcctaagtggttccgggttggtggatgaccttgagccctcaggaacgagatggcggttctctggaggctgagtgccgtttgcggtgccctaggaggccgagctctgttgcttcgaactccagtggtcagacctgctcatatctcagcatttcttcaggaccgacctatcccagaatggtgtggagtgcagcacatacacttgtcaccgagccaccattctggctccaaggctgcatctctccactggactagcgagagggttgtcagtgttttgctcctgggtctgcttccggctgcttatttgaatccttgctctgcgatggactattccctggctgcagccctcactcttcatggtcactgatgcatagaagtctcctctgccagatccttctcctcttgtctgacctcgagatgacaaaatctccagggctgagtcatggccttcttaatttctccatctgtacccttttttaggggccttggacaagttgttactgactatgttcatggggatgccttgcagaaagctgccaaggcagggcttttggcactttcagctttaacctttgctgggctttgctatttcaactatcacgatgtgggcatctgcaaagctgttgccatgctgtggaagctctgacctttttgacttcatactttgaagaattgatgtatgcctctttgcctctgctttgtcatgccattaagctcacaataaggaagaaataacagataagtccattggtggacagccttcttctcttaatcacaagattattttcagaatttaatctttgaggaaaaggtttgagaggaattatatctaagttgtgagactgagttctatattctggtgagttaatggggttgcctcccagcttcttataagactcacagtataactaaacatgatatatcagcttttgcctttcaatttatcaatctcttaaagagaatccaactttattacgattagtatatgatcaaacttccatatttgccttgggaataatggacaaagggaaatactcttaattcatgaataaaaactttgcagaaaattagacagtgtttaattttcgaaaacttccctctctagacagtagataccacctactgatggttacatatactagggaaattttaaaattaggaaatgctgatagctcatattataaatttctaaatcctaggaagaaacgcttggagtgcttctgaatatacagaagttccatttaagggcaagtttccctgtagatgtatcaaaatactaccaactgtaaattgagatttaattcccaaatgtattctacttgttctaaaacaatctgtccacaaatataaaactataagtaataaattgttattttcgcacaatgggaatctctaatgtgaaaatgtattctatgaaaataatttttttaaataaaaggtgtttcttcccccnaagaaagttatccctccaactttcccccatggaggcggtccgcgggtgttatccccggagagagggagatcaaaaaaccttccgggggagaggaaaacaa

SEQ ID NO: 372177 - DNA, 2749 bp, Homo sapiens
gcgacgggtgtgcaccgcctctcgacttccggttcacccagcatttcctcttccctgttttctttcgtcgtcgtgggtgggaatgtcgcctaagtggttccgggttggtggatgaccttgagccctcaggaacgagatggcggttctctggaggctgagtgccgtttgcggtgccctaggaggccgagctctgttgcttcgaactccagtggtcagacctgctcatatctcagcatttcttcaggaccgacctatcccagaatggtgtggagtgcagcacatacacttgtcaccgagccaccattctggctccaaggctgcatctctccactggactagcgagagggttgtcagtgttttgctcctgggtctgcttccggctgcttatttgaatccttgctctgcgatggactattccctggctgcagccctcactcttcatggtcactgtctccagtgccagatagtccacagctgtcctctcttggaaaatcagattcatctttctctgaaatttccggactattttataaagatgaagccttggagaaagatttaaatgttttcaaaaggtacatgggaaatactcctcagaaaaaagccgtctttgggcagtgtcggggtctgccatgtgttgcaccgctgctgaccacagtggaagaggctccacggggcatctctgctcgagtctggggacattttcctaagtggctcaatggctctctacttcgaattggacctgggaaattcgagtttgggaaggataagtacaatcattggtttgatgggatggcgctgcttcaccagttcagaatggcaaagggcacagtgacatacaggagcaagtttctacagagtgatacatataaggccaacagtgctaaaaaccgaattgtgatctcagaatttggcacactggctctcccggatccatgcaagaatgtttttgaacgtttcatgtccaggtttgagctgcctggtaaagctgcagccatgactgacaatactaatgtcaactatgtgcggtacaagggtgattactacctctgcactgagaccaactttatgaataaagtggacattgaaactctggaaaaaacagaaaaggtagattggagcaaatttattgctgtgaatggagcaactgcacatcctcattatgacccggatggaacagcatacaatatggggaactcctttgggccatatggtttctcctataaggttattcgggttcctccagagaaggtggaccttggggagacaatccatggagtccaggtgatatgttctattgcttctacagagaaagggaaaccttcttactaccatagctttggaatgacaaggaactatataattttcattgaacaacctctaaagatgaacctgtggaaaattgccacttctaaaattcggggaaaggccttttcagatgggataagctgggaaccccagtgtaatacgcggtttcatgtggtggaaaaacgcactggacagctccttccagggagatactacagcaaaccttttgttacatttcatcaaatcaatgcctttgaggaccagggctgtgttataattgatttgtgctgtcaagataatggaagaaccctagaagtttaccagttacagaatctcaggaaggctggggaagggcttgatcaggtccataattcagcagccaaatctttccctcgaaggtttgttttgcctttaaatgtcagtttgaatgcccctgagggagacaacctgagtccattgtcctatacttcagccagtgctgtgaaacaggctgatggaacgatctggtgctctcatgaaaatctacatcaggaggacctagaaaaggaaggaggcattgaatttcctcagatctactatgatcgattcagtggcaaaaagtatcatttcttttatggctgtggctttcggcatttagtgggggattctctgatcaaggttgatgtggtttggagagaagatggcttttatccctcagaacctgtttttgttccagcaccaggaaccaatgaagaagatggtggggttattctttctgtggtgatcactcccaaccagaatgaaagcaattttctcctagttttggatgccaagaactttgaagagctgggccgagcagaggtacctgtgcagatgccttatgggttccatggtaccttcatacccatctgatgggacaaccacaaggtctggaaactaggtttaaaataagtgtgcacttggacataaagactggagaaataaacactgaggactccaaaaggggggcaaggaggaagaggggcaggggttaaaaagctacctattgaatactatgttccctatttgggtgatgggttcgttagaagtccaaacctcagcagcacacaatatactcatgtaacaagcctgcacatgtaccccagaatctaaaataaaaataaaaagaaaaacaaagaatgtactctatacaaaagacagagcataaagggcaccgtacctcccaaaccaatgtcccaaatagacatttagtttaaaaatttctgttaaaaacagaattcactatttccttgccactgccaagtcacgccatggcagaggctcgagtgcatacaagcttcggttttacccttaatacaccatcatgaccaatggaggcattgctgctggaggtgtcatggccattaacactactttataagaggtgcggaagactgccctcactcatcatggcctagcatgtgca

SEQ ID NO: 372178 - DNA, 2386 bp, Homo sapiens
gcgacgggtgtgcaccgcctctcgacttccggttcacccagcatttcctcttccctgttttctttcgtcgtcgtgggtgggaatgtcgcctaagtggttccgggttggtggatgaccttgagccctcaggaacgagatggcggttctctggaggctgagtgccgtttgcggtgccctaggaggccgagctctgttgcttcgaactccagtggtcagacctgctcatatctcagcatttcttcaggaccgacctatcccagaatggtgtggagtgcagcacatacacttgtcaccgagccaccattctggctccaaggctgcatctctccactggactagcgagagggttgtcagtgttttgctcctgggtctgcttccggctgcttatttgaatccttgctctgcgatggactattccctggctgcagccctcactcttcatggtcactgtctccagtgccagatagtccacagctgtcctctcttggaaaatcagattcatctttctctgaaatttccggactattttataaagatgaagccttggagaaagatttaaatgttttcaaaaggtacatgggaaatactcctcagaaaaaagccgtctttgggcagtgtcggggtctgccatgtgttgcaccgctgctgaccacagtggaagaggctccacggggcatctctgctcgagtctggggacattttcctaagtggctcaatggctctctacttcgaattggacctgggaaattcgagtttgggaaggataagtacaatcattggtttgatgggatggcgctgcttcaccagttcagaatggcaaagggcacagtgacatacaggagcaagtttctacagagtgatacatataaggccaacagtgctaaaaaccgaattgtgatctcagaatttggcacactggctctcccggatccatgcaagaatgtttttgaacgtttcatgtccaggtttgagctgcctggtaaagctgcagccatgactgacaatactaatgtcaactatgtgcggtacaagggtgattactacctctgcactgagaccaactttatgaataaagtggacattgaaactctggaaaaaacagaaaaggtagattggagcaaatttattgctgtgaatggagcaactgcacatcctcattatgacccggatggaacagcatacaatatggggaactcctttgggccatatggtttctcctataaggttattcgggttcctccagagaaggtggaccttggggagacaatccatggagtccaggtgatatgttctattgcttctacagagaaagggaaaccttcttactaccatagctttggaatgacaaggaactatataattttcattgaacaacctctaaagatgaacctgtggaaaattgccacttctaaaattcggggaaaggccttttcagatgggataagctgggaaccccagtgtaatacgcggtttcatgtggtggaaaaacgcactggacagctccttccagggagatactacagcaaaccttttgttacatttcatcaaatcaatgcctttgaggaccagggctgtgttataattgatttgtgctgtcaagataatggaagaaccctagaagtttaccagttacagaatctcaggaaggctggggaagggcttgatcaggtccataattcagcagccaaatctttccctcgaaggtttgttttgcctttaaatgtcagtttgaatgcccctgagggagacaacctgagtccattgtcctatacttcagccagtgctgtgaaacaggctgatggaacgatctggtgctctcatgaaaatctacatcaggaggacctagaaaaggaaggaggcattgaatttcctcagatctactatgatcgattcagtggcaaaaagtatcatttcttttatggctgtggctttcggcatttagtgggggattctctgatcaaggttgatgtggtgaataagacactgaaggtttggagagaagatggcttttatccctcagaacctgtttttgttccagcaccaggaaccaatgaagaagatggtggggttattctttctgtggtgatcactcccaaccagaatgaaagcaattttctcctagttttggatgccaagaactttgaagagctgggccgagcagaggtacctgtgcagatgccttatgggttccatggtaccttcatacccatctgatgggacaaccacaaggaaacttttccaagcctgttattaatcagtgacttgtcctgcttttcatcatatacagtgatgatttttctcatatagagtggagctgtcctctccagtacctggaacaatgccagccacatagtagatgcccaataaatatttagtgaaagagtga

SEQ ID NO: 372179 - DNA, 725 bp, Homo sapiens
gcgacgggtgtgcaccgcctctcgacttccggttcacccagcatttcctcttccctgttttctttcgtcgtcgtgggtgggaatgtcgcctaagtggttccgggttggtggatgaccttgagccctcaggaacgagatggcggttctctggaggctgagtgccgtttgcggtgccctaggaggccgagctctgttgcttcgaactccagtggtcagacctgctcatatctcagcatttcttcaggaccgacctatcccagaatggtgtggagtgcagcacatacacttgtcaccgagccaccattctggctccaaggctgcatctctccactggactagcgagagggttgtcagtgttttgctcctgggtctgcttccggctgcttatttgaatccttgctctgcgatggactattccctggctgcagccctcactcttcatggtcactgggcaagtatagcaattccaaatatagttgtctgctcagtttgtttgctgtgagcttgtcttatgtattatatatgagggagaagttgattgaaatgccctaaatttgttgaaaactttaaaatatatatattcgatttccgtatctaatagcattttgaatgtagcctgtcaaactgaatttctgatctcccctaatctgttcctcctgcactcttgccccatctgaattaatggcatttccagttttctctttgttcaagtctaaacctggtaa

SEQ ID NO: 372180 - DNA, 2185 bp, Homo sapiens
acagtccaggcagttctgtgcgtgttcactgtttagtagtactcaaaactgccagtgtgagaggatttggaaatcactggatctgctcaatacaaaaatgttttttcgagtctttctccattttatcaggagtcattctgccactgcagtggatttccttcctgtgatggtgcaccggctcccaggtacaatcattggtttgatgggatggcgctgcttcaccagttcagaatggcaaagggcacagtgacatacaggagcaagtttctacagagtgatacatataaggccaacagtgctaaaaaccgaattgtgatctcagaatttggcacactggctctcccggatccatgcaagaatgtttttgaacgtttcatgtccaggtttgagctgcctggtaaagctgcagccatgactgacaatactaatgtcaactatgtgcggtacaagggtgattactacctctgcactgagaccaactttatgaataaagtggacattgaaactctggaaaaaacagaaaaggtagattggagcaaatttattgctgtgaatggagcaactgcacatcctcattatgacccggatggaacagcatacaatatggggaactcctttgggccatatggtttctcctataaggttattcgggttcctccagagaaggtggaccttggggagacaatccatggagtccaggtgatatgttctattgcttctacagagaaagggaaaccttcttactaccatagctttggaatgacaaggaactatataattttcattgaacaacctctaaagatgaacctgtggaaaattgccacttctaaaattcggggaaaggccttttcagatgggataagctgggaaccccagtgtaatacgcggtttcatgtggtggaaaaacgcactggacagctccttccagggagatactacagcaaaccttttgttacatttcatcaaatcaatgcctttgaggaccagggctgtgttataattgatttgtgctgtcaagataatggaagaaccctagaagtttaccagttacagaatctcaggaaggctggggaagggcttgatcaggtccataattcagcagccaaatctttccctcgaaggtttgttttgcctttaaatgtcagtttgaatgcccctgagggagacaacctgagtccattgtcctatacttcagccagtgctgtgaaacaggctgatggaacgatctggtgctctcatgaaaatctacatcaggaggacctagaaaaggaaggaggcattgaatttcctcagatctactatgatcgattcagtggcaaaaagtatcatttcttttatggctgtggctttcggcatttagtgggggattctctgatcaaggttgatgtggtgaataagacactgaaggtttggagagaagatggcttttatccctcagaacctgtttttgttccagcaccaggaaccaatgaagaagatggtggggttattctttctgtggtgatcactcccaaccagaatgaaagcaattttctcctagttttggatgccaagaactttgaagagctgggccgagcagaggtacctgtgcagatgccttatgggttccatggtaccttcatacccatctgatgggacaaccacaaggtctggaaactaggtttaaaataagtgtgcacttggacataaagactggagaaataaacactgaggactccaaaaggggggcaaggaggaagaggggcaggggttaaaaagctacctattgaatactatgttccctatttgggtgatgggttcgttagaagtccaaacctcagcagcacacaatatactcatgtaacaagcctgcacatgtaccccagaatctaaaataaaaataaaaagaaaaacaaagaatgtactctatacaaaagacagagcataaagggcaccgtacctcccaaaccaatgtcccaaatagacatttagtttaaaaatttctgttaaaaacagaattcactatttccttgccactgccaagtcacgccatggcagaggctcgagtgcatacaagcttcggttttacccttaatacaccatcatgaccaatggaggcattgctgctggaggtgtcatggccattaacactactttataagaggtgcggaagactgccctcactcatcatggcctagcatgtgca

SEQ ID NO: 372181 - DNA, 2171 bp, Homo sapiens
acagtccaggcagttctgtgcgtgttcactgtttagtagtactcaaaactgccagtgtgagaggatttggaaatcactggatctgctcaatacaaaaatgttttttcgagtctttctccattttatcaggagtcattctgccactgcagtggatttccttcctgtgatggtgcaccggctcccagttttcaaaaggtacatgggaaatactcctcagaaaaaagccgtctttgggcagtgtcggggtctgccatgtgttgcaccgctgctgaccacagtggaagaggctccacggggcatctctgctcgagtctggggacattttcctaagtggctcaatggctctctacttcgaattggacctgggaaattcgagtttgggaaggataagtacaatcattggtttgatgggatggcgctgcttcaccagttcagaatggcaaagggcacagtgacatacaggagcaagtttctacagagtgatacatataaggccaacagtgctaaaaaccgaattgtgatctcagaatttggcacactggctctcccggatccatgcaagaatgtttttgaacgtttcatgtccaggtttgagctgcctggtaaagctgcaggtttctcctataaggttattcgggttcctccagagaaggtggaccttggggagacaatccatggagtccaggtgatatgttctattgcttctacagagaaagggaaaccttcttactaccatagctttggaatgacaaggaactatataattttcattgaacaacctctaaagatgaacctgtggaaaattgccacttctaaaattcggggaaaggccttttcagatgggataagctgggaaccccagtgtaatacgcggtttcatgtggtggaaaaacgcactggacagctccttccagggagatactacagcaaaccttttgttacatttcatcaaatcaatgcctttgaggaccagggctgtgttataattgatttgtgctgtcaagataatggaagaaccctagaagtttaccagttacagaatctcaggaaggctggggaagggcttgatcaggtccataattcagcagccaaatctttccctcgaaggtttgttttgcctttaaatgtcagtttgaatgcccctgagggagacaacctgagtccattgtcctatacttcagccagtgctgtgaaacaggctgatggaacgatctggtgctctcatgaaaatctacatcaggaggacctagaaaaggaaggaggcattgaatttcctcagatctactatgatcgattcagtggcaaaaagtatcatttcttttatggctgtggctttcggcatttagtgggggattctctgatcaaggttgatgtggtgaataagacactgaaggtttggagagaagatggcttttatccctcagaacctgtttttgttccagcaccaggaaccaatgaagaagatggtggggttattctttctgtggtgatcactcccaaccagaatgaaagcaattttctcctagttttggatgccaagaactttgaagagctgggccgagcagaggtacctgtgcagatgccttatgggttccatggtaccttcatacccatctgatgggacaaccacaaggtctggaaactaggtttaaaataagtgtgcacttggacataaagactggagaaataaacactgaggactccaaaaggggggcaaggaggaagaggggcaggggttaaaaagctacctattgaatactatgttccctatttgggtgatgggttcgttagaagtccaaacctcagcagcacacaatatactcatgtaacaagcctgcacatgtaccccagaatctaaaataaaaataaaaagaaaaacaaagaatgtactctatacaaaagacagagcataaagggcaccgtacctcccaaaccaatgtcccaaatagacatttagtttaaaaatttctgttaaaaacagaattcactatttccttgccactgccaagtcacgccatggcagaggctcgagtgcatacaagcttcggttttacccttaatacaccatcatgaccaatggaggcattgctgctggaggtgtcatggccattaacactactttataagaggtgcggaagactgccctcactcatcatggcctagcatgtgca

SEQ ID NO: 372182 - DNA, 334 bp, Homo sapiens
tatgtccacataaaaacttgaacaggggctgggcatggtggctcacacctgtaatctcagcactttgggaggccaaggcaggtggatctccggaggtcaggagttcaaaaccagcctggccaacatggtaaaatgctgtctctactaaaaatacaaaaattagcctgatgtggtcatgtgcgcctgtaatcccagctactcgggaggctgaggcaggagaattgcttgaaaccagtagggatcccaggaggtagagcttgcagtgagctgagattgcgccacggcactgcagcctagcctgggtgacagagtgaggcttcctctcaaaaacaaa

SEQ ID NO: 372183 - DNA, 280 bp, Homo sapiens
  misc_feature (62)..(62): n is a, c, g, or t
taaatacaacatccaagcttgggctacgtagcaagaccccatctctttaaaaaaaaaaaaanttttatttaaaaaaaaattttttttaagacagtctcgctgggttgcccaggctgaagtgcagtggcgcggtcttgactcactgcaacctccgccttctgggttgaagtgattcttctgcctcagcgtcccaaagtgctgggattacaggcctagtcatagccacttaataatagcaggactttgggcaaatttcagtaaatgggtatttgaactaaaa

SEQ ID NO: 372184 - DNA, 467 bp, Homo sapiens
cacttcattaaatttcattttcttttctcttcccaccagggctattagctccagattgtgaaatcatacaggaagtgggaaaactctatccactggagatagtatttggaatgaatggaagaatatgggttaaggcaaaaaccatccagcagactttaattttggcaaacattttagaagcttgtgaacacatgacgtcagatcaaagaaaacagatcttctccagattggcagaaagttgatataggtggacttttttacaggtcagttgaggcaaaaaactatgggttttttcaggtgaacctcccccatttaaatactcagaagataaggtgtgaatgtatgtattattagagtccgaaagtatttttataagttactggttttcacccacgcttttgtgggagagaaaatcattgcaaaatcattttttttgttcggtacaataaagtttactaaaaaacaaa

SEQ ID NO: 372185 - DNA, 1101 bp, Homo sapiens
gagggagaaaggaaacatttaggctaggtcgaggctggtgtgcccgcgatggccgaacctgcgtctgtcgcggctgaatctctcgcgggcagcagggcgcgcgctgcacgcacagtactaggtcaggtggtgctcccgggtgaggagctgctcctgccggaacaggaggacgcggaaggccctgggggtgcagtggagcgaccgttgagcctgaatgctagagcgtgctcgcgggtgcgcgttgtatgcggtccgggccttcggcgctgtggggaccgcctgctggtcaccaagtgcggccgcctccgtcacaaggagcccggcagtggcagcggcggcggtgtttactgggtggactctcagcagaagcggtatgttccagtaaaaggagaccatgtgattggcatagtgacagctaaatctggagatatattcaaagttgatgttggagggagtgagccagcttctttgtcttacttgtcatttgaaggtgcaactaaaagaaacagaccaaatgtgcaggttggagatctcatctatggccagtttgtggttgctaataaagacatggaaccagagatggtctgtattgacagctgtggacgagccaatggaatgggtgtcattggacaggatggtctgctttttaaagtgactctgggcttaattagaaagctattagctccagattgtgaaatcatacaggaagtgggaaaactctatccactggagatagtatttggaatgaatggaagaatatgggttaaggcaaaaaccatccagcagactttaattttggcaaacattttagaagcttgtgaacacatgacgtcagatcaaagaaaacagatcttctccagattggcagaaagttgatataggtggacttttttacaggtcagttgaggcaaaaaactatgggttttttcaggtgaacctcccccatttaaatactcagaagataaggtgtgaatgtatgtattattagagtccgaaagtatttttataagttactggttttcacccacgcttttgtgggagagaaaatcattgcaaaatcattttttttgttcggtacaataaagtttactaaaaaacaaa

SEQ ID NO: 372186 - DNA, 1236 bp, Homo sapiens
gagggagaaaggaaacatttaggctaggtcgaggctggtgtgcccgcgatggccgaacctgcgtctgtcgcggctgaatctctcgcgggcagcagggcgcgcgctgcacgcacagtactaggtcaggtggtgctcccgggtgaggagctgctcctgccggaacaggaggacgcggaaggccctgggggtgcagtggagcgaccgttgagcctgaatgctagagcgtgctcgcgggtgcgcgttgtatgcggtccgggccttcggcgctgtggggaccgcctgctggtcaccaagtgcggccgcctccgtcacaaggagcccggcagtggcagcggcggcggtgtttactgggtggactctcagcagaagcggtatgttccagtaaaaggagaccatgtgattggcatagtgacagctaaatctggagatatattcaaagttgatgttggagggagtgagccagcttctttgtcttacttgtcatttgaaggtgcaactaaaagaaacagaccaaatgtgcaggttggagatctcatctatggccagtttgtggttgctaataaagacatggaaccagagatggtctgtattgacagctgtggacgagccaatggaatgggtgtcattggacaggatggtctgctttttaaagtgactctgggcttaattagaaagctattagctccagattgtgaaatcatacaggaagtgggaaaactctatccactggagatagtatttggaatgaatggaagaatatgggttaaggcaaaaaccatccagcagactttaattttggcaaacattttagaagcttgtgaacacatgacgtcagatcaaagaaaacagatcttctccagattggcagaaagttgatataggtggacttttttacagggtctggctgtgttacccaggctggagtgcagtggtacaatcatagctcactacagcctcaaattcctgggctcaagtgatcctcctacctcagcctcctgagtagctgggactacaggtacaggccaccatacctggctaatttttaattttttagaggcagggtcttcctatattgcctaggctagtcttgaactcctggcctcaagtgatcctcttgcctcggcctcccaagatgctgggattatatgcaggagccactgtgcccagcctaatagtagggaattcttggttaacattttcagaggactagagttagaagtttcaggtaggaacctc

SEQ ID NO: 372187 - DNA, 928 bp, Homo sapiens
cggaaacggtgtttggtggagcccgcgatggccgaacctgcgtctgtcgcggctgaatctctcgcgggcagcagggcgcgcgctgcacgcacagtactaggtcaggtggtgctcccgggtgaggagctgctcctgccggaacaggaggacgcggaaggccctgggggtgcagtggagcgaccgttgagcctgaatgctagagcgtgctcgcgggtgcgcgttgtatgcggtccgggccttcggcgctgtggggaccgcctgctggtcaccaagtgcggccgcctccgtcacaaggagcccggcagtggcagcggcggcggtgtttactgggtggactctcagcagaagcggtatgttccagtaaaaggagaccatgtgattggcatagtgacagctaaatctggagatatattcaaagttgatgttggagggagtgagccagcttctttgtcttacttgtcatttgaaggtgcaactaaaagaaacagaccaaatgtgcaggctattagctccagattgtgaaatcatacaggaagtgggaaaactctatccactggagatagtatttggaatgaatggaagaatatgggttaaggcaaaaaccatccagcagactttaattttggcaaacattttagaagcttgtgaacacatgacgtcagatcaaagaaaacagatcttctccagattggcagaaagttgatataggtggacttttttacaggtcagttgaggcaaaaaactatgggttttttcaggtgaacctcccccatttaaatactcagaagataaggtgtgaatgtatgtattattagagtccgaaagtatttttataagttactggttttcacccacgcttttgtgggagagaaaatcattgcaaaatcattttttttgttcggtacaataaagtttactaaaaaacaaa

SEQ ID NO: 372188 - DNA, 2353 bp, Homo sapiens
ggttttggttaatatactaaatagcatagaagagttttctatgcttagctcctaggaaatgattttagcaaaataagacttggccagatttggattcagaaatcctcatagtgttatttatataatgataaaactcaaaaatatcctgtaacatgaaatatgtgactaaagttgtgaaatgtatcatgctgtttgaagtagacaaaagtatattacaaagtggcatataagctataataactataaaataattttgtgattataacagtaagccaggttcaccagaggaaatgtggaatacctaagtataaagcagcaaagaaatgtcacctgtagtcccattattcagcgggtgagtatataacaacgaaatactttttcatttaccaagtattgtgttttgcatggattaactcctttattctaactgcagaagacacttatcctcataattgaaactgaggcacagaatttaacttggcctacattctctatattcatcaaattgaaattatagttattatagcttatatgccactttgtaatatacttttgtctacttcaaacagcatgatacatttcacaactttagtcacatatttcatgttacaggatatttttgagttttatcattatataaataacactatgaggatttctgaatccaaatctggccaagtcttattttgctaaaatcatttcctaggagctaagcatagaaaactcttctatgctatttagtatattaaccaaaacctttagaggtaaagagactgccaggtgatccacatcagtgattcttggtttctagacctctgagaatatgtgagatacagatcccctgaagcctatccatagaaagtcctttttggatcaaagagattatagaactctatttgttgataaagaccaaggagcttcgtgtgtttctaatgttttctaaggactggatggtttttagttcaatagcttttaggggtacaagtggttttggattacacggatgaattgtatagtggtgaagtctgagattttggtgtaccaatcacctgagtactatatattgtacccagtatgtagtttatccttcccccttccctgttccgggtctccagtatctgttataccactctgtgtgcttacctgtagcttagctcccacttaaagtgggaacatttggtatttggttttccattcctgagttacttcactaagaataatagcttccaatactatccaagttgctgcaaaagacattttttatggctaatattccatgggatatatataccacactttatccattcattggttgatgggtacttaggttggtcccatatcttttattatgaactgtctagccagtttttaaatagaaaagtactgattaggtgaacagttccttaggaattaaattgtgaaggggaggggacacagcagagaagtaatctgttggttcttttgagatattgaatacatgtcccaaatttgctagctgcttaactagcaagttaacccaaactgtcagagtaactgaagcaaatatgtccaactgggacataaggaacatgagatttgtgtaataagtaggttatctaacgtgttcatgtgtctaacactttctagctattttcaagacagacttatcaatactgtgtttgctttccaatttaatctgttacaaatacatatgaagaatctagttggtacaggctcagggaggatagaaagataggtacacagatttgtcctgttaggatcctaccattaggaaggattaggaagagaagccctccatgcccatactctgcaagggagaacaaggtaagagccacaggagggaacaaaatgctatggggactcagtagggataggtcagaacaggctggatcctgcaaagcttattactgagctgggcaacaacgagcatgatcagacaaggctggagaaagtcatacaattttatgatgccagtttagtgaatattaaactcttgatgtaaccatttaaacaatttcaagaggtctctcacaaatagatgtacaaaagttgaattagcacgtccaaagccatgtggttttgaggctaattccttgttacataattttttttttttttcccctcgagacaagagtctggctctgtcgcccaggctggatcttggctcactacaacctccgccgcccgggttcaggcgattctcctgcctcagcctcctgagtagctgagactactgggcatggtagcgcccacctgtggtcccagctacttgggaagctgaggtagggggatcaattgagcctggagtaagctgattgtgccactgccctccagcctgggcagcagagcaagg

SEQ ID NO: 372189 - DNA, 543 bp, Homo sapiens
cggaaacggtgtttggtggagcccgcgatggccgaacctgcgtctgtcgcggctgaatctctcgcgggcagcagggcgcgcgctgcacgcacagtactaggtcaggtggtgctcccgggtgaggagctgctcctgccggaacaggaggacgcggaaggccctgggggtgcagtggagcgaccgttgagcctgaatgctagagcgtgctcgcgggtgcgcgttgtatgcggtccgggccttcggcgctgtggggaccgcctgctggtcaccaagtgcggccgcctccgtcacaaggagcccggcagtggcagcggcggcggtgtttactgggtggactctcagcagaagcggtatgttccagtaaaaggagaccatgtgattggcatagtgacagctaaatctggagatatattcaaagttgatgttggagggagtgagccagcttctttgtcttacttgtcatttgaaggtgcaactaaaagaaacagaccaaatgtgcaggtaattacgggagcctttggtttcaaagaaacaaacatccat

SEQ ID NO: 372190 - DNA, 850 bp, Homo sapiens
  misc_feature (103)..(103): n is a, c, g, or t
cggcacatttattgtaaacgcttcacaaaaggcaaaatgggttacgggccccccccagagttttttatttttatatgatgaattgaaaagtggaaataagaanagagataaataataaattaaaataaaaatataatattttttttttaatgtgtttgctttccaatttaatctgttacaaatacatatgaagaatctagttggtacaggctcagggaggatagaaagataggtacacagatttgtcctgttaggatcctaccattaggaaggattaggaagagaagccctccatgcccatactctgcaagggagaacaaggtaagagccacaggagggaacaaaatgctatggggactcagtagggataggtcagaacaggctggatcctgcaaagcttattactgagctgggcaacaacgagcatgatcagacaaggctggagaaagtcatacaattttatgatgccagtttagtgaatattaaactcttgatgtaaccatttaaacaatttcaagaggtctctcacaaatagatgtacaaaagttgaattagcacgtccaaagccatgtggttttgaggctaattccttgttacataattttttttttttttcccctcgagacaagagtctggctctgtcgcccaggctggatcttggctcactacaacctccgccgcccgggttcaggcgattctcctgcctcagcctcctgagtagctgagactactgggcatggtagcgcccacctgtggtcccagctacttgggaagctgaggtagggggatcaattgagcctggagtaagctgattgtgccactgccctccagcctgggcagcagagcaagg

SEQ ID NO: 372191 - DNA, 696 bp, Homo sapiens
tgctcgctgtattggtggtgctccttgtattggtggtgctcaatgtattggtggtgctcagggaggatagaaagataggtacacagatttgtcctgttaggatcctaccattaggaaggattaggaagagaagccctccatgcccatactctgcaagggagaacaaggtaagagccacaggagggaacaaaatgctatggggactcagtagggataggtcagaacaggctggatcctgcaaagcttattactgagctgggcaacaacgagcatgatcagacaaggctggagaaagtcatacaattttatgatgccagtttagtgaatattaaactcttgatgtaaccatttaaacaatttcaagaggtctctcacaaatagatgtacaaaagttgaattagcacgtccaaagccatgtggttttgaggctaattccttgttacataattttttttttttttcccctcgagacaagagtctggctctgtcgcccaggctggatcttggctcactacaacctccgccgcccgggttcaggcgattctcctgcctcagcctcctgagtagctgagactactgggcatggtagcgcccacctgtggtcccagctacttgggaagctgaggtagggggatcaattgagcctggagtaagctgattgtgccactgccctccagcctgggcagcagagcaagg

SEQ ID NO: 372192 - DNA, 678 bp, Homo sapiens
gttcatgtgtctaacactttctagctattttcaagacagacttatcaatactgtgtttgctttccaatttaatctgttacaaatacatatgaagaatctagttggtacaggctcagggaggatagaaagataggtacacagatttgtcctgttaggatcctaccattaggaaggattaggaagagaagccctccatgcccatactctgcaagggagaacaaggtaagagccacaggagggaacaaaatgctatggggactcagtagggataggtcagaacaggctggatcctgcaaagcttattactgagctgggcaacaacgagcatgatcagacaaggctggagaaagtcatacaattttatgatgccagtttagtgaatattaaactcttgatgtaaccatttaaacaatttcaagaggtctctcacaaatagatgtacaaaagttgaattagcacgtccaaagccatgtggttttgaggctaattccttgttacataattttttttttttttcccctcgagacaagagtctggctctgtcgcccaggctggatcttggctcactacaacctccgccgcccgggttcaggcgattctcctgcctcagcctcctgagtagctgagactacaggcacgcaccaccatgcccagctaatttttgtatttttagtagag

SEQ ID NO: 372193 - DNA, 350 bp, Homo sapiens
cgggcgcccgccctccgaggggccgcgcttacccgtcgggcgagtactcgaggttgaagacggcgccgtgggtgcgggtgctgaggtacaccgagtccgcggggtggatggaaccgtagaggctagtcatggtgcgaaaattgtcccgcgccgggtccacgaacagcccgcggcccaggctgcgctctttcagccacccgaacagcctagcgccagggccgcccaggcccgcgccgaggccgtgtcggccccggctcttggccctgcagtctggcccgggccgccggcacggaggggagggaggtgacggctctcccggggcggaggcagttgaggactccggagctcca

SEQ ID NO: 372194 - DNA, 1080 bp, Homo sapiens
cggaaacggtgtttggtggagcccgcgatggccgaacctgcgtctgtcgcggctgaatctctcgcgggcagcagggcgcgcgctgcacgcacagtactaggtcaggtggtgctcccgggtgaggagctgctcctgccggaacaggaggacgcggaaggccctgggggtgcagtggagcgaccgttgagcctgaatgctagagcgtgctcgcgggtgcgcgttgtatgcggtccgggccttcggcgctgtggggaccgcctgctggtcaccaagtgcggccgcctccgtcacaaggagcccggcagtggcagcggcggcggtgtttactgggtggactctcagcagaagcggtatgttccagtaaaaggagaccatgtgattggcatagtgacagctaaatctggagatatattcaaagttgatgttggagggagtgagccagcttctttgtcttacttgtcatttgaaggtgcaactaaaagaaacagaccaaatgtgcaggttggagatctcatctatggccagtttgtggttgctaataaagacatggaaccagagatggtctgtattgacagctgtggacgagccaatggaatgggtgtcattggacaggatggtctgctttttaaagtgactctgggcttaattagaaagctattagctccagattgtgaaatcatacaggaagtgggaaaactctatccactggagatagtatttggaatgaatggaagaatatgggttaaggcaaaaaccatccagcagactttaattttggcaaacattttagaagcttgtgaacacatgacgtcagatcaaagaaaacagatcttctccagattggcagaaagttgatataggtggacttttttacaggtcagttgaggcaaaaaactatgggttttttcaggtgaacctcccccatttaaatactcagaagataaggtgtgaatgtatgtattattagagtccgaaagtatttttataagttactggttttcacccacgcttttgtgggagagaaaatcattgcaaaatcattttttttgttcggtacaataaagtttactaaaaaacaaa

SEQ ID NO: 372195 - DNA, 3287 bp, Homo sapiens
gagggagaaaggaaacatttaggctaggtcgaggctggtgtgcccgcgatggccgaacctgcgtctgtcgcggctgaatctctcgcgggcagcagggcgcgcgctgcacgcacagtactaggtcaggtggtgctcccgggtgaggagctgctcctgccggaacaggaggacgcggaaggccctgggggtgcagtggagcgaccgttgagcctgaatgctagagcgtgctcgcgggtgcgcgttgtatgcggtccgggccttcggcgctgtggggaccgcctgctggtcaccaagtgcggccgcctccgtcacaaggagcccggcagtggcagcggcggcggtgtttactgggtggactctcagcagaagcggtatgttccagtaaaaggagaccatgtgattggcatagtgacagctaaatctggagatatattcaaagttgatgttggagggagtgagccagcttctttgtcttacttgtcatttgaaggtgcaactaaaagaaacagaccaaatgtgcaggttggagatctcatctatggccagtttgtggttgctaataaagacatggaaccagagatggtctgtattgacagctgtggacgagccaatggaatgggtgtcattggacaggatggtctgctttttaaagtgactctgggcttaattagaaagctattagctccagattgtgaaatcatacaggaagtgggaaaactctatccactggagatagtatttggaatgaatggaagaatatgggttaaggcaaaaaccatccagcagactttaattttggcaaacattttagaagcttgtgaacacatgacgtcagatcaaagaaaacagatcttctccagattggcagaaagttgatataggtggacttttttacaggtcagttgaggcaaaaaactatgggttttttcaggtgaacctcccccatttaaatactcagaagataaggtgtgaatgtatgtattattagagtccgaaagtatttttataagttactggttttcacccacgcttttgtgggagagaaaatcattgcaaaatcattttttttgttcggtacaataaagtttactaaaaaacaaaaacagtattagggtttatttggagttaactcccttagtaattgctacagcttccataattaactggaggtcagcagtaaaataattttgtgattataacagtaagccaggttcaccagaggaaatgtggaatacctaagtataaagcagcaaagaaatgtcacctgtagtcccattattcagcgggtgagtatataacaacgaaatactttttcatttaccaagtattgtgttttgcatggattaactcctttattctaactgcagaagacacttatcctcataattgaaactgaggcacagaatttaacttggcctacattctctatattcatcaaattgaaattatagttattatagcttatatgccactttgtaatatacttttgtctacttcaaacagcatgatacatttcacaactttagtcacatatttcatgttacaggatatttttgagttttatcattatataaataacactatgaggatttctgaatccaaatctggccaagtcttattttgctaaaatcatttcctaggagctaagcatagaaaactcttctatgctatttagtatattaaccaaaacctttagaggtaaagagactgccaggtgatccacatcagtgattcttggtttctagacctctgagaatatgtgagatacagatcccctgaagcctatccatagaaagtcctttttggatcaaagagattatagaactctatttgttgataaagaccaaggagcttcgtgtgtttctaatgttttctaaggactggatggtttttagttcaatagcttttaggggtacaagtggttttggattacacggatgaattgtatagtggtgaagtctgagattttggtgtaccaatcacctgagtactatatattgtacccagtatgtagtttatccttcccccttccctgttccgggtctccagtatctgttataccactctgtgtgcttacctgtagcttagctcccacttaaagtgggaacatttggtatttggttttccattcctgagttacttcactaagaataatagcttccaatactatccaagttgctgcaaaagacattttttatggctaatattccatgggatatatataccacactttatccattcattggttgatgggtacttaggttggtcccatatcttttattatgaactgtctagccagtttttaaatagaaaagtactgattaggtgaacagttccttaggaattaaattgtgaaggggaggggacacagcagagaagtaatctgttggttcttttgagatattgaatacatgtcccaaatttgctagctgcttaactagcaagttaacccaaactgtcagagtaactgaagcaaatatgtccaactgggacataaggaacatgagatttgtgtaataagtaggttatctaacgtgttcatgtgtctaacactttctagctattttcaagacagacttatcaatactgtgtttgctttccaatttaatctgttacaaatacatatgaagaatctagttggtacaggctcagggaggatagaaagataggtacacagatttgtcctgttaggatcctaccattaggaaggattaggaagagaagccctccatgcccatactctgcaagggagaacaaggtaagagccacaggagggaacaaaatgctatggggactcagtagggataggtcagaacaggctggatcctgcaaagcttattactgagctgggcaacaacgagcatgatcagacaaggctggagaaagtcatacaattttatgatgccagtttagtgaatattaaactcttgatgtaaccatttaaacaatttcaagaggtctctcacaaatagatgtacaaaagttgaattagcacgtccaaagccatgtggttttgaggctaattccttgttacataattttttttttttttcccctcgagacaagagtctggctctgtcgcccaggctggatcttggctcactacaacctccgccgcccgggttcaggcgattctcctgcctcagcctcctgagtagctgagactactgggcatggtagcgcccacctgtggtcccagctacttgggaagctgaggtagggggatcaattgagcctggagtaagctgattgtgccactgccctccagcctgggcagcagagcaagg

SEQ ID NO: 372196 - DNA, 1684 bp, Homo sapiens
gagggagaaaggaaacatttaggctaggtcgaggctggtgtgcccgcgatggccgaacctgcgtctgtcgcggctgaatctctcgcgggcagcagggcgcgcgctgcacgcacagtactaggtcaggtggtgctcccgggtgaggagctgctcctgccggaacaggaggacgcggaaggccctgggggtgcagtggagcgaccgttgagcctgaatgctagagcgtgctcgcgggtgcgcgttgtatgcggtccgggccttcggcgctgtggggaccgcctgctggtcaccaagtgcggccgcctccgtcacaaggagcccggcagtggcagcggcggcggtgtttactgggtggactctcagcagaagcggtatgttccagtaaaaggagaccatgtgattggcatagtgacagctaaatctggagatatattcaaagttgatgttggagggagtgagccagcttctttgtcttacttgtcatttgaaggtgcaactaaaagaaacagaccaaatgtgcaggttggagatctcatctatggccagtttgtggttgctaataaagacatggaaccagagatggtctgtattgacagctgtggacgagccaatggaatgggtgtcattggacaggatggtctgctttttaaagtgactctgggcttaattagaaagctattagctccagattgtgaaatcatacaggaagtgggaaaactctatccactggagatagtatttggaatgaatggaagaatatgggttaaggcaaaaaccatccagcagactttaattttggcaaacattttagaagcttgtgaacacatgacgtcagatcaaagaaaacagatcttctccagattggcagaaagttgatataggtggacttttttacaggtcagttgaggcaaaaaactatgggttttttcaggtgaacctcccccatttaaatactcagaagataaggtgtgaatgtatgtattattagagtccgaaagtatttttataagttactggttttcacccacgcttttgtgggagagaaaatcattgcaaaatcattttttttgttcggtacaataaagtttactaaaaaacaaaaacagtattagggtttatttggagttaactcccttagtaattgctacagcttccataattaactggaggtcagcagtaaaataattttgtgattataacagtaagccaggttcaccagaggaaatgtggaatacctaagtataaagcagcaaagaaatgtcacctgtagtcccattattcagcgggtgagtatataacaacgaaatactttttcatttaccaagtattgtgttttgcatggattaactcctttattctaactgcagaagacacttatcctcataattgaaagctgaggcgggcggttcaaatgagcccatgagattgcggctgcagtgagccatgatcgcaccactgcactccagcctgggcaacagagtgagaccatgtctcaaaaaaattaaattaaaaactagctaggtgtggtggcacgcaccatcatgcccatgtaattttgtattttagtagagacgagtttcacatggttagccaggtgaggtgagtaagatgcttgagtccaggagtcaagacagctggaaacttgtggagacctgttttacaaaattaaatacgtggtggtggc

SEQ ID NO: 372197 - DNA, 3114 bp, Homo sapiens
cggaaacggtgtttggtggagcccgcgatggccgaacctgcgtctgtcgcggctgaatctctcgcgggcagcagggcgcgcgctgcacgcacagtactaggtcaggtggtgctcccgggtgaggagctgctcctgccggaacaggaggacgcggaaggccctgggggtgcagtggagcgaccgttgagcctgaatgctagagcgtgctcgcgggtgcgcgttgtatgcggtccgggccttcggcgctgtggggaccgcctgctggtcaccaagtgcggccgcctccgtcacaaggagcccggcagtggcagcggcggcggtgtttactgggtggactctcagcagaagcggtatgttccagtaaaaggagaccatgtgattggcatagtgacagctaaatctggagatatattcaaagttgatgttggagggagtgagccagcttctttgtcttacttgtcatttgaaggtgcaactaaaagaaacagaccaaatgtgcaggctattagctccagattgtgaaatcatacaggaagtgggaaaactctatccactggagatagtatttggaatgaatggaagaatatgggttaaggcaaaaaccatccagcagactttaattttggcaaacattttagaagcttgtgaacacatgacgtcagatcaaagaaaacagatcttctccagattggcagaaagttgatataggtggacttttttacaggtcagttgaggcaaaaaactatgggttttttcaggtgaacctcccccatttaaatactcagaagataaggtgtgaatgtatgtattattagagtccgaaagtatttttataagttactggttttcacccacgcttttgtgggagagaaaatcattgcaaaatcattttttttgttcggtacaataaagtttactaaaaaacaaaaacagtattagggtttatttggagttaactcccttagtaattgctacagcttccataattaactggaggtcagcagtaaaataattttgtgattataacagtaagccaggttcaccagaggaaatgtggaatacctaagtataaagcagcaaagaaatgtcacctgtagtcccattattcagcgggtgagtatataacaacgaaatactttttcatttaccaagtattgtgttttgcatggattaactcctttattctaactgcagaagacacttatcctcataattgaaactgaggcacagaatttaacttggcctacattctctatattcatcaaattgaaattatagttattatagcttatatgccactttgtaatatacttttgtctacttcaaacagcatgatacatttcacaactttagtcacatatttcatgttacaggatatttttgagttttatcattatataaataacactatgaggatttctgaatccaaatctggccaagtcttattttgctaaaatcatttcctaggagctaagcatagaaaactcttctatgctatttagtatattaaccaaaacctttagaggtaaagagactgccaggtgatccacatcagtgattcttggtttctagacctctgagaatatgtgagatacagatcccctgaagcctatccatagaaagtcctttttggatcaaagagattatagaactctatttgttgataaagaccaaggagcttcgtgtgtttctaatgttttctaaggactggatggtttttagttcaatagcttttaggggtacaagtggttttggattacacggatgaattgtatagtggtgaagtctgagattttggtgtaccaatcacctgagtactatatattgtacccagtatgtagtttatccttcccccttccctgttccgggtctccagtatctgttataccactctgtgtgcttacctgtagcttagctcccacttaaagtgggaacatttggtatttggttttccattcctgagttacttcactaagaataatagcttccaatactatccaagttgctgcaaaagacattttttatggctaatattccatgggatatatataccacactttatccattcattggttgatgggtacttaggttggtcccatatcttttattatgaactgtctagccagtttttaaatagaaaagtactgattaggtgaacagttccttaggaattaaattgtgaaggggaggggacacagcagagaagtaatctgttggttcttttgagatattgaatacatgtcccaaatttgctagctgcttaactagcaagttaacccaaactgtcagagtaactgaagcaaatatgtccaactgggacataaggaacatgagatttgtgtaataagtaggttatctaacgtgttcatgtgtctaacactttctagctattttcaagacagacttatcaatactgtgtttgctttccaatttaatctgttacaaatacatatgaagaatctagttggtacaggctcagggaggatagaaagataggtacacagatttgtcctgttaggatcctaccattaggaaggattaggaagagaagccctccatgcccatactctgcaagggagaacaaggtaagagccacaggagggaacaaaatgctatggggactcagtagggataggtcagaacaggctggatcctgcaaagcttattactgagctgggcaacaacgagcatgatcagacaaggctggagaaagtcatacaattttatgatgccagtttagtgaatattaaactcttgatgtaaccatttaaacaatttcaagaggtctctcacaaatagatgtacaaaagttgaattagcacgtccaaagccatgtggttttgaggctaattccttgttacataattttttttttttttcccctcgagacaagagtctggctctgtcgcccaggctggatcttggctcactacaacctccgccgcccgggttcaggcgattctcctgcctcagcctcctgagtagctgagactactgggcatggtagcgcccacctgtggtcccagctacttgggaagctgaggtagggggatcaattgagcctggagtaagctgattgtgccactgccctccagcctgggcagcagagcaagg

SEQ ID NO: 372198 - DNA, 3000 bp, Homo sapiens
cgggcgcccgccctccgaggggccgcgcttacccgtcgggcgagtactcgaggttgaagacggcgccgtgggtgcgggtgctgagtatgttccagtaaaaggagaccatgtgattggcatagtgacagctaaatctggagatatattcaaagttgatgttggagggagtgagccagcttctttgtcttacttgtcatttgaaggtgcaactaaaagaaacagaccaaatgtgcaggttggagatctcatctatggccagtttgtggttgctaataaagacatggaaccagagatggtctgtattgacagctgtggacgagccaatggaatgggtgtcattggacaggatggtctgctttttaaagtgactctgggcttaattagaaagctattagctccagattgtgaaatcatacaggaagtgggaaaactctatccactggagatagtatttggaatgaatggaagaatatgggttaaggcaaaaaccatccagcagactttaattttggcaaacattttagaagcttgtgaacacatgacgtcagatcaaagaaaacagatcttctccagattggcagaaagttgatataggtggacttttttacaggtcagttgaggcaaaaaactatgggttttttcaggtgaacctcccccatttaaatactcagaagataaggtgtgaatgtatgtattattagagtccgaaagtatttttataagttactggttttcacccacgcttttgtgggagagaaaatcattgcaaaatcattttttttgttcggtacaataaagtttactaaaaaacaaaaacagtattagggtttatttggagttaactcccttagtaattgctacagcttccataattaactggaggtcagcagtaaaataattttgtgattataacagtaagccaggttcaccagaggaaatgtggaatacctaagtataaagcagcaaagaaatgtcacctgtagtcccattattcagcgggtgagtatataacaacgaaatactttttcatttaccaagtattgtgttttgcatggattaactcctttattctaactgcagaagacacttatcctcataattgaaactgaggcacagaatttaacttggcctacattctctatattcatcaaattgaaattatagttattatagcttatatgccactttgtaatatacttttgtctacttcaaacagcatgatacatttcacaactttagtcacatatttcatgttacaggatatttttgagttttatcattatataaataacactatgaggatttctgaatccaaatctggccaagtcttattttgctaaaatcatttcctaggagctaagcatagaaaactcttctatgctatttagtatattaaccaaaacctttagaggtaaagagactgccaggtgatccacatcagtgattcttggtttctagacctctgagaatatgtgagatacagatcccctgaagcctatccatagaaagtcctttttggatcaaagagattatagaactctatttgttgataaagaccaaggagcttcgtgtgtttctaatgttttctaaggactggatggtttttagttcaatagcttttaggggtacaagtggttttggattacacggatgaattgtatagtggtgaagtctgagattttggtgtaccaatcacctgagtactatatattgtacccagtatgtagtttatccttcccccttccctgttccgggtctccagtatctgttataccactctgtgtgcttacctgtagcttagctcccacttaaagtgggaacatttggtatttggttttccattcctgagttacttcactaagaataatagcttccaatactatccaagttgctgcaaaagacattttttatggctaatattccatgggatatatataccacactttatccattcattggttgatgggtacttaggttggtcccatatcttttattatgaactgtctagccagtttttaaatagaaaagtactgattaggtgaacagttccttaggaattaaattgtgaaggggaggggacacagcagagaagtaatctgttggttcttttgagatattgaatacatgtcccaaatttgctagctgcttaactagcaagttaacccaaactgtcagagtaactgaagcaaatatgtccaactgggacataaggaacatgagatttgtgtaataagtaggttatctaacgtgttcatgtgtctaacactttctagctattttcaagacagacttatcaatactgtgtttgctttccaatttaatctgttacaaatacatatgaagaatctagttggtacaggctcagggaggatagaaagataggtacacagatttgtcctgttaggatcctaccattaggaaggattaggaagagaagccctccatgcccatactctgcaagggagaacaaggtaagagccacaggagggaacaaaatgctatggggactcagtagggataggtcagaacaggctggatcctgcaaagcttattactgagctgggcaacaacgagcatgatcagacaaggctggagaaagtcatacaattttatgatgccagtttagtgaatattaaactcttgatgtaaccatttaaacaatttcaagaggtctctcacaaatagatgtacaaaagttgaattagcacgtccaaagccatgtggttttgaggctaattccttgttacataattttttttttttttcccctcgagacaagagtctggctctgtcgcccaggctggatcttggctcactacaacctccgccgcccgggttcaggcgattctcctgcctcagcctcctgagtagctgagactactgggcatggtagcgcccacctgtggtcccagctacttgggaagctgaggtagggggatcaattgagcctggagtaagctgattgtgccactgccctccagcctgggcagcagagcaagg

SEQ ID NO: 372199 - DNA, 835 bp, Homo sapiens
cggaaacggtgtttggtggagcccgcgatggccgaacctgcgtctgtcgcggctgaatctctcgcgggcagcagggcgcgcgctgcacgcacagtactaggtcaggtggtgctcccgggtgaggagctgctcctgccggaacaggaggacgcggaaggccctgggggtgcagtggagcgaccgttgagcctgaatgctagagcgtgctcgcgggtgcgcgttgtatgcggtccgggccttcggcgctgtggggaccgcctgctggtcaccaagtgcggccgcctccgtcacaaggagcccggcagtggcagcggcggcggtgtttactgggtggactctcagcagaagcggtatgttccagtaaaaggagaccatgtgattggcatagtgacagctaaatctggagatatattcaaagttgatgttggagggagtgagccagcttctttgtcttacttgtcatttgaaggtgcaactaaaagaaacagaccaaatgtgcaggttggagatctcatctatggccagtttgtggttgctaataaagacatggaaccagagatggtctgtattgacagctgtggacgagccaatggaatgggtgtcattggacaggatggtctgctttttaaagtgactctgggcttaattagaaagtaagtcctgatgtctgctggcttgactgctttttataattatacattcttggaaagttggttaatcttcaggattcagattctttgtaacgtttgaatttctcctcagagttagaaatcagtatccattttaacacatttggaaactcatgaatttaatcctatcttcttggaaacatatc

SEQ ID NO: 372200 - DNA, 2968 bp, Homo sapiens
gctttttcttccctgatcagaagcttccgtgagggagccacacagaactcaccgagtccctcctggcagaggcggccgtcctctgttgcttccagggacgtggccctcttcccgacctcggtcgcctgagcgcgcagggattggggatccgtagggcactaggacccggcggggcggagggggcagcccatgtgctgcgattcgctccctcccaccccactgctcccgctccattgtctgggaattgcagccgcggggcgggcggcggcggcggcggcggcggccgggacccagcgggccaggtggggacggcgcggagcgggtgcgggagatgccgtgcgggactggggccacctgagccgcccgcctcgtccccgccttctgtgggaaggatgtgcgcgcggatggccggtcgcacaacagcggcccctcgggggccctacggcccctggctctgcctcctggtggccctcgccctggacgtcgtgagagtggactgtggccaggctcccctggaccctgtctactgcatgtgacagccgcccgcccagcccagcccacactctggactgccaagctagaccgcttcaagggctccaggcaccacaccaccctcatcacctgccaccgtgctgggctcacagagccagattccagcagtccccttgaactgtctgagttcctatgggtggactttgtggtggagaatagcactggtgggggcgtagcggtcactcgccccgtcacgtggcagctggagtacccaggccaggcccctgaagcagagaaggacaaaatggtgtgggaaatcctggtgtctgagcgggacatcagagcccttatcccactggccaaggctgaggagctggtgaatacagcaccactgactggagtgccccagcatgtccccgtgcgccttgtcactgtggacggcgggggggccttggtggaggtgacagagcatgtcggctgcgagtctgccaacacacaggtcctgcaggtgtctgaggcctgtgatgccgtgttcgtggctggcaaggagagccggggcgcccggggggtgcgagtggacttctggtggcgccggctccgcgcctcgctgcggctgaccgtgtgggcccccctgctaccgctgcgtatcgagctcaccgacaccaccctcgagcaggtccgcggctggagggtacctggccctgctgaagggcctgcggaacccgctgcagaggcgtcggatgaggccgagcggcgcgcccgtggctgccacctgcagtaccagcgggccggtgtgcgcttcctcgcccccttcgcggcccacccgctggacggcggccgccgcctcacgcacctgcttggccccgactggctgctagacgtgtcccacctcgtggcgccacacgcccgcgtgctggactcgcgtgtagcctctctggagggtggccgtgtcgtggtgggccgggagcccggtgtcacctccattgaggtgcgttccccactgtctgactccatcctgggggagcaggcgctggctgtgacggacgacaaggtctcagtgctggagctgagggtgcagccagtgatgggcatctcgctgaccttgagccggggcactgcccaccccggggaggtcacagctacgtgctgggcacagtcagcccttcccgccccaaagcaggaggtggccctctccctatggctgtccttctctgatcacactgtggccccagctgagctctacgaccgccgtgacctgggactgtccgtctcagccgaggagcctggtgccatcctgccagctgaggagcagggtgcccagctcggggtggtggtgagtggggcaggcgccgaggggctgccgctgcatgtggctctgcacccgcccgagccctgccgccggggccgccaccgtgtgcctctggcctctggcaccgcctggctggggctgccccctgcctccactccagcccctgctctcccatccagccctgcttggagcccaccagccacagaagccaccatgggtggtaaacggcaggtggcaggcagtgtcgggggcaacacaggtgtgaggggcaagtttgagcgggcagaggaggaggccaggaaggaggagaccgaagccagggaggaggaggaggaagaggaggaggagatggtccctgcccctcagcatgtcactgagctagagctgggcatgtacgccctgctgggagtcttctgcgtggccatcttcatcttcttggtcaatggtgtggtcttcgtcctgcgctatcagcgcaaagaacctcccgacagtgccactgaccccacctccccccagccccacaactgggtctggctgggcactgaccaggaggaactgagccgccagctggaccggcagtcccctggcccgcccaagggggaggggagctgcccctgtgagagtgggggaggaggggaggcccctaccctggcccctggccctcctgggggcaccaccagctcctcaagcaccctggcccgaaaggaggctggggggcggcggaagcgagtagagtttgtgacatttgcgccagcccctccagcccagtcacctgaggagcctgtaggggcccctgctgtgcagtccatccttgtggcaggcgaggaggacatccgctgggtgtgtgaggacatggggctgaaggaccctgaggagcttcgcaactacatggagaggatccggggcagctcctgaccctccacagccacctggtcagccaccagctggggcaacgagggtggaggtcccactgagcctctcgcctgcccccgccactcgtctggtgcttgttgatccaagtcccctgcctggtcccccacaaggactcccatccaggccccctctgccctgccccttgtcatggaccatggtcgtgaggaagggctcatgccccttatttatgggaaccatttcattctaacagaataaaccgagaaggaaaccaga

SEQ ID NO: 372201 - DNA, 3719 bp, Homo sapiens
gctttttcttccctgatcagaagcttccgtgagggagccacacagaactcaccgagtccctcctggcagaggcggccgtcctctgttgcttccagggacgtggccctcttcccgacctcggtcgcctgagcgcgcagggattggggatccgtagggcactaggacccggcggggcggagggggcagcccatgtgctgcgattcgctccctcccaccccactgctcccgctccattgtctgggaattgcagccgcggggcgggcggcggcggcggcggcggcggccgggacccagcgggccaggtggggacggcgcggagcgggtgcgggagatgccgtgcgggactggggccacctgagccgcccgcctcgtccccgccttctgtgggaaggatgtgcgcgcggatggccggtcgcacaacagcggcccctcgggggccctacggcccctggctctgcctcctggtggccctcgccctggacgtcgtgagagtggactgtggccaggctcccctggaccctgtctacctgccggcagccctggagctcctagacgcccctgaacacttccgtgtgcagcaggtgggccactacccacctgccaactcctctctgagctcccgatctgagacctttctgctcctacagccctggcccagggcccagccacttctccgggcctcctacccaccttttgccactcagcaggtggtcccccctcgagtcactgagccccaccaacggccagtcccatgggacgtgcgggccgtttcagtggaagcggctgtgactccagcagagccctacgcccgggttctcttccacctcaaagggcaggattggccaccagggtctggcagcctgccctgtgcccggctccatgccacacaccctgcaggcactgctcaccaagcctgccgcttccagccatccctgggcgcctgcgtggtggagctggagcttccctcgcactggttctcacaggcctccaccacacgggccgagctggcctacacgcttgagcctgcagctgagggccctgggggctgtggctccggcgaggagaacgaccctggggagcaggccctcccagtggggggtgtggagctgcgcccagcagaccccccgcagtaccaggaggtacctctggacgaggctgtgactctgcgggtgcctgacatgccagtgcggcccggccagctctttagtgctaccctcctgcttcggcacaacttcacagccagcctcctgaccctgcggatcaaggtgaagaaggggctgcatgtgacagccgcccgcccagcccagcccacactctggactgccaagctagaccgcttcaagggctccaggcaccacaccaccctcatcacctgccaccgtgctgggctcacagagccagattccagcagtccccttgaactgtctgagttcctatgggtggactttgtggtggagaatagcactggtgggggcgtagcggtcactcgccccgtcacgtggcagctggagtacccaggccaggcccctgaagcagagaaggacaaaatggtgtgggaaatcctggtgtctgagcgggacatcagagcccttatcccactggccaaggctgaggagctggtgaatacagcaccactgactggagtgccccagcatgtccccgtgcgccttgtcactgtggacggcgggggggccttggtggaggtgacagagcatgtcggctgcgagtctgccaacacacaggtcctgcaggtgtctgaggcctgtgatgccgtgttcgtggctggcaaggagagccggggcgcccggggggtgcgagtggacttctggtggcgccggctccgcgcctcgctgcggctgaccgtgtgggcccccctgctaccgctgcgtatcgagctcaccgacaccaccctcgagcaggtccgcggctggagggtacctggccctgctgaagggcctgcggaacccgctgcagaggcgtcggatgaggccgagcggcgcgcccgtggctgccacctgcagtaccagcgggccggtgtgcgcttcctcgcccccttcgcggcccacccgctggacggcggccgccgcctcacgcacctgcttggccccgactggctgctagacgtgtcccacctcgtggcgccacacgcccgcgtgctggactcgcgtgtagcctctctggagggtggccgtgtcgtggtgggccgggagcccggtgtcacctccattgaggtgcgttccccactgtctgactccatcctgggggagcaggcgctggctgtgacggacgacaaggtctcagtgctggagctgagggtgcagccagtgatgggcatctcgctgaccttgagccggggcactgcccaccccggggaggtcacagctacgtgctgggcacagtcagcccttcccgccccaaagcaggaggtggccctctccctatggctgtccttctctgatcacactgtggccccagctgagctctacgaccgccgtgacctgggactgtccgtctcagccgaggagcctggtgccatcctgccagctgaggagcagggtgcccagctcggggtggtggtgagtggggcaggcgccgaggggctgccgctgcatgtggctctgcacccgcccgagccctgccgccggggccgccaccgtgtgcctctggcctctggcaccgcctggctggggctgccccctgcctccactccagcccctgctctcccatccagccctgcttggagcccaccagccacagaagccaccatgggtggtaaacggcaggtggcaggcagtgtcgggggcaacacaggtgtgaggggcaagtttgagcgggcagaggaggaggccaggaaggaggagaccgaagccagggaggaggaggaggaagaggaggaggagatggtccctgcccctcagcatgtcactgagctagagctgggcatgtacgccctgctgggagtcttctgcgtggccatcttcatcttcttggtcaatggtgtggtcttcgtcctgcgctatcagcgcaaagaacctcccgacagtgccactgaccccacctccccccagccccacaactgggtctggctgggcactgaccaggaggaactgagccgccagctggaccggcagtcccctggcccgcccaagggggaggggagctgcccctgtgagagtgggggaggaggggaggcccctaccctggcccctggccctcctgggggcaccaccagctcctcaagcaccctggcccgaaaggaggctggggggcggcggaagcgagtagagtttgtgacatttgcgccagcccctccagcccagtcacctgaggagcctgtaggggcccctgctgtgcagtccatccttgtggcaggcgaggaggacatccgctgggtgtgtgaggacatggggctgaaggaccctgaggagcttcgcaactacatggagaggatccggggcagctcctgaccctccacagccacctggtcagccaccagctggggcaacgagggtggaggtcccactgagcctctcgcctgcccccgccactcgtctggtgcttgttgatccaagtcccctgcctggtcccccacaaggactcccatccaggccccctctgccctgccccttgtcatggaccatggtcgtgaggaagggctcatgccccttatttatgggaaccatttcattctaacagaataaaccgagaaggaaaccaga

SEQ ID NO: 372202 - DNA, 5271 bp, Homo sapiens
gctttttcttccctgatcagaagcttccgtgagggagccacacagaactcaccgagtccctcctggcagaggcggccgtcctctgttgcttccagggacgtggccctcttcccgacctcggtcgcctgagcgcgcagggattggggatccgtagggcactaggacccggcggggcggagggggcagcccatgtgctgcgattcgctccctcccaccccactgctcccgctccattgtctgggaattgcagccgcggggcgggcggcggcggcggcggcggcggccgggacccagcgggccaggtggggacggcgcggagcgggtgcgggagatgccgtgcgggactggggccacctgagccgcccgcctcgtccccgccttctgtgggaaggatgtgcgcgcggatggccggtcgcacaacagcggcccctcgggggccctacggcccctggctctgcctcctggtggccctcgccctggacgtcgtgagagtggactgtggccaggctcccctggaccctgtctacctgccggcagccctggagctcctagacgcccctgaacacttccgtgtgcagcaggtgggccactacccacctgccaactcctctctgagctcccgatctgagacctttctgctcctacagccctggcccagggcccagccacttctccgggcctcctacccaccttttgccactcagcaggtggtcccccctcgagtcactgagccccaccaacggccagtcccatgggacgtgcgggccgtttcagtggaagcggctgtgactccagcagagccctacgcccgggttctcttccacctcaaagggcaggattggccaccagggtctggcagcctgccctgtgcccggctccatgccacacaccctgcaggcactgctcaccaagcctgccgcttccagccatccctgggcgcctgcgtggtggagctggagcttccctcgcactggttctcacaggcctccaccacacgggccgagctggcctacacgcttgagcctgcagctgagggccctgggggctgtggctccggcgaggagaacgaccctggggagcaggccctcccagtggggggtgtggagctgcgcccagcagaccccccgcagtaccaggaggtacctctggacgaggctgtgactctgcgggtgcctgacatgccagtgcggcccggccagctctttagtgctaccctcctgcttcggcacaacttcacagccagcctcctgaccctgcggatcaaggtgaagaaggggctgcatgtgacagccgcccgcccagcccagcccacactctggactgccaagctagaccgcttcaagggctccaggcaccacaccaccctcatcacctgccaccgtgctgggctcacagagccagattccagcagtccccttgaactgtctgagttcctatgggtggactttgtggtggagaatagcactggtgggggcgtagcggtcactcgccccgtcacgtggcagctggagtacccaggccaggcccctgaagcagagaaggacaaaatggtgtgggaaatcctggtgtctgagcgggacatcagagcccttatcccactggccaaggctgaggagctggtgaatacagcaccactgactggagtgccccagcatgtccccgtgcgccttgtcactgtggacggcgggggggccttggtggaggtgacagagcatgtcggctgcgagtctgccaacacacaggtcctgcaggtgtctgaggcctgtgatgccgtgttcgtggctggcaaggagagccggggcgcccggggggtgcgagtggacttctggtggcgccggctccgcgcctcgctgcggctgaccgtgtgggcccccctgctaccgctgcgtatcgagctcaccgacaccaccctcgagcaggtccgcggctggagggtacctggccctgctgaagggcctgcggaacccgctgcagaggcgtcggatgaggccgagcggcgcgcccgtggctgccacctgcagtaccagcgggccggtgtgcgcttcctcgcccccttcgcggcccacccgctggacggcggccgccgcctcacgcacctgcttggccccgactggctgctagacgtgtcccacctcgtggcgccacacgcccgcgtgctggactcgcgtgtagcctctctggagggtggccgtgtcgtggtgggccgggagcccggtgtcacctccattgaggtgcgttccccactgtctgactccatcctgggggagcaggcgctggctgtgacggacgacaaggtctcagtgctggagctgagggtgcagccagtgatgggcatctcgctgaccttgagccggggcactgcccaccccggggaggtcacagctacgtgctgggcacagtcagcccttcccgccccaaagcaggaggtggccctctccctatggctgtccttctctgatcacactgtggccccagctgagctctacgaccgccgtgacctgggactgtccgtctcagccgaggagcctggtgccatcctgccagctgaggagcagggtgcccagctcggggtggtggtgagtggggcaggcgccgaggggctgccgctgcatgtggctctgcacccgcccgagccctgccgccggggccgccaccgtgtgcctctggcctctggcaccgcctggctggggctgccccctgcctccactccagcccctgctctcccatccagccctgcttggagcccaccagccacagaagccaccatgggtggtaaacggcaggtggcaggcagtgtcgggggcaacacaggtgtgaggggcaagtttgagcgggcagaggaggaggccaggaaggaggagaccgaagccagggaggaggaggaggaagaggaggaggagatggtccctgcccctcagcatgtcactgagctagagctgggcatgtacgccctgctgggagtcttctgcgtggccatcttcatcttcttggtcaatggtgtggtcttcgtcctgcgctatcagcgcaaagaacctcccgacagtgccactgaccccacctccccccagccccacaactgggtctggctgggcactgaccaggaggaactgagccgccagctggaccggcagtcccctggcccgcccaagggggaggggagctgcccctgtgagagtgggggaggaggggaggcccctaccctggcccctggccctcctgggggcaccaccagctcctcaagcaccctggcccgaaaggaggctggggggcggcggaagcgagtagagtttgtgacatttgcgccagcccctccagcccagtcacctgaggagcctgtaggggcccctgctgtgcagtccatccttgtggcaggcgaggaggacatccgctgggtgtgtgaggacatggggctgaaggaccctgaggagcttcgcaactacatggagaggatccggggcagctcctgaccctccacagccacctggtcagccaccagctggggcaacgagggtggaggtcccactgagcctctcgcctgcccccgccactcgtctggtgcttgttgatccaagtcccctgcctggtcccccacaaggactcccatccaggccccctctgccctgccccttgtcatggaccatggtcgtgaggaagggctcatgccccttatttatgggaaccatttcattctaacagaataaaccgagaaggaaaccagaaaaaaaaaaaaaaaaaaaaaaaaaaaaaaaaaaaaaaaaaaaaaaaaaaaaaaaaaaaaaacaaacggggcggccgacaccaaaagaatcccctcctcggcgggcgccccacatccaaccgccaccaccctggctacttctcgtagagcagcaggcggcacccaagaacgatgagacgcactgattatctatgatcgacacacagagacgcgccgacgagtaataacacagacctaagcagcagagggacagagacacacagtctgcgaccagacgcgggagcgggagcacactctcagcgtggaaggcgagcaacacacacatgcaaccgcgggggggggggcgcgcaacagcccaatacgatagggggagaccaccgaccccccgaccacagcaacgacagaatagcaatacaaacacagcacacactcacacgagcgcgggacaccaacaaacacagcaacagcagactaacgcagcagtctattaaagaggagggtgggcaacaacaccacaaacacaccgctctcactagtatcatacgtactagtcaccagcctgcgggcacgtgcgtgaagcgacagacaaaggaccatagtgagtccagtcctactaattatcagcgagtagataggtcatatagtgcatcactagtgtagacaacatctaatatagaatattattaacacgcccggcgacgatcaacgcatacagtagagttcaaaagacaaatacattaaccaaagcacaacaaacccacaatactgcagcgacacatacacacaagtactagcgaacacaactatcacagagaacacacacaaaaacaacagaacgcgcgagccacaccgacgcacagacgaaccaatcgacagaccacgagcacacccggcacggacgccgcaggcgcgcacgcagtgaagacacaagaacaacccagcagccgaaaagaaccacacaaccgacacacagcagcgaaagagcacaaatcaacaccgcacaagagcagacaacacagagccatacagcagggagccaccccgacgccgcaacacaaagaccgtatcaaaagagcacgcacacatccaagcacgaacacggcaagcacccgcacaagcacaggcgagacgcgaagcagagacgccgaaggcagcgcgcagccacagacgcaacagaagacggacaggcagctaaggccagcagaacgcggcacgagacgacagagaaacagatgagcacaacacagagagaacacgacgagacgcgacagcgcaagccaaacgcaacaacgcagccaaagcagagccacccgactcagcccgtcaggcacatacccaagaagccacagacaagggagcacgagaccacaagcacagcaagcgagaaggatacgcgagacgcacgacgcagccgagaacagcagagcaccagacgacggcacacgagacagctagaaagcgcacacagccagccgcgcgagaaaacagatcagagaaagaaagcaaagcacaagaacgacccgaaacagccagcacacgacacgagcacgacg

SEQ ID NO: 372203 - DNA, 3936 bp, Homo sapiens
gctttttcttccctgatcagaagcttccgtgagggagccacacagaactcaccgagtccctcctggcagaggcggccgtcctctgttgcttccagggacgtggccctcttcccgacctcggtcgcctgagcgcgcagggattggggatccgtagggcactaggacccggcggggcggagggggcagcccatgtgctgcgattcgctccctcccaccccactgctcccgctccattgtctgggaattgcagccgcggggcgggcggcggcggcggcggcggcggccgggacccagcgggccaggtggggacggcgcggagcgggtgcgggagatgccgtgcgggactggggccacctgagccgcccgcctcgtccccgccttctgtgggaaggatgtgcgcgcggatggccggtcgcacaacagcggcccctcgggggccctacggcccctggctctgcctcctggtggccctcgccctggacgtcgtgagagtggactgtggccaggctcccctggaccctgtctacctgccggcagccctggagctcctagacgcccctgaacacttccgtgtgcagcaggtgggccactacccacctgccaactcctctctgagctcccgatctgagacctttctgctcctacagccctggcccagggcccagccacttctccgggcctcctacccaccttttgccactcagcaggtggtcccccctcgagtcactgagccccaccaacggccagtcccatgggacgtgcgggccgtttcagtggaagcggctgtgactccagcagagccctacgcccgggttctcttccacctcaaagggcaggattggccaccagggtctggcagcctgccctgtgcccggctccatgccacacaccctgcaggcactgctcaccaagcctgccgcttccagccatccctgggcgcctgcgtggtggagctggagcttccctcgcactggttctcacaggcctccaccacacgggccgagctggcctacacgcttgagcctgcagctgagggccctgggggctgtggctccggcgaggagaacgaccctggggagcaggccctcccagtggggggtgtggagctgcgcccagcagaccccccgcagtaccaggaggtacctctggacgaggctgtgactctgcgggtgcctgacatgccagtgcggcccggccagctctttagtgctaccctcctgcttcggcacaacttcacagccagcctcctgaccctgcggatcaaggtgaagaaggggctgcatgtgacagccgcccgcccagcccagcccacactctggactgccaagctagaccgcttcaagggctccaggcaccacaccaccctcatcacctgccaccgtgctgggctcacagagccagattccagcagtccccttgaactgtctgagttcctatgggtggactttgtggtggagaatagcactggtgggggcgtagcggtcactcgccccgtcacgtggcagctggagtacccaggccaggcccctgaagcagagaaggacaaaatggtgtgggaaatcctggtgtctgagcgggacatcagagcccttatcccactggccaaggctgaggagctggtgaatacagcaccactgactggagtgccccagcatgtccccgtgcgccttgtcactgtggacggcgggggggccttggtggaggtgacagagcatgtcggctgcgagtctgccaacacacaggtcctgcaggtgtctgaggcctgtgatgccgtgttcgtggctggcaaggagagccggggcgcccggggggtgcgagtggacttctggtggcgccggctccgcgcctcgctgcggctgaccgtgtgggcccccctgctaccgctgcgtatcgagctcaccgacaccaccctcgagcaggtccgcggctggagggtacctggccctgctgaagggcctgcggaacccgctgcagaggcgtcggatgaggccgagcggcgcgcccgtggctgccacctgcagtaccagcgggccggtgtgcgcttcctcgcccccttcgcggcccacccgctggacggcggccgccgcctcacgcacctgcttggccccgactggctgctagacgtgtcccacctcgtggcgccacacgcccgcgtgctggactcgcgtgtagcctctctggagggtggccgtgtcgtggtgggccgggagcccggtgtcacctccattgaggtgcgttccccactgtctgactccatcctgggggagcaggcgctggctgtgacggacgacaaggtctcagtgctggagctgagggtgcagccagtgatgggcatctcgctgaccttgagccggggcactgcccaccccggggaggtcacagctacgtgctgggcacagtcagcccttcccgccccaaagcaggaggtggccctctccctatggctgtccttctctgatcacactgtggccccagctgagctctacgaccgccgtgacctgggactgtccgtctcagccgaggagcctggtgccatcctgccagctgaggagcagggtgcccagctcggggtggtggtgagtggggcaggcgccgaggggctgccgctgcatgtggctctgcacccgcccgagccctgccgccggggccgccaccgtgtgcctctggcctctggcaccgcctggctggggctgccccctgcctccactccagcccctgctctcccatccagccctgcttggagcccaccagccacagaagccaccatgggtggtaaacggcaggtggcaggcagtgtcgggggcaacacaggtgtgaggggcaagtttgagcgggcagaggaggaggccaggaaggaggagaccgaagccagggaggaggaggaggaagaggaggaggagatggtccctgcccctcagcatgtcactgagctagagctgggcatgtacgccctgctgggagtcttctgcgtggccatcttcatcttcttggtcaatggtgtggtcttcgtcctgcgctatcagcgcaaagaacctcccgacagtgccactgaccccacctccccccagccccacaactgggtctggctgggcactgaccaggaggaactgagccgccagctggaccggcagtcccctggcccgcccaagggggaggggagctgcccctgtgagagtgggggaggaggggaggcccctaccctggcccctggccctcctgggggcaccaccagctcctcaagcaccctggcccgaaaggaggctggggggcggcggaagcgagtagagtttgtgacatttgcgccagcccctccagcccagtcacctgaggagcctgtaggggcccctgctgtgcagtccatccttgtggcaggcgaggaggacatccgctgggtgtgtgaggacatggggctgaaggaccctgaggagcttcgcaactacatggagaggatccggggcagctcctgaccctccacagccacctggtcagccaccagctggggcaacgagggtggaggtcccactgagcctctcgcctgcccccgccactcgtctggtgcttgttgatccaagtcccctgcctggtcccccacaaggactcccatccaggccccctctgccctgccccttgtcatggaccatggtcgtgaggaagggctcatgccccttatttatgggaaccatttcattctaacagaataaaccgagaaggaaaccagagctgggactgctgccgtctgtccggtagagtgaagcaagggggctggaatagggcctgttcagcccctgtccctgctgaaacggctgtgggaggctgggccctgggacgccctctcatagcgtccagcgatccagacaaataggagagccgtgacggcctgaatgccagccagcaggaagaagtagaggtcaatccggcaattgtgatgctcccagg

SEQ ID NO: 372204 - DNA, 3651 bp, Homo sapiens
gctttttcttccctgatcagaagcttccgtgagggagccacacagaactcaccgagtccctcctggcagaggcggccgtcctctgttgcttccagggacgtggccctcttcccgacctcggtcgcctgagcgcgcagggattggggatccgtagggcactaggacccggcggggcggagggggcagcccatgtgctgcgattcgctccctcccaccccactgctcccgctccattgtctgggaattgcagccgcggggcgggcggcggcggcggcggcggcggccgggacccagcgggccaggtggggacggcgcggagcgggtgcgggagatgccgtgcgggactggggccacctgagccgcccgcctcgtccccgccttctgtgggaaggatgtgcgcgcggatggccggtcgcacaacagcggcccctcgggggccctacggcccctggctctgcctcctggtggccctcgccctggacgtcgtgagagtggactgtggccaggctcccctggaccctgtctacctgccggcagccctggagctcctagacgcccctgaacacttccgtgtgcagcaggtgggccactacccacctgccaactcctctctgagctcccgatctgagacctttctgctcctacagccctggcccagggcccagccacttctccgggcctcctacccaccttttgccactcagcaggtggtcccccctcgagtcactgagccccaccaacggccagtcccatgggacgtgcgggccgtttcagtggaagcggctgtgactccagcagagccctacgcccgggttctcttccacctcaaagggcaggattggccaccagggtctggcagcctgccctgtgcccggctccatgccacacaccctgcaggcactgctcaccaagcctgccgcttccagccatccctgggcgcctgcgtggtggagctggagcttccctcgcactggttctcacaggcctccaccacacgggccgagctggcctacacgcttgagcctgcagctgagggccctgggggctgtggctccggcgaggagaacgaccctggggagcaggccctcccagtggggggtgtggagctgcgcccagcagaccccccgcagtaccaggaggtacctctggacgaggctgtgactctgcgggtgcctgacatgccagtgcggcccggccagctctttagtgctaccctcctgcttcggcacaacttcacagccagcctcctgaccctgcggatcaaggtgaagaaggggctgcatgtgacagccgcccgcccagcccagcccacactctggactgccaagctagaccgcttcaagggctccaggcaccacaccaccctcatcacctgccaccgtgctgggctcacagagccagattccagcagtccccttgaactgtctgagttcctatgggtggactttgtggtggagaatagcactggtgggggcgtagcggtcactcgccccgtcacgtggcagctggagtacccaggccaggcccctgaagcagagaaggacaaaatggtgtgggaaatcctggtgtctgagcgggacatcagagcccttatcccactggccaaggctgaggagctggtgaatacagcaccactgactggagtgccccagcatgtccccgtgcgccttgtcactgtggacggcgggggggccttggtggaggtgacagagcatgtcggctgcgagtctgccaacacacaggtcctgcaggtgtctgaggcctgtgatgccgtgttcgtggctggcaaggagagccggggcgcccggggggtgcgagtggacttctggtggcgccggctccgcgcctcgctgcggctgaccgtgtgggcccccctgctaccgctgcgtatcgagctcaccgacaccaccctcgagcaggtccgcggctggagggtacctggccctgctgaagggcctgcggaacccgctgcagaggcgtcggatgaggccgagcggcgcgcccgtggctgccacctgcagtaccagcgggccggtgtgcgcttcctcgcccccttcgcggcccacccgctggacggcggccgccgcctcacgcacctgcttggccccgactggctgctagacgtgtcccacctcgtggcgccacacgcccgcgtgctggactcgcgtgtagcctctctggagggtggccgtgtcgtggtgggccgggagcccggtgtcacctccattgaggtgcgttccccactgtctgactccatcctgggggagcaggcgctggctgtgacggacgacaaggtctcagtgctggagctgagggtgcagccagtgatgggcatctcgctgaccttgagccggggcactgcccaccccggggaggtcacagctacgtgctgggcacagtcagcccttcccgccccaaagcaggaggtggccctctccctatggctgtccttctctgatcacactgtggccccagctgagctctacgaccgccgtgacctgggactgtccgtctcagccgaggagcctggtgccatcctgccagctgaggagcagggtgcccagctcggggtggtggtgagtggggcaggcgccgaggggctgccgctgcatgtggctctgcacccgcccgagccctgccgccggggccgccaccgtgtgcctctggcctctggcaccgcctggctggggctgccccctgcctccactccagcccctgctctcccatccagccctgcttggagcccaccagccacagaagccaccatgggtggtaaacggcaggtggcaggcagtgtcgggggcaacacaggtgtgaggggcaagtttgagcgggcagaggaggaggccaggaaggaggagaccgaagccagggaggaggaggaggaagaggaggaggagatggtccctgcccctcagcatgtcactgagctagagctgggcatgtacgccctgctgggagtcttctgcgtggccatcttcatcttcttggtcaatggtgtggtcttcgtcctgcgctatcagcgcaaagaacctcccgacagtgccactgaccccacctccccccagccccacaactgggtctggctgggcactgaccaggaggaactgagccgccagctggaccggcagtcccctggcccgcccaagggggaggggagctgcccctgtgagagtgggggaggaggggaggcccctaccctggcccctggccctcctgggggcaccaccagctcctcaagcaccctggcccgaaaggaggctggggggcggcggaagcgagtagagtttgtgacatttgcgccagcccctccagcccagtcacctgaggagcctgtaggggcccctgctgtgcagtccatccttgtggcaggcgaggaggacatccgctgggtgtgtgaggacatggggctgaaggaccctgaggagcttcgcaactacatggagaggatccggggcagctcctgaccctccacagccacctggtcagccaccagctggggcaacgagggtggaggtcccactgagcctctcgcctgcccccgccactcgtctggtgcttgtcatggaccatggtcgtgaggaagggctcatgccccttatttatgggaaccatttcattctaacagaataaaccgagaaggaaaccaga

SEQ ID NO: 372205 - DNA, 5621 bp, Homo sapiens
gtggtgagaggggaagggacatttacagcccttttctccctcccttgcccacaactactgtgccccagcatggcacccgggtcagcccctgccagctctggagctgtcatcatctctccctcttatgcctcttcagtggactgtggccaggctcccctggaccctgtctacctgccggcagccctggagctcctagacgcccctgaacacttccgtgtgcagcaggtgggccactacccacctgccaactcctctctgagctcccgatctgagacctttctgctcctacagccctggcccagggcccagccacttctccgggcctcctacccaccttttgccactcagcaggtggtcccccctcgagtcactgagccccaccaacggccagtcccatgggacgtgcgggccgtttcagtggaagcggctgtgactccagcagagccctacgcccgggttctcttccacctcaaagggcaggattggccaccagggtctggcagcctgccctgtgcccggctccatgccacacaccctgcaggcactgctcaccaagcctgccgcttccagccatccctgggcgcctgcgtggtggagctggagcttccctcgcactggttctcacaggcctccaccacacgggccgagctggcctacacgcttgagcctgcagctgagggccctgggggctgtggctccggcgaggagaacgaccctggggagcaggccctcccagtggggggtgtggagctgcgcccagcagaccccccgcagtaccaggaggtacctctggacgaggctgtgactctgcgggtgcctgacatgccagtgcggcccggccagctctttagtgctaccctcctgcttcggcacaacttcacagccagcctcctgaccctgcggatcaaggtgaagaaggggctgcatgtgacagccgcccgcccagcccagcccacactctggactgccaagctagaccgcttcaagggctccaggcaccacaccaccctcatcacctgccaccgtgctgggctcacagagccagattccagcagtccccttgaactgtctgagttcctatgggtggactttgtggtggagaatagcactggtgggggcgtagcggtcactcgccccgtcacgtggcagctggagtacccaggccaggcccctgaagcagagaaggacaaaatggtgtgggaaatcctggtgtctgagcgggacatcagagcccttatcccactggccaaggtaaggagacctccatctctgcctgggaaggctggaggccaagtcccaggagccccatgagctgaggggcctggggctgagcccctcctccacccccaggctgaggagctggtgaatacagcaccactgactggagtgccccagcatgtccccgtgcgccttgtcactgtggacggcgggggggccttggtggaggtgacagagcatgtcggctgcgagtctgccaacacacaggtcctgcaggtgagtggcaggtgcccagctcatgtgagtctgcatttgtgtgggcacagttacgcacacacacctttcctccttcctcatgtgggtccccaagagaacagcttcttcttgagacgagaaacctcatgggaggaaccacagcttcaacttcttttgttccagccacctctctcccgagtcaagtaaccctaacagccccccgaccttagacactttcacgctcattattgcactggcaagtgcgctggcctgagagagtcgagagcacatactctgggatcagaaagttttagtttgaaacacatctttgttgtcaaccagctttgtgatcatgggctggtctcttaacctctctgagcctcgttacctaaactttaaaatgagaacatatcttcgggttgttgtaagaattaaaagcactttaagacagtatttagcagatagcaggggctgaaacaatggcagttattgctgttataatatgatgtaataattatacaatggtaaaaattattattattattattaccggtgattgtgaagtgaaataaaagggagggtggtagagcaacttcctctatcttgaagttctaagaggggaagcatggagtctgcatgtatgcaaatcccagccacctgaagggggaaggtgcctttccccacttgtggtcctttgctcaaatgtgtgtggttcctgctggagggccttggtgggagatctgctttgtcccacctctgcctacctggctgtagctggttgccaggtggctccaagagcaatgtcaaaggccagcatgaataaggagccaaagttttgggttcacacccctgctctgccaggaggaagactggtatgcaatggccagttcccctgactgagccccagggaacctcaaggaatggcccctacagtaaaatcttaaacaaagaacaggggcttaaccaacaatcctgctgcaacatgcattccagtgacacacagagctgaactcagtgggagcccgtcctacggcctgaggtcagggctgctctcttctggcccatgccttttttttttttttaatctatttattttgaaacagagtctcactctgtccccaggctggagtgcaatggtacagtccggctcactgcagtctcagctacccaggctcaagggatcctcccacctcagcctccccagtagctaggactacaggcatgtgccaccacacccggctgatttattgtattttttgtagagagggagttttgccatgttgcccaggctggtctcaaactcctggactcaagcgatccacccacctcggcctctcagagtgctgggactacaggcatgagccacccacccggcccagcctcacacctgtctttagtggcttagcccgcccacctgccctctgcccttccataggtgtctgaggcctgtgatgccgtgttcgtggctggcaaggagagccggggcgcccggggggtgcgagtggacttctggtggcgccggctccgcgcctcgctgcggctgaccgtgtgggcccccctgctaccgctgcgtatcgagctcaccgacaccaccctcgagcaggtccgcggctggagggtacctggccctgctgaagggggtgagtggaggcctgaggaagctggcaggccttggcgagtcacactgggacggagagggcgcaggggacacagccatgggcccaagtcggggtcagaaaaactgccctgttgcttgcagttccttctgcccacctccaccctgggccgcccagccaatgatcgctttctgtgaaattgctgacttccgcatccctctcctccttccctgcctcacttctcccgtagcaccctccacttcctaatctacgtcagtactggttaatgttgcctgtccatcctttccacgctcctcccccgagaatgtcagccccttgaagctgcggtctgtctatgctggtcgtaccctcagagcctaagatgacacagagctcaggaaatgaacaccctcggagggggctccccaaaacccagggagaggtggcccacgcctctggaatctagcttccaggcccttcagagagtgagcgcccccagggtccccgtaagagagcgtctcccctgcggtccacttgggagcaagagcggtgatcgaggcacagcgccagtcgggagtgggctggggcggctcgcctgcaggtggaagggcctgaccccaagaggggcggatgtctgcgtttgagaaacaggagctgctggtgattaggagccgccggggacgagctgcgggtctccagcagctgggccctgggcaggctggggccgctcagcgctgacggccagtcccggcctccccgccctgcaggcctgcggaacccgctgcagaggcgtcggatgaggccgagcggcgcgcccgtggctgccacctgcagtaccagcgggccggtgtgcgcttcctcgcccccttcgcggcccacccgctggacggcggccgccgcctcacgcacctgcttggccccgactggctgctagacgtgtcccacctcgtggcgccacacgcccgcgtgctggactcgcgtgtagcctctctggagggtggccgtgtcgtggtgggccgggagcccggtgtcacctccattgaggtgcgttccccactgtctgactccatcctgggggagcaggcgctggctgtgacggacgacaaggtctcagtgctggagctgagggtgcagccagtgatgggcatctcgctgaccttgagccggggcactgcccaccccggggaggtcacagctacgtgctgggcacagtcagcccttcccgccccaaagcaggaggtggccctctccctatggctgtccttctctgatcacactgtggccccagctgagctctacgaccgccgtgacctgggactgtccgtctcagccgaggagcctggtgccatcctgccagctgaggagcagggtgcccagctcggggtggtggtgagtggggcaggcgccgaggggctgccgctgcatgtggctctgcacccgcccgagccctgccgccggggccgccaccgtgtgcctctggcctctggcaccgcctggctggggctgccccctgcctccactccagcccctgctctcccatccagccctgcttggagcccaccagccacagaagccaccatgggtggtaaacggcaggtggcaggcagtgtcgggggcaacacaggtgtgaggggcaagtttgagcgggcagaggaggaggccaggaaggaggagaccgaagccagggaggaggaggaggaagaggaggaggagatggtccctgcccctcagcatgtcactgagctagagctgggcatgtacgccctgctgggagtcttctgcgtggccatcttcatcttcttggtcaatggtgtggtcttcgtcctgcgctatcagcgcaaagaacctcccgacagtgccactgaccccacctccccccagccccacaactgggtctggctgggcactgaccaggaggaactgagccgccagctggaccggcagtcccctggcccgcccaagggggaggggagctgcccctgtgagagtgggggaggaggggaggcccctaccctggcccctggccctcctgggggcaccaccagctcctcaagcaccctggcccgaaaggaggctggggggcggcggaagcgagtagagtttgtgacatttgcgccagcccctccagcccagtcacctgaggagcctgtaggggcccctgctgtgcagtccatccttgtggcaggcgaggaggacatccgctgggtgtgtgaggacatggggctgaaggaccctgaggagcttcgcaactacatggagaggatccggggcagctcctgaccctccacagccacctggtcagccaccagctggggcaacgagggtggaggtcccactgagcctctcgcctgcccccgccactcgtctggtgcttgttgatccaagtcccctgcctggtcccccacaaggactcccatccaggccccctctgccctgccccttgtcatggaccatggtcgtgaggaagggctcatgccccttatttatgggaaccatttcattctaacagaataaaccgagaaggaaaccaga

SEQ ID NO: 372206 - DNA, 2444 bp, Homo sapiens
gctggacgggtgactatgagggctctagccttctgtgcaacctgaggtggcactgaagagggtccccacctccaccctgggccgcccagccaatgatcgctttctgtgaaattgctgacttccgcatccctctcctccttccctgcctcacttctcccgtagcaccctccacttcctaatctacgtcagtactggttaatgttgcctgtccatcctttccacgctcctcccccgagaatgtcagccccttgaagctgcggtctgtctatgctggtcgtaccctcagagcctaagatgacacagagctcaggaaatgaacaccctcggagggggctccccaaaacccagggagaggtggcccacgcctctggaatctagcttccaggcccttcagagagtgagcgcccccagggtccccgtaagagagcgtctcccctgcggtccacttgggagcaagagcggtgatcgaggcacagcgccagtcgggagtgggctggggcggctcgcctgcaggtggaagggcctgaccccaagaggggcggatgtctgcgtttgagaaacaggagctgctggtgattaggagccgccggggacgagctgcgggtctccagcagctgggccctgggcaggctggggccgctcagcgctgacggccagtcccggcctccccgccctgcaggcctgcggaacccgctgcagaggcgtcggatgaggccgagcggcgcgcccgtggctgccacctgcagtaccagcgggccggtgtgcgcttcctcgcccccttcgcggcccacccgctggacggcggccgccgcctcacgcacctgcttggccccgactggctgctagacgtgtcccacctcgtggcgccacacgcccgcgtgctggactcgcgtgtagcctctctggagggtggccgtgtcgtggtgggccgggagcccggtgtcacctccattgaggtgcgttccccactgtctgactccatcctgggggagcaggcgctggctgtgacggacgacaaggtctcagtgctggagctgagggtgcagccagtgatgggcatctcgctgaccttgagccggggcactgcccaccccggggaggtcacagctacgtgctgggcacagtcagcccttcccgccccaaagcaggaggtggccctctccctatggctgtccttctctgatcacactgtggccccagctgagctctacgaccgccgtgacctgggactgtccgtctcagccgaggagcctggtgccatcctgccagctgaggagcagggtgcccagctcggggtggtggtgagtggggcaggcgccgaggggctgccgctgcatgtggctctgcacccgcccgagccctgccgccggggccgccaccgtgtgcctctggcctctggcaccgcctggctggggctgccccctgcctccactccagcccctgctctcccatccagccctgcttggagcccaccagccacagaagccaccatgggtggtaaacggcaggtggcaggcagtgtcgggggcaacacaggtgtgaggggcaagtttgagcgggcagaggaggaggccaggaaggaggagaccgaagccagggaggaggaggaggaagaggaggaggagatggtccctgcccctcagcatgtcactgagctagagctgggcatgtacgccctgctgggagtcttctgcgtggccatcttcatcttcttggtcaatggtgtggtcttcgtcctgcgctatcagcgcaaagaacctcccgacagtgccactgaccccacctccccccagccccacaactgggtctggctgggcactgaccaggaggaactgagccgccagctggaccggcagtcccctggcccgcccaagggggaggggagctgcccctgtgagagtgggggaggaggggaggcccctaccctggcccctggccctcctgggggcaccaccagctcctcaagcaccctggcccgaaaggaggctggggggcggcggaagcgagtagagtttgtgacatttgcgccagcccctccagcccagtcacctgaggagcctgtaggggcccctgctgtgcagtccatccttgtggcaggcgaggaggacatccgctgggtgtgtgaggacatggggctgaaggaccctgaggagcttcgcaactacatggagaggatccggggcagctcctgaccctccacagccacctggtcagccaccagctggggcaacgagggtggaggtcccactgagcctctcgcctgcccccgccactcgtctggtgcttgttgatccaagtcccctgcctggtcccccacaaggactcccatccaggccccctctgccctgccccttgtcatggaccatggtcgtgaggaagggctcatgccccttatttatgggaaccatttcattctaacagaataaaccgagaaggaaaccaga

SEQ ID NO: 372207 - DNA, 4139 bp, Homo sapiens
gctttttcttccctgatcagaagcttccgtgagggagccacacagaactcaccgagtccctcctggcagaggcggccgtcctctgttgcttccagggacgtggccctcttcccgacctcggtcgcctgagcgcgcagggattggggatccgtagggcactaggacccggcggggcggagggggcagcccatgtgctgcgattcgctccctcccaccccactgctcccgctccattgtctgggaattgcagccgcggggcgggcggcggcggcggcggcggcggccgggacccagcgggccaggtggggacggcgcggagcgggtgcgggagatgccgtgcgggactggggccacctgagccgcccgcctcgtccccgccttctgtgggaaggatgtgcgcgcggatggccggtcgcacaacagcggcccctcgggggccctacggcccctggctctgcctcctggtggccctcgccctggacgtcgtgagagtggactgtggccaggctcccctggaccctgtctacctgccggcagccctggagctcctagacgcccctgaacacttccgtgtgcagcaggtgggccactacccacctgccaactcctctctgagctcccgatctgagacctttctgctcctacagccctggcccagggcccagccacttctccgggcctcctacccaccttttgccactcagcaggtggtcccccctcgagtcactgagccccaccaacggccagtcccatgggacgtgcgggccgtttcagtggaagcggctgtgactccagcagagccctacgcccgggttctcttccacctcaaagggcaggattggccaccagggtctggcagcctgccctgtgcccggctccatgccacacaccctgcaggcactgctcaccaagcctgccgcttccagccatccctgggcgcctgcgtggtggagctggagcttccctcgcactggttctcacaggcctccaccacacgggccgagctggcctacacgcttgagcctgcagctgagggccctgggggctgtggctccggcgaggagaacgaccctggggagcaggccctcccagtggggggtgtggagctgcgcccagcagaccccccgcagtaccaggaggtacctctggacgaggctgtgactctgcgggtgcctgacatgccagtgcggcccggccagctctttagtgctaccctcctgcttcggcacaacttcacagccagcctcctgaccctgcggatcaaggtgaagaaggggctgcatgtgacagccgcccgcccagcccagcccacactctggactgccaagctagaccgcttcaagggctccaggcaccacaccaccctcatcacctgccaccgtgctgggctcacagagccagattccagcagtccccttgaactgtctgagttcctatgggtggactttgtggtggagaatagcactggtgggggcgtagcggtcactcgccccgtcacgtggcagctggagtacccaggccaggcccctgaagcagagaaggacaaaatggtgtgggaaatcctggtgtctgagcgggacatcagagcccttatcccactggccaaggctgaggagctggtgaatacagcaccactgactggagtgccccagcatgtccccgtgcgccttgtcactgtggacggcgggggggccttggtggaggtgacagagcatgtcggctgcgagtctgccaacacacaggtcctgcaggtgtctgaggcctgtgatgccgtgttcgtggctggcaaggagagccggggcgcccggggggtgcgagtggacttctggtggcgccggctccgcgcctcgctgcggctgaccgtgtgggcccccctgctaccgctgcgtatcgagctcaccgacaccaccctcgagcaggtccgcggctggagggtacctggccctgctgaagggcctgcggaacccgctgcagaggcgtcggatgaggccgagcggcgcgcccgtggctgccacctgcagtaccagcgggccggtgtgcgcttcctcgcccccttcgcggcccacccgctggacggcggccgccgcctcacgcacctgcttggccccgactggctgctagacgtgtcccacctcgtggcgccacacgcccgcgtgctggactcgcgtgtagcctctctggagggtggccgtgtcgtggtgggccgggagcccggtgtcacctccattgaggtgcgttccccactgtctgactccatcctgggggagcaggcgctggctgtgacggacgacaaggtctcagtgctggagctgagggtgcagccagtgatgggcatctcgctgaccttgagccggggcactgcccaccccggggaggtcacagctacgtgctgggcacagtcagcccttcccgccccaaagcaggtgacagttggggggtcagggggatgaggtcaacatctccagatgggggctcatggtagaggggaatgggaggaagggaccctggtacctcgaccccttagggttttcagagtgaggactgactctgtgaggtagtgagctctctgcagctggaggtgatcaagcagtggctggagtatggcagtgggaggttggttagatggctctaactgaggaccctcccaataactcagaccctagggctgagtggcagacaggtgattgacacgcgtcccctctctccctgtgttttgtctatctgcctgtgtctctgttttctctctggtctctcctccatgtggcctatctctgtgggagtggtttctctgtgcatgcgtgcgtgccctcgcatgtctctgcctgtgtctgtgtgccccacaggaggtggccctctccctatggctgtccttctctgatcacactgtggccccagctgagctctacgaccgccgtgacctgggactgtccgtctcagccgaggagcctggtgccatcctgccagctgaggagcagggtgcccagctcggggtggtggtgagtggggcaggcgccgaggggctgccgctgcatgtggctctgcacccgcccgagccctgccgccggggccgccaccgtgtgcctctggcctctggcaccgcctggctggggctgccccctgcctccactccagcccctgctctcccatccagccctgcttggagcccaccagccacagaagccaccatgggtggtaaacggcaggtggcaggcagtgtcgggggcaacacaggtgtgaggggcaagtttgagcgggcagaggaggaggccaggaaggaggagaccgaagccagggaggaggaggaggaagaggaggaggagatggtccctgcccctcagcatgtcactgagctagagctgggcatgtacgccctgctgggagtcttctgcgtggccatcttcatcttcttggtcaatggtgtggtcttcgtcctgcgctatcagcgcaaagaacctcccgacagtgccactgaccccacctccccccagccccacaactgggtctggctgggcactgaccaggaggaactgagccgccagctggaccggcagtcccctggcccgcccaagggggaggggagctgcccctgtgagagtgggggaggaggggaggcccctaccctggcccctggccctcctgggggcaccaccagctcctcaagcaccctggcccgaaaggaggctggggggcggcggaagcgagtagagtttgtgacatttgcgccagcccctccagcccagtcacctgaggagcctgtaggggcccctgctgtgcagtccatccttgtggcaggcgaggaggacatccgctgggtgtgtgaggacatggggctgaaggaccctgaggagcttcgcaactacatggagaggatccggggcagctcctgaccctccacagccacctggtcagccaccagctggggcaacgagggtggaggtcccactgagcctctcgcctgcccccgccactcgtctggtgcttgttgatccaagtcccctgcctggtcccccacaaggactcccatccaggccccctctgccctgccccttgtcatggaccatggtcgtgaggaagggctcatgccccttatttatgggaaccatttcattctaacagaataaaccgagaaggaaaccaga

SEQ ID NO: 372208 - DNA, 4292 bp, Homo sapiens
gctttttcttccctgatcagaagcttccgtgagggagccacacagaactcaccgagtccctcctggcagaggcggccgtcctctgttgcttccagggacgtggccctcttcccgacctcggtcgcctgagcgcgcagggattggggatccgtagggcactaggacccggcggggcggagggggcagcccatgtgctgcgattcgctccctcccaccccactgctcccgctccattgtctgggaattgcagccgcggggcgggcggcggcggcggcggcggcggccgggacccagcgggccaggtggggacggcgcggagcgggtgcgggagatgccgtgcgggactggggccacctgagccgcccgcctcgtccccgccttctgtgggaaggatgtgcgcgcggatggccggtcgcacaacagcggcccctcgggggccctacggcccctggctctgcctcctggtggccctcgccctggacgtcgtgagagtggactgtggccaggctcccctggaccctgtctacctgccggcagccctggagctcctagacgcccctgaacacttccgtgtgcagcaggtgggccactacccacctgccaactcctctctgagctcccgatctgagacctttctgctcctacagccctggcccagggcccagccacttctccgggcctcctacccaccttttgccactcagcaggtggtcccccctcgagtcactgagccccaccaacggccagtcccatgggacgtgcgggccgtttcagtggaagcggctgtgactccagcagagccctacgcccgggttctcttccacctcaaagggcaggattggccaccagggtctggcagcctgccctgtgcccggctccatgccacacaccctgcaggcactgctcaccaagcctgccgcttccagccatccctgggcgcctgcgtggtggagctggagcttccctcgcactggttctcacaggcctccaccacacgggccgagctggcctacacgcttgagcctgcagctgagggccctgggggctgtggctccggcgaggagaacgaccctggggagcaggccctcccagtggggggtgtggagctgcgcccagcagaccccccgcagtaccaggaggtacctctggacgaggctgtgactctgcgggtgcctgacatgccagtgcggcccggccagctctttagtgctaccctcctgcttcggcacaacttcacagccagcctcctgaccctgcggatcaaggtgaagaaggggctgcatgtgacagccgcccgcccagcccagcccacactctggactgccaagctagaccgcttcaagggctccaggcaccacaccaccctcatcacctgccaccgtgctgggctcacagagccagattccagcagtccccttgaactgtctgagttcctatgggtggactttgtggtggagaatagcactggtgggggcgtagcggtcactcgccccgtcacgtggcagctggagtacccaggccaggcccctgaagcagagaaggacaaaatggtgtgggaaatcctggtgtctgagcgggacatcagagcccttatcccactggccaaggctgaggagctggtgaatacagcaccactgactggagtgccccagcatgtccccgtgcgccttgtcactgtggacggcgggggggccttggtggaggtgacagagcatgtcggctgcgagtctgccaacacacaggtcctgcaggtgtctgaggcctgtgatgccgtgttcgtgggggtgagtggaggcctgaggaagctggcaggccttggcgagtcacactgggacggagagggcgcaggggacacagccatgggcccaagtcggggtcagaaaaactgccctgttgcttgcagttccttctgcccacctccaccctgggccgcccagccaatgatcgctttctgtgaaattgctgacttccgcatccctctcctccttccctgcctcacttctcccgtagcaccctccacttcctaatctacgtcagtactggttaatgttgcctgtccatcctttccacgctcctcccccgagaatgtcagccccttgaagctgcggtctgtctatgctggtcgtaccctcagagcctaagatgacacagagctcaggaaatgaacaccctcggagggggctccccaaaacccagggagaggtggcccacgcctctggaatctagcttccaggcccttcagagagtgagcgcccccagggtccccgtaagagagcgtctcccctgcggtccacttgggagcaagagcggtgatcgaggcacagcgccagtcgggagtgggctggggcggctcgcctgcaggtggaagggcctgaccccaagaggggcggatgtctgcgtttgagaaacaggagctgctggtgattaggagccgccggggacgagctgcgggtctccagcagctgggccctgggcaggctggggccgctcagcgctgacggccagtcccggcctccccgccctgcaggcctgcggaacccgctgcagaggcgtcggatgaggccgagcggcgcgcccgtggctgccacctgcagtaccagcgggccggtgtgcgcttcctcgcccccttcgcggcccacccgctggacggcggccgccgcctcacgcacctgcttggccccgactggctgctagacgtgtcccacctcgtggcgccacacgcccgcgtgctggactcgcgtgtagcctctctggagggtggccgtgtcgtggtgggccgggagcccggtgtcacctccattgaggtgcgttccccactgtctgactccatcctgggggagcaggcgctggctgtgacggacgacaaggtctcagtgctggagctgagggtgcagccagtgatgggcatctcgctgaccttgagccggggcactgcccaccccggggaggtcacagctacgtgctgggcacagtcagcccttcccgccccaaagcaggaggtggccctctccctatggctgtccttctctgatcacactgtggccccagctgagctctacgaccgccgtgacctgggactgtccgtctcagccgaggagcctggtgccatcctgccagctgaggagcagggtgcccagctcggggtggtggtgagtggggcaggcgccgaggggctgccgctgcatgtggctctgcacccgcccgagccctgccgccggggccgccaccgtgtgcctctggcctctggcaccgcctggctggggctgccccctgcctccactccagcccctgctctcccatccagccctgcttggagcccaccagccacagaagccaccatgggtggtaaacggcaggtggcaggcagtgtcgggggcaacacaggtgtgaggggcaagtttgagcgggcagaggaggaggccaggaaggaggagaccgaagccagggaggaggaggaggaagaggaggaggagatggtccctgcccctcagcatgtcactgagctagagctgggcatgtacgccctgctgggagtcttctgcgtggccatcttcatcttcttggtcaatggtgtggtcttcgtcctgcgctatcagcgcaaagaacctcccgacagtgccactgaccccacctccccccagccccacaactgggtctggctgggcactgaccaggaggaactgagccgccagctggaccggcagtcccctggcccgcccaagggggaggggagctgcccctgtgagagtgggggaggaggggaggcccctaccctggcccctggccctcctgggggcaccaccagctcctcaagcaccctggcccgaaaggaggctggggggcggcggaagcgagtagagtttgtgacatttgcgccagcccctccagcccagtcacctgaggagcctgtaggggcccctgctgtgcagtccatccttgtggcaggcgaggaggacatccgctgggtgtgtgaggacatggggctgaaggaccctgaggagcttcgcaactacatggagaggatccggggcagctcctgaccctccacagccacctggtcagccaccagctggggcaacgagggtggaggtcccactgagcctctcgcctgcccccgccactcgtctggtgcttgttgatccaagtcccctgcctggtcccccacaaggactcccatccaggccccctctgccctgccccttgtcatggaccatggtcgtgaggaagggctcatgccccttatttatgggaaccatttcattctaacagaataaaccgagaaggaaaccaga

SEQ ID NO: 372209 - DNA, 2152 bp, Homo sapiens
tctcttccacctcaaagggcaggattggccaccagggtctggcagcctgccctgtgccgggctccatgccacacaccctggacgtcgtgagagtggactgtggccaggctcccctggaccctgtctacctgccggcagccctggagctcctagacgcccctgaacacttccgtgtgcagcaggtgggccactacccacctgccaactcctctctgagctcccgatctgagacctttctgctcctacagccctggcccagggcccagccactttccgcgcctcgctgcggctgaccgtgtgggcccccctgctaccgctgcgtatcgagctcaccgacaccaccctcgagcaggtccgcggctggagggtacctggccctgctgaagggcctgcggaacccgctgcagaggcgtcggatgaggccgagcggcgcgcccgtggctgccacctgcagtaccagcgggccggtgtgcgcttcctcgcccccttcgcggcccacccgctggacggcggccgccgcctcacgcacctgcttggccccgactggctgctagacgtgtcccacctcgtggcgccacacgcccgcgtgctggactcgcgtgtagcctctctggagggtggccgtgtcgtggtgggccgggagcccggtgtcacctccattgaggtgcgttccccactgtctgactccatcctgggggagcaggcgctggctgtgacggacgacaaggtctcagtgctggagctgagggtgcagccagtgatgggcatctcgctgaccttgagccggggcactgcccaccccggggaggtcacagctacgtgctgggcacagtcagcccttcccgccccaaagcaggaggtggccctctccctatggctgtccttctctgatcacactgtggccccagctgagctctacgaccgccgtgacctgggactgtccgtctcagccgaggagcctggtgccatcctgccagctgaggagcagggtgcccagctcggggtggtggtgagtggggcaggcgccgaggggctgccgctgcatgtggctctgcacccgcccgagccctgccgccggggccgccaccgtgtgcctctggcctctggcaccgcctggctggggctgccccctgcctccactccagcccctgctctcccatccagccctgcttggagcccaccagccacagaagccaccatgggtggtaaacggcaggtggcaggcagtgtcgggggcaacacaggtgtgaggggcaagtttgagcgggcagaggaggaggccaggaaggaggagaccgaagccagggaggaggaggaggaagaggaggaggagatggtccctgcccctcagcatgtcactgagctagagctgggcatgtacgccctgctgggagtcttctgcgtggccatcttcatcttcttggtcaatggtgtggtcttcgtcctgcgctatcagcgcaaagaacctcccgacagtgccactgaccccacctccccccagccccacaactgggtctggctgggcactgaccaggaggaactgagccgccagctggaccggcagtcccctggcccgcccaagggggaggggagctgcccctgtgagagtgggggaggaggggaggcccctaccctggcccctggccctcctgggggcaccaccagctcctcaagcaccctggcccgaaaggaggctggggggcggcggaagcgagtagagtttgtgacatttgcgccagcccctccagcccagtcacctgaggagcctgtaggggcccctgctgtgcagtccatccttgtggcaggcgaggaggacatccgctgggtgtgtgaggacatggggctgaaggaccctgaggagcttcgcaactacatggagaggatccggggcagctcctgaccctccacagccacctggtcagccaccagctggggcaacgagggtggaggtcccactgagcctctcgcctgcccccgccactcgtctggtgcttgttgatccaagtcccctgcctggtcccccacaaggactcccatccaggccccctctgccctgccccttgtcatggaccatggtcgtgaggaagggctcatgccccttatttatgggaaccatttcattctaacagaataaaccgagaaggaaaccaga

SEQ ID NO: 372210 - DNA, 843 bp, Homo sapiens
agagtggcgcgcagccccgggacgcgtaagagccgctgccggctcctttttctctctcccactagggctgcccttccgacgctaaaaaagcagtggagctagggtgaaagccgccctcacgctcacttccggcaggcgcgcctcccgacagtgtcgtgcggggggcgtggcccggcattgctgacaggcggccccgggggcggtggccaaggcggcgaccggagcgcgatggcgggggcggcgggactcacggcagaagtgagctggaaggtcttggagcgaagagctcggaccaagcgctcaggctcagtttatgaacctcttaaaagcattaatcttccaagacctgataatgaaactctctgggataagttggaccattattacagaattgtcaagtcaacattgctgctgtatcaaagtccaactaccggtctctttcccactaaaacatgcggtggtgaccagaaggccaagatccaggacagcctatactgcgctgctggggcctgggctttggctcttgcatacaggcgaattgatgatgacaagggaaggacccatgagctggagcactcagctataaaatgcatgagaggaattctctactgctatatgcgtcaggccgataaggtccagcagtttaagcaggatccacgcccaacaacatgtcttcactctgttttcaatgtgcatacaggagatgagttgctttcctatgaggaatatggtcatcttcagataaatgcagtgtcactttatctcctttaccttgtggaaatgatttcctcaggactccagattatctacaacactgatgagatggagtcttgctctgtcacg

SEQ ID NO: 372211 - DNA, 758 bp, Homo sapiens
aacagtgtctgcttttctacccccacttttctatgtcacatttgatttggggaaaataaattatacaaaataccatattatcccatcctataaattactcccggaaaacaagtcatgtgtttagaagctgtgccattaagactgatttcttttgcatactttgtgttacaacacttgtcactattgcagttgttggtttacatgcctgacttcctcaaagaggtcctgagagtagagaatgtgtcttactcttgccttctcttagcctagtttggtatttgacaggaccagagaatagaagtgatagatacaatgataactactattgattgtgtttcttttgtttataggcactgtacatgccacttctacccacattatatctgattttaacatttttttctgagacaaatattatatccattttacaggtagacaacgtgagtctcagagaggtttagtaatctctccaaggtcccacagttgtcaagtgacagaaccaatatgaaggcgttaactgaagaatgaaaggaaggagggaatgtcaagcatttggaagcagtgatttttgtaatggtgtgaaggagttaacaggagaaatagcttgttcttgaacagcctggctgaatatcacatcataggaacacagttgcaccggtgccttaggatgctgagagttctgtgaaagtgatctgtaatcccagcactttgggaggctgaggcaggtggatcacttgagcccaggagttctagaccag

SEQ ID NO: 372212 - DNA, 4783 bp, Homo sapiens
  misc_feature (4607)..(4607): n is a, c, g, or t
  misc_feature (4613)..(4613): n is a, c, g, or t
agagtggcgcgcagccccgggacgcgtaagagccgctgccggctcctttttctctctcccactagggctgcccttccgacgctaaaaaagcagtggagctagggtgaaagccgccctcacgctcacttccggcaggcgcgcctcccgacagtgtcgtgcggggggcgtggcccggcattgctgacaggcggccccgggggcggtggccaaggcggcgaccggagcgcgatggcgggggcggcgggactcacggcagaagtgagctggaaggtcttggagcgaagagctcggaccaagcgctcaggctcagtttatgaacctcttaaaagcattaatcttccaagacctgataatgaaactctctgggataagttggaccattattacagaattgtcaagtcaacattgctgctgtatcaaagtccaactaccggtctctttcccactaaaacatgcggtggtgaccagaaggccaagatccaggacagcctatactgcgctgctggggcctgggctttggctcttgcatacaggcgaattgatgatgacaagggaaggacccatgagctggagcactcagctataaaatgcatgagaggaattctctactgctatatgcgtcaggccgataaggtccagcagtttaagcaggatccacgcccaacaacatgtcttcactctgttttcaatgtgcatacaggagatgagttgctttcctatgaggaatatggtcatcttcagataaatgcagtgtcactttatctcctttaccttgtggaaatgatttcctcaggactccagattatctacaacactgatgaggtctcttttattcaaaaccttgtattttgtgtggaaagagtttaccgtgtgcctgactttggtgtctgggaaagaggaagcaaatataataatggcagcacagagctacattcgagctcggttggtttagcaaaagcagctctagaagcaattaatggattcaacctttttggcaaccagggctgttcgtggtcagttatatttgtggatctcgatgctcacaatcgcaacaggcaaactttgtgctcgctgttacccagagaatcaagatcacataatacagatgctgccctgctcccctgcatcagttatcctgcatttgccctggatgatgaagttctttttagccagacacttgataaagtggttagaaaattaaaaggaaaatatggatttaaacgtttcttgagagatgggtatagaacatcattggaagatcccaacagatgctactacaagccagctgaaattaagctatttgatggcattgaatgtgaatttcccatatttttcctttatatgatgattgatggagtttttagaggcaatcctaagcaagtacaggaatatcaggatcttttgactccagtacttcatcataccacagaaggatatcctgttgtaccaaagtactattatgtgccagctgactttgtagaatatgaaaaaaataaccctggtagtcaaaaacgatttcctagcaactgtggccgtgatggaaaactgtttctttggggacaagcactttatatcatcgcaaaactcctggctgatgaacttattagtcctaaagacattgatcctgtccagcgctatgtcccactaaaggatcaacgtaacgtgagcatgaggttttccaatcagggcccactggaaaatgacttggtagttcatgtggcacttatagcagaaagccaaagacttcaagtttttctgaacacatatggtattcaaactcaaactcctcaacaagtagaacccattcagatatggcctcagcaggagcttgtgaaagcttatttgcagctgggtatcaatgaaaagttaggactctctggaaggccagacaggcccattggctgcctcgggacatcaaagatttatcgcattctaggaaagactgtggtttgttacccgattattttcgacctaagtgatttctacatgtctcaggatgttttcctgctgatagatgacataaagaatgcgctgcagttcattaaacaatattggaaaatgcatggacgtccacttttccttgttctcatccgggaagacaatataagaggtagccggttcaaccccatattagatatgctggcagcccttaaaaaaggaataattggaggagtcaaagttcatgtggatcgtctacagacactaatatctggagctgtggtagaacaacttgatttcctacgaatcagtgacacagaagagcttccagaatttaagagttttgaggaactagaacctcccaaacattcaaaagtcaaacggcaaagcagcacccctagtgctcctgaactgggacagcagccggatgtcaacattagtgaatggaaggacaaacccacccacgaaattcttcaaaaactgaatgattgcagttgtctggctagccaagccatcctgctgggtatactgctcaaaagagaaggccccaacttcatcacaaaggaaggtaccgtttctgatcacattgagagagtctatagaagagctggcagccaaaaactttggtcggttgtacgccgtgcagcaagtcttttaagtaaagtagtggacagcctggccccatccattactaatgttttagtgcagggcaaacaggtaactctgggtgcctttgggcatgaagaagaagttatctctaatcctttgtctccaagagtgattcaaaacatcatctattataagtgtaacacccatgatgagagggaagcggtcattcagcaagaactggtcatccatattggctggatcatctccaataaccctgagttattcagtggcatgctgaaaatacgaatcgggtggatcatccatgccatggagtatgaacttcagatccgtggcggagacaagccagccttggacttgtatcagctgtcacctagtgaagttaaacagcttctgctggatattctgcagcctcaacagaatggaagatgttggctgaacaggcgtcagatcgatgggtctttgaatagaactcccaccgggttctatgaccgagtgtggcagattctggagcgcacgcccaatgggatcattgttgctgggaagcatttgcctcagcaaccaaccctgtcagatatgaccatgtatgagatgaatttctctctccttgttgaagacacgttgggaaatattgaccagccacagtacagacagatcgttgtagagttacttatggttgtatccattgtactggaaagaaaccccgagctagaatttcaagacaaagtagatctagacagactggtcaaagaagcatttaatgaatttcaaaaagatcagagtcggctaaaggaaattgaaaaacaagatgacatgacttccttttacaacactcctcccctgggaaaaagaggaacatgcagctatttgacaaaggcggtgatgaatctgctgctggaaggagaagtcaagccaaacaatgatgacccgtgtctgattagctagtggggaaggtgtaggaagctctgttgagacacatgttctgaagtgtgttgtgtttcatgttcaagcttaatcaaggcagccattaatatacgaactgagcatgctggggaggtgaatgccacatccttggcggggttatggacctcttgcatgtcatagccaatctaacggtaatggtaaatgcttttaatcaagcaggaaaaagttctcatgattatgccaactataatagtaatcctcactgagtgataaaaatagtttatgaattgaaaatttgccgctgcatgttgtatgatcaaatagttcatcaaaatgaatctttgctctttggactgaattcttaccatactgccattaaaataaatttgccaactagtaatgcatactggaaatcaaaagatactgaaagaatggtgaacttctcttagtggtattgtcatgctaaaagatgttaatatacatcataaaagcaaagtcagccagctgatattttggttctcaaaaactgcattattaataatattttagtatacagagctattctacagtttttacattgtaaacatgactgtggttttgtatttgctaaatataggggttggactaaaatataataaatctgtaccttatcaaacattttctttgagctcctgctaaaaataggacatgtctatgattgttcaaaaatatgttaaatttaggctcagcacagtagctcacacctgaaatcttagcacttcgggaggctgaggcaggtggatcacttgaggttaggagttcaagaccagcccagccaacatggtgaaaaccctgtctctactaaaaatacaaaaattagccaggcatgatggtgcatgcctttaaacccagctactgaggaggctgaggcatgagaattgcttgaaccaggagacggaggttgcagtgagctgaaatcctgccactgcacaccagcctgggtgacagagcgagactccatctcaaaaaaaaaaaaaaaaaagaaaaagaaaaaaatatgttaaatttaaggactgttaacctacgttctactagtaaaaacaacattaagggtcattaaattttatttctgaattaanaaaaanaaaaaaaaaaaaaaaaaaaaaaaaaaaaaaaaaaaaaaaaaaacccggggttttttttttttttttccctgccaaacctttaagggtttttgggcggggaacctaaaggggggaaccggaaaatccttggggggtttgccaccacccaggggcccgttttccacaataat

SEQ ID NO: 372213 - DNA, 5769 bp, Homo sapiens
agagtggcgcgcagccccgggacgcgtaagagccgctgccggctcctttttctctctcccactagggctgcccttccgacgctaaaaaagcagtggagctagggtgaaagccgccctcacgctcacttccggcaggcgcgcctcccgacagtgtcgtgcggggggcgtggcccggcattgctgacaggcggccccgggggcggtggccaaggcggcgaccggagcgcgatggcgggggcggcgggactcacggcagaagtgagctggaaggtcttggagcgaagagctcggaccaagcgctcagcttagcctgcgacgcttatgattagagccaacaatttgaaatggcctgctcacctgatgcagtcgtctctccgtcttccgctttcttaaggtctggctcagtttatgaacctcttaaaagcattaatcttccaagacctgataatgaaactctctgggataagttggaccattattacagaattgtcaagtcaacattgctgctgtatcaaagtccaactaccggtctctttcccactaaaacatgcggtggtgaccagaaggccaagatccaggacagcctatactgcgctgctggggcctgggctttggctcttgcatacaggcgaattgatgatgacaagggaaggacccatgagctggagcactcagctataaaatgcatgagaggaattctctactgctatatgcgtcaggccgataaggtccagcagtttaagcaggatccacgcccaacaacatgtcttcactctgttttcaatgtgcatacaggagatgagttgctttcctatgaggaatatggtcatcttcagataaatgcagtgtcactttatctcctttaccttgtggaaatgatttcctcaggactccagattatctacaacactgatgaggtctcttttattcaaaaccttgtattttgtgtggaaagagtttaccgtgtgcctgactttggtgtctgggaaagaggaagcaaatataataatggcagcacagagctacattcgagctcggttggtttagcaaaagcagctctagaagcaattaatggattcaacctttttggcaaccagggctgttcgtggtcagttatatttgtggatctcgatgctcacaatcgcaacaggcaaactttgtgctcgctgttacccagagaatcaagatcacataatacagatgctgccctgctcccctgcatcagttatcctgcatttgccctggatgatgaagttctttttagccagacacttgataaagtggttagaaaattaaaaggaaaatatggatttaaacgtttcttgagagatgggtatagaacatcattggaagatcccaacagatgctactacaagccagctgaaattaagctatttgatggcattgaatgtgaatttcccatatttttcctttatatgatgattgatggagtttttagaggcaatcctaagcaagtacaggaatatcaggatcttttgactccagtacttcatcataccacagaaggatatcctgttgtaccaaagtactattatgtgccagctgactttgtagaatatgaaaaaaataaccctggtagtcaaaaacgatttcctagcaactgtggccgtgatggaaaactgtttctttggggacaagcactttatatcatcgcaaaactcctggctgatgaacttattagtcctaaagacattgatcctgtccagcgctatgtcccactaaaggatcaacgtaacgtgagcatgaggttttccaatcagggcccactggaaaatgacttggtagttcatgtggcacttatagcagaaagccaaagacttcaagtttttctgaacacatatggtattcaaactcaaactcctcaacaagtagaacccattcagatatggcctcagcaggagcttgtgaaagcttatttgcagctgggtatcaatgaaaagttaggactctctggaaggccagacaggcccattggctgcctcgggacatcaaagatttatcgcattctaggaaagactgtggtttgttacccgattattttcgacctaagtgatttctacatgtctcaggatgttttcctgctgatagatgacataaagaatgcgctgcagttcattaaacaatattggaaaatgcatggacgtccacttttccttgttctcatccgggaagacaatataagaggtagccggttcaaccccatattagatatgctggcagcccttaaaaaaggaataattggaggagtcaaagttcatgtggatcgtctacagacactaatatctggagctgtggtagaacaacttgatttcctacgaatcagtgacacagaagagcttccagaatttaagagttttgaggaactagaacctcccaaacattcaaaagtcaaacggcaaagcagcacccctagtgctcctgaactgggacagcagccggatgtcaacattagtgaatggaaggacaaacccacccacgaaattcttcaaaaactgaatgattgcagttgtctggctagccaagccatcctgctgggtatactgctcaaaagagaaggccccaacttcatcacaaaggaaggtaccgtttctgatcacattgagagagtctatagaagagctggcagccaaaaactttggtcggttgtacgccgtgcagcaagtcttttaagtaaagtagtggacagcctggccccatccattactaatgttttagtgcagggcaaacaggtaactctgggtgcctttgggcatgaagaagaagttatctctaatcctttgtctccaagagtgattcaaaacatcatctattataagtgtaacacccatgatgagagggaagcggtcattcagcaagaactggtcatccatattggctggatcatctccaataaccctgagttattcagtggcatgctgaaaatacgaatcgggtggatcatccatgccatggagtatgaacttcagatccgtggcggagacaagccagccttggacttgtatcagctgtcacctagtgaagttaaacagcttctgctggatattctgcagcctcaacagaatggaagatgttggctgaacaggcgtcagatcgatgggtctttgaatagaactcccaccgggttctatgaccgagtgtggcagattctggagcgcacgcccaatgggatcattgttgctgggaagcatttgcctcagcaaccaaccctgtcagatatgaccatgtatgagatgaatttctctctccttgttgaagacacgttgggaaatattgaccagccacagtacagacagatcgttgtagagttacttatggttgtatccattgtactggaaagaaaccccgagctagaatttcaagacaaagtagatctagacagactggtcaaagaagcatttaatgaatttcaaaaagatcagagtcggctaaaggaaattgaaaaacaagatgacatgacttccttttacaacactcctcccctgggaaaaagaggaacatgcagctatttgacaaaggcggtgatgaatctgctgctggaaggagaagtcaagccaaacaatgatgacccgtgtctgattagctagtggggaaggtgtaggaagctctgttgagacacatgttctgaagtgtgttgtgtttcatgttcaagcttaatcaaggcagccattaatatacgaactgagcatgctggggaggtgaatgccacatccttggcggggttatggacctcttgcatgtcatagccaatctaacggtaatggtaaatgcttttaatcaagcaggaaaaagttctcatgattatgccaactataatagtaatcctcactgagtgataaaaatagtttatgaattgaaaatttgccgctgcatgttgtatgatcaaatagttcatcaaaatgaatctttgctctttggactgaattcttaccatactgccattaaaataaatttgccaactagtaatgcatactggaaatcaaaagatactgaaagaatggtgaacttctcttagtggtattgtcatgctaaaagatgttaatatacatcataaaagcaaagtcagccagctgatattttggttctcaaaaactgcattattaataatattttagtatacagagctattctacagtttttacattgtaaacatgactgtggttttgtatttgctaaatataggggttggactaaaatataataaatctgtaccttatcaaacattttctttgagctcctgctaaaaataggacatgtctatgattgttcaaaaatatgttaaatttaggctcagcacagtagctcacacctgaaatcttagcacttcgggaggctgaggcaggtggatcacttgaggttaggagttcaagaccagcccagccaacatggtgaaaaccctgtctctactaaaaatacaaaaattagccaggcatgatggtgcatgcctttaaacccagctactgaggaggctgaggcatgagaattgcttgaaccaggagacggaggttgcagtgagctgaaatcctgccactgcacaccagcctgggtgacagagcgagactccatctcaaaaaaaaaaaaaaaaaagaaaaagaaaaaaatatgttaaatttaaggactgttaacctacgttctactagtaaaaacaacattaagggtcattaaattttatttctgaattaatgaacatatctggacattttttgttcctaggttcacaagattgagcttcaaactcccgagtgttttcatttaattgatttagaggtagaatggaagagaatctgtggtacctaccattatacacatttagttgcccagtttacttaaactttaatgaaagtagaaagtagattaaacatttaaattttatttctttcctaaatagaaaaaaaaaaggcccatgagtttgagcccttgccccaaagagagttgtttttctgatcaatcttactggagtttcacctgagaagatagatttgtcacataaaaaatgcagcttatttgtagtgttttgaaaggatgtaagaaaggatgagtggcttcagtattgagtcaatcgatatcaaatgaatggatgtgtgagcacatggaaaaatctgctgtcagtcacatttctcataacattgaggtacagtgccgagatcttgcataagaaattgtatggatattagttggcaaaattgaaatgaatgagacacagttgggccctaaagaactaaggagggggattgacaaagaatagaattaaactacttgactcaatatgttaagagagtttatgaaaagatagtcgtgaagggtgaagctaatttgtaaaactaatgcctgaaaaaaacataagcatgaagtccatggagagggaattgagagctgacacttcataactggagaaactggaaattaaagaaagggaaacaaaagacttaaaatttttgtttgccgaaatttttacgaaagtaaactgtgttgtagttttaagaatttttttaaaaaatctgattagctgagcaaagttaccagaaaactgctatcctagttgaaatcaaacattacttgcaaatgtgttttctgagtgttagcttcctgcttaaatgttacatatgcaaaattctgaagttttcctgtgctactcctgaaagcattcagaatctgtgacacgtattgacttcatgctttgagattcaaaatttattgttctgaaagttatatttagaatcagtaaatcttgatattcacctttaaaaaagc

SEQ ID NO: 372214 - DNA, 4611 bp, Homo sapiens
  misc_feature (4526)..(4526): n is a, c, g, or t
  misc_feature (4568)..(4568): n is a, c, g, or t
agagtggcgcgcagccccgggacgcgtaagagccgctgccggctcctttttctctctcccactagggctgcccttccgacgctaaaaaagcagtggagctagggtgaaagccgccctcacgctcacttccggcaggcgcgcctcccgacagtgtcgtgcggggggcgtggcccggcattgctgacaggcggccccgggggcggtggccaaggcggcgaccggagcgcgatggcgggggcggcgggactcacggcagaagtgagctggaaggtcttggagcgaagagctcggaccaagcgctcagcttagcctgcgacgcttatgattagagccaacaatttgaaatggcctgctcacctgatgcagtcgtctctccgtcttccgctttcttaaggtctggctcagtttatgaacctcttaaaagcattaatcttccaagacctgataatgaaactctctgggataagttggaccattattacagaattgtcaagtcaacattgctgctgtatcaaagtccaactaccggtctctttcccactaaaacatgcggtggtgaccagaaggccaagatccaggacagcctatactgcgctgctggggcctgggctttggctcttgcatacaggcgaattgatgatgacaagggaaggacccatgagctggagcactcagctataaaatgcatgagaggaattctctactgctatatgcgtcaggccgataaggtccagcagtttaagcaggatccacgcccaacaacatgtcttcactctgttttcaatgtgcatacaggagatgagttgctttcctatgaggaatatggtcatcttcagataaatgcagtgtcactttatctcctttaccttgtggaaatgatttcctcaggactccagattatctacaacactgatgaggtctcttttattcaaaaccttgtattttgtgtggaaagagtttaccgtgtgcctgactttggtgtctgggaaagaggaagcaaatataataatggcagcacagagctacattcgagctcggttggtttagcaaaagcagctctagaagcaattaatggattcaacctttttggcaaccagggctgttcgtggtcagttatatttgtggatctcgatgctcacaatcgcaacaggcaaactttgtgctcgctgttacccagagaatcaagatcacataatacagatgctgccctgctcccctgcatcagttatcctgcatttgccctggatgatgaagttctttttagccagacacttgataaagtggttagaaaattaaaaggaaaatatggatttaaacgtttcttgagagatgggtatagaacatcattggaagatcccaacagatgctactacaagccagctgaaattaagctatttgatggcattgaatgtgaatttcccatatttttcctttatatgatgattgatggagtttttagaggcaatcctaagcaagtacaggaatatcaggatcttttgactccagtacttcatcataccacagaaggatatcctgttgtaccaaagtactattatgtgccagctgactttgtagaatatgaaaaaaataaccctggtagtcaaaaacgatttcctagcaactgtggccgtgatggaaaactgtttctttggggacaagcactttatatcatcgcaaaactcctggctgatgaacttattagtcctaaagacattgatcctgtccagcgctatgtcccactaaaggatcaacgtaacgtgagcatgaggttttccaatcagggcccactggaaaatgacttggtagttcatgtggcacttatagcagaaagccaaagacttcaagtttttctgaacacatatggtattcaaactcaaactcctcaacaagtagaacccattcagatatggcctcagcaggagcttgtgaaagcttatttgcagctgggtatcaatgaaaagttaggactctctggaaggccagacaggcccattggctgcctcgggacatcaaagatttatcgcattctaggaaagactgtggtttgttacccgattattttcgacctaagtgatttctacatgtctcaggatgttttcctgctgatagatgacataaagaatgcgctgcagttcattaaacaatattggaaaatgcatggacgtccacttttccttgttctcatccgggaagacaatataagaggtagccggttcaaccccatattagatatgctggcagcccttaaaaaaggaataattggaggagtcaaagttcatgtggatcgtctacagacactaatatctggagctgtggtagaacaacttgatttcctacgaatcagtgacacagaagagcttccagaatttaagagttttgaggaactagaacctcccaaacattcaaaagtcaaacggcaaagcagcacccctagtgctcctgaactgggacagcagccggatgtcaacattagtgaatggaaggacaaacccacccacgaaattcttcaaaaactgaatgattgcagttgtctggctagccaagccatcctgctgggtatactgctcaaaagagaaggccccaacttcatcacaaaggaaggtaccgtttctgatcacattgagagagtctatagaagagctggcagccaaaaactttggtcggttgtacgccgtgcagcaagtcttttaagtaaagtagtggacagcctggccccatccattactaatgttttagtgcagggcaaacaggtaactctgggtgcctttgggcatgaagaagaagttatctctaatcctttgtctccaagagtgattcaaaacatcatctattataagtgtaacacccatgatgagagggaagcggtcattcagcaagaactggtcatccatattggctggatcatctccaataaccctgagttattcagtggcatgctgaaaatacgaatcgggtggatcatccatgccatggagtatgaacttcagatccgtggcggagacaagccagccttggacttgtatcagctgtcacctagtgaagttaaacagcttctgctggatattctgcagcctcaacagaatggaagatgttggctgaacaggcgtcagatcgatgggtctttgaatagaactcccaccgggttctatgaccgagtgtggcagattctggagcgcacgcccaatgggatcattgttgctgggaagcatttgcctcagcaaccaaccctgtcagatatgaccatgtatgagatgaatttctctctccttgttgaagacacgttgggaaatattgaccagccacagtacagacagatcgttgtagagttacttatggttgtatccattgtactggaaagaaaccccgagctagaatttcaagacaaagtagatctagacagactggtcaaagaagcatttaatgaatttcaaaaagatcagagtcggctaaaggaaattgaaaaacaagatgacatgacttccttttacaacactcctcccctgggaaaaagaggaacatgcagctatttgacaaaggcggtgatgaatctgctgctggaaggagaagtcaagccaaacaatgatgacccgtgtctgattagctagtggggaaggtgtaggaagctctgttgagacacatgttctgaagtgtgttgtgtttcatgttcaagcttaatcaaggcagccattaatatacgaactgagcatgctggggaggtgaatgccacatccttggcggggttatggacctcttgcatgtcatagccaatctaacggtaatggtaaatgcttttaatcaagcaggaaaaagttctcatgattatgccaactataatagtaatcctcactgagtgataaaaatagtttatgaattgaaaatttgccgctgcatgttgtatgatcaaatagttcatcaaaatgaatctttgctctttggactgaattcttaccatactgccattaaaataaatttgccaactagtaatgcatactggaaatcaaaagatactgaaagaatggtgaacttctcttagtggtattgtcatgctaaaagatgttaatatacatcataaaagcaaagtcagccagctgatattttggttctcaaaaactgcattattaataatattttagtatacagagctattctacagtttttacattgtaaacatgactgtggttttgtatttgctaaatataggggttggactaaaatataataaatctgtaccttatcaaacattttctttgagctcctgctaaaaataggacatgtctatgattgttcaaaaatatgttaaatttaggctcagcacagtagctcacacctgaaatcttagcacttcggcctcccaaaatgctgggattacaggtgtgagccaccacgcccaacctttaggcacatcttttgaaccaattcagtgttatttaatttcttcaagtgtcttactactttccatggattgaggatagtttaggcatttccatatttaaagtacatttaatttccattacagtttgtggaangagacaggcatggaggtagggtgcgacttttgccggttcggncaccggggaccggccgtttaccctaggggggggtttgcctgag

SEQ ID NO: 372215 - DNA, 5842 bp, Homo sapiens
agagtggcgcgcagccccgggacgcgtaagagccgctgccggctcctttttctctctcccactagggctgcccttccgacgctaaaaaagcagtggagctagggtgaaagccgccctcacgctcacttccggcaggcgcgcctcccgacagtgtcgtgcggggggcgtggcccggcattgctgacaggcggccccgggggcggtggccaaggcggcgaccggagcgcgatggcgggggcggcgggactcacggcagaagtgagctggaaggtcttggagcgaagagctcggaccaagcgctcagcttagcctgcgacgcttatgattagagccaacaatttgaaatggcctgctcacctgatgcagtcgtctctccgtcttccgctttcttaaggtctggctcagtttatgaacctcttaaaagcattaatcttccaagacctgataatgaaactctctgggataagttggaccattattacagaattgtcaagtcaacattgctgctgtatcaaagtccaactaccggtctctttcccactaaaacatgcggtggtgaccagaaggccaagatccaggacagcctatactgcgctgctggggcctgggctttggctcttgcatacaggcgaattgatgatgacaagggaaggacccatgagctggagcactcagctataaaatgcatgagaggaattctctactgctatatgcgtcaggccgataaggtccagcagtttaagcaggatccacgcccaacaacatgtcttcactctgttttcaatgtgcatacaggagatgagttgctttcctatgaggaatatggtcatcttcagataaatgcagtgtcactttatctcctttaccttgtggaaatgatttcctcaggactccagattatctacaacactgatgaggtctcttttattcaaaaccttgtattttgtgtggaaagagtttaccgtgtgcctgactttggtgtctgggaaagaggaagcaaatataataatggcagcacagagctacattcgagctcggttggtttagcaaaagcagctctagaagcaattaatggattcaacctttttggcaaccagggctgttcgtggtcagttatatttgtggatctcgatgctcacaatcgcaacaggcaaactttgtgctcgctgttacccagagaatcaagatcacataatacagatgctgccctgctcccctgcatcagttatcctgcatttgccctggatgatgaagttctttttagccagacacttgataaagtggttagaaaattaaaaggaaaatatggatttaaacgtttcttgagagatgggtatagaacatcattggaagatcccaacagatgctactacaagccagctgaaattaagctatttgatggcattgaatgtgaatttcccatatttttcctttatatgatgattgatggagtttttagaggcaatcctaagcaagtacaggaatatcaggatcttttgactccagtacttcatcataccacagaaggatatcctgttgtaccaaagtactattatgtgccagctgactttgtagaatatgaaaaaaataaccctggtagtcaaaaacgatttcctagcaactgtggccgtgatggaaaactgtttctttggggacaagcactttatatcatcgcaaaactcctggctgatgaacttattagtcctaaagacattgatcctgtccagcgctatgtcccactaaaggatcaacgtaacgtgagcatgaggttttccaatcagggcccactggaaaatgacttggtagttcatgtggcacttatagcagaaagccaaagacttcaagtttttctgaacacatatggtattcaaactcaaactcctcaacaagtagaacccattcagatatggcctcagcaggagcttgtgaaagcttatttgcagctgggtatcaatgaaaagttaggactctctggaaggccagacaggcccattggctgcctcgggacatcaaagatttatcgcattctaggaaagactgtggtttgttacccgattattttcgacctaagtgatttctacatgtctcaggatgttttcctgctgatagatgacataaagaatgcgctgcagttcattaaacaatattggaaaatgcatggacgtccacttttccttgttctcatccgggaagacaatataagaggtagccggttcaaccccatattagatatgctggcagcccttaaaaaaggaataattggaggagtcaaagttcatgtggatcgtctacagacactaatatctggagctgtggtagaacaacttgatttcctacgaatcagtgacacagaagagcttccagaatttaagagttttgaggaactagaacctcccaaacattcaaaagtcaaacggcaaagcagcacccctagtgctcctgaactgggacagcagccggatgtcaacattagtgaatggaaggacaaacccacccacgaaattcttcaaaaactgaatgattgcagttgtctggctagccaagccatcctgctgggtatactgctcaaaagagaaggccccaacttcatcacaaaggaaggtaccgtttctgatcacattgagagagtctatagaagagctggcagccaaaaactttggtcggttgtacgccgtgcagcaagtcttttaagtaaagtagtggacagcctggccccatccattactaatgttttagtgcagggcaaacaggtaactctgggtgcctttgggcatgaagaagaagttatctctaatcctttgtctccaagagtgattcaaaacatcatctattataagtgtaacacccatgatgagagggaagcggtcattcagcaagaactggtcatccatattggctggatcatctccaataaccctgagttattcagtggcatgctgaaaatacgaatcgggtggatcatccatgccatggagtatgaacttcagatccgtggcggagacaagccagccttggacttgtatcagctgtcacctagtgaagttaaacagcttctgctggatattctgcagcctcaacagaatggaagatgttggctgaacaggcgtcagatcgatgggtctttgaatagaactcccaccgggttctatgaccgagtgtggcagattctggagcgcacgcccaatgggatcattgttgctgggaagcatttgcctcagcaaccaaccctgtcagatatgaccatgtatgagatgaatttctctctccttgttgaagacacgttgggaaatattgaccagccacagtacagacagatcgttgtagagttacttatggttgtatccattgtactggaaagaaaccccgagctagaatttcaagacaaagtagatctagacagactggtcaaagaagcatttaatgaatttcaaaaagatcagagtcggctaaaggaaattgaaaaacaactgacacagattttacctgtcaactctttacaaacagaagatcgaatgccttgcctactgttttcctttgtaggatgacatgacttccttttacaacactcctcccctgggaaaaagaggaacatgcagctatttgacaaaggcggtgatgaatctgctgctggaaggagaagtcaagccaaacaatgatgacccgtgtctgattagctagtggggaaggtgtaggaagctctgttgagacacatgttctgaagtgtgttgtgtttcatgttcaagcttaatcaaggcagccattaatatacgaactgagcatgctggggaggtgaatgccacatccttggcggggttatggacctcttgcatgtcatagccaatctaacggtaatggtaaatgcttttaatcaagcaggaaaaagttctcatgattatgccaactataatagtaatcctcactgagtgataaaaatagtttatgaattgaaaatttgccgctgcatgttgtatgatcaaatagttcatcaaaatgaatctttgctctttggactgaattcttaccatactgccattaaaataaatttgccaactagtaatgcatactggaaatcaaaagatactgaaagaatggtgaacttctcttagtggtattgtcatgctaaaagatgttaatatacatcataaaagcaaagtcagccagctgatattttggttctcaaaaactgcattattaataatattttagtatacagagctattctacagtttttacattgtaaacatgactgtggttttgtatttgctaaatataggggttggactaaaatataataaatctgtaccttatcaaacattttctttgagctcctgctaaaaataggacatgtctatgattgttcaaaaatatgttaaatttaggctcagcacagtagctcacacctgaaatcttagcacttcgggaggctgaggcaggtggatcacttgaggttaggagttcaagaccagcccagccaacatggtgaaaaccctgtctctactaaaaatacaaaaattagccaggcatgatggtgcatgcctttaaacccagctactgaggaggctgaggcatgagaattgcttgaaccaggagacggaggttgcagtgagctgaaatcctgccactgcacaccagcctgggtgacagagcgagactccatctcaaaaaaaaaaaaaaaaaagaaaaagaaaaaaatatgttaaatttaaggactgttaacctacgttctactagtaaaaacaacattaagggtcattaaattttatttctgaattaatgaacatatctggacattttttgttcctaggttcacaagattgagcttcaaactcccgagtgttttcatttaattgatttagaggtagaatggaagagaatctgtggtacctaccattatacacatttagttgcccagtttacttaaactttaatgaaagtagaaagtagattaaacatttaaattttatttctttcctaaatagaaaaaaaaaaggcccatgagtttgagcccttgccccaaagagagttgtttttctgatcaatcttactggagtttcacctgagaagatagatttgtcacataaaaaatgcagcttatttgtagtgttttgaaaggatgtaagaaaggatgagtggcttcagtattgagtcaatcgatatcaaatgaatggatgtgtgagcacatggaaaaatctgctgtcagtcacatttctcataacattgaggtacagtgccgagatcttgcataagaaattgtatggatattagttggcaaaattgaaatgaatgagacacagttgggccctaaagaactaaggagggggattgacaaagaatagaattaaactacttgactcaatatgttaagagagtttatgaaaagatagtcgtgaagggtgaagctaatttgtaaaactaatgcctgaaaaaaacataagcatgaagtccatggagagggaattgagagctgacacttcataactggagaaactggaaattaaagaaagggaaacaaaagacttaaaatttttgtttgccgaaatttttacgaaagtaaactgtgttgtagttttaagaatttttttaaaaaatctgattagctgagcaaagttaccagaaaactgctatcctagttgaaatcaaacattacttgcaaatgtgttttctgagtgttagcttcctgcttaaatgttacatatgcaaaattctgaagttttcctgtgctactcctgaaagcattcagaatctgtgacacgtattgacttcatgctttgagattcaaaatttattgttctgaaagttatatttagaatcagtaaatcttgatattcacctttaaaaaagc

SEQ ID NO: 372216 - DNA, 3337 bp, Homo sapiens
acagcttggtggcagggatgaggtggagggatccctccctaattctgaatggtcctgcagtctgggaaatttcagctgttaggttcaatgtcctgggcagtgtttcctccaaatgatgatgtgaggattccactgtgtatattttaaagactacccaatcagggccccatgcattcctcatcttttagatttgtgaacatctggcctgctctcttctttgcccccaggtcggttgtacgccgtgcagcaagtcttttaagtaaagtagtggacagcctggccccatccattactaatgttttagtgcagggcaaacaggtaactctgggtgcctttgggcatgaagaagaagttatctctaatcctttgtctccaagagtgattcaaaacatcatctattataagtgtaacacccatgatgagagggaagcggtcattcagcaagaactggtcatccatattggctggatcatctccaataaccctgagttattcagtggcatgctgaaaatacgaatcgggtggatcatccatgccatggagtatgaacttcagatccgtggcggagacaagccagccttggacttgtatcagctgtcacctagtgaagttaaacagcttctgctggatattctgcagcctcaacagaatggaagatgttggctgaacaggcgtcagatcgatgggtctttgaatagaactcccaccgggttctatgaccgagtgtggcagattctggagcgcacgcccaatgggatcattgttgctgggaagcatttgcctcagcaaccaaccctgtcagatatgaccatgtatgagatgaatttctctctccttgttgaagacacgttgggaaatattgaccagccacagtacagacagatcgttgtagagttacttatggttgtatccattgtactggaaagaaaccccgagctagaatttcaagacaaagtagatctagacagactggtcaaagaagcatttaatgaatttcaaaaagatcagagtcggctaaaggaaattgaaaaacaagatgacatgacttccttttacaacactcctcccctgggaaaaagaggaacatgcagctatttgacaaaggcggtgatgaatctgctgctggaaggagaagtcaagccaaacaatgatgacccgtgtctgattagctagtggggaaggtgtaggaagctctgttgagacacatgttctgaagtgtgttgtgtttcatgttcaagcttaatcaaggcagccattaatatacgaactgagcatgctggggaggtgaatgccacatccttggcggggttatggacctcttgcatgtcatagccaatctaacggtaatggtaaatgcttttaatcaagcaggaaaaagttctcatgattatgccaactataatagtaatcctcactgagtgataaaaatagtttatgaattgaaaatttgccgctgcatgttgtatgatcaaatagttcatcaaaatgaatctttgctctttggactgaattcttaccatactgccattaaaataaatttgccaactagtaatgcatactggaaatcaaaagatactgaaagaatggtgaacttctcttagtggtattgtcatgctaaaagatgttaatatacatcataaaagcaaagtcagccagctgatattttggttctcaaaaactgcattattaataatattttagtatacagagctattctacagtttttacattgtaaacatgactgtggttttgtatttgctaaatataggggttggactaaaatataataaatctgtaccttatcaaacattttctttgagctcctgctaaaaataggacatgtctatgattgttcaaaaatatgttaaatttaggctcagcacagtagctcacacctgaaatcttagcacttcgggaggctgaggcaggtggatcacttgaggttaggagttcaagaccagcccagccaacatggtgaaaaccctgtctctactaaaaatacaaaaattagccaggcatgatggtgcatgcctttaaacccagctactgaggaggctgaggcatgagaattgcttgaaccaggagacggaggttgcagtgagctgaaatcctgccactgcacaccagcctgggtgacagagcgagactccatctcaaaaaaaaaaaaaaaaaagaaaaagaaaaaaatatgttaaatttaaggactgttaacctacgttctactagtaaaaacaacattaagggtcattaaattttatttctgaattaatgaacatatctggacattttttgttcctaggttcacaagattgagcttcaaactcccgagtgttttcatttaattgatttagaggtagaatggaagagaatctgtggtacctaccattatacacatttagttgcccagtttacttaaactttaatgaaagtagaaagtagattaaacatttaaattttatttctttcctaaatagaaaaaaaaaaggcccatgagtttgagcccttgccccaaagagagttgtttttctgatcaatcttactggagtttcacctgagaagatagatttgtcacataaaaaatgcagcttatttgtagtgttttgaaaggatgtaagaaaggatgagtggcttcagtattgagtcaatcgatatcaaatgaatggatgtgtgagcacatggaaaaatctgctgtcagtcacatttctcataacattgaggtacagtgccgagatcttgcataagaaattgtatggatattagttggcaaaattgaaatgaatgagacacagttgggccctaaagaactaaggagggggattgacaaagaatagaattaaactacttgactcaatatgttaagagagtttatgaaaagatagtcgtgaagggtgaagctaatttgtaaaactaatgcctgaaaaaaacataagcatgaagtccatggagagggaattgagagctgacacttcataactggagaaactggaaattaaagaaagggaaacaaaagacttaaaatttttgtttgccgaaatttttacgaaagtaaactgtgttgtagttttaagaatttttttaaaaaatctgattagctgagcaaagttaccagaaaactgctatcctagttgaaatcaaacattacttgcaaatgtgttttctgagtgttagcttcctgcttaaatgttacatatgcaaaattctgaagttttcctgtgctactcctgaaagcattcagaatctgtgacacgtattgacttcatgctttgagattcaaaatttattgttctgaaagttatatttagaatcagtaaatcttgatattcacctttaaaaaagc

SEQ ID NO: 372217 - DNA, 5651 bp, Homo sapiens
agagtggcgcgcagccccgggacgcgtaagagccgctgccggctcctttttctctctcccactagggctgcccttccgacgctaaaaaagcagtggagctagggtgaaagccgccctcacgctcacttccggcaggcgcgcctcccgacagtgtcgtgcggggggcgtggcccggcattgctgacaggcggccccgggggcggtggccaaggcggcgaccggagcgcgatggcgggggcggcgggactcacggcagaagtgagctggaaggtcttggagcgaagagctcggaccaagcgctcagcttagcctgcgacgcttatgattagagccaacaatttgaaatggcctgctcacctgatgcagtcgtctctccgtcttccgctttcttaaggtctggctcagtttatgaacctcttaaaagcattaatcttccaagacctgataatgaaactctctgggataagttggaccattattacagaattgtcaagtcaacattgctgctgtatcaaagtccaactaccggtctctttcccactaaaacatgcggtggtgaccagaaggccaagatccaggacagcctatactgcgctgctggggcctgggctttggctcttgcatacaggcgaattgatgatgacaagggaaggacccatgagctggagcactcagctataaaatgcatgagaggaattctctactgctatatgcgtcaggccgataaggtccagcagtttaagcaggatccacgcccaacaacatgtcttcactctgttttcaatgtgcatacaggagatgagttgctttcctatgaggaatatggtcatcttcagataaatgcagtgtcactttatctcctttaccttgtggaaatgatttcctcaggactccagattatctacaacactgatgaggtctcttttattcaaaaccttgtattttgtgtggaaagagtttaccgtgtgcctgactttggtgtctgggaaagaggaagcaaatataataatggcagcacagagctacattcgagctcggttggtttagcaaaagcagctctagaagcaattaatggattcaacctttttggcaaccagggctgttcgtggtcagttatatttgtggatctcgatgctcacaatcgcaacaggcaaactttgtgctcgctgttacccagagaatcaagatcacataatacagatgctgccctgctcccctgcatcagttatcctgcatttgccctggatgatgaagttctttttagccagacacttgataaagtggttagaaaattaaaaggaaaatatggatttaaacgtttcttgagagatgggtatagaacatcattggaagatcccaacagatgctactacaagccagctgaaattaagctatttgatggcattgaatgtgaatttcccatatttttcctttatatgatgattgatggagtttttagaggcaatcctaagcaagtacaggaatatcaggatcttttgactccagtacttcatcataccacagaaggatatcctgttgtaccaaagtactattatgtgccagctgactttgtagaatatgaaaaaaataaccctggtagtcaaaaacgatttcctagcaactgtggccgtgatggaaaactgtttctttggggacaagcactttatatcatcgcaaaactcctggctgatgaacttattagtcctaaagacattgatcctgtccagcgctatgtcccactaaaggatcaacgtaacgtgagcatgaggttttccaatcagggcccactggaaaatgacttggtagttcatgtggcacttatagcagaaagccaaagacttcaagtttttctgaacacatatggtattcaaactcaaactcctcaacaagtagaacccattcagatatggcctcagcaggagcttgtgaaagcttatttgcagctgggtatcaatgaaaagttaggactctctggaaggccagacaggcccattggctgcctcgggacatcaaagatttatcgcattctaggaaagactgtggtttgttacccgattattttcgacctaagtgatttctacatgtctcaggatgttttcctgctgatagatgacataaagaatgcgctgcagttcattaaacaatattggaaaatgcatggacgtccacttttccttgttctcatccgggaagacaatataagaggtagccggttcaaccccatattagatatgctggcagcccttaaaaaaggaataattggaggagtcaaagttcatgtggatcgtctacagacactaatatctggagctgtggtagaacaacttgatttcctacgaatcagtgacacagaagagcttccagaatttaagagttttgaggaactagaacctcccaaacattcaaaagtcaaacggcaaagcagcacccctagtgctcctgaactgggacagcagccggatgtcaacattagtgaatggaaggacaaacccacccacgaaattcttcaaaaactgaatgattgcagttgtctggctagccaagccatcctgctgggtatactgctcaaaagagaaggccccaacttcatcacaaaggaaggtaccgtttctgatcacattgagagagtctatagaagagctggcagccaaaaactttggtcggttgtacgccgtgcagcaagtcttttaagtaaagtagtggacagcctggccccatccattactaatgttttagtgcagggcaaacaggtaactctgggtgcctttgggcatgaagaagaagttatctctaatcctttgtctccaagagtgattcaaaacatcatctattataagtgtaacacccatgatgagagggaagcggtcattcagcaagaactggtcatccatattggctggatcatctccaataaccctgagttattcagtggcatgctgaaaatacgaatcgggtggatcatccatgccatggagtatgaacttcagatccgtggcggagacaagccagccttggacttgtatcagctgtcacctagtgaagttaaacagcttctgctggatattctgcagcctcaacagaatggaagatgttggctgaacaggcgtcagatcgatgggtctttgaatagaactcccaccgggttctatgaccgagtgtggcagattctggagcgcacgcccaatgggatcattgttgctgggaagcatttgcctcagcaaccaaccctgtcagatatgaccatgtatgagatgaatttctctctccttgttgaagacacgttgggaaatattgaccagccacagtacagacagatcgttgtagagttacttatggttgtatccattgtactggaaagaaaccccgagctagaatttcaagacaaagtagatctagacagactggtcaaagaagcatttaatgaatttcaaaaagatcagagtcggctaaaggaaattgaaaaacaagatgacatgacttccttttacaacactcctcccctgggaaaaagaggaacatgcagctatttgacaaaggcggtgatgaatctgctgctggaaggagaaccattaatatacgaactgagcatgctggggaggtgaatgccacatccttggcggggttatggacctcttgcatgtcatagccaatctaacggtaatggtaaatgcttttaatcaagcaggaaaaagttctcatgattatgccaactataatagtaatcctcactgagtgataaaaatagtttatgaattgaaaatttgccgctgcatgttgtatgatcaaatagttcatcaaaatgaatctttgctctttggactgaattcttaccatactgccattaaaataaatttgccaactagtaatgcatactggaaatcaaaagatactgaaagaatggtgaacttctcttagtggtattgtcatgctaaaagatgttaatatacatcataaaagcaaagtcagccagctgatattttggttctcaaaaactgcattattaataatattttagtatacagagctattctacagtttttacattgtaaacatgactgtggttttgtatttgctaaatataggggttggactaaaatataataaatctgtaccttatcaaacattttctttgagctcctgctaaaaataggacatgtctatgattgttcaaaaatatgttaaatttaggctcagcacagtagctcacacctgaaatcttagcacttcgggaggctgaggcaggtggatcacttgaggttaggagttcaagaccagcccagccaacatggtgaaaaccctgtctctactaaaaatacaaaaattagccaggcatgatggtgcatgcctttaaacccagctactgaggaggctgaggcatgagaattgcttgaaccaggagacggaggttgcagtgagctgaaatcctgccactgcacaccagcctgggtgacagagcgagactccatctcaaaaaaaaaaaaaaaaaagaaaaagaaaaaaatatgttaaatttaaggactgttaacctacgttctactagtaaaaacaacattaagggtcattaaattttatttctgaattaatgaacatatctggacattttttgttcctaggttcacaagattgagcttcaaactcccgagtgttttcatttaattgatttagaggtagaatggaagagaatctgtggtacctaccattatacacatttagttgcccagtttacttaaactttaatgaaagtagaaagtagattaaacatttaaattttatttctttcctaaatagaaaaaaaaaaggcccatgagtttgagcccttgccccaaagagagttgtttttctgatcaatcttactggagtttcacctgagaagatagatttgtcacataaaaaatgcagcttatttgtagtgttttgaaaggatgtaagaaaggatgagtggcttcagtattgagtcaatcgatatcaaatgaatggatgtgtgagcacatggaaaaatctgctgtcagtcacatttctcataacattgaggtacagtgccgagatcttgcataagaaattgtatggatattagttggcaaaattgaaatgaatgagacacagttgggccctaaagaactaaggagggggattgacaaagaatagaattaaactacttgactcaatatgttaagagagtttatgaaaagatagtcgtgaagggtgaagctaatttgtaaaactaatgcctgaaaaaaacataagcatgaagtccatggagagggaattgagagctgacacttcataactggagaaactggaaattaaagaaagggaaacaaaagacttaaaatttttgtttgccgaaatttttacgaaagtaaactgtgttgtagttttaagaatttttttaaaaaatctgattagctgagcaaagttaccagaaaactgctatcctagttgaaatcaaacattacttgcaaatgtgttttctgagtgttagcttcctgcttaaatgttacatatgcaaaattctgaagttttcctgtgctactcctgaaagcattcagaatctgtgacacgtattgacttcatgctttgagattcaaaatttattgttctgaaagttatatttagaatcagtaaatcttgatattcacctttaaaaaagc

SEQ ID NO: 372218 - DNA, 3645 bp, Homo sapiens
agagtggcgcgcagccccgggacgcgtaagagccgctgccggctcctttttctctctcccactagggctgcccttccgacgctaaaaaagcagtggagctagggtgaaagccgccctcacgctcacttccggcaggcgcgcctcccgacagtgtcgtgcggggggcgtggcccggcattgctgacaggcggccccgggggcggtggccaaggcggcgaccggagcgcgatggcgggggcggcgggactcacggcagaagtgagctggaaggtcttggagcgaagagctcggaccaagcgctcagcttagcctgcgacgcttatgattagagccaacaatttgaaatggcctgctcacctgatgcagtcgtctctccgtcttccgctttcttaaggtctggctcagtttatgaacctcttaaaagcattaatcttccaagacctgataatgaaactctctgggataagttggaccattattacagaattgtcaagtcaacattgctgctgtatcaaagtccaactaccggtctctttcccactaaaacatgcggtggtgaccagaaggccaagatccaggacagcctatactgcgctgctggggcctgggctttggctcttgcatacaggcgaattgatgatgacaagggaaggacccatgagctggagcactcagctataaaatgcatgagaggaattctctactgctatatgcgtcaggccgataaggtccagcagtttaagcaggatccacgcccaacaacatgtcttcactctgttttcaatgtgcatacaggagatgagttgctttcctatgaggaatatggtcatcttcagataaatgcagtgtcactttatctcctttaccttgtggaaatgatttcctcaggactccagattatctacaacactgatgaggtctcttttattcaaaaccttgtattttgtgtggaaagagtttaccgtgtgcctgactttggtgtctgggaaagaggaagcaaatataataatggcagcacagagctacattcgagctcggttggtttagcaaaagcagctctagaagcaattaatggattcaacctttttggcaaccagggctgttcgtggtcagttatatttgtggatctcgatgctcacaatcgcaacaggcaaactttgtgctcgctgttacccagagaatcaagatcacataatacagatgctgccctgctcccctgcatcagttatcctgcatttgccctggatgatgaagttctttttagccagacacttgataaagtggttagaaaattaaaaggaaaatatggatttaaacgtttcttgagagatgggtatagaacatcattggaagatcccaacagatgctactacaagccagctgaaattaagctatttgatggcattgaatgtgaatttcccatatttttcctttatatgatgattgatggagtttttagaggcaatcctaagcaagtacaggaatatcaggatcttttgactccagtacttcatcataccacagaaggatatcctgttgtaccaaagtactattatgtgccagctgactttgtagaatatgaaaaaaataaccctggtagtcaaaaacgatttcctagcaactgtggccgtgatggaaaactgtttctttggggacaagcactttatatcatcgcaaaactcctggctgatgaacttattagtcctaaagacattgatcctgtccagcgctatgtcccactaaaggatcaacgtaacgtgagcatgaggttttccaatcagggcccactggaaaatgacttggtagttcatgtggcacttatagcagaaagccaaagacttcaagtttttctgaacacatatggtattcaaactcaaactcctcaacaagtagaacccattcagatatggcctcagcaggagcttgtgaaagcttatttgcagctgggtatcaatgaaaagttaggactctctggaaggccagacaggcccattggctgcctcgggacatcaaagatttatcgcattctaggaaagactgtggtttgttacccgattattttcgacctaagtgatttctacatgtctcaggatgttttcctgctgatagatgacataaagaatgcgctgcagttcattaaacaatattggaaaatgcatggacgtccacttttccttgttctcatccgggaagacaatataagaggtagccggttcaaccccatattagatatgctggcagcccttaaaaaaggaataattggaggagtcaaagttcatgtggatcgtctacagacactaatatctggagctgtggtagaacaacttgatttcctacgaatcagtgacacagaagagcttccagaatttaagagttttgaggaactagaacctcccaaacattcaaaagtcaaacggcaaagcagcacccctagtgctcctgaactgggacagcagccggatgtcaacattagtgaatggaaggacaaacccacccacgaaattcttcaaaaactgaatgattgcagttgtctggctagccaagccatcctgctgggtatactgctcaaaagagaaggccccaacttcatcacaaaggaaggtaccgtttctgatcacattgagagagtctatagaagagctggcagccaaaaactttggtttgtattagtgtccttgttgttatgttttatttttgtgttgttatattcgatagcctaaagaaaatggaccaatattaaagatagttattcatcctaatttttacttttaacctccaaggttacagcactttctaagaatgtgcctatgtagcatgtctgtccccccactgcctccaccaaaattctgagaacaaagacactgtagggattgaacctgaagagtattcgctggaatggtatgctaaggtttctttcctgctgtacacctcctctgccccaacaaggtgctttaagttctgttttttaatttaggaaacctgttctgctattatagaaggccatgaaaagagaccagtgatttatctaatcataagcaaaaatagtagaaggctattgtcttgtcacttaagttgaatgaatcccagtgattgtagttgcttcacgaaaaataaccaatttgttctacagaggtagtctgttcccagagattgaaaaaaaaaaaagatgtaggaaagtttaaataaataaaattgtttaaattcacaatggagggccaattcacatggccctctgcattttgatgtaattctaacagttttactagcagaatctaacaaattttgaaagtcagagcgtatgtatagatatatatacacatgcacacatttttttaatgatacgttatccacttaaaaaaaaaagtctcaagaatgtcataagaaactcccttaacctcaatgagcctcaggtttctaatccctaaaataaggggattaaacaaaacaatcccttagaatatttcaattctatttttataataaatatgccgttcctcctcagaagaaataatgtaataatcctatagttaaatctttcaaattttcactgtaaattttcagtacagtaagacatcaagccaataagtgatagttctggtaaactttcttagccagtaagtttcaagtgtggtctgtagtcttatt

SEQ ID NO: 372219 - DNA, 3468 bp, Homo sapiens
agagtggcgcgcagccccgggacgcgtaagagccgctgccggctcctttttctctctcccactagggctgcccttccgacgctaaaaaagcagtggagctagggtgaaagccgccctcacgctcacttccggcaggcgcgcctcccgacagtgtcgtgcggggggcgtggcccggcattgctgacaggcggccccgggggcggtggccaaggcggcgaccggagcgcgatggcgggggcggcgggactcacggcagaagtgagctggaaggtcttggagcgaagagctcggaccaagcgctcagcttagcctgcgacgcttatgattagagccaacaatttgaaatggcctgctcacctgatgcagtcgtctctccgtcttccgctttcttaaggtctggctcagtttatgaacctcttaaaagcattaatcttccaagacctgataatgaaactctctgggataagttggaccattattacagaattgtcaagtcaacattgctgctgtatcaaagtccaactaccggtctctttcccactaaaacatgcggtggtgaccagaaggccaagatccaggacagcctatactgcgctgctggggcctgggctttggctcttgcatacaggcgaattgatgatgacaagggaaggacccatgagctggagcactcagctataaaatgcatgagaggaattctctactgctatatgcgtcaggccgataaggtccagcagtttaagcaggatccacgcccaacaacatgtcttcactctgttttcaatgtgcatacaggagatgagttgctttcctatgaggaatatggtcatcttcagataaatgcagtgtcactttatctcctttaccttgtggaaatgatttcctcaggactccagattatctacaacactgatgaggtctcttttattcaaaaccttgtattttgtgtggaaagagtttaccgtgtgcctgactttggtgtctgggaaagaggaagcaaatataataatggcagcacagagctacattcgagctcggttggtttagcaaaagcagctctagaagcaattaatggattcaacctttttggcaaccagggctgttcgtggtcagttatatttgtggatctcgatgctcacaatcgcaacaggcaaactttgtgctcgctgttacccagagaatcaagatcacataatacagatgctgccctgctcccctgcatcagttatcctgcatttgccctggatgatgaagttctttttagccagacacttgataaagtggttagaaaattaaaaggaaaatatggatttaaacgtttcttgagagatgggtatagaacatcattggaagatcccaacagatgctactacaagccagctgaaattaagctatttgatggcattgaatgtgaatttcccatatttttcctttatatgatgattgatggagtttttagaggcaatcctaagcaagtacaggaatatcaggatcttttgactccagtacttcatcataccacagaaggatatcctgttgtaccaaagtactattatgtgccagctgactttgtagaatatgaaaaaaataaccctggtagtcaaaaacgatttcctagcaactgtggccgtgatggaaaactgtttctttggggacaagcactttatatcatcgcaaaactcctggctgatgaacttattagtcctaaagacattgatcctgtccagcgctatgtcccactaaaggatcaacgtaacgtgagcatgaggttttccaatcagggcccactggaaaatgacttggtagttcatgtggcacttatagcagaaagccaaagacttcaagtttttctgaacacatatggtattcaaactcaaactcctcaacaagtagaacccattcagatatggcctcagcaggagcttgtgaaagcttatttgcagctgggtatcaatgaaaagttaggactctctggaaggccagacaggcccattggctgcctcgggacatcaaagatttatcgcattctaggaaagactgtggtttgttacccgattattttcgacctaagtgatttctacatgtctcaggatgttttcctgctgatagatgacataaagaatgcgctgcagttcattaaacaatattggaaaatgcatggacgtccacttttccttgttctcatccgggaagacaatataagaggtagccggttcaaccccatattagatatgctggcagcccttaaaaaaggaataattggaggagtcaaagttcatgtggatcgtctacagacactaatatctggagctgtggtagaacaacttgatttcctacgaatcagtgacacagaagagcttccagaatttaagagttttgaggaactagaacctcccaaacattcaaaagtcaaacggcaaagcagcacccctagtgctcctgaactgggacagcagccggatgtcaacattagtgaatggaaggacaaacccacccacgaaattcttcaaaaactgaatgattgcagttgtctggctagccaagccatcctgctgggtatactgctcaaaagagaaggccccaacttcatcacaaaggaaggtaccgtttctgatcacattgagagagtctatagaagagctggcagccaaaaactttggtcggttgtacgccgtgcagcaagtcttttaagtaaagtagtggacagcctggccccatccattactaatgttttagtgcagggcaaacaggtaactctgggtgcctttgggcatgaagaagaagttatctctaatcctttgtctccaagagtgattcaaaacatcatctattataagtgtaacacccatgatgagagggaagcggtcattcagcaagaactggtcatccatattggctggatcatctccaataaccctgagttattcagtggcatgctgaaaatacgaatcgggtttgcaaaggccgtgtgctctcacaagagaagttcaccttggaggagggggccctttcagccatggttgagtcccctgtaggcccagtggaatgatcccaaagcatctcatatggaaactccatctcagaatcccattgggatgatctcttgccatctaacatgatgtcacctctccgtcacctggtagacactcacgacacctgtggcaaacaccctaaaatcccttcagacctacgcccacagcactcttccaccacagtaataaaggcttgggaatgctgtttctgccctagggatatcagacaacttcagataactgtcatcctgtctgtggggcttgtgatagtgcccctctgaagagtaaaaagatacttttgtgtcttctatgtttttattagacttcatcctcaataaattatactaaggcctcaacccctttaagtgaatgggccccttgcatatttgtttattagcagcagcaaatacatactcagtatgtttctttacaaatt

SEQ ID NO: 372220 - DNA, 1922 bp, Homo sapiens
agagtggcgcgcagccccgggacgcgtaagagccgctgccggctcctttttctctctcccactagggctgcccttccgacgctaaaaaagcagtggagctagggtgaaagccgccctcacgctcacttccggcaggcgcgcctcccgacagtgtcgtgcggggggcgtggcccggcattgctgacaggcggccccgggggcggtggccaaggcggcgaccggagcgcgatggcgggggcggcgggactcacggcagaagtgagctggaaggtcttggagcgaagagctcggaccaagcgctcagcttagcctgcgacgcttatgattagagccaacaatttgaaatggcctgctcacctgatgcagtcgtctctccgtcttccgctttcttaaggtctggctcagtttatgaacctcttaaaagcattaatcttccaagacctgataatgaaactctctgggataagttggaccattattacagaattgtcaagtcaacattgctgctgtatcaaagtccaactaccggtctctttcccactaaaacatgcggtggtgaccagaaggccaagatccaggacagcctatactgcgctgctggggcctgggctttggctcttgcatacaggcgaattgatgatgacaagggaaggacccatgagctggagcactcagctataaaatgcatgagaggaattctctactgctatatgcgtcaggccgataaggtccagcagtttaagcaggatccacgcccaacaacatgtcttcactctgttttcaatgtgcatacaggagatgagttgctttcctatgaggaatatggtcatcttcagataaatgcagtgtcactttatctcctttaccttgtggaaatgatttcctcaggactccagattatctacaacactgatgaggtctcttttattcaaaaccttgtattttgtgtggaaagagtttaccgtgtgcctgactttggtgtctgggaaagaggaagcaaatataataatggcagcacagagctacattcgagctcggttggtttagcaaaagcagctctagaagcaattaatggattcaacctttttggcaaccagggctgttcgtggtcagttatatttgtggatctcgatgctcacaatcgcaacaggcaaactttgtgctcgctgttacccagagaatcaagatcacataatacagatgctgccctgctcccctgcatcagttatcctgcatttgccctggatgatgaagttctttttagccagacacttgataaagtggttagaaaattaaaaggaaaatatggatttaaacgtttcttgagagatgggtatagaacatcattggaagatcccaacagatgctactacaagccagctgaaattaagctatttgatggcattgaatgtgaatttcccatatttttcctttatatgatgattgatggagtttttagaggcaatcctaagcaagtacaggaatatcaggatcttttgactccagtacttcatcataccacagaaggatatcctgttgtaccaaagtactattatgtgccagctgactttgtagaatatgaaaaaaataaccctggtagtcaaaaacgatttcctagcaactgtggccgtgatggaaaactgtttctttggggacaagcactttatatcatcgcaaaactcctggaaactctacctctatcctgatgtaattaggttaagaaaattaaaggccacggtccagaaaactaacttccacaaatgcaacaaaaggaaaaatttctccagtaacctctgtgcaatgggaaatctttcttttaagtaccaagtcaatttcttcaactgtacaatgtattctaatttgaaggttttcaaatataatatagtaacaacaaaatataataaaattaaaactatcagaaa

SEQ ID NO: 372221 - DNA, 999 bp, Homo sapiens
  misc_feature (944)..(944): n is a, c, g, or t
agagtggcgcgcagccccgggacgcgtaagagccgctgccggctcctttttctctctcccactagggctgcccttccgacgctaaaaaagcagtggagctagggtgaaagccgccctcacgctcacttccggcaggcgcgcctcccgacagtgtcgtgcggggggcgtggcccggcattgctgacaggcggccccgggggcggtggccaaggcggcgaccggagcgcgatggcgggggcggcgggactcacggcagaagtgagctggaaggtcttggagcgaagagctcggaccaagcgctcaggctcagtttatgaacctcttaaaagcattaatcttccaagacctgataatgaaactctctgggataagttggaccattattacagaattgtcaagtcaacattgctgctgtatcaaagtccaactaccggtctctttcccactaaaacatgcggtggtgaccagaaggccaagatccaggacagcctatactgcgctgctggggcctgggctttggctcttgcatacaggcgaattgatgatgacaagggaaggacccatgagctggagcactcagctataaaatgcatgagaggaattctctactgctatatgcgtcaggccgataaggtccagcagtttaagcaggatccacgcccaacaacatgtcttcactctgttttcaatgtgcatacaggagatgagttgctttcctatgaggaatatggtcatcttcagataaatgcagtgtcactttatctcctttaccttgtggaaatgatttcctcaggactccagattatctacaacactgatgaggtctcttttattcaaaaccttgtattttgtgtggaaagagtttaccgtgtgcctgactttggtgtctgggaaagaggaagcaaatataataatggcagcacagagctacattcgagctcggntggtttagcttcgtggtcgagtatatttggtgatctcgatgctcactcgcacggg

SEQ ID NO: 372222 - DNA, 564 bp, Homo sapiens
tttagtgattccgcttttaatttatagtcgtatgactaagatgttttgaatataagcctatccgtatgccagatataaatttcaggaactcttaatgtctcttttacagaaactctacctctatcctgatgtaattaggttaagaaaattaaaggccacggtccagaaaactaacttccacaaatgcaacaaaaggaaaaatttctccagtaacctctgtgcaatgggaaatctttcttttaagtaccaagtcaatttcttcaactgtacaatgtattctaatttgaaggttttcaaatataatatagtaacaacaaaatataataaaattaaaactatcagaaaacagagtaaatggtataattcaaataatgactaaaataaaatgacattatggattttgtaatcaacctataattatatatttaaattttgctttacatacataagatcacagctgaggttaaccataatttcaaattttatcaccagccacttgtgctattttatcacatttgaaaatattcactcatattatttacctcaaacagtgatctataaatt

SEQ ID NO: 372223 - DNA, 5674 bp, Homo sapiens
agagtggcgcgcagccccgggacgcgtaagagccgctgccggctcctttttctctctcccactagggctgcccttccgacgctaaaaaagcagtggagctagggtgaaagccgccctcacgctcacttccggcaggcgcgcctcccgacagtgtcgtgcggggggcgtggcccggcattgctgacaggcggccccgggggcggtggccaaggcggcgaccggagcgcgatggcgggggcggcgggactcacggcagaagtgagctggaaggtcttggagcgaagagctcggaccaagcgctcaggctcagtttatgaacctcttaaaagcattaatcttccaagacctgataatgaaactctctgggataagttggaccattattacagaattgtcaagtcaacattgctgctgtatcaaagtccaactaccggtctctttcccactaaaacatgcggtggtgaccagaaggccaagatccaggacagcctatactgcgctgctggggcctgggctttggctcttgcatacaggcgaattgatgatgacaagggaaggacccatgagctggagcactcagctataaaatgcatgagaggaattctctactgctatatgcgtcaggccgataaggtccagcagtttaagcaggatccacgcccaacaacatgtcttcactctgttttcaatgtgcatacaggagatgagttgctttcctatgaggaatatggtcatcttcagataaatgcagtgtcactttatctcctttaccttgtggaaatgatttcctcaggactccagattatctacaacactgatgaggtctcttttattcaaaaccttgtattttgtgtggaaagagtttaccgtgtgcctgactttggtgtctgggaaagaggaagcaaatataataatggcagcacagagctacattcgagctcggttggtttagcaaaagcagctctagaagcaattaatggattcaacctttttggcaaccagggctgttcgtggtcagttatatttgtggatctcgatgctcacaatcgcaacaggcaaactttgtgctcgctgttacccagagaatcaagatcacataatacagatgctgccctgctcccctgcatcagttatcctgcatttgccctggatgatgaagttctttttagccagacacttgataaagtggttagaaaattaaaaggaaaatatggatttaaacgtttcttgagagatgggtatagaacatcattggaagatcccaacagatgctactacaagccagctgaaattaagctatttgatggcattgaatgtgaatttcccatatttttcctttatatgatgattgatggagtttttagaggcaatcctaagcaagtacaggaatatcaggatcttttgactccagtacttcatcataccacagaaggatatcctgttgtaccaaagtactattatgtgccagctgactttgtagaatatgaaaaaaataaccctggtagtcaaaaacgatttcctagcaactgtggccgtgatggaaaactgtttctttggggacaagcactttatatcatcgcaaaactcctggctgatgaacttattagtcctaaagacattgatcctgtccagcgctatgtcccactaaaggatcaacgtaacgtgagcatgaggttttccaatcagggcccactggaaaatgacttggtagttcatgtggcacttatagcagaaagccaaagacttcaagtttttctgaacacatatggtattcaaactcaaactcctcaacaagtagaacccattcagatatggcctcagcaggagcttgtgaaagcttatttgcagctgggtatcaatgaaaagttaggactctctggaaggccagacaggcccattggctgcctcgggacatcaaagatttatcgcattctaggaaagactgtggtttgttacccgattattttcgacctaagtgatttctacatgtctcaggatgttttcctgctgatagatgacataaagaatgcgctgcagttcattaaacaatattggaaaatgcatggacgtccacttttccttgttctcatccgggaagacaatataagaggtagccggttcaaccccatattagatatgctggcagcccttaaaaaaggaataattggaggagtcaaagttcatgtggatcgtctacagacactaatatctggagctgtggtagaacaacttgatttcctacgaatcagtgacacagaagagcttccagaatttaagagttttgaggaactagaacctcccaaacattcaaaagtcaaacggcaaagcagcacccctagtgctcctgaactgggacagcagccggatgtcaacattagtgaatggaaggacaaacccacccacgaaattcttcaaaaactgaatgattgcagttgtctggctagccaagccatcctgctgggtatactgctcaaaagagaaggccccaacttcatcacaaaggaaggtaccgtttctgatcacattgagagagtctatagaagagctggcagccaaaaactttggtcggttgtacgccgtgcagcaagtcttttaagtaaagtagtggacagcctggccccatccattactaatgttttagtgcagggcaaacaggtaactctgggtgcctttgggcatgaagaagaagttatctctaatcctttgtctccaagagtgattcaaaacatcatctattataagtgtaacacccatgatgagagggaagcggtcattcagcaagaactggtcatccatattggctggatcatctccaataaccctgagttattcagtggcatgctgaaaatacgaatcgggtggatcatccatgccatggagtatgaacttcagatccgtggcggagacaagccagccttggacttgtatcagctgtcacctagtgaagttaaacagcttctgctggatattctgcagcctcaacagaatggaagatgttggctgaacaggcgtcagatcgatgggtctttgaatagaactcccaccgggttctatgaccgagtgtggcagattctggagcgcacgcccaatgggatcattgttgctgggaagcatttgcctcagcaaccaaccctgtcagatatgaccatgtatgagatgaatttctctctccttgttgaagacacgttgggaaatattgaccagccacagtacagacagatcgttgtagagttacttatggttgtatccattgtactggaaagaaaccccgagctagaatttcaagacaaagtagatctagacagactggtcaaagaagcatttaatgaatttcaaaaagatcagagtcggctaaaggaaattgaaaaacaagatgacatgacttccttttacaacactcctcccctgggaaaaagaggaacatgcagctatttgacaaaggcggtgatgaatctgctgctggaaggagaagtcaagccaaacaatgatgacccgtgtctgattagctagtggggaaggtgtaggaagctctgttgagacacatgttctgaagtgtgttgtgtttcatgttcaagcttaatcaaggcagccattaatatacgaactgagcatgctggggaggtgaatgccacatccttggcggggttatggacctcttgcatgtcatagccaatctaacggtaatggtaaatgcttttaatcaagcaggaaaaagttctcatgattatgccaactataatagtaatcctcactgagtgataaaaatagtttatgaattgaaaatttgccgctgcatgttgtatgatcaaatagttcatcaaaatgaatctttgctctttggactgaattcttaccatactgccattaaaataaatttgccaactagtaatgcatactggaaatcaaaagatactgaaagaatggtgaacttctcttagtggtattgtcatgctaaaagatgttaatatacatcataaaagcaaagtcagccagctgatattttggttctcaaaaactgcattattaataatattttagtatacagagctattctacagtttttacattgtaaacatgactgtggttttgtatttgctaaatataggggttggactaaaatataataaatctgtaccttatcaaacattttctttgagctcctgctaaaaataggacatgtctatgattgttcaaaaatatgttaaatttaggctcagcacagtagctcacacctgaaatcttagcacttcgggaggctgaggcaggtggatcacttgaggttaggagttcaagaccagcccagccaacatggtgaaaaccctgtctctactaaaaatacaaaaattagccaggcatgatggtgcatgcctttaaacccagctactgaggaggctgaggcatgagaattgcttgaaccaggagacggaggttgcagtgagctgaaatcctgccactgcacaccagcctgggtgacagagcgagactccatctcaaaaaaaaaaaaaaaaaagaaaaagaaaaaaatatgttaaatttaaggactgttaacctacgttctactagtaaaaacaacattaagggtcattaaattttatttctgaattaatgaacatatctggacattttttgttcctaggttcacaagattgagcttcaaactcccgagtgttttcatttaattgatttagaggtagaatggaagagaatctgtggtacctaccattatacacatttagttgcccagtttacttaaactttaatgaaagtagaaagtagattaaacatttaaattttatttctttcctaaatagaaaaaaaaaaggcccatgagtttgagcccttgccccaaagagagttgtttttctgatcaatcttactggagtttcacctgagaagatagatttgtcacataaaaaatgcagcttatttgtagtgttttgaaaggatgtaagaaaggatgagtggcttcagtattgagtcaatcgatatcaaatgaatggatgtgtgagcacatggaaaaatctgctgtcagtcacatttctcataacattgaggtacagtgccgagatcttgcataagaaattgtatggatattagttggcaaaattgaaatgaatgagacacagttgggccctaaagaactaaggagggggattgacaaagaatagaattaaactacttgactcaatatgttaagagagtttatgaaaagatagtcgtgaagggtgaagctaatttgtaaaactaatgcctgaaaaaaacataagcatgaagtccatggagagggaattgagagctgacacttcataactggagaaactggaaattaaagaaagggaaacaaaagacttaaaatttttgtttgccgaaatttttacgaaagtaaactgtgttgtagttttaagaatttttttaaaaaatctgattagctgagcaaagttaccagaaaactgctatcctagttgaaatcaaacattacttgcaaatgtgttttctgagtgttagcttcctgcttaaatgttacatatgcaaaattctgaagttttcctgtgctactcctgaaagcattcagaatctgtgacacgtattgacttcatgctttgagattcaaaatttattgttctgaaagttatatttagaatcagtaaatcttgatattcacctttaaaaaagc

SEQ ID NO: 372224 - DNA, 4237 bp, Homo sapiens
agagtggcgcgcagccccgggacgcgtaagagccgctgccggctcctttttctctctcccactagggctgcccttccgacgctaaaaaagcagtggagctagggtgaaagccgccctcacgctcacttccggcaggcgcgcctcccgacagtgtcgtgcggggggcgtggcccggcattgctgacaggcggccccgggggcggtggccaaggcggcgaccggagcgcgatggcgggggcggcgggactcacggcagaagtgagctggaaggtcttggagcgaagagctcggaccaagcgctcagcttagcctgcgacgcttatgattagagccaacaatttgaaatggcctgctcacctgatgcagtcgtctctccgtcttccgctttcttaaggtctggctcagtttatgaacctcttaaaagcattaatcttccaagacctgataatgaaactctctgggataagttggaccattattacagaattgtcaagtcaacattgctgctgtatcaaagtccaactaccggtctctttcccactaaaacatgcggtggtgaccagaaggccaagatccaggacagcctatactgcgctgctggggcctgggctttggctcttgcatacaggcgaattgatgatgacaagggaaggacccatgagctggagcactcagctataaaatgcatgagaggaattctctactgctatatgcgtcaggccgataaggtccagcagtttaagcaggatccacgcccaacaacatgtcttcactctgttttcaatgtgcatacaggagatgagttgctttcctatgaggaatatggtcatcttcagataaatgcagtgtcactttatctcctttaccttgtggaaatgatttcctcaggactccagattatctacaacactgatgaggtctcttttattcaaaaccttgtattttgtgtggaaagagtttaccgtgtgcctgactttggtgtctgggaaagaggaagcaaatataataatggcagcacagagctacattcgagctcggttggtttagcaaaagcagctctagaagcaattaatggattcaacctttttggcaaccagggctgttcgtggtcagttatatttgtggatctcgatgctcacaatcgcaacaggcaaactttgtgctcgctgttacccagagaatcaagatcacataatacagatgctgccctgctcccctgcatcagttatcctgcatttgccctggatgatgaagttctttttagccagacacttgataaagtggttagaaaattaaaaggaaaatatggatttaaacgtttcttgagagatgggtatagaacatcattggaagatcccaacagatgctactacaagccagctgaaattaagctatttgatggcattgaatgtgaatttcccatatttttcctttatatgatgattgatggagtttttagaggcaatcctaagcaagtacaggaatatcaggatcttttgactccagtacttcatcataccacagaaggatatcctgttgtaccaaagtactattatgtgccagctgactttgtagaatatgaaaaaaataaccctggtagtcaaaaacgatttcctagcaactgtggccgtgatggaaaactgtttctttggggacaagcactttatatcatcgcaaaactcctggctgatgaacttattagtcctaaagacattgatcctgtccagcgctatgtcccactaaaggatcaacgtaacgtgagcatgaggttttccaatcagggcccactggaaaatgacttggtagttcatgtggcacttatagcagaaagccaaagacttcaagtttttctgaacacatatggtattcaaactcaaactcctcaacaagtagaacccattcagatatggcctcagcaggagcttgtgaaagcttatttgcagctgggtatcaatgaaaagttaggactctctggaaggccagacaggcccattggctgcctcgggacatcaaagatttatcgcattctaggaaagactgtggtttgttacccgattattttcgacctaagtgatttctacatgtctcaggatgttttcctgctgatagatgacataaagaatgcgctgcagttcattaaacaatattggaaaatgcatggacgtccacttttccttgttctcatccgggaagacaatataagaggtagccggttcaaccccatattagatatgctggcagcccttaaaaaaggaataattggaggagtcaaagttcatgtggatcgtctacagacactaatatctggagctgtggtagaacaacttgatttcctacgaatcagtgacacagaagagcttccagaatttaagagttttgaggaactagaacctcccaaacattcaaaagtcaaacggcaaagcagcacccctagtgctcctgaactgggacagcagccggatgtcaacattagtgaatggaaggacaaacccacccacgaaattcttcaaaaactgaatgattgcagttgtctggctagccaagccatcctgctgggtatactgctcaaaagagaaggccccaacttcatcacaaaggaaggtaccgtttctgatcacattgagagagtctatagaagagctggcagccaaaaactttggtcggttgtacgccgtgcagcaagtcttttaagtaaagtagtggacagcctggccccatccattactaatgttttagtgcagggcaaacaggtaactctgggtgcctttgggcatgaagaagaagttatctctaatcctttgtctccaagagtgattcaaaacatcatctattataagtgtaacacccatgatgagagggaagcggtcattcagcaagaactggtcatccatattggctggatcatctccaataaccctgagttattcagtggcatgctgaaaatacgaatcgggtggatcatccatgccatggagtatgaacttcagatccgtggcggagacaagccagccttggacttgtatcagctgtcacctagtgaagttaaacagcttctgctggatattctgcagcctcaacagaatggaagatgttggctgaacaggcgtcagatcgatgggtctttgaatagaactcccaccgggttctatgaccgagtgtggcagattctggagcgcacgcccaatgggatcattgttgctgggaagcatttgcctcagcaaccaaccctgtcagatatgaccatgtatgagatgaatttctctctccttgttgaagacacgttgggaaatattgaccagccacagtacagacagatcgttgtagagttacttatggttgtatccattgtactggaaagaaaccccgagctagaatttcaagacaaagtagatctagacagactggtcaaagaagcatttaatgaatttcaaaaagatcagagtcggctaaaggaaattgaaaaacaagatgacatgacttccttttacaacactcctcccctgggaaaaagaggaacatgcagctatttgacaaaggcggtgatgaatctgctgctggaaggagaagtcaagccaaacaatgatgacccgtgtctgattagctagtggggaaggtgtaggaagctctgttgagacacatgttctgaagtgtgttgtgtttcatgttcaagcttaatcaaggcagccattaatatacgaactgagcatgctggggaggtgaatgccacatccttggcggggttatggacctcttgcatgtcatagccaatctaacggtaatggtaaatgcttttaatcaagcaggaaaaagttctcatgattatgccaactataatagtaatcctcactgagtgataaaaatagtttatgaattgaaaatttgccgctgcatgttgtatgatcaaatagttcatcaaaatgaatctttgctctttggactgaattcttaccatactgccattaaaataaatttgccaactagtaatgcatactggaaatcaaaagatactgaaagaatggtgaacttctcttagtggtattgtcatgctaaaagatgttaatatacatcataaaagcaaagtcagccagctgatattttggttctcaaaaactgcattattaataatattttagtatacagagctattctacagtttttacattgtaaacatgactgtggttttgtatttgctaaatataggggttggactaaaatataataaatctgtaccttatca

SEQ ID NO: 372225 - DNA, 3684 bp, Homo sapiens
cccttgcgtcttcagcagcattctgcccagagtttttttggccatttcactctatgctgtctcctgtcccaggctgtgggcagcctgttccttcccctccacaggtgagagatctgtcaccacatattttaaccctcaccaggcaccttgcattatgcccagaaaaatgagggctacacaggaactgggtgcctcacacctgcctttgaaaggttatagtgttgctgaggcaaaaggatctgcctgagaaactataaaagaatcaaaaagtttatctctcaaataccaaattgtgtagactgcagtaaagtgaaactcttcaacctattctggtttctctggggagtttctagtactaaagtcattcagaataattttaacttaatttatattccttccctgcttttatccactcacctccactcccctaactggaaccctcacctgcccttatattttagactagactgtgaaccatcatgaattccagtgggagtcatgctttgaaagccattttaataaataccaggaacagttattctacctaattccctagcttatatagagtaatttcagcctgccagtcattctgagccttgatttttttttaatttttatcttttagtagctaggagaattttacaataaaattctgccacttgtaggtaactctgggtgcctttgggcatgaagaagaagttatctctaatcctttgtctccaagagtgattcaaaacatcatctattataagtgtaacacccatgatgagagggaagcggtcattcagcaagaactggtcatccatattggctggatcatctccaataaccctgagttattcagtggcatgctgaaaatacgaatcgggtggatcatccatgccatggagtatgaacttcagatccgtggcggagacaagccagccttggacttgtatcagctgtcacctagtgaagttaaacagcttctgctggatattctgcagcctcaacagaatggaagatgttggctgaacaggcgtcagatcgatgggtctttgaatagaactcccaccgggttctatgaccgagtgtggcagattctggagcgcacgcccaatgggatcattgttgctgggaagcatttgcctcagcaaccaaccctgtcagatatgaccatgtatgagatgaatttctctctccttgttgaagacacgttgggaaatattgaccagccacagtacagacagatcgttgtagagttacttatggttgtatccattgtactggaaagaaaccccgagctagaatttcaagacaaagtagatctagacagactggtcaaagaagcatttaatgaatttcaaaaagatcagagtcggctaaaggaaattgaaaaacaagatgacatgacttccttttacaacactcctcccctgggaaaaagaggaacatgcagctatttgacaaaggcggtgatgaatctgctgctggaaggagaagtcaagccaaacaatgatgacccgtgtctgattagctagtggggaaggtgtaggaagctctgttgagacacatgttctgaagtgtgttgtgtttcatgttcaagcttaatcaaggcagccattaatatacgaactgagcatgctggggaggtgaatgccacatccttggcggggttatggacctcttgcatgtcatagccaatctaacggtaatggtaaatgcttttaatcaagcaggaaaaagttctcatgattatgccaactataatagtaatcctcactgagtgataaaaatagtttatgaattgaaaatttgccgctgcatgttgtatgatcaaatagttcatcaaaatgaatctttgctctttggactgaattcttaccatactgccattaaaataaatttgccaactagtaatgcatactggaaatcaaaagatactgaaagaatggtgaacttctcttagtggtattgtcatgctaaaagatgttaatatacatcataaaagcaaagtcagccagctgatattttggttctcaaaaactgcattattaataatattttagtatacagagctattctacagtttttacattgtaaacatgactgtggttttgtatttgctaaatataggggttggactaaaatataataaatctgtaccttatcaaacattttctttgagctcctgctaaaaataggacatgtctatgattgttcaaaaatatgttaaatttaggctcagcacagtagctcacacctgaaatcttagcacttcgggaggctgaggcaggtggatcacttgaggttaggagttcaagaccagcccagccaacatggtgaaaaccctgtctctactaaaaatacaaaaattagccaggcatgatggtgcatgcctttaaacccagctactgaggaggctgaggcatgagaattgcttgaaccaggagacggaggttgcagtgagctgaaatcctgccactgcacaccagcctgggtgacagagcgagactccatctcaaaaaaaaaaaaaaaaaagaaaaagaaaaaaatatgttaaatttaaggactgttaacctacgttctactagtaaaaacaacattaagggtcattaaattttatttctgaattaatgaacatatctggacattttttgttcctaggttcacaagattgagcttcaaactcccgagtgttttcatttaattgatttagaggtagaatggaagagaatctgtggtacctaccattatacacatttagttgcccagtttacttaaactttaatgaaagtagaaagtagattaaacatttaaattttatttctttcctaaatagaaaaaaaaaaggcccatgagtttgagcccttgccccaaagagagttgtttttctgatcaatcttactggagtttcacctgagaagatagatttgtcacataaaaaatgcagcttatttgtagtgttttgaaaggatgtaagaaaggatgagtggcttcagtattgagtcaatcgatatcaaatgaatggatgtgtgagcacatggaaaaatctgctgtcagtcacatttctcataacattgaggtacagtgccgagatcttgcataagaaattgtatggatattagttggcaaaattgaaatgaatgagacacagttgggccctaaagaactaaggagggggattgacaaagaatagaattaaactacttgactcaatatgttaagagagtttatgaaaagatagtcgtgaagggtgaagctaatttgtaaaactaatgcctgaaaaaaacataagcatgaagtccatggagagggaattgagagctgacacttcataactggagaaactggaaattaaagaaagggaaacaaaagacttaaaatttttgtttgccgaaatttttacgaaagtaaactgtgttgtagttttaagaatttttttaaaaaatctgattagctgagcaaagttaccagaaaactgctatcctagttgaaatcaaacattacttgcaaatgtgttttctgagtgttagcttcctgcttaaatgttacatatgcaaaattctgaagttttcctgtgctactcctgaaagcattcagaatctgtgacacgtattgacttcatgctttgagattcaaaatttattgttctgaaagttatatttagaatcagtaaatcttgatattcacctttaaaaaagc

SEQ ID NO: 372226 - DNA, 5710 bp, Homo sapiens
agagtggcgcgcagccccgggacgcgtaagagccgctgccggctcctttttctctctcccactagggctgcccttccgacgctaaaaaagcagtggagctagggtgaaagccgccctcacgctcacttccggcaggcgcgcctcccgacagtgtcgtgcggggggcgtggcccggcattgctgacaggcggccccgggggcggtggccaaggcggcgaccggagcgcgatggcgggggcggcgggactcacggcagaagtgagctggaaggtcttggagcgaagagctcggaccaagcgctcagcttagcctgcgacgcttatgattagagccaacaatttgaaatggcctgctcacctgatgcagtcgtctctccgtcttccgctttcttaaggtctggctcagtttatgaacctcttaaaagcattaatcttccaagacctgataatgaaactctctgggataagttggaccattattacagaattgtcaagtcaacattgctgctgtatcaaagtccaactaccggtctctttcccactaaaacatgcggtggtgaccagaaggccaagatccaggacagcctatactgcgctgctggggcctgggctttggctcttgcatacaggcgaattgatgatgacaagggaaggacccatgagctggagcactcagctataaaatgcatgagaggaattctctactgctatatgcgtcaggccgataaggtccagcagtttaagcaggatccacgcccaacaacatgtcttcactctgttttcaatgtgcatacaggagatgagttgctttcctatgaggaatatggtcatcttcagataaatgcagtgtcactttatctcctttaccttgtggaaatgatttcctcaggactccagattatctacaacactgatgaggtctcttttattcaaaaccttgtattttgtgtggaaagagtttaccgtgtgcctgactttggtgtctgggaaagaggaagcaaatataataatggcagcacagagctacattcgagctcggttggtttagcaaaagcagctctagaagcaattaatggattcaacctttttggcaaccagggctgttcgtggtcagttatatttgtggatctcgatgctcacaatcgcaacaggcaaactttgtgctcgctgttacccagagaatcaagatcacataatacagatgctgccctgctcccctgcatcagttatcctgcatttgccctggatgatgaagttctttttagccagacacttgataaagtggttagaaaattaaaaggaaaatatggatttaaacgtttcttgagagatgggtatagaacatcattggaagatcccaacagatgctactacaagccagctgaaattaagctatttgatggcattgaatgtgaatttcccatatttttcctttatatgatgattgatggagtttttagaggcaatcctaagcaagtacaggaatatcaggatcttttgactccagtacttcatcataccacagaaggatatcctgttgtaccaaagtactattatgtgccagctgactttgtagaatatgaaaaaaataaccctggtagtcaaaaacgatttcctagcaactgtggccgtgatggaaaactgtttctttggggacaagcactttatatcatcgcaaaactcctggctgatgaacttattagtcctaaagacattgatcctgtccagcgctatgtcccactaaaggatcaacgtaacgtgagcatgaggttttccaatcagggcccactggaaaatgacttggtagttcatgtggcacttatagcagaaagccaaagacttcaagtttttctgaacacatatggtattcaaactcaaactcctcaacaagtagaacccattcagatatggcctcagcaggagcttgtgaaagcttatttgcagctgggtatcaatgaaaagttaggactctctggaaggccagacaggcccattggctgcctcgggacatcaaagatttatcgcattctaggaaagactgtggtttgttacccgattattttcgacctaagtgatttctacatgtctcaggatgttttcctgctgatagatgacataaagaatgcgctgcagttcattaaacaatattggaaaatgcatggacgtccacttttccttgttctcatccgggaagacaatataagaggtagccggttcaaccccatattagatatgctggcagcccttaaaaaaggaataattggaggagtcaaagttcatgtggatcgtctacagacactaatatctggagctgtggtagaacaacttgatttcctacgaatcagtgacacagaagagcttccagaatttaagagttttgaggaactagaacctcccaaacattcaaaagtcaaacggcaaagcagcacccctagtgctcctgaactgggacagcagccggatgtcaacattagtgaatggaaggacaaacccacccacgaaattcttcaaaaactgaatgattgcagttgtctggctagccaagccatcctgctgggtatactgctcaaaagagaaggccccaacttcatcacaaaggaaggtaccgtttctgatcacattgagagagtctatagaagagctggcagccaaaaactttggtcggttgtacgccgtgcagcaagtcttttaagtaaagtagtggacagcctggccccatccattactaatgttttagtgcagggcaaacaggtaactctgggtgcctttgggcatgaagaagaagttatctctaatcctttgtctccaagagtgattcaaaacatcatctattataagtgtaacacccatgatgagagggaagcggtcattcagcaagaactggtcatccatattggctggatcatctccaataaccctgagttattcagtggcatgctgaaaatacgaatcgggtggatcatccatgccatggagtatgaacttcagatccgtggcggagacaagccagccttggacttgtatcagctgtcacctagtgaagttaaacagcttctgctggatattctgcagcctcaacagaatggaagatgttggctgaacaggcgtcagatcgatgggtctttgaatagaactcccaccgggttctatgaccgagtgtggcagattctggagcgcacgcccaatgggatcattgttgctgggaagcatttgcctcagcaaccaaccctgtcagatatgaccatgtatgagatgaatttctctctccttgttgaagacacgttgggaaatattgaccagccacagtacagacagatcgttgtagagttacttatggttgtatccattgtactggaaagaaaccccgagctagaatttcaagacaaagtagatctagacagactggtcaaagaagcatttaatgaatttcaaaaagatcagagtcggctaaaggaaattgaaaaacaagatgacatgacttccttttacaacactcctcccctgggaagtcaagccaaacaatgatgacccgtgtctgattagctagtggggaaggtgtaggaagctctgttgagacacatgttctgaagtgtgttgtgtttcatgttcaagcttaatcaaggcagccattaatatacgaactgagcatgctggggaggtgaatgccacatccttggcggggttatggacctcttgcatgtcatagccaatctaacggtaatggtaaatgcttttaatcaagcaggaaaaagttctcatgattatgccaactataatagtaatcctcactgagtgataaaaatagtttatgaattgaaaatttgccgctgcatgttgtatgatcaaatagttcatcaaaatgaatctttgctctttggactgaattcttaccatactgccattaaaataaatttgccaactagtaatgcatactggaaatcaaaagatactgaaagaatggtgaacttctcttagtggtattgtcatgctaaaagatgttaatatacatcataaaagcaaagtcagccagctgatattttggttctcaaaaactgcattattaataatattttagtatacagagctattctacagtttttacattgtaaacatgactgtggttttgtatttgctaaatataggggttggactaaaatataataaatctgtaccttatcaaacattttctttgagctcctgctaaaaataggacatgtctatgattgttcaaaaatatgttaaatttaggctcagcacagtagctcacacctgaaatcttagcacttcgggaggctgaggcaggtggatcacttgaggttaggagttcaagaccagcccagccaacatggtgaaaaccctgtctctactaaaaatacaaaaattagccaggcatgatggtgcatgcctttaaacccagctactgaggaggctgaggcatgagaattgcttgaaccaggagacggaggttgcagtgagctgaaatcctgccactgcacaccagcctgggtgacagagcgagactccatctcaaaaaaaaaaaaaaaaaagaaaaagaaaaaaatatgttaaatttaaggactgttaacctacgttctactagtaaaaacaacattaagggtcattaaattttatttctgaattaatgaacatatctggacattttttgttcctaggttcacaagattgagcttcaaactcccgagtgttttcatttaattgatttagaggtagaatggaagagaatctgtggtacctaccattatacacatttagttgcccagtttacttaaactttaatgaaagtagaaagtagattaaacatttaaattttatttctttcctaaatagaaaaaaaaaaggcccatgagtttgagcccttgccccaaagagagttgtttttctgatcaatcttactggagtttcacctgagaagatagatttgtcacataaaaaatgcagcttatttgtagtgttttgaaaggatgtaagaaaggatgagtggcttcagtattgagtcaatcgatatcaaatgaatggatgtgtgagcacatggaaaaatctgctgtcagtcacatttctcataacattgaggtacagtgccgagatcttgcataagaaattgtatggatattagttggcaaaattgaaatgaatgagacacagttgggccctaaagaactaaggagggggattgacaaagaatagaattaaactacttgactcaatatgttaagagagtttatgaaaagatagtcgtgaagggtgaagctaatttgtaaaactaatgcctgaaaaaaacataagcatgaagtccatggagagggaattgagagctgacacttcataactggagaaactggaaattaaagaaagggaaacaaaagacttaaaatttttgtttgccgaaatttttacgaaagtaaactgtgttgtagttttaagaatttttttaaaaaatctgattagctgagcaaagttaccagaaaactgctatcctagttgaaatcaaacattacttgcaaatgtgttttctgagtgttagcttcctgcttaaatgttacatatgcaaaattctgaagttttcctgtgctactcctgaaagcattcagaatctgtgacacgtattgacttcatgctttgagattcaaaatttattgttctgaaagttatatttagaatcagtaaatcttgatattcacctttaaaaaagc

SEQ ID NO: 372227 - DNA, 2712 bp, Homo sapiens
tcaactctgagacatttgccttttgttacagatgttggctgaacaggcgtcagatcgatgggtctttgaatagaactcccaccgggttctatgaccgagtgtggcagattctggagcgcacgcccaatgggatcattgttgctgggaagcatttgcctcagcaaccaaccctgtcagatatgaccatgtatgagatgaatttctctctccttgttgaagacacgttgggaaatattgaccagccacagtacagacagatcgttgtagagttacttatggttgtatccattgtactggaaagaaaccccgagctagaatttcaagacaaagtagatctagacagactggtcaaagaagcatttaatgaatttcaaaaagatcagagtcggctaaaggaaattgaaaaacaagatgacatgacttccttttacaacactcctcccctgggaaaaagaggaacatgcagctatttgacaaaggcggtgatgaatctgctgctggaaggagaagtcaagccaaacaatgatgacccgtgtctgattagctagtggggaaggtgtaggaagctctgttgagacacatgttctgaagtgtgttgtgtttcatgttcaagcttaatcaaggcagccattaatatacgaactgagcatgctggggaggtgaatgccacatccttggcggggttatggacctcttgcatgtcatagccaatctaacggtaatggtaaatgcttttaatcaagcaggaaaaagttctcatgattatgccaactataatagtaatcctcactgagtgataaaaatagtttatgaattgaaaatttgccgctgcatgttgtatgatcaaatagttcatcaaaatgaatctttgctctttggactgaattcttaccatactgccattaaaataaatttgccaactagtaatgcatactggaaatcaaaagatactgaaagaatggtgaacttctcttagtggtattgtcatgctaaaagatgttaatatacatcataaaagcaaagtcagccagctgatattttggttctcaaaaactgcattattaataatattttagtatacagagctattctacagtttttacattgtaaacatgactgtggttttgtatttgctaaatataggggttggactaaaatataataaatctgtaccttatcaaacattttctttgagctcctgctaaaaataggacatgtctatgattgttcaaaaatatgttaaatttaggctcagcacagtagctcacacctgaaatcttagcacttcgggaggctgaggcaggtggatcacttgaggttaggagttcaagaccagcccagccaacatggtgaaaaccctgtctctactaaaaatacaaaaattagccaggcatgatggtgcatgcctttaaacccagctactgaggaggctgaggcatgagaattgcttgaaccaggagacggaggttgcagtgagctgaaatcctgccactgcacaccagcctgggtgacagagcgagactccatctcaaaaaaaaaaaaaaaaaagaaaaagaaaaaaatatgttaaatttaaggactgttaacctacgttctactagtaaaaacaacattaagggtcattaaattttatttctgaattaatgaacatatctggacattttttgttcctaggttcacaagattgagcttcaaactcccgagtgttttcatttaattgatttagaggtagaatggaagagaatctgtggtacctaccattatacacatttagttgcccagtttacttaaactttaatgaaagtagaaagtagattaaacatttaaattttatttctttcctaaatagaaaaaaaaaaggcccatgagtttgagcccttgccccaaagagagttgtttttctgatcaatcttactggagtttcacctgagaagatagatttgtcacataaaaaatgcagcttatttgtagtgttttgaaaggatgtaagaaaggatgagtggcttcagtattgagtcaatcgatatcaaatgaatggatgtgtgagcacatggaaaaatctgctgtcagtcacatttctcataacattgaggtacagtgccgagatcttgcataagaaattgtatggatattagttggcaaaattgaaatgaatgagacacagttgggccctaaagaactaaggagggggattgacaaagaatagaattaaactacttgactcaatatgttaagagagtttatgaaaagatagtcgtgaagggtgaagctaatttgtaaaactaatgcctgaaaaaaacataagcatgaagtccatggagagggaattgagagctgacacttcataactggagaaactggaaattaaagaaagggaaacaaaagacttaaaatttttgtttgccgaaatttttacgaaagtaaactgtgttgtagttttaagaatttttttaaaaaatctgattagctgagcaaagttaccagaaaactgctatcctagttgaaatcaaacattacttgcaaatgtgttttctgagtgttagcttcctgcttaaatgttacatatgcaaaattctgaagttttcctgtgctactcctgaaagcattcagaatctgtgacacgtattgacttcatgctttgagattcaaaatttattgttctgaaagttatatttagaatcagtaaatcttgatattcacctttaaaaaagc

SEQ ID NO: 372228 - DNA, 2076 bp, Homo sapiens
agagtggcgcgcagccccgggacgcgtaagagccgctgccggctcctttttctctctcccactagggctgcccttccgacgctaaaaaagcagtggagctagggtgaaagccgccctcacgctcacttccggcaggcgcgcctcccgacagtgtcgtgcggggggcgtggcccggcattgctgacaggcggccccgggggcggtggccaaggcggcgaccggagcgcgatggcgggggcggcgggactcacggcagaagtgagctggaaggtcttggagcgaagagctcggaccaagcgctcagcttagcctgcgacgcttatgattagagccaacaatttgaaatggcctgctcacctgatgcagtcgtctctccgtcttccgctttcttaaggtctggctcagtttatgaacctcttaaaagcattaatcttccaagacctgataatgaaactctctgggataagttggaccattattacagaattgtcaagtcaacattgctgctgtatcaaagtccaactaccggtctctttcccactaaaacatgcggtggtgaccagaaggccaagatccaggacagcctatactgcgctgctggggcctgggctttggctcttgcatacaggcgaattgatgatgacaagggaaggacccatgagctggagcactcagctataaaatgcatgagaggaattctctactgctatatgcgtcaggccgataaggtccagcagtttaagcaggatccacgcccaacaacatgtcttcactctgttttcaatgtgcatacaggagatgagttgctttcctatgaggaatatggtcatcttcagataaatgcagtgtcactttatctcctttaccttgtggaaatgatttcctcaggactccagattatctacaacactgatgaggtctcttttattcaaaaccttgtattttgtgtggaaagagtttaccgtgtgcctgactttggtgtctgggaaagaggaagcaaatataataatggcagcacagagctacattcgagctcggttggtttagcaaaagcagctctagaagcaattaatggattcaacctttttggcaaccagggctgttcgtggtcagttatatttgtggatctcgatgctcacaatcgcaacaggcaaactttgtgctcgctgttacccagagaatcaagatcacataatacagatgctgccctgctcccctgcatcagttatcctgcatttgccctggatgatgaagttctttttagccagacacttgataaagtggttagaaaattaaaaggaaaatatggatttaaacgtttcttgagagatgggtatagaacatcattggaagatcccaacagatgctactacaagccagctgaaattaagctatttgatggcattgaatgtgaatttcccatatttttcctttatatgatgattgatggagtttttagaggcaatcctaagcaagtacaggaatatcaggatcttttgactccagtacttcatcataccacagaaggatatcctgttgtaccaaagtactattatgtgccagctgactttgtagaatatgaaaaaaataaccctggtagtcaaaaacgatttcctagcaactgtggccgtgatggaaaactgtttctttggggacaagcactttatatcatcgcaaaactcctggctgatgaacttattagtcctaaagacattgatcctgtccagcgctatgtcccactaaaggatcaacgtaacgtgagcatgaggttttccaatcaggtagacaacgtgagtctcagagaggtttagtaatctctccaaggtcccacagttgtcaagtgacagaaccaatatgaaggcgttaactgaagaatgaaaggaaggagggaatgtcaagcatttggaagcagtgatttttgtaatggtgtgaaggagttaacaggagaaatagcttgttcttgaacagcctggctgaatatcacatcataggaacacagttgcaccggtgccttaggatgctgagagttctgtgaaagtgatctgaaaaattaaacacaaagatgccccatcagta

SEQ ID NO: 372229 - DNA, 1014 bp, Homo sapiens
taatttaggaaatgtttttctttttctctgtccagggctgttcgtggtcagttatatttgtggatctcgatgctcacaatcgcaacaggcaaactttgtgctcgctgttacccagagaatcaagatcacataatacagatgctgccctgctcccctgcatcagttatcctgcatttgccctggatgatgaagttctttttagccagacacttgataaagtggttagaaaattaaaaggaaaatatggatttaaacgtttcttgagagatgggtatagaacatcattggaagatcccaacagatgctactacaagccagctgaaattaagctatttgatggcattgaatgtgaatttcccatatttttcctttatatgatgattgatggagtttttagaggcaatcctaagcaagtacaggaatatcaggatcttttgactccagtacttcatcataccacagaaggatatcctgttgtaccaaagtactattatgtgccagctgactttgtagaatatgaaaaaaataaccctggtagtcaaaaacgatttcctagcaactgtggccgtgatggaaaactgtttctttggggacaagcactttatatcatcgcaaaactcctggctgatgaacttattagtcctaaagacattgatcctgtccagcgctatgtcccactaaaggatcaacgtaacgtgagcatgaggttttccaatcaggtagacaacgtgagtctcagagaggtttagtaatctctccaaggtcccacagttgtcaagtgacagaaccaatatgaaggcgttaactgaagaatgaaaggaaggagggaatgtcaagcatttggaagcagtgatttttgtaatggtgtgaaggagttaacaggagaaatagcttgttcttgaacagcctggctgaatatcacatcataggaacacagttgcaccggtgccttaggatgctgagagttctgtgaaagtgatctgaaaaattaaacacaaagatgccccatcagta

SEQ ID NO: 372230 - DNA, 915 bp, Homo sapiens
  misc_feature (776)..(776): n is a, c, g, or t
  misc_feature (781)..(781): n is a, c, g, or t
  misc_feature (794)..(797): n is a, c, g, or t
  misc_feature (802)..(802): n is a, c, g, or t
  misc_feature (814)..(814): n is a, c, g, or t
  misc_feature (822)..(822): n is a, c, g, or t
  misc_feature (827)..(827): n is a, c, g, or t
  misc_feature (830)..(830): n is a, c, g, or t
  misc_feature (837)..(837): n is a, c, g, or t
cggacgcgtgggtcgacccacgcgtcgcaggattactgtgtgtttaattttttaaaaactgaacactgtgattatggggttttgtaatttagcagaactcttactggtagaaaaaatagacctgaattatgtgtaactttttggaaggtttaatctgatatcaaaataatcattgaaatacaattccattgtaaagttgtacagaaagttatagagattatattgtgatgctggaacttggagtgagacacacatcatttggcatttgagttgaatggtaattcacagtaatgctgccgttgttcgggacttaaagacacttgacctgtttgggctgttgccacttaaaagttcatgaccacaaatgtccacagtgtcttcctctgaggaaactcgaatcctgaaatggaaattctttgtggcagataactggcttatgacaccttgaaaagttcaagtgctcatataacacaccacactgaaccccctttcctacagcaatatgttcactatgttaccaatttgcaacttgtgcttcaatagtggaatctactttcattgttaacactgagctaaagaaaaaaagccgtgtgttttatgaatgaccttatctgtttcctggataatacctttaagaataatgtcctgagtcaggcgtggtggtgcgtgcatctagtcccaactatttgggaggctgaggcaggaggatcgcttgagcccaggagtttaaagctgcagtgccctgtggttgcacctgtgaatactgactccagctnggcanatggggactctcnnnnaaagnaacaaacccaanaggatgtntctgnaanaggcttnctgggagacacaacaagactccaaccgggtaaaatggaaaaattttcccaccttgagagggccggatctacaaggctg

SEQ ID NO: 372231 - DNA, 501 bp, Homo sapiens
  misc_feature (455)..(455): n is a, c, g, or t
  misc_feature (465)..(465): n is a, c, g, or t
  misc_feature (468)..(468): n is a, c, g, or t
  misc_feature (495)..(495): n is a, c, g, or t
cttttttttttttggtttgttttaaatcagtgcataaaaaaaaaagaaaaaaacaaaaaaaaaaatccctcctttctagctgaacaaaaatgtgcagttaatacttggcgcttgaaaatgcagtagtgaatgtggaaccaagcctgtctgtatatctggtagctcttttcttgctttgttttttcttaccagtattctgcctaacgtttgcttctgtgatggttatattgcctagcaagcacacccgtggttgtgaaaatagtatagcaaaaaagaaaaatccccggttattgatgtactagatttgtgtatgtcttttaaacagttctagtttcaccttacacagaataatcaggaaaagtgtaaaaattcaaaagtgaaataaaaattttatcagttagttgcctgtgaaaaaaaaaaaaaacaaaaaaaaaaaaaaaaaaaaaaaaaaaaanaaaaaaaaanaanaaaaaagagaaaaacaaaaaaaaaaanaaacaa

SEQ ID NO: 372232 - DNA, 204 bp, Homo sapiens
gcagaatactggtaagaaaaaacaaagcaagcacacccgtggttgtgaaaatagtatagcaaaaaagaaaaatccccggttattgatgtactagatttgtgtatgtcttttaaacagttctagtttcaccttacacagaataatcaggaaaagtgtaaaaattcaaaagtgaaataaaaattttatcagttagttgcctgtgaa

SEQ ID NO: 372233 - DNA, 394 bp, Homo sapiens
  misc_feature (3)..(3): n is a, c, g, or t
  misc_feature (5)..(5): n is a, c, g, or t
gcntntgctgcctgctgtcgctctagaggatccccgccaattcctgcctttgccgatttggcatttgagttgaatggtaattcacagtaatgctgccgttgttcgggacttaaagacacttgacctgtttgggctgttgccacttaaaagttcatgaccacaaatgtccacagtgtcttcctctgaggaaactcgaatcctgaaatggaaattctttgtggcagataactggcttatgacaccttgaaaagttcaagtgctcatataacacaccacactgaaccccctttcctacagcaatatgttcactatgttaccaaatcggcaaagtgcaggaattggcgccaattcctgcactttgccgatttggcctaacctgacttgaaaagctatt

SEQ ID NO: 372234 - DNA, 2433 bp, Homo sapiens
attttcatctttatgttacaaccactgtgtcgaactcccagcaggcttaccaggaagcatttgaaattagtaagaaagaaatgcagcctacacacccaattcgtcttggtctggcactaaatttctcagtcttttactatgagattctaaactctcctgaaaaggcctgtagcctggcaaaaacggcatttgatgaagcaattgctgaattggatacgctgaatgaagagtcttataaagacagcactctgatcatgcagttacttagggacaatctcactctgtggacatcggaaaaccagggagacgaaggagacgctggggagggagagaactaatgtttctcgtgctttgtgatctgttcagtgtcactctgtaccctcaacatatatcccttgtgcgataaaaaaaaaaaaaaaaaaaaaaaagagaatcgtacgtcgactttcgatttttcacagcctcagcctaggaaaaatggttcatgggataaacagctggtatttgtatctaaaactcagattggtcacataaatgccacggcattccgaagttttgattttgattaacattgacaggattactgtgtgtttaattttttaaaaactgaacactgtgattatggggttttgtaatttagcagaactcttactggtagaaaaaatagacctgaattatgtgtaactttttggaaggtttaatctgatatcaaaataatcattgaaatacaattccattgtaaagttgtacagaaagttatagagattatattgtgatgctggaacttggagtgagacacacatcatttggcatttgagttgaatggtaattcacagtaatgctgccgttgttcgggacttaaagacacttgacctgtttgggctgttgccacttaaaagttcatgaccacaaatgtccacagtgtcttcctctgaggaaactcgaatcctgaaatggaaattctttgtggcagataactggcttatgacaccttgaaaagttcaagtgctcatataacacaccacactgaaccccctttcctacagcaatatgttcactatgttaccaatttgcaacttgtgcttcaatagtggaatctactttcattgttaacactgagctaaagaaaaaaagccgtgtgttttatgaatgaccttatctgtttcctggataatacctttaagaataatgtcctgagtcaggcgtggtggtgcgtgcatctagtcccaactatttgggaggctgaggcaggaggatcgcttgagcccaggagtttaaagctgcagtgccctgtggttgcacctgtgaataactgcactccagcctgggcaacatagcgagacctcatctccaaaaaagaaaacaaaaaacaaaaaaaggaatgatgttctgtagagatggcctttcacttgaggagtactcagttttcaggttcttcctagctcggggcttttaaattttgaaatctaaacattctttcccaccatcctttttgactgttgaccttggttttctcttctaagtttctgtccctctgcttccttactttttttcctttttgaattctatctttatctgtcttttgttcactttttaatgctatatatgggcaggggtgagagacattactgagcaccttggtgagcaagcctggctttaaagattggagaagagcttctggcaccagaaccctgtcttcctccagttctcaacacggtgttgctcttcagtcataccggaatctgaatcaaaaaagtatttttaaatatccatgatttctccctgtattgaggctagccctgatcatgctttttgtgcctgtcaccaggtctcccaagtgcactcatccaggtcagtgctcagatgtgtttaaggagaccctatattcagggaagttgcgtgaacactgcagtggggagaattgagaatagtcaggcctatcagtctcacagaatcacccctctacctttgatattccacttagctgtagagtccatctgtttgtccatctgctgaaatgagaaaagaaaaatttatgcactgatttaaaacaaaccaaaaaaaaagaaaaaaacaaaaaaaaaaatccctcctttctagctgaacaaaaatgtgcagttaatacttggcgcttgaaaatgcagtagtgaatgtggaaccaagcctgtctgtatatctggtagctcttttcttgctttgttttttcttaccagtattctgcctaacgtttgcttctgtgatggttatattgcctagcaagcacacccgtggttgtgaaaatagtatagcaaaaaagaaaaatccccggttattgatgtactagatttgtgtatgtcttttaaacagttctagtttcaccttacacagaataatcaggaaaagtgtaaaaattcaaaagtgaaataaaaattttatcagttagttgcctgtgaa

SEQ ID NO: 372235 - DNA, 2111 bp, Homo sapiens
tgggaaggaaaaaaataaaatttctccggccttgtgatctggtcaagggccccccggaccccccacaaaaattccctggggggttaaaaaaaaaaaaaaaaaaaaagagaatcgtacgtcgactttcgatttttcacagcctcagcctaggaaaaatggttcatgggataaacagctggtatttgtatctaaaactcagattggtcacataaatgccacggcattccgaagttttgattttgattaacattgacaggattactgtgtgtttaattttttaaaaactgaacactgtgattatggggttttgtaatttagcagaactcttactggtagaaaaaatagacctgaattatgtgtaactttttggaaggtttaatctgatatcaaaataatcattgaaatacaattccattgtaaagttgtacagaaagttatagagattatattgtgatgctggaacttggagtgagacacacatcatttggcatttgagttgaatggtaattcacagtaatgctgccgttgttcgggacttaaagacacttgacctgtttgggctgttgccacttaaaagttcatgaccacaaatgtccacagtgtcttcctctgaggaaactcgaatcctgaaatggaaattctttgtggcagataactggcttatgacaccttgaaaagttcaagtgctcatataacacaccacactgaaccccctttcctacagcaatatgttcactatgttaccaatttgcaacttgtgcttcaatagtggaatctactttcattgttaacactgagctaaagaaaaaaagccgtgtgttttatgaatgaccttatctgtttcctggataatacctttaagaataatgtcctgagtcaggcgtggtggtgcgtgcatctagtcccaactatttgggaggctgaggcaggaggatcgcttgagcccaggagtttaaagctgcagtgccctgtggttgcacctgtgaataactgcactccagcctgggcaacatagcgagacctcatctccaaaaaagaaaacaaaaaacaaaaaaaggaatgatgttctgtagagatggcctttcacttgaggagtactcagttttcaggttcttcctagctcggggcttttaaattttgaaatctaaacattctttcccaccatcctttttgactgttgaccttggttttctcttctaagtttctgtccctctgcttccttactttttttcctttttgaattctatctttatctgtcttttgttcactttttaatgctatatatgggcaggggtgagagacattactgagcaccttggtgagcaagcctggctttaaagattggagaagagcttctggcaccagaaccctgtcttcctccagttctcaacacggtgttgctcttcagtcataccggaatctgaatcaaaaaagtatttttaaatatccatgatttctccctgtattgaggctagccctgatcatgctttttgtgcctgtcaccaggtctcccaagtgcactcatccaggtcagtgctcagatgtgtttaaggagaccctatattcagggaagttgcgtgaacactgcagtggggagaattgagaatagtcaggcctatcagtctcacagaatcacccctctacctttgatattccacttagctgtagagtccatctgtttgtccatctgctgaaatgagaaaagaaaaatttatgcactgatttaaaacaaaccaaaaaaaaagaaaaaaacaaaaaaaaaaatccctcctttctagctgaacaaaaatgtgcagttaatacttggcgcttgaaaatgcagtagtgaatgtggaaccaagcctgtctgtatatctggtagctcttttcttgctttgttttttcttaccagtattctgcctaacgtttgcttctgtgatggttatattgcctagcaagcacacccgtggttgtgaaaatagtatagcaaaaaagaaaaatccccggttattgatgtactagatttgtgtatgtcttttaaacagttctagtttcaccttacacagaataatcaggaaaagtgtaaaaattcaaaagtgaaataaaaattttatcagttagttgcctgtgaa

SEQ ID NO: 372236 - DNA, 2748 bp, Homo sapiens
attttcatctttatgttacaaccactgtgtcgaactcccagcaggcttaccaggaagcatttgaaattagtaagaaagaaatgcagcctacacacccaattcgtcttggtctggcactaaatttctcagtcttttactatgagattctaaactctcctgaaaaggcctgtagcctggcaaaaacggcatttgatgaagcaattgctgaattggatacgctgaatgaagagtcttataaagacagcactctgatcatgcagttacttagggacaatctcactctgtggacatcggaaaaccagggagacgaaggagacgctggggagggagagaactaatgtttctcgtgctttgtgatctgttcagtgtcactctgtaccctcaacatatatcccttgtgcgataaaaaaaaaaaaaaaaaaaaaaaagagaatcgtacgtcgactttcgatttttcacagcctcagcctaggaaaaatggttcatgggataaacagctggtatttgtatctaaaactcagattggtcacataaatgccacggcattccgaagttttgattttgattaacattgacaggattactgtgtgtttaattttttaaaaactgaacactgtgattatggggttttgtaatttagcagaactcttactggtagaaaaaatagacctgaattatgtgtaactttttggaaggtttaatctgatatcaaaataatcattgaaatacaattccattgtaaagttgtacagaaagttatagagattatattgtgatgctggaacttggagtgagacacacatcatttggcatttgagttgaatggtaattcacagtaatgctgccgttgttcgggacttaaagacacttgacctgtttgggctgttgccacttaaaagttcatgaccacaaatgtccacagtgtcttcctctgaggaaactcgaatcctgaaatggaaattctttgtggcagataactggcttatgacaccttgaaaagttcaagtgctcatataacacaccacactgaaccccctttcctacagcaatatgttcactatgttaccaatttgcaacttgtgcttcaatagtggaatctactttcattgttaacactgagctaaagaaaaaaagccgtgtgttttatgaatgaccttatctgtttcctggataatacctttaagaataatgtcctgagtcaggcgtggtggtgcgtgcatctagtcccaactatttgggaggctgaggcaggaggatcgcttgagcccaggagtttaaagctgcagtgccctgtggttgcacctgtgaataactgcactccagcctgggcaacatagcgagacctcatctccaaaaaagaaaacaaaaaacaaaaaaaggaatgatgttctgtagagatggcctttcacttgaggagtactcagttttcaggttcttcctagctcggggcttttaaattttgaaatctaaacattctttcccaccatcctttttgactgttgaccttggttttctcttctaagtttctgtccctctgcttccttactttttttcctttttgaattctatctttatctgtcttttgttcactttttaatgctatatatgggcaggggtgagagacattactgagcaccttggtgagcaagcctggctttaaagattggagaagagcttctggcaccagaaccctgtcttcctccagttctcaacacggtgttgctcttcagtcataccggaatctgaatcaaaaaagtatttttaaatatccatgatttctccctgtattgaggctagccctgatcatgctttttgtgcctgtcaccaggtctcccaagtgcactcatccaggtcagtgctcagatgtgtttaaggagaccctatattcagggaagttgcgtgaacactgcagtggggagaattgagaatagtcaggcctatcagtctcacagaatcacccctctacctttgatattccacttagctgtagagtccatctgtttgtccatctgctgaaatgagaaaagaaaaatttatgcactgatttaaaacaaaccaaaaaaaaagaaaaaaacaaaaaaaaaaatccctcctttctagctgaacaaaaatgtgcagttaatacttggcgcttgaaaatgcagtagtgaatgtggaaccaagcctgtctgtatatctggtagctcttttcttgctttgttttttcttaccagtattctgcctaacgtttgcttctgtgatggttatattgcctagcaagcacacccgtggttgtgaaaatagtatagcaaaaaagaaaaatccccggttattgatgtactagatttgtgtatgtcttttaaacagttctagtttcaccttacacagaataatcaggaaaagtgtaaaaattcaaaagtgaaataaaaattttatcagttagttgcctgtgaaaaaaaaaaaaaaaaaactcggagactagtcctctctctctctcgggctaaggcagagacggtagtagcgggcgacagcgacgacgggcagcgatggctgggggcgggggccagccccggggacccccgggtgcaggaggacccggggccccgggccctgggcgctgggcatcccggggcaaaagcgggcgaggaacgcttgaagggaaatgggaggcgggagatgggccctgtttgagcaggaagttctgggggcgctccagtacctggaatcccaactggctgtgcctgcggtgcccactgtccccagggtccc

SEQ ID NO: 372237 - DNA, 2787 bp, Homo sapiens
  misc_feature (2435)..(2435): n is a, c, g, or t
  misc_feature (2444)..(2444): n is a, c, g, or t
attttcatctttatgttacaaccactgtgtcgaactcccagcaggcttaccaggaagcatttgaaattagtaagaaagaaatgcagcctacacacccaattcgtcttggtctggcactaaatttctcagtcttttactatgagattctaaactctcctgaaaaggcctgtagcctggcaaaaacggcatttgatgaagcaattgctgaattggatacgctgaatgaagagtcttataaagacagcactctgatcatgcagttacttagggacaatctcactctgtggacatcggaaaaccagggagacgaaggagacgctggggagggagagaactaatgtttctcgtgctttgtgatctgttcagtgtcactctgtaccctcaacatatatcccttgtgcgataaaaaaaaaaaaaaaaaaaaaaaagagaatcgtacgtcgactttcgatttttcacagcctcagcctaggaaaaatggttcatgggataaacagctggtatttgtatctaaaactcagattggtcacataaatgccacggcattccgaagttttgattttgattaacattgacaggattactgtgtgtttaattttttaaaaactgaacactgtgattatggggttttgtaatttagcagaactcttactggtagaaaaaatagacctgaattatgtgtaactttttggaaggtttaatctgatatcaaaataatcattgaaatacaattccattgtaaagttgtacagaaagttatagagattatattgtgatgctggaacttggagtgagacacacatcatttggcatttgagttgaatggtaattcacagtaatgctgccgttgttcgggacttaaagacacttgacctgtttgggctgttgccacttaaaagttcatgaccacaaatgtccacagtgtcttcctctgaggaaactcgaatcctgaaatggaaattctttgtggcagataactggcttatgacaccttgaaaagttcaagtgctcatataacacaccacactgaaccccctttcctacagcaatatgttcactatgttaccaatttgcaacttgtgcttcaatagtggaatctactttcattgttaacactgagctaaagaaaaaaagccgtgtgttttatgaatgaccttatctgtttcctggataatacctttaagaataatgtcctgagtcaggcgtggtggtgcgtgcatctagtcccaactatttgggaggctgaggcaggaggatcgcttgagcccaggagtttaaagctgcagtgccctgtggttgcacctgtgaataactgcactccagcctgggcaacatagcgagacctcatctccaaaaaagaaaacaaaaaacaaaaaaaggaatgatgttctgtagagatggcctttcacttgaggagtactcagttttcaggttcttcctagctcggggcttttaaattttgaaatctaaacattctttcccaccatcctttttgactgttgaccttggttttctcttctaagtttctgtccctctgcttccttactttttttcctttttgaattctatctttatctgtcttttgttcactttttaatgctatatatgggcaggggtgagagacattactgagcaccttggtgagcaagcctggctttaaagattggagaagagcttctggcaccagaaccctgtcttcctccagttctcaacacggtgttgctcttcagtcataccggaatctgaatcaaaaaagtatttttaaatatccatgatttctccctgtattgaggctagccctgatcatgctttttgtgcctgtcaccaggtctcccaagtgcactcatccaggtcagtgctcagatgtgtttaaggagaccctatattcagggaagttgcgtgaacactgcagtggggagaattgagaatagtcaggcctatcagtctcacagaatcacccctctacctttgatattccacttagctgtagagtccatctgtttgtccatctgctgaaatgagaaaagaaaaatttatgcactgatttaaaacaaaccaaaaaaaaagaaaaaaacaaaaaaaaaaatccctcctttctagctgaacaaaaatgtgcagttaatacttggcgcttgaaaatgcagtagtgaatgtggaaccaagcctgtctgtatatctggtagctcttttcttgctttgttttttcttaccagtattctgcctaacgtttgcttctgtgatggttatattgcctagcaagcacacccgtggttgtgaaaatagtatagcaaaaaagaaaaatccccggttattgatgtactagatttgtgtatgtcttttaaacagttctagtttcaccttacacagaataatcaggaaaagtgtaaaaattcaaaagtgaaataaaaattttatcagttagttgcctgtgaaanaaaaaaaanaaaaaaaaaaaaaaagggggggaggattagaaaatttccctgaaggggcccaaggaataagagataacacaggttatttgggtacaagggggccccaatatatggacacgagaattattaggcatggaccgggagcggtaatatttacacagcttcgtgcatcgggaacaatatgatagctggggaattttggggaagggaacctaccttatggggggtatgcaaaatacgggaacaaatacctacgaattaaaggtccaagggaactaatacaattaagggtacagggtgtaacaagtgaattgcgaatgtgaaaatggataagaatgaatgtgaatttacg

SEQ ID NO: 372238 - DNA, 2757 bp, Homo sapiens
attttcatctttatgttacaaccactgtgtcgaactcccagcaggcttaccaggaagcatttgaaattagtaagaaagaaatgcagcctacacacccaattcgtcttggtctggcactaaatttctcagtcttttactatgagattctaaactctcctgaaaaggcctgtagcctggcaaaaacggcatttgatgaagcaattgctgaattggatacgctgaatgaagagtcttataaagacagcactctgatcatgcagttacttagggacaatctcactctgtggacatcggaaaaccagggagacgaaggagacgctggggagggagagaactaatgtttctcgtgctttgtgatctgttcagtgtcactctgtaccctcaacatatatcccttgtgcgataaaaaaaaaaaaaaaaaaaaaaaagagaatcgtacgtcgactttcgatttttcacagcctcagcctaggaaaaatggttcatgggataaacagctggtatttgtatctaaaactcagattggtcacataaatgccacggcattccgaagttttgattttgattaacattgacaggattactgtgtgtttaattttttaaaaactgaacactgtgattatggggttttgtaatttagcagaactcttactggtagaaaaaatagacctgaattatgtgtaactttttggaaggtttaatctgatatcaaaataatcattgaaatacaattccattgtaaagttgtacagaaagttatagagattatattgtgatgctggaacttggagtgagacacacatcatttggcatttgagttgaatggtaattcacagtaatgctgccgttgttcgggacttaaagacacttgacctgtttgggctgttgccacttaaaagttcatgaccacaaatgtccacagtgtcttcctctgaggaaactcgaatcctgaaatggaaattctttgtggcagataactggcttatgacaccttgaaaagttcaagtgctcatataacacaccacactgaaccccctttcctacagcaatatgttcactatgttaccaatttgcaacttgtgcttcaatagtggaatctactttcattgttaacactgagctaaagaaaaaaagccgtgtgttttatgaatgaccttatctgtttcctggataatacctttaagaataatgtcctgagtcaggcgtggtggtgcgtgcatctagtcccaactatttgggaggctgaggcaggaggatcgcttgagcccaggagtttaaagctgcagtgccctgtggttgcacctgtgaataactgcactccagcctgggcaacatagcgagacctcatctccaaaaaagaaaacaaaaaacaaaaaaaggaatgatgttctgtagagatggcctttcacttgaggagtactcagttttcaggttcttcctagctcggggcttttaaattttgaaatctaaacattctttcccaccatcctttttgactgttgaccttggttttctcttctaagtttctgtccctctgcttccttactttttttcctttttgaattctatctttatctgtcttttgttcactttttaatgctatatatgggcaggggtgagagacattactgagcaccttggtgagcaagcctggctttaaagattggagaagagcttctggcaccagaaccctgtcttcctccagttctcaacacggtgttgctcttcagtcataccggaatctgaatcaaaaaagtatttttaaatatccatgatttctccctgtattgaggctagccctgatcatgctttttgtgcctgtcaccaggtctcccaagtgcactcatccaggtcagtgctcagatgtgtttaaggagaccctatattcagggaagttgcgtgaacactgcagtggggagaattgagaatagtcaggcctatcagtctcacagaatcacccctctacctttgatattccacttagctgtagagtccatctgtttgtccatctgctgaaatgagaaaagaaaaatttatgcactgatttaaaacaaaccaaaaaaaaagaaaaaaacaaaaaaaaaaatccctcctttctagctgaacaaaaatgtgcagttaatacttggcgcttgaaaatgcagtagtgaatgtggaaccaagcctgtctgtatatctggtagctcttttcttgctttgttttttcttaccagtattctgcctaacgtttgcttctgtgatggttatattgcctagcaagcacacccgtggttgtgaaaatagtatagcaaaaaagaaaaatccccggttattgatgtactagatttgtgtatgtcttttaaacagttctagtttcaccttacacagaataatcaggaaaagtgtaaaaattcaaaagtgaaataaaaattttatcagttagttgcctgtgaaaaaaaaaaaaaacaaaaaaaaaaaaaaaaaaaaaaaaagaataaaaaaaaaaaacaaagaaaaaaagaaaaaaaaactaaacaatcaaaacaaaaaggcgggggcgccatatacaactaccgacgcgacgaagcaatatcggataccacacccgtaatgaaaagggagcaccaaggggacaaaaaacagaggcggcgcccaaaaacgtctgagcagaaacaatccctgcactagaagcacccccgggggagcagcgcaacccaccagataccgccgagaaaaacagtggtggcaacccatcagcgaccagccgcaattaataca

SEQ ID NO: 372239 - DNA, 2403 bp, Homo sapiens
attttcatctttatgttacaaccactgtgtcgaactcccagcaggcttaccaggaagcatttgaaattagtaagaaagaaatgcagcctacacacccaattcgtcttggtctggcactaaatttctcagtcttttactatgagattctaaactctcctgaaaaggcctgtagcctggcaaaaacggcatttgatgaagcaattgctgaattggatacgctgaatgaagagtcttataaagacagcactctgatcatgcagttacttagggacaatctcactctgtggacatcggaaaaccagggagacgaaggagacgctggggagggagagaactaatgtttctcgtgctttgtgatctgttcagtgtcactctgtaccctcaacatatatcccttgtgcgataaaaaaaaaaaaaaaaaaaaaaaagagaatcgtacgtcgactttcgatttttcacagcctcagcctaggaaaaatggttcatgggataaacagctggtatttgtatctaaaactcagattggtcacataaatgccacggcattccgaagttttgattttgattaacattgacaggattactgtgtgtttaattttttaaaaactgaacactgtgattatggggttttgtaatttagcagaactcttactggtagaaaaaatagacctgaattatgtgtaactttttggaaggtttaatctgatatcaaaataatcattgaaatacaattccattgtaaagttgtacagaaagttatagagattatattgtgatgctggaacttggagtgagacacacatcatttggcatttgagttgaatggtaattcacagtaatgctgccgttgttcgggacttaaagacacttgacctgtttgggctgttgccacttaaaagttcatgaccacaaatgtccacagtgtcttcctctgaggaaactcgaatcctgaaatggaaattctttgtggcagataactggcttatgacaccttgaaaagttcaagtgctcatataacacaccacactgaaccccctttcctacagcaatatgttcactatgttaccaatttgcaacttgtgcttcaatagtggaatctactttcattgttaacactgagctaaagaaaaaaagccgtgtgttttatgaatgaccttatctgtttcctggataatacctttaagaataatgtcctgagtcaggcgtggtggtgcgtgcatctagtcccaactatttgggaggctgaggcaggaggatcgcttgagcccaggagtttaaagctgcagtgccctgtggttgcacctgtgaataactgcactccagcctgggcaacatagcgagacctcatctccaaaaaagaaaacaaaaaacaaaaaaaggaatgatgttctgtagagatggcctttcacttgaggagtactcagttttcaggttcttcctagctcggggcttttaaattttgaaatctaaacattctttcccaccatcctttttgactgttgaccttggttttctcttctaagtttctgtccctctgcttccttactttttttcctttttgaattctatctttatctgtcttttgttcactttttaatgctatatatgggcaggggtgagagacattactgagcaccttggtgagcaagcctggctttaaagattggagaagagcttctggcaccagaaccctgtcttcctccagttctcaacacggtgttgctcttcagtcataccggaatctgaatcaaaaaagtatttttaaatatccatgatttctccctgtattgaggctagccctgatcatgctttttgtgcctgtcaccaggtctcccaagtgcactcatccaggtcagtgctcagatgtgtttaaggagaccctatattcagggaagttgcgtgaacactgcagtggggagaattgagaatagtcaggcctatcagtctcacagaatcacccctctacctttgatattccacttagctgtagagtccatctgtttgtccatctgctgaaatgagaaaagaaaaatttatgcactgatttaaaacaaaccaaaaaaaaagaaaaaaacaaaaggagaatcgtgcgtcgactttcgatttttcacagactcagcctatgaaaaatggttcatgggataaacagcgtggatttgtatctaaaactcagattggtcacataaatgccacggcattccgaagttttgattttgattaacattgacaggattactgtgtggttaattttttaaaaaccgaacactgtgattatgggggtttgtaatttaacagaactcttactgtgagaaaaaatagacctgaattatgtgtaactttttggaagggttaatctgatatcattatattgtgatgctggaacttggagtgagacacacatca

SEQ ID NO: 372240 - DNA, 2379 bp, Homo sapiens
attttcatctttatgttacaaccactgtgtcgaactcccagcaggcttaccaggaagcatttgaaattagtaagaaagaaatgcagcctacacacccaattcgtcttggtctggcactaaatttctcagtcttttactatgagattctaaactctcctgaaaaggcctgtagcctggcaaaaacggcatttgatgaagcaattgctgaattggatacgctgaatgaagagtcttataaagacagcactctgatcatgcagttacttagggacaatctcactctgtggacatcggaaaaccagggagacgaaggagacgctggggagggagagaactaatgtttctcgtgctttgtgatctgttcagtgtcactctgtaccctcaacatatatcccttgtgcgataaaaaaaaaaaaaaaaaaaaaaaagagaatcgtacgtcgactttcgatttttcacagcctcagcctaggaaaaatggttcatgggataaacagctggtatttgtatctaaaactcagattggtcacataaatgccacggcattccgaagttttgattttgattaacattgacaggattactgtgtgtttaattttttaaaaactgaacactgtgattatggggttttgtaatttagcagaactcttactggtagaaaaaatagacctgaattatgtgtaactttttggaaggtttaatctgatatcaaaataatcattgaaatacaattccattgtaaagttgtacagaaagttatagagattatattgtgatgctggaacttggagtgagacacacatcatttggcatttgagttgaatggtaattcacagtaatgctgccgttgttcgggacttaaagacacttgacctgtttgggctgttgccacttaaaagttcatgaccacaaatgtccacagtgtcttcctctgaggaaactcgaatcctgaaatggaaattctttgtggcagataactggcttatgacaccttgtatgttcactatgttaccaatttgcaacttgtgcttcaatagtggaatctactttcattgttaacactgagctaaagaaaaaaagccgtgtgttttatgaatgaccttatctgtttcctggataatacctttaagaataatgtcctgagtcaggcgtggtggtgcgtgcatctagtcccaactatttgggaggctgaggcaggaggatcgcttgagcccaggagtttaaagctgcagtgccctgtggttgcacctgtgaataactgcactccagcctgggcaacatagcgagacctcatctccaaaaaagaaaacaaaaaacaaaaaaaggaatgatgttctgtagagatggcctttcacttgaggagtactcagttttcaggttcttcctagctcggggcttttaaattttgaaatctaaacattctttcccaccatcctttttgactgttgaccttggttttctcttctaagtttctgtccctctgcttccttactttttttcctttttgaattctatctttatctgtcttttgttcactttttaatgctatatatgggcaggggtgagagacattactgagcaccttggtgagcaagcctggctttaaagattggagaagagcttctggcaccagaaccctgtcttcctccagttctcaacacggtgttgctcttcagtcataccggaatctgaatcaaaaaagtatttttaaatatccatgatttctccctgtattgaggctagccctgatcatgctttttgtgcctgtcaccaggtctcccaagtgcactcatccaggtcagtgctcagatgtgtttaaggagaccctatattcagggaagttgcgtgaacactgcagtggggagaattgagaatagtcaggcctatcagtctcacagaatcacccctctacctttgatattccacttagctgtagagtccatctgtttgtccatctgctgaaatgagaaaagaaaaatttatgcactgatttaaaacaaaccaaaaaaaaagaaaaaaacaaaaaaaaaaatccctcctttctagctgaacaaaaatgtgcagttaatacttggcgcttgaaaatgcagtagtgaatgtggaaccaagcctgtctgtatatctggtagctcttttcttgctttgttttttcttaccagtattctgcctaacgtttgcttctgtgatggttatattgcctagcaagcacacccgtggttgtgaaaatagtatagcaaaaaagaaaaatccccggttattgatgtactagatttgtgtatgtcttttaaacagttctagtttcaccttacacagaataatcaggaaaagtgtaaaaattcaaaagtgaaataaaaattttatcagttagttgcctgtgaa

SEQ ID NO: 372241 - DNA, 2048 bp, Homo sapiens
attttcatctttatgttacaaccactgtgtcgaactcccagcaggcttaccaggaagcatttgaaattagtaagaaagaaatgcagcctacacacccaattcgtcttggtctggcactaaatttctcagtcttttactatgagattctaaactctcctgaaaaggcctgtagcctggcaaaaacggcatttgatgaagcaattgctgaattggatacgctgaatgaagagtcttataaagacagcactctgatcatgcagttacttagggacaatctcactctgtggacatcggaaaaccagggagacgaaggagacgctggggagggagagaactaatgtttctcgtgctttgtgatctgttcagtgtcactctgtaccctcaacatatatcccttgtgcgataaaaaaaaaaaaaaaaaaaaaaaagagaatcgtacgtcgactttcgatttttcacagcctcagcctaggaaaaatggttcatgggataaacagctggtatttgtatctaaaactcagattggtcacataaatgccacggcattccgaagttttgattttgattaacattgattctttgtggcagataactggcttatgacaccttgaaaagttcaagtgctcatataacacaccacactgaaccccctttcctacagcaatatgttcactatgttaccaatttgcaacttgtgcttcaatagtggaatctactttcattgttaacactgagctaaagaaaaaaagccgtgtgttttatgaatgaccttatctgtttcctggataatacctttaagaataatgtcctgagtcaggcgtggtggtgcgtgcatctagtcccaactatttgggaggctgaggcaggaggatcgcttgagcccaggagtttaaagctgcagtgccctgtggttgcacctgtgaataactgcactccagcctgggcaacatagcgagacctcatctccaaaaaagaaaacaaaaaacaaaaaaaggaatgatgttctgtagagatggcctttcacttgaggagtactcagttttcaggttcttcctagctcggggcttttaaattttgaaatctaaacattctttcccaccatcctttttgactgttgaccttggttttctcttctaagtttctgtccctctgcttccttactttttttcctttttgaattctatctttatctgtcttttgttcactttttaatgctatatatgggcaggggtgagagacattactgagcaccttggtgagcaagcctggctttaaagattggagaagagcttctggcaccagaaccctgtcttcctccagttctcaacacggtgttgctcttcagtcataccggaatctgaatcaaaaaagtatttttaaatatccatgatttctccctgtattgaggctagccctgatcatgctttttgtgcctgtcaccaggtctcccaagtgcactcatccaggtcagtgctcagatgtgtttaaggagaccctatattcagggaagttgcgtgaacactgcagtggggagaattgagaatagtcaggcctatcagtctcacagaatcacccctctacctttgatattccacttagctgtagagtccatctgtttgtccatctgctgaaatgagaaaagaaaaatttatgcactgatttaaaacaaaccaaaaaaaaagaaaaaaacaaaaaaaaaaatccctcctttctagctgaacaaaaatgtgcagttaatacttggcgcttgaaaatgcagtagtgaatgtggaaccaagcctgtctgtatatctggtagctcttttcttgctttgttttttcttaccagtattctgcctaacgtttgcttctgtgatggttatattgcctagcaagcacacccgtggttgtgaaaatagtatagcaaaaaagaaaaatccccggttattgatgtactagatttgtgtatgtcttttaaacagttctagtttcaccttacacagaataatcaggaaaagtgtaaaaattcaaaagtgaaataaaaattttatcagttagttgcctgtgaa

SEQ ID NO: 372242 - DNA, 2378 bp, Homo sapiens
attttcatctttatgttacaaccactgtgtcgaactcccagcaggcttaccaggaagcatttgaaattagtaagaaagaaatgcagcctacacacccaattcgtcttggtctggcactaaatttctcagtcttttactatgagattctaaactctcctgaaaaggcctgtagcctggcaaaaacggcatttgatgaagcaattgctgaattggatacgctgaatgaagagtcttataaagacagcactctgatcatgcagttacttagggacaatctcactctgtggacatcggaaaaccagggagacgaaggagacgctggggagggagagaactaatgtttctcgtgctttgtgatctgttcagtgtcactctgtaccctcaacatatatcccttgtgcgataaaaaaaaaaaaaaaaaaaaaaaagagaatcgtacgtcgactttcgatttttcacagcctcagcctaggaaaaatggttcatgggataaacagctggtatttgtatctaaaactcagattggtcacataaatgccacggcattccgaagttttgattttgattaacattgacaggattactgtgtgtttaattttttaaaaactgaacactgtgattatggggttttgtaatttagcagaactcttactggtagaaaaaatagacctgaattatgtgtaactttttggaaggtttaatctgatatcaaaataatcattgaaatacaattccattgtaaagttgtacagaaagttatagagattatattgtgatgctggaacttggagtgagacacacatcatttggcatttgagttgaatggtaattcacagtaatgctgccgttgttcgggacttaaagacacttgacctgtttgggctgttgccacttaaaagttcatgaccacaaatgtccacagtgtcttcctctgaggaaactcgaatcctgaaatggaaattctttgtggcagataactggcttatgacaccttgaaaagttcaagtgctcatataacacaccacactgaaccccctttcctacagcaatatgttcactatgttaccaatttgcaacttgtgcttcaatagtggaatctactttcattgttaacactgagctaaagaagaataatgtcctgagtcaggcgtggtggtgcgtgcatctagtcccaactatttgggaggctgaggcaggaggatcgcttgagcccaggagtttaaagctgcagtgccctgtggttgcacctgtgaataactgcactccagcctgggcaacatagcgagacctcatctccaaaaaagaaaacaaaaaacaaaaaaaggaatgatgttctgtagagatggcctttcacttgaggagtactcagttttcaggttcttcctagctcggggcttttaaattttgaaatctaaacattctttcccaccatcctttttgactgttgaccttggttttctcttctaagtttctgtccctctgcttccttactttttttcctttttgaattctatctttatctgtcttttgttcactttttaatgctatatatgggcaggggtgagagacattactgagcaccttggtgagcaagcctggctttaaagattggagaagagcttctggcaccagaaccctgtcttcctccagttctcaacacggtgttgctcttcagtcataccggaatctgaatcaaaaaagtatttttaaatatccatgatttctccctgtattgaggctagccctgatcatgctttttgtgcctgtcaccaggtctcccaagtgcactcatccaggtcagtgctcagatgtgtttaaggagaccctatattcagggaagttgcgtgaacactgcagtggggagaattgagaatagtcaggcctatcagtctcacagaatcacccctctacctttgatattccacttagctgtagagtccatctgtttgtccatctgctgaaatgagaaaagaaaaatttatgcactgatttaaaacaaaccaaaaaaaaagaaaaaaacaaaaaaaaaaatccctcctttctagctgaacaaaaatgtgcagttaatacttggcgcttgaaaatgcagtagtgaatgtggaaccaagcctgtctgtatatctggtagctcttttcttgctttgttttttcttaccagtattctgcctaacgtttgcttctgtgatggttatattgcctagcaagcacacccgtggttgtgaaaatagtatagcaaaaaagaaaaatccccggttattgatgtactagatttgtgtatgtcttttaaacagttctagtttcaccttacacagaataatcaggaaaagtgtaaaaattcaaaagtgaaataaaaattttatcagttagttgcctgtgaa

SEQ ID NO: 372243 - DNA, 1563 bp, Homo sapiens
ttaccaatttgctgtggaggaaagggggttcagtgtggtgtgttatatgagcacttgaacttttcaaggtgtcataagccagttatctgccacaaagaatttccatttcaggattcgagtttcctcagaggaagacactgtggacattgtggtcatgaacttttaagtggcaacagcaatatgttcactatgttaccaatttgcaacttgtgcttcaatagtggaatctactttcattgttaacactgagctaaagaaaaaaagccgtgtgttttatgaatgaccttatctgtttcctggataatacctttaagaataatgtcctgagtcaggcgtggtggtgcgtgcatctagtcccaactatttgggaggctgaggcaggaggatcgcttgagcccaggagtttaaagctgcagtgccctgtggttgcacctgtgaataactgcactccagcctgggcaacatagcgagacctcatctccaaaaaagaaaacaaaaaacaaaaaaaggaatgatgttctgtagagatggcctttcacttgaggagtactcagttttcaggttcttcctagctcggggcttttaaattttgaaatctaaacattctttcccaccatcctttttgactgttgaccttggttttctcttctaagtttctgtccctctgcttccttactttttttcctttttgaattctatctttatctgtcttttgttcactttttaatgctatatatgggcaggggtgagagacattactgagcaccttggtgagcaagcctggctttaaagattggagaagagcttctggcaccagaaccctgtcttcctccagttctcaacacggtgttgctcttcagtcataccggaatctgaatcaaaaaagtatttttaaatatccatgatttctccctgtattgaggctagccctgatcatgctttttgtgcctgtcaccaggtctcccaagtgcactcatccaggtcagtgctcagatgtgtttaaggagaccctatattcagggaagttgcgtgaacactgcagtggggagaattgagaatagtcaggcctatcagtctcacagaatcacccctctacctttgatattccacttagctgtagagtccatctgtttgtccatctgctgaaatgagaaaagaaaaatttatgcactgatttaaaacaaaccaaaaaaaaagaaaaaaacaaaaaaaaaaatccctcctttctagctgaacaaaaatgtgcagttaatacttggcgcttgaaaatgcagtagtgaatgtggaaccaagcctgtctgtatatctggtagctcttttcttgctttgttttttcttaccagtattctgcctaacgtttgcttctgtgatggttatattgcctagcaagcacacccgtggttgtgaaaatagtatagcaaaaaagaaaaatccccggttattgatgtactagatttgtgtatgtcttttaaacagttctagtttcaccttacacagaataatcaggaaaagtgtaaaaattcaaaagtgaaataaaaattttatcagttagttgcctgtgaa

SEQ ID NO: 372244 - DNA, 2379 bp, Homo sapiens
attttcatctttatgttacaaccactgtgtcgaactcccagcaggcttaccaggaagcatttgaaattagtaagaaagaaatgcagcctacacacccaattcgtcttggtctggcactaaatttctcagtcttttactatgagattctaaactctcctgaaaaggcctgtagcctggcaaaaacggcatttgatgaagcaattgctgaattggatacgctgaatgaagagtcttataaagacagcactctgatcatgcagttacttagggacaatctcactctgtggacatcggaaaaccagggagacgaaggagacgctggggagggagagaactaatgtttctcgtgctttgtgatctgttcagtgtcactctgtaccctcaacatatatcccttgtgcgataaaaaaaaaaaaaaaaaaaaaaaagagaatcgtacgtcgactttcgatttttcacagcctcagcctaggaaaaatggttcatgggataaacagctggtatttgtatctaaaactcagattggtcacataaatgccacggcattccgaagttttgattttgattaacattgacaggattactgtgtgtttaattttttaaaaactgaacactgtgattatggggttttgtaatttagcagaactcttactggtagaaaaaatagacctgaattatgtgtaactttttggaaggtttaatctgatatcaaaataatcattgaaatacaattccattgtaaagttgtacagaaagttatagagattatattgtgatgctggaacttggagtgagacacacatcatttggcatttgagttgaatggtaattcacagtaatgctgccgttgttcgggacttaaagacacttgacctgtttgggctgttgccacttaaaagttcatgaccacaaatgtccacagtgtcttcctctgaggaaactcgaatcctgaaatggaaattctttgtggcagataactggcttatgacaccttgaaaagttcaagtgctcatataacacaccacactgaaccccctttcctacagcaatatgttcactatgttaccaatttgcaacttgtgcttcaatagtggaatctactttcattgttaacactgagctaaagaaaaaaagccgtgtgttttatgaatgaccttatctgtttcctggataatacctttaagaataatgtcctgagtcaggcgtggtggtgcgtgcatctagtcccaactatttgggaggctgaggcaggaggatcgcttgagcccaggagtttaaagctgcagtgccctgtggttgcacctgtgaataactgcactccagcctgggcaacatagcgagacctcatctccaaaaaagaaaacaaaaaacaaaaaaaggaatgatgttctgtagagatggcctttcacttgaggagtactcagttttcaggttcttcctagctcggggcttttaaattttgaaatctaaacattctttcccaccatcctttttgactgttgaccttggttttctcttctaagtttctgtccctctgcttccttactttttttcctttttgaattctatctttatctgtcttttgttcactttttaatgctatatatgggcaggggtgagagacattactgagcaccttggtgagcaagcctggctttaaagattggagaagagcttctggcaccagaaccctgtcttcctccagttctcaacacggtgttgctcttcagtcataccggaatctgaatcaaatgctttttgtgcctgtcaccaggtctcccaagtgcactcatccaggtcagtgctcagatgtgtttaaggagaccctatattcagggaagttgcgtgaacactgcagtggggagaattgagaatagtcaggcctatcagtctcacagaatcacccctctacctttgatattccacttagctgtagagtccatctgtttgtccatctgctgaaatgagaaaagaaaaatttatgcactgatttaaaacaaaccaaaaaaaaagaaaaaaacaaaaaaaaaaatccctcctttctagctgaacaaaaatgtgcagttaatacttggcgcttgaaaatgcagtagtgaatgtggaaccaagcctgtctgtatatctggtagctcttttcttgctttgttttttcttaccagtattctgcctaacgtttgcttctgtgatggttatattgcctagcaagcacacccgtggttgtgaaaatagtatagcaaaaaagaaaaatccccggttattgatgtactagatttgtgtatgtcttttaaacagttctagtttcaccttacacagaataatcaggaaaagtgtaaaaattcaaaagtgaaataaaaattttatcagttagttgcctgtgaa

SEQ ID NO: 372245 - DNA, 869 bp, Homo sapiens
ttttccacagggtagggggatagacagactcagtgagagaggaactggaccccatgtcaattattgagacagattggtgagcaagcctggctttaaagattggagaagagcttctggcaccagaaccctgtcttcctccagttctcaacacggtgttgctcttcagtcataccggaatctgaatcaaaaaagtatttttaaatatccatgatttctccctgtattgaggctagccctgatcatgctttttgtgcctgtcaccaggtctcccaagtgcactcatccaggtcagtgctcagatgtgtttaaggagaccctatattcagggaagttgcgtgaacactgcagtggggagaattgagaatagtcaggcctatcagtctcacagaatcacccctctacctttgatattccacttagctgtagagtccatctgtttgtccatctgctgaaatgagaaaagaaaaatttatgcactgatttaaaacaaaccaaaaaaaaagaaaaaaacaaaaaaaaaaatccctcctttctagctgaacaaaaatgtgcagttaatacttggcgcttgaaaatgcagtagtgaatgtggaaccaagcctgtctgtatatctggtagctcttttcttgctttgttttttcttaccagtattctgcctaacgtttgcttctgtgatggttatattgcctagcaagcacacccgtggttgtgaaaatagtatagcaaaaaagaaaaatccccggttattgatgtactagatttgtgtatgtcttttaaacagttctagtttcaccttacacagaataatcaggaaaagtgtaaaaattcaaaagtgaaataaaaattttatcagttagttgcctgtgaa

SEQ ID NO: 372246 - DNA, 1463 bp, Homo sapiens
  misc_feature (1324)..(1324): n is a, c, g, or t
  misc_feature (1329)..(1329): n is a, c, g, or t
  misc_feature (1342)..(1345): n is a, c, g, or t
  misc_feature (1350)..(1350): n is a, c, g, or t
  misc_feature (1362)..(1362): n is a, c, g, or t
  misc_feature (1370)..(1370): n is a, c, g, or t
  misc_feature (1375)..(1375): n is a, c, g, or t
  misc_feature (1378)..(1378): n is a, c, g, or t
  misc_feature (1385)..(1385): n is a, c, g, or t
attttcatctttatgttacaaccactgtgtcgaactcccagcaggcttaccaggaagcatttgaaattagtaagaaagaaatgcagcctacacacccaattcgtcttggtctggcactaaatttctcagtcttttactatgagattctaaactctcctgaaaaggcctgtagcctggcaaaaacggcatttgatgaagcaattgctgaattggatacgctgaatgaagagtcttataaagacagcactctgatcatgcagttacttagggacaatctcactctgtggacatcggaaaaccagggagacgaaggagacgctggggagggagagaactaatgtttctcgtgctttgtgatctgttcagtgtcactctgtaccctcaacatatatcccttgtgcgataaaaaaaaaaaaaaaaaaaaaaaagagaatcgtacgtcgactttcgatttttcacagcctcagcctaggaaaaatggttcatgggataaacagctggtatttgtatctaaaactcagattggtcacataaatgccacggcattccgaagttttgattttgattaacattgacaggattactgtgtgtttaattttttaaaaactgaacactgtgattatggggttttgtaatttagcagaactcttactggtagaaaaaatagacctgaattatgtgtaactttttggaaggtttaatctgatatcaaaataatcattgaaatacaattccattgtaaagttgtacagaaagttatagagattatattgtgatgctggaacttggagtgagacacacatcatttggcatttgagttgaatggtaattcacagtaatgctgccgttgttcgggacttaaagacacttgacctgtttgggctgttgccacttaaaagttcatgaccacaaatgtccacagtgtcttcctctgaggaaactcgaatcctgaaatggaaattctttgtggcagataactggcttatgacaccttgaaaagttcaagtgctcatataacacaccacactgaaccccctttcctacagcaatatgttcactatgttaccaatttgcaacttgtgcttcaatagtggaatctactttcattgttaacactgagctaaagaaaaaaagccgtgtgttttatgaatgaccttatctgtttcctggataatacctttaagaataatgtcctgagtcaggcgtggtggtgcgtgcatctagtcccaactatttgggaggctgaggcaggaggatcgcttgagcccaggagtttaaagctgcagtgccctgtggttgcacctgtgaatactgactccagctnggcanatggggactctcnnnnaaagnaacaaacccaanaggatgtntctgnaanaggcttnctgggagacacaacaagactccaaccgggtaaaatggaaaaattttcccaccttgagagggccggatctacaaggctg

SEQ ID NO: 372247 - DNA, 2155 bp, Homo sapiens
attttcatctttatgttacaaccactgtgtcgaactcccagcaggcttaccaggaagcatttgaaattagtaagaaagaaatgcagcctacacacccaattcgtcttggtctggcactaaatttctcagtcttttactatgagattctaaactctcctgaaaaggcctgtagcctggcaaaaacggcatttgatgaagcaattgctgaattggatacgctgaatgaagagtcttataaagacagcactctgatcatgcagttacttagggacaatctcactctgtggacatcggaaaaccagggagacgaaggagacgctggggagggagagaactaatgtttctcgtgctttgtgatctgttcagtgtcactctgtaccctcaacatatatcccttgtgcgataaaaaaaaaaaaaaaaaaaaaaaagagaatcgtacgtcgactttcgatttttcacagcctcagcctaggaaaaatggttcatgggataaacagctggtatttgtatctaaaactcagattggtcacataaatgccacggcattccgaagttttgattttgattaacattgacaggattactgtgtgtttaattttttaaaaactgaacactgtgattatggggttttgtaatttagcagaactcttactggtagaaaaaatagacctgaattatgtgtaactttttggaaggtttaatctgatatcaaaataatcattgaaatacaattccattgtaaagttgtacagaaagttatagagattatattgtgatgctggaacttggagtgagacacacatcatttggcatttgagttgaatggtaattcacagtaatgctgccgttgttcgggacttaaagacacttgacctgtttgggctgttgccacttaaaagttcatgaccacaaatgtccacagtgtcttcctctgaggaaactcgaatcctgaaatggaaattctttgtggcagataactggcttatgacaccttgaaaagttcaagtgctcatataacacaccacactgaaccccctttcctacagcaatatgttcactatgttaccaatttgcaacttgtgcttcaatagtggaatctactttcattgttaacactgagctaaagaaaaaaagccgtgtgttttatgaatgaccttatctgtttcctggataatacctttaagaataatgtcctgagtcaggcgtggtggtgcgtgcatctaatcccagcactttgggaggcccaggtgggtggatcacctgaggtcaggagtccaggaccagcctagccaacatggtgaaactccatctctactaaaaatacaaaacaggccaggcatggtggctcacgcctgtaatcccagcactttgggaggctgaggcaggcagatcacttgaggtcaggagtttgagaccagcctggccaacatggtgaaaccctctctctactgaaaatacaaaaattagccaggtgtggtggcacacgcctgtagtcccatctacccaggaggctaaggcaggagaattgcttgaacccgggaggctgaggttgcagttagccgagatcgtgccactccactccagcctgggcaacaagagcgagacctcatctccaaaaagaaaacaaaaaacaaaaaaaggaatgatgttctgtagagatggcctttcacttgaggagtactcagttttcaggttcttcctagctcggggcttttaaattttgaaatctaaacattctttcccaccatcctttttgacttgtctaatatttcattaccaccttcccataagttaattttctgttcccacctgaccagtgtaaatccacgaaatccaattttccatttaaaatgccctgactaccagattgctccccgaaagctccaggacatatgcttccagtgaattctcccagcatccctttatgtaccattagaaaaatgttggtttttttttaaaaaaaaaaaccttttttttttaaaggaattaattctacattaaaacctggcatgagacctgaagcattctattttccccccaaaacgcgggtgtgtttttatggcatgaaatcacatgtggtcaacactttgttatgacaaacttcatgcatatgcacactcctatacctgcctctatctcaccttccgggaccctc

SEQ ID NO: 372248 - DNA, 709 bp, Homo sapiens
cggacgcgtgggtcgacccacgcgtcgaaaagtatttttaaatatccatgatttctccctgtattgaggctagccctgatcatgctttttgtgcctgtcaccaggtctcccaagtgcactcatccaggtcagtgctcagatgtgtttaaggagaccctatattcagggaagttgcgtgaacactgcagtggggagaattgagaatagtcaggcctatcagtctcacagaatcacccctctacctttgatattccacttagctgtagagtccatctgtttgtccatctgctgaaatgagaaaagaaaaatttatgcactgatttaaaacaaaccaaaaaaaaagaaaaaaacaaaaaaaaaaatccctcctttctagctgaacaaaaatgtgcagttaatacttggcgcttgaaaatgcagtagtgaatgtggaaccaagcctgtctgtatatctggtagctcttttcttgctttgttttttcttaccagtattctgcctaacgtttgcttctgtgatggttatattgcctagcaagcacacccgtggttgtgaaaatagtatagcaaaaaagaaaaatccccggttattgatgtactagatttgtgtatgtcttttaaacagttctagtttcaccttacacagaataatcaggaaaagtgtaaaaattcaaaagtgaaataaaaattttatcagttagttgcctgtgaa

SEQ ID NO: 372249 - DNA, 779 bp, Homo sapiens
  misc_feature (13)..(13): n is a, c, g, or t
  misc_feature (40)..(40): n is a, c, g, or t
  misc_feature (63)..(63): n is a, c, g, or t
atactttttgatncagattccggtatgactgaagagcaanaccatgttgagaactggaggaanacagggttctggtgccagaagctcttctccaatcaaaagtatttttaaatatccatgatttctccctgtattgaggctagccctgatcatgctttttgtgcctgtcaccaggtctcccaagtgcactcatccaggtcagtgctcagatgtgtttaaggagaccctatattcagggaagttgcgtgaacactgcagtggggagaattgagaatagtcaggcctatcagtctcacagaatcacccctctacctttgatattccacttagctgtagagtccatctgtttgtccatctgctgaaatgagaaaagaaaaatttatgcactgatttaaaacaaaccaaaaaaaaagaaaaaaacaaaaaaaaaaatccctcctttctagctgaacaaaaatgtgcagttaatacttggcgcttgaaaatgcagtagtgaatgtggaaccaagcctgtctgtatatctggtagctcttttcttgctttgttttttcttaccagtattctgcctaacgtttgcttctgtgatggttatattgcctagcaagcacacccgtggttgtgaaaatagtatagcaaaaaagaaaaatccccggttattgatgtactagatttgtgtatgtcttttaaacagttctagtttcaccttacacagaataatcaggaaaagtgtaaaaattcaaaagtgaaataaaaattttatcagttagttgcctgtgaa

SEQ ID NO: 372250 - DNA, 684 bp, Homo sapiens
gcggccgcctactactactactgctcgaattcaagcttctaacgatgtacggggacatgctttttgtgcctgtcaccaggtctcccaagtgcactcatccaggtcagtgctcagatgtgtttaaggagaccctatattcagggaagttgcgtgaacactgcagtggggagaattgagaatagtcaggcctatcagtctcacagaatcacccctctacctttgatattccacttagctgtagagtccatctgtttgtccatctgctgaaatgagaaaagaaaaatttatgcactgatttaaaacaaaccaaaaaaaaagaaaaaaacaaaaaaaaaaatccctcctttctagctgaacaaaaatgtgcagttaatacttggcgcttgaaaatgcagtagtgaatgtggaaccaagcctgtctgtatatctggtagctcttttcttgctttgttttttcttaccagtattctgcctaacgtttgcttctgtgatggttatattgcctagcaagcacacccgtggttgtgaaaatagtatagcaaaaaagaaaaatccccggttattgatgtactagatttgtgtatgtcttttaaacagttctagtttcaccttacacagaataatcaggaaaagtgtaaaaattcaaaagtgaaataaaaattttatcagttagttgcctgtgaa

SEQ ID NO: 372251 - DNA, 1716 bp, Homo sapiens
  misc_feature (1566)..(1566): n is a, c, g, or t
  misc_feature (1600)..(1600): n is a, c, g, or t
attttcatctttatgttacaaccactgtgtcgaactcccagcaggcttaccaggaagcatttgaaattagtaagaaagaaatgcagcctacacacccaattcgtcttggtctggcactaaatttctcagtcttttactatgagattctaaactctcctgaaaaggcctgtagcctggcaaaaacggcatttgatgaagcaattgctgaattggatacgctgaatgaagagtcttataaagacagcactctgatcatgcagttacttagggacaatctcactctgtggacatcggaaaaccagggagacgaaggagacgctggggagggagagaactaatgtttctcgtgctttgtgatctgttcagtgtcactctgtaccctcaacatatatcccttgtgcgataaaaaaaaaaaaaaaaaaaaaaaagagaatcgtacgtcgactttcgatttttcacagcctcagcctaggaaaaatggttcatgggataaacagctggtatttgtatctaaaactcagattggtcacataaatgccacggcattccgaagttttgattttgattaacattgacaggattactgtgtgtttaattttttaaaaactgaacactgtgattatggggttttgtaatttagcagaactcttactggtagaaaaaatagacctgaattatgtgtaactttttggaaggtttaatctgatatcaaaataatcattgaaatacaattccattgtaaagttgtacagaaagttatagagattatattgtgatgctggaacttggagtgagacacacatcatttggcatttgagttgaatggtaattcacagtaatgctgccgttgttcgggacttaaagacacttgacctgtttgggctgttgccacttaaaagttcatgcttcctctgaggaaactcgaatcctgaaatggaaattctttgtggcagataactggcttatgacaccttgaaaagttcaagtgctcatataacacaccacactgaaccccctttcctacagcaatatgttcactatgttaccaatttgcaacttgtgcttcaatagtggaatctactttcattgttaacactgagctaaagaaaaaaagccgtgtgttttatgaatgaccttatctgtttcctggataatacctttaagaataatgtcctgagtcaggcgtggtggtgcgtgcatctagtcccaactatttgggaggctgaggcaggaggatcgcttgagcccaggagtttaaagctgcagtgccctgtggttgcacctgtgaataactgcactccagcctgggcaacatagcgagacctcatctccaaaaaagaaaacaaaaaacaaaaaaaggaatgatgttctgtagagatggcctttcacttgaggagtactcagttttcaggttcttcctagctcggggcttttaaattttgaaatctaaacattctttcccaccatcctttttgactgttgacctgggttatctcttctaagtaaggttcgttaccttctcttatttctttctcgccgcgttctctttttgtttgcgcgcggcgntttgctctaggggggggtattgccgacgcacggngacacgctggctatggaggaatcgccgcgcgacgcccccccgtgcacgggggccgccccgcactcgaggcatagatctcgacccgggagggttctatcgcgcgctgcgccgccggg

SEQ ID NO: 372252 - DNA, 412 bp, Homo sapiens
cttttttttttttggtttgttttaaatcagtgcataaaaaaaaaagaaaaaaacaaaaaaaaaaatccctcctttctagctgaacaaaaatgtgcagttaatacttggcgcttgaaaatgcagtagtgaatgtggaaccaagcctgtctgtatatctggtagctcttttcttgctttgttttttcttaccagtattctgcctaacgtttgcttctgtgatggttatattgcctagcaagcacacccgtggttgtgaaaatagtatagcaaaaaagaaaaatccccggttattgatgtactagatttgtgtatgtcttttaaacagttctagtttcaccttacacagaataatcaggaaaagtgtaaaaattcaaaagtgaaataaaaattttatcagttagttgcctgtgaa

SEQ ID NO: 372253 - DNA, 1033 bp, Homo sapiens
attttcatctttatgttacaaccactgtgtcgaactcccagcaggcttaccaggaagcatttgaaattagtaagaaagaaatgcagcctacacacccaattcgtcttggtctggcactaaatttctcagtcttttactatgagattctaaactctcctgaaaaggcctgtagcctggcaaaaacggcatttgatgaagcaattgctgaattggatacgctgaatgaagagtcttataaagacagcactctgatcatgcagttacttagggacaatctcactctgtggacatcggaaaaccagggagacgaaggagacgctggggagggagagaactaatgtttctcgtgctttgtgatctgttcagtgtcactctgtaccctcaacatatatcccttgtgcgataaaaaaaaaaaaaaaaaaaaaaaagagaaaatccgtcctttggattttacaacccccaccctaggaaaaggggtccggggaaaccccgggggttttttgggctttcttaaaacccgaattgggccacattaaatgcccagggcaattcccgaagatattggaattaggaacatacccattcgaacggcaatacacgggggtgtgttcaaattttctctaaaacactgtgcacccgcgtgtgaattagcggggattggtgctaatttacagccagacaacctctttcctgtggctcgaaaaaacatcagaccctgtgaaaattatgttgtcacctttcttgggaagaggttcacctctgattcttccaccaagtcataccttcggcgagctaacggttcccagttgggaacggttgggcccagcgcgggttcatcggagcattctcctggggaatcgcgggccctgggcgttgtttagcaccaccactgttcgtttggggacttgcgggctcggactggggcaccccccgcagtattgttgccgttggtcccgaggctaaaaggacccttgagctggtaggggtggtcgcccttacagtccgtgcccaaactgtccacgggttcctctgg

SEQ ID NO: 372254 - DNA, 413 bp, Homo sapiens
tttcttaccagtattctgcctaacgtttgcttctgtgatggttatattgcctagcaagcacacccgtggttgtgaaaatagtatagcaaaaaagaaaaatccccggttattgatgtactagatttgtgtatgtcttttaaacagttctagtttcaccttacacagaataatcaggaaaagtgtaaaaattcaaaagtgaaataaaaattttatcagttagttgcctgtgaattgatgtgtcaccaccatctctgttgttaccagacctagctaactattctgatcacacttatttttaactctgttttctttaaaaataggcaaacagttttatttcattatttaggaccagaagtcaaggtgttatccaggggaagaaattaccattaattaaacagcctctttacacccgt

SEQ ID NO: 372255 - DNA, 305 bp, Homo sapiens
ccggaatctgaatcaaaaaagtatttttaaatatccatgatttctccctgtattgaggctagccctgatcatgctttttgtgcctgtcaccaggtctcccaagtgcactcatccaggtcagtgctcagatgtgtttaaggagaccctatattcagggaagttgcgtgaacactgcagtggggagaattgagaatagtcaggcctatcagtctcacagaatcacccctctacctttgatattccacttagctgtagagtccatctgtttgtccatctgctgaaatgagaaaagaaaaatttatgca

SEQ ID NO: 372256 - DNA, 838 bp, Homo sapiens
  misc_feature (447)..(447): n is a, c, g, or t
  misc_feature (456)..(456): n is a, c, g, or t
attttcatctttatgttacaaccactgtgtcgaactcccagcaggcttaccaggaagcatttgaaattagtaagaaagaaatgcagcctacacacccaattcgtcttggtctggcactaaatttctcagtcttttactatgagattctaaactctcctgaaaaggcctgtagcctggcaaaaacggcatttgatgaagcaattgctgaattggatacgctgaatgaagagtcttataaagacagcactctgatcatgcagttacttagggacaatctcactctgtggacatcggaaaaccagggagacgaaggagacgctggggagggagagaactaatgtttctcgtgctttgtgatctgttcagtgtcactctgtaccctcaacatatatcccttgtgcgataaaaaaaaaaaaaaacaaaaaaaaaaaaaaaaaaaaaaaaaanaaaaaaaanaaaaaaaaaaaaaaaaaaaaaaaggggggggccaaaacccgggggggaaaaacattttttataaaaagggggggtgctcaaatgaagggtagatgaatttatataagataagagaagcgggcgggggaatttttaacacaacaaagaatggcagagaggaggagaaaacccgagccaacgacaagccaaaatcgagaaggcaacaaacaccaacaccaggggggggaagagaccaaaataagacaacacaaccaaccaaaagaaaagtaaaaaacccacgagaggaaacaaaaaacagaaggagaggtagtaggctaacccacacgaagatggctgcgggaaaaagagcgcaccgaggaatgtaaaaatagaccccgacggg

SEQ ID NO: 372257 - DNA, 2468 bp, Homo sapiens
attttcatctttatgttacaaccactgtgtcgaactcccagcaggcttaccaggaagcatttgaaattagtaagaaagaaatgcagcctacacacccaattcgtcttggtctggcactaaatttctcagtcttttactatgagattctaaactctcctgaaaaggcctgtagcctggcaaaaacggcatttgatgaagcaattgctgaattggatacgctgaatgaagagtcttataaagacagcaactctgatcatgcaagttacttagggacaatctcactctgatcatgcagttacttagggacaatctcactctgtggacatcggaaaaccagggagacgaaggagacgctggggagggagagaactaatgtttctcgtgctttgtgatctgttcagtgtcactctgtaccctcaacatatatcccttgtgcgataaaaaaaaaaaaaaaaaaaaaaaagagaatcgtacgtcgactttcgatttttcacagcctcagcctaggaaaaatggttcatgggataaacagctggtatttgtatctaaaactcagattggtcacataaatgccacggcattccgaagttttgattttgattaacattgacaggattactgtgtgtttaattttttaaaaactgaacactgtgattatggggttttgtaatttagcagaactcttactggtagaaaaaatagacctgaattatgtgtaactttttggaaggtttaatctgatatcaaaataatcattgaaatacaattccattgtaaagttgtacagaaagttatagagattatattgtgatgctggaacttggagtgagacacacatcatttggcatttgagttgaatggtaattcacagtaatgctgccgttgttcgggacttaaagacacttgacctgtttgggctgttgccacttaaaagttcatgaccacaaatgtccacagtgtcttcctctgaggaaactcgaatcctgaaatggaaattctttgtggcagataactggcttatgacaccttgaaaagttcaagtgctcatataacacaccacactgaaccccctttcctacagcaatatgttcactatgttaccaatttgcaacttgtgcttcaatagtggaatctactttcattgttaacactgagctaaagaaaaaaagccgtgtgttttatgaatgaccttatctgtttcctggataatacctttaagaataatgtcctgagtcaggcgtggtggtgcgtgcatctagtcccaactatttgggaggctgaggcaggaggatcgcttgagcccaggagtttaaagctgcagtgccctgtggttgcacctgtgaataactgcactccagcctgggcaacatagcgagacctcatctccaaaaaagaaaacaaaaaacaaaaaaaggaatgatgttctgtagagatggcctttcacttgaggagtactcagttttcaggttcttcctagctcggggcttttaaattttgaaatctaaacattctttcccaccatcctttttgactgttgaccttggttttctcttctaagtttctgtccctctgcttccttactttttttcctttttgaattctatctttatctgtcttttgttcactttttaatgctatatatgggcaggggtgagagacattactgagcaccttggtgagcaagcctggctttaaagattggagaagagcttctggcaccagaaccctgtcttcctccagttctcaacacggtgttgctcttcagtcataccggaatctgaatcaaaaaagtatttttaaatatccatgatttctccctgtattgaggctagccctgatcatgctttttgtgcctgtcaccaggtctcccaagtgcactcatccaggtcagtgctcagatgtgtttaaggagaccctatattcagggaagttgcgtgaacactgcagtggggagaattgagaatagtcaggcctatcagtctcacagaatcacccctctacctttgatattccacttagctgtagagtccatctgtttgtccatctgctgaaatgagaaaagaaaaatttatgcactgatttaaaacaaaccaaaaaaaaagaaaaaaacaaaaaaaaaaatccctcctttctagctgaacaaaaatgtgcagttaatacttggcgcttgaaaatgcagtagtgaatgtggaaccaagcctgtctgtatatctggtagctcttttcttgctttgttttttcttaccagtattctgcctaacgtttgcttctgtgatggttatattgcctagcaagcacacccgtggttgtgaaaatagtatagcaaaaaagaaaaatccccggttattgatgtactagatttgtgtatgtcttttaaacagttctagtttcaccttacacagaataatcaggaaaagtgtaaaaattcaaaagtgaaataaaaattttatcagttagttgcctgtgaa

SEQ ID NO: 372258 - DNA, 2793 bp, Homo sapiens
  misc_feature (2793)..(2793): n is a, c, g, or t
attttcatctttatgttacaaccactgtgtcgaactcccagcaggcttaccaggaagcatttgaaattagtaagaaagaaatgcagcctacacacccaattcgtcttggtctggcactaaatttctcagtcttttactatgagattctaaactctcctgaaaaggcctgtagcctggcaaaaacggcatttgatgaagcaattgctgaattggatacgctgaatgaagagtcttataaagacagcactctgatcatgcagttacttagggacaatctcactctgtggacatcggaaaaccagggagacgaaggagacgctggggagggagagaactaatgtttctcgtgctttgtgatctgttcagtgtcactctgtaccctcaacatatatcccttgtgcgataaaaaaaaaaaaaaaaaaaaaaaagagaatcgtacgtcgactttcgatttttcacagcctcagcctaggaaaaatggttcatgggataaacagctggtatttgtatctaaaactcagattggtcacataaatgccacggcattccgaagttttgattttgattaacattgacaggattactgtgtgtttaattttttaaaaactgaacactgtgattatggggttttgtaatttagcagaactcttactggtagaaaaaatagacctgaattatgtgtaactttttggaaggtttaatctgatatcaaaataatcattgaaatacaattccattgtaaagttgtacagaaagttatagagattatattgtgatgctggaacttggagtgagacacacatcatttggcatttgagttgaatggtaattcacagtaatgctgccgttgttcgggacttaaagacacttgacctgtttgggctgttgccacttaaaagttcatgaccacaaatgtccacagtgtcttcctctgaggaaactcgaatcctgaaatggaaattctttgtggcagataactggcttatgacaccttgaaaagttcaagtgctcatataacacaccacactgaaccccctttcctacagcaatatgttcactatgttaccaatttgcaacttgtgcttcaatagtggaatctactttcattgttaacactgagctaaagaaaaaaagccgtgtgttttatgaatgaccttatctgtttcctggataatacctttaagaataatgtcctgagtcaggcgtggtggtgcgtgcatctagtcccaactatttgggaggctgaggcaggaggatcgcttgagcccaggagtttaaagctgcagtgccctgtggttgcacctgtgaataactgcactccagcctgggcaacatagcgagacctcatctccaaaaaagaaaacaaaaaacaaaaaaaggaatgatgttctgtagagatggcctttcacttgaggagtactcagttttcaggttcttcctagctcggggcttttaaattttgaaatctaaacattctttcccaccatcctttttgactgttgaccttggttttctcttctaagtttctgtccctctgcttccttactttttttcctttttgaattctatctttatctgtcttttgttcactttttaatgctatatatgggcaggggtgagagacattactgagcaccttggtgagcaagcctggctttaaagattggagaagagcttctggcaccagaaccctgtcttcctccagttctcaacacggtgttgctcttcagtcataccggaatctgaatcaaaaaagtatttttaaatatccatgatttctccctgtattgaggctagccctgatcatgctttttgtgcctgtcaccaggtctcccaagtgcactcatccaggtcagtgctcagatgtgtttaaggagaccctatattcagggaagttgcgtgaacactgcagtggggagaattgagaatagtcaggcctatcagtctcacagaatcacccctctacctttgatattccacttagctgtagagtccatctgtttgtccatctgctgaaatgagaaaagaaaaatttatgcactgatttaaaacaaaccaaaaaaaaagaaaaaaacaaaaaaaaaaatccctcctttctagctgaacaaaaatgtgcagttaatacttggcgcttgaaaatgcagtagtgaatgtggaaccaagcctgtctgtatatctggtagctcttttcttgctttgttttttcttaccagtattctgcctaacgtttgcttctgtgatggttatattgcctagcaagcacacccgtggttgtgaaaatagtatagcaaaaaagaaaaatccccggttattgatgtactagatttgtgtatgtcttttaaacagttctagtttcaccttacacagaataatcaggaaaagtgtaaaaattcaaaagtgaaataaaaattttatcagttagttgcctgtgaaaaaaaaaaaaaacaaaaaaaaaaaaaaaaaaaaaaaaacatccaattctcaaactgaagctcgcactctcgcctccagcatgaaaggtctctgcgcccttctgtgcctgctgctcatagcagccaccttcattccccaagggctcgctcagccagatgcaatcaatgccccagcaacttgctttataacttaaccaataggaagatctcattgcaaaggctctcgaagcttagaggaatcaccagcagcaagtggccaaagaacctgtaacttaaagaacaattgtggcaaggagactgggctgaccccaagcagagttgggtcaggaattcatggccaactgacaaggcaacccaatcn

SEQ ID NO: 372259 - DNA, 2522 bp, Homo sapiens
  misc_feature (2476)..(2476): n is a, c, g, or t
  misc_feature (2486)..(2486): n is a, c, g, or t
  misc_feature (2489)..(2489): n is a, c, g, or t
  misc_feature (2516)..(2516): n is a, c, g, or t
attttcatctttatgttacaaccactgtgtcgaactcccagcaggcttaccaggaagcatttgaaattagtaagaaagaaatgcagcctacacacccaattcgtcttggtctggcactaaatttctcagtcttttactatgagattctaaactctcctgaaaaggcctgtagcctggcaaaaacggcatttgatgaagcaattgctgaattggatacgctgaatgaagagtcttataaagacagcactctgatcatgcagttacttagggacaatctcactctgtggacatcggaaaaccagggagacgaaggagacgctggggagggagagaactaatgtttctcgtgctttgtgatctgttcagtgtcactctgtaccctcaacatatatcccttgtgcgataaaaaaaaaaaaaaaaaaaaaaaagagaatcgtacgtcgactttcgatttttcacagcctcagcctaggaaaaatggttcatgggataaacagctggtatttgtatctaaaactcagattggtcacataaatgccacggcattccgaagttttgattttgattaacattgacaggattactgtgtgtttaattttttaaaaactgaacactgtgattatggggttttgtaatttagcagaactcttactggtagaaaaaatagacctgaattatgtgtaactttttggaaggtttaatctgatatcaaaataatcattgaaatacaattccattgtaaagttgtacagaaagttatagagattatattgtgatgctggaacttggagtgagacacacatcatttggcatttgagttgaatggtaattcacagtaatgctgccgttgttcgggacttaaagacacttgacctgtttgggctgttgccacttaaaagttcatgaccacaaatgtccacagtgtcttcctctgaggaaactcgaatcctgaaatggaaattctttgtggcagataactggcttatgacaccttgaaaagttcaagtgctcatataacacaccacactgaaccccctttcctacagcaatatgttcactatgttaccaatttgcaacttgtgcttcaatagtggaatctactttcattgttaacactgagctaaagaaaaaaagccgtgtgttttatgaatgaccttatctgtttcctggataatacctttaagaataatgtcctgagtcaggcgtggtggtgcgtgcatctagtcccaactatttgggaggctgaggcaggaggatcgcttgagcccaggagtttaaagctgcagtgccctgtggttgcacctgtgaataactgcactccagcctgggcaacatagcgagacctcatctccaaaaaagaaaacaaaaaacaaaaaaaggaatgatgttctgtagagatggcctttcacttgaggagtactcagttttcaggttcttcctagctcggggcttttaaattttgaaatctaaacattctttcccaccatcctttttgactgttgaccttggttttctcttctaagtttctgtccctctgcttccttactttttttcctttttgaattctatctttatctgtcttttgttcactttttaatgctatatatgggcaggggtgagagacattactgagcaccttggtgagcaagcctggctttaaagattggagaagagcttctggcaccagaaccctgtcttcctccagttctcaacacggtgttgctcttcagtcataccggaatctgaatcaaaaaagtatttttaaatatccatgatttctccctgtattgaggctagccctgatcatgctttttgtgcctgtcaccaggtctcccaagtgcactcatccaggtcagtgctcagatgtgtttaaggagaccctatattcagggaagttgcgtgaacactgcagtggggagaattgagaatagtcaggcctatcagtctcacagaatcacccctctacctttgatattccacttagctgtagagtccatctgtttgtccatctgctgaaatgagaaaagaaaaatttatgcactgatttaaaacaaaccaaaaaaaaagaaaaaaacaaaaaaaaaaatccctcctttctagctgaacaaaaatgtgcagttaatacttggcgcttgaaaatgcagtagtgaatgtggaaccaagcctgtctgtatatctggtagctcttttcttgctttgttttttcttaccagtattctgcctaacgtttgcttctgtgatggttatattgcctagcaagcacacccgtggttgtgaaaatagtatagcaaaaaagaaaaatccccggttattgatgtactagatttgtgtatgtcttttaaacagttctagtttcaccttacacagaataatcaggaaaagtgtaaaaattcaaaagtgaaataaaaattttatcagttagttgcctgtgaaaaaaaaaaaaaacaaaaaaaaaaaaaaaaaaaaaaaaaaaaanaaaaaaaaanaanaaaaaagagaaaaacaaaaaaaaaaanaaacaa

SEQ ID NO: 372260 - DNA, 2141 bp, Homo sapiens
attttcatctttatgttacaaccactgtgtcgaactcccagcaggcttaccaggaagcatttgaaattagtaagaaagaaatgcagcctacacacccaattcgtcttggtctggcactaaatttctcagtcttttactatgagattctaaactctcctgaaaaggcctgtagcctggcaaaaacggcatttgatgaagcaattgctgaattggatacgctgaatgaagagtcttataaagacagcactctgatcatgcagttacttagggacaatctcactctgtggacatcggaaaaccagggagacgaaggagacgctggggagggagagaactaatgtttctcgtgctttgtgatctgttcagtgtcactctgtaccctcaacatatatcccttgtgcgataaaaaaaaaaaaaaaaaaaaaaaagagaatcgtacgtcgactttcgatttttcacagcctcagcctaggaaaaatggttcatgggataaacagctggtatttgtatctaaaactcagattggtcacataaatgccacggcattccgaagttttgattttgattaacattgacaggattactgtgtgtttaattttttaaaaactgaacactgtgattatggggttttgtaatttagcagaactcttactggtagaaaaaatagacctgaattatgtgtaactttttggaaggtttaatctgatatcaaaataatcattgaaatacaattccattgtaaagttgtacagaaagttatagagattatattgtgatgctggaacttggagtgagacacacatcatttggcatttgagttgaatggtaattcacagtaatgctgccgttgttcgggacttaaagacacttgacctgtttgggctgttgccacttaaaagttcatgaccacaaatgtccacagtgtcttcctctgaggaaactcgaatcctgaaatggaaattctttgtggcagataactggcttatgacaccttgaaaagttcaagtgctcatataacacaccacactgaaccccctttcctacagcaatatgttcactatgttaccaatttgcaacttgtgcttcaatagtggaatctactttcattgttaacactgagctaaagaaaaaaagccgtgtgttttatgaatgaccttatctgtttcctggataatacctttaagaataatgtcctgagtcaggcgtggtggtgcgtgcatctagtcccaactatttgggaggctgaggcaggaggatcgcttgagcccaggagtttaaagctgcagtgccctgtggttgcacctgtgaataactgcactccagcctgggcaacatagcgagacctcatctccaaaaaagaaaacaaaaaacaaaaaaaggaatgatgttctgtagagatggcctttcacttgaggagtactcagttttcaggttcttcctagctcggggcttttaaattttgaaatctaaacattctttcccaccatcctttttgactgttgaccttggttttctcttctaagtttctgtccctctgcttccttactttttttcctttttgaattctatctttatctgtcttttgttcactttttaatgctatatatgggcaggggtgagagacattactgagcaccttggtgagcaagcctggctttaaagattggagaagagcttctggcaccagaaccctgtcttcctccagttctcaacacggtgttgctcttcagtcataccggaatctgaatcaaaaaagtatttttaaatatccatgatttctccctgtattgaggctagccctgatcatgctttttgtgcctgtcaccaggtctcccaagtgcactcatccaggtcagtgctcagatgtgtttaaggagaccctatattcagggaagttgcgtgaacactgcagtggggagaattgagaatagtcaggcctatcagtctcacagaatcacccctctacctttgatattccacttagctgtagagtccatctgtttgtccatctgctgaaatgagaaaagaaaaatttatgcactgatttaaaacaaaccaaaaaaaaagaaaaaaacctcagggggggcccgggtccccaatcgccctataggaagtcgtttacaattaattggccgccgttt

SEQ ID NO: 372261 - DNA, 2379 bp, Homo sapiens
attttcatctttatgttacaaccactgtgtcgaactcccagcaggcttaccaggaagcatttgaaattagtaagaaagaaatgcagcctacacacccaattcgtcttggtctggcactaaatttctcagtcttttactatgagattctaaactctcctgaaaaggcctgtagcctggcaaaaacggcatttgatgaagcaattgctgaattggatacgctgaatgaagagtcttataaagacagcactctgatcatgcagttacttagggacaatctcactctgtggacatcggaaaaccagggagacgaaggagacgctggggagggagagaactaatgtttctcgtgctttgtgatctgttcagtgtcactctgtaccctcaacatatatcccttgtgcgataaaaaaaaaaaaaaaaaaaaaaaagagaatcgtacgtcgactttcgatttttcacagcctcagcctaggaaaaatggttcatgggataaacagctggtatttgtatctaaaactcagattggtcacataaatgccacggcattccgaagttttgattttgattaacattgacaggattactgtgtgtttaattttttaaaaactgaacactgtgattatggggttttgtaatttagcagaactcttactggtagaaaaaatagacctgaattatgtgtaactttttggaaggtttaatctgatatcaaaataatcattgaaatacaattccattgtaaagttgtacagaaagttatagagattatattgtgatgctggaacttggagtgagacacacatcatttggcatttgagttgaatggtaattcacagtaatgctgccgttgttcgggacttaaagacacttgacctgtttgggctgttgccacttaaaagttcatgaccacaaatgtccacagtgtcttcctctgaggaaactcgaatcctgaaatggaaattctttgtggcagataactggcttatgacaccttgaaaagttcaagtgctcatataacacaccacactgaaccccctttcctacagcaatatgttcactatgttaccaatttgcaacttgtgcttcaatagtggaatctactttcattgttaacactgagctaaagaaaaaaagccgtgtgttttatgaatgaccttatctgtttcctggataatacctttaagaataatgtcctgagtcaggcgtggtggtgcgtgcatctagtcccaactatttgggaggctgaggcaggaggatcgcttgagcccaggagtttaaagctgcagtgccctgtggttgcacctgtgaataactgcactccagcctgggcaacatagcgagacctcatctccaaaaaagaaaacaaaaaacaaacaggttcttcctagctcggggcttttaaattttgaaatctaaacattctttcccaccatcctttttgactgttgaccttggttttctcttctaagtttctgtccctctgcttccttactttttttcctttttgaattctatctttatctgtcttttgttcactttttaatgctatatatgggcaggggtgagagacattactgagcaccttggtgagcaagcctggctttaaagattggagaagagcttctggcaccagaaccctgtcttcctccagttctcaacacggtgttgctcttcagtcataccggaatctgaatcaaaaaagtatttttaaatatccatgatttctccctgtattgaggctagccctgatcatgctttttgtgcctgtcaccaggtctcccaagtgcactcatccaggtcagtgctcagatgtgtttaaggagaccctatattcagggaagttgcgtgaacactgcagtggggagaattgagaatagtcaggcctatcagtctcacagaatcacccctctacctttgatattccacttagctgtagagtccatctgtttgtccatctgctgaaatgagaaaagaaaaatttatgcactgatttaaaacaaaccaaaaaaaaagaaaaaaacaaaaaaaaaaatccctcctttctagctgaacaaaaatgtgcagttaatacttggcgcttgaaaatgcagtagtgaatgtggaaccaagcctgtctgtatatctggtagctcttttcttgctttgttttttcttaccagtattctgcctaacgtttgcttctgtgatggttatattgcctagcaagcacacccgtggttgtgaaaatagtatagcaaaaaagaaaaatccccggttattgatgtactagatttgtgtatgtcttttaaacagttctagtttcaccttacacagaataatcaggaaaagtgtaaaaattcaaaagtgaaataaaaattttatcagttagttgcctgtgaa

SEQ ID NO: 372262 - DNA, 2090 bp, Homo sapiens
attttcatctttatgttacaaccactgtgtcgaactcccagcaggcttaccaggaagcatttgaaattagtaagaaagaaatgcagcctacacacccaattcgtcttggtctggcactaaatttctcagtcttttactatgagattctaaactctcctgaaaaggcctgtagcctggcaaaaacggcatttgatgaagcaattgctgaattggatacgctgaatgaagagtcttataaagacagcactctgatcatgcagttacttagggacaatctcactctgtggacatcggaaaaccagggagacgaaggagacgctggggagggagagaactaatgtttctcgtgctttgtgatctgttcagtgtcactctgtaccctcaacatatatcccttgtgcgataaaaaaaaaaaaaaaaaaaaaaaagagaatcgtacgtcgactttcgatttttcacagcctcagcctaggaaaaatggttcatgggataaacagctggtatttgtatctaaaactcagattggtcacataaatgccacggcattccgaagttttgattttgattaacattgacaggattactgtgtgtttaattttttaaaaactgaacactgtgattatggggttttgtaatttagcagaactcttactggtagaaaaaatagacctgaattatgtgtaactttttggaaggtttaatctgatatcaaaataatcattgaaatacaattccattgtaaagttgtacagaaagttatagagattatattgtgatgctggaacttggagtgagacacacatcatttggcatttgagttgaatggtaattcacagtaatgctgccgttgttcgggacttaaagacacttgacctgtttgggctgttgccacttaaaagttcatgaccacaaatgtccacagtgtcttcctctgaggaaactcgaatcctgaaatggaaattctttgtggcagataactggcttatgacaccttgaaaagttcaagtgctcatataacacaccacactgaaccccctttcctacagcaatatgttcactatgttaccaatttgcaacttgtgcttcaatagtggaatctactttcattgttaacactgagctaaagaaaaaaagccgtgtgttttatgaatgaccttatctgtttcctggataatacctttaagaataatgtcctgagtcaggcgtggtggtgcgtgcatctagtcccaactatttgggaggctgaggcaggaggatcgcttgagcccaggagtttaaagctgcagtgccctgtggttgcacctgtgaataactgcactccagcctgggcaacatagcgagacctcatctccaaaaaagaaaacaaaaaacaaaaaaaggaatgatgttctgtagagatggcctttcacttgaggagtactcagttttcaggttcttcctagctcggggcttttaaattttgaaatctaaacattctttcccaccatcctttttgactgttgaccttggttttctcttctaagtttctgtccctctgcttccttactttttttcctttttgaattctatctttatctgtcttttgttcactttttaatgctatatatgggcaggggtgagagacattactgagcaccttggtgagcaagcctggctttaaagattggagaagagcttctggcaccagaaccctgtcttcctccagttctcaacacggtgttgctcttcagtcataccggaatctgaatcaaaaaagtatttttaaatatccatgatttctccctgtattgaggctagccctgatcatgctttttgtgcctgtcaccaggtctcccaagtgcactcatccaggtcagtgctcagatgtgtttaaggagaccctatattcagggaagttgcgtgaacactgcagtggggagaattgagaatagtcaggcctatcagtctcacagaatcacccctctacctttgatattccacttagctgtagagtccatctgtttgtccatctgctgaaatgagaaaagaaaattttgcctgtttaaacaaccaaaaaacataatattatgttataataaacccttgtcggc

SEQ ID NO: 372263 - DNA, 1734 bp, Homo sapiens
  misc_feature (1571)..(1571): n is a, c, g, or t
  misc_feature (1577)..(1577): n is a, c, g, or t
  misc_feature (1586)..(1586): n is a, c, g, or t
  misc_feature (1589)..(1589): n is a, c, g, or t
attttcatctttatgttacaaccactgtgtcgaactcccagcaggcttaccaggaagcatttgaaattagtaagaaagaaatgcagcctacacacccaattcgtcttggtctggcactaaatttctcagtcttttactatgagattctaaactctcctgaaaaggcctgtagcctggcaaaaacggcatttgatgaagcaattgctgaattggatacgctgaatgaagagtcttataaagacagcactctgatcatgcagttacttagggacaatctcactctgtggacatcggaaaaccagggagacgaaggagacgctggggagggagagaactaatgtttctcgtgctttgtgatctgttcagtgtcactctgtaccctcaacatatatcccttgtgcgataaaaaaaaaaaaaaaaaaaaaaaagagaatcgtacgtcgactttcgatttttcacagcctcagcctaggaaaaatggttcatgggataaacagctggtatttgtatctaaaactcagattggtcacataaatgccacggcattccgaagttttgattttgattaacattgacaggattactgtgtgtttaattttttaaaaactgaacactgtgattatggggttttgtaatttagcagaactcttactggtagaaaaaatagacctgaattatgtgtaactttttggaaggtttaatctgatatcaaaataatcattgaaatacaattccattgtaaagttgtacagaaagttatagagattatattgtgatgctggaacttggagtgagacacacatcatttggcatttgagttgaatggtaattcacagtaatgctgccgttgttcgggacttaaagacacttgacctgtttgggctgttgccacttaaaagttcatgaccacaaatgtccacagtgtcttcctctgaggaaactcgaatcctgaaatggaaattctttgtggcagataactggcttatgacaccttgaaaagttcaagtgctcatataacacaccacactgaaccccctttcctacagcaatatgttcactatgttaccaatttgcaacttgtgcttcaatagtggaatctactttcattgttaacactgagctaaagaaaaaaagccgtgtgttttatgaatgaccttatctgtttcctggataatacctttaagaataatgtcctgagtcaggcgtggtggtgcgtgcatctagtcccaactatttgggaggctgaggcaggaggatcgcttgagcccaggagtttaaagctgcagtgccctgtggttgcacctgtgaataactgcactccagcctgggcaacatagcgagacctcatctccaaaaaagaaaacaaaaaacaaaaaaaggaatgatgttctgtagagatggcctttcacttgaggagtactcagttttcaggttcttcctagctcggggcttttaaattttgaaatctaaacattctttcccaccatcctttttgactgttgaccttggttttctcttctaagtttctgtccctctgcttcttactttttccttttgaatctatcttatcngcttgnccccttacngcnatatggggggggggagaacttctgaggccttgggggcacccggttaaaatggaaaggtctggcaacccgttctcgctccaaaggggggttagcaccgcgggcaaattatttaggccctggggcgcatgggacgccaccaacaagg

SEQ ID NO: 372264 - DNA, 3453 bp, Homo sapiens
  misc_feature (234)..(234): n is a, c, g, or t
ggaaaagcacttctgctctaccggcattaagaggcattccgtcttggaattccggcattaagaggcattccgtcttcatagcccgtgagacgccagtgtcacctttagcccaaccagtgccctgagggtggcattttcctaccttcctgtaacgacccccgggattgcccagggctacagcctctctcccgtgagcctccagaccgcgccctggccccgccccccaccccgatnggcccggccgggtctgggggcggggcgtttgcggcctttccagggccggggaaccccaggaggaagctgctgagccatgggcgcctacgcgcgggcttcgggggtctgcgctcgcggctgcctggactcagcaggcccctggaccatgtcccgcgccctgcggccaccgctcccgcctctctgctttttccttttgttgctggcggctgccggtgctcgggccgggggatacgagacatgccccacagtgcagccgaacatgctgaacgtgcacctgctgcctcacacacatgatgacgtgggctggctcaaaaccgtggaccagtacttttatggaatcaagaatgacatccagcacgccggtgtgcagtacatcctggactcggtcatctctgccttgctggcagatcccacccgtcgcttcatttacgtggagattgccttcttctcccgttggtggcaccagcagacaaatgccacacaggaagtcgtgcgagaccttgtgcgccaggggcgcctggagttcgccaatggtggctgggtgatgaacgatgaggcagccacccactacggtgccatcgtggaccagatgacacttgggctgcgctttctggaggacacatttggcaatgatgggcgaccccgtgtggcctggcacattgaccccttcggccactctcgggagcaggcctcgctgtttgcgcagatgggcttcgacggcttcttctttgggcgccttgattatcaagataagtgggtacggatgcagaagctggagatggagcaggtgtggcgggccagcaccagcctgaagcccccgaccgcggacctcttcactggtgtgcttcccaatggttacaacccgccaaggaatctgtgctgggatgtgctgtgtgtcgatcagccgctggtggaggaccctcgcagccccgagtacaacgccaaggagctggtcgattacttcctaaatgtggccactgcccagggccggtattaccgcaccaaccacactgtgatgaccatgggctcggacttccaatatgagaatgccaacatgtggttcaagaaccttgacaagctcatccggctggtaaatgcgcagcaggcaaaaggaagcagtgtccatgttctctactccacccccgcttgttacctctgggagctgaacaaggccaacctcacctggtcagtgaaacatgacgacttcttcccttacgcggatggcccccaccagttctggaccggttacttttccagtcggccggccctcaaacgctacgagcgcctcagctacaacttcctgcaggtgtgcaaccagctggaggcgctggtgggcctggcggccaacgtgggaccctatggctccggagacagtgcacccctcaatgaggcgatggctgtgctccagcatcacgacgccgtcagcggcacctcccgccagcacgtggccaacgactacgcgcgccagcttgcggcaggctgggggccttgcgaggttcttctgagcaacgcgctggcgcggctcagaggcttcaaagatcacttcaccttttgccaacagctaaacatcagcatctgcccgctcagccagacggcggcgcgcttccaggtcatcgtttataatcccctggggcggaaggtgaattggatggtacggctgccggtcagcgaaggcgttttcgttgtgaaggaccccaatggcaggacagtgcccagcgatgtggtaatatttcccagctcagacagccaggcgcaccctccggagctgctgttctcagcctcactgcccgccctgggcttcagcacctattcagtagcccaggtgcctcgctggaagccccaggcccgcgcaccacagcccatccccagaagatcctggtcccctgctttaaccatcgaaaatgagcacatccgggcaacgtttgatcctgacacagggctgttgatggagattatgaacatgaatcagcaactcctgctgcctgttcgccagaccttcttctggtacaacgccagtataggtgacaacgaaagtgaccaggcctcaggtgcctacatcttcagacccaaccaacagaaaccgctgcctgtgagccgctgggctcagatccacctggtgaagacacccttggtgcaggaggtgcaccagaacttctcagcttggtgttcccaggtggttcgcctgtacccaggacagcggcacctggagctagagtggtcggtggggccgatacctgtgggcgacacctgggggaaggaggtcatcagccgttttgacacaccgctggagacaaagggacgcttctacacagacagcaatggccgggagatcctggagaggaggcgggattatcgacccacctggaaactgaaccagacggagcccgtggcaggaaactactatccagtcaacacccggatttacatcacggatggaaacatgcagctgactgtgctgactgaccgctcccaggggggcagcagcctgagagatggctcgctggagctcatggtgcaccgaaggctgctgaaggacgatggacgcggagtatcggagccactaatggagaacgggtcgggggcgtgggtgcgagggcgccacctggtgctgctggacacagcccaggctgcagccgccggacaccggctcctggcggagcaggaggtcctggcccctcaggtggtgctggccccgggtggcggcgccgcctacaatctcggggctcctccgcgcacgcagttctcagggctgcgcagggacctgccgccctcggtgcacctgctcacgctggccagctggggccccgaaatggtgctgctgcgcttggagcaccagtttgccgtaggagaggattccggacgtaacctgagcgcccccgttaccttgaacttgagggacctgttctccaccttcaccatcacccgcctgcaggagaccacgctggtggccaaccagctccgcgaggcagcctccaggctcaagtggacaacaaacacaggccccacaccccaccaaactccgtaccagctggacccggccaacatcacgctggaacccatggaaatccgcactttcctggcctcagttcaatggaaggaggtggatggttaggtctgctgggatgggccctccaagcccaagcctcctgctccgggggcagaccagactctgactctcctcttggggctgctgccattaaaacgctactactaagactc

SEQ ID NO: 372265 - DNA, 1893 bp, Homo sapiens
cagactttcagcccctttaattaggtgctctgagaagaggtcagaatggcaggcagggggtggggaaggcggtgcttcttgagccccacttagcaactggtcactcatcctctggcagctggatcttgctggggtcgaagcagttggattccatgatgggaaggccattggcctctcggtatttcacaagcctctcagcttcgcggcgggaccactctttcatcccatcccacgctcttggacaccctgtgcacctgtagtcaggcagataggccacaaaggtgctgccaaggaccaggatgatggagacgccaaagaagaagacaagtcgcatgttccagacgtccaaaacggggtccttgtcataaccatgggagtctgggttcttctcatacaagttttcgtcctcgggttctgggtcctcttgccacggtgtggtcggttctgggggccgctttcccgccacagcggacggggcgaccacagtcctggagaagctagattcccagcggacgcgggcggccgggagccctcgcgtcgccgctgccgccaaaagacggcgagcgctcaaaccaaacagcacatccgggcaacgtttgatcctgacacagggctgttgatggagattatgaacatgaatcagcaactcctgctgcctgttcgccagaccttcttctggtacaacgccagtataggtgacaacgaaagtgaccaggcctcaggtgcctacatcttcagacccaaccaacagaaaccgctgcctgtgagccgctgggctcagatccacctggtgaagacacccttggtgcaggaggtgcaccagaacttctcagcttggtgttcccaggtggttcgcctgtacccaggacagcggcacctggagctagagtggtcggtggggccgatacctgtgggcgacacctgggggaaggaggtcatcagccgttttgacacaccgctggagacaaagggacgcttctacacagacagcaatggccgggagatcctggagaggaggcgggattatcgacccacctggaaactgaaccagacggagcccgtggcaggaaactactatccagtcaacacccggatttacatcacggatggaaacatgcagctgactgtgctgactgaccgctcccaggggggcagcagcctgagagatggctcgctggagctcatggtgcaccgaaggctgctgaaggacgatggacgcggagtatcggagccactaatggagaacgggtcgggggcgtgggtgcgagggcgccacctggtgctgctggacacagcccaggctgcagccgccggacaccggctcctggcggagcaggaggtcctggcccctcaggtggtgctggccccgggtggcggcgccgcctacaatctcggggctcctccgcgcacgcagttctcagggctgcgcagggacctgccgccctcggtgcacctgctcacgctggccagctggggccccgaaatggtgctgctgcgcttggagcaccagtttgccgtaggagaggattccggacgtaacctgagcgcccccgttaccttgaacttgagggacctgttctccaccttcaccatcacccgcctgcaggagaccacgctggtggccaaccagctccgcgaggcagcctccaggctcaagtggacaacaaacacaggccccacaccccaccaaactccgtaccagctggacccggccaacatcacgctggaacccatggaaatccgcactttcctggcctcagttcaatggaaggaggtggatggttaggtctgctgggatgggccctccaagcccaagcctcctgctccgggggcagaccagactctgactctcctcttggggctgctgccattaaaacgctactactaagactc

SEQ ID NO: 372266 - DNA, 170 bp, Homo sapiens
accaatctatcaccctatagaagaactaatgttagtataactatgaaaactccccagtcatggaaaatctggataagtggcgggccctgcactcatgagggcttccaatgtgctgcccccctcttaatactcaccaataaattctacttcctgtccacctaaaaaaaaaa

SEQ ID NO: 372267 - DNA, 3529 bp, Homo sapiens
  misc_feature (310)..(310): n is a, c, g, or t
cttgggtcgctgtctactgctccttcatcagctttgccaactctcggagctcggaggacacgaagcaaatgatgagtagcttcatgtgagacttgcccggcattaagaggcattccgtcttggaattccggcattaagaggcattccgtcttcatagcccgtgagacgccagtgtcacctttagcccaaccagtgccctgagggtggcattttcctaccttcctgtaacgacccccgggattgcccagggctacagcctctctcccgtgagcctccagaccgcgccctggccccgccccccaccccgatnggcccggccgggtctgggggcggggcgtttgcggcctttccagggccggggaaccccaggaggaagctgctgagccatgggcgcctacgcgcgggcttcgggggtctgcgctcgcggctgcctggactcagcaggcccctggaccatgtcccgcgccctgcggccaccgctcccgcctctctgctttttccttttgttgctggcggctgccggtgctcgggccgggggatacgagacatgccccacagtgcagccgaacatgctgaacgtgcacctgctgcctcacacacatgatgacgtgggctggctcaaaaccgtggaccagtacttttatggaatcaagaatgacatccagcacgccggtgtgcagtacatcctggactcggtcatctctgccttgctggcagatcccacccgtcgcttcatttacgtggagattgccttcttctcccgttggtggcaccagcagacaaatgccacacaggaagtcgtgcgagaccttgtgcgccaggggcgcctggagttcgccaatggtggctgggtgatgaacgatgaggcagccacccactacggtgccatcgtggaccagatgacacttgggctgcgctttctggaggacacatttggcaatgatgggcgaccccgtgtggcctggcacattgaccccttcggccactctcgggagcaggcctcgctgtttgcgcagatgggcttcgacggcttcttctttgggcgccttgattatcaagataagtgggtacggatgcagaagctggagatggagcaggtgtggcgggccagcaccagcctgaagcccccgaccgcggacctcttcactggtgtgcttcccaatggttacaacccgccaaggaatctgtgctgggatgtgctgtgtgtcgatcagccgctggtggaggaccctcgcagccccgagtacaacgccaaggagctggtcgattacttcctaaatgtggccactgcccagggccggtattaccgcaccaaccacactgtgatgaccatgggctcggacttccaatatgagaatgccaacatgtggttcaagaaccttgacaagctcatccggctggtaaatgcgcagcaggcaaaaggaagcagtgtccatgttctctactccacccccgcttgttacctctgggagctgaacaaggccaacctcacctggtcagtgaaacatgacgacttcttcccttacgcggatggcccccaccagttctggaccggttacttttccagtcggccggccctcaaacgctacgagcgcctcagctacaacttcctgcaggtgtgcaaccagctggaggcgctggtgggcctggcggccaacgtgggaccctatggctccggagacagtgcacccctcaatgaggcgatggctgtgctccagcatcacgacgccgtcagcggcacctcccgccagcacgtggccaacgactacgcgcgccagcttgcggcaggctgggggccttgcgaggttcttctgagcaacgcgctggcgcggctcagaggcttcaaagatcacttcaccttttgccaacagctaaacatcagcatctgcccgctcagccagacggcggcgcgcttccaggtcatcgtttataatcccctggggcggaaggtgaattggatggtacggctgccggtcagcgaaggcgttttcgttgtgaaggaccccaatggcaggacagtgcccagcgatgtggtaatatttcccagctcagacagccaggcgcaccctccggagctgctgttctcagcctcactgcccgccctgggcttcagcacctattcagtagcccaggtgcctcgctggaagccccaggcccgcgcaccacagcccatccccagaagatcctggtcccctgctttaaccatcgaaaatgagcacatccgggcaacgtttgatcctgacacagggctgttgatggagattatgaacatgaatcagcaactcctgctgcctgttcgccagaccttcttctggtacaacgccagtataggtgacaacgaaagtgaccaggcctcaggtgcctacatcttcagacccaaccaacagaaaccgctgcctgtgagccgctgggctcagatccacctggtgaagacacccttggtgcaggaggtgcaccagaacttctcagcttggtgttcccaggtggttcgcctgtacccaggacagcggcacctggagctagagtggtcggtggggccgatacctgtgggcgacacctgggggaaggaggtcatcagccgttttgacacaccgctggagacaaagggacgcttctacacagacagcaatggccgggagatcctggagaggaggcgggattatcgacccacctggaaactgaaccagacggagcccgtggcaggaaactactatccagtcaacacccggatttacatcacggatggaaacatgcagctgactgtgctgactgaccgctcccaggggggcagcagcctgagagatggctcgctggagctcatggtgcaccgaaggctgctgaaggacgatggacgcggagtatcggagccactaatggagaacgggtcgggggcgtgggtgcgagggcgccacctggtgctgctggacacagcccaggctgcagccgccggacaccggctcctggcggagcaggaggtcctggcccctcaggtggtgctggccccgggtggcggcgccgcctacaatctcggggctcctccgcgcacgcagttctcagggctgcgcagggacctgccgccctcggtgcacctgctcacgctggccagctggggccccgaaatggtgctgctgcgcttggagcaccagtttgccgtaggagaggattccggacgtaacctgagcgcccccgttaccttgaacttgagggacctgttctccaccttcaccatcacccgcctgcaggagaccacgctggtggccaaccagctccgcgaggcagcctccaggctcaagtggacaacaaacacaggccccacaccccaccaaactccgtaccagctggacccggccaacatcacgctggaacccatggaaatccgcactttcctggcctcagttcaatggaaggaggtggatggttaggtctgctgggatgggccctccaagcccaagcctcctgctccgggggcagaccagactctgactctcctcttggggctgctgccattaaaacgctactactaagactc

SEQ ID NO: 372268 - DNA, 4293 bp, Homo sapiens
  misc_feature (310)..(310): n is a, c, g, or t
cttgggtcgctgtctactgctccttcatcagctttgccaactctcggagctcggaggacacgaagcaaatgatgagtagcttcatgtgagacttgcccggcattaagaggcattccgtcttggaattccggcattaagaggcattccgtcttcatagcccgtgagacgccagtgtcacctttagcccaaccagtgccctgagggtggcattttcctaccttcctgtaacgacccccgggattgcccagggctacagcctctctcccgtgagcctccagaccgcgccctggccccgccccccaccccgatnggcccggccgggtctgggggcggggcgtttgcggcctttccagggccggggaaccccaggaggaagctgctgagccatgggcgcctacgcgcgggcttcgggggtctgcgctcgcggctgcctggactcagcaggcccctggaccatgtcccgcgccctgcggccaccgctcccgcctctctgctttttccttttgttgctggcggctgccggtgctcgggccgggggatacgagacatgccccacagtgcagccgaacatgctgaacgtgcacctgctgcctcacacacatgatgacgtgggctggctcaaaaccgtggaccagtacttttatggaatcaagaatgacatccagcacgccggtgtgcagtacatcctggactcggtcatctctgccttgctggcagatcccacccgtcgcttcatttacgtggagattgccttcttctcccgttggtggcaccagcagacaaatgccacacaggaagtcgtgcgagaccttgtgcgccaggggcgcctggagttcgccaatggtggctgggtgatgaacgatgaggcagccacccactacggtgccatcgtggaccagatgacacttgggctgcgctttctggaggacacatttggcaatgatgggcgaccccgtgtggcctggcacattgaccccttcggccactctcgggagcaggcctcgctgtttgcgcagatgggcttcgacggcttcttctttgggcgccttgattatcaagataagtgggtacggatgcagaagctggagatggagcaggtgtggcgggccagcaccagcctgaagcccccgaccgcggacctcttcactggtgtgcttcccaatggttacaacccgccaaggaatctgtgctgggatgtgctgtgtgtcgatcagccgctggtggaggaccctcgcagccccgagtacaacgccaaggagctggtcgattacttcctaaatgtggccactgcccagggccggtattaccgcaccaaccacactgtgatgaccatgggctcggacttccaatatgagaatgccaacatgtggttcaagaaccttgacaagctcatccggctggtaaatgcgcagcaggcaaaaggaagcagtgtccatgttctctactccacccccgcttgttacctctgggagctgaacaaggccaacctcacctggtcagtgaaacatgacgacttcttcccttacgcggatggcccccaccagttctggaccggttacttttccagtcggccggccctcaaacgctacgagcgcctcagctacaacttcctgcaggtgtgcaaccagctggaggcgctggtgggcctggcggccaacgtgggaccctatggctccggagacagtgcacccctcaatgaggcgatggctgtgctccagcatcacgacgccgtcagcggcacctcccgccagcacgtggccaacgactacgcgcgccagcttgcggcaggctgggggccttgcgaggttcttctgagcaacgcgctggcgcggctcagaggcttcaaagatcacttcaccttttgccaacagctaaacatcagcatctgcccgctcagccagacggcggcgcgcttccaggtcatcgtttataatcccctggggcggaaggtgaattggatggtacggctgccggtcagcgaaggcgttttcgttgtgaaggaccccaatggcaggacagtgcccagcgatgtggtaatatttcccagctcagacagccaggcgcaccctccggagctgctgttctcagcctcactgcccgccctgggcttcagcacctattcagtagcccaggtgcctcgctggaagccccaggcccgcgcaccacagcccatccccagaagatcctggtcccctgctttaaccatcgaaaatgagcacatccgggcaacgtttgatcctgacacagggctgttgatggagattatgaacatgaatcagcaactcctgctgcctgttcgccagaccttcttctggtacaacgccagtataggtgacaacgaaagtgaccaggcctcaggtgcctacatcttcagacccaaccaacagaaaccgctgcctgtgagccgctgggctcagatccacctggtgaagacacccttggtgcaggaggtgcaccagaacttctcagcttggtgttcccaggtggttcgcctgtacccaggacagcggcacctggagctagagtggtcggtggggccgatacctgtgggcgacacctgggggaaggaggtcatcagccgttttgacacaccgctggagacaaagggacgcttctacacagacagcaatggccgggagatcctggagaggaggcgggattatcgacccacctggaaactgaaccagacggagcccgtggcaggaaactactatccagtcaacacccggatttacatcacggatggaaacatgcagctgactgtgctgactgaccgctcccaggggggcagcagcctgagagatggctcgctggagctcatggtgcaccgaaggctgctgaaggacgatggacgcggagtatcggagccactaatggagaacgggtcgggggcgtgggtgcgagggcgccacctggtgctgctggacacagcccaggctgcagccgccggacaccggctcctggcggagcaggaggtcctggcccctcaggtggtgctggccccgggtggcggcgccgcctacaatctcggggctcctccgcgcacgcagttctcagggctgcgcagggacctgccgccctcggtgcacctgctcacgctggccagctggggccccgaaatggtgctgctgcgcttggagcaccagtttgccgtaggagaggattccggacgtaacctgagcgcccccgttaccttgaacttgagggacctgttctccaccttcaccatcacccgcctgcaggagaccacgctggtggccaaccagctccgcgaggcagcctccaggctcaagtggacaacaaacacaggccccacaccccaccaaactccgtaccagctggacccggccaacatcacgctggaacccatggaaatccgcactttcctggcctcagttcaatggaaggaggtggatggttaggtctgctgggatgggccctccaagcccaagcctcctgctccgggggcagaccagactctgactctcctcttggggctgctgccattaaaacgctactactaagactcaggtcgctctgtgactgagttgtgccactgaagatcctggtgtcgccatgggccgccgccccgcccgttgttaccggtattgtaagaacaagccgtacccaaagtctcgcttctgccgaggtgtccctgatgccaagattcgcatttttgacctggggcggaaaaaggcaaaagtggatgagtttccgctttgtggccacatggtgtcagatgaatatgagcagctgtcctctgaagccctggaggctgcccgaatttgtgccaataagtacatggtaaaaagttgtggcaaagatggcttccatatccgggtgcggctccaccccttccacgtcatccgcatcaacaagatgttgtcctgtgctggggctgacaggctccaaacaggcatgcgaggtgcctttggaaagccccagggcactgtggccagggttcacattggccaagttatcatgtccatccgcaccaagctgcagaacaaggagcatgtgattgaggccctgcgcagggccaagttcaagtttcctggccgccagaagatccacatctcaaagaagtggggcttcaccaagttcaatgctgatgaatttgaagacatggtggctgaaaagcggctcatcccagatggctgtggggtcaagtacatccccagtcgtggccctctggacaagtggcgggccctgcactcatgagggcttccaatgtgctgcccccctcttaatactcaccaataaattctacttcctgtccacctaaaaaaaaaa

SEQ ID NO: 372269 - DNA, 4130 bp, Homo sapiens
  misc_feature (310)..(310): n is a, c, g, or t
cttgggtcgctgtctactgctccttcatcagctttgccaactctcggagctcggaggacacgaagcaaatgatgagtagcttcatgtgagacttgcccggcattaagaggcattccgtcttggaattccggcattaagaggcattccgtcttcatagcccgtgagacgccagtgtcacctttagcccaaccagtgccctgagggtggcattttcctaccttcctgtaacgacccccgggattgcccagggctacagcctctctcccgtgagcctccagaccgcgccctggccccgccccccaccccgatnggcccggccgggtctgggggcggggcgtttgcggcctttccagggccggggaaccccaggaggaagctgctgagccatgggcgcctacgcgcgggcttcgggggtctgcgctcgcggctgcctggactcagcaggcccctggaccatgtcccgcgccctgcggccaccgctcccgcctctctgctttttccttttgttgctggcggctgccggtgctcgggccgggggatacgagacatgccccacagtgcagccgaacatgctgaacgtgcacctgctgcctcacacacatgatgacgtgggctggctcaaaaccgtggaccagtacttttatggaatcaagaatgacatccagcacgccggtgtgcagtacatcctggactcggtcatctctgccttgctggcagatcccacccgtcgcttcatttacgtggagattgccttcttctcccgttggtggcaccagcagacaaatgccacacaggaagtcgtgcgagaccttgtgcgccaggggcgcctggagttcgccaatggtggctgggtgatgaacgatgaggcagccacccactacggtgccatcgtggaccagatgacacttgggctgcgctttctggaggacacatttggcaatgatgggcgaccccgtgtggcctggcacattgaccccttcggccactctcgggagcaggcctcgctgtttgcgcagatgggcttcgacggcttcttctttgggcgccttgattatcaagataagtgggtacggatgcagaagctggagatggagcaggtgtggcgggccagcaccagcctgaagcccccgaccgcggacctcttcactggtgtgcttcccaatggttacaacccgccaaggaatctgtgctgggatgtgctgtgtgtcgatcagccgctggtggaggaccctcgcagccccgagtacaacgccaaggagctggtcgattacttcctaaatgtggccactgcccagggccggtattaccgcaccaaccacactgtgatgaccatgggctcggacttccaatatgagaatgccaacatgtggttcaagaaccttgacaagctcatccggctggtaaatgcgcagcaggcaaaaggaagcagtgtccatgttctctactccacccccgcttgttacctctgggagctgaacaaggccaacctcacctggtcagtgaaacatgacgacttcttcccttacgcggatggcccccaccagttctggaccggttacttttccagtcggccggccctcaaacgctacgagcgcctcagctacaacttcctgcaggtgtgcaaccagctggaggcgctggtgggcctggcggccaacgtgggaccctatggctccggagacagtgcacccctcaatgaggcgatggctgtgctccagcatcacgacgccgtcagcggcacctcccgccagcacgtggccaacgactacgcgcgccagcttgcggcaggctgggggccttgcgaggttcttctgagcaacgcgctggcgcggctcagaggcttcaaagatcacttcaccttttgccaacagctaaacatcagcatctgcccgctcagccagacggcggcgcgcttccaggtcatcgtttataatcccctggggcggaaggtgaattggatggtacggctgccggtcagcgaaggcgttttcgttgtgaaggaccccaatggcaggacagtgcccagcgatgtggtaatatttcccagctcagacagccaggcgcaccctccggagctgctgttctcagcctcactgcccgccctgggcttcagcacctattcagtagcccaggtgcctcgctggaagccccaggcccgcgcaccacagcccatccccagaagatcctggtcccctgctttaaccatcgaaaatgagcacatccgggcaacgtttgatcctgacacagggctgttgatggagattatgaacatgaatcagcaactcctgctgcctgttcgccagaccttcttctggtacaacgccagtataggtgacaacgaaagtgaccaggcctcaggtgcctacatcttcagacccaaccaacagaaaccgctgcctgtgagccgctgggctcagatccacctggtgaagacacccttggtgcaggaggtgcaccagaacttctcagcttggtgttcccaggtggttcgcctgtacccaggacagcggcacctggagctagagtggtcggtggggccgatacctgtgggcgacacctgggggaaggaggtcatcagccgttttgacacaccgctggagacaaagggacgcttctacacagacagcaatggccgggagatcctggagaggaggcgggattatcgacccacctggaaactgaaccagacggagcccgtggcaggaaactactatccagtcaacacccggatttacatcacggatggaaacatgcagctgactgtgctgactgaccgctcccaggggggcagcagcctgagagatggctcgctggagctcatggtgcaccgaaggctgctgaaggacgatggacgcggagtatcggagccactaatggagaacgggtcgggggcgtgggtgcgagggcgccacctggtgctgctggacacagcccaggctgcagccgccggacaccggctcctggcggagcaggaggtcctggcccctcaggtggtgctggccccgggtggcggcgccgcctacaatctcggggctcctccgcgcacgcagttctcagggctgcgcagggacctgccgccctcggtgcacctgctcacgctggccagctggggccccgaaatggtgctgctgcgcttggagcaccagtttgccgtaggagaggattccggacgtaacctgagcgcccccgttaccttgaacttgagggacctgttctccaccttcaccatcacccgcctgcaggagaccacgctggtggccaaccagctccgcgaggcagcctccaggctcaagtggacaacaaacacaggccccacaccccaccaaactccgtaccagctggacccggccaacatcacgctggaacccatggaaatccgcactttcctggcctcagttcaatggaaggaggtggatggttaggtctgctgggatgggccctccaagcccaagcctcctgctccgggggcagaccagactctgactctcctcttggggctgctgccattaaaacgctactactaagactcaggtcgctctgtgactgagttgtgccactgaagatcctggtgtcgccatgggccgccgccccgcccgttgttaccggtattgtaagaacaagccgtacccaaagtctcgcttctgccgaggtgtccctgatgccaagattcgcatttttgacctggggcggaaaaaggcaaaagtggatgagtttccgctttgtggccacatggtgtcagatgaatatgagcagctgtcctctgaagccctggaggctgcccgaatttgtgccaataagtacatggtaaaaagttgtggcaaagatggcttccatatccgggtgcggctccaccccttccacgtcatccgcatcaacaagatgttgtcctgtgctggggctgacagatccacatctcaaagaagtggggcttcaccaagttcaatgctgatgaatttgaagacatggtggctgaaaagcggctcatcccagatggctgtggggtcaagtacatccccagtcgtggccctctggacaagtggcgggccctgcactcatgagggcttccaatgtgctgcccccctcttaatactcaccaataaattctacttcctgtccacctaaaaaaaaaa

SEQ ID NO: 372270 - DNA, 3385 bp, Homo sapiens
  misc_feature (310)..(310): n is a, c, g, or t
cttgggtcgctgtctactgctccttcatcagctttgccaactctcggagctcggaggacacgaagcaaatgatgagtagcttcatgtgagacttgcccggcattaagaggcattccgtcttggaattccggcattaagaggcattccgtcttcatagcccgtgagacgccagtgtcacctttagcccaaccagtgccctgagggtggcattttcctaccttcctgtaacgacccccgggattgcccagggctacagcctctctcccgtgagcctccagaccgcgccctggccccgccccccaccccgatnggcccggccgggtctgggggcggggcgtttgcggcctttccagggccggggaaccccaggaggaagctgctgagccatgggcgcctacgcgcgggcttcgggggtctgcgctcgcggctgcctggactcagcaggcccctggaccatgtcccgcgccctgcggccaccgctcccgcctctctgctttttccttttgttgctggcggctgccggtgctcgggccgggggatacgagacatgccccacagtgcagccgaacatgctgaacgtgcacctggtcagtgaaacatgacgacttcttcccttacgcggatggcccccaccagttctggaccggttacttttccagtcggccggccctcaaacgctacgagcgcctcagctacaacttcctgcaggtgtgcaaccagctggaggcgctggtgggcctggcggccaacgtgggaccctatggctccggagacagtgcacccctcaatgaggcgatggctgtgctccagcatcacgacgccgtcagcggcacctcccgccagcacgtggccaacgactacgcgcgccagcttgcggcaggctgggggccttgcgaggttcttctgagcaacgcgctggcgcggctcagaggcttcaaagatcacttcaccttttgccaacagctaaacatcagcatctgcccgctcagccagacggcggcgcgcttccaggtcatcgtttataatcccctggggcggaaggtgaattggatggtacggctgccggtcagcgaaggcgttttcgttgtgaaggaccccaatggcaggacagtgcccagcgatgtggtaatatttcccagctcagacagccaggcgcaccctccggagctgctgttctcagcctcactgcccgccctgggcttcagcacctattcagtagcccaggtgcctcgctggaagccccaggcccgcgcaccacagcccatccccagaagatcctggtcccctgctttaaccatcgaaaatgagcacatccgggcaacgtttgatcctgacacagggctgttgatggagattatgaacatgaatcagcaactcctgctgcctgttcgccagaccttcttctggtacaacgccagtataggtgacaacgaaagtgaccaggcctcaggtgcctacatcttcagacccaaccaacagaaaccgctgcctgtgagccgctgggctcagatccacctggtgaagacacccttggtgcaggaggtgcaccagaacttctcagcttggtgttcccaggtggttcgcctgtacccaggacagcggcacctggagctagagtggtcggtggggccgatacctgtgggcgacacctgggggaaggaggtcatcagccgttttgacacaccgctggagacaaagggacgcttctacacagacagcaatggccgggagatcctggagaggaggcgggattatcgacccacctggaaactgaaccagacggagcccgtggcaggaaactactatccagtcaacacccggatttacatcacggatggaaacatgcagctgactgtgctgactgaccgctcccaggggggcagcagcctgagagatggctcgctggagctcatggtgcaccgaaggctgctgaaggacgatggacgcggagtatcggagccactaatggagaacgggtcgggggcgtgggtgcgagggcgccacctggtgctgctggacacagcccaggctgcagccgccggacaccggctcctggcggagcaggaggtcctggcccctcaggtggtgctggccccgggtggcggcgccgcctacaatctcggggctcctccgcgcacgcagttctcagggctgcgcagggacctgccgccctcggtgcacctgctcacgctggccagctggggccccgaaatggtgctgctgcgcttggagcaccagtttgccgtaggagaggattccggacgtaacctgagcgcccccgttaccttgaacttgagggacctgttctccaccttcaccatcacccgcctgcaggagaccacgctggtggccaaccagctccgcgaggcagcctccaggctcaagtggacaacaaacacaggccccacaccccaccaaactccgtaccagctggacccggccaacatcacgctggaacccatggaaatccgcactttcctggcctcagttcaatggaaggaggtggatggttaggtctgctgggatgggccctccaagcccaagcctcctgctccgggggcagaccagactctgactctcctcttggggctgctgccattaaaacgctactactaagactcaggtcgctctgtgactgagttgtgccactgaagatcctggtgtcgccatgggccgccgccccgcccgttgttaccggtattgtaagaacaagccgtacccaaagtctcgcttctgccgaggtgtccctgatgccaagattcgcatttttgacctggggcggaaaaaggcaaaagtggatgagtttccgctttgtggccacatggtgtcagatgaatatgagcagctgtcctctgaagccctggaggctgcccgaatttgtgccaataagtacatggtaaaaagttgtggcaaagatggcttccatatccgggtgcggctccaccccttccacgtcatccgcatcaacaagatgttgtcctgtgctggggctgacaggctccaaacaggcatgcgaggtgcctttggaaagccccagggcactgtggccagggttcacattggccaagttatcatgtccatccgcaccaagctgcagaacaaggagcatgtgattgaggccctgcgcagggccaagttcaagtttcctggccgccagaagatccacatctcaaagaagtggggcttcaccaagttcaatgctgatgaatttgaagacatggtggctgaaaagcggctcatcccagatggctgtggggtcaagtacatccccagtcgtggccctctggacaagtggcgggccctgcactcatgagggcttccaatgtgctgcccccctcttaatactcaccaataaattctacttcctgtccacctaaaaaaaaaa

SEQ ID NO: 372271 - DNA, 3083 bp, Homo sapiens
gtggcgggcacctgtagtcccaggtactcatgaggctgaggctggagaatggcgtgaacccaagaggtggagcttgcagtgagctgagattgagccactgcactacagcctgggcaacaaagtaagactccgtcccaaaaaaaaaaagttgtgttttttggtaacaatctgacagtcctgcaaaacgattattcctgccctataatgtcacacttagtttttccacaaaagtttttaataataaagttggaattattgtaaaagtttagtaaaatttcaggatggtctcgatctgacctcgtgatccgcccgcctcggtctctcaaagtgctgggattacaggcgtgagccaccgcccccagccgtcctcgagttccttcttaaagcctctaagaatcctgcccgccagcaccggacctttcgcttccccttggggtctcagctgagtcccacagaacctcaccggactcattgtctatgagcagatgaggcgatggctgtgctccagcatcacgacgccgtcagcggcacctcccgccagcacgtggccaacgactacgcgcgccagcttgcggcaggctgggggccttgcgaggttcttctgagcaacgcgctggcgcggctcagaggcttcaaagatcacttcaccttttgccaacagctaaacatcagcatctgcccgctcagccagacggcggcgcgcttccaggtcatcgtttataatcccctggggcggaaggtgaattggatggtacggctgccggtcagcgaaggcgttttcgttgtgaaggaccccaatggcaggacagtgcccagcgatgtggtaatatttcccagctcagacagccaggcgcaccctccggagctgctgttctcagcctcactgcccgccctgggcttcagcacctattcagtagcccaggtgcctcgctggaagccccaggcccgcgcaccacagcccatccccagaagatcctggtcccctgctttaaccatcgaaaatgagcacatccgggcaacgtttgatcctgacacagggctgttgatggagattatgaacatgaatcagcaactcctgctgcctgttcgccagaccttcttctggtacaacgccagtataggtgacaacgaaagtgaccaggcctcaggtgcctacatcttcagacccaaccaacagaaaccgctgcctgtgagccgctgggctcagatccacctggtgaagacacccttggtgcaggaggtgcaccagaacttctcagcttggtgttcccaggtggttcgcctgtacccaggacagcggcacctggagctagagtggtcggtggggccgatacctgtgggcgacacctgggggaaggaggtcatcagccgttttgacacaccgctggagacaaagggacgcttctacacagacagcaatggccgggagatcctggagaggaggcgggattatcgacccacctggaaactgaaccagacggagcccgtggcaggaaactactatccagtcaacacccggatttacatcacggatggaaacatgcagctgactgtgctgactgaccgctcccaggggggcagcagcctgagagatggctcgctggagctcatggtgcaccgaaggctgctgaaggacgatggacgcggagtatcggagccactaatggagaacgggtcgggggcgtgggtgcgagggcgccacctggtgctgctggacacagcccaggctgcagccgccggacaccggctcctggcggagcaggaggtcctggcccctcaggtggtgctggccccgggtggcggcgccgcctacaatctcggggctcctccgcgcacgcagttctcagggctgcgcagggacctgccgccctcggtgcacctgctcacgctggccagctggggccccgaaatggtgctgctgcgcttggagcaccagtttgccgtaggagaggattccggacgtaacctgagcgcccccgttaccttgaacttgagggacctgttctccaccttcaccatcacccgcctgcaggagaccacgctggtggccaaccagctccgcgaggcagcctccaggctcaagtggacaacaaacacaggccccacaccccaccaaactccgtaccagctggacccggccaacatcacgctggaacccatggaaatccgcactttcctggcctcagttcaatggaaggaggtggatggttaggtctgctgggatgggccctccaagcccaagcctcctgctccgggggcagaccagactctgactctcctcttggggctgctgccattaaaacgctactactaagactcaggtcgctctgtgactgagttgtgccactgaagatcctggtgtcgccatgggccgccgccccgcccgttgttaccggtattgtaagaacaagccgtacccaaagtctcgcttctgccgaggtgtccctgatgccaagattcgcatttttgacctggggcggaaaaaggcaaaagtggatgagtttccgctttgtggccacatggtgtcagatgaatatgagcagctgtcctctgaagccctggaggctgcccgaatttgtgccaataagtacatggtaaaaagttgtggcaaagatggcttccatatccgggtgcggctccaccccttccacgtcatccgcatcaacaagatgttgtcctgtgctggggctgacaggctccaaacaggcatgcgaggtgcctttggaaagccccagggcactgtggccagggttcacattggccaagttatcatgtccatccgcaccaagctgcagaacaaggagcatgtgattgaggccctgcgcagggccaagttcaagtttcctggccgccagaagatccacatctcaaagaagtggggcttcaccaagttcaatgctgatgaatttgaagacatggtggctgaaaagcggctcatcccagatggctgtggggtcaagtacatccccagtcgtggccctctggacaagtggcgggccctgcactcatgagggcttccaatgtgctgcccccctcttaatactcaccaataaattctacttcctgtccacctaaaaaaaaaa

SEQ ID NO: 372272 - DNA, 3034 bp, Homo sapiens
  misc_feature (310)..(310): n is a, c, g, or t
cttgggtcgctgtctactgctccttcatcagctttgccaactctcggagctcggaggacacgaagcaaatgatgagtagcttcatgtgagacttgcccggcattaagaggcattccgtcttggaattccggcattaagaggcattccgtcttcatagcccgtgagacgccagtgtcacctttagcccaaccagtgccctgagggtggcattttcctaccttcctgtaacgacccccgggattgcccagggctacagcctctctcccgtgagcctccagaccgcgccctggccccgccccccaccccgatnggcccggccgggtctgggggcggggcgtttgcggcctttccagggccggggaaccccaggaggaagctgctgagccatgggcgcctacgcgcgggcttcgggggtctgcgctcgcggctgcctggactcagcaggcccctggaccatgtcccgcgccctgcggccaccgctcccgcctctctgctttttccttttgttgctggcggctgccggtgctcgggccgggggatacgagacatgccccacagtgcagccgaacatgctgaacgtgcacctgctgcctcacacacatgatgacgtgggctggctcaaaaccgtggaccagtacttttatggaatcaagaatgacatccagcacgccggtgtgcagtacatcctggactcggtcatctctgccttgctggcagatcccacccgtcgcttcatttacgtggagattgccttcttctcccgttggtggcaccagcagacaaatgccacacaggaagtcgtgcgagaccttgtgcgccaggggcgcctggagttcgccaatggtggctgggtgatgaacgatgaggcagccacccactacggtgccatcgtggaccagatgacacttgggctgcgctttctggaggacacatttggcaatgatgggcgaccccgtgtggcctggcacattgaccccttcggccactctcgggagcaggcctcgctgtttgcgcagatgggcttcgacggcttcttctttgggcgccttgattatcaagataagtgggtacggatgcagaagctggagatggagcaggtgtggcgggccagcaccagcctgaagcccccgaccgcggacctcttcactggtgtgcttcccaatggttacaacccgccaaggaatctgtgctgggatgtgctgtgtgtcgatcagccgctggtggaggaccctcgcagccccgagtacaacgccaaggagctggtcgattacttcctaaatgtggccactgcccagggccggtattaccgcaccaaccacactgtgatgaccatgggctcggacttccaatatgagaatgccaacatgtggttcaagaaccttgacaagctcatccggctggtaaatgcgcagcaggcaaaaggaagcagtgtccatgttctctactccacccccgcttgttacctctgggagctgaacaaggccaacctcacctggtcagtgaaacatgacgacttcttcccttacgcggatggcccccaccagttctggaccggttacttttccagtcggccggccctcaaacgctacgagcgcctcagctacaacttcctgcaggtgtgcaaccagctggaggcgctggtgggcctggcggccaacgtgggaccctatggctccggagacagtgcacccctcaatgaggcgatggctgtgctccagcatcacgacgccgtcagcggcacctcccgccagcacgtggccaacgactacgcgcgccagcttgcggcaggctgggggccttgcgaggttcttctgagcaacgcgctggcgcggctcagaggcttcaaagatcacttcaccttttgccaacagctaaacatcagcatctgcccgctcagccagacggcggcgcgcttccaggtcatcgtttataatcccctggggcggaaggtgaattggatggtacggctgccggtcagcgaaggcgttttcgttgtgaaggaccccaatggcaggacagtgcccagcgatgtggtaatatttcccagctcagacagccaggcgcaccctccggagctgctgttctcagcctcactgcccgccctgggcttcagcacctattcagtagcccaggtgcctcgctggaagccccaggcccgcgcaccacagcccatccccagaagatcctggtcccctgctttaaccatcgaaaatgagcacatccgggcaacgtttgatcctgacacagggctgttgatggagattatgaacatgaatcagcaactcctgctgcctgttcgccagaccttcttctggtacaacgccagtataggtgacaacgaaagtgaccaggcctcaggtgcctacatcttcagacccaaccaacagaaaccgctgcctgtgagccgctgggctcagatccacctggtgaagacacccttggtgcaggaggtgcaccagaacttctcagcttggtgttcccaggtggttcgcctgtacccaggacagcggcacctggagctagagtggtcggtggggccgatacctgtgggcgacacctgggggaaggaggtcatcagccgttttgacacaccgctggagacaaagggacgcttctacacagacagcaatggccgggagatcctggagaggaggcgggattatcgacccacctggaaactgaaccagacggagcccgtggcaggaaactactatccagtcaacacccggatttacatcacggatggaaacatgcagctgactgtgctgactgaccgctcccaggggggcagcagcctgagagatggctcgctggagctcatggtgcaccgaaggctgctgaaggacgatggacgcggagtatcggagccactaatggagaacgggtcgggggcgtgggtgcgagggcgccacctggtgctgctggacacagcccaggctgcagccgccggacaccggcctcctgctccgggggcagaccagactctgactctcctcttggggctgctgccattaaaacgctactactaagactc

SEQ ID NO: 372273 - DNA, 2991 bp, Homo sapiens
  misc_feature (310)..(310): n is a, c, g, or t
cttgggtcgctgtctactgctccttcatcagctttgccaactctcggagctcggaggacacgaagcaaatgatgagtagcttcatgtgagacttgcccggcattaagaggcattccgtcttggaattccggcattaagaggcattccgtcttcatagcccgtgagacgccagtgtcacctttagcccaaccagtgccctgagggtggcattttcctaccttcctgtaacgacccccgggattgcccagggctacagcctctctcccgtgagcctccagaccgcgccctggccccgccccccaccccgatnggcccggccgggtctgggggcggggcgtttgcggcctttccagggccggggaaccccaggaggaagctgctgagccatgggcgcctacgcgcgggcttcgggggtctgcgctcgcggctgcctggactcagcaggcccctggaccatgtcccgcgccctgcggccaccgctcccgcctctctgctttttccttttgttgctggcggctgccggtgctcgggccgggggatacgagacatgccccacagtgcagccgaacatgctgaacgtgcacctgctgcctcacacacatgatgacgtgggctggctcaaaaccgtggaccagtacttttatggaatcaagaatgacatccagcacgccggtgtgcagtacatcctggactcggtcatctctgccttgctggcagatcccacccgtcgcttcatttacgtggagattgccttcttctcccgttggtggcaccagcagacaaatgccacacaggaagtcgtgcgagaccttgtgcgccaggggcgcctggagttcgccaatggtggctgggtgatgaacgatgaggcagccacccactacggtgccatcgtggaccagatgacacttgggctgcgctttctggaggacacatttggcaatgatgggcgaccccgtgtggcctggcacattgaccccttcggccactctcgggagcaggcctcgctgtttgcgcagatgggcttcgacggcttcttctttgggcgccttgattatcaagataagtgggtacggatgcagaagctggagatggagcaggtgtggcgggccagcaccagcctgaagcccccgaccgcggacctcttcactggtgtgcttcccaatggttacaacccgccaaggaatctgtgctgggatgtgctgtgtgtcgatcagccgctggtggaggaccctcgcagccccgagtacaacgccaaggagctggtcgattacttcctaaatgtggccactgcccagggccggtattaccgcaccaaccacactgtgatgaccatgggctcggacttccaatatgagaatgccaacatgtggttcaagaaccttgacaagctcatccggctggtaaatgcgcagcaggcaaaaggaagcagtgtccatgttctctactccacccccgcttgttacctctgggagctgaacaaggccaacctcacctggtcagtgaaacatgacgacttcttcccttacgcggatggcccccaccagttctggaccggttacttttccagtcggccggccctcaaacgctacgagcgcctcagctacaacttcctgcaggtgtgcaaccagctggaggcgctggtgggcctggcggccaacgtgggaccctatggctccggagacagtgcacccctcaatgaggcgatggctgtgctccagcatcacgacgccgtcagcggcacctcccgccagcacgtggccaacgactacgcgcgccagcttgcggcaggctgggggccttgcgaggttcttctgagcaacgcgctggcgcggctcagaggcttcaaagatcacttcaccttttgccaacagctaaacatcagcatctgcccgctcagccagacggcggcgcgcttccaggtcatcgtttataatcccctggggcggaaggtgaattggatggtacggctgccggtcagcgaaggcgttttcgttgtgaaggaccccaatggcaggacagtgcccagcgatgtggtaatatttcccagctcagacagccaggcgcaccctccggagctgctgttctcagcctcactgcccgccctgggcttcagcacctattcagtagcccaggtgcctcgctggaagccccaggcccgcgcaccacagcccatccccagaagatcctggtcccctgctttaaccatcgaaaatgagcacatccgggcaacgtttgatcctgacacagggctgttgatggagattatgaacatgaatcagcaactcctgctgcctgttcgccagaccttcttctggtacaacgccagtataggtgacaacgaaagtgaccaggcctcaggtgcctacatcttcagacccaaccaacagaaaccgctgcctgtgagccgctgggctcagatccacctggtgaagacacccttggtgcaggaggtgcaccagaacttctcagcttggtgttcccaggtggttcgcctgtacccaggacagcggcacctggagctagagtggtcggtggggccgatacctgtgggcgacacctgggggaaggaggtcatcagccgttttgacacaccggcttggagcaccagtttgccgtaggagaggattccggacgtaacctgagcgcccccgttaccttgaacttgagggacctgttctccaccttcaccatcacccgcctgcaggagaccacgctggtggccaaccagctccgcgaggcagcctccaggctcaagtggacaacaaacacaggccccacaccccaccaaactccgtaccagctggacccggccaacatcacgctggaacccatggaaatccgcactttcctggcctcagttcaatggaaggaggtggatggttaggtctgctgggatgggccctccaagcccaagcctcctgctccgggggcagaccagactctgactctcctcttggggctgctgccattaaaacgctactactaagactc

SEQ ID NO: 372274 - DNA, 2932 bp, Homo sapiens
  misc_feature (310)..(310): n is a, c, g, or t
cttgggtcgctgtctactgctccttcatcagctttgccaactctcggagctcggaggacacgaagcaaatgatgagtagcttcatgtgagacttgcccggcattaagaggcattccgtcttggaattccggcattaagaggcattccgtcttcatagcccgtgagacgccagtgtcacctttagcccaaccagtgccctgagggtggcattttcctaccttcctgtaacgacccccgggattgcccagggctacagcctctctcccgtgagcctccagaccgcgccctggccccgccccccaccccgatnggcccggccgggtctgggggcggggcgtttgcggcctttccagggccggggaaccccaggaggaagctgctgagccatgggcgcctacgcgcgggcttcgggggtctgcgctcgcggctgcctggactcagcaggcccctggaccatgtcccgcgccctgcggccaccgctcccgcctctctgctttttccttttgttgctggcggctgccggtgctcgggccgggggatacgagacatgccccacagtgcagccgaacatgctgaacgtgcacctgctgcctcacacacatgatgacgtgggctggctcaaaaccgtggaccagtacttttatggaatcaagaatgacatccagcacgccggtgtgcagtacatcctggactcggtcatctctgccttgctggcagatcccacccgtcgcttcatttacgtggagattgccttcttctcccgttggtggcaccagcagacaaatgccacacaggaagtcgtgcgagaccttgtgcgccaggggcgcctggagttcgccaatggtggctgggtgatgaacgatgaggcagccacccactacggtgccatcgtggaccagatgacacttgggctgcgctttctggaggacacatttggcaatgatgggcgaccccgtgtggcctggcacattgaccccttcggccactctcgggagcaggcctcgctgtttgcgcagatgggcttcgacggcttcttctttgggcgccttgattatcaagataagtgggtacggatgcagaagctggagatggagcaggtgtggcgggccagcaccagcctgaagcccccgaccgcggacctcttcactggtgtgcttcccaatggttacaacccgccaaggaatctgtgctgggatgtgctgtgtgtcgatcagccgctggtggaggaccctcgcagccccgagtacaacgccaaggagctggtcgattacttcctaaatgtggccactgcccagggccggtattaccgcaccaaccacactgtgatgaccatgggctcggacttccaatatgagaatgccaacatgtggttcaagaaccttgacaagctcatccggctggtaaatgcgcagcaggcaaaaggaagcagtgtccatgttctctactccacccccgcttgttacctctgggagctgaacaaggccaacctcacctggtcagtgaaacatgacgacttcttcccttacgcggatggcccccaccagttctggaccggttacttttccagtcggccggccctcaaacgctacgagcgcctcagctacaacttcctgcaggtgtgcaaccagctggaggcgctggtgggcctggcggccaacgtgggaccctatggctccggagacagtgcacccctcaatgaggcgatggctgtgctccagcatcacgacgccgtcagcggcacctcccgccagcacgtggccaacgactacgcgcgccagcttgcggcaggctgggggccttgcgaggttcttctgagcaacgcgctggcgcggctcagaggcttcaaagatcacttcaccttttgccaacagctaaacatcagcatctgcccgctcagccagacggcggcgcgcttccaggtcatcgtttataatcccctggggcggaaggtgaattggatggtacggctgccggtcagcgaaggcgttttcgttgtgaaggaccccaatggcaggacagtgcccagcgatgtggtaatatttcccagctcagacagccaggcgcaccctccggagctgctgttctcagcctcactgcccgccctgggcttcagcacctattcagtagcccaggtgcctcgctggaagccccaggcccgcgcaccacagcccatccccagaagatcctggtcccctgctttaaccatcgaaaatgagcacatccgggcaacgtttgatcctgacacagggctgttgatggagattatgaacatgaatcagcaactcctgctgcctgttcgccagaccttcttctggtacaacgccagtataggtgacaacgaaagtgaccaggcctcaggtgcctacatcttcagacccaaccaacagaaaccgctgcctgtgagccgctgggctcagatccacctggtgaagacacccttggtgcaggaggtgcaccagaacttctcagcttggtgttcccaggtggttcgcctgtacccaggacagcggcacctggagctagagtggtcggtggggccgatacctgtgggcgacacctgggggaaggaggtcatcagccgttttgacacaccgctggagacaaagggacgcttctacacagacagcaatggccgggagatcctggagaggaggcgggattatcgacccacctggaaactgaaccagacggagcccgtggcaggaaactactatccagtcaacacccggatttacatcacgctggacccggccaacatcacgctggaacccatggaaatccgcactttcctggcctcagttcaatggaaggaggtggatggttaggtctgctgggatgggccctccaagcccaagcctcctgctccgggggcagaccagactctgactctcctcttggggctgctgccattaaaacgctactactaagactc

SEQ ID NO: 372275 - DNA, 2245 bp, Homo sapiens
  misc_feature (310)..(310): n is a, c, g, or t
cttgggtcgctgtctactgctccttcatcagctttgccaactctcggagctcggaggacacgaagcaaatgatgagtagcttcatgtgagacttgcccggcattaagaggcattccgtcttggaattccggcattaagaggcattccgtcttcatagcccgtgagacgccagtgtcacctttagcccaaccagtgccctgagggtggcattttcctaccttcctgtaacgacccccgggattgcccagggctacagcctctctcccgtgagcctccagaccgcgccctggccccgccccccaccccgatnggcccggccgggtctgggggcggggcgtttgcggcctttccagggccggggaaccccaggaggaagctgctgagccatgggcgcctacgcgcgggcttcgggggtctgcgctcgcggctgcctggactcagcaggcccctggaccatgtcccgcgccctgcggccaccgctcccgcctctctgctttttccttttgttgctggcggctgccggtgctcgggccgggggatacgagacatgccccacagtgcagccgaacatgctgaacgtgcacctgctgcctcacacacatgatgacgtgggctggctcaaaaccgtggaccagtacttttatggaatcaagaatgacatccagcacgccggtgtgcagtacatcctggactcggtcatctctgccttgctggcagatcccacccgtcgcttcatttacgtggagattgccttcttctcccgttggtggcaccagcagacaaatgccacacaggaagtcgtgcgagaccttgtgcgccaggggcgcctggagttcgccaatggtggctgggtgatgaacgatgaggcagccacccactacggtgccatcgtggaccagatgacacttgggctgcgctttctggaggacacatttggcaatgatgggcgaccccgtgtggcctggcacattgaccccttcggccactctcgggagcaggcctcgctgtttgcgcagatgggcttcgacggcttcttctttgggcgccttgattatcaagataagtgggtacggatgcagaagctggagatggagcaggtgtggcgggccagcaccagcctgaagcccccgaccgcggacctcttcactggtgtgcttcccaatggttacaacccgccaaggaatctgtgctgggatgtgctgtgtgtcgatcagccgctggtggaggaccctcgcagccccgagtacaacgccaaggagctggtcgattacttcctaaatgtggccactgcccagggccggtattaccgcaccaaccacactgtgatgaccatgggctcggacttccaatatgagaatgccaacatgtggttcaagaaccttgacaagctcatccggctggtaaatgcgcagcaggcaaaaggaagcagtgtccatgttctctactccacccccgcttgttacctctgggagctgaacaaggccaacctcacctggtcagtgaaacatgacgacttcttcccttacgcggatggcccccaccagttctggaccggttacttttccagtcggccggccctcaaacgctacgagcgcctcagctacaacttcctgcaggtgtgcaaccagctggaggcgctggtgggcctggcggccaacgtgggaccctatggctccggagacagtgcacccctcaatgaggcgatggctgtgctccagcatcacgacgccgtcagcggcacctcccgccagcacgtggccaacgactacgcgcgccagcttgcggcaggctgggggccttgcgaggttcttctgagcaacgcgctggcgcggctcagaggcttcaaagatcacttcaccttttgccaacagctaaacatcagcatctgcccgctcagccagacggcggcgcgcttccaggtcatcgtttataatcccctggggcggaaggtgaattggatggtacggctgccggtcagcgaaggcgttttcgttgtgaaggaccccaatggcaggacagtgcccagcgatgtggtaatatttcccagctcagacagccaggcgcaccctccggagctgctgttctcagcctcactgcccgccctgggcttcagcacctattcagtagcccaggtgcctcgctggaagccccaggcccgcgcaccacagcctcctgctccgggggcagaccagactctgactctcctcttggggctgctgccattaaaacgctactactaagactc

SEQ ID NO: 372276 - DNA, 1570 bp, Homo sapiens
  misc_feature (310)..(310): n is a, c, g, or t
cttgggtcgctgtctactgctccttcatcagctttgccaactctcggagctcggaggacacgaagcaaatgatgagtagcttcatgtgagacttgcccggcattaagaggcattccgtcttggaattccggcattaagaggcattccgtcttcatagcccgtgagacgccagtgtcacctttagcccaaccagtgccctgagggtggcattttcctaccttcctgtaacgacccccgggattgcccagggctacagcctctctcccgtgagcctccagaccgcgccctggccccgccccccaccccgatnggcccggccgggtctgggggcggggcgtttgcggcctttccagggccggggaaccccaggaggaagctgctgagccatgggcgcctacgcgcgggcttcgggggtctgcgctcgcggctgcctggactcagcaggcccctggaccatgtcccgcgccctgcggccaccgctcccgcctctctgctttttccttttgttgctggcggctgccggtgctcgggccgggggatacgagacatgccccacagtgcagccgaacatgctgaacgtgcacctgctgcctcacacacatgatgacgtgggctggctcaaaaccgtggaccagtacttttatggaatcaagaatgacatccagcacgccggtgtgcagtacatcctggactcggtcatctctgccttgctggcagatcccacccgtcgcttcatttacgtggagattgccttcttctcccgttggtggcaccagcagacaaatgccacacaggaagtcgtgcgagaccttgtgcgccaggggcgcctggagttcgccaatggtggctgggtgatgaacgatgaggcagccacccactacggtgccatcgtggaccagatgacacttgggctgcgctttctggaggacacatttggcaatgatgggcgaccccgtgtggcctggcacattgaccccttcggccactctcgggagcaggcctcgctgtttgcgcagatgggcttcgacggcttcttctttgggcgccttgattatcaagataagtgggtacggatgcagaagctggagatggagcaggtgtggcgggccagcaccagcctgaagcccccgaccgcggacctcttcactggtgtgcttcccaatggttacaacccgccaaggaatctgtgctgggatgtgctgtgtgtcgatcagccgctggtggaggaccctcgcagccccgagtacaacgccaaggagctggtcgattacttcctaaatgtggccactgcccagggccggtattaccgcaccaaccacactgtgatgaccatgggctcggacttccaatatgagaatgccaacatgtggttcaagaacctggacccggccaacatcacgctggaacccatggaaatccgcactttcctggcctcagttcaatggaaggaggtggatggttaggtctgctgggatgggccctccaagcccaagcctcctgctccgggggcagaccagactctgactctcctcttggggctgctgccattaaaacgctactactaagactc

SEQ ID NO: 372277 - DNA, 1706 bp, Homo sapiens
aaaaaaaaaaaaaaaaagagttggggagccagatcccaagcctgatcagctcacccccaaccccaggcgggattatcgacccacctggaaactgaaccagacggagcccgtggcaggaaactactatccagtcaacacccggatttacatcacggatggaaacatgcagctgactgtgctgactgaccgctcccaggggggcagcagcctgagagatggctcgctggagctcatggtgcaccgaaggctgctgaaggacgatggacgcggagtatcggagccactaatggagaacgggtcgggggcgtgggtgcgagggcgccacctggtgctgctggacacagcccaggctgcagccgccggacaccggctcctggcggagcaggaggtcctggcccctcaggtggtgctggccccgggtggcggcgccgcctacaatctcggggctcctccgcgcacgcagttctcagggctgcgcagggacctgccgccctcggtgcacctgctcacgctggccagctggggccccgaaatggtgctgctgcgcttggagcaccagtttgccgtaggagaggattccggacgtaacctgagcgcccccgttaccttgaacttgagggacctgttctccaccttcaccatcacccgcctgcaggagaccacgctggtggccaaccagctccgcgaggcagcctccaggctcaagtggacaacaaacacaggccccacaccccaccaaactccgtaccagctggacccggccaacatcacgctggaacccatggaaatccgcactttcctggcctcagttcaatggaaggaggtggatggttaggtctgctgggatgggccctccaagcccaagcctcctgctccgggggcagaccagactctgactctcctcttggggctgctgccattaaaacgctactactaagactcaggtcgctctgtgactgagttgtgccactgaagatcctggtgtcgccatgggccgccgccccgcccgttgttaccggtattgtaagaacaagccgtacccaaagtctcgcttctgccgaggtgtccctgatgccaagattcgcatttttgacctggggcggaaaaaggcaaaagtggatgagtttccgctttgtggccacatggtgtcagatgaatatgagcagctgtcctctgaagccctggaggctgcccgaatttgtgccaataagtacatggtaaaaagttgtggcaaagatggcttccatatccgggtgcggctccaccccttccacgtcatccgcatcaacaagatgttgtcctgtgctggggctgacaggctccaaacaggcatgcgaggtgcctttggaaagccccagggcactgtggccagggttcacattggccaagttatcatgtccatccgcaccaagctgcagaacaaggagcatgtgattgaggccctgcgcagggccaagttcaagtttcctggccgccagaagatccacatctcaaagaagtggggcttcaccaagttcaatgctgatgaatttgaagacatggtggctgaaaagcggctcatcccagatggctgtggggtcaagtacatccccagtcgtggccctctggacaagtggcgggccctgcactcatgagggcttccaatgtgctgcccccctcttaatactcaccaataaattctacttcctgtccacctaaaaaaaaaa

SEQ ID NO: 372278 - DNA, 516 bp, Homo sapiens
gcttttcctctccgtttttctccatctcctgcccaggctccctccacgctctggcgtgccatatccaggcccccctgttaggcatttacctccttccggcctggttcccatgcctacttggatcctgcctctgctggggttgccctaccagaccctcaccttcatcctcatccgttcctcccaccctttaatttcttttgacattcccacacgcccttacccagtttctggcccaaggacacccacaaacccacgactctcaccccctcctggccactctccccccaggtgcaccgaaggctgctgaaggacgatggacgcggagtatcggagccactaatggagaacgggtcgggggcgtgggtgcgagggcgccacctggtgctgctggacacagcccaggctgcagccgccggacaccggctcctggcggagcaggaggtcctggcccctcaggtggtgctggccccgggtggcggcgccgcctacaatctcggggctcctccgcgcacgcag

SEQ ID NO: 372279 - DNA, 205 bp, Homo sapiens
caaaaaaaaaaaaaaaaaaaaaagagttggggagccagatcccaagcctgatcagctcacccccaaccccaggcgggattatcgacccacctggaaactgaaccagacggagcccgtggcaggaaactactatccagtcaacacccggatttacatcacggtagctctcccccatcctgcacctccccacctcgatagaaaggga

SEQ ID NO: 372280 - DNA, 414 bp, Homo sapiens
atcaagataagtgggtacggatgcagaagctggagatggagcaggtgtggcgggccagcaccagcctgaagcccccgaccgcggacctcttcactggtagggggcttggtgagggcagggccagccatggtgccacacactcagaagggccctgggcttgatatctgctctgttgtcactgtcctggaattcctatagtctgggaacaaaggccctgcatttccttttgcattgggacacaaattctgaagcccatcctgggtgggacatggccggctttgaaaccagggaaggtctgggtgatgggccaccccttgaacttggtgtgacctgcaggtgtgcttcccaatggttacaacccgccaaggaatctgtgctgggatgtgctgtgtgtcgatcagccgctggtggagg

SEQ ID NO: 372281 - DNA, 3202 bp, Homo sapiens
  misc_feature (26)..(26): n is a, c, g, or t
  misc_feature (28)..(28): n is a, c, g, or t
  misc_feature (33)..(33): n is a, c, g, or t
aaattaggctagtagagctgggtttnantcggncgagcccaggaggaagctgctgagccatgggcgcctacgcgcgggcttcgggggtctgcgctcgcggctgcctggactcagcaggcccctggaccatgtcccgcgccctgcggccaccgctcccgcctctctgctttttccttttgttgctggcggctgccggtgctcgggccgggggatacgagacatgccccacagtgcagccgaacatgctgaacgtgcacctgctgcctcacacacatgatgacgtgggctggctcaaaaccgtggaccagtacttttatggaatcaagaatgacatccagcacgccggtgtgcagtacatcctggactcggtcatctctgccttgctggcagatcccacccgtcgcttcatttacgtggagattgccttcttctcccgttggtggcaccagcagacaaatgccacacaggaagtcgtgcgagaccttgtgcgccaggggcgcctggagttcgccaatggtggctgggtgatgaacgatgaggcagccacccactacggtgccatcgtggaccagatgacacttgggctgcgctttctggaggacacatttggcaatgatgggcgaccccgtgtggcctggcacattgaccccttcggccactctcgggagcaggcctcgctgtttgcgcagatgggcttcgacggcttcttctttgggcgccttgattatcaagataagtgggtacggatgcagaagctggagatggagcaggtgtggcgggccagcaccagcctgaagcccccgaccgcggacctcttcactggtgtgcttcccaatggttacaacccgccaaggaatctgtgctgggatgtgctgtgtgtcgatcagccgctggtggaggaccctcgcagccccgagtacaacgccaaggagctggtcgattacttcctaaatgtggccactgcccagggccggtattaccgcaccaaccacactgtgatgaccatgggctcggacttccaatatgagaatgccaacatgtggttcaagaaccttgacaagctcatccggctggtaaatgcgcagcaggcaaaaggaagcagtgtccatgttctctactccacccccgcttgttacctctgggagctgaacaaggccaacctcacctggtcagtgaaacatgacgacttcttcccttacgcggatggcccccaccagttctggaccggttacttttccagtcggccggccctcaaacgctacgagcgcctcagctacaacttcctgcaggtgtgcaaccagctggaggcgctggtgggcctggcggccaacgtgggaccctatggctccggagacagtgcacccctcaatgaggcgatggctgtgctccagcatcacgacgccgtcagcggcacctcccgccagcacgtggccaacgactacgcgcgccagcttgcggcaggctgggggccttgcgaggttcttctgagcaacgcgctggcgcggctcagaggcttcaaagatcacttcaccttttgccaacagctaaacatcagcatctgcccgctcagccagacggcggcgcgcttccaggtcatcgtttataatcccctggggcggaaggtgaattggatggtacggctgccggtcagcgaaggcgttttcgttgtgaaggaccccaatggcaggacagtgcccagcgatgtggtaatatttcccagctcagacagccaggcgcaccctccggagctgctgttctcagcctcactgcccgccctgggcttcagcacctattcagtagcccaggtgcctcgctggaagccccaggcccgcgcaccacagcccatccccagaagatcctggtcccctgctttaaccatcgaaaatgagcacatccgggcaacgtttgatcctgacacagggctgttgatggagattatgaacatgaatcagcaactcctgctgcctgttcgccagaccttcttctggtacaacgccagtataggtgacaacgaaagtgaccaggcctcaggtgcctacatcttcagacccaaccaacagaaaccgctgcctgtgagccgctgggctcagatccacctggtgaagacacccttggtgcaggaggtgcaccagaacttctcagcttggtgttcccaggtggttcgcctgtacccaggacagcggcacctggagctagagtggtcggtggggccgatacctgtgggcgacacctgggggaaggaggtcatcagccgttttgacacaccgctggagacaaagggacgcttctacacagacagcaatggccgggagatcctggagaggaggcgggattatcgacccacctggaaactgaaccagacggagcccgtggcaggaaactactatccagtcaacacccggatttacatcacggatggaaacatgcagctgactgtgctgactgaccgctcccaggggggcagcagcctgagagatggctcgctggagctcatggtgcaccgaaggctgctgaaggacgatggacgcggagtatcggagccactaatggagaacgggtcgggggcgtgggtgcgagggcgccacctggtgctgctggacacagcccaggctgcagccgccggacaccggctcctggcggagcaggaggtcctggcccctcaggtggtgctggccccgggtggcggcgccgcctacaatctcggggctcctccgcgcacgcagttctcagggctgcgcagggacctgccgccctcggtgcacctgctcacgctggccagctggggccccgaaatggtgctgctgcgcttggagcaccagtttgccgtaggagaggattccggacgtaacctgagcgcccccgttaccttgaacttgagggacctgttctccaccttcaccatcacccgcctgcaggagaccacgctggtggccaaccagctccgcgaggcagcctccaggctcaagtggacaacaaacacaggccccacaccccaccaaactccgtaccagctggacccggccaacatcacgctggaacccatggaaatccgcactttcctggcctcagttcaatggaaggaggtggatggttaggtctgctgggatgggccctccaagcccaagcctcctgctccgggggcagaccagactctgactctcctcttggggctgctgccattaaaacgctactactaagactc

SEQ ID NO: 372282 - DNA, 4901 bp, Homo sapiens
  misc_feature (310)..(310): n is a, c, g, or t
  misc_feature (2589)..(2589): n is a, c, g, or t
cttgggtcgctgtctactgctccttcatcagctttgccaactctcggagctcggaggacacgaagcaaatgatgagtagcttcatgtgagacttgcccggcattaagaggcattccgtcttggaattccggcattaagaggcattccgtcttcatagcccgtgagacgccagtgtcacctttagcccaaccagtgccctgagggtggcattttcctaccttcctgtaacgacccccgggattgcccagggctacagcctctctcccgtgagcctccagaccgcgccctggccccgccccccaccccgatnggcccggccgggtctgggggcggggcgtttgcggcctttccagggccggggaaccccaggaggaagctgctgagccatgggcgcctacgcgcgggcttcgggggtctgcgctcgcggctgcctggactcagcaggcccctggaccatgtcccgcgccctgcggccaccgctcccgcctctctgctttttccttttgttgctggcggctgccggtgctcgggccgggggatacgagacatgccccacagtgcagccgaacatgctgaacgtgcacctgctgcctcacacacatgatgacgtgggctggctcaaaaccgtggaccagtacttttatggaatcaagaatgacatccagcacgccggtgtgcagtacatcctggactcggtcatctctgccttgctggcagatcccacccgtcgcttcatttacgtggagattgccttcttctcccgttggtggcaccagcagacaaatgccacacaggaagtcgtgcgagaccttgtgcgccaggggcgcctggagttcgccaatggtggctgggtgatgaacgatgaggcagccacccactacggtgccatcgtggaccagatgacacttgggctgcgctttctggaggacacatttggcaatgatgggcgaccccgtgtggcctggcacattgaccccttcggccactctcgggagcaggcctcgctgtttgcgcagatgggcttcgacggcttcttctttgggcgccttgattatcaagataagtgggtacggatgcagaagctggagatggagcaggtgtggcgggccagcaccagcctgaagcccccgaccgcggacctcttcactggtgtgcttcccaatggttacaacccgccaaggaatctgtgctgggatgtgctgtgtgtcgatcagccgctggtggaggaccctcgcagccccgagtacaacgccaaggagctggtcgattacttcctaaatgtggccactgcccagggccggtattaccgcaccaaccacactgtgatgaccatgggctcggacttccaatatgagaatgccaacatgtggttcaagaaccttgacaagctcatccggctggtaaatgcgcaggtcagtgaaacatgacgacttcttcccttacgcggatggcccccaccagttctggaccggttacttttccagtcggccggccctcaaacgctacgagcgcctcagctacaacttcctgcaggtgtgcaaccagctggaggcgctggtgggcctggcggccaacgtgggaccctatggctccggagacagtgcacccctcaatgaggcgatggctgtgctccagcatcacgacgccgtcagcggcacctcccgccagcacgtggccaacgactacgcgcgccagcttgcggcaggctgggggccttgcgaggttcttctgagcaacgcgctggcgcggctcagaggcttcaaagatcacttcaccttttgccaacagctaaacatcagcatctgcccgctcagccagacggcggcgcgcttccaggtcatcgtttataatcccctggggcggaaggtgaattggatggtacggctgccggtcagcgaaggcgttttcgttgtgaaggaccccaatggcaggacagtgcccagcgatgtgagcccaaacaacgaatattcccccgctgggactcctcccccagtgggcatttcctcatcgcccccatggatatcgcctgcttccatgaatacctcccactcatgcatatctcttcccccctcttgtatcttctccctctgccccttaatatcagtctccccttgggaacatatgcctcctgtgagtggtcctcccttttttttttttttttgagacggagtctcgctctgtcacccaggctggagtgcagtggcgcgatcttggctcacttcaaactccgcctgctggattataggcatgagccaccgtgcctggctggtcctccattttaataccccgcttccccaggaaaatttattgctgtttatggacatctccttcattccagaaaacgtcctcccccaaacctcttcctcccccgagaacctgcctcaagggtttcttcccctacttcctccttcactcccccgactccatggtctctccaccctcccggtgggtttttttttccacctggtgaatcttctctgcaatcatttccttggaatctgactgtccccccaccacacacacctccatttcctttccccatctcaggactcttttccttccttgagttttttgtctccatgcatgtanagctttccatgggtactcttgactcagtttccctcctcctttatccgaggtggtaatatttcccagctcagacagccaggcgcaccctccggagctgctgttctcagcctcactgcccgccctgggcttcagcacctattcagtagcccaggtgcctcgctggaagccccaggcccgcgcaccacagcccatccccagaagatcctggtcccctgctttaaccatcgaaaatgagcacatccgggcaacgtttgatcctgacacagggctgttgatggagattatgaacatgaatcagcaactcctgctgcctgttcgccagaccttcttctggtacaacgccagtataggtgacaacgaaagtgaccaggcctcaggtgcctacatcttcagacccaaccaacagaaaccgctgcctgtgagccgctgggctcagatccacctggtgaagacacccttggtgcaggaggtgcaccagaacttctcagcttggtgttcccaggtggttcgcctgtacccaggacagcggcacctggagctagagtggtcggtggggccgatacctgtgggcgacacctgggggaaggaggtcatcagccgttttgacacaccgctggagacaaagggacgcttctacacagacagcaatggccgggagatcctggagaggaggcgggattatcgacccacctggaaactgaaccagacggagcccgtggcaggaaactactatccagtcaacacccggatttacatcacggatggaaacatgcagctgactgtgctgactgaccgctcccaggggggcagcagcctgagagatggctcgctggagctcatggtgcaccgaaggctgctgaaggacgatggacgcggagtatcggagccactaatggagaacgggtcgggggcgtgggtgcgagggcgccacctggtgctgctggacacagcccaggctgcagccgccggacaccggctcctggcggagcaggaggtcctggcccctcaggtggtgctggccccgggtggcggcgccgcctacaatctcggggctcctccgcgcacgcagttctcagggctgcgcagggacctgccgccctcggtgcacctgctcacgctggccagctggggccccgaaatggtgctgctgcgcttggagcaccagtttgccgtaggagaggattccggacgtaacctgagcgcccccgttaccttgaacttgagggacctgttctccaccttcaccatcacccgcctgcaggagaccacgctggtggccaaccagctccgcgaggcagcctccaggctcaagtggacaacaaacacaggccccacaccccaccaaactccgtaccagctggacccggccaacatcacgctggaacccatggaaatccgcactttcctggcctcagttcaatggaaggaggtggatggttaggtctgctgggatgggccctccaagcccaagcctcctgctccgggggcagaccagactctgactctcctcttggggctgctgccattaaaacgctactactaagactcaggtcgctctgtgactgagttgtgccactgaagatcctggtgtcgccatgggccgccgccccgcccgttgttaccggtattgtaagaacaagccgtacccaaagtctcgcttctgccgaggtgtccctgatgccaagattcgcatttttgacctggggcggaaaaaggcaaaagtggatgagtttccgctttgtggccacatggtgtcagatgaatatgagcagctgtcctctgaagccctggaggctgcccgaatttgtgccaataagtacatggtaaaaagttgtggcaaagatggcttccatatccgggtgcggctccaccccttccacgtcatccgcatcaacaagatgttgtcctgtgctggggctgacaggctccaaacaggcatgcgaggtgcctttggaaagccccagggcactgtggccagggttcacattggccaagttatcatgtccatccgcaccaagctgcagaacaaggagcatgtgattgaggccctgcgcagggccaagttcaagtttcctggccgccagaagatccacatctcaaagaagtggggcttcaccaagttcaatgctgatgaatttgaagacatggtggctgaaaagcggctcatcccagatggctgtggggtcaagtacatccccagtcgtggccctctggacaagtggcgggccctgcactcatgagggcttccaatgtgctgcccccctcttaatactcaccaataaattctacttcctgtccacctaaaaaaaaaa

SEQ ID NO: 372283 - DNA, 3885 bp, Homo sapiens
  misc_feature (310)..(310): n is a, c, g, or t
  misc_feature (3412)..(3412): n is a, c, g, or t
cttgggtcgctgtctactgctccttcatcagctttgccaactctcggagctcggaggacacgaagcaaatgatgagtagcttcatgtgagacttgcccggcattaagaggcattccgtcttggaattccggcattaagaggcattccgtcttcatagcccgtgagacgccagtgtcacctttagcccaaccagtgccctgagggtggcattttcctaccttcctgtaacgacccccgggattgcccagggctacagcctctctcccgtgagcctccagaccgcgccctggccccgccccccaccccgatnggcccggccgggtctgggggcggggcgtttgcggcctttccagggccggggaaccccaggaggaagctgctgagccatgggcgcctacgcgcgggcttcgggggtctgcgctcgcggctgcctggactcagcaggcccctggaccatgtcccgcgccctgcggccaccgctcccgcctctctgctttttccttttgttgctggcggctgccggtgctcgggccgggggatacgagacatgccccacagtgcagccgaacatgctgaacgtgcacctgctgcctcacacacatgatgacgtgggctggctcaaaaccgtggaccagtacttttatggaatcaagaatgacatccagcacgccggtgtgcagtacatcctggactcggtcatctctgccttgctggcagatcccacccgtcgcttcatttacgtggagattgccttcttctcccgttggtggcaccagcagacaaatgccacacaggaagtcgtgcgagaccttgtgcgccaggggcgcctggagttcgccaatggtggctgggtgatgaacgatgaggcagccacccactacggtgccatcgtggaccagatgacacttgggctgcgctttctggaggacacatttggcaatgatgggcgaccccgtgtggcctggcacattgaccccttcggccactctcgggagcaggcctcgctgtttgcgcagatgggcttcgacggcttcttctttgggcgccttgattatcaagataagtgggtacggatgcagaagctggagatggagcaggtgtggcgggccagcaccagcctgaagcccccgaccgcggacctcttcactggtgtgcttcccaatggttacaacccgccaaggaatctgtgctgggatgtgctgtgtgtcgatcagccgctggtggaggaccctcgcagccccgagtacaacgccaaggagctggtcgattacttcctaaatgtggccactgcccagggccggtattaccgcaccaaccacactgtgatgaccatgggctcggacttccaatatgagaatgccaacatgtggttcaagaaccttgacaagctcatccggctggtaaatgcgcagcaggcaaaaggaagcagtgtccatgttctctactccacccccgcttgttacctctgggagctgaacaaggccaacctcacctggtcagtgaaacatgacgacttcttcccttacgcggatggcccccaccagttctggaccggttacttttccagtcggccggccctcaaacgctacgagcgcctcagctacaacttcctgcaggtgtgcaaccagctggaggcgctggtgggcctggcggccaacgtgggaccctatggctccggagacagtgcacccctcaatgaggcgatggctgtgctccagcatcacgacgccgtcagcggcacctcccgccagcacgtggccaacgactacgcgcgccagcttgcggcaggctgggggccttgcgaggttcttctgagcaacgcgctggcgcggctcagaggcttcaaagatcacttcaccttttgccaacagctaaacatcagcatctgcccgctcagccagacggcggcgcgcttccaggtcatcgtttataatcccctggggcggaaggtgaattggatggtacggctgccggtcagcgaaggcgttttcgttgtgaaggaccccaatggcaggacagtgcccagcgatgtggtaatatttcccagctcagacagccaggcgcaccctccggagctgctgttctcagcctcactgcccgccctgggcttcagcacctattcagtagcccaggtgcctcgctggaagccccaggcccgcgcaccacagcccatccccagaagatcctggtcccctgctttaaccatcgaaaatgagcacatccgggcaacgtttgatcctgacacagggctgttgatggagattatgaacatgaatcagcaactcctgctgcctgttcgccagaccttcttctggtacaacgccagtataggtgacaacgaaagtgaccaggcctcaggtgcctacatcttcagacccaaccaacagaaaccgctgcctgtgagccgctgggctcagatccacctggtgaagacacccttggtgcaggaggtgcaccagaacttctcagcttggtgttcccaggtggttcgcctgtacccaggacagcggcacctggagctagagtggtcggtggggccgatacctgtgggcgacacctgggggaaggaggtcatcagccgttttgacacaccgctggagacaaagggacgcttctacacagacagcaatggccgggagatcctggagaggaggcgggattatcgacccacctggaaactgaaccagacggagcccgtggcaggaaactactatccagtcaacacccggatttacatcacggatggaaacatgcagctgactgtgctgactgaccgctcccaggggggcagcagcctgagagatggctcgctggagctcatggtgcaccgaaggctgctgaaggacgatggacgcggagtatcggagccactaatggagaacgggtcgggggcgtgggtgcgagggcgccacctggtgctgctggacacagcccaggctgcagccgccggacaccggctcctggcggagcaggaggtcctggcccctcaggtggtgctggccccgggtggcggcgccgcctacaatctcggggctcctccgcgcacgcagttctcagggctgcgcagggacctgccgccctcggtgcacctgctcacgctggccagctggggccccgaaatggtgctgctgcgcttggagcaccagtttgccgtaggagaggattccggacgtaacctgagcgcccccgttaccttgaacttgagggacctgttctccaccttcaccatcacccgcctgcaggagaccacgctggtggccaaccagctccgcgaggcagcctccaggctcaagtggacaacaaacacaggccccacaccccaccaaactccgtaccagctggacccggccaacatcacgctggaacccatggaaatccgcactttcctggcctcagttcaatggaaggagtngaaagactttgactctctttggggctgtggcattaaaacgctctactaggacccgagaaaaaaaataatcttaacgaaatgggctaatggccaattggcctataggggccttaaaataacggccgccttttacagggggcttggaaaaacgtgggtcccactaatgcttgtgaacaaccctttgccacgtgggaaatctaaagcgccctcacgggctttcaaaacgtgcgcccctaagggatgggtactcggcctaaatttgtaaaaccgaaaatttgtaacacctttttttaacaagcgcagtgaacactctctaaacaaaacacccccccgcggttgtgtgtctcttgcaaagtctctttaagaaggggtccccccggggcaactcttcagggggctcccttgacaactccccacccttttgttgcgggcgtaccttcttaggcgccgcctttctgctgtaggccgggcct

SEQ ID NO: 372284 - DNA, 2318 bp, Homo sapiens
  misc_feature (22)..(22): n is a, c, g, or t
  misc_feature (41)..(41): n is a, c, g, or t
caagcttggtaacgcatggtgnaaggaccccaatggcaggncagtgcccagcgatgtggtaatatttcccagctcagacagccaggcgcaccctccggagctgctgttctcagcctcactgcccgccctgggcttcagcacctattcagtagcccaggtgcctcgctggaagccccaggcccgcgcaccacagcccatccccagaagatcctggtcccctgctttaaccatcgaaaatgagcacatccgggcaacgtttgatcctgacacagggctgttgatggagattatgaacatgaatcagcaactcctgctgcctgttcgccagaccttcttctggtacaacgccagtataggtgacaacgaaagtgaccaggcctcaggtgcctacatcttcagacccaaccaacagaaaccgctgcctgtgagccgctgggctcagatccacctggtgaagacacccttggtgcaggaggtgcaccagaacttctcagcttggtgttcccaggtggttcgcctgtacccaggacagcggcacctggagctagagtggtcggtggggccgatacctgtgggcgacacctgggggaaggaggtcatcagccgttttgacacaccgctggagacaaagggacgcttctacacagacagcaatggccgggagatcctggagaggaggcgggattatcgacccacctggaaactgaaccagacggagcccgtggcaggaaactactatccagtcaacacccggatttacatcacggatggaaacatgcagctgactgtgctgactgaccgctcccaggggggcagcagcctgagagatggctcgctggagctcatggtgcaccgaaggctgctgaaggacgatggacgcggagtatcggagccactaatggagaacgggtcgggggcgtgggtgcgagggcgccacctggtgctgctggacacagcccaggctgcagccgccggacaccggctcctggcggagcaggaggtcctggcccctcaggtggtgctggccccgggtggcggcgccgcctacaatctcggggctcctccgcgcacgcagttctcagggctgcgcagggacctgccgccctcggtgcacctgctcacgctggccagctggggccccgaaatggtgctgctgcgcttggagcaccagtttgccgtaggagaggattccggacgtaacctgagcgcccccgttaccttgaacttgagggacctgttctccaccttcaccatcacccgcctgcaggagaccacgctggtggccaaccagctccgcgaggcagcctccaggctcaagtggacaacaaacacaggccccacaccccaccaaactccgtaccagctggacccggccaacatcacgctggaacccatggaaatccgcactttcctggcctcagttcaatggaaggaggtggatggttaggtctgctgggatgggccctccaagcccaagcctcctgctccgggggcagaccagactctgactctcctcttggggctgctgccattaaaacgctactactaagactcaggtcgctctgtgactgagttgtgccactgaagatcctggtgtcgccatgggccgccgccccgcccgttgttaccggtattgtaagaacaagccgtacccaaagtctcgcttctgccgaggtgtccctgatgccaagattcgcatttttgacctggggcggaaaaaggcaaaagtggatgagtttccgctttgtggccacatggtgtcagatgaatatgagcagctgtcctctgaagccctggaggctgcccgaatttgtgccaataagtacatggtaaaaagttgtggcaaagatggcttccatatccgggtgcggctccaccccttccacgtcatccgcatcaacaagatgttgtcctgtgctggggctgacaggctccaaacaggcatgcgaggtgcctttggaaagccccagggcactgtggccagggttcacattggccaagttatcatgtccatccgcaccaagctgcagaacaaggagcatgtgattgaggccctgcgcagggccaagttcaagtttcctggccgccagaagatccacatctcaaagaagtggggcttcaccaagttcaatgctgatgaatttgaagacatggtggctgaaaagcggctcatcccagatggctgtggggtcaagtacatccccagtcgtggccctctggacaagtggcgggccctgcactcatgagggcttccaatgtgctgcccccctcttaatactcaccaataaattctacttcctgtccacctaaaaaaaaaa

SEQ ID NO: 372285 - DNA, 2604 bp, Homo sapiens
  misc_feature (310)..(310): n is a, c, g, or t
cttgggtcgctgtctactgctccttcatcagctttgccaactctcggagctcggaggacacgaagcaaatgatgagtagcttcatgtgagacttgcccggcattaagaggcattccgtcttggaattccggcattaagaggcattccgtcttcatagcccgtgagacgccagtgtcacctttagcccaaccagtgccctgagggtggcattttcctaccttcctgtaacgacccccgggattgcccagggctacagcctctctcccgtgagcctccagaccgcgccctggccccgccccccaccccgatnggcccggccgggtctgggggcggggcgtttgcggcctttccagggccggggaaccccaggaggaagctgctgagccatgggcgcctacgcgcgggcttcgggggtctgcgctcgcggctgcctggactcagcaggcccctggaccatgtcccgcgccctgcggccaccgctcccgcctctctgctttttccttttgttgctggcggctgccggtgctcgggccgggggatacgagacatgccccacagtgcagccgaacatgctgaacgtgcacctgctgcctcacacacatgatgacgtgggctggctcaaaaccgtggaccagtacttttatggaatcaagaatgacatccagcacgccggtgtgcagtacatcctggactcggtcatctctgccttgctggcagatcccacccgtcgcttcatttacgtggagattgccttcttctcccgttggtggcaccagcagacaaatgccacacaggaagtcgtgcgagaccttgtgcgccaggggcgcctggagttcgccaatggtggctgggtgatgaacgatgaggcagccacccactacggtgccatcgtggaccagatgacacttgggctgcgctttctggaggacacatttggcaatgatgggcgaccccgtgtggcctggcacattgaccccttcggccactctcgggagcaggcctcgctgtttgcgcagatgggcttcgacggcttcttctttgggcgccttgattatcaagataagtgggtacggatgcagaagctggagatggagcaggtgtggcgggccagcaccagcctgaagcccccgaccgcggacctcttcactggtgtgcttcccaatggttacaacccgccaaggaatctgtgctgggatgtgctgtgtgtcgatcagccgctggtggaggaccctcgcagccccgagtacaacgccaaggagctggtcgattacttcctaaatgtggccactgcccagggccggtattaccgcaccaaccacactgtgatgaccatgggctcggacttccaatatgagaatgccaacatgtggttcaagaaccttgacaagctcatccggctggtaaatgcgcagcaggcaaaaggaagcagtgtccatgttctctactccacccccgcttgttacctctgggagctgaacaaggccaacctcacctggtcagtgaaacatgacgacttcttcccttacgcggatggcccccaccagttctggaccggttacttttccagtcggccggccctcaaacgctacgagcgcctcagctacaacttcctgcaggtgtgcaaccagctggaggcgctggtgggcctggcggccaacgtgggaccctatggctccggagacagtgcacccctcaatgaggcgatggctgtgctccagcatcacgacgccgtcagcggcacctcccgccagcacgtggccaacgactacgcgcgccagcttgcggcaggctgggggccttgcgaggttcttctgagcaacgcgctggcgcggctcagaggcttcaaagatcacttcaccttttgccaacagctaaacatcagcatctgcccgctcagccagacggcggcgcgcttccaggtcatcgtttataatcccctggggcggaaggtgaattggatggtacggctgccggtcagcgaaggcgttttcgttgtgaaggaccccaatggcaggacagtgcccagcgatgtggtaatatttcccagctcagacagccaggcgcaccctccggagctgctgttctcagcctcactgcccgccctgggcttcagcacctattcagtagcccaggtgcctcgctggaagccccaggcccgcgcaccacagcccatccccagaagatcctggtcccctgctttaaccatcgaaaatgagcacatccgggcaacgtttgatcctgacacagggctgttgatggagattatgaacatgaatcagcaactcctgctgcctgttcgccagaccttcttctggtacaacgccagtataggtgacaacgaaagtgaccaggcccctccaggctcaagtggacaacaaacacaggccccacaccccaccaaactccgtaccagctggacccggccaacatcacgctggaacccatggaaatccgcactttcctggcctcagttcaatggaaggaggtggatggttaggtctgctgggatgggccctccaagcccaagcctcctgctccgggggcagaccagactctgactctcctcttggggctgctgccattaaaacgctactactaagactc

SEQ ID NO: 372286 - DNA, 2818 bp, Homo sapiens
  misc_feature (310)..(310): n is a, c, g, or t
cttgggtcgctgtctactgctccttcatcagctttgccaactctcggagctcggaggacacgaagcaaatgatgagtagcttcatgtgagacttgcccggcattaagaggcattccgtcttggaattccggcattaagaggcattccgtcttcatagcccgtgagacgccagtgtcacctttagcccaaccagtgccctgagggtggcattttcctaccttcctgtaacgacccccgggattgcccagggctacagcctctctcccgtgagcctccagaccgcgccctggccccgccccccaccccgatnggcccggccgggtctgggggcggggcgtttgcggcctttccagggccggggaaccccaggaggaagctgctgagccatgggcgcctacgcgcgggcttcgggggtctgcgctcgcggctgcctggactcagcaggcccctggaccatgtcccgcgccctgcggccaccgctcccgcctctctgctttttccttttgttgctggcggctgccggtgctcgggccgggggatacgagacatgccccacagtgcagccgaacatgctgaacgtgcacctgctgcctcacacacatgatgacgtgggctggctcaaaaccgtggaccagtacttttatggaatcaagaatgacatccagcacgccggtgtgcagtacatcctggactcggtcatctctgccttgctggcagatcccacccgtcgcttcatttacgtggagattgccttcttctcccgttggtggcaccagcagacaaatgccacacaggaagtcgtgcgagaccttgtgcgccaggggcgcctggagttcgccaatggtggctgggtgatgaacgatgaggcagccacccactacggtgccatcgtggaccagatgacacttgggctgcgctttctggaggacacatttggcaatgatgggcgaccccgtgtggcctggcacattgaccccttcggccactctcgggagcaggcctcgctgtttgcgcagatgggcttcgacggcttcttctttgggcgccttgattatcaagataagtgggtacggatgcagaagctggagatggagcaggtgtggcgggccagcaccagcctgaagcccccgaccgcggacctcttcactggtgtgcttcccaatggttacaacccgccaaggaatctgtgctgggatgtgctgtgtgtcgatcagccgctggtggaggaccctcgcagccccgagtacaacgccaaggagctggtcgattacttcctaaatgtggccactgcccagggccggtattaccgcaccaaccacactgtgatgaccatgggctcggacttccaatatgagaatgccaacatgtggttcaagaaccttgacaagctcatccggctggtaaatgcgcagcaggcaaaaggaagcagtgtccatgttctctactccacccccgcttgttacctctgggagctgaacaaggccaacctcacctggtcagtgaaacatgacgacttcttcccttacgcggatggcccccaccagttctggaccggttacttttccagtcggccggccctcaaacgctacgagcgcctcagctacaacttcctgcaggtgtgcaaccagctggaggcgctggtgggcctggcggccaacgtgggaccctatggctccggagacagtgcacccctcaatgaggcgatggctgtgctccagcatcacgacgccgtcagcggcacctcccgccagcacgtggccaacgactacgcgcgccagcttgcggcaggctgggggccttgcgaggttcttctgagcaacgcgctggcgcggctcagaggcttcaaagatcacttcaccttttgccaacagctaaacatcagcatctgcccgctcagccagacggcggcgcgcttccaggtcatcgtttataatcccctggggcggaaggtgaattggatggtacggctgccggtcagcgaaggcgttttcgttgtgaaggaccccaatggcaggacagtgcccagcgatgtggtaatatttcccagctcagacagccaggcgcaccctccggagctgctgttctcagcctcactgcccgccctgggcttcagcacctattcagtagcccaggtgcctcgctggaagccccaggcccgcgcaccacagcccatccccagaagatcctggtcccctgctttaaccatcgaaaatgagcacatccgggcaacgtttgatcctgacacagggctgttgatggagattatgaacatgaatcagcaactcctgctgcctgttcgccagaccttcttctggtacaacgccagtataggtgacaacgaaagtgaccaggcctcaggtgcctacatcttcagacccaaccaacagaaaccgctgcctgtgagccgctgggctcagatccacctggtgaagacacccttggtgcaggaggtgcaccagaacttctcagcttggtgttcccaggtggttcgcctgtacccaggacagcggcacctggagctagagtggtcggtggggccgatacctgtgggcgacacctgggggaaggaggtcatcagccgttttgacacaccgctggagacaaagggacgcttctacacagacagcaatggccgggagatcctggagaggaggcgggattatcgacccacctggaaactgaaccagacgggaagcgcacgatggcgcgtccctcacactttctctatctcattccctttccattcagaatctcaagagaaagctggttctagaaagttctgtgttaccttctctggaatgttttctgactcccataa

SEQ ID NO: 372287 - DNA, 1764 bp, Homo sapiens
  misc_feature (310)..(310): n is a, c, g, or t
  misc_feature (1763)..(1763): n is a, c, g, or t
cttgggtcgctgtctactgctccttcatcagctttgccaactctcggagctcggaggacacgaagcaaatgatgagtagcttcatgtgagacttgcccggcattaagaggcattccgtcttggaattccggcattaagaggcattccgtcttcatagcccgtgagacgccagtgtcacctttagcccaaccagtgccctgagggtggcattttcctaccttcctgtaacgacccccgggattgcccagggctacagcctctctcccgtgagcctccagaccgcgccctggccccgccccccaccccgatnggcccggccgggtctgggggcggggcgtttgcggcctttccagggccggggaaccccaggaggaagctgctgagccatgggcgcctacgcgcgggcttcgggggtctgcgctcgcggctgcctggactcagcaggcccctggaccatgtcccgcgccctgcggccaccgctcccgcctctctgctttttccttttgttgctggcggctgccggtgctcgggccgggggatacgagacatgccccacagtgcagccgaacatgctgaacgtgcacctgctgcctcacacacatgatgacgtgggctggctcaaaaccgtggaccagtacttttatggaatcaagaatgacatccagcacgccggtgtgcagtacatcctggactcggtcatctctgccttgctggcagatcccacccgtcgcttcatttacgtggagattgccttcttctcccgttggtggcaccagcagacaaatgccacacaggaagtcgtgcgagaccttgtgcgccaggggcgcctggagttcgccaatggtggctgggtgatgaacgatgaggcagccacccactacggtgccatcgtggaccagatgacacttgggctgcgctttctggaggacacatttggcaatgatgggcgaccccgtgtggcctggcacattgaccccttcggccactctcgggagcaggcctcgctgtttgcgcagatgggcttcgacggcttcttctttgggcgccttgattatcaagataagtgggtacggatgcagaagctggagatggagcaggtgtggcgggccagcaccagcctgaagcccccgaccgcggacctcttcactggtgtgcttcccaatggttacaacccgccaaggaatctgtgctgggatgtgctgtgtgtcgatcagccgctggtggaggaccctcgcagccccgagtacaacgccaaggagctggtcgattacttcctaaatgtggccactgcccagactcactccagcctgagcaacagaatgaaactctatctcaaacaaaaacaaaaacaaaccccccaaaatttccaaatctggaaaaggaaaaatgaatatgaagatccatgaagccccaaaaaccccaaatagggttaaggtatagagaacgtcactgagacacattgtaataaaattctcaaaaatcagagataaaaagaatttgaaagcagcaagagaaaagcaactcatcatatacaacagaacctctattcaagtattagagattcctcagcagaaacattccaggccaggagaaagtgggatgatgtattccaagtgccaaaagagaacaaaaacgactgtcaatcaagagtactataacagcaaagctatcctttagaaataaaaataagtaaataaaaactttccctgataaacaaaaactgagggagttcctcaccacttgacctgcatgacaagaaatgnt

SEQ ID NO: 372288 - DNA, 1274 bp, Homo sapiens
tcttttaaagattgttctcatacaagatttattccccagcacacccctcccctcctcagttcacagtggagactatggagattcagggcaggatccctcaggtacaagaaacaccttccgaagattttgctctccttccttccctccctcttgccaactcccaaggcctgaagcgcacaatcagagctctgaacttgagaggtgtcaaaagtctgtttgagaagcctaaagtggggagatgccattacccctgaccaccccactatgagtgactatgagacacctaactcttccctcttctgtcaaccattttcactccctggcctctgtaccttctccatcaaccaagagcaaacatgtcagcacacccccacctgcagtacatgaaaacaggctctgtccaacatccctcacccaagtacaggggtgttgggggagtggcccctgaggatcagcaaagggttaatgcagaaggaaagaggacagaagcgtttggcttgagctctgcttggggaggcagaggctatagactggcacaggtttagaatcaagtaccatgtttaggtttctgtctcacatcacatgatttcactaggggctgcagaacagatacccctcagaggggtctctgctgattacagccacattcttactattggctcatccttaaaggaggccccaccaagttgggaagcagttgaaaataaaagctgtaaaggagctgaacaggaagtaagaataggtggtgcaagagattatggcccctgggatgaatgacatggagccatttgtaaagtgctactgtatcatcccccatgaattattgcttctccaaaggaggagcagaggaaggaacaggaacatagaaatgagtatggtattgctttgctcactgctgaggctgatggccagatggacccaggggttatcagaaaccgaagattaactacacagctccagaagactcagacctcaaaatacagaggtgctcactaatcctcccagccagctgatccccctgggccaaggtaatgtagaagaggcccatccccacatcatattcacattttttaaatttcacaagcaatactttggaccactggggttcaggccccaagaaatggtgggctagatgagagggagcaggcctgttctgcaaaaccaaaggacaagtttgctttaaaaaaaaaaaaaaatcacgctgggcacagtggctcacacctgtaatcccaacactttgggtggctgaggcgggctgatcatttgcagtcagg

SEQ ID NO: 372289 - DNA, 1032 bp, Homo sapiens
cactcatagtggggtggtcaggggtaatggcatctccccactttagtcttccctcttctgtcaaccattttcactccctggcctctgtaccttctccatcaaccaagagcaaacatgtcagcacacccccacctgcagtacatgaaaacaggctctgtccaacatccctcacccaagtacaggggtgttgggggagtggcccctgaggatcagcaaagggttaatgcagaaggaaagaggacagaagcgtttggcttgagctctgcttggggaggcagaggctatagactggcacaggtttagaatcaagtaccatgtttaggtttctgtctcacatcacatgatttcactaggggctgcagaacagatacccctcagaggggtctctgctgattacagccacattcttactattggctcatccttaaaggaggccccaccaagttgggaagcagttgaaaataaaagctgtaaaggagctgaacaggaagtaagaataggtggtgcaagagattatggcccctgggatgaatgacatggagccatttgtaaagtgctactgtatcatcccccatgaattattgcttctccaaaggaggagcagaggaaggaacaggaacatagaaatgagtatggtattgctttgctcactgctgaggctgatggccagatggacccaggggttatcagaaaccgaagattaactacacagctccagaagactcagacctcaaaatacagaggtgctcactaatcctcccagccagctgatccccctgggccaaggtaatgtagaagaggcccatccccacatcatattcacattttttaaatttcacaagcaatactttggaccactggggttcaggccccaagaaatggtgggctagatgagagggagcaggcctgttctgcaaaaccaaaggacaagtttgctttaaaaaaaaaaaaaaatcacgctgggcacagtggctcacacctgtaatcccaacactttgggtggctgaggcgggctgatcatttgcagtcagg

SEQ ID NO: 372290 - DNA, 1327 bp, Homo sapiens
tcttttaaagattgttctcatacaagatttattccccagcacacccctcccctcctcagttcacagtggagactatggagattcagggcaggatccctcaggtacaagaaacaccttccgaagattttgctctccttccttccctccctcttgccaactcccaaggcctgaagcgcacactcatgcaaacacacgaaatccccctccttccccacacctcctgtctttccacatcagagctctgaacttgagaggtgtcaaaagtctgtttgagaagcctaaagtggggagatgccattacccctgaccaccccactatgagtgactatgagacacctaactcttccctcttctgtcaaccattttcactccctggcctctgtaccttctccatcaaccaagagcaaacatgtcagcacacccccacctgcagtacatgaaaacaggctctgtccaacatccctcacccaagtacaggggtgttgggggagtggcccctgaggatcagcaaagggttaatgcagaaggaaagaggacagaagcgtttggcttgagctctgcttggggaggcagaggctatagactggcacaggtttagaatcaagtaccatgtttaggtttctgtctcacatcacatgatttcactaggggctgcagaacagatacccctcagaggggtctctgctgattacagccacattcttactattggctcatccttaaaggaggccccaccaagttgggaagcagttgaaaataaaagctgtaaaggagctgaacaggaagtaagaataggtggtgcaagagattatggcccctgggatgaatgacatggagccatttgtaaagtgctactgtatcatcccccatgaattattgcttctccaaaggaggagcagaggaaggaacaggaacatagaaatgagtatggtattgctttgctcactgctgaggctgatggccagatggacccaggggttatcagaaaccgaagattaactacacagctccagaagactcagacctcaaaatacagaggtgctcactaatcctcccagccagctgatccccctgggccaaggtaatgtagaagaggcccatccccacatcatattcacattttttaaatttcacaagcaatactttggaccactggggttcaggccccaagaaatggtgggctagatgagagggagcaggcctgttctgcaaaaccaaaggacaagtttgctttaaaaaaaaaaaaaaatcacgctgggcacagtggctcacacctgtaatcccaacactttgggtggctgaggcgggctgatcatttgcagtcagg

SEQ ID NO: 372291 - DNA, 845 bp, Homo sapiens
agcgggtgatagccgtcaaaggcagcaaatagactgaatgaaagatgagcttctgcctttatatccttctctcctgctacccaactcattgtggtgaaggaaaaagaaaacgcgggtggagactgcactatatgcttaggactgaaatgcaactgcagaagcaacatgtgaccttttagagatgcttgtgggactgcataaagtgaagagggaaactggaaaaaaacaatgaacatttatcaccatccagccactgtagataaatttgattggctgtctccctgccttcccttcacacccagtaccttccctgcctgaaatcctcattgagggcaagaactttatccccaggatctaaaccagtgctggacaatagatgctcatcccttccataggaaacagggaatgtttgtttctgtcttctggtaggagaaggattggtcccacccccagctccagggatggatcttgattgtttaagcccagtcagtgattctaacccatggaccaagaccctgccttggagattggggaacaggtgttggaagggctctattttggcaaagaatggattatttatgtgagcatatttccgcaaagctaatcccgaactcctggcctcaaatgatcttcctaccttggcttcccaaagtgctgggattacagacgtgagctgctgtgcctggccaagacttaattttgaatgacattgggactattgccaaaaatcaaatccatcttcatgttgtccacttctcagccttatattgaataggggaaacctggttcctgaaacaaactgaaaaagtggcttaaaaatgggccttggggcctcattgagaaac

SEQ ID NO: 372292 - DNA, 9360 bp, Homo sapiens
  misc_feature (5847)..(5847): n is a, c, g, or t
ccggagtcggttggtgcagctgcgtccccgccgctcagcagtccgcggctccggcgtcgccgccgccgccgcctctgcggggcctgcgccggccgcccgcccggccgcggggagggaggcccgcagcgcgggaagagcggcccggtcgcgggcgccgccaccgccgccgctgccaggactgaaatgcaactgcagaagcaacatgtgaccttttagagatgcttgtgggactgcataaagtgaagagggaaactggaaaaaaacaatgaaattgaatagggaaaacctgctttctgcaaacaactgaaaaagctgcatttagaaactgtttctttggccctcatcgagaagctggaacttgtattgttaggccccttatgggacaagctctcaactgctgatcacccagtgattgtcaccatggccagcaagaggaaatccaccacaccatgcatgatcccagtgaagactgtggtgttgcaagatgccagcatggaggcccagcccgctgagaccttgcctgaaggaccccagcaggatctgcccccagaagcatctgctgccagcagtgaggcagcacagaaccccagcagtactgatggctctacactggccaatgggcatcggagcactttagatggctatttatattcctgtaaatactgcgatttcagatcccatgacatgacccaatttgtgggacatatgaactcagagcacacagactttaataaagacccaacctttgtatgcagtgggtgcagttttctggcaaaaacccctgaggggctttccttgcacaatgccacatgtcactccggggaagccagctttgtgtggaacgtggccaagccagacaatcatgtggttgtggagcagagcatccctgagagcaccagcactcctgacctagcgggtgagcccagtgctgaaggggctgatggacaggcagaaatcatcattaccaaaactccaatcatgaagataatgaaaggcaaagctgaagccaaaaaaattcatacactcaaggagaatgtccctagccagcctgtgggtgaggccttaccaaagctgtcgactggagaaatggaggtgagagagggggaccattccttcatcaatggggcagttccagtcagccaggcatctgccagctctgcaaaaaacccccatgccgccaacgggcccctgataggaacagtgccagttttgccagctggcatagcacagttcctctccctccagcagcagcccccagtgcatgcccaacaccatgtccaccagccactgcccacggccaaggcccttcccaaagtgatgatccccctgagcagcattccaacgtacagtgcagccatggactctaacagcttcctgaagaactccttccacaagttcccctaccccaccaaagccgagctctgctatttgactgtggtgaccaagtatccagaagaacagctcaagatctggttcacagcccaaaggctgaagcaggggatcagctggtcccctgaggagattgaggatgcccggaaaaagatgttcaatacagtcatccagtctgtgcctcagcccacaattacggttctaaataccccactcgtcgccagtgctggcaatgtccagcatctcatccaggccgctcttccaggtcacgttgtggggcagccagagggtacaggagggggacttctggtcactcagccattgatggccaatgggttgcaagcaacaagttcccctctccccctcacggtgacatccgtccccaagcagccaggtgtggcacccattaacactgtgtgttcaaatacaacgtcagctgtgaaggtggtcaatgcggcccagtcgctcctcacggcctgccccagcataacctcccaagccttccttgatgctagcatctacaaaaataagaaatctcatgaacagctgtcagctctgaaagggagcttctgtcggaaccagttcccagggcagagcgaagttgaacatctcacaaaagtgacgggcctcagtaccagagaggtgcggaaatggttcagtgatcgtagataccactgccggaacttgaagggctccagagcgatgatacctggagatcacagttccatcatcattgactctgtgccagaggtgtccttctccccatcgtccaaggtccctgaggtaacctgcattccgacaacagccacactagcaacccacccttctgccaaacgacaatcttggcaccagactcctgacttcacaccaaccaaatacaaggagagagcccctgagcagctcagagccctggagagcagttttgcacaaaaccctcttcctcttgatgaggaactggaccgcctgagaagtgaaaccaaaatgacccgacgagaaattgatagctggttttcagagagacggaaaaaagtgaatgctgaggagaccaagaaggctgaggagaatgcctctcaggaggaagaggaggctgctgaggatgagggtggagaagaggatttggccagtgagctaagggtctctggtgaaaatggctctctggaaatgcccagcagccatatcttggcagagcgcaaagtcagccccattaaaatcaacctgaagaacctgagggtcactgaagccaatggcaggaacgagattccagggctgggtgcctgtgaccctgaggatgatgagtcaaacaaactggcagagcagctcccaggcaaagtgagctgcaaaaagactgcccagcagcggcacttgctgcggcagctctttgtccagacacagtggccaagcaaccaggactatgactccatcatggcccagacgggtctgccacggccagaggtggtgcgctggtttggagatagcaggtacgcactgaagaacggccaactcaaatggtacgaagactataagcgaggcaacttcccaccagggctactggtcattgcccctggcaaccgggagctcctgcaggactattacatgacacacaagatgctgtatgaagaggacctgcagaacctctgtgacaagacccagatgagctcccagcaggtcaagcagtggtttgctgagaaaatgggggaggagaccagagccgtggcagacacaggcagtgaggaccagggccctggtactggtgagctcacagcagttcacaaagggatgggtgacacctattcagaggtgtctgagaacagtgagtcgtgggagccccgtgtccctgaggccagctcagagccctttgacacatcgagtccccaggctggacgtcagctcgaaacagactgaatttgatctgattaatgtgaaggactggccagtctgggaaaccgcctgccacgtggaagagccaaacccgactctctgctgccacatgccgttcccatgcccggctgctgggcacctgggagagcttccagaatcctcgcagacagcccagagcctgccgctaccctcggcctgcccaccaccaagcaagcagcaagcaagatggggttctcatcagttcttcctcccacaatgtaggacctttcctttaccttccaatggataaaatagttcagagttcatagtcatattcatagacacagaatcaagcttttaacatatacatccacctctatatgttaaataaaacatcagattatcaacactgtcattacgtagaaactttggttagccaagcagtgcattgtcagttacgtcatctctaaaaatgacctgtgtctgttctctggggattgctgggtcacaggtgcccctcaccttccacagtcaggcagggaagttataggcacaaagctacgtctggaacccctttgtgccccctttgtgttcctcaaggaagcagtacctttgaagagatctctgctgcattaagtgatgaccggctacgtttcatgtcaggcttgctttgccttgtgggctactcagtgcagaacctgctgtaaccctcagttcaaaaaatggactggcaatgtgattagcgttggatgctttaccattctctttagttgttaccgtaattctgctttttcatgggagtttgaatcatggaccataacttttcagttatcagatcaactaaagaaacatttgttgttaagcctaatgtgctgacctatgtgcctgcattttttttttaatctagacatgtttggagtgagagaaagatggaaaaaagacatggggtagggacgtaagtggaaatctatagccacagcctgaagctttgaccactgcggttttcagagccctttctccacactcatttcagagcctcctatggtttgggaaggaataacacactggcccattagtaagggtgaaggctggagggatttgttgacttcttggaattatcagaggtagggtggtctttagcacaaagacttgcatgcagagatccctggcagaacacccagagtgcccgtggctcccaccccagggtctggccggtgtgctggatgcatgcccaagggtgctgggcatcactggtccttgtgaggatgcttttaaagttttatatttatgtccccaaacttggaaacaagaactctactttagcctaaccctcatgtccttttttgaattgagaaaattacaggaaatggtgcctttgaaaattagaaaacttgcttacagagctgttctaaatggtaaatcctcaatttccccaagaccggttgctctgagagtagctggtaaagaggggcgaactaaagacctgtccacctgtagctccgctcatttcttagaaaccacctgcttcccagagtgccaagccacaagtaccaggcttcgtgggcacagacacctcctgggctgggcagagtgacagtgctagaagaccccagagagagggcaagggctttgggcaagaagcactggtggtgttttagggaccgtccttctcccctacccagggaactggacctggcagggcaccgtgctcatgtggctccaaggacaagcatggcggtggccccttctgccttccaggagaggtcttgcttttgaaaccaaaatcatgttcttctaaagtgtcatcttctgccctccctgtcccaatagggaccacatcttatttgtctcaaacagggacttgtgagtacttggcaagttttgcagcctatttttgtattcttaatttggggagtaaagatgtttggtctcaaaaacctttgaggaattgccaagaatggcgagtgattgctttccttcagagaacagacacttggaatttctccttttagtgtttatatacgtgcagattaatttatatatatatatatacacacacacatatacagtataaatactcatttgattctcgtaaaacgcgcatctggcgtgtgcagttgagaaacttggtggcacatgggtgttgggggagtagcctgtgttggagggacaccagtgcactaggcagctggggcggcccaggctgaagccatctccgggtgtctgagaaaccacccagtgcctcacctccagatcctgctggcatcacctccagagccctgcatgcactggctgaagagttggtctgtggagaggattttcttggttacttgtattcacggttaatttacaacccaaacagcaaaacacagttggtggacaagttcatgcaggacctacagtgacccagccatgggcactagctcatctttcaggtggaaaagtacagtgctgcctgccctggtatgtttttcttatagatgttagccctgcccaacagccagggctacactacaaaaggcaagaatgcccatgtaaggagcccagcagtctggacagatccttcttcctctgctgttggatgagagtgagtgagtatgntctggaccttatccttgaaagatgatcaaaagcgatgatgagggaggcagtcatcacgcaggtgcttaaagggacattgtaggaggtactcaagggtttgggggcaaaaccctgaatccagccagtcgtgcacagagacacacccacactagcccagtggcagtgggggatgtgggatggcagcagccaggtatgtagccctgtcacaggacagctcactgtggttttgcacactgcctaagggttaaattgtgttgttgccttcagtagaaggcatttgtgggctgcagagttgagagttgggtgaggttagtctctcctgaagaaaaagcctataaaaagtggctaatcttatcccttttctctgtatgcagttggactcgtcagagatagtaaaatcatcttttagtgtttttttgttgctgatgtcttgtacccatttgttttttacatggggttgtagatcgagttctcaaaggtgaaaccagatgatcattctgataaaggaaatttaaatttgatacatatgctttgtatattttgattacttgttttcgtttttgactataaaggagctcttttttcttgctcagagtttacctgggagatttcaccagtttgactcaccatttgcagatgtgcttttgtattaaatttaaattttcacatatcacatccattctcaaggtagttatatgctggagaagaaaaatcctctagacacatgaaggcccacatagtcaagtcttccagggcaaagccagcagcccacccaggtcaggtagccagcagggctcagttcccctcactccagacacggaccctcctcttcagggtctcttgacccagcttccttctctccttttacctgagagcacagacctctctcagccagcctgcccagaccacggggggctactcccatgtagtttggggagcacttgatctcagaaaagctccattgtctgagcaaatgggcagttgtggagctcaagcctttctcctgtgctcaagtcccttccccaagcaaggcttcaacctcatctacccaccatgtagttttctctggccatttaagtggggcggcagggacatggttgggccatgccacaccagggctggtgaggcaaccagttttgattttgacagagtggctggaggaaaagtggcaatcaaggtgctgcttggtttgctctgagtgcaaatggaaccaacaggtttctgctgcaatctgtgtgttcccagtgccaggtcacaccaggaggggtggggcagggctaaccaagtggtctctgaactcaccgagcgtctgcacttggttgtgaagttaatgggagtacagagagcgtctggccttggagaggggttgagagcctcctttttggttcttcattcctgagctcttgcctgcccacaaatctgacctctttgaatggggacgcagtccttcaacagagaagtttctatggcaaagaagtttctatttagctctagatccagcagagtcatccattctaactgccctgaagtctagagcaggggagggaacccagaggctggggatgagactaggcagaccctggttaccatatggacaaggacaggggaaagcacccccttcctcaatttctgaaagttctatctttgggttcgcaggactttgaggatgataaagaacatataggtactagcttgttgttgctggtccaaagcttccacagccctgagaatttggctttcgtggctgctctggcagctgagcgaagggaggaaggcagccgctctggtggggactctaggcaccttccctgctgtccacttggataggcggtgagccccagggtactgagaggagcctgagcatttacctgccattagtgcctcttccttcaggagactggcttgaaacgtgtgttcatgtgcgcgtgcacacacacacatgagcacctgtatgtgttaatgaatagtttttcttggttaatgctttttaacttctgttcctttccgtaagtggatgattcaaaattaacgtgacttggctgggcgcagtggctcacacctgtaatcccagcactttgggaggccaagggaggcggatcacctgaggtcaggagttcgagaccagcctgatcggcatggtgaaaccccgtttctactaaaaatacaaaaattagccgggcgtggtggtgcgcgcctgtaatcccagctactcaggaggctgaggaaggagaatcacttgaacccgggaggtggaggttgcagtgagctgagatcgtgccactgcactccagcctgggcgacagagcgaaactccgtctcaaaaaaaaaaaaaaaacttaatgtgactggagttaaaagtgaaatgtcaggttgtttagtcactgaatagagagctacaagtgcttggtctttcccaagaatcaaacctgagtagaaatacatttaaaagaaaaatctacatggtacctatgaatcctgtaatttgtttagggagatcttgtcactcatccctggttcctgcccatactgtttggtctcgttcttgcagtttgcttggaacagggccagagccccacatgagattgtcagcaggagtgaggagcgccagtccctactcctcagcagggacccagcacagcaatccggttgttctcggttagactgggtcggggccaggggagaagcagtcacccctgtgtagagggttcccgctgtgcttctgagcagttgctttgttcagaagtgttaggagggtcagattgtgccataattgttattaaagagaaaacacgcccaccttcctttctcccctgctggccattgttcattgagttttactgagggcagcctttgtggaagtcagggaggttgccaaaggcctgtagatgcctcctgacaaggtcttgattcctggttttctagcacccatttgcattttggtcttcagcacaaagccttgttccctgtggccggacttctgggcaataagactggggagtgactgttgagcagtctgctgtcaggagagatggctgaaaaggtgatcatcttggtgctaaacaagtaagaggcaactgccctgtttttgtttgttttgaggcacaatgaaactttagccaaactctgcaagagggtcccatctcctgccatggccaggtgtgagagaccaaaccgagaaaacagcatactctatcacttaagccttgggtagaatgggaattctttaccctgggtaaacgttttaacaaaaaaatggaacttaacttcggtttggactgtggtcgtgctgaggcaggagtggggttgccctcttggggctgaatctccaggcctcacgaggtcccctgtggggatgctgctatttctaagatgcaaattgcacatttcctagattttgtatctgtggatttggataagggaggggaacacggacaaattgcttgtacaatttgaaatgggcctcaatggtacttcaaaccttttgattattcctaaataaaaacataaatatat

SEQ ID NO: 372293 - DNA, 9323 bp, Homo sapiens
  misc_feature (5810)..(5810): n is a, c, g, or t
agcgggtgatagccgtcaaaggcagcaaatagactgaatgaaagatgagcttctgcctttatatccttctctcctgctacccaactcattgtggtgaaggaaaaagaaaacgcgggtggagactgcactatatgcttaggactgaaatgcaactgcagaagcaacatgtgaccttttagagatgcttgtgggactgcataaagtgaagagggaaactggaaaaaaacaatgaaattgaatagggaaaacctgctttctgcaaacaactgaaaaagctgcatttagaaactgtttctttggccctcatcgagaagctggaacttgtattgttaggccccttatgggacaagctctcaactgctgatcacccagtgattgtcaccatggccagcaagaggaaatccaccacaccatgcatgatcccagtgaagactgtggtgttgcaagatgccagcatggaggcccagcccgctgagaccttgcctgaaggaccccagcaggatctgcccccagaagcatctgctgccagcagtgaggcagcacagaaccccagcagtactgatggctctacactggccaatgggcatcggagcactttagatggctatttatattcctgtaaatactgcgatttcagatcccatgacatgacccaatttgtgggacatatgaactcagagcacacagactttaataaagacccaacctttgtatgcagtgggtgcagttttctggcaaaaacccctgaggggctttccttgcacaatgccacatgtcactccggggaagccagctttgtgtggaacgtggccaagccagacaatcatgtggttgtggagcagagcatccctgagagcaccagcactcctgacctagcgggtgagcccagtgctgaaggggctgatggacaggcagaaatcatcattaccaaaactccaatcatgaagataatgaaaggcaaagctgaagccaaaaaaattcatacactcaaggagaatgtccctagccagcctgtgggtgaggccttaccaaagctgtcgactggagaaatggaggtgagagagggggaccattccttcatcaatggggcagttccagtcagccaggcatctgccagctctgcaaaaaacccccatgccgccaacgggcccctgataggaacagtgccagttttgccagctggcatagcacagttcctctccctccagcagcagcccccagtgcatgcccaacaccatgtccaccagccactgcccacggccaaggcccttcccaaagtgatgatccccctgagcagcattccaacgtacagtgcagccatggactctaacagcttcctgaagaactccttccacaagttcccctaccccaccaaagccgagctctgctatttgactgtggtgaccaagtatccagaagaacagctcaagatctggttcacagcccaaaggctgaagcaggggatcagctggtcccctgaggagattgaggatgcccggaaaaagatgttcaatacagtcatccagtctgtgcctcagcccacaattacggttctaaataccccactcgtcgccagtgctggcaatgtccagcatctcatccaggccgctcttccaggtcacgttgtggggcagccagagggtacaggagggggacttctggtcactcagccattgatggccaatgggttgcaagcaacaagttcccctctccccctcacggtgacatccgtccccaagcagccaggtgtggcacccattaacactgtgtgttcaaatacaacgtcagctgtgaaggtggtcaatgcggcccagtcgctcctcacggcctgccccagcataacctcccaagccttccttgatgctagcatctacaaaaataagaaatctcatgaacagctgtcagctctgaaagggagcttctgtcggaaccagttcccagggcagagcgaagttgaacatctcacaaaagtgacgggcctcagtaccagagaggtgcggaaatggttcagtgatcgtagataccactgccggaacttgaagggctccagagcgatgatacctggagatcacagttccatcatcattgactctgtgccagaggtgtccttctccccatcgtccaaggtccctgaggtaacctgcattccgacaacagccacactagcaacccacccttctgccaaacgacaatcttggcaccagactcctgacttcacaccaaccaaatacaaggagagagcccctgagcagctcagagccctggagagcagttttgcacaaaaccctcttcctcttgatgaggaactggaccgcctgagaagtgaaaccaaaatgacccgacgagaaattgatagctggttttcagagagacggaaaaaagtgaatgctgaggagaccaagaaggctgaggagaatgcctctcaggaggaagaggaggctgctgaggatgagggtggagaagaggatttggccagtgagctaagggtctctggtgaaaatggctctctggaaatgcccagcagccatatcttggcagagcgcaaagtcagccccattaaaatcaacctgaagaacctgagggtcactgaagccaatggcaggaacgagattccagggctgggtgcctgtgaccctgaggatgatgagtcaaacaaactggcagagcagctcccaggcaaagtgagctgcaaaaagactgcccagcagcggcacttgctgcggcagctctttgtccagacacagtggccaagcaaccaggactatgactccatcatggcccagacgggtctgccacggccagaggtggtgcgctggtttggagatagcaggtacgcactgaagaacggccaactcaaatggtacgaagactataagcgaggcaacttcccaccagggctactggtcattgcccctggcaaccgggagctcctgcaggactattacatgacacacaagatgctgtatgaagaggacctgcagaacctctgtgacaagacccagatgagctcccagcaggtcaagcagtggtttgctgagaaaatgggggaggagaccagagccgtggcagacacaggcagtgaggaccagggccctggtactggtgagctcacagcagttcacaaagggatgggtgacacctattcagaggtgtctgagaacagtgagtcgtgggagccccgtgtccctgaggccagctcagagccctttgacacatcgagtccccaggctggacgtcagctcgaaacagactgaatttgatctgattaatgtgaaggactggccagtctgggaaaccgcctgccacgtggaagagccaaacccgactctctgctgccacatgccgttcccatgcccggctgctgggcacctgggagagcttccagaatcctcgcagacagcccagagcctgccgctaccctcggcctgcccaccaccaagcaagcagcaagcaagatggggttctcatcagttcttcctcccacaatgtaggacctttcctttaccttccaatggataaaatagttcagagttcatagtcatattcatagacacagaatcaagcttttaacatatacatccacctctatatgttaaataaaacatcagattatcaacactgtcattacgtagaaactttggttagccaagcagtgcattgtcagttacgtcatctctaaaaatgacctgtgtctgttctctggggattgctgggtcacaggtgcccctcaccttccacagtcaggcagggaagttataggcacaaagctacgtctggaacccctttgtgccccctttgtgttcctcaaggaagcagtacctttgaagagatctctgctgcattaagtgatgaccggctacgtttcatgtcaggcttgctttgccttgtgggctactcagtgcagaacctgctgtaaccctcagttcaaaaaatggactggcaatgtgattagcgttggatgctttaccattctctttagttgttaccgtaattctgctttttcatgggagtttgaatcatggaccataacttttcagttatcagatcaactaaagaaacatttgttgttaagcctaatgtgctgacctatgtgcctgcattttttttttaatctagacatgtttggagtgagagaaagatggaaaaaagacatggggtagggacgtaagtggaaatctatagccacagcctgaagctttgaccactgcggttttcagagccctttctccacactcatttcagagcctcctatggtttgggaaggaataacacactggcccattagtaagggtgaaggctggagggatttgttgacttcttggaattatcagaggtagggtggtctttagcacaaagacttgcatgcagagatccctggcagaacacccagagtgcccgtggctcccaccccagggtctggccggtgtgctggatgcatgcccaagggtgctgggcatcactggtccttgtgaggatgcttttaaagttttatatttatgtccccaaacttggaaacaagaactctactttagcctaaccctcatgtccttttttgaattgagaaaattacaggaaatggtgcctttgaaaattagaaaacttgcttacagagctgttctaaatggtaaatcctcaatttccccaagaccggttgctctgagagtagctggtaaagaggggcgaactaaagacctgtccacctgtagctccgctcatttcttagaaaccacctgcttcccagagtgccaagccacaagtaccaggcttcgtgggcacagacacctcctgggctgggcagagtgacagtgctagaagaccccagagagagggcaagggctttgggcaagaagcactggtggtgttttagggaccgtccttctcccctacccagggaactggacctggcagggcaccgtgctcatgtggctccaaggacaagcatggcggtggccccttctgccttccaggagaggtcttgcttttgaaaccaaaatcatgttcttctaaagtgtcatcttctgccctccctgtcccaatagggaccacatcttatttgtctcaaacagggacttgtgagtacttggcaagttttgcagcctatttttgtattcttaatttggggagtaaagatgtttggtctcaaaaacctttgaggaattgccaagaatggcgagtgattgctttccttcagagaacagacacttggaatttctccttttagtgtttatatacgtgcagattaatttatatatatatatatacacacacacatatacagtataaatactcatttgattctcgtaaaacgcgcatctggcgtgtgcagttgagaaacttggtggcacatgggtgttgggggagtagcctgtgttggagggacaccagtgcactaggcagctggggcggcccaggctgaagccatctccgggtgtctgagaaaccacccagtgcctcacctccagatcctgctggcatcacctccagagccctgcatgcactggctgaagagttggtctgtggagaggattttcttggttacttgtattcacggttaatttacaacccaaacagcaaaacacagttggtggacaagttcatgcaggacctacagtgacccagccatgggcactagctcatctttcaggtggaaaagtacagtgctgcctgccctggtatgtttttcttatagatgttagccctgcccaacagccagggctacactacaaaaggcaagaatgcccatgtaaggagcccagcagtctggacagatccttcttcctctgctgttggatgagagtgagtgagtatgntctggaccttatccttgaaagatgatcaaaagcgatgatgagggaggcagtcatcacgcaggtgcttaaagggacattgtaggaggtactcaagggtttgggggcaaaaccctgaatccagccagtcgtgcacagagacacacccacactagcccagtggcagtgggggatgtgggatggcagcagccaggtatgtagccctgtcacaggacagctcactgtggttttgcacactgcctaagggttaaattgtgttgttgccttcagtagaaggcatttgtgggctgcagagttgagagttgggtgaggttagtctctcctgaagaaaaagcctataaaaagtggctaatcttatcccttttctctgtatgcagttggactcgtcagagatagtaaaatcatcttttagtgtttttttgttgctgatgtcttgtacccatttgttttttacatggggttgtagatcgagttctcaaaggtgaaaccagatgatcattctgataaaggaaatttaaatttgatacatatgctttgtatattttgattacttgttttcgtttttgactataaaggagctcttttttcttgctcagagtttacctgggagatttcaccagtttgactcaccatttgcagatgtgcttttgtattaaatttaaattttcacatatcacatccattctcaaggtagttatatgctggagaagaaaaatcctctagacacatgaaggcccacatagtcaagtcttccagggcaaagccagcagcccacccaggtcaggtagccagcagggctcagttcccctcactccagacacggaccctcctcttcagggtctcttgacccagcttccttctctccttttacctgagagcacagacctctctcagccagcctgcccagaccacggggggctactcccatgtagtttggggagcacttgatctcagaaaagctccattgtctgagcaaatgggcagttgtggagctcaagcctttctcctgtgctcaagtcccttccccaagcaaggcttcaacctcatctacccaccatgtagttttctctggccatttaagtggggcggcagggacatggttgggccatgccacaccagggctggtgaggcaaccagttttgattttgacagagtggctggaggaaaagtggcaatcaaggtgctgcttggtttgctctgagtgcaaatggaaccaacaggtttctgctgcaatctgtgtgttcccagtgccaggtcacaccaggaggggtggggcagggctaaccaagtggtctctgaactcaccgagcgtctgcacttggttgtgaagttaatgggagtacagagagcgtctggccttggagaggggttgagagcctcctttttggttcttcattcctgagctcttgcctgcccacaaatctgacctctttgaatggggacgcagtccttcaacagagaagtttctatggcaaagaagtttctatttagctctagatccagcagagtcatccattctaactgccctgaagtctagagcaggggagggaacccagaggctggggatgagactaggcagaccctggttaccatatggacaaggacaggggaaagcacccccttcctcaatttctgaaagttctatctttgggttcgcaggactttgaggatgataaagaacatataggtactagcttgttgttgctggtccaaagcttccacagccctgagaatttggctttcgtggctgctctggcagctgagcgaagggaggaaggcagccgctctggtggggactctaggcaccttccctgctgtccacttggataggcggtgagccccagggtactgagaggagcctgagcatttacctgccattagtgcctcttccttcaggagactggcttgaaacgtgtgttcatgtgcgcgtgcacacacacacatgagcacctgtatgtgttaatgaatagtttttcttggttaatgctttttaacttctgttcctttccgtaagtggatgattcaaaattaacgtgacttggctgggcgcagtggctcacacctgtaatcccagcactttgggaggccaagggaggcggatcacctgaggtcaggagttcgagaccagcctgatcggcatggtgaaaccccgtttctactaaaaatacaaaaattagccgggcgtggtggtgcgcgcctgtaatcccagctactcaggaggctgaggaaggagaatcacttgaacccgggaggtggaggttgcagtgagctgagatcgtgccactgcactccagcctgggcgacagagcgaaactccgtctcaaaaaaaaaaaaaaaacttaatgtgactggagttaaaagtgaaatgtcaggttgtttagtcactgaatagagagctacaagtgcttggtctttcccaagaatcaaacctgagtagaaatacatttaaaagaaaaatctacatggtacctatgaatcctgtaatttgtttagggagatcttgtcactcatccctggttcctgcccatactgtttggtctcgttcttgcagtttgcttggaacagggccagagccccacatgagattgtcagcaggagtgaggagcgccagtccctactcctcagcagggacccagcacagcaatccggttgttctcggttagactgggtcggggccaggggagaagcagtcacccctgtgtagagggttcccgctgtgcttctgagcagttgctttgttcagaagtgttaggagggtcagattgtgccataattgttattaaagagaaaacacgcccaccttcctttctcccctgctggccattgttcattgagttttactgagggcagcctttgtggaagtcagggaggttgccaaaggcctgtagatgcctcctgacaaggtcttgattcctggttttctagcacccatttgcattttggtcttcagcacaaagccttgttccctgtggccggacttctgggcaataagactggggagtgactgttgagcagtctgctgtcaggagagatggctgaaaaggtgatcatcttggtgctaaacaagtaagaggcaactgccctgtttttgtttgttttgaggcacaatgaaactttagccaaactctgcaagagggtcccatctcctgccatggccaggtgtgagagaccaaaccgagaaaacagcatactctatcacttaagccttgggtagaatgggaattctttaccctgggtaaacgttttaacaaaaaaatggaacttaacttcggtttggactgtggtcgtgctgaggcaggagtggggttgccctcttggggctgaatctccaggcctcacgaggtcccctgtggggatgctgctatttctaagatgcaaattgcacatttcctagattttgtatctgtggatttggataagggaggggaacacggacaaattgcttgtacaatttgaaatgggcctcaatggtacttcaaaccttttgattattcctaaataaaaacataaatatat

SEQ ID NO: 372294 - DNA, 9407 bp, Homo sapiens
  misc_feature (5894)..(5894): n is a, c, g, or t
tgggaagttctttccagctctggacaggaaaacatgaaaacagatgatcccaaggaggactgaaatgcaactgcagaagcaacatgtgaccttttagagatgcttgtgggactgcataaagtgaagagggaaactggaaaaaaacaatgaagctaatcccgaactcctggcctcaaatgatcttcctaccttggcttcccaaagtgctgggattacagacgtgagctgctgtgcctggccaagacttaattttgaatgacattgggactattgccaaaaatcaaatccatcttcatgttgtccacttctcagccttaattgaatagggaaaacctgctttctgcaaacaactgaaaaagctgcatttagaaactgtttctttggccctcatcgagaagctggaacttgtattgttaggccccttatgggacaagctctcaactgctgatcacccagtgattgtcaccatggccagcaagaggaaatccaccacaccatgcatgatcccagtgaagactgtggtgttgcaagatgccagcatggaggcccagcccgctgagaccttgcctgaaggaccccagcaggatctgcccccagaagcatctgctgccagcagtgaggcagcacagaaccccagcagtactgatggctctacactggccaatgggcatcggagcactttagatggctatttatattcctgtaaatactgcgatttcagatcccatgacatgacccaatttgtgggacatatgaactcagagcacacagactttaataaagacccaacctttgtatgcagtgggtgcagttttctggcaaaaacccctgaggggctttccttgcacaatgccacatgtcactccggggaagccagctttgtgtggaacgtggccaagccagacaatcatgtggttgtggagcagagcatccctgagagcaccagcactcctgacctagcgggtgagcccagtgctgaaggggctgatggacaggcagaaatcatcattaccaaaactccaatcatgaagataatgaaaggcaaagctgaagccaaaaaaattcatacactcaaggagaatgtccctagccagcctgtgggtgaggccttaccaaagctgtcgactggagaaatggaggtgagagagggggaccattccttcatcaatggggcagttccagtcagccaggcatctgccagctctgcaaaaaacccccatgccgccaacgggcccctgataggaacagtgccagttttgccagctggcatagcacagttcctctccctccagcagcagcccccagtgcatgcccaacaccatgtccaccagccactgcccacggccaaggcccttcccaaagtgatgatccccctgagcagcattccaacgtacagtgcagccatggactctaacagcttcctgaagaactccttccacaagttcccctaccccaccaaagccgagctctgctatttgactgtggtgaccaagtatccagaagaacagctcaagatctggttcacagcccaaaggctgaagcaggggatcagctggtcccctgaggagattgaggatgcccggaaaaagatgttcaatacagtcatccagtctgtgcctcagcccacaattacggttctaaataccccactcgtcgccagtgctggcaatgtccagcatctcatccaggccgctcttccaggtcacgttgtggggcagccagagggtacaggagggggacttctggtcactcagccattgatggccaatgggttgcaagcaacaagttcccctctccccctcacggtgacatccgtccccaagcagccaggtgtggcacccattaacactgtgtgttcaaatacaacgtcagctgtgaaggtggtcaatgcggcccagtcgctcctcacggcctgccccagcataacctcccaagccttccttgatgctagcatctacaaaaataagaaatctcatgaacagctgtcagctctgaaagggagcttctgtcggaaccagttcccagggcagagcgaagttgaacatctcacaaaagtgacgggcctcagtaccagagaggtgcggaaatggttcagtgatcgtagataccactgccggaacttgaagggctccagagcgatgatacctggagatcacagttccatcatcattgactctgtgccagaggtgtccttctccccatcgtccaaggtccctgaggtaacctgcattccgacaacagccacactagcaacccacccttctgccaaacgacaatcttggcaccagactcctgacttcacaccaaccaaatacaaggagagagcccctgagcagctcagagccctggagagcagttttgcacaaaaccctcttcctcttgatgaggaactggaccgcctgagaagtgaaaccaaaatgacccgacgagaaattgatagctggttttcagagagacggaaaaaagtgaatgctgaggagaccaagaaggctgaggagaatgcctctcaggaggaagaggaggctgctgaggatgagggtggagaagaggatttggccagtgagctaagggtctctggtgaaaatggctctctggaaatgcccagcagccatatcttggcagagcgcaaagtcagccccattaaaatcaacctgaagaacctgagggtcactgaagccaatggcaggaacgagattccagggctgggtgcctgtgaccctgaggatgatgagtcaaacaaactggcagagcagctcccaggcaaagtgagctgcaaaaagactgcccagcagcggcacttgctgcggcagctctttgtccagacacagtggccaagcaaccaggactatgactccatcatggcccagacgggtctgccacggccagaggtggtgcgctggtttggagatagcaggtacgcactgaagaacggccaactcaaatggtacgaagactataagcgaggcaacttcccaccagggctactggtcattgcccctggcaaccgggagctcctgcaggactattacatgacacacaagatgctgtatgaagaggacctgcagaacctctgtgacaagacccagatgagctcccagcaggtcaagcagtggtttgctgagaaaatgggggaggagaccagagccgtggcagacacaggcagtgaggaccagggccctggtactggtgagctcacagcagttcacaaagggatgggtgacacctattcagaggtgtctgagaacagtgagtcgtgggagccccgtgtccctgaggccagctcagagccctttgacacatcgagtccccaggctggacgtcagctcgaaacagactgaatttgatctgattaatgtgaaggactggccagtctgggaaaccgcctgccacgtggaagagccaaacccgactctctgctgccacatgccgttcccatgcccggctgctgggcacctgggagagcttccagaatcctcgcagacagcccagagcctgccgctaccctcggcctgcccaccaccaagcaagcagcaagcaagatggggttctcatcagttcttcctcccacaatgtaggacctttcctttaccttccaatggataaaatagttcagagttcatagtcatattcatagacacagaatcaagcttttaacatatacatccacctctatatgttaaataaaacatcagattatcaacactgtcattacgtagaaactttggttagccaagcagtgcattgtcagttacgtcatctctaaaaatgacctgtgtctgttctctggggattgctgggtcacaggtgcccctcaccttccacagtcaggcagggaagttataggcacaaagctacgtctggaacccctttgtgccccctttgtgttcctcaaggaagcagtacctttgaagagatctctgctgcattaagtgatgaccggctacgtttcatgtcaggcttgctttgccttgtgggctactcagtgcagaacctgctgtaaccctcagttcaaaaaatggactggcaatgtgattagcgttggatgctttaccattctctttagttgttaccgtaattctgctttttcatgggagtttgaatcatggaccataacttttcagttatcagatcaactaaagaaacatttgttgttaagcctaatgtgctgacctatgtgcctgcattttttttttaatctagacatgtttggagtgagagaaagatggaaaaaagacatggggtagggacgtaagtggaaatctatagccacagcctgaagctttgaccactgcggttttcagagccctttctccacactcatttcagagcctcctatggtttgggaaggaataacacactggcccattagtaagggtgaaggctggagggatttgttgacttcttggaattatcagaggtagggtggtctttagcacaaagacttgcatgcagagatccctggcagaacacccagagtgcccgtggctcccaccccagggtctggccggtgtgctggatgcatgcccaagggtgctgggcatcactggtccttgtgaggatgcttttaaagttttatatttatgtccccaaacttggaaacaagaactctactttagcctaaccctcatgtccttttttgaattgagaaaattacaggaaatggtgcctttgaaaattagaaaacttgcttacagagctgttctaaatggtaaatcctcaatttccccaagaccggttgctctgagagtagctggtaaagaggggcgaactaaagacctgtccacctgtagctccgctcatttcttagaaaccacctgcttcccagagtgccaagccacaagtaccaggcttcgtgggcacagacacctcctgggctgggcagagtgacagtgctagaagaccccagagagagggcaagggctttgggcaagaagcactggtggtgttttagggaccgtccttctcccctacccagggaactggacctggcagggcaccgtgctcatgtggctccaaggacaagcatggcggtggccccttctgccttccaggagaggtcttgcttttgaaaccaaaatcatgttcttctaaagtgtcatcttctgccctccctgtcccaatagggaccacatcttatttgtctcaaacagggacttgtgagtacttggcaagttttgcagcctatttttgtattcttaatttggggagtaaagatgtttggtctcaaaaacctttgaggaattgccaagaatggcgagtgattgctttccttcagagaacagacacttggaatttctccttttagtgtttatatacgtgcagattaatttatatatatatatatacacacacacatatacagtataaatactcatttgattctcgtaaaacgcgcatctggcgtgtgcagttgagaaacttggtggcacatgggtgttgggggagtagcctgtgttggagggacaccagtgcactaggcagctggggcggcccaggctgaagccatctccgggtgtctgagaaaccacccagtgcctcacctccagatcctgctggcatcacctccagagccctgcatgcactggctgaagagttggtctgtggagaggattttcttggttacttgtattcacggttaatttacaacccaaacagcaaaacacagttggtggacaagttcatgcaggacctacagtgacccagccatgggcactagctcatctttcaggtggaaaagtacagtgctgcctgccctggtatgtttttcttatagatgttagccctgcccaacagccagggctacactacaaaaggcaagaatgcccatgtaaggagcccagcagtctggacagatccttcttcctctgctgttggatgagagtgagtgagtatgntctggaccttatccttgaaagatgatcaaaagcgatgatgagggaggcagtcatcacgcaggtgcttaaagggacattgtaggaggtactcaagggtttgggggcaaaaccctgaatccagccagtcgtgcacagagacacacccacactagcccagtggcagtgggggatgtgggatggcagcagccaggtatgtagccctgtcacaggacagctcactgtggttttgcacactgcctaagggttaaattgtgttgttgccttcagtagaaggcatttgtgggctgcagagttgagagttgggtgaggttagtctctcctgaagaaaaagcctataaaaagtggctaatcttatcccttttctctgtatgcagttggactcgtcagagatagtaaaatcatcttttagtgtttttttgttgctgatgtcttgtacccatttgttttttacatggggttgtagatcgagttctcaaaggtgaaaccagatgatcattctgataaaggaaatttaaatttgatacatatgctttgtatattttgattacttgttttcgtttttgactataaaggagctcttttttcttgctcagagtttacctgggagatttcaccagtttgactcaccatttgcagatgtgcttttgtattaaatttaaattttcacatatcacatccattctcaaggtagttatatgctggagaagaaaaatcctctagacacatgaaggcccacatagtcaagtcttccagggcaaagccagcagcccacccaggtcaggtagccagcagggctcagttcccctcactccagacacggaccctcctcttcagggtctcttgacccagcttccttctctccttttacctgagagcacagacctctctcagccagcctgcccagaccacggggggctactcccatgtagtttggggagcacttgatctcagaaaagctccattgtctgagcaaatgggcagttgtggagctcaagcctttctcctgtgctcaagtcccttccccaagcaaggcttcaacctcatctacccaccatgtagttttctctggccatttaagtggggcggcagggacatggttgggccatgccacaccagggctggtgaggcaaccagttttgattttgacagagtggctggaggaaaagtggcaatcaaggtgctgcttggtttgctctgagtgcaaatggaaccaacaggtttctgctgcaatctgtgtgttcccagtgccaggtcacaccaggaggggtggggcagggctaaccaagtggtctctgaactcaccgagcgtctgcacttggttgtgaagttaatgggagtacagagagcgtctggccttggagaggggttgagagcctcctttttggttcttcattcctgagctcttgcctgcccacaaatctgacctctttgaatggggacgcagtccttcaacagagaagtttctatggcaaagaagtttctatttagctctagatccagcagagtcatccattctaactgccctgaagtctagagcaggggagggaacccagaggctggggatgagactaggcagaccctggttaccatatggacaaggacaggggaaagcacccccttcctcaatttctgaaagttctatctttgggttcgcaggactttgaggatgataaagaacatataggtactagcttgttgttgctggtccaaagcttccacagccctgagaatttggctttcgtggctgctctggcagctgagcgaagggaggaaggcagccgctctggtggggactctaggcaccttccctgctgtccacttggataggcggtgagccccagggtactgagaggagcctgagcatttacctgccattagtgcctcttccttcaggagactggcttgaaacgtgtgttcatgtgcgcgtgcacacacacacatgagcacctgtatgtgttaatgaatagtttttcttggttaatgctttttaacttctgttcctttccgtaagtggatgattcaaaattaacgtgacttggctgggcgcagtggctcacacctgtaatcccagcactttgggaggccaagggaggcggatcacctgaggtcaggagttcgagaccagcctgatcggcatggtgaaaccccgtttctactaaaaatacaaaaattagccgggcgtggtggtgcgcgcctgtaatcccagctactcaggaggctgaggaaggagaatcacttgaacccgggaggtggaggttgcagtgagctgagatcgtgccactgcactccagcctgggcgacagagcgaaactccgtctcaaaaaaaaaaaaaaaacttaatgtgactggagttaaaagtgaaatgtcaggttgtttagtcactgaatagagagctacaagtgcttggtctttcccaagaatcaaacctgagtagaaatacatttaaaagaaaaatctacatggtacctatgaatcctgtaatttgtttagggagatcttgtcactcatccctggttcctgcccatactgtttggtctcgttcttgcagtttgcttggaacagggccagagccccacatgagattgtcagcaggagtgaggagcgccagtccctactcctcagcagggacccagcacagcaatccggttgttctcggttagactgggtcggggccaggggagaagcagtcacccctgtgtagagggttcccgctgtgcttctgagcagttgctttgttcagaagtgttaggagggtcagattgtgccataattgttattaaagagaaaacacgcccaccttcctttctcccctgctggccattgttcattgagttttactgagggcagcctttgtggaagtcagggaggttgccaaaggcctgtagatgcctcctgacaaggtcttgattcctggttttctagcacccatttgcattttggtcttcagcacaaagccttgttccctgtggccggacttctgggcaataagactggggagtgactgttgagcagtctgctgtcaggagagatggctgaaaaggtgatcatcttggtgctaaacaagtaagaggcaactgccctgtttttgtttgttttgaggcacaatgaaactttagccaaactctgcaagagggtcccatctcctgccatggccaggtgtgagagaccaaaccgagaaaacagcatactctatcacttaagccttgggtagaatgggaattctttaccctgggtaaacgttttaacaaaaaaatggaacttaacttcggtttggactgtggtcgtgctgaggcaggagtggggttgccctcttggggctgaatctccaggcctcacgaggtcccctgtggggatgctgctatttctaagatgcaaattgcacatttcctagattttgtatctgtggatttggataagggaggggaacacggacaaattgcttgtacaatttgaaatgggcctcaatggtacttcaaaccttttgattattcctaaataaaaacataaatatat

SEQ ID NO: 372295 - DNA, 9489 bp, Homo sapiens
  misc_feature (5976)..(5976): n is a, c, g, or t
agcgggtgatagccgtcaaaggcagcaaatagactgaatgaaagatgagcttctgcctttatatccttctctcctgctacccaactcattgtggtgaaggaaaaagaaaacgcgggtggagactgcactatatgcttaggactgaaatgcaactgcagaagcaacatgtgaccttttagagatgcttgtgggactgcataaagtgaagagggaaactggaaaaaaacaatgaagctaatcccgaactcctggcctcaaatgatcttcctaccttggcttcccaaagtgctgggattacagacgtgagctgctgtgcctggccaagacttaattttgaatgacattgggactattgccaaaaatcaaatccatcttcatgttgtccacttctcagccttaattgaatagggaaaacctgctttctgcaaacaactgaaaaagctgcatttagaaactgtttctttggccctcatcgagaagctggaacttgtattgttaggccccttatgggacaagctctcaactgctgatcacccagtgattgtcaccatggccagcaagaggaaatccaccacaccatgcatgatcccagtgaagactgtggtgttgcaagatgccagcatggaggcccagcccgctgagaccttgcctgaaggaccccagcaggatctgcccccagaagcatctgctgccagcagtgaggcagcacagaaccccagcagtactgatggctctacactggccaatgggcatcggagcactttagatggctatttatattcctgtaaatactgcgatttcagatcccatgacatgacccaatttgtgggacatatgaactcagagcacacagactttaataaagacccaacctttgtatgcagtgggtgcagttttctggcaaaaacccctgaggggctttccttgcacaatgccacatgtcactccggggaagccagctttgtgtggaacgtggccaagccagacaatcatgtggttgtggagcagagcatccctgagagcaccagcactcctgacctagcgggtgagcccagtgctgaaggggctgatggacaggcagaaatcatcattaccaaaactccaatcatgaagataatgaaaggcaaagctgaagccaaaaaaattcatacactcaaggagaatgtccctagccagcctgtgggtgaggccttaccaaagctgtcgactggagaaatggaggtgagagagggggaccattccttcatcaatggggcagttccagtcagccaggcatctgccagctctgcaaaaaacccccatgccgccaacgggcccctgataggaacagtgccagttttgccagctggcatagcacagttcctctccctccagcagcagcccccagtgcatgcccaacaccatgtccaccagccactgcccacggccaaggcccttcccaaagtgatgatccccctgagcagcattccaacgtacagtgcagccatggactctaacagcttcctgaagaactccttccacaagttcccctaccccaccaaagccgagctctgctatttgactgtggtgaccaagtatccagaagaacagctcaagatctggttcacagcccaaaggctgaagcaggggatcagctggtcccctgaggagattgaggatgcccggaaaaagatgttcaatacagtcatccagtctgtgcctcagcccacaattacggttctaaataccccactcgtcgccagtgctggcaatgtccagcatctcatccaggccgctcttccaggtcacgttgtggggcagccagagggtacaggagggggacttctggtcactcagccattgatggccaatgggttgcaagcaacaagttcccctctccccctcacggtgacatccgtccccaagcagccaggtgtggcacccattaacactgtgtgttcaaatacaacgtcagctgtgaaggtggtcaatgcggcccagtcgctcctcacggcctgccccagcataacctcccaagccttccttgatgctagcatctacaaaaataagaaatctcatgaacagctgtcagctctgaaagggagcttctgtcggaaccagttcccagggcagagcgaagttgaacatctcacaaaagtgacgggcctcagtaccagagaggtgcggaaatggttcagtgatcgtagataccactgccggaacttgaagggctccagagcgatgatacctggagatcacagttccatcatcattgactctgtgccagaggtgtccttctccccatcgtccaaggtccctgaggtaacctgcattccgacaacagccacactagcaacccacccttctgccaaacgacaatcttggcaccagactcctgacttcacaccaaccaaatacaaggagagagcccctgagcagctcagagccctggagagcagttttgcacaaaaccctcttcctcttgatgaggaactggaccgcctgagaagtgaaaccaaaatgacccgacgagaaattgatagctggttttcagagagacggaaaaaagtgaatgctgaggagaccaagaaggctgaggagaatgcctctcaggaggaagaggaggctgctgaggatgagggtggagaagaggatttggccagtgagctaagggtctctggtgaaaatggctctctggaaatgcccagcagccatatcttggcagagcgcaaagtcagccccattaaaatcaacctgaagaacctgagggtcactgaagccaatggcaggaacgagattccagggctgggtgcctgtgaccctgaggatgatgagtcaaacaaactggcagagcagctcccaggcaaagtgagctgcaaaaagactgcccagcagcggcacttgctgcggcagctctttgtccagacacagtggccaagcaaccaggactatgactccatcatggcccagacgggtctgccacggccagaggtggtgcgctggtttggagatagcaggtacgcactgaagaacggccaactcaaatggtacgaagactataagcgaggcaacttcccaccagggctactggtcattgcccctggcaaccgggagctcctgcaggactattacatgacacacaagatgctgtatgaagaggacctgcagaacctctgtgacaagacccagatgagctcccagcaggtcaagcagtggtttgctgagaaaatgggggaggagaccagagccgtggcagacacaggcagtgaggaccagggccctggtactggtgagctcacagcagttcacaaagggatgggtgacacctattcagaggtgtctgagaacagtgagtcgtgggagccccgtgtccctgaggccagctcagagccctttgacacatcgagtccccaggctggacgtcagctcgaaacagactgaatttgatctgattaatgtgaaggactggccagtctgggaaaccgcctgccacgtggaagagccaaacccgactctctgctgccacatgccgttcccatgcccggctgctgggcacctgggagagcttccagaatcctcgcagacagcccagagcctgccgctaccctcggcctgcccaccaccaagcaagcagcaagcaagatggggttctcatcagttcttcctcccacaatgtaggacctttcctttaccttccaatggataaaatagttcagagttcatagtcatattcatagacacagaatcaagcttttaacatatacatccacctctatatgttaaataaaacatcagattatcaacactgtcattacgtagaaactttggttagccaagcagtgcattgtcagttacgtcatctctaaaaatgacctgtgtctgttctctggggattgctgggtcacaggtgcccctcaccttccacagtcaggcagggaagttataggcacaaagctacgtctggaacccctttgtgccccctttgtgttcctcaaggaagcagtacctttgaagagatctctgctgcattaagtgatgaccggctacgtttcatgtcaggcttgctttgccttgtgggctactcagtgcagaacctgctgtaaccctcagttcaaaaaatggactggcaatgtgattagcgttggatgctttaccattctctttagttgttaccgtaattctgctttttcatgggagtttgaatcatggaccataacttttcagttatcagatcaactaaagaaacatttgttgttaagcctaatgtgctgacctatgtgcctgcattttttttttaatctagacatgtttggagtgagagaaagatggaaaaaagacatggggtagggacgtaagtggaaatctatagccacagcctgaagctttgaccactgcggttttcagagccctttctccacactcatttcagagcctcctatggtttgggaaggaataacacactggcccattagtaagggtgaaggctggagggatttgttgacttcttggaattatcagaggtagggtggtctttagcacaaagacttgcatgcagagatccctggcagaacacccagagtgcccgtggctcccaccccagggtctggccggtgtgctggatgcatgcccaagggtgctgggcatcactggtccttgtgaggatgcttttaaagttttatatttatgtccccaaacttggaaacaagaactctactttagcctaaccctcatgtccttttttgaattgagaaaattacaggaaatggtgcctttgaaaattagaaaacttgcttacagagctgttctaaatggtaaatcctcaatttccccaagaccggttgctctgagagtagctggtaaagaggggcgaactaaagacctgtccacctgtagctccgctcatttcttagaaaccacctgcttcccagagtgccaagccacaagtaccaggcttcgtgggcacagacacctcctgggctgggcagagtgacagtgctagaagaccccagagagagggcaagggctttgggcaagaagcactggtggtgttttagggaccgtccttctcccctacccagggaactggacctggcagggcaccgtgctcatgtggctccaaggacaagcatggcggtggccccttctgccttccaggagaggtcttgcttttgaaaccaaaatcatgttcttctaaagtgtcatcttctgccctccctgtcccaatagggaccacatcttatttgtctcaaacagggacttgtgagtacttggcaagttttgcagcctatttttgtattcttaatttggggagtaaagatgtttggtctcaaaaacctttgaggaattgccaagaatggcgagtgattgctttccttcagagaacagacacttggaatttctccttttagtgtttatatacgtgcagattaatttatatatatatatatacacacacacatatacagtataaatactcatttgattctcgtaaaacgcgcatctggcgtgtgcagttgagaaacttggtggcacatgggtgttgggggagtagcctgtgttggagggacaccagtgcactaggcagctggggcggcccaggctgaagccatctccgggtgtctgagaaaccacccagtgcctcacctccagatcctgctggcatcacctccagagccctgcatgcactggctgaagagttggtctgtggagaggattttcttggttacttgtattcacggttaatttacaacccaaacagcaaaacacagttggtggacaagttcatgcaggacctacagtgacccagccatgggcactagctcatctttcaggtggaaaagtacagtgctgcctgccctggtatgtttttcttatagatgttagccctgcccaacagccagggctacactacaaaaggcaagaatgcccatgtaaggagcccagcagtctggacagatccttcttcctctgctgttggatgagagtgagtgagtatgntctggaccttatccttgaaagatgatcaaaagcgatgatgagggaggcagtcatcacgcaggtgcttaaagggacattgtaggaggtactcaagggtttgggggcaaaaccctgaatccagccagtcgtgcacagagacacacccacactagcccagtggcagtgggggatgtgggatggcagcagccaggtatgtagccctgtcacaggacagctcactgtggttttgcacactgcctaagggttaaattgtgttgttgccttcagtagaaggcatttgtgggctgcagagttgagagttgggtgaggttagtctctcctgaagaaaaagcctataaaaagtggctaatcttatcccttttctctgtatgcagttggactcgtcagagatagtaaaatcatcttttagtgtttttttgttgctgatgtcttgtacccatttgttttttacatggggttgtagatcgagttctcaaaggtgaaaccagatgatcattctgataaaggaaatttaaatttgatacatatgctttgtatattttgattacttgttttcgtttttgactataaaggagctcttttttcttgctcagagtttacctgggagatttcaccagtttgactcaccatttgcagatgtgcttttgtattaaatttaaattttcacatatcacatccattctcaaggtagttatatgctggagaagaaaaatcctctagacacatgaaggcccacatagtcaagtcttccagggcaaagccagcagcccacccaggtcaggtagccagcagggctcagttcccctcactccagacacggaccctcctcttcagggtctcttgacccagcttccttctctccttttacctgagagcacagacctctctcagccagcctgcccagaccacggggggctactcccatgtagtttggggagcacttgatctcagaaaagctccattgtctgagcaaatgggcagttgtggagctcaagcctttctcctgtgctcaagtcccttccccaagcaaggcttcaacctcatctacccaccatgtagttttctctggccatttaagtggggcggcagggacatggttgggccatgccacaccagggctggtgaggcaaccagttttgattttgacagagtggctggaggaaaagtggcaatcaaggtgctgcttggtttgctctgagtgcaaatggaaccaacaggtttctgctgcaatctgtgtgttcccagtgccaggtcacaccaggaggggtggggcagggctaaccaagtggtctctgaactcaccgagcgtctgcacttggttgtgaagttaatgggagtacagagagcgtctggccttggagaggggttgagagcctcctttttggttcttcattcctgagctcttgcctgcccacaaatctgacctctttgaatggggacgcagtccttcaacagagaagtttctatggcaaagaagtttctatttagctctagatccagcagagtcatccattctaactgccctgaagtctagagcaggggagggaacccagaggctggggatgagactaggcagaccctggttaccatatggacaaggacaggggaaagcacccccttcctcaatttctgaaagttctatctttgggttcgcaggactttgaggatgataaagaacatataggtactagcttgttgttgctggtccaaagcttccacagccctgagaatttggctttcgtggctgctctggcagctgagcgaagggaggaaggcagccgctctggtggggactctaggcaccttccctgctgtccacttggataggcggtgagccccagggtactgagaggagcctgagcatttacctgccattagtgcctcttccttcaggagactggcttgaaacgtgtgttcatgtgcgcgtgcacacacacacatgagcacctgtatgtgttaatgaatagtttttcttggttaatgctttttaacttctgttcctttccgtaagtggatgattcaaaattaacgtgacttggctgggcgcagtggctcacacctgtaatcccagcactttgggaggccaagggaggcggatcacctgaggtcaggagttcgagaccagcctgatcggcatggtgaaaccccgtttctactaaaaatacaaaaattagccgggcgtggtggtgcgcgcctgtaatcccagctactcaggaggctgaggaaggagaatcacttgaacccgggaggtggaggttgcagtgagctgagatcgtgccactgcactccagcctgggcgacagagcgaaactccgtctcaaaaaaaaaaaaaaaacttaatgtgactggagttaaaagtgaaatgtcaggttgtttagtcactgaatagagagctacaagtgcttggtctttcccaagaatcaaacctgagtagaaatacatttaaaagaaaaatctacatggtacctatgaatcctgtaatttgtttagggagatcttgtcactcatccctggttcctgcccatactgtttggtctcgttcttgcagtttgcttggaacagggccagagccccacatgagattgtcagcaggagtgaggagcgccagtccctactcctcagcagggacccagcacagcaatccggttgttctcggttagactgggtcggggccaggggagaagcagtcacccctgtgtagagggttcccgctgtgcttctgagcagttgctttgttcagaagtgttaggagggtcagattgtgccataattgttattaaagagaaaacacgcccaccttcctttctcccctgctggccattgttcattgagttttactgagggcagcctttgtggaagtcagggaggttgccaaaggcctgtagatgcctcctgacaaggtcttgattcctggttttctagcacccatttgcattttggtcttcagcacaaagccttgttccctgtggccggacttctgggcaataagactggggagtgactgttgagcagtctgctgtcaggagagatggctgaaaaggtgatcatcttggtgctaaacaagtaagaggcaactgccctgtttttgtttgttttgaggcacaatgaaactttagccaaactctgcaagagggtcccatctcctgccatggccaggtgtgagagaccaaaccgagaaaacagcatactctatcacttaagccttgggtagaatgggaattctttaccctgggtaaacgttttaacaaaaaaatggaacttaacttcggtttggactgtggtcgtgctgaggcaggagtggggttgccctcttggggctgaatctccaggcctcacgaggtcccctgtggggatgctgctatttctaagatgcaaattgcacatttcctagattttgtatctgtggatttggataagggaggggaacacggacaaattgcttgtacaatttgaaatgggcctcaatggtacttcaaaccttttgattattcctaaataaaaacataaatatat

SEQ ID NO: 372296 - DNA, 9539 bp, Homo sapiens
  misc_feature (6026)..(6026): n is a, c, g, or t
agcgggtgatagccgtcaaaggcagcaaatagactgaatgaaagatgagcttctgcctttatatccttctctcctgctacccaactcattgtggtgaaggaaaaagaaaacgcgggtggagactgcactatatgcttaggactgaaatgcaactgcagaagcaacatgtgaccttttagagatgcttgtgggactgcataaagtgaagagggaaactggaaaaaaacaatgaatcccttccataggaaacagggaatgtttgtttctgtcttctggtaggagaaggattggtcccacccccagctccagggatggatcttgattgtttaagcccagtcagtgattctaacccatggaccaagaccctgccttggagattggggaacaggtgttggaagggctctattttggcaaagaatggattatttatgtgagcatatttccgcaaaattgaatagggaaaacctgctttctgcaaacaactgaaaaagctgcatttagaaactgtttctttggccctcatcgagaagctggaacttgtattgttaggccccttatgggacaagctctcaactgctgatcacccagtgattgtcaccatggccagcaagaggaaatccaccacaccatgcatgatcccagtgaagactgtggtgttgcaagatgccagcatggaggcccagcccgctgagaccttgcctgaaggaccccagcaggatctgcccccagaagcatctgctgccagcagtgaggcagcacagaaccccagcagtactgatggctctacactggccaatgggcatcggagcactttagatggctatttatattcctgtaaatactgcgatttcagatcccatgacatgacccaatttgtgggacatatgaactcagagcacacagactttaataaagacccaacctttgtatgcagtgggtgcagttttctggcaaaaacccctgaggggctttccttgcacaatgccacatgtcactccggggaagccagctttgtgtggaacgtggccaagccagacaatcatgtggttgtggagcagagcatccctgagagcaccagcactcctgacctagcgggtgagcccagtgctgaaggggctgatggacaggcagaaatcatcattaccaaaactccaatcatgaagataatgaaaggcaaagctgaagccaaaaaaattcatacactcaaggagaatgtccctagccagcctgtgggtgaggccttaccaaagctgtcgactggagaaatggaggtgagagagggggaccattccttcatcaatggggcagttccagtcagccaggcatctgccagctctgcaaaaaacccccatgccgccaacgggcccctgataggaacagtgccagttttgccagctggcatagcacagttcctctccctccagcagcagcccccagtgcatgcccaacaccatgtccaccagccactgcccacggccaaggcccttcccaaagtgatgatccccctgagcagcattccaacgtacagtgcagccatggactctaacagcttcctgaagaactccttccacaagttcccctaccccaccaaagccgagctctgctatttgactgtggtgaccaagtatccagaagaacagctcaagatctggttcacagcccaaaggctgaagcaggggatcagctggtcccctgaggagattgaggatgcccggaaaaagatgttcaatacagtcatccagtctgtgcctcagcccacaattacggttctaaataccccactcgtcgccagtgctggcaatgtccagcatctcatccaggccgctcttccaggtcacgttgtggggcagccagagggtacaggagggggacttctggtcactcagccattgatggccaatgggttgcaagcaacaagttcccctctccccctcacggtgacatccgtccccaagcagccaggtgtggcacccattaacactgtgtgttcaaatacaacgtcagctgtgaaggtggtcaatgcggcccagtcgctcctcacggcctgccccagcataacctcccaagccttccttgatgctagcatctacaaaaataagaaatctcatgaacagctgtcagctctgaaagggagcttctgtcggaaccagttcccagggcagagcgaagttgaacatctcacaaaagtgacgggcctcagtaccagagaggtgcggaaatggttcagtgatcgtagataccactgccggaacttgaagggctccagagcgatgatacctggagatcacagttccatcatcattgactctgtgccagaggtgtccttctccccatcgtccaaggtccctgaggtaacctgcattccgacaacagccacactagcaacccacccttctgccaaacgacaatcttggcaccagactcctgacttcacaccaaccaaatacaaggagagagcccctgagcagctcagagccctggagagcagttttgcacaaaaccctcttcctcttgatgaggaactggaccgcctgagaagtgaaaccaaaatgacccgacgagaaattgatagctggttttcagagagacggaaaaaagtgaatgctgaggagaccaagaaggctgaggagaatgcctctcaggaggaagaggaggctgctgaggatgagggtggagaagaggatttggccagtgagctaagggtctctggtgaaaatggctctctggaaatgcccagcagccatatcttggcagagcgcaaagtcagccccattaaaatcaacctgaagaacctgagggtcactgaagccaatggcaggaacgagattccagggctgggtgcctgtgaccctgaggatgatgagtcaaacaaactggcagagcagctcccaggcaaagtgagctgcaaaaagactgcccagcagcggcacttgctgcggcagctctttgtccagacacagtggccaagcaaccaggactatgactccatcatggcccagacgggtctgccacggccagaggtggtgcgctggtttggagatagcaggtacgcactgaagaacggccaactcaaatggtacgaagactataagcgaggcaacttcccaccagggctactggtcattgcccctggcaaccgggagctcctgcaggactattacatgacacacaagatgctgtatgaagaggacctgcagaacctctgtgacaagacccagatgagctcccagcaggtcaagcagtggtttgctgagaaaatgggggaggagaccagagccgtggcagacacaggcagtgaggaccagggccctggtactggtgagctcacagcagttcacaaagggatgggtgacacctattcagaggtgtctgagaacagtgagtcgtgggagccccgtgtccctgaggccagctcagagccctttgacacatcgagtccccaggctggacgtcagctcgaaacagactgaatttgatctgattaatgtgaaggactggccagtctgggaaaccgcctgccacgtggaagagccaaacccgactctctgctgccacatgccgttcccatgcccggctgctgggcacctgggagagcttccagaatcctcgcagacagcccagagcctgccgctaccctcggcctgcccaccaccaagcaagcagcaagcaagatggggttctcatcagttcttcctcccacaatgtaggacctttcctttaccttccaatggataaaatagttcagagttcatagtcatattcatagacacagaatcaagcttttaacatatacatccacctctatatgttaaataaaacatcagattatcaacactgtcattacgtagaaactttggttagccaagcagtgcattgtcagttacgtcatctctaaaaatgacctgtgtctgttctctggggattgctgggtcacaggtgcccctcaccttccacagtcaggcagggaagttataggcacaaagctacgtctggaacccctttgtgccccctttgtgttcctcaaggaagcagtacctttgaagagatctctgctgcattaagtgatgaccggctacgtttcatgtcaggcttgctttgccttgtgggctactcagtgcagaacctgctgtaaccctcagttcaaaaaatggactggcaatgtgattagcgttggatgctttaccattctctttagttgttaccgtaattctgctttttcatgggagtttgaatcatggaccataacttttcagttatcagatcaactaaagaaacatttgttgttaagcctaatgtgctgacctatgtgcctgcattttttttttaatctagacatgtttggagtgagagaaagatggaaaaaagacatggggtagggacgtaagtggaaatctatagccacagcctgaagctttgaccactgcggttttcagagccctttctccacactcatttcagagcctcctatggtttgggaaggaataacacactggcccattagtaagggtgaaggctggagggatttgttgacttcttggaattatcagaggtagggtggtctttagcacaaagacttgcatgcagagatccctggcagaacacccagagtgcccgtggctcccaccccagggtctggccggtgtgctggatgcatgcccaagggtgctgggcatcactggtccttgtgaggatgcttttaaagttttatatttatgtccccaaacttggaaacaagaactctactttagcctaaccctcatgtccttttttgaattgagaaaattacaggaaatggtgcctttgaaaattagaaaacttgcttacagagctgttctaaatggtaaatcctcaatttccccaagaccggttgctctgagagtagctggtaaagaggggcgaactaaagacctgtccacctgtagctccgctcatttcttagaaaccacctgcttcccagagtgccaagccacaagtaccaggcttcgtgggcacagacacctcctgggctgggcagagtgacagtgctagaagaccccagagagagggcaagggctttgggcaagaagcactggtggtgttttagggaccgtccttctcccctacccagggaactggacctggcagggcaccgtgctcatgtggctccaaggacaagcatggcggtggccccttctgccttccaggagaggtcttgcttttgaaaccaaaatcatgttcttctaaagtgtcatcttctgccctccctgtcccaatagggaccacatcttatttgtctcaaacagggacttgtgagtacttggcaagttttgcagcctatttttgtattcttaatttggggagtaaagatgtttggtctcaaaaacctttgaggaattgccaagaatggcgagtgattgctttccttcagagaacagacacttggaatttctccttttagtgtttatatacgtgcagattaatttatatatatatatatacacacacacatatacagtataaatactcatttgattctcgtaaaacgcgcatctggcgtgtgcagttgagaaacttggtggcacatgggtgttgggggagtagcctgtgttggagggacaccagtgcactaggcagctggggcggcccaggctgaagccatctccgggtgtctgagaaaccacccagtgcctcacctccagatcctgctggcatcacctccagagccctgcatgcactggctgaagagttggtctgtggagaggattttcttggttacttgtattcacggttaatttacaacccaaacagcaaaacacagttggtggacaagttcatgcaggacctacagtgacccagccatgggcactagctcatctttcaggtggaaaagtacagtgctgcctgccctggtatgtttttcttatagatgttagccctgcccaacagccagggctacactacaaaaggcaagaatgcccatgtaaggagcccagcagtctggacagatccttcttcctctgctgttggatgagagtgagtgagtatgntctggaccttatccttgaaagatgatcaaaagcgatgatgagggaggcagtcatcacgcaggtgcttaaagggacattgtaggaggtactcaagggtttgggggcaaaaccctgaatccagccagtcgtgcacagagacacacccacactagcccagtggcagtgggggatgtgggatggcagcagccaggtatgtagccctgtcacaggacagctcactgtggttttgcacactgcctaagggttaaattgtgttgttgccttcagtagaaggcatttgtgggctgcagagttgagagttgggtgaggttagtctctcctgaagaaaaagcctataaaaagtggctaatcttatcccttttctctgtatgcagttggactcgtcagagatagtaaaatcatcttttagtgtttttttgttgctgatgtcttgtacccatttgttttttacatggggttgtagatcgagttctcaaaggtgaaaccagatgatcattctgataaaggaaatttaaatttgatacatatgctttgtatattttgattacttgttttcgtttttgactataaaggagctcttttttcttgctcagagtttacctgggagatttcaccagtttgactcaccatttgcagatgtgcttttgtattaaatttaaattttcacatatcacatccattctcaaggtagttatatgctggagaagaaaaatcctctagacacatgaaggcccacatagtcaagtcttccagggcaaagccagcagcccacccaggtcaggtagccagcagggctcagttcccctcactccagacacggaccctcctcttcagggtctcttgacccagcttccttctctccttttacctgagagcacagacctctctcagccagcctgcccagaccacggggggctactcccatgtagtttggggagcacttgatctcagaaaagctccattgtctgagcaaatgggcagttgtggagctcaagcctttctcctgtgctcaagtcccttccccaagcaaggcttcaacctcatctacccaccatgtagttttctctggccatttaagtggggcggcagggacatggttgggccatgccacaccagggctggtgaggcaaccagttttgattttgacagagtggctggaggaaaagtggcaatcaaggtgctgcttggtttgctctgagtgcaaatggaaccaacaggtttctgctgcaatctgtgtgttcccagtgccaggtcacaccaggaggggtggggcagggctaaccaagtggtctctgaactcaccgagcgtctgcacttggttgtgaagttaatgggagtacagagagcgtctggccttggagaggggttgagagcctcctttttggttcttcattcctgagctcttgcctgcccacaaatctgacctctttgaatggggacgcagtccttcaacagagaagtttctatggcaaagaagtttctatttagctctagatccagcagagtcatccattctaactgccctgaagtctagagcaggggagggaacccagaggctggggatgagactaggcagaccctggttaccatatggacaaggacaggggaaagcacccccttcctcaatttctgaaagttctatctttgggttcgcaggactttgaggatgataaagaacatataggtactagcttgttgttgctggtccaaagcttccacagccctgagaatttggctttcgtggctgctctggcagctgagcgaagggaggaaggcagccgctctggtggggactctaggcaccttccctgctgtccacttggataggcggtgagccccagggtactgagaggagcctgagcatttacctgccattagtgcctcttccttcaggagactggcttgaaacgtgtgttcatgtgcgcgtgcacacacacacatgagcacctgtatgtgttaatgaatagtttttcttggttaatgctttttaacttctgttcctttccgtaagtggatgattcaaaattaacgtgacttggctgggcgcagtggctcacacctgtaatcccagcactttgggaggccaagggaggcggatcacctgaggtcaggagttcgagaccagcctgatcggcatggtgaaaccccgtttctactaaaaatacaaaaattagccgggcgtggtggtgcgcgcctgtaatcccagctactcaggaggctgaggaaggagaatcacttgaacccgggaggtggaggttgcagtgagctgagatcgtgccactgcactccagcctgggcgacagagcgaaactccgtctcaaaaaaaaaaaaaaaacttaatgtgactggagttaaaagtgaaatgtcaggttgtttagtcactgaatagagagctacaagtgcttggtctttcccaagaatcaaacctgagtagaaatacatttaaaagaaaaatctacatggtacctatgaatcctgtaatttgtttagggagatcttgtcactcatccctggttcctgcccatactgtttggtctcgttcttgcagtttgcttggaacagggccagagccccacatgagattgtcagcaggagtgaggagcgccagtccctactcctcagcagggacccagcacagcaatccggttgttctcggttagactgggtcggggccaggggagaagcagtcacccctgtgtagagggttcccgctgtgcttctgagcagttgctttgttcagaagtgttaggagggtcagattgtgccataattgttattaaagagaaaacacgcccaccttcctttctcccctgctggccattgttcattgagttttactgagggcagcctttgtggaagtcagggaggttgccaaaggcctgtagatgcctcctgacaaggtcttgattcctggttttctagcacccatttgcattttggtcttcagcacaaagccttgttccctgtggccggacttctgggcaataagactggggagtgactgttgagcagtctgctgtcaggagagatggctgaaaaggtgatcatcttggtgctaaacaagtaagaggcaactgccctgtttttgtttgttttgaggcacaatgaaactttagccaaactctgcaagagggtcccatctcctgccatggccaggtgtgagagaccaaaccgagaaaacagcatactctatcacttaagccttgggtagaatgggaattctttaccctgggtaaacgttttaacaaaaaaatggaacttaacttcggtttggactgtggtcgtgctgaggcaggagtggggttgccctcttggggctgaatctccaggcctcacgaggtcccctgtggggatgctgctatttctaagatgcaaattgcacatttcctagattttgtatctgtggatttggataagggaggggaacacggacaaattgcttgtacaatttgaaatgggcctcaatggtacttcaaaccttttgattattcctaaataaaaacataaatatat

SEQ ID NO: 372297 - DNA, 9267 bp, Homo sapiens
  misc_feature (5754)..(5754): n is a, c, g, or t
cgaatcgtaaccgttcgtacgagaatcgctgtcctctccttgctcgagatccattgtgctctaaagtgtgaaaagacctagatggtagaaggcaagcagtggaatgtgtctgggtatccgagaaatatacagaaagcacttaagagaacttaatcatttttttctccctttccttagattgaatagggaaaacctgctttctgcaaacaactgaaaaagctgcatttagaaactgtttctttggccctcatcgagaagctggaacttgtattgttaggccccttatgggacaagctctcaactgctgatcacccagtgattgtcaccatggccagcaagaggaaatccaccacaccatgcatgatcccagtgaagactgtggtgttgcaagatgccagcatggaggcccagcccgctgagaccttgcctgaaggaccccagcaggatctgcccccagaagcatctgctgccagcagtgaggcagcacagaaccccagcagtactgatggctctacactggccaatgggcatcggagcactttagatggctatttatattcctgtaaatactgcgatttcagatcccatgacatgacccaatttgtgggacatatgaactcagagcacacagactttaataaagacccaacctttgtatgcagtgggtgcagttttctggcaaaaacccctgaggggctttccttgcacaatgccacatgtcactccggggaagccagctttgtgtggaacgtggccaagccagacaatcatgtggttgtggagcagagcatccctgagagcaccagcactcctgacctagcgggtgagcccagtgctgaaggggctgatggacaggcagaaatcatcattaccaaaactccaatcatgaagataatgaaaggcaaagctgaagccaaaaaaattcatacactcaaggagaatgtccctagccagcctgtgggtgaggccttaccaaagctgtcgactggagaaatggaggtgagagagggggaccattccttcatcaatggggcagttccagtcagccaggcatctgccagctctgcaaaaaacccccatgccgccaacgggcccctgataggaacagtgccagttttgccagctggcatagcacagttcctctccctccagcagcagcccccagtgcatgcccaacaccatgtccaccagccactgcccacggccaaggcccttcccaaagtgatgatccccctgagcagcattccaacgtacagtgcagccatggactctaacagcttcctgaagaactccttccacaagttcccctaccccaccaaagccgagctctgctatttgactgtggtgaccaagtatccagaagaacagctcaagatctggttcacagcccaaaggctgaagcaggggatcagctggtcccctgaggagattgaggatgcccggaaaaagatgttcaatacagtcatccagtctgtgcctcagcccacaattacggttctaaataccccactcgtcgccagtgctggcaatgtccagcatctcatccaggccgctcttccaggtcacgttgtggggcagccagagggtacaggagggggacttctggtcactcagccattgatggccaatgggttgcaagcaacaagttcccctctccccctcacggtgacatccgtccccaagcagccaggtgtggcacccattaacactgtgtgttcaaatacaacgtcagctgtgaaggtggtcaatgcggcccagtcgctcctcacggcctgccccagcataacctcccaagccttccttgatgctagcatctacaaaaataagaaatctcatgaacagctgtcagctctgaaagggagcttctgtcggaaccagttcccagggcagagcgaagttgaacatctcacaaaagtgacgggcctcagtaccagagaggtgcggaaatggttcagtgatcgtagataccactgccggaacttgaagggctccagagcgatgatacctggagatcacagttccatcatcattgactctgtgccagaggtgtccttctccccatcgtccaaggtccctgaggtaacctgcattccgacaacagccacactagcaacccacccttctgccaaacgacaatcttggcaccagactcctgacttcacaccaaccaaatacaaggagagagcccctgagcagctcagagccctggagagcagttttgcacaaaaccctcttcctcttgatgaggaactggaccgcctgagaagtgaaaccaaaatgacccgacgagaaattgatagctggttttcagagagacggaaaaaagtgaatgctgaggagaccaagaaggctgaggagaatgcctctcaggaggaagaggaggctgctgaggatgagggtggagaagaggatttggccagtgagctaagggtctctggtgaaaatggctctctggaaatgcccagcagccatatcttggcagagcgcaaagtcagccccattaaaatcaacctgaagaacctgagggtcactgaagccaatggcaggaacgagattccagggctgggtgcctgtgaccctgaggatgatgagtcaaacaaactggcagagcagctcccaggcaaagtgagctgcaaaaagactgcccagcagcggcacttgctgcggcagctctttgtccagacacagtggccaagcaaccaggactatgactccatcatggcccagacgggtctgccacggccagaggtggtgcgctggtttggagatagcaggtacgcactgaagaacggccaactcaaatggtacgaagactataagcgaggcaacttcccaccagggctactggtcattgcccctggcaaccgggagctcctgcaggactattacatgacacacaagatgctgtatgaagaggacctgcagaacctctgtgacaagacccagatgagctcccagcaggtcaagcagtggtttgctgagaaaatgggggaggagaccagagccgtggcagacacaggcagtgaggaccagggccctggtactggtgagctcacagcagttcacaaagggatgggtgacacctattcagaggtgtctgagaacagtgagtcgtgggagccccgtgtccctgaggccagctcagagccctttgacacatcgagtccccaggctggacgtcagctcgaaacagactgaatttgatctgattaatgtgaaggactggccagtctgggaaaccgcctgccacgtggaagagccaaacccgactctctgctgccacatgccgttcccatgcccggctgctgggcacctgggagagcttccagaatcctcgcagacagcccagagcctgccgctaccctcggcctgcccaccaccaagcaagcagcaagcaagatggggttctcatcagttcttcctcccacaatgtaggacctttcctttaccttccaatggataaaatagttcagagttcatagtcatattcatagacacagaatcaagcttttaacatatacatccacctctatatgttaaataaaacatcagattatcaacactgtcattacgtagaaactttggttagccaagcagtgcattgtcagttacgtcatctctaaaaatgacctgtgtctgttctctggggattgctgggtcacaggtgcccctcaccttccacagtcaggcagggaagttataggcacaaagctacgtctggaacccctttgtgccccctttgtgttcctcaaggaagcagtacctttgaagagatctctgctgcattaagtgatgaccggctacgtttcatgtcaggcttgctttgccttgtgggctactcagtgcagaacctgctgtaaccctcagttcaaaaaatggactggcaatgtgattagcgttggatgctttaccattctctttagttgttaccgtaattctgctttttcatgggagtttgaatcatggaccataacttttcagttatcagatcaactaaagaaacatttgttgttaagcctaatgtgctgacctatgtgcctgcattttttttttaatctagacatgtttggagtgagagaaagatggaaaaaagacatggggtagggacgtaagtggaaatctatagccacagcctgaagctttgaccactgcggttttcagagccctttctccacactcatttcagagcctcctatggtttgggaaggaataacacactggcccattagtaagggtgaaggctggagggatttgttgacttcttggaattatcagaggtagggtggtctttagcacaaagacttgcatgcagagatccctggcagaacacccagagtgcccgtggctcccaccccagggtctggccggtgtgctggatgcatgcccaagggtgctgggcatcactggtccttgtgaggatgcttttaaagttttatatttatgtccccaaacttggaaacaagaactctactttagcctaaccctcatgtccttttttgaattgagaaaattacaggaaatggtgcctttgaaaattagaaaacttgcttacagagctgttctaaatggtaaatcctcaatttccccaagaccggttgctctgagagtagctggtaaagaggggcgaactaaagacctgtccacctgtagctccgctcatttcttagaaaccacctgcttcccagagtgccaagccacaagtaccaggcttcgtgggcacagacacctcctgggctgggcagagtgacagtgctagaagaccccagagagagggcaagggctttgggcaagaagcactggtggtgttttagggaccgtccttctcccctacccagggaactggacctggcagggcaccgtgctcatgtggctccaaggacaagcatggcggtggccccttctgccttccaggagaggtcttgcttttgaaaccaaaatcatgttcttctaaagtgtcatcttctgccctccctgtcccaatagggaccacatcttatttgtctcaaacagggacttgtgagtacttggcaagttttgcagcctatttttgtattcttaatttggggagtaaagatgtttggtctcaaaaacctttgaggaattgccaagaatggcgagtgattgctttccttcagagaacagacacttggaatttctccttttagtgtttatatacgtgcagattaatttatatatatatatatacacacacacatatacagtataaatactcatttgattctcgtaaaacgcgcatctggcgtgtgcagttgagaaacttggtggcacatgggtgttgggggagtagcctgtgttggagggacaccagtgcactaggcagctggggcggcccaggctgaagccatctccgggtgtctgagaaaccacccagtgcctcacctccagatcctgctggcatcacctccagagccctgcatgcactggctgaagagttggtctgtggagaggattttcttggttacttgtattcacggttaatttacaacccaaacagcaaaacacagttggtggacaagttcatgcaggacctacagtgacccagccatgggcactagctcatctttcaggtggaaaagtacagtgctgcctgccctggtatgtttttcttatagatgttagccctgcccaacagccagggctacactacaaaaggcaagaatgcccatgtaaggagcccagcagtctggacagatccttcttcctctgctgttggatgagagtgagtgagtatgntctggaccttatccttgaaagatgatcaaaagcgatgatgagggaggcagtcatcacgcaggtgcttaaagggacattgtaggaggtactcaagggtttgggggcaaaaccctgaatccagccagtcgtgcacagagacacacccacactagcccagtggcagtgggggatgtgggatggcagcagccaggtatgtagccctgtcacaggacagctcactgtggttttgcacactgcctaagggttaaattgtgttgttgccttcagtagaaggcatttgtgggctgcagagttgagagttgggtgaggttagtctctcctgaagaaaaagcctataaaaagtggctaatcttatcccttttctctgtatgcagttggactcgtcagagatagtaaaatcatcttttagtgtttttttgttgctgatgtcttgtacccatttgttttttacatggggttgtagatcgagttctcaaaggtgaaaccagatgatcattctgataaaggaaatttaaatttgatacatatgctttgtatattttgattacttgttttcgtttttgactataaaggagctcttttttcttgctcagagtttacctgggagatttcaccagtttgactcaccatttgcagatgtgcttttgtattaaatttaaattttcacatatcacatccattctcaaggtagttatatgctggagaagaaaaatcctctagacacatgaaggcccacatagtcaagtcttccagggcaaagccagcagcccacccaggtcaggtagccagcagggctcagttcccctcactccagacacggaccctcctcttcagggtctcttgacccagcttccttctctccttttacctgagagcacagacctctctcagccagcctgcccagaccacggggggctactcccatgtagtttggggagcacttgatctcagaaaagctccattgtctgagcaaatgggcagttgtggagctcaagcctttctcctgtgctcaagtcccttccccaagcaaggcttcaacctcatctacccaccatgtagttttctctggccatttaagtggggcggcagggacatggttgggccatgccacaccagggctggtgaggcaaccagttttgattttgacagagtggctggaggaaaagtggcaatcaaggtgctgcttggtttgctctgagtgcaaatggaaccaacaggtttctgctgcaatctgtgtgttcccagtgccaggtcacaccaggaggggtggggcagggctaaccaagtggtctctgaactcaccgagcgtctgcacttggttgtgaagttaatgggagtacagagagcgtctggccttggagaggggttgagagcctcctttttggttcttcattcctgagctcttgcctgcccacaaatctgacctctttgaatggggacgcagtccttcaacagagaagtttctatggcaaagaagtttctatttagctctagatccagcagagtcatccattctaactgccctgaagtctagagcaggggagggaacccagaggctggggatgagactaggcagaccctggttaccatatggacaaggacaggggaaagcacccccttcctcaatttctgaaagttctatctttgggttcgcaggactttgaggatgataaagaacatataggtactagcttgttgttgctggtccaaagcttccacagccctgagaatttggctttcgtggctgctctggcagctgagcgaagggaggaaggcagccgctctggtggggactctaggcaccttccctgctgtccacttggataggcggtgagccccagggtactgagaggagcctgagcatttacctgccattagtgcctcttccttcaggagactggcttgaaacgtgtgttcatgtgcgcgtgcacacacacacatgagcacctgtatgtgttaatgaatagtttttcttggttaatgctttttaacttctgttcctttccgtaagtggatgattcaaaattaacgtgacttggctgggcgcagtggctcacacctgtaatcccagcactttgggaggccaagggaggcggatcacctgaggtcaggagttcgagaccagcctgatcggcatggtgaaaccccgtttctactaaaaatacaaaaattagccgggcgtggtggtgcgcgcctgtaatcccagctactcaggaggctgaggaaggagaatcacttgaacccgggaggtggaggttgcagtgagctgagatcgtgccactgcactccagcctgggcgacagagcgaaactccgtctcaaaaaaaaaaaaaaaacttaatgtgactggagttaaaagtgaaatgtcaggttgtttagtcactgaatagagagctacaagtgcttggtctttcccaagaatcaaacctgagtagaaatacatttaaaagaaaaatctacatggtacctatgaatcctgtaatttgtttagggagatcttgtcactcatccctggttcctgcccatactgtttggtctcgttcttgcagtttgcttggaacagggccagagccccacatgagattgtcagcaggagtgaggagcgccagtccctactcctcagcagggacccagcacagcaatccggttgttctcggttagactgggtcggggccaggggagaagcagtcacccctgtgtagagggttcccgctgtgcttctgagcagttgctttgttcagaagtgttaggagggtcagattgtgccataattgttattaaagagaaaacacgcccaccttcctttctcccctgctggccattgttcattgagttttactgagggcagcctttgtggaagtcagggaggttgccaaaggcctgtagatgcctcctgacaaggtcttgattcctggttttctagcacccatttgcattttggtcttcagcacaaagccttgttccctgtggccggacttctgggcaataagactggggagtgactgttgagcagtctgctgtcaggagagatggctgaaaaggtgatcatcttggtgctaaacaagtaagaggcaactgccctgtttttgtttgttttgaggcacaatgaaactttagccaaactctgcaagagggtcccatctcctgccatggccaggtgtgagagaccaaaccgagaaaacagcatactctatcacttaagccttgggtagaatgggaattctttaccctgggtaaacgttttaacaaaaaaatggaacttaacttcggtttggactgtggtcgtgctgaggcaggagtggggttgccctcttggggctgaatctccaggcctcacgaggtcccctgtggggatgctgctatttctaagatgcaaattgcacatttcctagattttgtatctgtggatttggataagggaggggaacacggacaaattgcttgtacaatttgaaatgggcctcaatggtacttcaaaccttttgattattcctaaataaaaacataaatatat

SEQ ID NO: 372298 - DNA, 7172 bp, Homo sapiens
  misc_feature (3659)..(3659): n is a, c, g, or t
ccggagtcggttggtgcagctgcgtccccgccgctcagcagtccgcggctccggcgtcgccgccgccgccgcctctgcggggcctgcgccggccgcccgcccggccgcggggagggaggcccgcagcgcgggaagagcggcccggtcgcgggcgccgccaccgccgccgctgccaggactgaaatgcaactgcagaagcaacatgtgaccttttagagatgcttgtgggactgcataaagtgaagagggaaactggaaaaaaacaatgaaattgaatagggaaaacctgctttctgcaaacaactgaaaaagctgcatttagaaactgtttctttggccctcatcgagaagctggaacttgtattgttaggccccttatgggacaagctctcaactgctgatcacccagtgattgtcaccatggccagcaagaggaaatccaccacaccatgcatgatcccagtgaagactgtggtgttgcaagatgccagcatggaggcccagcccgctgagaccttgcctgaaggaccccagcaggatctgcccccagaagcatctgctgccagcagtgaggcagcacagaaccccagcagtactgatggctctacactggccaatgggcatcggagcactttagatggctatttatattcctgtaaatactgcgatttcagatcccatgacatgacccaatttgtgggacatatgaactcagagcacacagactttaataaagacccaacctttgtatgcagtgggtgcagttttctggcaaaaacccctgaggggctttccttgcacaatgccacatgtcactccggggaagccagctttgtgtggaacgtggccaagccagacaatcatgtggttgtggagcagagcatccctgagagcaccagcactcctgacctagcgggtgagcccagtgctgaaggggctgatggacaggcagaaatcatcattaccaaaactccaatcatgaagataatgaaaggcaaagctgaagccaaaaaaattcatacactcaaggagaatgtccctagccagcctgtgggtgaggccttaccaaagctgtcgactggagaaatggagaaacagactgaatttgatctgattaatgtgaaggactggccagtctgggaaaccgcctgccacgtggaagagccaaacccgactctctgctgccacatgccgttcccatgcccggctgctgggcacctgggagagcttccagaatcctcgcagacagcccagagcctgccgctaccctcggcctgcccaccaccaagcaagcagcaagcaagatggggttctcatcagttcttcctcccacaatgtaggacctttcctttaccttccaatggataaaatagttcagagttcatagtcatattcatagacacagaatcaagcttttaacatatacatccacctctatatgttaaataaaacatcagattatcaacactgtcattacgtagaaactttggttagccaagcagtgcattgtcagttacgtcatctctaaaaatgacctgtgtctgttctctggggattgctgggtcacaggtgcccctcaccttccacagtcaggcagggaagttataggcacaaagctacgtctggaacccctttgtgccccctttgtgttcctcaaggaagcagtacctttgaagagatctctgctgcattaagtgatgaccggctacgtttcatgtcaggcttgctttgccttgtgggctactcagtgcagaacctgctgtaaccctcagttcaaaaaatggactggcaatgtgattagcgttggatgctttaccattctctttagttgttaccgtaattctgctttttcatgggagtttgaatcatggaccataacttttcagttatcagatcaactaaagaaacatttgttgttaagcctaatgtgctgacctatgtgcctgcattttttttttaatctagacatgtttggagtgagagaaagatggaaaaaagacatggggtagggacgtaagtggaaatctatagccacagcctgaagctttgaccactgcggttttcagagccctttctccacactcatttcagagcctcctatggtttgggaaggaataacacactggcccattagtaagggtgaaggctggagggatttgttgacttcttggaattatcagaggtagggtggtctttagcacaaagacttgcatgcagagatccctggcagaacacccagagtgcccgtggctcccaccccagggtctggccggtgtgctggatgcatgcccaagggtgctgggcatcactggtccttgtgaggatgcttttaaagttttatatttatgtccccaaacttggaaacaagaactctactttagcctaaccctcatgtccttttttgaattgagaaaattacaggaaatggtgcctttgaaaattagaaaacttgcttacagagctgttctaaatggtaaatcctcaatttccccaagaccggttgctctgagagtagctggtaaagaggggcgaactaaagacctgtccacctgtagctccgctcatttcttagaaaccacctgcttcccagagtgccaagccacaagtaccaggcttcgtgggcacagacacctcctgggctgggcagagtgacagtgctagaagaccccagagagagggcaagggctttgggcaagaagcactggtggtgttttagggaccgtccttctcccctacccagggaactggacctggcagggcaccgtgctcatgtggctccaaggacaagcatggcggtggccccttctgccttccaggagaggtcttgcttttgaaaccaaaatcatgttcttctaaagtgtcatcttctgccctccctgtcccaatagggaccacatcttatttgtctcaaacagggacttgtgagtacttggcaagttttgcagcctatttttgtattcttaatttggggagtaaagatgtttggtctcaaaaacctttgaggaattgccaagaatggcgagtgattgctttccttcagagaacagacacttggaatttctccttttagtgtttatatacgtgcagattaatttatatatatatatatacacacacacatatacagtataaatactcatttgattctcgtaaaacgcgcatctggcgtgtgcagttgagaaacttggtggcacatgggtgttgggggagtagcctgtgttggagggacaccagtgcactaggcagctggggcggcccaggctgaagccatctccgggtgtctgagaaaccacccagtgcctcacctccagatcctgctggcatcacctccagagccctgcatgcactggctgaagagttggtctgtggagaggattttcttggttacttgtattcacggttaatttacaacccaaacagcaaaacacagttggtggacaagttcatgcaggacctacagtgacccagccatgggcactagctcatctttcaggtggaaaagtacagtgctgcctgccctggtatgtttttcttatagatgttagccctgcccaacagccagggctacactacaaaaggcaagaatgcccatgtaaggagcccagcagtctggacagatccttcttcctctgctgttggatgagagtgagtgagtatgntctggaccttatccttgaaagatgatcaaaagcgatgatgagggaggcagtcatcacgcaggtgcttaaagggacattgtaggaggtactcaagggtttgggggcaaaaccctgaatccagccagtcgtgcacagagacacacccacactagcccagtggcagtgggggatgtgggatggcagcagccaggtatgtagccctgtcacaggacagctcactgtggttttgcacactgcctaagggttaaattgtgttgttgccttcagtagaaggcatttgtgggctgcagagttgagagttgggtgaggttagtctctcctgaagaaaaagcctataaaaagtggctaatcttatcccttttctctgtatgcagttggactcgtcagagatagtaaaatcatcttttagtgtttttttgttgctgatgtcttgtacccatttgttttttacatggggttgtagatcgagttctcaaaggtgaaaccagatgatcattctgataaaggaaatttaaatttgatacatatgctttgtatattttgattacttgttttcgtttttgactataaaggagctcttttttcttgctcagagtttacctgggagatttcaccagtttgactcaccatttgcagatgtgcttttgtattaaatttaaattttcacatatcacatccattctcaaggtagttatatgctggagaagaaaaatcctctagacacatgaaggcccacatagtcaagtcttccagggcaaagccagcagcccacccaggtcaggtagccagcagggctcagttcccctcactccagacacggaccctcctcttcagggtctcttgacccagcttccttctctccttttacctgagagcacagacctctctcagccagcctgcccagaccacggggggctactcccatgtagtttggggagcacttgatctcagaaaagctccattgtctgagcaaatgggcagttgtggagctcaagcctttctcctgtgctcaagtcccttccccaagcaaggcttcaacctcatctacccaccatgtagttttctctggccatttaagtggggcggcagggacatggttgggccatgccacaccagggctggtgaggcaaccagttttgattttgacagagtggctggaggaaaagtggcaatcaaggtgctgcttggtttgctctgagtgcaaatggaaccaacaggtttctgctgcaatctgtgtgttcccagtgccaggtcacaccaggaggggtggggcagggctaaccaagtggtctctgaactcaccgagcgtctgcacttggttgtgaagttaatgggagtacagagagcgtctggccttggagaggggttgagagcctcctttttggttcttcattcctgagctcttgcctgcccacaaatctgacctctttgaatggggacgcagtccttcaacagagaagtttctatggcaaagaagtttctatttagctctagatccagcagagtcatccattctaactgccctgaagtctagagcaggggagggaacccagaggctggggatgagactaggcagaccctggttaccatatggacaaggacaggggaaagcacccccttcctcaatttctgaaagttctatctttgggttcgcaggactttgaggatgataaagaacatataggtactagcttgttgttgctggtccaaagcttccacagccctgagaatttggctttcgtggctgctctggcagctgagcgaagggaggaaggcagccgctctggtggggactctaggcaccttccctgctgtccacttggataggcggtgagccccagggtactgagaggagcctgagcatttacctgccattagtgcctcttccttcaggagactggcttgaaacgtgtgttcatgtgcgcgtgcacacacacacatgagcacctgtatgtgttaatgaatagtttttcttggttaatgctttttaacttctgttcctttccgtaagtggatgattcaaaattaacgtgacttggctgggcgcagtggctcacacctgtaatcccagcactttgggaggccaagggaggcggatcacctgaggtcaggagttcgagaccagcctgatcggcatggtgaaaccccgtttctactaaaaatacaaaaattagccgggcgtggtggtgcgcgcctgtaatcccagctactcaggaggctgaggaaggagaatcacttgaacccgggaggtggaggttgcagtgagctgagatcgtgccactgcactccagcctgggcgacagagcgaaactccgtctcaaaaaaaaaaaaaaaacttaatgtgactggagttaaaagtgaaatgtcaggttgtttagtcactgaatagagagctacaagtgcttggtctttcccaagaatcaaacctgagtagaaatacatttaaaagaaaaatctacatggtacctatgaatcctgtaatttgtttagggagatcttgtcactcatccctggttcctgcccatactgtttggtctcgttcttgcagtttgcttggaacagggccagagccccacatgagattgtcagcaggagtgaggagcgccagtccctactcctcagcagggacccagcacagcaatccggttgttctcggttagactgggtcggggccaggggagaagcagtcacccctgtgtagagggttcccgctgtgcttctgagcagttgctttgttcagaagtgttaggagggtcagattgtgccataattgttattaaagagaaaacacgcccaccttcctttctcccctgctggccattgttcattgagttttactgagggcagcctttgtggaagtcagggaggttgccaaaggcctgtagatgcctcctgacaaggtcttgattcctggttttctagcacccatttgcattttggtcttcagcacaaagccttgttccctgtggccggacttctgggcaataagactggggagtgactgttgagcagtctgctgtcaggagagatggctgaaaaggtgatcatcttggtgctaaacaagtaagaggcaactgccctgtttttgtttgttttgaggcacaatgaaactttagccaaactctgcaagagggtcccatctcctgccatggccaggtgtgagagaccaaaccgagaaaacagcatactctatcacttaagccttgggtagaatgggaattctttaccctgggtaaacgttttaacaaaaaaatggaacttaacttcggtttggactgtggtcgtgctgaggcaggagtggggttgccctcttggggctgaatctccaggcctcacgaggtcccctgtggggatgctgctatttctaagatgcaaattgcacatttcctagattttgtatctgtggatttggataagggaggggaacacggacaaattgcttgtacaatttgaaatgggcctcaatggtacttcaaaccttttgattattcctaaataaaaacataaatatat

SEQ ID NO: 372299 - DNA, 6109 bp, Homo sapiens
  misc_feature (2596)..(2596): n is a, c, g, or t
accccatcagagggcagccagaagctcagaaacagactgaatttgatctgattaatgtgaaggactggccagtctgggaaaccgcctgccacgtggaagagccaaacccgactctctgctgccacatgccgttcccatgcccggctgctgggcacctgggagagcttccagaatcctcgcagacagcccagagcctgccgctaccctcggcctgcccaccaccaagcaagcagcaagcaagatggggttctcatcagttcttcctcccacaatgtaggacctttcctttaccttccaatggataaaatagttcagagttcatagtcatattcatagacacagaatcaagcttttaacatatacatccacctctatatgttaaataaaacatcagattatcaacactgtcattacgtagaaactttggttagccaagcagtgcattgtcagttacgtcatctctaaaaatgacctgtgtctgttctctggggattgctgggtcacaggtgcccctcaccttccacagtcaggcagggaagttataggcacaaagctacgtctggaacccctttgtgccccctttgtgttcctcaaggaagcagtacctttgaagagatctctgctgcattaagtgatgaccggctacgtttcatgtcaggcttgctttgccttgtgggctactcagtgcagaacctgctgtaaccctcagttcaaaaaatggactggcaatgtgattagcgttggatgctttaccattctctttagttgttaccgtaattctgctttttcatgggagtttgaatcatggaccataacttttcagttatcagatcaactaaagaaacatttgttgttaagcctaatgtgctgacctatgtgcctgcattttttttttaatctagacatgtttggagtgagagaaagatggaaaaaagacatggggtagggacgtaagtggaaatctatagccacagcctgaagctttgaccactgcggttttcagagccctttctccacactcatttcagagcctcctatggtttgggaaggaataacacactggcccattagtaagggtgaaggctggagggatttgttgacttcttggaattatcagaggtagggtggtctttagcacaaagacttgcatgcagagatccctggcagaacacccagagtgcccgtggctcccaccccagggtctggccggtgtgctggatgcatgcccaagggtgctgggcatcactggtccttgtgaggatgcttttaaagttttatatttatgtccccaaacttggaaacaagaactctactttagcctaaccctcatgtccttttttgaattgagaaaattacaggaaatggtgcctttgaaaattagaaaacttgcttacagagctgttctaaatggtaaatcctcaatttccccaagaccggttgctctgagagtagctggtaaagaggggcgaactaaagacctgtccacctgtagctccgctcatttcttagaaaccacctgcttcccagagtgccaagccacaagtaccaggcttcgtgggcacagacacctcctgggctgggcagagtgacagtgctagaagaccccagagagagggcaagggctttgggcaagaagcactggtggtgttttagggaccgtccttctcccctacccagggaactggacctggcagggcaccgtgctcatgtggctccaaggacaagcatggcggtggccccttctgccttccaggagaggtcttgcttttgaaaccaaaatcatgttcttctaaagtgtcatcttctgccctccctgtcccaatagggaccacatcttatttgtctcaaacagggacttgtgagtacttggcaagttttgcagcctatttttgtattcttaatttggggagtaaagatgtttggtctcaaaaacctttgaggaattgccaagaatggcgagtgattgctttccttcagagaacagacacttggaatttctccttttagtgtttatatacgtgcagattaatttatatatatatatatacacacacacatatacagtataaatactcatttgattctcgtaaaacgcgcatctggcgtgtgcagttgagaaacttggtggcacatgggtgttgggggagtagcctgtgttggagggacaccagtgcactaggcagctggggcggcccaggctgaagccatctccgggtgtctgagaaaccacccagtgcctcacctccagatcctgctggcatcacctccagagccctgcatgcactggctgaagagttggtctgtggagaggattttcttggttacttgtattcacggttaatttacaacccaaacagcaaaacacagttggtggacaagttcatgcaggacctacagtgacccagccatgggcactagctcatctttcaggtggaaaagtacagtgctgcctgccctggtatgtttttcttatagatgttagccctgcccaacagccagggctacactacaaaaggcaagaatgcccatgtaaggagcccagcagtctggacagatccttcttcctctgctgttggatgagagtgagtgagtatgntctggaccttatccttgaaagatgatcaaaagcgatgatgagggaggcagtcatcacgcaggtgcttaaagggacattgtaggaggtactcaagggtttgggggcaaaaccctgaatccagccagtcgtgcacagagacacacccacactagcccagtggcagtgggggatgtgggatggcagcagccaggtatgtagccctgtcacaggacagctcactgtggttttgcacactgcctaagggttaaattgtgttgttgccttcagtagaaggcatttgtgggctgcagagttgagagttgggtgaggttagtctctcctgaagaaaaagcctataaaaagtggctaatcttatcccttttctctgtatgcagttggactcgtcagagatagtaaaatcatcttttagtgtttttttgttgctgatgtcttgtacccatttgttttttacatggggttgtagatcgagttctcaaaggtgaaaccagatgatcattctgataaaggaaatttaaatttgatacatatgctttgtatattttgattacttgttttcgtttttgactataaaggagctcttttttcttgctcagagtttacctgggagatttcaccagtttgactcaccatttgcagatgtgcttttgtattaaatttaaattttcacatatcacatccattctcaaggtagttatatgctggagaagaaaaatcctctagacacatgaaggcccacatagtcaagtcttccagggcaaagccagcagcccacccaggtcaggtagccagcagggctcagttcccctcactccagacacggaccctcctcttcagggtctcttgacccagcttccttctctccttttacctgagagcacagacctctctcagccagcctgcccagaccacggggggctactcccatgtagtttggggagcacttgatctcagaaaagctccattgtctgagcaaatgggcagttgtggagctcaagcctttctcctgtgctcaagtcccttccccaagcaaggcttcaacctcatctacccaccatgtagttttctctggccatttaagtggggcggcagggacatggttgggccatgccacaccagggctggtgaggcaaccagttttgattttgacagagtggctggaggaaaagtggcaatcaaggtgctgcttggtttgctctgagtgcaaatggaaccaacaggtttctgctgcaatctgtgtgttcccagtgccaggtcacaccaggaggggtggggcagggctaaccaagtggtctctgaactcaccgagcgtctgcacttggttgtgaagttaatgggagtacagagagcgtctggccttggagaggggttgagagcctcctttttggttcttcattcctgagctcttgcctgcccacaaatctgacctctttgaatggggacgcagtccttcaacagagaagtttctatggcaaagaagtttctatttagctctagatccagcagagtcatccattctaactgccctgaagtctagagcaggggagggaacccagaggctggggatgagactaggcagaccctggttaccatatggacaaggacaggggaaagcacccccttcctcaatttctgaaagttctatctttgggttcgcaggactttgaggatgataaagaacatataggtactagcttgttgttgctggtccaaagcttccacagccctgagaatttggctttcgtggctgctctggcagctgagcgaagggaggaaggcagccgctctggtggggactctaggcaccttccctgctgtccacttggataggcggtgagccccagggtactgagaggagcctgagcatttacctgccattagtgcctcttccttcaggagactggcttgaaacgtgtgttcatgtgcgcgtgcacacacacacatgagcacctgtatgtgttaatgaatagtttttcttggttaatgctttttaacttctgttcctttccgtaagtggatgattcaaaattaacgtgacttggctgggcgcagtggctcacacctgtaatcccagcactttgggaggccaagggaggcggatcacctgaggtcaggagttcgagaccagcctgatcggcatggtgaaaccccgtttctactaaaaatacaaaaattagccgggcgtggtggtgcgcgcctgtaatcccagctactcaggaggctgaggaaggagaatcacttgaacccgggaggtggaggttgcagtgagctgagatcgtgccactgcactccagcctgggcgacagagcgaaactccgtctcaaaaaaaaaaaaaaaacttaatgtgactggagttaaaagtgaaatgtcaggttgtttagtcactgaatagagagctacaagtgcttggtctttcccaagaatcaaacctgagtagaaatacatttaaaagaaaaatctacatggtacctatgaatcctgtaatttgtttagggagatcttgtcactcatccctggttcctgcccatactgtttggtctcgttcttgcagtttgcttggaacagggccagagccccacatgagattgtcagcaggagtgaggagcgccagtccctactcctcagcagggacccagcacagcaatccggttgttctcggttagactgggtcggggccaggggagaagcagtcacccctgtgtagagggttcccgctgtgcttctgagcagttgctttgttcagaagtgttaggagggtcagattgtgccataattgttattaaagagaaaacacgcccaccttcctttctcccctgctggccattgttcattgagttttactgagggcagcctttgtggaagtcagggaggttgccaaaggcctgtagatgcctcctgacaaggtcttgattcctggttttctagcacccatttgcattttggtcttcagcacaaagccttgttccctgtggccggacttctgggcaataagactggggagtgactgttgagcagtctgctgtcaggagagatggctgaaaaggtgatcatcttggtgctaaacaagtaagaggcaactgccctgtttttgtttgttttgaggcacaatgaaactttagccaaactctgcaagagggtcccatctcctgccatggccaggtgtgagagaccaaaccgagaaaacagcatactctatcacttaagccttgggtagaatgggaattctttaccctgggtaaacgttttaacaaaaaaatggaacttaacttcggtttggactgtggtcgtgctgaggcaggagtggggttgccctcttggggctgaatctccaggcctcacgaggtcccctgtggggatgctgctatttctaagatgcaaattgcacatttcctagattttgtatctgtggatttggataagggaggggaacacggacaaattgcttgtacaatttgaaatgggcctcaatggtacttcaaaccttttgattattcctaaataaaaacataaatatat

SEQ ID NO: 372300 - DNA, 3236 bp, Homo sapiens
ggcctaggggcaggtcctgtgttctctccctctctctcctggctctgggacatctgtccctggctgcctttcatggaggaaggacactggcctttctggttggatgctgtgtggatgctctctgcttgagcctcgtggtctcttgtctctttttggaccaatatcctcagattggtgcagctttttcagttcagatatcacaccccaagtggataaaggcaacttgcaggagaggagagccagccaagaagaaaattttaaaaccaaacctcgtttaggattttcctaaagtcatcttctcttttttcttgctcagagtttacctgggagatttcaccagtttgactcaccatttgcagatgtgcttttgtattaaatttaaattttcacatatcacatccattctcaaggtagttatatgctggagaagaaaaatcctctagacacatgaaggcccacatagtcaagtcttccagggcaaagccagcagcccacccaggtcaggtagccagcagggctcagttcccctcactccagacacggaccctcctcttcagggtctcttgacccagcttccttctctccttttacctgagagcacagacctctctcagccagcctgcccagaccacggggggctactcccatgtagtttggggagcacttgatctcagaaaagctccattgtctgagcaaatgggcagttgtggagctcaagcctttctcctgtgctcaagtcccttccccaagcaaggcttcaacctcatctacccaccatgtagttttctctggccatttaagtggggcggcagggacatggttgggccatgccacaccagggctggtgaggcaaccagttttgattttgacagagtggctggaggaaaagtggcaatcaaggtgctgcttggtttgctctgagtgcaaatggaaccaacaggtttctgctgcaatctgtgtgttcccagtgccaggtcacaccaggaggggtggggcagggctaaccaagtggtctctgaactcaccgagcgtctgcacttggttgtgaagttaatgggagtacagagagcgtctggccttggagaggggttgagagcctcctttttggttcttcattcctgagctcttgcctgcccacaaatctgacctctttgaatggggacgcagtccttcaacagagaagtttctatggcaaagaagtttctatttagctctagatccagcagagtcatccattctaactgccctgaagtctagagcaggggagggaacccagaggctggggatgagactaggcagaccctggttaccatatggacaaggacaggggaaagcacccccttcctcaatttctgaaagttctatctttgggttcgcaggactttgaggatgataaagaacatataggtactagcttgttgttgctggtccaaagcttccacagccctgagaatttggctttcgtggctgctctggcagctgagcgaagggaggaaggcagccgctctggtggggactctaggcaccttccctgctgtccacttggataggcggtgagccccagggtactgagaggagcctgagcatttacctgccattagtgcctcttccttcaggagactggcttgaaacgtgtgttcatgtgcgcgtgcacacacacacatgagcacctgtatgtgttaatgaatagtttttcttggttaatgctttttaacttctgttcctttccgtaagtggatgattcaaaattaacgtgacttggctgggcgcagtggctcacacctgtaatcccagcactttgggaggccaagggaggcggatcacctgaggtcaggagttcgagaccagcctgatcggcatggtgaaaccccgtttctactaaaaatacaaaaattagccgggcgtggtggtgcgcgcctgtaatcccagctactcaggaggctgaggaaggagaatcacttgaacccgggaggtggaggttgcagtgagctgagatcgtgccactgcactccagcctgggcgacagagcgaaactccgtctcaaaaaaaaaaaaaaaacttaatgtgactggagttaaaagtgaaatgtcaggttgtttagtcactgaatagagagctacaagtgcttggtctttcccaagaatcaaacctgagtagaaatacatttaaaagaaaaatctacatggtacctatgaatcctgtaatttgtttagggagatcttgtcactcatccctggttcctgcccatactgtttggtctcgttcttgcagtttgcttggaacagggccagagccccacatgagattgtcagcaggagtgaggagcgccagtccctactcctcagcagggacccagcacagcaatccggttgttctcggttagactgggtcggggccaggggagaagcagtcacccctgtgtagagggttcccgctgtgcttctgagcagttgctttgttcagaagtgttaggagggtcagattgtgccataattgttattaaagagaaaacacgcccaccttcctttctcccctgctggccattgttcattgagttttactgagggcagcctttgtggaagtcagggaggttgccaaaggcctgtagatgcctcctgacaaggtcttgattcctggttttctagcacccatttgcattttggtcttcagcacaaagccttgttccctgtggccggacttctgggcaataagactggggagtgactgttgagcagtctgctgtcaggagagatggctgaaaaggtgatcatcttggtgctaaacaagtaagaggcaactgccctgtttttgtttgttttgaggcacaatgaaactttagccaaactctgcaagagggtcccatctcctgccatggccaggtgtgagagaccaaaccgagaaaacagcatactctatcacttaagccttgggtagaatgggaattctttaccctgggtaaacgttttaacaaaaaaatggaacttaacttcggtttggactgtggtcgtgctgaggcaggagtggggttgccctcttggggctgaatctccaggcctcacgaggtcccctgtggggatgctgctatttctaagatgcaaattgcacatttcctagattttgtatctgtggatttggataagggaggggaacacggacaaattgcttgtacaatttgaaatgggcctcaatggtacttcaaaccttttgattattcctaaataaaaacataaatatat

SEQ ID NO: 372301 - DNA, 3425 bp, Homo sapiens
ccggagtcggttggtgcagctgcgtccccgccgctcagcagtccgcggctccggcgtcgccgccgccgccgcctctgcggggcctgcgccggccgcccgcccggccgcggggagggaggcccgcagcgcgggaagagcggcccggtcgcgggcgccgccaccgccgccgctgccaggactgaaatgcaactgcagaagcaacatgtgaccttttagagatgcttgtgggactgcataaagtgaagagggaaactggaaaaaaacaatgaaattgaatagggaaaacctgctttctgcaaacaactgaaaaagctgcatttagaaactgtttctttggccctcatcgagaagctggaacttgtattgttaggccccttatgggacaagctctcaactgctgatcacccagtgattgtcaccatggccagcaagaggaaatccaccacaccatgcatgatcccagtgaagactgtggtgttgcaagatgccagcatggaggcccagcccgctgagaccttgcctgaaggaccccagcaggatctgcccccagaagcatctgctgccagcagtgaggcagcacagaaccccagcagtactgatggctctacactggccaatgggcatcggagcactttagatggctatttatattcctgtaaatactgcgatttcagatcccatgacatgacccaatttgtgggacatatgaactcagagcacacagactttaataaagacccaacctttgtatgcagtgggtgcagttttctggcaaaaacccctgaggggctttccttgcacaatgccacatgtcactccggggaagccagctttgtgtggaacgtggccaagccagacaatcatgtggttgtggagcagagcatccctgagagcaccagcactcctgacctagcgggtgagcccagtgctgaaggggctgatggacaggcagaaatcatcattaccaaaactccaatcatgaagataatgaaaggcaaagctgaagccaaaaaaattcatacactcaaggagaatgtccctagccagcctgtgggtgaggccttaccaaagctgtcgactggagaaatggaggtgagagagggggaccattccttcatcaatggggcagttccagtcagccaggcatctgccagctctgcaaaaaacccccatgccgccaacgggcccctgataggaacagtgccagttttgccagctggcatagcacagttcctctccctccagcagcagcccccagtgcatgcccaacaccatgtccaccagccactgcccacggccaaggcccttcccaaagtgatgatccccctgagcagcattccaacgtacagtgcagccatggactctaacagcttcctgaagaactccttccacaagttcccctaccccaccaaagccgagctctgctatttgactgtggtgaccaagtatccagaagaacagctcaagatctggttcacagcccaaaggctgaagcaggggatcagctggtcccctgaggagattgaggatgcccggaaaaagatgttcaatacagtcatccagtctgtgcctcagcccacaattacggttctaaataccccactcgtcgccagtgctggcaatgtccagcatctcatccaggccgctcttccaggtcacgttgtggggcagccagagggtacaggagggggacttctggtcactcagccattgatggccaatgggttgcaagcaacaagttcccctctccccctcacggtgacatccgtccccaagcagccaggtgtggcacccattaacactgtgtgttcaaatacaacgtcagctgtgaaggtggtcaatgcggcccagtcgctcctcacggcctgccccagcataacctcccaagccttccttgatgctagcatctacaaaaataagaaatctcatgaacagctgtcagctctgaaagggagcttctgtcggaaccagttcccagggcagagcgaagttgaacatctcacaaaagtgacgggcctcagtaccagagaggtgcggaaatggttcagtgatcgtagataccactgccggaacttgaagggctccagagcgatgatacctggagatcacagttccatcatcattgactctgtgccagaggtgtccttctccccatcgtccaaggtccctgaggtaacctgcattccgacaacagccacactagcaacccacccttctgccaaacgacaatcttggcaccagactcctgacttcacaccaaccaaatacaaggagagagcccctgagcagctcagagccctggagagcagttttgcacaaaaccctcttcctcttgatgaggaactggaccgcctgagaagtgaaaccaaaatgacccgacgagaaattgatagctggttttcagagagacggaaaaaagtgaatgctgaggagaccaagaaggctgaggagaatgcctctcaggaggaagaggaggctgctgaggatgagggtggagaagaggatttggccagtgagctaagggtctctggtgaaaatggctctctggaaatgcccagcagccatatcttggcagagcgcaaagtcagccccattaaaatcaacctgaagaacctgagggtcactgaagccaatggcaggaacgagattccagggctgggtgcctgtgaccctgaggatgatgagtcaaacaaactggcagagcagctcccaggcaaagtgagctgcaaaaagactgcccagcagcggcacttgctgcggcagctctttgtccagacacagtggccaagcaaccaggactatgactccatcatggcccagacgggtctgccacggccagaggtggtgcgctggtttggagatagcaggtacgcactgaagaacggccaactcaaatggtacgaagactataagcgaggcaacttcccaccagggctactggtcattgcccctggcaaccgggagctcctgcaggactattacatgacacacaagatgctgtatgaagaggacctgcagaacctctgtgacaagacccagatgagctcccagcaggtcaagcagtggtttgctgagaaaatgggggaggagaccagagccgtggcagacacaggcagtgaggaccagggccctggtactggtgagctcacagcagttcacaaagggatgggtgacacctattcagaggtgtctgagaacagtgagtcgtgggagccccgtgtccctgaggccagctcagagccctttgacacatcgagtccccaggctggacgtcagctcggtaaggagtccacaggggccatggctatcctgtgtgggtaaggggaggaggcacttatggttgggcactgaatttactgcacaggggcatctgctgtctctaaggctgcctggcagcagcattaaccgcctggctgcttcagagg

SEQ ID NO: 372302 - DNA, 446 bp, Homo sapiens
atggatcttgattgtttaagcccagtcaggtaaaccccacacctgttgcacagtgattaacccagtggcagtcatgccaagaggtttgttcatggctgggcatgtgacctgtgcaggccaccagcatgcttgctgaggactttgggaagaaggctcttcagtcttctgatagacctccccaagacggccctctctctgtgtccttctggatgtttgggacatgaagcttggggctgctggagttaccttgctgtcacgagggaagctacccctaggatgtggttgacgaagtagaaagaaagaaaataggcccttattggccaggcacggtggctcacgcctgtaatcccagcactttgggaggccgaggcgggcggatcacgaggtcaggagaccgagagcatcctggctaacatggtgaaaccccgtttctactaaaaaataca

SEQ ID NO: 372303 - DNA, 8080 bp, Homo sapiens
  misc_feature (4567)..(4567): n is a, c, g, or t
ggccacaatatcactcaaagacgactgaagtgacagtccaccacatgaaagcagcattccaacgtacagtgcagccatggactctaacagcttcctgaagaactccttccacaagttcccctaccccaccaaagccgagctctgctatttgactgtggtgaccaagtatccagaagaacagctcaagatctggttcacagcccaaaggctgaagcaggggatcagctggtcccctgaggagattgaggatgcccggaaaaagatgttcaatacagtcatccagtctgtgcctcagcccacaattacggttctaaataccccactcgtcgccagtgctggcaatgtccagcatctcatccaggccgctcttccaggtcacgttgtggggcagccagagggtacaggagggggacttctggtcactcagccattgatggccaatgggttgcaagcaacaagttcccctctccccctcacggtgacatccgtccccaagcagccaggtgtggcacccattaacactgtgtgttcaaatacaacgtcagctgtgaaggtggtcaatgcggcccagtcgctcctcacggcctgccccagcataacctcccaagccttccttgatgctagcatctacaaaaataagaaatctcatgaacagctgtcagctctgaaagggagcttctgtcggaaccagttcccagggcagagcgaagttgaacatctcacaaaagtgacgggcctcagtaccagagaggtgcggaaatggttcagtgatcgtagataccactgccggaacttgaagggctccagagcgatgatacctggagatcacagttccatcatcattgactctgtgccagaggtgtccttctccccatcgtccaaggtccctgaggtaacctgcattccgacaacagccacactagcaacccacccttctgccaaacgacaatcttggcaccagactcctgacttcacaccaaccaaatacaaggagagagcccctgagcagctcagagccctggagagcagttttgcacaaaaccctcttcctcttgatgaggaactggaccgcctgagaagtgaaaccaaaatgacccgacgagaaattgatagctggttttcagagagacggaaaaaagtgaatgctgaggagaccaagaaggctgaggagaatgcctctcaggaggaagaggaggctgctgaggatgagggtggagaagaggatttggccagtgagctaagggtctctggtgaaaatggctctctggaaatgcccagcagccatatcttggcagagcgcaaagtcagccccattaaaatcaacctgaagaacctgagggtcactgaagccaatggcaggaacgagattccagggctgggtgcctgtgaccctgaggatgatgagtcaaacaaactggcagagcagctcccaggcaaagtgagctgcaaaaagactgcccagcagcggcacttgctgcggcagctctttgtccagacacagtggccaagcaaccaggactatgactccatcatggcccagacgggtctgccacggccagaggtggtgcgctggtttggagatagcaggtacgcactgaagaacggccaactcaaatggtacgaagactataagcgaggcaacttcccaccagggctactggtcattgcccctggcaaccgggagctcctgcaggactattacatgacacacaagatgctgtatgaagaggacctgcagaacctctgtgacaagacccagatgagctcccagcaggtcaagcagtggtttgctgagaaaatgggggaggagaccagagccgtggcagacacaggcagtgaggaccagggccctggtactggtgagctcacagcagttcacaaagggatgggtgacacctattcagaggtgtctgagaacagtgagtcgtgggagccccgtgtccctgaggccagctcagagccctttgacacatcgagtccccaggctggacgtcagctcgaaacagactgaatttgatctgattaatgtgaaggactggccagtctgggaaaccgcctgccacgtggaagagccaaacccgactctctgctgccacatgccgttcccatgcccggctgctgggcacctgggagagcttccagaatcctcgcagacagcccagagcctgccgctaccctcggcctgcccaccaccaagcaagcagcaagcaagatggggttctcatcagttcttcctcccacaatgtaggacctttcctttaccttccaatggataaaatagttcagagttcatagtcatattcatagacacagaatcaagcttttaacatatacatccacctctatatgttaaataaaacatcagattatcaacactgtcattacgtagaaactttggttagccaagcagtgcattgtcagttacgtcatctctaaaaatgacctgtgtctgttctctggggattgctgggtcacaggtgcccctcaccttccacagtcaggcagggaagttataggcacaaagctacgtctggaacccctttgtgccccctttgtgttcctcaaggaagcagtacctttgaagagatctctgctgcattaagtgatgaccggctacgtttcatgtcaggcttgctttgccttgtgggctactcagtgcagaacctgctgtaaccctcagttcaaaaaatggactggcaatgtgattagcgttggatgctttaccattctctttagttgttaccgtaattctgctttttcatgggagtttgaatcatggaccataacttttcagttatcagatcaactaaagaaacatttgttgttaagcctaatgtgctgacctatgtgcctgcattttttttttaatctagacatgtttggagtgagagaaagatggaaaaaagacatggggtagggacgtaagtggaaatctatagccacagcctgaagctttgaccactgcggttttcagagccctttctccacactcatttcagagcctcctatggtttgggaaggaataacacactggcccattagtaagggtgaaggctggagggatttgttgacttcttggaattatcagaggtagggtggtctttagcacaaagacttgcatgcagagatccctggcagaacacccagagtgcccgtggctcccaccccagggtctggccggtgtgctggatgcatgcccaagggtgctgggcatcactggtccttgtgaggatgcttttaaagttttatatttatgtccccaaacttggaaacaagaactctactttagcctaaccctcatgtccttttttgaattgagaaaattacaggaaatggtgcctttgaaaattagaaaacttgcttacagagctgttctaaatggtaaatcctcaatttccccaagaccggttgctctgagagtagctggtaaagaggggcgaactaaagacctgtccacctgtagctccgctcatttcttagaaaccacctgcttcccagagtgccaagccacaagtaccaggcttcgtgggcacagacacctcctgggctgggcagagtgacagtgctagaagaccccagagagagggcaagggctttgggcaagaagcactggtggtgttttagggaccgtccttctcccctacccagggaactggacctggcagggcaccgtgctcatgtggctccaaggacaagcatggcggtggccccttctgccttccaggagaggtcttgcttttgaaaccaaaatcatgttcttctaaagtgtcatcttctgccctccctgtcccaatagggaccacatcttatttgtctcaaacagggacttgtgagtacttggcaagttttgcagcctatttttgtattcttaatttggggagtaaagatgtttggtctcaaaaacctttgaggaattgccaagaatggcgagtgattgctttccttcagagaacagacacttggaatttctccttttagtgtttatatacgtgcagattaatttatatatatatatatacacacacacatatacagtataaatactcatttgattctcgtaaaacgcgcatctggcgtgtgcagttgagaaacttggtggcacatgggtgttgggggagtagcctgtgttggagggacaccagtgcactaggcagctggggcggcccaggctgaagccatctccgggtgtctgagaaaccacccagtgcctcacctccagatcctgctggcatcacctccagagccctgcatgcactggctgaagagttggtctgtggagaggattttcttggttacttgtattcacggttaatttacaacccaaacagcaaaacacagttggtggacaagttcatgcaggacctacagtgacccagccatgggcactagctcatctttcaggtggaaaagtacagtgctgcctgccctggtatgtttttcttatagatgttagccctgcccaacagccagggctacactacaaaaggcaagaatgcccatgtaaggagcccagcagtctggacagatccttcttcctctgctgttggatgagagtgagtgagtatgntctggaccttatccttgaaagatgatcaaaagcgatgatgagggaggcagtcatcacgcaggtgcttaaagggacattgtaggaggtactcaagggtttgggggcaaaaccctgaatccagccagtcgtgcacagagacacacccacactagcccagtggcagtgggggatgtgggatggcagcagccaggtatgtagccctgtcacaggacagctcactgtggttttgcacactgcctaagggttaaattgtgttgttgccttcagtagaaggcatttgtgggctgcagagttgagagttgggtgaggttagtctctcctgaagaaaaagcctataaaaagtggctaatcttatcccttttctctgtatgcagttggactcgtcagagatagtaaaatcatcttttagtgtttttttgttgctgatgtcttgtacccatttgttttttacatggggttgtagatcgagttctcaaaggtgaaaccagatgatcattctgataaaggaaatttaaatttgatacatatgctttgtatattttgattacttgttttcgtttttgactataaaggagctcttttttcttgctcagagtttacctgggagatttcaccagtttgactcaccatttgcagatgtgcttttgtattaaatttaaattttcacatatcacatccattctcaaggtagttatatgctggagaagaaaaatcctctagacacatgaaggcccacatagtcaagtcttccagggcaaagccagcagcccacccaggtcaggtagccagcagggctcagttcccctcactccagacacggaccctcctcttcagggtctcttgacccagcttccttctctccttttacctgagagcacagacctctctcagccagcctgcccagaccacggggggctactcccatgtagtttggggagcacttgatctcagaaaagctccattgtctgagcaaatgggcagttgtggagctcaagcctttctcctgtgctcaagtcccttccccaagcaaggcttcaacctcatctacccaccatgtagttttctctggccatttaagtggggcggcagggacatggttgggccatgccacaccagggctggtgaggcaaccagttttgattttgacagagtggctggaggaaaagtggcaatcaaggtgctgcttggtttgctctgagtgcaaatggaaccaacaggtttctgctgcaatctgtgtgttcccagtgccaggtcacaccaggaggggtggggcagggctaaccaagtggtctctgaactcaccgagcgtctgcacttggttgtgaagttaatgggagtacagagagcgtctggccttggagaggggttgagagcctcctttttggttcttcattcctgagctcttgcctgcccacaaatctgacctctttgaatggggacgcagtccttcaacagagaagtttctatggcaaagaagtttctatttagctctagatccagcagagtcatccattctaactgccctgaagtctagagcaggggagggaacccagaggctggggatgagactaggcagaccctggttaccatatggacaaggacaggggaaagcacccccttcctcaatttctgaaagttctatctttgggttcgcaggactttgaggatgataaagaacatataggtactagcttgttgttgctggtccaaagcttccacagccctgagaatttggctttcgtggctgctctggcagctgagcgaagggaggaaggcagccgctctggtggggactctaggcaccttccctgctgtccacttggataggcggtgagccccagggtactgagaggagcctgagcatttacctgccattagtgcctcttccttcaggagactggcttgaaacgtgtgttcatgtgcgcgtgcacacacacacatgagcacctgtatgtgttaatgaatagtttttcttggttaatgctttttaacttctgttcctttccgtaagtggatgattcaaaattaacgtgacttggctgggcgcagtggctcacacctgtaatcccagcactttgggaggccaagggaggcggatcacctgaggtcaggagttcgagaccagcctgatcggcatggtgaaaccccgtttctactaaaaatacaaaaattagccgggcgtggtggtgcgcgcctgtaatcccagctactcaggaggctgaggaaggagaatcacttgaacccgggaggtggaggttgcagtgagctgagatcgtgccactgcactccagcctgggcgacagagcgaaactccgtctcaaaaaaaaaaaaaaaacttaatgtgactggagttaaaagtgaaatgtcaggttgtttagtcactgaatagagagctacaagtgcttggtctttcccaagaatcaaacctgagtagaaatacatttaaaagaaaaatctacatggtacctatgaatcctgtaatttgtttagggagatcttgtcactcatccctggttcctgcccatactgtttggtctcgttcttgcagtttgcttggaacagggccagagccccacatgagattgtcagcaggagtgaggagcgccagtccctactcctcagcagggacccagcacagcaatccggttgttctcggttagactgggtcggggccaggggagaagcagtcacccctgtgtagagggttcccgctgtgcttctgagcagttgctttgttcagaagtgttaggagggtcagattgtgccataattgttattaaagagaaaacacgcccaccttcctttctcccctgctggccattgttcattgagttttactgagggcagcctttgtggaagtcagggaggttgccaaaggcctgtagatgcctcctgacaaggtcttgattcctggttttctagcacccatttgcattttggtcttcagcacaaagccttgttccctgtggccggacttctgggcaataagactggggagtgactgttgagcagtctgctgtcaggagagatggctgaaaaggtgatcatcttggtgctaaacaagtaagaggcaactgccctgtttttgtttgttttgaggcacaatgaaactttagccaaactctgcaagagggtcccatctcctgccatggccaggtgtgagagaccaaaccgagaaaacagcatactctatcacttaagccttgggtagaatgggaattctttaccctgggtaaacgttttaacaaaaaaatggaacttaacttcggtttggactgtggtcgtgctgaggcaggagtggggttgccctcttggggctgaatctccaggcctcacgaggtcccctgtggggatgctgctatttctaagatgcaaattgcacatttcctagattttgtatctgtggatttggataagggaggggaacacggacaaattgcttgtacaatttgaaatgggcctcaatggtacttcaaaccttttgattattcctaaataaaaacataaatatat

SEQ ID NO: 372304 - DNA, 7632 bp, Homo sapiens
  misc_feature (4119)..(4119): n is a, c, g, or t
cgaatcgtaaccgttcgtacgagaatcgctgtcctctccttgctcgagatccattgtgctctaaagattaacactgtgtgttcaaatacaacgtcagctgtgaaggtggtcaatgcggcccagtcgctcctcacggcctgccccagcataacctcccaagccttccttgatgctagcatctacaaaaataagaaatctcatgaacagctgtcagctctgaaagggagcttctgtcggaaccagttcccagggcagagcgaagttgaacatctcacaaaagtgacgggcctcagtaccagagaggtgcggaaatggttcagtgatcgtagataccactgccggaacttgaagggctccagagcgatgatacctggagatcacagttccatcatcattgactctgtgccagaggtgtccttctccccatcgtccaaggtccctgaggtaacctgcattccgacaacagccacactagcaacccacccttctgccaaacgacaatcttggcaccagactcctgacttcacaccaaccaaatacaaggagagagcccctgagcagctcagagccctggagagcagttttgcacaaaaccctcttcctcttgatgaggaactggaccgcctgagaagtgaaaccaaaatgacccgacgagaaattgatagctggttttcagagagacggaaaaaagtgaatgctgaggagaccaagaaggctgaggagaatgcctctcaggaggaagaggaggctgctgaggatgagggtggagaagaggatttggccagtgagctaagggtctctggtgaaaatggctctctggaaatgcccagcagccatatcttggcagagcgcaaagtcagccccattaaaatcaacctgaagaacctgagggtcactgaagccaatggcaggaacgagattccagggctgggtgcctgtgaccctgaggatgatgagtcaaacaaactggcagagcagctcccaggcaaagtgagctgcaaaaagactgcccagcagcggcacttgctgcggcagctctttgtccagacacagtggccaagcaaccaggactatgactccatcatggcccagacgggtctgccacggccagaggtggtgcgctggtttggagatagcaggtacgcactgaagaacggccaactcaaatggtacgaagactataagcgaggcaacttcccaccagggctactggtcattgcccctggcaaccgggagctcctgcaggactattacatgacacacaagatgctgtatgaagaggacctgcagaacctctgtgacaagacccagatgagctcccagcaggtcaagcagtggtttgctgagaaaatgggggaggagaccagagccgtggcagacacaggcagtgaggaccagggccctggtactggtgagctcacagcagttcacaaagggatgggtgacacctattcagaggtgtctgagaacagtgagtcgtgggagccccgtgtccctgaggccagctcagagccctttgacacatcgagtccccaggctggacgtcagctcgaaacagactgaatttgatctgattaatgtgaaggactggccagtctgggaaaccgcctgccacgtggaagagccaaacccgactctctgctgccacatgccgttcccatgcccggctgctgggcacctgggagagcttccagaatcctcgcagacagcccagagcctgccgctaccctcggcctgcccaccaccaagcaagcagcaagcaagatggggttctcatcagttcttcctcccacaatgtaggacctttcctttaccttccaatggataaaatagttcagagttcatagtcatattcatagacacagaatcaagcttttaacatatacatccacctctatatgttaaataaaacatcagattatcaacactgtcattacgtagaaactttggttagccaagcagtgcattgtcagttacgtcatctctaaaaatgacctgtgtctgttctctggggattgctgggtcacaggtgcccctcaccttccacagtcaggcagggaagttataggcacaaagctacgtctggaacccctttgtgccccctttgtgttcctcaaggaagcagtacctttgaagagatctctgctgcattaagtgatgaccggctacgtttcatgtcaggcttgctttgccttgtgggctactcagtgcagaacctgctgtaaccctcagttcaaaaaatggactggcaatgtgattagcgttggatgctttaccattctctttagttgttaccgtaattctgctttttcatgggagtttgaatcatggaccataacttttcagttatcagatcaactaaagaaacatttgttgttaagcctaatgtgctgacctatgtgcctgcattttttttttaatctagacatgtttggagtgagagaaagatggaaaaaagacatggggtagggacgtaagtggaaatctatagccacagcctgaagctttgaccactgcggttttcagagccctttctccacactcatttcagagcctcctatggtttgggaaggaataacacactggcccattagtaagggtgaaggctggagggatttgttgacttcttggaattatcagaggtagggtggtctttagcacaaagacttgcatgcagagatccctggcagaacacccagagtgcccgtggctcccaccccagggtctggccggtgtgctggatgcatgcccaagggtgctgggcatcactggtccttgtgaggatgcttttaaagttttatatttatgtccccaaacttggaaacaagaactctactttagcctaaccctcatgtccttttttgaattgagaaaattacaggaaatggtgcctttgaaaattagaaaacttgcttacagagctgttctaaatggtaaatcctcaatttccccaagaccggttgctctgagagtagctggtaaagaggggcgaactaaagacctgtccacctgtagctccgctcatttcttagaaaccacctgcttcccagagtgccaagccacaagtaccaggcttcgtgggcacagacacctcctgggctgggcagagtgacagtgctagaagaccccagagagagggcaagggctttgggcaagaagcactggtggtgttttagggaccgtccttctcccctacccagggaactggacctggcagggcaccgtgctcatgtggctccaaggacaagcatggcggtggccccttctgccttccaggagaggtcttgcttttgaaaccaaaatcatgttcttctaaagtgtcatcttctgccctccctgtcccaatagggaccacatcttatttgtctcaaacagggacttgtgagtacttggcaagttttgcagcctatttttgtattcttaatttggggagtaaagatgtttggtctcaaaaacctttgaggaattgccaagaatggcgagtgattgctttccttcagagaacagacacttggaatttctccttttagtgtttatatacgtgcagattaatttatatatatatatatacacacacacatatacagtataaatactcatttgattctcgtaaaacgcgcatctggcgtgtgcagttgagaaacttggtggcacatgggtgttgggggagtagcctgtgttggagggacaccagtgcactaggcagctggggcggcccaggctgaagccatctccgggtgtctgagaaaccacccagtgcctcacctccagatcctgctggcatcacctccagagccctgcatgcactggctgaagagttggtctgtggagaggattttcttggttacttgtattcacggttaatttacaacccaaacagcaaaacacagttggtggacaagttcatgcaggacctacagtgacccagccatgggcactagctcatctttcaggtggaaaagtacagtgctgcctgccctggtatgtttttcttatagatgttagccctgcccaacagccagggctacactacaaaaggcaagaatgcccatgtaaggagcccagcagtctggacagatccttcttcctctgctgttggatgagagtgagtgagtatgntctggaccttatccttgaaagatgatcaaaagcgatgatgagggaggcagtcatcacgcaggtgcttaaagggacattgtaggaggtactcaagggtttgggggcaaaaccctgaatccagccagtcgtgcacagagacacacccacactagcccagtggcagtgggggatgtgggatggcagcagccaggtatgtagccctgtcacaggacagctcactgtggttttgcacactgcctaagggttaaattgtgttgttgccttcagtagaaggcatttgtgggctgcagagttgagagttgggtgaggttagtctctcctgaagaaaaagcctataaaaagtggctaatcttatcccttttctctgtatgcagttggactcgtcagagatagtaaaatcatcttttagtgtttttttgttgctgatgtcttgtacccatttgttttttacatggggttgtagatcgagttctcaaaggtgaaaccagatgatcattctgataaaggaaatttaaatttgatacatatgctttgtatattttgattacttgttttcgtttttgactataaaggagctcttttttcttgctcagagtttacctgggagatttcaccagtttgactcaccatttgcagatgtgcttttgtattaaatttaaattttcacatatcacatccattctcaaggtagttatatgctggagaagaaaaatcctctagacacatgaaggcccacatagtcaagtcttccagggcaaagccagcagcccacccaggtcaggtagccagcagggctcagttcccctcactccagacacggaccctcctcttcagggtctcttgacccagcttccttctctccttttacctgagagcacagacctctctcagccagcctgcccagaccacggggggctactcccatgtagtttggggagcacttgatctcagaaaagctccattgtctgagcaaatgggcagttgtggagctcaagcctttctcctgtgctcaagtcccttccccaagcaaggcttcaacctcatctacccaccatgtagttttctctggccatttaagtggggcggcagggacatggttgggccatgccacaccagggctggtgaggcaaccagttttgattttgacagagtggctggaggaaaagtggcaatcaaggtgctgcttggtttgctctgagtgcaaatggaaccaacaggtttctgctgcaatctgtgtgttcccagtgccaggtcacaccaggaggggtggggcagggctaaccaagtggtctctgaactcaccgagcgtctgcacttggttgtgaagttaatgggagtacagagagcgtctggccttggagaggggttgagagcctcctttttggttcttcattcctgagctcttgcctgcccacaaatctgacctctttgaatggggacgcagtccttcaacagagaagtttctatggcaaagaagtttctatttagctctagatccagcagagtcatccattctaactgccctgaagtctagagcaggggagggaacccagaggctggggatgagactaggcagaccctggttaccatatggacaaggacaggggaaagcacccccttcctcaatttctgaaagttctatctttgggttcgcaggactttgaggatgataaagaacatataggtactagcttgttgttgctggtccaaagcttccacagccctgagaatttggctttcgtggctgctctggcagctgagcgaagggaggaaggcagccgctctggtggggactctaggcaccttccctgctgtccacttggataggcggtgagccccagggtactgagaggagcctgagcatttacctgccattagtgcctcttccttcaggagactggcttgaaacgtgtgttcatgtgcgcgtgcacacacacacatgagcacctgtatgtgttaatgaatagtttttcttggttaatgctttttaacttctgttcctttccgtaagtggatgattcaaaattaacgtgacttggctgggcgcagtggctcacacctgtaatcccagcactttgggaggccaagggaggcggatcacctgaggtcaggagttcgagaccagcctgatcggcatggtgaaaccccgtttctactaaaaatacaaaaattagccgggcgtggtggtgcgcgcctgtaatcccagctactcaggaggctgaggaaggagaatcacttgaacccgggaggtggaggttgcagtgagctgagatcgtgccactgcactccagcctgggcgacagagcgaaactccgtctcaaaaaaaaaaaaaaaacttaatgtgactggagttaaaagtgaaatgtcaggttgtttagtcactgaatagagagctacaagtgcttggtctttcccaagaatcaaacctgagtagaaatacatttaaaagaaaaatctacatggtacctatgaatcctgtaatttgtttagggagatcttgtcactcatccctggttcctgcccatactgtttggtctcgttcttgcagtttgcttggaacagggccagagccccacatgagattgtcagcaggagtgaggagcgccagtccctactcctcagcagggacccagcacagcaatccggttgttctcggttagactgggtcggggccaggggagaagcagtcacccctgtgtagagggttcccgctgtgcttctgagcagttgctttgttcagaagtgttaggagggtcagattgtgccataattgttattaaagagaaaacacgcccaccttcctttctcccctgctggccattgttcattgagttttactgagggcagcctttgtggaagtcagggaggttgccaaaggcctgtagatgcctcctgacaaggtcttgattcctggttttctagcacccatttgcattttggtcttcagcacaaagccttgttccctgtggccggacttctgggcaataagactggggagtgactgttgagcagtctgctgtcaggagagatggctgaaaaggtgatcatcttggtgctaaacaagtaagaggcaactgccctgtttttgtttgttttgaggcacaatgaaactttagccaaactctgcaagagggtcccatctcctgccatggccaggtgtgagagaccaaaccgagaaaacagcatactctatcacttaagccttgggtagaatgggaattctttaccctgggtaaacgttttaacaaaaaaatggaacttaacttcggtttggactgtggtcgtgctgaggcaggagtggggttgccctcttggggctgaatctccaggcctcacgaggtcccctgtggggatgctgctatttctaagatgcaaattgcacatttcctagattttgtatctgtggatttggataagggaggggaacacggacaaattgcttgtacaatttgaaatgggcctcaatggtacttcaaaccttttgattattcctaaataaaaacataaatatat

SEQ ID NO: 372305 - DNA, 7546 bp, Homo sapiens
  misc_feature (4033)..(4033): n is a, c, g, or t
cgaatcgtaaccgttcgtacgagaatcgctgtcctctccttgctcgagatccattgtgctctaaagctcccaagccttccttgatgctagcatctacaaaaataagaaatctcatgaacagctgtcagctctgaaagggagcttctgtcggaaccagttcccagggcagagcgaagttgaacatctcacaaaagtgacgggcctcagtaccagagaggtgcggaaatggttcagtgatcgtagataccactgccggaacttgaagggctccagagcgatgatacctggagatcacagttccatcatcattgactctgtgccagaggtgtccttctccccatcgtccaaggtccctgaggtaacctgcattccgacaacagccacactagcaacccacccttctgccaaacgacaatcttggcaccagactcctgacttcacaccaaccaaatacaaggagagagcccctgagcagctcagagccctggagagcagttttgcacaaaaccctcttcctcttgatgaggaactggaccgcctgagaagtgaaaccaaaatgacccgacgagaaattgatagctggttttcagagagacggaaaaaagtgaatgctgaggagaccaagaaggctgaggagaatgcctctcaggaggaagaggaggctgctgaggatgagggtggagaagaggatttggccagtgagctaagggtctctggtgaaaatggctctctggaaatgcccagcagccatatcttggcagagcgcaaagtcagccccattaaaatcaacctgaagaacctgagggtcactgaagccaatggcaggaacgagattccagggctgggtgcctgtgaccctgaggatgatgagtcaaacaaactggcagagcagctcccaggcaaagtgagctgcaaaaagactgcccagcagcggcacttgctgcggcagctctttgtccagacacagtggccaagcaaccaggactatgactccatcatggcccagacgggtctgccacggccagaggtggtgcgctggtttggagatagcaggtacgcactgaagaacggccaactcaaatggtacgaagactataagcgaggcaacttcccaccagggctactggtcattgcccctggcaaccgggagctcctgcaggactattacatgacacacaagatgctgtatgaagaggacctgcagaacctctgtgacaagacccagatgagctcccagcaggtcaagcagtggtttgctgagaaaatgggggaggagaccagagccgtggcagacacaggcagtgaggaccagggccctggtactggtgagctcacagcagttcacaaagggatgggtgacacctattcagaggtgtctgagaacagtgagtcgtgggagccccgtgtccctgaggccagctcagagccctttgacacatcgagtccccaggctggacgtcagctcgaaacagactgaatttgatctgattaatgtgaaggactggccagtctgggaaaccgcctgccacgtggaagagccaaacccgactctctgctgccacatgccgttcccatgcccggctgctgggcacctgggagagcttccagaatcctcgcagacagcccagagcctgccgctaccctcggcctgcccaccaccaagcaagcagcaagcaagatggggttctcatcagttcttcctcccacaatgtaggacctttcctttaccttccaatggataaaatagttcagagttcatagtcatattcatagacacagaatcaagcttttaacatatacatccacctctatatgttaaataaaacatcagattatcaacactgtcattacgtagaaactttggttagccaagcagtgcattgtcagttacgtcatctctaaaaatgacctgtgtctgttctctggggattgctgggtcacaggtgcccctcaccttccacagtcaggcagggaagttataggcacaaagctacgtctggaacccctttgtgccccctttgtgttcctcaaggaagcagtacctttgaagagatctctgctgcattaagtgatgaccggctacgtttcatgtcaggcttgctttgccttgtgggctactcagtgcagaacctgctgtaaccctcagttcaaaaaatggactggcaatgtgattagcgttggatgctttaccattctctttagttgttaccgtaattctgctttttcatgggagtttgaatcatggaccataacttttcagttatcagatcaactaaagaaacatttgttgttaagcctaatgtgctgacctatgtgcctgcattttttttttaatctagacatgtttggagtgagagaaagatggaaaaaagacatggggtagggacgtaagtggaaatctatagccacagcctgaagctttgaccactgcggttttcagagccctttctccacactcatttcagagcctcctatggtttgggaaggaataacacactggcccattagtaagggtgaaggctggagggatttgttgacttcttggaattatcagaggtagggtggtctttagcacaaagacttgcatgcagagatccctggcagaacacccagagtgcccgtggctcccaccccagggtctggccggtgtgctggatgcatgcccaagggtgctgggcatcactggtccttgtgaggatgcttttaaagttttatatttatgtccccaaacttggaaacaagaactctactttagcctaaccctcatgtccttttttgaattgagaaaattacaggaaatggtgcctttgaaaattagaaaacttgcttacagagctgttctaaatggtaaatcctcaatttccccaagaccggttgctctgagagtagctggtaaagaggggcgaactaaagacctgtccacctgtagctccgctcatttcttagaaaccacctgcttcccagagtgccaagccacaagtaccaggcttcgtgggcacagacacctcctgggctgggcagagtgacagtgctagaagaccccagagagagggcaagggctttgggcaagaagcactggtggtgttttagggaccgtccttctcccctacccagggaactggacctggcagggcaccgtgctcatgtggctccaaggacaagcatggcggtggccccttctgccttccaggagaggtcttgcttttgaaaccaaaatcatgttcttctaaagtgtcatcttctgccctccctgtcccaatagggaccacatcttatttgtctcaaacagggacttgtgagtacttggcaagttttgcagcctatttttgtattcttaatttggggagtaaagatgtttggtctcaaaaacctttgaggaattgccaagaatggcgagtgattgctttccttcagagaacagacacttggaatttctccttttagtgtttatatacgtgcagattaatttatatatatatatatacacacacacatatacagtataaatactcatttgattctcgtaaaacgcgcatctggcgtgtgcagttgagaaacttggtggcacatgggtgttgggggagtagcctgtgttggagggacaccagtgcactaggcagctggggcggcccaggctgaagccatctccgggtgtctgagaaaccacccagtgcctcacctccagatcctgctggcatcacctccagagccctgcatgcactggctgaagagttggtctgtggagaggattttcttggttacttgtattcacggttaatttacaacccaaacagcaaaacacagttggtggacaagttcatgcaggacctacagtgacccagccatgggcactagctcatctttcaggtggaaaagtacagtgctgcctgccctggtatgtttttcttatagatgttagccctgcccaacagccagggctacactacaaaaggcaagaatgcccatgtaaggagcccagcagtctggacagatccttcttcctctgctgttggatgagagtgagtgagtatgntctggaccttatccttgaaagatgatcaaaagcgatgatgagggaggcagtcatcacgcaggtgcttaaagggacattgtaggaggtactcaagggtttgggggcaaaaccctgaatccagccagtcgtgcacagagacacacccacactagcccagtggcagtgggggatgtgggatggcagcagccaggtatgtagccctgtcacaggacagctcactgtggttttgcacactgcctaagggttaaattgtgttgttgccttcagtagaaggcatttgtgggctgcagagttgagagttgggtgaggttagtctctcctgaagaaaaagcctataaaaagtggctaatcttatcccttttctctgtatgcagttggactcgtcagagatagtaaaatcatcttttagtgtttttttgttgctgatgtcttgtacccatttgttttttacatggggttgtagatcgagttctcaaaggtgaaaccagatgatcattctgataaaggaaatttaaatttgatacatatgctttgtatattttgattacttgttttcgtttttgactataaaggagctcttttttcttgctcagagtttacctgggagatttcaccagtttgactcaccatttgcagatgtgcttttgtattaaatttaaattttcacatatcacatccattctcaaggtagttatatgctggagaagaaaaatcctctagacacatgaaggcccacatagtcaagtcttccagggcaaagccagcagcccacccaggtcaggtagccagcagggctcagttcccctcactccagacacggaccctcctcttcagggtctcttgacccagcttccttctctccttttacctgagagcacagacctctctcagccagcctgcccagaccacggggggctactcccatgtagtttggggagcacttgatctcagaaaagctccattgtctgagcaaatgggcagttgtggagctcaagcctttctcctgtgctcaagtcccttccccaagcaaggcttcaacctcatctacccaccatgtagttttctctggccatttaagtggggcggcagggacatggttgggccatgccacaccagggctggtgaggcaaccagttttgattttgacagagtggctggaggaaaagtggcaatcaaggtgctgcttggtttgctctgagtgcaaatggaaccaacaggtttctgctgcaatctgtgtgttcccagtgccaggtcacaccaggaggggtggggcagggctaaccaagtggtctctgaactcaccgagcgtctgcacttggttgtgaagttaatgggagtacagagagcgtctggccttggagaggggttgagagcctcctttttggttcttcattcctgagctcttgcctgcccacaaatctgacctctttgaatggggacgcagtccttcaacagagaagtttctatggcaaagaagtttctatttagctctagatccagcagagtcatccattctaactgccctgaagtctagagcaggggagggaacccagaggctggggatgagactaggcagaccctggttaccatatggacaaggacaggggaaagcacccccttcctcaatttctgaaagttctatctttgggttcgcaggactttgaggatgataaagaacatataggtactagcttgttgttgctggtccaaagcttccacagccctgagaatttggctttcgtggctgctctggcagctgagcgaagggaggaaggcagccgctctggtggggactctaggcaccttccctgctgtccacttggataggcggtgagccccagggtactgagaggagcctgagcatttacctgccattagtgcctcttccttcaggagactggcttgaaacgtgtgttcatgtgcgcgtgcacacacacacatgagcacctgtatgtgttaatgaatagtttttcttggttaatgctttttaacttctgttcctttccgtaagtggatgattcaaaattaacgtgacttggctgggcgcagtggctcacacctgtaatcccagcactttgggaggccaagggaggcggatcacctgaggtcaggagttcgagaccagcctgatcggcatggtgaaaccccgtttctactaaaaatacaaaaattagccgggcgtggtggtgcgcgcctgtaatcccagctactcaggaggctgaggaaggagaatcacttgaacccgggaggtggaggttgcagtgagctgagatcgtgccactgcactccagcctgggcgacagagcgaaactccgtctcaaaaaaaaaaaaaaaacttaatgtgactggagttaaaagtgaaatgtcaggttgtttagtcactgaatagagagctacaagtgcttggtctttcccaagaatcaaacctgagtagaaatacatttaaaagaaaaatctacatggtacctatgaatcctgtaatttgtttagggagatcttgtcactcatccctggttcctgcccatactgtttggtctcgttcttgcagtttgcttggaacagggccagagccccacatgagattgtcagcaggagtgaggagcgccagtccctactcctcagcagggacccagcacagcaatccggttgttctcggttagactgggtcggggccaggggagaagcagtcacccctgtgtagagggttcccgctgtgcttctgagcagttgctttgttcagaagtgttaggagggtcagattgtgccataattgttattaaagagaaaacacgcccaccttcctttctcccctgctggccattgttcattgagttttactgagggcagcctttgtggaagtcagggaggttgccaaaggcctgtagatgcctcctgacaaggtcttgattcctggttttctagcacccatttgcattttggtcttcagcacaaagccttgttccctgtggccggacttctgggcaataagactggggagtgactgttgagcagtctgctgtcaggagagatggctgaaaaggtgatcatcttggtgctaaacaagtaagaggcaactgccctgtttttgtttgttttgaggcacaatgaaactttagccaaactctgcaagagggtcccatctcctgccatggccaggtgtgagagaccaaaccgagaaaacagcatactctatcacttaagccttgggtagaatgggaattctttaccctgggtaaacgttttaacaaaaaaatggaacttaacttcggtttggactgtggtcgtgctgaggcaggagtggggttgccctcttggggctgaatctccaggcctcacgaggtcccctgtggggatgctgctatttctaagatgcaaattgcacatttcctagattttgtatctgtggatttggataagggaggggaacacggacaaattgcttgtacaatttgaaatgggcctcaatggtacttcaaaccttttgattattcctaaataaaaacataaatatat

SEQ ID NO: 372306 - DNA, 6889 bp, Homo sapiens
  misc_feature (3376)..(3376): n is a, c, g, or t
agcgggtgatagccgtcaaaggcagcaaatagactgaatgaaagatgagcttctgcctttatatccttctctcctgctacccaactcattgtggtgaaggaaaaagaaaacgcgggtggagactgcactatatgcttaggactgaaatgcaactgcagaagcaacatgtgaccttttagagatgcttgtgggactgcataaagtgaagagggaaactggaaaaaaacaatgaatcccttccataggaaacagggaatgtttgtttctgtcttctggtaggagaaggattggtcccacccccagctccagggatggatcttgattgtttaagcccagtcagtgattctaacccatggaccaagaccctgccttggagattggggaacaggtgttggaagggctctattttggcaaagaatggattatttatgtgagcatatttccgcaaaattgaatagggaaaacctgctttctgcaaacaactgaaaaagctgcatttagaaactgtttctttggccctcatcgagaagctggaacttgtattgttaggccccttatgggacaagctctcaactgctgatcacccagtgattgtcaccatggccagcaagaggaaatccaccacaccatgcatgatcccagtgaagactgtggtgttgcaagatgccagcatggaggcccagcccgctgagaccttgcctgaaggaccccagcaggatctgcccccagaagcatctgctgccagcagtgaggcagcacagaaccccagccctttgacacatcgagtccccaggctggacgtcagctcgaaacagactgaatttgatctgattaatgtgaaggactggccagtctgggaaaccgcctgccacgtggaagagccaaacccgactctctgctgccacatgccgttcccatgcccggctgctgggcacctgggagagcttccagaatcctcgcagacagcccagagcctgccgctaccctcggcctgcccaccaccaagcaagcagcaagcaagatggggttctcatcagttcttcctcccacaatgtaggacctttcctttaccttccaatggataaaatagttcagagttcatagtcatattcatagacacagaatcaagcttttaacatatacatccacctctatatgttaaataaaacatcagattatcaacactgtcattacgtagaaactttggttagccaagcagtgcattgtcagttacgtcatctctaaaaatgacctgtgtctgttctctggggattgctgggtcacaggtgcccctcaccttccacagtcaggcagggaagttataggcacaaagctacgtctggaacccctttgtgccccctttgtgttcctcaaggaagcagtacctttgaagagatctctgctgcattaagtgatgaccggctacgtttcatgtcaggcttgctttgccttgtgggctactcagtgcagaacctgctgtaaccctcagttcaaaaaatggactggcaatgtgattagcgttggatgctttaccattctctttagttgttaccgtaattctgctttttcatgggagtttgaatcatggaccataacttttcagttatcagatcaactaaagaaacatttgttgttaagcctaatgtgctgacctatgtgcctgcattttttttttaatctagacatgtttggagtgagagaaagatggaaaaaagacatggggtagggacgtaagtggaaatctatagccacagcctgaagctttgaccactgcggttttcagagccctttctccacactcatttcagagcctcctatggtttgggaaggaataacacactggcccattagtaagggtgaaggctggagggatttgttgacttcttggaattatcagaggtagggtggtctttagcacaaagacttgcatgcagagatccctggcagaacacccagagtgcccgtggctcccaccccagggtctggccggtgtgctggatgcatgcccaagggtgctgggcatcactggtccttgtgaggatgcttttaaagttttatatttatgtccccaaacttggaaacaagaactctactttagcctaaccctcatgtccttttttgaattgagaaaattacaggaaatggtgcctttgaaaattagaaaacttgcttacagagctgttctaaatggtaaatcctcaatttccccaagaccggttgctctgagagtagctggtaaagaggggcgaactaaagacctgtccacctgtagctccgctcatttcttagaaaccacctgcttcccagagtgccaagccacaagtaccaggcttcgtgggcacagacacctcctgggctgggcagagtgacagtgctagaagaccccagagagagggcaagggctttgggcaagaagcactggtggtgttttagggaccgtccttctcccctacccagggaactggacctggcagggcaccgtgctcatgtggctccaaggacaagcatggcggtggccccttctgccttccaggagaggtcttgcttttgaaaccaaaatcatgttcttctaaagtgtcatcttctgccctccctgtcccaatagggaccacatcttatttgtctcaaacagggacttgtgagtacttggcaagttttgcagcctatttttgtattcttaatttggggagtaaagatgtttggtctcaaaaacctttgaggaattgccaagaatggcgagtgattgctttccttcagagaacagacacttggaatttctccttttagtgtttatatacgtgcagattaatttatatatatatatatacacacacacatatacagtataaatactcatttgattctcgtaaaacgcgcatctggcgtgtgcagttgagaaacttggtggcacatgggtgttgggggagtagcctgtgttggagggacaccagtgcactaggcagctggggcggcccaggctgaagccatctccgggtgtctgagaaaccacccagtgcctcacctccagatcctgctggcatcacctccagagccctgcatgcactggctgaagagttggtctgtggagaggattttcttggttacttgtattcacggttaatttacaacccaaacagcaaaacacagttggtggacaagttcatgcaggacctacagtgacccagccatgggcactagctcatctttcaggtggaaaagtacagtgctgcctgccctggtatgtttttcttatagatgttagccctgcccaacagccagggctacactacaaaaggcaagaatgcccatgtaaggagcccagcagtctggacagatccttcttcctctgctgttggatgagagtgagtgagtatgntctggaccttatccttgaaagatgatcaaaagcgatgatgagggaggcagtcatcacgcaggtgcttaaagggacattgtaggaggtactcaagggtttgggggcaaaaccctgaatccagccagtcgtgcacagagacacacccacactagcccagtggcagtgggggatgtgggatggcagcagccaggtatgtagccctgtcacaggacagctcactgtggttttgcacactgcctaagggttaaattgtgttgttgccttcagtagaaggcatttgtgggctgcagagttgagagttgggtgaggttagtctctcctgaagaaaaagcctataaaaagtggctaatcttatcccttttctctgtatgcagttggactcgtcagagatagtaaaatcatcttttagtgtttttttgttgctgatgtcttgtacccatttgttttttacatggggttgtagatcgagttctcaaaggtgaaaccagatgatcattctgataaaggaaatttaaatttgatacatatgctttgtatattttgattacttgttttcgtttttgactataaaggagctcttttttcttgctcagagtttacctgggagatttcaccagtttgactcaccatttgcagatgtgcttttgtattaaatttaaattttcacatatcacatccattctcaaggtagttatatgctggagaagaaaaatcctctagacacatgaaggcccacatagtcaagtcttccagggcaaagccagcagcccacccaggtcaggtagccagcagggctcagttcccctcactccagacacggaccctcctcttcagggtctcttgacccagcttccttctctccttttacctgagagcacagacctctctcagccagcctgcccagaccacggggggctactcccatgtagtttggggagcacttgatctcagaaaagctccattgtctgagcaaatgggcagttgtggagctcaagcctttctcctgtgctcaagtcccttccccaagcaaggcttcaacctcatctacccaccatgtagttttctctggccatttaagtggggcggcagggacatggttgggccatgccacaccagggctggtgaggcaaccagttttgattttgacagagtggctggaggaaaagtggcaatcaaggtgctgcttggtttgctctgagtgcaaatggaaccaacaggtttctgctgcaatctgtgtgttcccagtgccaggtcacaccaggaggggtggggcagggctaaccaagtggtctctgaactcaccgagcgtctgcacttggttgtgaagttaatgggagtacagagagcgtctggccttggagaggggttgagagcctcctttttggttcttcattcctgagctcttgcctgcccacaaatctgacctctttgaatggggacgcagtccttcaacagagaagtttctatggcaaagaagtttctatttagctctagatccagcagagtcatccattctaactgccctgaagtctagagcaggggagggaacccagaggctggggatgagactaggcagaccctggttaccatatggacaaggacaggggaaagcacccccttcctcaatttctgaaagttctatctttgggttcgcaggactttgaggatgataaagaacatataggtactagcttgttgttgctggtccaaagcttccacagccctgagaatttggctttcgtggctgctctggcagctgagcgaagggaggaaggcagccgctctggtggggactctaggcaccttccctgctgtccacttggataggcggtgagccccagggtactgagaggagcctgagcatttacctgccattagtgcctcttccttcaggagactggcttgaaacgtgtgttcatgtgcgcgtgcacacacacacatgagcacctgtatgtgttaatgaatagtttttcttggttaatgctttttaacttctgttcctttccgtaagtggatgattcaaaattaacgtgacttggctgggcgcagtggctcacacctgtaatcccagcactttgggaggccaagggaggcggatcacctgaggtcaggagttcgagaccagcctgatcggcatggtgaaaccccgtttctactaaaaatacaaaaattagccgggcgtggtggtgcgcgcctgtaatcccagctactcaggaggctgaggaaggagaatcacttgaacccgggaggtggaggttgcagtgagctgagatcgtgccactgcactccagcctgggcgacagagcgaaactccgtctcaaaaaaaaaaaaaaaacttaatgtgactggagttaaaagtgaaatgtcaggttgtttagtcactgaatagagagctacaagtgcttggtctttcccaagaatcaaacctgagtagaaatacatttaaaagaaaaatctacatggtacctatgaatcctgtaatttgtttagggagatcttgtcactcatccctggttcctgcccatactgtttggtctcgttcttgcagtttgcttggaacagggccagagccccacatgagattgtcagcaggagtgaggagcgccagtccctactcctcagcagggacccagcacagcaatccggttgttctcggttagactgggtcggggccaggggagaagcagtcacccctgtgtagagggttcccgctgtgcttctgagcagttgctttgttcagaagtgttaggagggtcagattgtgccataattgttattaaagagaaaacacgcccaccttcctttctcccctgctggccattgttcattgagttttactgagggcagcctttgtggaagtcagggaggttgccaaaggcctgtagatgcctcctgacaaggtcttgattcctggttttctagcacccatttgcattttggtcttcagcacaaagccttgttccctgtggccggacttctgggcaataagactggggagtgactgttgagcagtctgctgtcaggagagatggctgaaaaggtgatcatcttggtgctaaacaagtaagaggcaactgccctgtttttgtttgttttgaggcacaatgaaactttagccaaactctgcaagagggtcccatctcctgccatggccaggtgtgagagaccaaaccgagaaaacagcatactctatcacttaagccttgggtagaatgggaattctttaccctgggtaaacgttttaacaaaaaaatggaacttaacttcggtttggactgtggtcgtgctgaggcaggagtggggttgccctcttggggctgaatctccaggcctcacgaggtcccctgtggggatgctgctatttctaagatgcaaattgcacatttcctagattttgtatctgtggatttggataagggaggggaacacggacaaattgcttgtacaatttgaaatgggcctcaatggtacttcaaaccttttgattattcctaaataaaaacataaatatat

SEQ ID NO: 372307 - DNA, 6617 bp, Homo sapiens
  misc_feature (3104)..(3104): n is a, c, g, or t
cgaatcgtaaccgttcgtacgagaatcgctgtcctctccttgctcgagatccattgtgctctaaagtgtgaaaagacctagatggtagaaggcaagcagtggaatgtgtctgggtatccgagaaatatacagaaagcacttaagagaacttaatcatttttttctccctttccttagattgaatagggaaaacctgctttctgcaaacaactgaaaaagctgcatttagaaactgtttctttggccctcatcgagaagctggaacttgtattgttaggccccttatgggacaagctctcaactgctgatcacccagtgattgtcaccatggccagcaagaggaaatccaccacaccatgcatgatcccagtgaagactgtggtgttgcaagatgccagcatggaggcccagcccgctgagaccttgcctgaaggaccccagcaggatctgcccccagaagcatctgctgccagcagtgaggcagcacagaaccccagccctttgacacatcgagtccccaggctggacgtcagctcgaaacagactgaatttgatctgattaatgtgaaggactggccagtctgggaaaccgcctgccacgtggaagagccaaacccgactctctgctgccacatgccgttcccatgcccggctgctgggcacctgggagagcttccagaatcctcgcagacagcccagagcctgccgctaccctcggcctgcccaccaccaagcaagcagcaagcaagatggggttctcatcagttcttcctcccacaatgtaggacctttcctttaccttccaatggataaaatagttcagagttcatagtcatattcatagacacagaatcaagcttttaacatatacatccacctctatatgttaaataaaacatcagattatcaacactgtcattacgtagaaactttggttagccaagcagtgcattgtcagttacgtcatctctaaaaatgacctgtgtctgttctctggggattgctgggtcacaggtgcccctcaccttccacagtcaggcagggaagttataggcacaaagctacgtctggaacccctttgtgccccctttgtgttcctcaaggaagcagtacctttgaagagatctctgctgcattaagtgatgaccggctacgtttcatgtcaggcttgctttgccttgtgggctactcagtgcagaacctgctgtaaccctcagttcaaaaaatggactggcaatgtgattagcgttggatgctttaccattctctttagttgttaccgtaattctgctttttcatgggagtttgaatcatggaccataacttttcagttatcagatcaactaaagaaacatttgttgttaagcctaatgtgctgacctatgtgcctgcattttttttttaatctagacatgtttggagtgagagaaagatggaaaaaagacatggggtagggacgtaagtggaaatctatagccacagcctgaagctttgaccactgcggttttcagagccctttctccacactcatttcagagcctcctatggtttgggaaggaataacacactggcccattagtaagggtgaaggctggagggatttgttgacttcttggaattatcagaggtagggtggtctttagcacaaagacttgcatgcagagatccctggcagaacacccagagtgcccgtggctcccaccccagggtctggccggtgtgctggatgcatgcccaagggtgctgggcatcactggtccttgtgaggatgcttttaaagttttatatttatgtccccaaacttggaaacaagaactctactttagcctaaccctcatgtccttttttgaattgagaaaattacaggaaatggtgcctttgaaaattagaaaacttgcttacagagctgttctaaatggtaaatcctcaatttccccaagaccggttgctctgagagtagctggtaaagaggggcgaactaaagacctgtccacctgtagctccgctcatttcttagaaaccacctgcttcccagagtgccaagccacaagtaccaggcttcgtgggcacagacacctcctgggctgggcagagtgacagtgctagaagaccccagagagagggcaagggctttgggcaagaagcactggtggtgttttagggaccgtccttctcccctacccagggaactggacctggcagggcaccgtgctcatgtggctccaaggacaagcatggcggtggccccttctgccttccaggagaggtcttgcttttgaaaccaaaatcatgttcttctaaagtgtcatcttctgccctccctgtcccaatagggaccacatcttatttgtctcaaacagggacttgtgagtacttggcaagttttgcagcctatttttgtattcttaatttggggagtaaagatgtttggtctcaaaaacctttgaggaattgccaagaatggcgagtgattgctttccttcagagaacagacacttggaatttctccttttagtgtttatatacgtgcagattaatttatatatatatatatacacacacacatatacagtataaatactcatttgattctcgtaaaacgcgcatctggcgtgtgcagttgagaaacttggtggcacatgggtgttgggggagtagcctgtgttggagggacaccagtgcactaggcagctggggcggcccaggctgaagccatctccgggtgtctgagaaaccacccagtgcctcacctccagatcctgctggcatcacctccagagccctgcatgcactggctgaagagttggtctgtggagaggattttcttggttacttgtattcacggttaatttacaacccaaacagcaaaacacagttggtggacaagttcatgcaggacctacagtgacccagccatgggcactagctcatctttcaggtggaaaagtacagtgctgcctgccctggtatgtttttcttatagatgttagccctgcccaacagccagggctacactacaaaaggcaagaatgcccatgtaaggagcccagcagtctggacagatccttcttcctctgctgttggatgagagtgagtgagtatgntctggaccttatccttgaaagatgatcaaaagcgatgatgagggaggcagtcatcacgcaggtgcttaaagggacattgtaggaggtactcaagggtttgggggcaaaaccctgaatccagccagtcgtgcacagagacacacccacactagcccagtggcagtgggggatgtgggatggcagcagccaggtatgtagccctgtcacaggacagctcactgtggttttgcacactgcctaagggttaaattgtgttgttgccttcagtagaaggcatttgtgggctgcagagttgagagttgggtgaggttagtctctcctgaagaaaaagcctataaaaagtggctaatcttatcccttttctctgtatgcagttggactcgtcagagatagtaaaatcatcttttagtgtttttttgttgctgatgtcttgtacccatttgttttttacatggggttgtagatcgagttctcaaaggtgaaaccagatgatcattctgataaaggaaatttaaatttgatacatatgctttgtatattttgattacttgttttcgtttttgactataaaggagctcttttttcttgctcagagtttacctgggagatttcaccagtttgactcaccatttgcagatgtgcttttgtattaaatttaaattttcacatatcacatccattctcaaggtagttatatgctggagaagaaaaatcctctagacacatgaaggcccacatagtcaagtcttccagggcaaagccagcagcccacccaggtcaggtagccagcagggctcagttcccctcactccagacacggaccctcctcttcagggtctcttgacccagcttccttctctccttttacctgagagcacagacctctctcagccagcctgcccagaccacggggggctactcccatgtagtttggggagcacttgatctcagaaaagctccattgtctgagcaaatgggcagttgtggagctcaagcctttctcctgtgctcaagtcccttccccaagcaaggcttcaacctcatctacccaccatgtagttttctctggccatttaagtggggcggcagggacatggttgggccatgccacaccagggctggtgaggcaaccagttttgattttgacagagtggctggaggaaaagtggcaatcaaggtgctgcttggtttgctctgagtgcaaatggaaccaacaggtttctgctgcaatctgtgtgttcccagtgccaggtcacaccaggaggggtggggcagggctaaccaagtggtctctgaactcaccgagcgtctgcacttggttgtgaagttaatgggagtacagagagcgtctggccttggagaggggttgagagcctcctttttggttcttcattcctgagctcttgcctgcccacaaatctgacctctttgaatggggacgcagtccttcaacagagaagtttctatggcaaagaagtttctatttagctctagatccagcagagtcatccattctaactgccctgaagtctagagcaggggagggaacccagaggctggggatgagactaggcagaccctggttaccatatggacaaggacaggggaaagcacccccttcctcaatttctgaaagttctatctttgggttcgcaggactttgaggatgataaagaacatataggtactagcttgttgttgctggtccaaagcttccacagccctgagaatttggctttcgtggctgctctggcagctgagcgaagggaggaaggcagccgctctggtggggactctaggcaccttccctgctgtccacttggataggcggtgagccccagggtactgagaggagcctgagcatttacctgccattagtgcctcttccttcaggagactggcttgaaacgtgtgttcatgtgcgcgtgcacacacacacatgagcacctgtatgtgttaatgaatagtttttcttggttaatgctttttaacttctgttcctttccgtaagtggatgattcaaaattaacgtgacttggctgggcgcagtggctcacacctgtaatcccagcactttgggaggccaagggaggcggatcacctgaggtcaggagttcgagaccagcctgatcggcatggtgaaaccccgtttctactaaaaatacaaaaattagccgggcgtggtggtgcgcgcctgtaatcccagctactcaggaggctgaggaaggagaatcacttgaacccgggaggtggaggttgcagtgagctgagatcgtgccactgcactccagcctgggcgacagagcgaaactccgtctcaaaaaaaaaaaaaaaacttaatgtgactggagttaaaagtgaaatgtcaggttgtttagtcactgaatagagagctacaagtgcttggtctttcccaagaatcaaacctgagtagaaatacatttaaaagaaaaatctacatggtacctatgaatcctgtaatttgtttagggagatcttgtcactcatccctggttcctgcccatactgtttggtctcgttcttgcagtttgcttggaacagggccagagccccacatgagattgtcagcaggagtgaggagcgccagtccctactcctcagcagggacccagcacagcaatccggttgttctcggttagactgggtcggggccaggggagaagcagtcacccctgtgtagagggttcccgctgtgcttctgagcagttgctttgttcagaagtgttaggagggtcagattgtgccataattgttattaaagagaaaacacgcccaccttcctttctcccctgctggccattgttcattgagttttactgagggcagcctttgtggaagtcagggaggttgccaaaggcctgtagatgcctcctgacaaggtcttgattcctggttttctagcacccatttgcattttggtcttcagcacaaagccttgttccctgtggccggacttctgggcaataagactggggagtgactgttgagcagtctgctgtcaggagagatggctgaaaaggtgatcatcttggtgctaaacaagtaagaggcaactgccctgtttttgtttgttttgaggcacaatgaaactttagccaaactctgcaagagggtcccatctcctgccatggccaggtgtgagagaccaaaccgagaaaacagcatactctatcacttaagccttgggtagaatgggaattctttaccctgggtaaacgttttaacaaaaaaatggaacttaacttcggtttggactgtggtcgtgctgaggcaggagtggggttgccctcttggggctgaatctccaggcctcacgaggtcccctgtggggatgctgctatttctaagatgcaaattgcacatttcctagattttgtatctgtggatttggataagggaggggaacacggacaaattgcttgtacaatttgaaatgggcctcaatggtacttcaaaccttttgattattcctaaataaaaacataaatatat

SEQ ID NO: 372308 - DNA, 8239 bp, Homo sapiens
  misc_feature (5847)..(5847): n is a, c, g, or t
ccggagtcggttggtgcagctgcgtccccgccgctcagcagtccgcggctccggcgtcgccgccgccgccgcctctgcggggcctgcgccggccgcccgcccggccgcggggagggaggcccgcagcgcgggaagagcggcccggtcgcgggcgccgccaccgccgccgctgccaggactgaaatgcaactgcagaagcaacatgtgaccttttagagatgcttgtgggactgcataaagtgaagagggaaactggaaaaaaacaatgaaattgaatagggaaaacctgctttctgcaaacaactgaaaaagctgcatttagaaactgtttctttggccctcatcgagaagctggaacttgtattgttaggccccttatgggacaagctctcaactgctgatcacccagtgattgtcaccatggccagcaagaggaaatccaccacaccatgcatgatcccagtgaagactgtggtgttgcaagatgccagcatggaggcccagcccgctgagaccttgcctgaaggaccccagcaggatctgcccccagaagcatctgctgccagcagtgaggcagcacagaaccccagcagtactgatggctctacactggccaatgggcatcggagcactttagatggctatttatattcctgtaaatactgcgatttcagatcccatgacatgacccaatttgtgggacatatgaactcagagcacacagactttaataaagacccaacctttgtatgcagtgggtgcagttttctggcaaaaacccctgaggggctttccttgcacaatgccacatgtcactccggggaagccagctttgtgtggaacgtggccaagccagacaatcatgtggttgtggagcagagcatccctgagagcaccagcactcctgacctagcgggtgagcccagtgctgaaggggctgatggacaggcagaaatcatcattaccaaaactccaatcatgaagataatgaaaggcaaagctgaagccaaaaaaattcatacactcaaggagaatgtccctagccagcctgtgggtgaggccttaccaaagctgtcgactggagaaatggaggtgagagagggggaccattccttcatcaatggggcagttccagtcagccaggcatctgccagctctgcaaaaaacccccatgccgccaacgggcccctgataggaacagtgccagttttgccagctggcatagcacagttcctctccctccagcagcagcccccagtgcatgcccaacaccatgtccaccagccactgcccacggccaaggcccttcccaaagtgatgatccccctgagcagcattccaacgtacagtgcagccatggactctaacagcttcctgaagaactccttccacaagttcccctaccccaccaaagccgagctctgctatttgactgtggtgaccaagtatccagaagaacagctcaagatctggttcacagcccaaaggctgaagcaggggatcagctggtcccctgaggagattgaggatgcccggaaaaagatgttcaatacagtcatccagtctgtgcctcagcccacaattacggttctaaataccccactcgtcgccagtgctggcaatgtccagcatctcatccaggccgctcttccaggtcacgttgtggggcagccagagggtacaggagggggacttctggtcactcagccattgatggccaatgggttgcaagcaacaagttcccctctccccctcacggtgacatccgtccccaagcagccaggtgtggcacccattaacactgtgtgttcaaatacaacgtcagctgtgaaggtggtcaatgcggcccagtcgctcctcacggcctgccccagcataacctcccaagccttccttgatgctagcatctacaaaaataagaaatctcatgaacagctgtcagctctgaaagggagcttctgtcggaaccagttcccagggcagagcgaagttgaacatctcacaaaagtgacgggcctcagtaccagagaggtgcggaaatggttcagtgatcgtagataccactgccggaacttgaagggctccagagcgatgatacctggagatcacagttccatcatcattgactctgtgccagaggtgtccttctccccatcgtccaaggtccctgaggtaacctgcattccgacaacagccacactagcaacccacccttctgccaaacgacaatcttggcaccagactcctgacttcacaccaaccaaatacaaggagagagcccctgagcagctcagagccctggagagcagttttgcacaaaaccctcttcctcttgatgaggaactggaccgcctgagaagtgaaaccaaaatgacccgacgagaaattgatagctggttttcagagagacggaaaaaagtgaatgctgaggagaccaagaaggctgaggagaatgcctctcaggaggaagaggaggctgctgaggatgagggtggagaagaggatttggccagtgagctaagggtctctggtgaaaatggctctctggaaatgcccagcagccatatcttggcagagcgcaaagtcagccccattaaaatcaacctgaagaacctgagggtcactgaagccaatggcaggaacgagattccagggctgggtgcctgtgaccctgaggatgatgagtcaaacaaactggcagagcagctcccaggcaaagtgagctgcaaaaagactgcccagcagcggcacttgctgcggcagctctttgtccagacacagtggccaagcaaccaggactatgactccatcatggcccagacgggtctgccacggccagaggtggtgcgctggtttggagatagcaggtacgcactgaagaacggccaactcaaatggtacgaagactataagcgaggcaacttcccaccagggctactggtcattgcccctggcaaccgggagctcctgcaggactattacatgacacacaagatgctgtatgaagaggacctgcagaacctctgtgacaagacccagatgagctcccagcaggtcaagcagtggtttgctgagaaaatgggggaggagaccagagccgtggcagacacaggcagtgaggaccagggccctggtactggtgagctcacagcagttcacaaagggatgggtgacacctattcagaggtgtctgagaacagtgagtcgtgggagccccgtgtccctgaggccagctcagagccctttgacacatcgagtccccaggctggacgtcagctcgaaacagactgaatttgatctgattaatgtgaaggactggccagtctgggaaaccgcctgccacgtggaagagccaaacccgactctctgctgccacatgccgttcccatgcccggctgctgggcacctgggagagcttccagaatcctcgcagacagcccagagcctgccgctaccctcggcctgcccaccaccaagcaagcagcaagcaagatggggttctcatcagttcttcctcccacaatgtaggacctttcctttaccttccaatggataaaatagttcagagttcatagtcatattcatagacacagaatcaagcttttaacatatacatccacctctatatgttaaataaaacatcagattatcaacactgtcattacgtagaaactttggttagccaagcagtgcattgtcagttacgtcatctctaaaaatgacctgtgtctgttctctggggattgctgggtcacaggtgcccctcaccttccacagtcaggcagggaagttataggcacaaagctacgtctggaacccctttgtgccccctttgtgttcctcaaggaagcagtacctttgaagagatctctgctgcattaagtgatgaccggctacgtttcatgtcaggcttgctttgccttgtgggctactcagtgcagaacctgctgtaaccctcagttcaaaaaatggactggcaatgtgattagcgttggatgctttaccattctctttagttgttaccgtaattctgctttttcatgggagtttgaatcatggaccataacttttcagttatcagatcaactaaagaaacatttgttgttaagcctaatgtgctgacctatgtgcctgcattttttttttaatctagacatgtttggagtgagagaaagatggaaaaaagacatggggtagggacgtaagtggaaatctatagccacagcctgaagctttgaccactgcggttttcagagccctttctccacactcatttcagagcctcctatggtttgggaaggaataacacactggcccattagtaagggtgaaggctggagggatttgttgacttcttggaattatcagaggtagggtggtctttagcacaaagacttgcatgcagagatccctggcagaacacccagagtgcccgtggctcccaccccagggtctggccggtgtgctggatgcatgcccaagggtgctgggcatcactggtccttgtgaggatgcttttaaagttttatatttatgtccccaaacttggaaacaagaactctactttagcctaaccctcatgtccttttttgaattgagaaaattacaggaaatggtgcctttgaaaattagaaaacttgcttacagagctgttctaaatggtaaatcctcaatttccccaagaccggttgctctgagagtagctggtaaagaggggcgaactaaagacctgtccacctgtagctccgctcatttcttagaaaccacctgcttcccagagtgccaagccacaagtaccaggcttcgtgggcacagacacctcctgggctgggcagagtgacagtgctagaagaccccagagagagggcaagggctttgggcaagaagcactggtggtgttttagggaccgtccttctcccctacccagggaactggacctggcagggcaccgtgctcatgtggctccaaggacaagcatggcggtggccccttctgccttccaggagaggtcttgcttttgaaaccaaaatcatgttcttctaaagtgtcatcttctgccctccctgtcccaatagggaccacatcttatttgtctcaaacagggacttgtgagtacttggcaagttttgcagcctatttttgtattcttaatttggggagtaaagatgtttggtctcaaaaacctttgaggaattgccaagaatggcgagtgattgctttccttcagagaacagacacttggaatttctccttttagtgtttatatacgtgcagattaatttatatatatatatatacacacacacatatacagtataaatactcatttgattctcgtaaaacgcgcatctggcgtgtgcagttgagaaacttggtggcacatgggtgttgggggagtagcctgtgttggagggacaccagtgcactaggcagctggggcggcccaggctgaagccatctccgggtgtctgagaaaccacccagtgcctcacctccagatcctgctggcatcacctccagagccctgcatgcactggctgaagagttggtctgtggagaggattttcttggttacttgtattcacggttaatttacaacccaaacagcaaaacacagttggtggacaagttcatgcaggacctacagtgacccagccatgggcactagctcatctttcaggtggaaaagtacagtgctgcctgccctggtatgtttttcttatagatgttagccctgcccaacagccagggctacactacaaaaggcaagaatgcccatgtaaggagcccagcagtctggacagatccttcttcctctgctgttggatgagagtgagtgagtatgntctggaccttatccttgaaagatgatcaaaagcgatgatgagggaggcagtcatcacgcaggtgcttaaagggacattgtaggaggtactcaagggtttgggggcaaaaccctgaatccagccagtcgtgcacagagacacacccacactagcccagtggcagtgggggatgtgggatggcagcagccaggtatgtagccctgtcacaggacagctcactgtggttttgcacactgcctaagggttaaattgtgttgttgccttcagtagaaggcatttgtgggctgcagagttgagagttgggtgaggttagtctctcctgaagaaaaagcctataaaaagtggctaatcttatcccttttctctgtatgcagttggactcgtcagagatagtaaaatcatcttttagtgtttttttgttgctgatgtcttgtacccatttgttttttacatggggttgtagatcgagttctcaaaggtgaaaccagatgatcattctgataaaggaaatttaaatttgatacatatgctttgtatattttgattacttgttttcgtttttgactataaaggagctcttttttcttgctcagagtttacctgggagatttcaccagtttgactcaccatttgcagatgtgcttttgtattaaatttaaattttcacatatcacatccattctcaaggtagttatatgctggagaagaaaaatcctctagacacatgaaggcccacatagtcaagtcttccagggcaaagccagcagcccacccaggtcaggtagccagcagggctcagttcccctcactccagacacggaccctcctcttcagggtctcttgacccagcttccttctctccttttacctgagagcacagacctctctcagccagcctgcccagaccacggggggctactcccatgtagtttggggagcacttgatctcagaaaagctccattgtctgagcaaatgggcagttgtggagctcaagcctttctcctgtgctcaagtcccttccccaagcaaggcttcaacctcatctacccaccatgtagttttctctggccatttaagtggggcggcagggacatggttgggccatgccacaccagggctggtgaggcaaccagttttgattttgacagagtggctggaggaaaagtggcaatcaaggtgctgcttggtttgctctgagtgcaaatggaaccaacaggtttctgctgcaatctgtgtgttcccagtgccaggtcacaccaggaggggtggggcagggctaaccaagtggtctctgaactcaccgagcgtctgcacttggttgtgaagttaatgggagtacagagagcgtctggccttggagaggggttgagagcctcctttttggttcttcattcctgagctcttgcctgcccacaaatctgacctctttgaatggggacgcagtccttcaacagagaagtttctatggcaaagaagtttctatttagctctagatccagcagagtcatccattctaactgccctgaagtctagagcaggggagggaacccagaggctggggatgagactaggcagaccctggttaccatatggacaaggacaggggaaagcacccccttcctcaatttctgaaagttctatctttgggttcgcaggactttgaggatgataaagaacatataggtactagcttgttgttgctggtccaaagcttccacagccctgagaatttggctttcgtggctgctctggcagctgagcgaagggaggaaggcagccgctctggtggggactctaggcaccttccctgctgtccacttggataggcggtgagccccagggtactgagaggagcctgagcatttacctgccattagtgcctcttccttcaggagactggcttgaaacgtgtgttcatgtgcgcgtgcacacacacacatgagcacctgtatgtgttaatgaatagtttttcttggttaatgctttttaacttctgttcctttccgtaagtggatgattcaaaattaacgtgacttggctgggcgcagtggctcacacctgtaatcccagcactttgggaggccaagggaggcggatcacctgaggtcaggagttcgagaccagcctgatcggcatggtgaaaccccgtttctactaaaaatacaaaaattagccgggcgtggtggtgcgcgcctgtaatcccagctactcaggaggctgaggaaggagaatcacttgaacccgggaggtggaggttgcagtgagctgagatcgtgccactgcactccagcctgggcgacagagcgaaactccgtctcaaaaaaaaaaaaaaaactcgacctactaccagacaaccttagccaaaccatttacccaaataaaggataggcg

SEQ ID NO: 372309 - DNA, 6688 bp, Homo sapiens
  misc_feature (5847)..(5847): n is a, c, g, or t
ccggagtcggttggtgcagctgcgtccccgccgctcagcagtccgcggctccggcgtcgccgccgccgccgcctctgcggggcctgcgccggccgcccgcccggccgcggggagggaggcccgcagcgcgggaagagcggcccggtcgcgggcgccgccaccgccgccgctgccaggactgaaatgcaactgcagaagcaacatgtgaccttttagagatgcttgtgggactgcataaagtgaagagggaaactggaaaaaaacaatgaaattgaatagggaaaacctgctttctgcaaacaactgaaaaagctgcatttagaaactgtttctttggccctcatcgagaagctggaacttgtattgttaggccccttatgggacaagctctcaactgctgatcacccagtgattgtcaccatggccagcaagaggaaatccaccacaccatgcatgatcccagtgaagactgtggtgttgcaagatgccagcatggaggcccagcccgctgagaccttgcctgaaggaccccagcaggatctgcccccagaagcatctgctgccagcagtgaggcagcacagaaccccagcagtactgatggctctacactggccaatgggcatcggagcactttagatggctatttatattcctgtaaatactgcgatttcagatcccatgacatgacccaatttgtgggacatatgaactcagagcacacagactttaataaagacccaacctttgtatgcagtgggtgcagttttctggcaaaaacccctgaggggctttccttgcacaatgccacatgtcactccggggaagccagctttgtgtggaacgtggccaagccagacaatcatgtggttgtggagcagagcatccctgagagcaccagcactcctgacctagcgggtgagcccagtgctgaaggggctgatggacaggcagaaatcatcattaccaaaactccaatcatgaagataatgaaaggcaaagctgaagccaaaaaaattcatacactcaaggagaatgtccctagccagcctgtgggtgaggccttaccaaagctgtcgactggagaaatggaggtgagagagggggaccattccttcatcaatggggcagttccagtcagccaggcatctgccagctctgcaaaaaacccccatgccgccaacgggcccctgataggaacagtgccagttttgccagctggcatagcacagttcctctccctccagcagcagcccccagtgcatgcccaacaccatgtccaccagccactgcccacggccaaggcccttcccaaagtgatgatccccctgagcagcattccaacgtacagtgcagccatggactctaacagcttcctgaagaactccttccacaagttcccctaccccaccaaagccgagctctgctatttgactgtggtgaccaagtatccagaagaacagctcaagatctggttcacagcccaaaggctgaagcaggggatcagctggtcccctgaggagattgaggatgcccggaaaaagatgttcaatacagtcatccagtctgtgcctcagcccacaattacggttctaaataccccactcgtcgccagtgctggcaatgtccagcatctcatccaggccgctcttccaggtcacgttgtggggcagccagagggtacaggagggggacttctggtcactcagccattgatggccaatgggttgcaagcaacaagttcccctctccccctcacggtgacatccgtccccaagcagccaggtgtggcacccattaacactgtgtgttcaaatacaacgtcagctgtgaaggtggtcaatgcggcccagtcgctcctcacggcctgccccagcataacctcccaagccttccttgatgctagcatctacaaaaataagaaatctcatgaacagctgtcagctctgaaagggagcttctgtcggaaccagttcccagggcagagcgaagttgaacatctcacaaaagtgacgggcctcagtaccagagaggtgcggaaatggttcagtgatcgtagataccactgccggaacttgaagggctccagagcgatgatacctggagatcacagttccatcatcattgactctgtgccagaggtgtccttctccccatcgtccaaggtccctgaggtaacctgcattccgacaacagccacactagcaacccacccttctgccaaacgacaatcttggcaccagactcctgacttcacaccaaccaaatacaaggagagagcccctgagcagctcagagccctggagagcagttttgcacaaaaccctcttcctcttgatgaggaactggaccgcctgagaagtgaaaccaaaatgacccgacgagaaattgatagctggttttcagagagacggaaaaaagtgaatgctgaggagaccaagaaggctgaggagaatgcctctcaggaggaagaggaggctgctgaggatgagggtggagaagaggatttggccagtgagctaagggtctctggtgaaaatggctctctggaaatgcccagcagccatatcttggcagagcgcaaagtcagccccattaaaatcaacctgaagaacctgagggtcactgaagccaatggcaggaacgagattccagggctgggtgcctgtgaccctgaggatgatgagtcaaacaaactggcagagcagctcccaggcaaagtgagctgcaaaaagactgcccagcagcggcacttgctgcggcagctctttgtccagacacagtggccaagcaaccaggactatgactccatcatggcccagacgggtctgccacggccagaggtggtgcgctggtttggagatagcaggtacgcactgaagaacggccaactcaaatggtacgaagactataagcgaggcaacttcccaccagggctactggtcattgcccctggcaaccgggagctcctgcaggactattacatgacacacaagatgctgtatgaagaggacctgcagaacctctgtgacaagacccagatgagctcccagcaggtcaagcagtggtttgctgagaaaatgggggaggagaccagagccgtggcagacacaggcagtgaggaccagggccctggtactggtgagctcacagcagttcacaaagggatgggtgacacctattcagaggtgtctgagaacagtgagtcgtgggagccccgtgtccctgaggccagctcagagccctttgacacatcgagtccccaggctggacgtcagctcgaaacagactgaatttgatctgattaatgtgaaggactggccagtctgggaaaccgcctgccacgtggaagagccaaacccgactctctgctgccacatgccgttcccatgcccggctgctgggcacctgggagagcttccagaatcctcgcagacagcccagagcctgccgctaccctcggcctgcccaccaccaagcaagcagcaagcaagatggggttctcatcagttcttcctcccacaatgtaggacctttcctttaccttccaatggataaaatagttcagagttcatagtcatattcatagacacagaatcaagcttttaacatatacatccacctctatatgttaaataaaacatcagattatcaacactgtcattacgtagaaactttggttagccaagcagtgcattgtcagttacgtcatctctaaaaatgacctgtgtctgttctctggggattgctgggtcacaggtgcccctcaccttccacagtcaggcagggaagttataggcacaaagctacgtctggaacccctttgtgccccctttgtgttcctcaaggaagcagtacctttgaagagatctctgctgcattaagtgatgaccggctacgtttcatgtcaggcttgctttgccttgtgggctactcagtgcagaacctgctgtaaccctcagttcaaaaaatggactggcaatgtgattagcgttggatgctttaccattctctttagttgttaccgtaattctgctttttcatgggagtttgaatcatggaccataacttttcagttatcagatcaactaaagaaacatttgttgttaagcctaatgtgctgacctatgtgcctgcattttttttttaatctagacatgtttggagtgagagaaagatggaaaaaagacatggggtagggacgtaagtggaaatctatagccacagcctgaagctttgaccactgcggttttcagagccctttctccacactcatttcagagcctcctatggtttgggaaggaataacacactggcccattagtaagggtgaaggctggagggatttgttgacttcttggaattatcagaggtagggtggtctttagcacaaagacttgcatgcagagatccctggcagaacacccagagtgcccgtggctcccaccccagggtctggccggtgtgctggatgcatgcccaagggtgctgggcatcactggtccttgtgaggatgcttttaaagttttatatttatgtccccaaacttggaaacaagaactctactttagcctaaccctcatgtccttttttgaattgagaaaattacaggaaatggtgcctttgaaaattagaaaacttgcttacagagctgttctaaatggtaaatcctcaatttccccaagaccggttgctctgagagtagctggtaaagaggggcgaactaaagacctgtccacctgtagctccgctcatttcttagaaaccacctgcttcccagagtgccaagccacaagtaccaggcttcgtgggcacagacacctcctgggctgggcagagtgacagtgctagaagaccccagagagagggcaagggctttgggcaagaagcactggtggtgttttagggaccgtccttctcccctacccagggaactggacctggcagggcaccgtgctcatgtggctccaaggacaagcatggcggtggccccttctgccttccaggagaggtcttgcttttgaaaccaaaatcatgttcttctaaagtgtcatcttctgccctccctgtcccaatagggaccacatcttatttgtctcaaacagggacttgtgagtacttggcaagttttgcagcctatttttgtattcttaatttggggagtaaagatgtttggtctcaaaaacctttgaggaattgccaagaatggcgagtgattgctttccttcagagaacagacacttggaatttctccttttagtgtttatatacgtgcagattaatttatatatatatatatacacacacacatatacagtataaatactcatttgattctcgtaaaacgcgcatctggcgtgtgcagttgagaaacttggtggcacatgggtgttgggggagtagcctgtgttggagggacaccagtgcactaggcagctggggcggcccaggctgaagccatctccgggtgtctgagaaaccacccagtgcctcacctccagatcctgctggcatcacctccagagccctgcatgcactggctgaagagttggtctgtggagaggattttcttggttacttgtattcacggttaatttacaacccaaacagcaaaacacagttggtggacaagttcatgcaggacctacagtgacccagccatgggcactagctcatctttcaggtggaaaagtacagtgctgcctgccctggtatgtttttcttatagatgttagccctgcccaacagccagggctacactacaaaaggcaagaatgcccatgtaaggagcccagcagtctggacagatccttcttcctctgctgttggatgagagtgagtgagtatgntctggaccttatccttgaaagatgatcaaaagcgatgatgagggaggcagtcatcacgcaggtgcttaaagggacattgtaggaggtactcaagggtttgggggcaaaaccctgaatccagccagtcgtgcacagagacacacccacactagcccagtggcagtgggggatgtgggatggcagcagccaggtatgtagccctgtcacaggacagctcactgtggttttgcacactgcctaagggttaaattgtgttgttgccttcagtagaaggcatttgtgggctgcagagttgagagttgggtgaggttagtctctcctgaagaaaaagcctataaaaagtggctaatcttatcccttttctctgtatgcagttggactcgtcagagatagtaaaatcatcttttagtgtttttttgttgctgatgtcttgtacccatttgttttttacatggggttgtagatcgagttctcaaaggtgaaaccagatgatcattctgataaaggaaatttaaatttgatacatatgctttgtatattttgattacttgttttcgtttttgactataaaggagcttttttattttgggaggggaggagtgtcatttttgagaatcttgggttcctgaaaaagaacgccctagttggatggcttgccagggccttggggtttggtagtgattgtacaacttaaagctcctttctcttggctgagtgacaggtggctgttcaggtggaccaaagcaccttgacacaaggactccacactgtgctctctagtagcacaaggaggaagttggacagaacattgggtagtgccttgcgggctcacacatgtact

SEQ ID NO: 372310 - DNA, 2124 bp, Homo sapiens
ccggagtcggttggtgcagctgcgtccccgccgctcagcagtccgcggctccggcgtcgccgccgccgccgcctctgcggggcctgcgccggccgcccgcccggccgcggggagggaggcccgcagcgcgggaagagcggcccggtcgcgggcgccgccaccgccgccgctgccaggactgaaatgcaactgcagaagcaacatgtgaccttttagagatgcttgtgggactgcataaagtgaagagggaaactggaaaaaaacaatgaaattgaatagggaaaacctgctttctgcaaacaactgaaaaagctgcatttagaaactgtttctttggccctcatcgagaagctggaacttgtattgttaggccccttatgggacaagctctcaactgctgatcacccagtgattgtcaccatggccagcaagaggaaatccaccacaccatgcatgatcccagtgaagactgtggtgttgcaagatgccagcatggaggcccagcccgctgagaccttgcctgaaggaccccagcaggatctgcccccagaagcatctgctgccagcagtgaggcagcacagaaccccagcagtactgatggctctacactggccaatgggcatcggagcactttagatggctatttatattcctgtaaatactgcgatttcagatcccatgacatgacccaatttgtgggacatatgaactcagagcacacagactttaataaagacccaacctttgtatgcagtgggtgcagttttctggcaaaaacccctgaggggctttccttgcacaatgccacatgtcactccggggaagccagctttgtgtggaacgtggccaagccagacaatcatgtggttgtggagcagagcatccctgagagcaccagcactcctgacctagcgggtgagcccagtgctgaaggggctgatggacaggcagaaatcatcattaccaaaactccaatcatgaagataatgaaaggcaaagctgaagccaaaaaaattcatacactcaaggagaatgtccctagccagcctgtgggtgaggccttaccaaagctgtcgactggagaaatggaggtgagagagggggaccattccttcatcaatggggcagttccagtcagccaggcatctgccagctctgcaaaaaacccccatgccgccaacgggcccctgataggaacagtgccagttttgccagctggcatagcacagttcctctccctccagcagcagcccccagtgcatgcccaacaccatgtccaccagccactgcccacggccaaggcccttcccaaagtgatgatccccctgagcagcattccaacgtacagtgcagccatggactctaacagcttcctgaagaactccttccacaagttcccctaccccaccaaagccgagctctgctatttgactgtggtgaccaagtatccagaagaacagctcaagatctggttcacagcccaaaggctgaagcaggggatcagctggtcccctgaggagattgaggatgcccggaaaaagatgttcaatacagtcatccagtctgtgcctcagcccacaattacggttctaaataccccactcgtcgccagtgctggcaatgtccagcatctcatccaggccgctcttccaggtcacgttgtggggcagccagagggtacaggagggggacttctggtcactcagccattgatggccaatgggttgcaagcaacaagttcccctctccccctcacggtgacatccgtccccaagcagccaggtgtggcacccattaacactgtgtgttcaaatacaacgtcagctgtgaaggtggtcaatgcggcccagtcgctcctcacggcctgccccagcataacctcccaagccttccttgatgctagcatctacaaaaataagaaatctcatgaacagctgtcagctctgaaagggagcttctgtcggaaccagttcccagggcagagcgaagttgaacatctcacaaaagtgcgcctgggtgcagaagtgcgcctgggtgcagaagtgcgcctgggtgcagaagtgcgcctgggtgcagaagtgcgcctgggtgcagaagtgcgccgggagcagaaggcgcctggt

SEQ ID NO: 372311 - DNA, 1186 bp, Homo sapiens
  misc_feature (2)..(3): n is a, c, g, or t
  misc_feature (1185)..(1185): n is a, c, g, or t
gnngataatgcagagcatgtgaagggagaccggctcggtctctctctctcccagtggactagaaggagcagagagttgtgctgtttctcccattctttacagctcaccggatgtaaaagaactctggctagagaccctccaaggacagaggcacagccacacgggagtgaaatccacccctggacagtcagccgcaatactgatgaagctgagaagcagccacaatgcttcaaaaacactaaacgccaataatatggagacactaatcgaatgtcaatcagagggtgatatcaaggaacatcccctgttggcatcatgtgagagtgaagacagtatttgccagctcattgaagttaagaagagaaagaaggtgctgtcctggccctttctcatgagaaggctctcccctgcatcagatttttctggggctttggagacagacttgaaagcatcgctatttgatcagcccttgtcaattatctgcggtgacagtgacacactccccagacccatccaggacattctcactattctatgccttaaaggcccttcaacggaagggatattcaggagagcagccaacgagaaagcccgtaaggagctgaaggaggagctcaactctggggatgcggtggatctggagaggctccccgtgcacctcctcgctgtggtctttaaggacttcctcagaagtatcccccggaagctactttcaagcgacctctttgaggagtggatgggtgctctggagatgcaggacgaggaggacagaatcgaggccctgaaacaggttgcagataagctcccccggcccaacctcctgctactcaagcacttggtctatgtgctgcacctcatcagcaagaactctgaggtgaacaggatggactccagcaatctggccatctgcattggacccaacatgctcaccctggagaatgaccagagcctgtcatttgaagcccagaaggacctgaacaacaaggtttgttctgcttactgatgagaaatccccaacttatgatctcaccatctgtttgccaagtccaggcaataaaatgcttcagaatgtctccaactgactcagaatcacagtgaaaatataaaatgcaaaatgcttttgtcatagttccactctctcagatacatgtatctaatgaaactgaataaatccgtgtcttctgnc

SEQ ID NO: 372312 - DNA, 471 bp, Homo sapiens
tgagagttggagtcgtatttcaagtgggaccagaatttatacaatctgggctacaggccagttctcccttggctcgcttgatgaagtagaactaggaactacaactatgaactggctctatgccacagctcacaattttccatcttcggtcacgatggagcccttgtagcccttgacagcagaactgttacacatgaggtctttgatccatggcaaaccctttcttgaagtagcagttttatcattgtggcccttccttcctcagaattcctaataagggagggaggatcccggcctaacctcagctctcctgttctcctcagacctctgtgtgagcggcggaagtttcttcatgacaacatggttgaaattccaaaccggatcatgttctcagaaatgaagcgagtcacagtaagtgaagaccctatgctaggcagtgtcctagaagtttgaaagcagggcagagaactc

SEQ ID NO: 372313 - DNA, 3465 bp, Homo sapiens
tgcgcctgcgcgctgcctcccgctctaggacccggatttaaagagacaggcgctccaaccgtcgtgggctgcccgcggcctgtaatgagcaagttccgaggcctacggtgagcgccggagccggagaggcagctatatgtctttggctttcaagatcttctttccacaaaccctccgtgcactcagccgaaaagaactgtgcctattccgaaaacatcactggcgtgatgtaagacaattcagccagtggtcagaaacagatctgcttcatggacatcccctcttcctgagaagaaagcctgttctatcattccagggaagccatctaagatcacgtgccacctaccttgttttcttgccagggttgcatgtgggactctgcagtggcccctgtgagatggctgagcaacggttctgtgtggactatgccaagcgtggcacagctggctgcaaaaaatgcaaggaaaagattgtgaagggcgtatgccgaattggcaaagtggtgcccaatcccttctcagagtctgggggtgatatgaaagagtggtaccacattaaatgcatgtttgagaaactagagcgggcccgggccaccacaaaaaaaatcgaggacctcacagagctggaaggctgggaagagctggaagataatgagaaggaacagataacccagcacattgcagatctgtcttctaaggcagcaggtacaccaaagaagaaagctgttgtccaggctaagttgacaaccactggccaggtgacttctccagtgaaaggcgcctcatttgtcaccagtaccaatccccggaaattttctggcttttcagccaagcccaacaactctggggaagccccctcgagccccacccctaagagaagtctgtcttcaagcaaatgtgaccccaggcataaggactgtctgctacgggagtttcgaaagttatgcgccatggtggccgataatcctagctacaacacgaagacccagatcatccaggacttccttcggaaaggctcagcaggagatggtttccacggtgatgtgtacctaacagtgaagctgctgctgccaggagtcattaagactgtttacaacttgaacgataagcagattgtgaagcttttcagtcgcatttttaactgcaacccagatgatatggcacgggacctagagcagggtgacgtgtcagagacaatcagagtcttctttgagcagagcaagtctttccccccagctgccaagagcctccttaccatccaggaagtggatgagttccttctgcggctgtccaagctcaccaaggaggatgagcagcaacaggccctacaggacattgcctccaggtgtacagccaatgaccttaaatgcatcatcaggttgatcaaacatgatctgaagatgaactcaggtgcaaaacatgtgttagacgcccttgaccccaatgcctatgaagccttcaaagcctcgcgcaacctgcaggatgtggtggagcgggtccttcacaacgcgcaggaggtggagaaggagccgggccagagacgagctctgagcgtccaggcctcgctgatgacacctgtgcagcccatgttggcggaggcctgcaagtccgttgagtatgcaatgaagaaatgtcccaatggcatgttctctgagatcaagtacgatggagagcgagtccaggtgcataagaatggagaccacttcagctacttcagccgcagtctcaagcccgtccttcctcacaaggtggcccactttaaggactacattccccaggcttttcctgggggccacagcatgatcttggattctgaagtgcttctgattgacaacaagacaggcaaaccactgccctttgggactctgggagtacacaagaaagcagccttccaggatgctaatgtctgcctgtttgtttttgattgtatctactttaatgatgtcagcttgatggacagacctctgtgtgagcggcggaagtttcttcatgacaacatggttgaaattccaaaccggatcatgttctcagaaatgaagcgagtcacaaaagctttggacttggctgacatgataacccgggtgatccaggagggattggaggggctggtgctgaaggatgtgaagggtacatatgagcctgggaagcggcactggctgaaagtgaagaaagactatttgaacgagggggccatggccgacacagctgacctggtggtccttggagccttctatgggcaagggagcaaaggcggcatgatgtcaatcttcctcatgggctgctacgaccctggcagccagaagtggtgcacagtcaccaagtgtgcaggaggccatgatgatgccacgcttgcccgcctgcagaatgaactagacatggtgaagatcagcaaggaccccagcaaaatacccagctggttgaaggtcaacaagatctactatcctgacttcatcgtcccagacccaaagaaagctgccgtgtgggagatcacaggggctgaattctccaaatcggaggctcatacagctgacgggatctccatccgattccctcgctgcacccgaatccgagatgataaggactggaaatctgccactaaccttccccaactcaaggaactgtaccagttgtccaaggagaaggcagacttcactgtagtggctggagatgaggggagctccactacagggggtagcagtgaagagaataagggtccctcagggtctgctgtgtcccgcaaggcccccagcaagccctcagccagtaccaagaaagcagaagggaagctgagtaactccaacagcaaagatggcaacatgcagactgcaaagccttccgctatgaaggtgggggagaagctggccacaaagtcttctccagtgaaagtaggggagaagcggaaagctgctgatgagacgctgtgccaaacaaaggtattgctggacatcttcactggggtgcggctttacttgccaccctccacaccagacttcagccgtctcagacgctactttgtggcattcgacggggacctggtacaggaatttgatatgacttcagccacgcacgtgctgggtagcagggacaagaaccctgcggcccagcaggtctccccagagtggatttgggcatgtatccggaaacggagactggtagctccctgctaggtttgctgtcttccctctccctcaggccatactctcctttaccatactattggactggactcaggctggaggcagatagacacagtatagggggaatgggcttgcttctcccaaacccaccagttctccactgtctcttctggaccaggaattagttgctgtgggtgccacagctgaagtcagtttgtcttgctggtttaaatagatctttcagagctgggtgctgggtttgccatctttttgttttctttgaaaagcagcttagttaccctttttataaataaaatatcttgcagtta

SEQ ID NO: 372314 - DNA, 3731 bp, Homo sapiens
tgcgcctgcgcgctgcctcccgctctaggacccggatttaaagagacaggcgctccaaccgtcgtgggctgcccgcggcctgtaatgagcaagttccgaggcctacggtgagcgccggagccggagaggcagctatatgtctttggctttcaagatcttctttccacaaaccctccgtgcactcagccgaaaagaactgtgcctattccgaaaacatcactggcgtgatgtaagacaattcagccagtggtcagaaacagatctgcttcatggacatcccctcttcctgagaagaaagcctgttctatcattccagggaagccatctaagatcacgtgccacctaccttgttttcttgccagggttgcatgtgggactctgcagtggcccctgtgagatggctgagcaacggttctgtgtggactatgccaagcgtggcacagctggctgcaaaaaatgcaaggaaaagattgtgaagggcgtatgccgaattggcaaagtggtgcccaatcccttctcagagtctgggggtgatatgaaagagtggtaccacattaaatgcatgtttgagaaactagagcgggcccgggccaccacaaaaaaaatcgaggacctcacagagctggaaggctgggaagagctggaagataatgagaaggaacagataacccagcacattgcagatctgtcttctaaggcagcaggtacaccaaagaagaaagctgttgtccaggctaagttgacaaccactggccaggtgacttctccagtgaaaggcgcctcatttgtcaccagtaccaatccccggaaattttctggcttttcagccaagcccaacaactctggggaagccccctcgagccccacccctaagagaagtctgtcttcaagcaaatgtgaccccaggcataaggactgtctgctacgggagtttcgaaagttatgcgccatggtggccgataatcctagctacaacacgaagacccagatcatccaggacttccttcggaaaggctcagcaggagatggtttccacggtgatgtgtacctaacagtgaagctgctgctgccaggagtcattaagactgtttacaacttgaacgataagcagattgtgaagcttttcagtcgcatttttaactgcaacccagatgatatggcacgggacctagagcagggtgacgtgtcagagacaatcagagtcttctttgagcagagcaagtctttccccccagctgccaagagcctccttaccatccaggaagtggatgagttccttctgcggctgtccaagctcaccaaggaggatgagcagcaacaggccctacaggacattgcctccaggtgtacagccaatgaccttaaatgcatcatcaggttgatcaaacatgatctgaagatgaactcaggtgcaaaacatgtgttagacgcccttgaccccaatgcctatgaagccttcaaagcctcgcgcaacctgcaggatgtggtggagcgggtccttcacaacgcgcaggaggtggagaaggagccgggccagagacgagctctgagcgtccaggcctcgctgatgacacctgtgcagcccatgttggcggaggcctgcaagtccgttgagtatgcaatgaagaaatgtcccaatggcatgttctctgagatcaagtacgatggagagcgagtccaggtgcataagaatggagaccacttcagctacttcagccgcagtctcaagcccgtccttcctcacaaggtggcccactttaaggactacattccccaggcttttcctgggggccacagcatgatcttggattctgaagtgcttctgattgacaacaagacaggcaaaccactgccctttgggactctgggagtacacaagaaagcagccttccaggatgctaatgtctgcctgtttgtttttgattgtatctactttaatgatgtcagcttgatggacagacctctgtgtgagcggcggaagtttcttcatgacaacatggttgaaattccaaaccggatcatgttctcagaaatgaagcgagtcacaaaagctttggacttggctgacatgataacccgggtgatccaggagggattggaggggctggtgctgaaggatgtgaagggtacatatgagcctgggaagcggcactggctgaaagtgaagaaagactatttgaacgagggggccatggccgacacagctgacctggtggtccttggagccttctatgggcaagggagcaaaggcggcatgatgtcaatcttcctcatgggctgctacgaccctggcagccagaagtggtgcacagtcaccaagtgtgcaggaggccatgatgatgccacgcttgcccgcctgcagaatgaactagacatggtgaagatcagcaaggaccccagcaaaatacccagctggttgaaggtcaacaagatctactatcctgacttcatcgtcccagacccaaagaaagctgccgtgtgggagatcacaggggctgaattctccaaatcggaggctcatacagctgacgggatctccatccgattccctcgctgcacccgaatccgagatgataaggactggaaatctgccactaaccttccccaactcaaggaactgtaccagttgtccaaggagaaggcagacttcactgtagtggctggagatgaggggagctccactacagggggtagcagtgaagagaataagggtccctcagggtctgctgtgtcccgcaaggcccccagcaagccctcagccagtaccaagaaagcagaagggaagctgagtaactccaacagcaaagatggcaacatgcagactgcaaagccttccgctatgaaggtgggggagaagctggccacaaagtcttctccagtgaaagtaggggagaagcggaaagctgctgatgagacgctgtgccaaacaaaggtattgctggacatcttcactggggtgcggctttacttgccaccctccacaccagacttcagccgtctcagacgctactttgtggcattcgacggggacctggtacaggaatttgatatgacttcagccacgcacgtgctgggtagcagggacaagaaccctgcggcccagcaggtctccccagagtggatttgggcatgtatccggaaacggagactggtagctccctgctaggtttgctgtcttccctctccctcaggccatactctcctttaccatactattggactggactcaggctggaggcagatagacacagtatagggggaatgggcttgcttctcccaaacccaccagttctccactgtctcttctggaccaggaattagttgctgtgggtgccacagctgaagtcagtttgtcttgctggtttaaatagatctttcagagctgggtgctgggtttgccatctttttgttttctttgaaaagcagcttagttaccctttttataaataaaatatcttgcagttatctttgtcctttccccacctacacccccaataatttccctagagattaaggagtaaaggctgggctatggcagctctgtccacaaagccttctctcccatccttgcctgttcctttgtacttccaggctcattttaaagttgtatttaaaggactgccctcggaaatgcttctgtttagcggaacttgtattcagcctgacacgctttgccaggaacaaacctcatgtgaaagaaaacaaaatgaatttttttactttcttctctg

SEQ ID NO: 372315 - DNA, 3180 bp, Homo sapiens
tgcgcctgcgcgctgcctcccgctctaggacccggatttaaagagacaggcgctccaaccgtcgtgggctgcccgcggcctgtaatgagcaagttccgaggcctacggtgagcgccggagccggagaggcagatctgtcttctaaggcagcaggtacaccaaagaagaaagctgttgtccaggctaagttgacaaccactggccaggtgacttctccagtgaaaggcgcctcatttgtcaccagtaccaatccccggaaattttctggcttttcagccaagcccaacaactctggggaagccccctcgagccccacccctaagagaagtctgtcttcaagcaaatgtgaccccaggcataaggactgtctgctacgggagtttcgaaagttatgcgccatggtggccgataatcctagctacaacacgaagacccagatcatccaggacttccttcggaaaggctcagcaggagatggtttccacggtgatgtgtacctaacagtgaagctgctgctgccaggagtcattaagactgtttacaacttgaacgataagcagattgtgaagcttttcagtcgcatttttaactgcaacccagatgatatggcacgggacctagagcagggtgacgtgtcagagacaatcagagtcttctttgagcagagcaagtctttccccccagctgccaagagcctccttaccatccaggaagtggatgagttccttctgcggctgtccaagctcaccaaggaggatgagcagcaacaggccctacaggacattgcctccaggtgtacagccaatgaccttaaatgcatcatcaggttgatcaaacatgatctgaagatgaactcaggtgcaaaacatgtgttagacgcccttgaccccaatgcctatgaagccttcaaagcctcgcgcaacctgcaggatgtggtggagcgggtccttcacaacgcgcaggaggtggagaaggagccgggccagagacgagctctgagcgtccaggcctcgctgatgacacctgtgcagcccatgttggcggaggcctgcaagtccgttgagtatgcaatgaagaaatgtcccaatggcatgttctctgagatcaagtacgatggagagcgagtccaggtgcataagaatggagaccacttcagctacttcagccgcagtctcaagcccgtccttcctcacaaggtggcccactttaaggactacattccccaggcttttcctgggggccacagcatgatcttggattctgaagtgcttctgattgacaacaagacaggcaaaccactgccctttgggactctgggagtacacaagaaagcagccttccaggatgctaatgtctgcctgtttgtttttgattgtatctactttaatgatgtcagcttgatggacagacctctgtgtgagcggcggaagtttcttcatgacaacatggttgaaattccaaaccggatcatgttctcagaaatgaagcgagtcacaaaagctttggacttggctgacatgataacccgggtgatccaggagggattggaggggctggtgctgaaggatgtgaagggtacatatgagcctgggaagcggcactggctgaaagtgaagaaagactatttgaacgagggggccatggccgacacagctgacctggtggtccttggagccttctatgggcaagggagcaaaggcggcatgatgtcaatcttcctcatgggctgctacgaccctggcagccagaagtggtgcacagtcaccaagtgtgcaggaggccatgatgatgccacgcttgcccgcctgcagaatgaactagacatggtgaagatcagcaaggaccccagcaaaatacccagctggttgaaggtcaacaagatctactatcctgacttcatcgtcccagacccaaagaaagctgccgtgtgggagatcacaggggctgaattctccaaatcggaggctcatacagctgacgggatctccatccgattccctcgctgcacccgaatccgagatgataaggactggaaatctgccactaaccttccccaactcaaggaactgtaccagttgtccaaggagaaggcagacttcactgtagtggctggagatgaggggagctccactacagggggtagcagtgaagagaataagggtccctcagggtctgctgtgtcccgcaaggcccccagcaagccctcagccagtaccaagaaagcagaagggaagctgagtaactccaacagcaaagatggcaacatgcagactgcaaagccttccgctatgaaggtgggggagaagctggccacaaagtcttctccagtgaaagtaggggagaagcggaaagctgctgatgagacgctgtgccaaacaaaggtattgctggacatcttcactggggtgcggctttacttgccaccctccacaccagacttcagccgtctcagacgctactttgtggcattcgacggggacctggtacaggaatttgatatgacttcagccacgcacgtgctgggtagcagggacaagaaccctgcggcccagcaggtctccccagagtggatttgggcatgtatccggaaacggagactggtagctccctgctaggtttgctgtcttccctctccctcaggccatactctcctttaccatactattggactggactcaggctggaggcagatagacacagtatagggggaatgggcttgcttctcccaaacccaccagttctccactgtctcttctggaccaggaattagttgctgtgggtgccacagctgaagtcagtttgtcttgctggtttaaatagatctttcagagctgggtgctgggtttgccatctttttgttttctttgaaaagcagcttagttaccctttttataaataaaatatcttgcagttatctttgtcctttccccacctacacccccaataatttccctagagattaaggagtaaaggctgggctatggcagctctgtccacaaagccttctctcccatccttgcctgttcctttgtacttccaggctcattttaaagttgtatttaaaggactgccctcggaaatgcttctgtttagcggaacttgtattcagcctgacacgctttgccaggaacaaacctcatgtgaaagaaaacaaaatgaatttttttactttcttctctg

SEQ ID NO: 372316 - DNA, 3706 bp, Homo sapiens
tgcgcctgcgcgctgcctcccgctctaggacccggatttaaagagacaggcgctccaaccgtcgtgggctgcccgcggcctgtaatgagcaagttccgaggcctacgctatatgtctttggctttcaagatcttctttccacaaaccctccgtgcactcagccgaaaagaactgtgcctattccgaaaacatcactggcgtgatgtaagacaattcagccagtggtcagaaacagatctgcttcatggacatcccctcttcctgagaagaaagcctgttctatcattccagggaagccatctaagatcacgtgccacctaccttgttttcttgccagggttgcatgtgggactctgcagtggcccctgtgagatggctgagcaacggttctgtgtggactatgccaagcgtggcacagctggctgcaaaaaatgcaaggaaaagattgtgaagggcgtatgccgaattggcaaagtggtgcccaatcccttctcagagtctgggggtgatatgaaagagtggtaccacattaaatgcatgtttgagaaactagagcgggcccgggccaccacaaaaaaaatcgaggacctcacagagctggaaggctgggaagagctggaagataatgagaaggaacagataacccagcacattgcagatctgtcttctaaggcagcaggtacaccaaagaagaaagctgttgtccaggctaagttgacaaccactggccaggtgacttctccagtgaaaggcgcctcatttgtcaccagtaccaatccccggaaattttctggcttttcagccaagcccaacaactctggggaagccccctcgagccccacccctaagagaagtctgtcttcaagcaaatgtgaccccaggcataaggactgtctgctacgggagtttcgaaagttatgcgccatggtggccgataatcctagctacaacacgaagacccagatcatccaggacttccttcggaaaggctcagcaggagatggtttccacggtgatgtgtacctaacagtgaagctgctgctgccaggagtcattaagactgtttacaacttgaacgataagcagattgtgaagcttttcagtcgcatttttaactgcaacccagatgatatggcacgggacctagagcagggtgacgtgtcagagacaatcagagtcttctttgagcagagcaagtctttccccccagctgccaagagcctccttaccatccaggaagtggatgagttccttctgcggctgtccaagctcaccaaggaggatgagcagcaacaggccctacaggacattgcctccaggtgtacagccaatgaccttaaatgcatcatcaggttgatcaaacatgatctgaagatgaactcaggtgcaaaacatgtgttagacgcccttgaccccaatgcctatgaagccttcaaagcctcgcgcaacctgcaggatgtggtggagcgggtccttcacaacgcgcaggaggtggagaaggagccgggccagagacgagctctgagcgtccaggcctcgctgatgacacctgtgcagcccatgttggcggaggcctgcaagtccgttgagtatgcaatgaagaaatgtcccaatggcatgttctctgagatcaagtacgatggagagcgagtccaggtgcataagaatggagaccacttcagctacttcagccgcagtctcaagcccgtccttcctcacaaggtggcccactttaaggactacattccccaggcttttcctgggggccacagcatgatcttggattctgaagtgcttctgattgacaacaagacaggcaaaccactgccctttgggactctgggagtacacaagaaagcagccttccaggatgctaatgtctgcctgtttgtttttgattgtatctactttaatgatgtcagcttgatggacagacctctgtgtgagcggcggaagtttcttcatgacaacatggttgaaattccaaaccggatcatgttctcagaaatgaagcgagtcacaaaagctttggacttggctgacatgataacccgggtgatccaggagggattggaggggctggtgctgaaggatgtgaagggtacatatgagcctgggaagcggcactggctgaaagtgaagaaagactatttgaacgagggggccatggccgacacagctgacctggtggtccttggagccttctatgggcaagggagcaaaggcggcatgatgtcaatcttcctcatgggctgctacgaccctggcagccagaagtggtgcacagtcaccaagtgtgcaggaggccatgatgatgccacgcttgcccgcctgcagaatgaactagacatggtgaagatcagcaaggaccccagcaaaatacccagctggttgaaggtcaacaagatctactatcctgacttcatcgtcccagacccaaagaaagctgccgtgtgggagatcacaggggctgaattctccaaatcggaggctcatacagctgacgggatctccatccgattccctcgctgcacccgaatccgagatgataaggactggaaatctgccactaaccttccccaactcaaggaactgtaccagttgtccaaggagaaggcagacttcactgtagtggctggagatgaggggagctccactacagggggtagcagtgaagagaataagggtccctcagggtctgctgtgtcccgcaaggcccccagcaagccctcagccagtaccaagaaagcagaagggaagctgagtaactccaacagcaaagatggcaacatgcagactgcaaagccttccgctatgaaggtgggggagaagctggccacaaagtcttctccagtgaaagtaggggagaagcggaaagctgctgatgagacgctgtgccaaacaaaggtattgctggacatcttcactggggtgcggctttacttgccaccctccacaccagacttcagccgtctcagacgctactttgtggcattcgacggggacctggtacaggaatttgatatgacttcagccacgcacgtgctgggtagcagggacaagaaccctgcggcccagcaggtctccccagagtggatttgggcatgtatccggaaacggagactggtagctccctgctaggtttgctgtcttccctctccctcaggccatactctcctttaccatactattggactggactcaggctggaggcagatagacacagtatagggggaatgggcttgcttctcccaaacccaccagttctccactgtctcttctggaccaggaattagttgctgtgggtgccacagctgaagtcagtttgtcttgctggtttaaatagatctttcagagctgggtgctgggtttgccatctttttgttttctttgaaaagcagcttagttaccctttttataaataaaatatcttgcagttatctttgtcctttccccacctacacccccaataatttccctagagattaaggagtaaaggctgggctatggcagctctgtccacaaagccttctctcccatccttgcctgttcctttgtacttccaggctcattttaaagttgtatttaaaggactgccctcggaaatgcttctgtttagcggaacttgtattcagcctgacacgctttgccaggaacaaacctcatgtgaaagaaaacaaaatgaatttttttactttcttctctg

SEQ ID NO: 372317 - DNA, 3501 bp, Homo sapiens
tgcgcctgcgcgctgcctcccgctctaggacccggatttaaagagacaggcgctccaaccgtcgtgggctgcccgcggcctgtaatgagcaagttccgaggcctacggtgagcgccggagccggagaggcagggttgcatgtgggactctgcagtggcccctgtgagatggctgagcaacggttctgtgtggactatgccaagcgtggcacagctggctgcaaaaaatgcaaggaaaagattgtgaagggcgtatgccgaattggcaaagtggtgcccaatcccttctcagagtctgggggtgatatgaaagagtggtaccacattaaatgcatgtttgagaaactagagcgggcccgggccaccacaaaaaaaatcgaggacctcacagagctggaaggctgggaagagctggaagataatgagaaggaacagataacccagcacattgcagatctgtcttctaaggcagcaggtacaccaaagaagaaagctgttgtccaggctaagttgacaaccactggccaggtgacttctccagtgaaaggcgcctcatttgtcaccagtaccaatccccggaaattttctggcttttcagccaagcccaacaactctggggaagccccctcgagccccacccctaagagaagtctgtcttcaagcaaatgtgaccccaggcataaggactgtctgctacgggagtttcgaaagttatgcgccatggtggccgataatcctagctacaacacgaagacccagatcatccaggacttccttcggaaaggctcagcaggagatggtttccacggtgatgtgtacctaacagtgaagctgctgctgccaggagtcattaagactgtttacaacttgaacgataagcagattgtgaagcttttcagtcgcatttttaactgcaacccagatgatatggcacgggacctagagcagggtgacgtgtcagagacaatcagagtcttctttgagcagagcaagtctttccccccagctgccaagagcctccttaccatccaggaagtggatgagttccttctgcggctgtccaagctcaccaaggaggatgagcagcaacaggccctacaggacattgcctccaggtgtacagccaatgaccttaaatgcatcatcaggttgatcaaacatgatctgaagatgaactcaggtgcaaaacatgtgttagacgcccttgaccccaatgcctatgaagccttcaaagcctcgcgcaacctgcaggatgtggtggagcgggtccttcacaacgcgcaggaggtggagaaggagccgggccagagacgagctctgagcgtccaggcctcgctgatgacacctgtgcagcccatgttggcggaggcctgcaagtccgttgagtatgcaatgaagaaatgtcccaatggcatgttctctgagatcaagtacgatggagagcgagtccaggtgcataagaatggagaccacttcagctacttcagccgcagtctcaagcccgtccttcctcacaaggtggcccactttaaggactacattccccaggcttttcctgggggccacagcatgatcttggattctgaagtgcttctgattgacaacaagacaggcaaaccactgccctttgggactctgggagtacacaagaaagcagccttccaggatgctaatgtctgcctgtttgtttttgattgtatctactttaatgatgtcagcttgatggacagacctctgtgtgagcggcggaagtttcttcatgacaacatggttgaaattccaaaccggatcatgttctcagaaatgaagcgagtcacaaaagctttggacttggctgacatgataacccgggtgatccaggagggattggaggggctggtgctgaaggatgtgaagggtacatatgagcctgggaagcggcactggctgaaagtgaagaaagactatttgaacgagggggccatggccgacacagctgacctggtggtccttggagccttctatgggcaagggagcaaaggcggcatgatgtcaatcttcctcatgggctgctacgaccctggcagccagaagtggtgcacagtcaccaagtgtgcaggaggccatgatgatgccacgcttgcccgcctgcagaatgaactagacatggtgaagatcagcaaggaccccagcaaaatacccagctggttgaaggtcaacaagatctactatcctgacttcatcgtcccagacccaaagaaagctgccgtgtgggagatcacaggggctgaattctccaaatcggaggctcatacagctgacgggatctccatccgattccctcgctgcacccgaatccgagatgataaggactggaaatctgccactaaccttccccaactcaaggaactgtaccagttgtccaaggagaaggcagacttcactgtagtggctggagatgaggggagctccactacagggggtagcagtgaagagaataagggtccctcagggtctgctgtgtcccgcaaggcccccagcaagccctcagccagtaccaagaaagcagaagggaagctgagtaactccaacagcaaagatggcaacatgcagactgcaaagccttccgctatgaaggtgggggagaagctggccacaaagtcttctccagtgaaagtaggggagaagcggaaagctgctgatgagacgctgtgccaaacaaaggtattgctggacatcttcactggggtgcggctttacttgccaccctccacaccagacttcagccgtctcagacgctactttgtggcattcgacggggacctggtacaggaatttgatatgacttcagccacgcacgtgctgggtagcagggacaagaaccctgcggcccagcaggtctccccagagtggatttgggcatgtatccggaaacggagactggtagctccctgctaggtttgctgtcttccctctccctcaggccatactctcctttaccatactattggactggactcaggctggaggcagatagacacagtatagggggaatgggcttgcttctcccaaacccaccagttctccactgtctcttctggaccaggaattagttgctgtgggtgccacagctgaagtcagtttgtcttgctggtttaaatagatctttcagagctgggtgctgggtttgccatctttttgttttctttgaaaagcagcttagttaccctttttataaataaaatatcttgcagttatctttgtcctttccccacctacacccccaataatttccctagagattaaggagtaaaggctgggctatggcagctctgtccacaaagccttctctcccatccttgcctgttcctttgtacttccaggctcattttaaagttgtatttaaaggactgccctcggaaatgcttctgtttagcggaacttgtattcagcctgacacgctttgccaggaacaaacctcatgtgaaagaaaacaaaatgaatttttttactttcttctctg

SEQ ID NO: 372318 - DNA, 3750 bp, Homo sapiens
tgcgcctgcgcgctgcctcccgctctaggacccggatttaaagagacaggcgctccaaccgtcgtgggctgcccgcggcctgtaatgagcaagttccgaggcctacggtgagcgccggagccggagaggcagctatatgtctttggctttcaagatcttctttccacaaaccctccgtgcactcagccgaaaagaactgtgcctattccgaaaacatcactggcgtgatgtaagacaattcagccagtggtcagaaacagatctgcttcatggacatcccctcttcctgagaagaaagcctgttctatcattccagggaagccatctaagatcacgtgccacctaccttgttttcttgccagggttgcatgtgggactctgcagtggcccctgtgagatggctgagcaacggttctgtgtggactatgccaagcgtggcacagctggctgcaaaaaatgcaaggaaaagattgtgaagggcgtatgccgaattggcaaagtggtgcccaatcccttctcagagtctgggggtgatatgaaagagtggtaccacattaaatgcatgtttgagaaactagagcgggcccgggccaccacaaaaaaaatcgaggacctcacagagctggaaggctgggaagagctggaagataatgagaaggaacagataacccagcacattgcagatctgtcttctaaggcagcaggtacaccaaagaagaaagctgttgtccaggctaagttgacaaccactggccaggtgacttctccagtgaaaggcgcctcatttgtcaccagtaccaatccccggaaattttctggcttttcagccaagcccaacaactctggggaagccccctcgagccccacccctaagagaagtctgtcttcaagcaaatgtgaccccaggcataaggactgtctgctacgggagtttcgaaagttatgcgccatggtggccgataatcctagctacaacacgaagacccagatcatccaggacttccttcggaaaggctcagcaggagatggtttccacggtgatgtgtacctaacagtgaagctgctgctgccaggagtcattaagactgtttacaacttgaacgataagcagattgtgaagcttttcagtcgcatttttaactgcaacccagatgatatggcacgggacctagagcagggtgacgtgtcagagacaatcagagtcttctttgagcagagcaagtctttccccccagctgccaagagcctccttaccatccaggaagtggatgagttccttctgcggctgtccaagctcaccaaggaggatgagcagcaacaggccctacaggacattgcctccaggtgtacagccaatgaccttaaatgcatcatcaggttgatcaaacatgatctgaagatgaactcaggtgcaaaacatgtgttagacgcccttgaccccaatgcctatgaagccttcaaagcctcgcgcaacctgcaggatgtggtggagcgggtccttcacaacgcgcaggaggtggagaaggagccgggccagagacgagctctgagcgtccaggcctcgctgatgacacctgtgcagcccatgttggcggaggcctgcaagtccgttgagtatgcaatgaagaaatgtcccaatggcatgttctctgagatcaagtacgatggagagcgagtccaggtgcataagaatggagaccacttcagctacttcagccgcagtctcaagcccgtccttcctcacaaggtggcccactttaaggactacattccccaggcttttcctgggggccacagcatgatcttggattctgaagtgcttctgattgacaacaagacaggcaaaccactgccctttgggactctgggagtacacaagaaagcagccttccaggatgctaatgtctgcctgtttgtttttgattgtatctactttaatgatgtcagcttgatggacagacctctgtgtgagcggcggaagtttcttcatgacaacatggttgaaattccaaaccggatcatgttctcagaaatgaagcgagtcacacatctctcttgtccctcagaaagctttggacttggctgacatgataacccgggtgatccaggagggattggaggggctggtgctgaaggatgtgaagggtacatatgagcctgggaagcggcactggctgaaagtgaagaaagactatttgaacgagggggccatggccgacacagctgacctggtggtccttggagccttctatgggcaagggagcaaaggcggcatgatgtcaatcttcctcatgggctgctacgaccctggcagccagaagtggtgcacagtcaccaagtgtgcaggaggccatgatgatgccacgcttgcccgcctgcagaatgaactagacatggtgaagatcagcaaggaccccagcaaaatacccagctggttgaaggtcaacaagatctactatcctgacttcatcgtcccagacccaaagaaagctgccgtgtgggagatcacaggggctgaattctccaaatcggaggctcatacagctgacgggatctccatccgattccctcgctgcacccgaatccgagatgataaggactggaaatctgccactaaccttccccaactcaaggaactgtaccagttgtccaaggagaaggcagacttcactgtagtggctggagatgaggggagctccactacagggggtagcagtgaagagaataagggtccctcagggtctgctgtgtcccgcaaggcccccagcaagccctcagccagtaccaagaaagcagaagggaagctgagtaactccaacagcaaagatggcaacatgcagactgcaaagccttccgctatgaaggtgggggagaagctggccacaaagtcttctccagtgaaagtaggggagaagcggaaagctgctgatgagacgctgtgccaaacaaaggtattgctggacatcttcactggggtgcggctttacttgccaccctccacaccagacttcagccgtctcagacgctactttgtggcattcgacggggacctggtacaggaatttgatatgacttcagccacgcacgtgctgggtagcagggacaagaaccctgcggcccagcaggtctccccagagtggatttgggcatgtatccggaaacggagactggtagctccctgctaggtttgctgtcttccctctccctcaggccatactctcctttaccatactattggactggactcaggctggaggcagatagacacagtatagggggaatgggcttgcttctcccaaacccaccagttctccactgtctcttctggaccaggaattagttgctgtgggtgccacagctgaagtcagtttgtcttgctggtttaaatagatctttcagagctgggtgctgggtttgccatctttttgttttctttgaaaagcagcttagttaccctttttataaataaaatatcttgcagttatctttgtcctttccccacctacacccccaataatttccctagagattaaggagtaaaggctgggctatggcagctctgtccacaaagccttctctcccatccttgcctgttcctttgtacttccaggctcattttaaagttgtatttaaaggactgccctcggaaatgcttctgtttagcggaacttgtattcagcctgacacgctttgccaggaacaaacctcatgtgaaagaaaacaaaatgaatttttttactttcttctctg

SEQ ID NO: 372319 - DNA, 2095 bp, Homo sapiens
tgagagttggagtcgtatttcaagtgggaccagaatttatacaatctgggctacaggccagttctcccttggctcgcttgatgaagtagaactaggaactacaactatgaactggctctatgccacagctcacaattttccatcttcggtcacgatggagcccttgtagcccttgacagcagaactgttacacatgaggtctttgatccatggcaaaccctttcttgaagtagcagttttatcattgtggcccttccttcctcagaattcctaataagggagggaggatcccggcctaacctcagctctcctgttctcctcagacctctgtgtgagcggcggaagtttcttcatgacaacatggttgaaattccaaaccggatcatgttctcagaaatgaagcgagtcacaaaagctttggacttggctgacatgataacccgggtgatccaggagggattggaggggctggtgctgaaggatgtgaagggtacatatgagcctgggaagcggcactggctgaaagtgaagaaagactatttgaacgagggggccatggccgacacagctgacctggtggtccttggagccttctatgggcaagggagcaaaggcggcatgatgtcaatcttcctcatgggctgctacgaccctggcagccagaagtggtgcacagtcaccaagtgtgcaggaggccatgatgatgccacgcttgcccgcctgcagaatgaactagacatggtgaagatcagcaaggaccccagcaaaatacccagctggttgaaggtcaacaagatctactatcctgacttcatcgtcccagacccaaagaaagctgccgtgtgggagatcacaggggctgaattctccaaatcggaggctcatacagctgacgggatctccatccgattccctcgctgcacccgaatccgagatgataaggactggaaatctgccactaaccttccccaactcaaggaactgtaccagttgtccaaggagaaggcagacttcactgtagtggctggagatgaggggagctccactacagggggtagcagtgaagagaataagggtccctcagggtctgctgtgtcccgcaaggcccccagcaagccctcagccagtaccaagaaagcagaagggaagctgagtaactccaacagcaaagatggcaacatgcagactgcaaagccttccgctatgaaggtgggggagaagctggccacaaagtcttctccagtgaaagtaggggagaagcggaaagctgctgatgagacgctgtgccaaacaaaggtattgctggacatcttcactggggtgcggctttacttgccaccctccacaccagacttcagccgtctcagacgctactttgtggcattcgacggggacctggtacaggaatttgatatgacttcagccacgcacgtgctgggtagcagggacaagaaccctgcggcccagcaggtctccccagagtggatttgggcatgtatccggaaacggagactggtagctccctgctaggtttgctgtcttccctctccctcaggccatactctcctttaccatactattggactggactcaggctggaggcagatagacacagtatagggggaatgggcttgcttctcccaaacccaccagttctccactgtctcttctggaccaggaattagttgctgtgggtgccacagctgaagtcagtttgtcttgctggtttaaatagatctttcagagctgggtgctgggtttgccatctttttgttttctttgaaaagcagcttagttaccctttttataaataaaatatcttgcagttatctttgtcctttccccacctacacccccaataatttccctagagattaaggagtaaaggctgggctatggcagctctgtccacaaagccttctctcccatccttgcctgttcctttgtacttccaggctcattttaaagttgtatttaaaggactgccctcggaaatgcttctgtttagcggaacttgtattcagcctgacacgctttgccaggaacaaacctcatgtgaaagaaaacaaaatgaatttttttactttcttctctg

SEQ ID NO: 372320 - DNA, 3596 bp, Homo sapiens
tgcgcctgcgcgctgcctcccgctctaggacccggatttaaagagacaggcgctccaaccgtcgtgggctgcccgcggcctgtaatgagcaagttccgaggcctacggtgagcgccggagccggagaggcagctatatgtctttggctttcaagatcttctttccacaaaccctccgtgcactcagccgaaaagaactgtgcctattccgaaaacatcactggcgtgatgtaagacaattcagccagtggtcagaaacagatctgcttcatggacatcccctcttcctgagaagaaagcctgttctatcattccagggaagccatctaagatcacgtgccacctaccttgttttcttgccagggttgcatgtgggactctgcagtggcccctgtgagatggctgagcaacggttctgtgtggactatgccaagcgtggcacagctggctgcaaaaaatgcaaggaaaagattgtgaagggcgtatgccgaattggcaaagtggtgcccaatcccttctcagagtctgggggtgatatgaaagagtggtaccacattaaatgcatgtttgagaaactagagcgggcccgggccaccacaaaaaaaatcgaggacctcacagagctggaaggctgggaagagctggaagataatgagaaggaacagataacccagcacattgcagatctgtcttctaaggcagcaggtacaccaaagaagaaagctgttgtccaggctaagttgacaaccactggccaggtgacttctccagtgaaaggcgcctcatttgtcaccagtaccaatccccggaaattttctggcttttcagccaagcccaacaactctggggaagccccctcgagccccacccctaagagaagtctgtcttcaagcaaatgtgaccccaggcataaggactgtctgctacgggagtttcgaaagttatgcgccatggtggccgataatcctagctacaacacgaagacccagatcatccaggacttccttcggaaaggctcagcaggagatggtttccacggtgatgtgtacctaacagtgaagctgctgctgccaggagtcattaagactgtttacaacttgaacgataagcagattgtgaagcttttcagtcgcatttttaactgcaacccagatgatatggcacgggacctagagcagggtgacgtgtcagagacaatcagagtcttctttgagcagagcaagtctttccccccagctgccaagagcctccttaccatccaggaagtggatgagttccttctgcggctgtccaagctcaccaaggaggatgagcagcaacaggccctacaggacattgcctccaggtgtacagccaatgaccttaaatgcatcatcaggttgatcaaacatgatctgaagatgaactcaggtgcaaaacatgtgttagacgcccttgaccccaatgcctatgaagccttcaaagcctcgcgcaacctgcaggatgtggtggagcgggtccttcacaacgcgcaggaggtggagaaggagccgggccagagacgagctctgagcgtccaggcctcgctgatgacacctgtgcagcccatgttggcggaggcctgcaagtccgttgagtatgcaatgaagaaatgtcccaatggcatgttctctgagatcaagtacgatggagagcgagtccaggtgcataagaatggagaccacttcagctacttcagccgcagtctcaagcccgtccttcctcacaaggtggcccactttaaggactacattccccaggcttttcctgggggccacagcatgatcttggattctgaagtgcttctgattgacaacaagacaggcaaaccactgccctttgggactctgggagtacacaagaaagcagccttccaggatgctaatgtctgcctgtttgtttttgattgtatctactttaatgatgtcagcttgatggacagacctctgtgtgagcggcggaagtttcttcatgacaacatggttgaaattccaaaccggatcatgttctcagaaatgaagcgagtcacaaaagctttggacttggctgacatgataacccgggtgatccaggagggattggaggggctggtgctgaaggatgtgaagggtacatatgagcctgggaagcggcactggctgaaagtgaagaaagactatttgaacgagggggccatggccgacacagctgacctggtggtccttggagccttctatgggcaagggagcaaaggcggcatgatgtcaatcttcctcatgggctgctacgaccctggcagccagaagtggtgcacagtcaccaagtgtgcaggaggccatgatgatgccacgcttgcccgcctgcagaatgaactagacatggtgaagatcagcaaggaccccagcaaaatacccagctggttgaaggtcaacaagatctactatcctgacttcatcgtcccagacccaaagaaagctgccgtgtgggagatcacaggggctgaattctccaaatcggaggctcatacagctgacgggatctccatccgattccctcgctgcacccgaatccgagatgataaggactggaaatctgccactaaccttccccaactcaaggaactgtaccagttgtccaaggagaaggcagacttcactgtagtggctggagatgaggggagctccactacagggggtagcagtgaagagaataagggtccctcagggtctgctgtgtcccgcaaggcccccagcaagccctcagccagtaccaagaaagcagaagggaagctgagtaactccaacagcaaagatggtaaggatagggagggggctggtatggtgaagagggcggtgtgaggggcagagatccaagggcagggacccagtctcacattccagccctgagatctcatgattatctgtgtccactgcagtggacacagactacattcctggtgtgtgtccagccatgggccagagacccttctgctgggcaccctgtatctgctcagcaaacctgaatggagcagtaccctggggacagccagtctgaccagggaataagctacctttgagtaaagggcttagctgataactcttcactcccctctcacctatgctcatagcagagaaagcccctggtccttcccattactgcccctgacttcagggagcattatcagcaatccctaccctcttagttcttttgtatcatatgttttttagagacagggtctcactctgtcatccaggctggagtgcagtggcacgaccatagctcactgcagcctcgaactcctgagttgaattgatcctcccgagtagctgggactataggtgtgcaccaccacacccagcttcctctctgtcctgcaggcaacatgcagactgcaaagccttccgctatgaaggtgggggagaagctggccacaaagtcttctccagtgaaagtaggggagaagcggaaagctgctgatgagacgctgtgccaaacaaaggtgagggtaaaaacagcaacacaccacgtgggccagtttagcccaggttgtgttcccaaccttctgtacaagaagtttgaaagaggatgagcaaaggtgtt

SEQ ID NO: 372321 - DNA, 394 bp, Homo sapiens
gatgataaggactggaaatctgccactaaccttccccaactcaaggtagcagctcttaggctgtatatgtattctccaccccactgtccaggccttggagccttgggcatctagaccattcacatgtcctctgtcttctcctttcccccattctcctgaggcagagcaaggagggcaattagagagggagacaaactgctgctgggccaggggcacagcactagacctccttctccctccatctctgagtagagaaccttgcatttgcaaggccccactgagcagcctttagtctggggaataagagtttgctcctgttgccccagcaaagcctgctttgctgtacagagaacaatgatttgtaccctgattactcaggctatagggccatact

SEQ ID NO: 372322 - DNA, 3110 bp, Homo sapiens
tgcgcctgcgcgctgcctcccgctctaggacccggatttaaagagacaggcgctccaaccgtcgtgggctgcccgcggcctgtaatgagcaagttccgaggcctacggtgagcgccggagccggagaggcagctatatgtctttggctttcaagatcttctttccacaaaccctccgtgcactcagccgaaaagaactgtgcctattccgaaaacatcactggcgtgatgtaagacaattcagccagtggtcagaaacagatctgcttcatggacatcccctcttcctgagaagaaagcctgttctatcattccagggaagccatctaagatcacgtgccacctaccttgttttcttgccagggttgcatgtgggactctgcagtggcccctgtgagatggctgagcaacggttctgtgtggactatgccaagcgtggcacagctggctgcaaaaaatgcaaggaaaagattgtgaagggcgtatgccgaattggcaaagtggtgcccaatcccttctcagagtctgggggtgatatgaaagagtggtaccacattaaatgcatgtttgagaaactagagcgggcccgggccaccacaaaaaaaatcgaggacctcacagagctggaaggctgggaagagctggaagataatgagaaggaacagataacccagcacattgcagatctgtcttctaaggcagcaggtacaccaaagaagaaagctgttgtccaggctaagttgacaaccactggccaggtgacttctccagtgaaaggcgcctcatttgtcaccagtaccaatccccggaaattttctggcttttcagccaagcccaacaactctggggaagccccctcgagccccacccctaagagaagtctgtcttcaagcaaatgtgaccccaggcataaggactgtctgctacgggagtttcgaaagttatgcgccatggtggccgataatcctagctacaacacgaagacccagatcatccaggacttccttcggaaaggctcagcaggagatggtttccacggtgatgtgtacctaacagtgaagctgctgctgccaggagtcattaagactgtttacaacttgaacgataagcagattgtgaagcttttcagtcgcatttttaactgcaacccagatgatatggcacgggacctagagcagggtgacgtgtcagagacaatcagagtcttctttgagcagagcaagtctttccccccagctgccaagagcctccttaccatccaggaagtggatgagttccttctgcggctgtccaagctcaccaaggaggatgagcagcaacaggccctacaggacattgcctccaggtgtacagccaatgaccttaaatgcatcatcaggttgatcaaacatgatctgaagatgaactcaggtgcaaaacatgtgttagacgcccttgaccccaatgcctatgaagccttcaaagcctcgcgcaacctgcaggatgtggtggagcgggtccttcacaacgcgcaggaggtggagaaggagccgggccagagacgagctctgagcgtccaggcctcgctgatgacacctgtgcagcccatgttggcggaggcctgcaagtccgttgagtatgcaatgaagaaatgtcccaatggcatgttctctgagatcaagtacgatggagagcgagtccaggtgcataagaatggagaccacttcagctacttcagccgcagtctcaagcccgtccttcctcacaaggtggcccactttaaggactacattccccaggcttttcctgggggccacagcatgatcttggattctgaagtgcttctgattgacaacaagacaggcaaaccactgccctttgggactctgggagtacacaagaaagcagccttccaggatgctaatgtctgcctgtttgtttttgattgtatctactttaatgatgtcagcttgatggacagacctctgtgtgagcggcggaagtttcttcatgacaacatggttgaaattccaaaccggatcatgttctcagaaatgaagcgagtcacaaaagctttggacttggctgacatgataacccgggtgatccaggagggattggaggggctggtgctgaaggatgtgaagggtacatatgagcctgggaagcggcactggctgaaagtgaagaaagactatttgaacgagggggccatggccgacacagctgacctggtggtccttggagccttctatgggcaagggagcaaaggcggcatgatgtcaatcttcctcatgggctgctacgaccctggcagccagaagtggtgcacagtcaccaagtgtgcaggaggccatgatgatgccacgcttgcccgcctgcagaatgaactagacatggtgaagatcagcaaggaccccagcaaaatacccagctggttgaaggtcaacaagatctactatcctgacttcatcgtcccagacccaaagaaagctgccgtgtgggagatcacaggggctgaattctccaaatcggaggctcatacagctgacgggatctccatccgattccctcgctgcacccgaatccgagatgataaggactggaaatctgccactaaccttccccaactcaaggaactgtaccagttgtccaaggagaaggcagacttcactgtagtggctggagatgaggggagctccactacagggggtagcagtgaagagaataagggtccctcagggtctgctgtgtcccgcaaggcccccagcaagccctcagccagtaccaagaaagcagaagggaagctgagtaactccaacagcaaagatggcaacatgcagactgcaaagccttccgctatgaaggtgggggagaagctggccacaaagtcttctccagtgaaagtaggggagaagcggaaagctgctgatgagacgctgtgccaaacaaagaggcggccagccagtgagcagagaggaagaactgtgccagcaggcaggagatagaacagcccggcctagccaggagagactgcagggactcactcagctgctggccccaagtcaaaatttacattaaagggaaaagcccagtctgggtgtgggaatgcagcattgagtttgtggtcag

SEQ ID NO: 372323 - DNA, 3689 bp, Homo sapiens
acgacgattatgttttcgcgtccgtacgttatgtttccaactgacgaggtgtctgtcttggctgttaatgagtaagttccgaggcctacgctatatgtctttggctttcaagatcttctttccacaaaccctccgtgcactcagccgaaaagaactgtgcctattccgaaaacatcactggcgtgatgtaagacaattcagccagtggtcagaaacagatctgcttcatggacatcccctcttcctgagaagaaagcctgttctatcattccagggaagccatctaagatcacgtgccacctaccttgttttcttgccagggttgcatgtgggactctgcagtggcccctgtgagatggctgagcaacggttctgtgtggactatgccaagcgtggcacagctggctgcaaaaaatgcaaggaaaagattgtgaagggcgtatgccgaattggcaaagtggtgcccaatcccttctcagagtctgggggtgatatgaaagagtggtaccacattaaatgcatgtttgagaaactagagcgggcccgggccaccacaaaaaaaatcgaggacctcacagagctggaaggctgggaagagctggaagataatgagaaggaacagataacccagcacattgcagatctgtcttctaaggcagcaggtacaccaaagaagaaagctgttgtccaggctaagttgacaaccactggccaggtgacttctccagtgaaaggcgcctcatttgtcaccagtaccaatccccggaaattttctggcttttcagccaagcccaacaactctggggaagccccctcgagccccacccctaagagaagtctgtcttcaagcaaatgtgaccccaggcataaggactgtctgctacgggagtttcgaaagttatgcgccatggtggccgataatcctagctacaacacgaagacccagatcatccaggacttccttcggaaaggctcagcaggagatggtttccacggtgatgtgtacctaacagtgaagctgctgctgccaggagtcattaagactgtttacaacttgaacgataagcagattgtgaagcttttcagtcgcatttttaactgcaacccagatgatatggcacgggacctagagcagggtgacgtgtcagagacaatcagagtcttctttgagcagagcaagtctttccccccagctgccaagagcctccttaccatccaggaagtggatgagttccttctgcggctgtccaagctcaccaaggaggatgagcagcaacaggccctacaggacattgcctccaggtgtacagccaatgaccttaaatgcatcatcaggttgatcaaacatgatctgaagatgaactcaggtgcaaaacatgtgttagacgcccttgaccccaatgcctatgaagccttcaaagcctcgcgcaacctgcaggatgtggtggagcgggtccttcacaacgcgcaggaggtggagaaggagccgggccagagacgagctctgagcgtccaggcctcgctgatgacacctgtgcagcccatgttggcggaggcctgcaagtccgttgagtatgcaatgaagaaatgtcccaatggcatgttctctgagatcaagtacgatggagagcgagtccaggtgcataagaatggagaccacttcagctacttcagccgcagtctcaagcccgtccttcctcacaaggtggcccactttaaggactacattccccaggcttttcctgggggccacagcatgatcttggattctgaagtgcttctgattgacaacaagacaggcaaaccactgccctttgggactctgggagtacacaagaaagcagccttccaggatgctaatgtctgcctgtttgtttttgattgtatctactttaatgatgtcagcttgatggacagacctctgtgtgagcggcggaagtttcttcatgacaacatggttgaaattccaaaccggatcatgttctcagaaatgaagcgagtcacaaaagctttggacttggctgacatgataacccgggtgatccaggagggattggaggggctggtgctgaaggatgtgaagggtacatatgagcctgggaagcggcactggctgaaagtgaagaaagactatttgaacgagggggccatggccgacacagctgacctggtggtccttggagccttctatgggcaagggagcaaaggcggcatgatgtcaatcttcctcatgggctgctacgaccctggcagccagaagtggtgcacagtcaccaagtgtgcaggaggccatgatgatgccacgcttgcccgcctgcagaatgaactagacatggtgaagatcagcaaggaccccagcaaaatacccagctggttgaaggtcaacaagatctactatcctgacttcatcgtcccagacccaaagaaagctgccgtgtgggagatcacaggggctgaattctccaaatcggaggctcatacagctgacgggatctccatccgattccctcgctgcacccgaatccgagatgataaggactggaaatctgccactaaccttccccaactcaaggaactgtaccagttgtccaaggagaaggcagacttcactgtagtggctggagatgaggggagctccactacagggggtagcagtgaagagaataagggtccctcagggtctgctgtgtcccgcaaggcccccagcaagccctcagccagtaccaagaaagcagaagggaagctgagtaactccaacagcaaagatggcaacatgcagactgcaaagccttccgctatgaaggtgggggagaagctggccacaaagtcttctccagtgaaagtaggggagaagcggaaagctgctgatgagacgctgtgccaaacaaaggtattgctggacatcttcactggggtgcggctttacttgccaccctccacaccagacttcagccgtctcagacgctactttgtggcattcgacggggacctggtacaggaatttgatatgacttcagccacgcacgtgctgggtagcagggacaagaaccctgcggcccagcaggtctccccagagtggatttgggcatgtatccggaaacggagactggtagctccctgctaggtttgctgtcttccctctccctcaggccatactctcctttaccatactattggactggactcaggctggaggcagatagacacagtatagggggaatgggcttgcttctcccaaacccaccagttctccactgtctcttctggaccaggaattagttgctgtgggtgccacagctgaagtcagtttgtcttgctggtttaaatagatctttcagagctgggtgctgggtttgccatctttttgttttctttgaaaagcagcttagttaccctttttataaataaaatatcttgcagttatctttgtcctttccccacctacacccccaataatttccctagagattaaggagtaaaggctgggctatggcagctctgtccacaaagccttctctcccatccttgcctgttcctttgtacttccaggctcattttaaagttgtatttaaaggactgccctcggaaatgcttctgtttagcggaacttgtattcagcctgacacgctttgccaggaacaaacctcatgtgaaagaaaacaaaatgaatttttttactttcttctctg

SEQ ID NO: 372324 - DNA, 3645 bp, Homo sapiens
cgcggcacggcgcggcggggcccggcgtggggaaggcagcgggcccggggcgaggagctcggcgcggccggggagccagccccccggctcctcccccgcccgcctgcggagccccggggcacaccctccgtgacgtggcggccctcccgggagcccagggggaggctcgcggctccccgggacccccacggggccgcgtgaggcggggaggccggcgcccgggctgtgttccctgtggaacccacggggccttctcgtaccctggcccggcgtgcgtcctcctgcgctgaaccgggagcgctcgggtgggactcagggagccttgatcacttcccgcctgcgtcccggacccggtggaggagcgctcctttctgcctcgccgggggtcgcggcctacgccgccgaccccactgtccccgccactctccgacagcggcgcgggaagcccttcgagaaaagcggcggcggccaggcctcagcgatttccttctcgggcccctgggctgcggcagttgtgaggagagctcagaacagcctccctcccccacaaccagcgcattcatggattccttgtaattttcccaactaccctgtgagatctgtcttctaaggcagcaggtacaccaaagaagaaagctgttgtccaggctaagttgacaaccactggccaggtgacttctccagtgaaaggcgcctcatttgtcaccagtaccaatccccggaaattttctggcttttcagccaagcccaacaactctggggaagccccctcgagccccacccctaagagaagtctgtcttcaagcaaatgtgaccccaggcataaggactgtctgctacgggagtttcgaaagttatgcgccatggtggccgataatcctagctacaacacgaagacccagatcatccaggacttccttcggaaaggctcagcaggagatggtttccacggtgatgtgtacctaacagtgaagctgctgctgccaggagtcattaagactgtttacaacttgaacgataagcagattgtgaagcttttcagtcgcatttttaactgcaacccagatgatatggcacgggacctagagcagggtgacgtgtcagagacaatcagagtcttctttgagcagagcaagtctttccccccagctgccaagagcctccttaccatccaggaagtggatgagttccttctgcggctgtccaagctcaccaaggaggatgagcagcaacaggccctacaggacattgcctccaggtgtacagccaatgaccttaaatgcatcatcaggttgatcaaacatgatctgaagatgaactcaggtgcaaaacatgtgttagacgcccttgaccccaatgcctatgaagccttcaaagcctcgcgcaacctgcaggatgtggtggagcgggtccttcacaacgcgcaggaggtggagaaggagccgggccagagacgagctctgagcgtccaggcctcgctgatgacacctgtgcagcccatgttggcggaggcctgcaagtccgttgagtatgcaatgaagaaatgtcccaatggcatgttctctgagatcaagtacgatggagagcgagtccaggtgcataagaatggagaccacttcagctacttcagccgcagtctcaagcccgtccttcctcacaaggtggcccactttaaggactacattccccaggcttttcctgggggccacagcatgatcttggattctgaagtgcttctgattgacaacaagacaggcaaaccactgccctttgggactctgggagtacacaagaaagcagccttccaggatgctaatgtctgcctgtttgtttttgattgtatctactttaatgatgtcagcttgatggacagacctctgtgtgagcggcggaagtttcttcatgacaacatggttgaaattccaaaccggatcatgttctcagaaatgaagcgagtcacaaaagctttggacttggctgacatgataacccgggtgatccaggagggattggaggggctggtgctgaaggatgtgaagggtacatatgagcctgggaagcggcactggctgaaagtgaagaaagactatttgaacgagggggccatggccgacacagctgacctggtggtccttggagccttctatgggcaagggagcaaaggcggcatgatgtcaatcttcctcatgggctgctacgaccctggcagccagaagtggtgcacagtcaccaagtgtgcaggaggccatgatgatgccacgcttgcccgcctgcagaatgaactagacatggtgaagatcagcaaggaccccagcaaaatacccagctggttgaaggtcaacaagatctactatcctgacttcatcgtcccagacccaaagaaagctgccgtgtgggagatcacaggggctgaattctccaaatcggaggctcatacagctgacgggatctccatccgattccctcgctgcacccgaatccgagatgataaggactggaaatctgccactaaccttccccaactcaaggaactgtaccagttgtccaaggagaaggcagacttcactgtagtggctggagatgaggggagctccactacagggggtagcagtgaagagaataagggtccctcagggtctgctgtgtcccgcaaggcccccagcaagccctcagccagtaccaagaaagcagaagggaagctgagtaactccaacagcaaagatggcaacatgcagactgcaaagccttccgctatgaaggtgggggagaagctggccacaaagtcttctccagtgaaagtaggggagaagcggaaagctgctgatgagacgctgtgccaaacaaaggtattgctggacatcttcactggggtgcggctttacttgccaccctccacaccagacttcagccgtctcagacgctactttgtggcattcgacggggacctggtacaggaatttgatatgacttcagccacgcacgtgctgggtagcagggacaagaaccctgcggcccagcaggtctccccagagtggatttgggcatgtatccggaaacggagactggtagctccctgctaggtttgctgtcttccctctccctcaggccatactctcctttaccatactattggactggactcaggctggaggcagatagacacagtatagggggaatgggcttgcttctcccaaacccaccagttctccactgtctcttctggaccaggaattagttgctgtgggtgccacagctgaagtcagtttgtcttgctggtttaaatagatctttcagagctgggtgctgggtttgccatctttttgttttctttgaaaagcagcttagttaccctttttataaataaaatatcttgcagttatctttgtcctttccccacctacacccccaataatttccctagagattaaggagtaaaggctgggctatggcagctctgtccacaaagccttctctcccatccttgcctgttcctttgtacttccaggctcattttaaagttgtatttaaaggactgccctcggaaatgcttctgtttagcggaacttgtattcagcctgacacgctttgccaggaacaaacctcatgtgaaagaaaacaaaatgaatttttttactttcttctctg

SEQ ID NO: 372325 - DNA, 4294 bp, Homo sapiens
tgcgcctgcgcgctgcctcccgctctaggacccggatttaaagagacaggcgctccaaccgtcgtgggctgcccgcggcctgtaatgagcaagttccgaggcctacggtgagcgccggagccggagaggcagctatatgtctttggctttcaagatcttctttccacaaaccctccgtgcactcagccgaaaagaactgtgcctattccgaaaacatcactggcgtgatgtaagacaattcagccagtggtcagaaacagatctgcttcatggacatcccctcttcctgagaagaaagcctgttctatcattccagggaagccatctaagatcacgtgccacctaccttgttttcttgccagggttgcatgtgggactctgcagtggcccctgtgagatggctgagcaacggttctgtgtggactatgccaagcgtggcacagctggctgcaaaaaatgcaaggaaaagattgtgaagggcgtatgccgaattggcaaagtggtgcccaatcccttctcagagtctgggggtgatatgaaagagtggtaccacattaaatgcatgtttgagaaactagagcgggcccgggccaccacaaaaaaaatcgaggacctcacagagctggaaggctgggaagagctggaagataatgagaaggaacagataacccagcacattgcagatctgtcttctaaggcagcaggtacaccaaagaagaaagctgttgtccaggctaagttgacaaccactggccaggtgacttctccagtgaaaggcgcctcatttgtcaccagtaccaatccccggaaattttctggcttttcagccaagcccaacaactctggggaagccccctcgagccccacccctaagagaagtctgtcttcaagcaaatgtgaccccaggcataaggactgtctgctacgggagtttcgaaagttatgcgccatggtggccgataatcctagctacaacacgaagacccagatcatccaggacttccttcggaaaggctcagcaggagatggtttccacggtgatgtgtacctaacagtgaagctgctgctgccaggagtcattaagactgtttacaacttgaacgataagcagattgtgaagcttttcagtcgcatttttaactgcaacccagatgatatggcacgggacctagagcagggtgacgtgtcagagacaatcagagtcttctttgagcagagcaagtctttccccccagctgccaagagcctccttaccatccaggaagtggatgagttccttctgcggctgtccaagctcaccaaggaggatgagcagcaacaggccctacaggacattgcctccaggtgtacagccaatgaccttaaatgcatcatcaggttgatcaaacatgatctgaagatgaactcaggtgcaaaacatgtgttagacgcccttgaccccaatgcctatgaagccttcaaagcctcgcgcaacctgcaggatgtggtggagcgggtccttcacaacgcgcaggaggtggagaaggagccgggccagagacgagctctgagcgtccaggcctcgctgatgacacctgtgcagcccatgttggcggaggcctgcaagtccgttgagtatgcaatgaagaaatgtcccaatggcatgttctctgagatcaagtacgatggagagcgagtccaggtgcataagaatggagaccacttcagctacttcagccgcagtctcaagcccgtccttcctcacaaggtggcccactttaaggactacattccccaggcttttcctgggggccacagcatgatcttggattctgaagtgcttctgattgacaacaagacaggcaaaccactgccctttgggactctgggagtacacaagaaagcagccttccaggatgctaatgtctgcctgtttgtttttgattgtatctactttaatgatgtcagcttgatggacagacctctgtgtgagcggcggaagtttcttcatgacaacatggttgaaattccaaaccggatcatgttctcagaaatgaagcgagtcacaaaagctttggacttggctgacatgataacccgggtgatccaggagggattggaggggctggtgctgaaggatgtgaagggtacatatgagcctgggaagcggcactggctgaaagtgaagaaagactatttgaacgagggggccatggccgacacagctgacctggtggtccttggagccttctatgggcaagggagcaaaggcggcatgatgtcaatcttcctcatgggctgctacgaccctggcagccagaagtggtgcacagtcaccaagtgtgcaggaggccatgatgatgccacgcttgcccgcctgcagaatgaactagacatggtgaagatcagcaaggaccccagcaaaatacccagctggttgaaggtcaacaagatctactatcctgacttcatcgtcccagacccaaagaaagctgccgtgtgggagatcacaggggctgaattctccaaatcggaggctcatacagctgacgggatctccatccgattccctcgctgcacccgaatccgagatgataaggactggaaatctgccactaaccttccccaactcaaggaactgtaccagttgtccaaggagaaggcagacttcactgtagtggctggagatgaggggagctccactacagggggtagcagtgaagagaataagggtccctcagggtctgctgtgtcccgcaaggcccccagcaagccctcagccagtaccaagaaagcagaagggaagctgagtaactccaacagcaaagatggtaaggatagggagggggctggtatggtgaagagggcggtgtgaggggcagagatccaagggcagggacccagtctcacattccagccctgagatctcatgattatctgtgtccactgcagtggacacagactacattcctggtgtgtgtccagccatgggccagagacccttctgctgggcaccctgtatctgctcagcaaacctgaatggagcagtaccctggggacagccagtctgaccagggaataagctacctttgagtaaagggcttagctgataactcttcactcccctctcacctatgctcatagcagagaaagcccctggtccttcccattactgcccctgacttcagggagcattatcagcaatccctaccctcttagttcttttgtatcatatgttttttagagacagggtctcactctgtcatccaggctggagtgcagtggcacgaccatagctcactgcagcctcgaactcctgagttgaattgatcctcccgagtagctgggactataggtgtgcaccaccacacccagcttcctctctgtcctgcaggcaacatgcagactgcaaagccttccgctatgaaggtgggggagaagctggccacaaagtcttctccagtgaaagtaggggagaagcggaaagctgctgatgagacgctgtgccaaacaaaggtattgctggacatcttcactggggtgcggctttacttgccaccctccacaccagacttcagccgtctcagacgctactttgtggcattcgacggggacctggtacaggaatttgatatgacttcagccacgcacgtgctgggtagcagggacaagaaccctgcggcccagcaggtctccccagagtggatttgggcatgtatccggaaacggagactggtagctccctgctaggtttgctgtcttccctctccctcaggccatactctcctttaccatactattggactggactcaggctggaggcagatagacacagtatagggggaatgggcttgcttctcccaaacccaccagttctccactgtctcttctggaccaggaattagttgctgtgggtgccacagctgaagtcagtttgtcttgctggtttaaatagatctttcagagctgggtgctgggtttgccatctttttgttttctttgaaaagcagcttagttaccctttttataaataaaatatcttgcagttatctttgtcctttccccacctacacccccaataatttccctagagattaaggagtaaaggctgggctatggcagctctgtccacaaagccttctctcccatccttgcctgttcctttgtacttccaggctcattttaaagttgtatttaaaggactgccctcggaaatgcttctgtttagcggaacttgtattcagcctgacacgctttgccaggaacaaacctcatgtgaaagaaaacaaaatgaatttttttactttcttctctg

SEQ ID NO: 372326 - DNA, 3033 bp, Homo sapiens
tgcgcctgcgcgctgcctcccgctctaggacccggatttaaagagacaggcgctccaaccgtcgtgggctgcccgcggcctgtaatgagcaagttccgaggcctacggtgagcgccggagccggagaggcagctatatgtctttggctttcaagatcttctttccacaaaccctccgtgcactcagccgaaaagaactgtgcctattccgaaaacatcactggcgtgatgtaagacaattcagccagtggtcagaaacagatctgcttcatggacatcccctcttcctgagaagaaagcctgttctatcattccagggaagccatctaagatcacgtgccacctaccttgttttcttgccagggttgcatgtgggactctgcagtggcccctgtgagatggctgagcaacggttctgtgtggactatgccaagcgtggcacagctggctgcaaaaaatgcaaggaaaagattgtgaagggcgtatgccgaattggcaaagtggtgcccaatcccttctcagagtctgggggtgatatgaaagagtggtaccacattaaatgcatgtttgagaaactagagcgggcccgggccaccacaaaaaaaatcgaggacctcacagagctggaaggctgggaagagctggaagataatgagaaggaacagataacccagcacattgcagatctgtcttctaaggcagcaggtacaccaaagaagaaagctgttgtccaggctaagttgacaaccactggccaggtgacttctccagtgaaaggcgcctcatttgtcaccagtaccaatccccggaaattttctggcttttcagccaagcccaacaactctggggaagccccctcgagccccacccctaagagaagtctgtcttcaagcaaatgtgaccccaggcataaggactgtctgctacgggagtttcgaaagttatgcgccatggtggccgataatcctagctacaacacgaagacccagatcatccaggacttccttcggaaaggctcagcaggagatggtttccacggtgatgtgtacctaacagtgaagctgctgctgccaggagtcattaagactgtttacaacttgaacgataagcagattgtgaagcttttcagtcgcatttttaactgcaacccagatgatatggcacgggacctagagcagggtgacgtgtcagagacaatcagagtcttctttgagcagagcaagtctttccccccagctgccaagagcctccttaccatccaggaagtggatgagttccttctgcggctgtccaagctcaccaaggaggatgagcagcaacaggccctacaggacattgcctccaggtgtacagccaatgaccttaaatgcatcatcaggttgatcaaacatgatctgaagatgaactcaggtgcaaaacatgtgttagacgcccttgaccccaatgcctatgaagccttcaaagcctcgcgcaacctgcaggatgtggtggagcgggtccttcacaacgcgcaggaggtggagaaggagccgggccagagacgagctctgagcgtccaggcctcgctgatgacacctgtgcagcccatgttggcggaggcctgcaagtccgttgagtatgcaatgaagaaatgtcccaatggcatgttctctgagatcaagtacgatggagagcgagtccaggtgcataagaatggagaccacttcagctacttcagccgcagtctcaagcccgtccttcctcacaaggtggcccactttaaggactacattccccaggcttttcctgggggccacagcatgatcttggattctgaagtgcttctgattgacaacaagacaggcaaaccactgccctttgggactctgggagtacacaagaaagcagccttccaggatgctaatgtctgcctgtttgtttttgattgtatctactttaatgatgtcagcttgatggacagacctctgtgtgagcggcggaagtttcttcatgacaacatggttgaaattccaaaccggatcatgttctcagaaatgaagcgagtcacaaaagctttggacttggctgacatgataacccgggtgatccaggagggattggaggggctggtgctgaaggatgtgaagggtacatatgagcctgggaagcggcactggctgaaagtgaagaaagactatttgaacgagggggccatggccgacacagctgacctggtggtccttggagccttctatgggcaagggagcaaaggcggcatgatgtcaatcttcctcatgggctgctacgaccctggcagccagaagtggtgcacagtcaccaagtgtgcaggaggccatgatgatgccacgcttgcccgcctgcagaatgaactagacatggtgaagatcagcaaggaccccagcaaaatacccagctggttgaaggtcaacaagatctactatcctgacttcatcgtcccagacccaaagaaagctgccgtgtgggagatcacaggggctgaattctccaaatcggaggctcatacagctgacgggatctccatccgattccctcgctgcacccgaatccgagatgataaggactggaaatctgccactaaccttccccaactcaaggaactgtaccagttgtccaaggagaaggcagacttcactgtagtggctggagatgaggggagctccactacagggggtagcagtgaagagaataagggtccctcagggtctgctgtgtcccgcaaggcccccagcaagccctcagccagtaccaagaaagcagaagggaagctgagtaactccaacagcaaagatggcaacatgcagactgcaaagccttccgctatgaaggtgggggagaagctggccacaaagtcttctccagtgaaagtaggggagaagcggaaagctgctgatgagacgctgtgccaaacaaaggtgagggtaaaaacagcaacacaccacgtgggccagtttagcccaggttgtgttcccaaccttctgtacaagaagtttgaaagaggatgagcaaaggtgtt

SEQ ID NO: 372327 - DNA, 1241 bp, Homo sapiens
tgcgcctgcgcgctgcctcccgctctaggacccggatttaaagagacaggcgctccaaccgtcgtgggctgcccgcggcctgtaatgagcaagttccgaggcctacggtgagcgccggagccggagaggcagctatatgtctttggctttcaagatcttctttccacaaaccctccgtgcactcagccgaaaagaactgtgcctattccgaaaacatcactggcgtgatgtaagacaattcagccagtggtcagaaacagatctgcttcatggacatcccctcttcctgagaagaaagcctgttctatcattccagggaagccatctaagatcacgtgccacctaccttgttttcttgccagggttgcatgtgggactctgcagtggcccctgtgagatggctgagcaacggttctgtgtggactatgccaagcgtggcacagctggctgcaaaaaatgcaaggaaaagattgtgaagggcgtatgccgaattggcaaagtggtgcccaatcccttctcagagtctgggggtgatatgaaagagtggtaccacattaaatgcatgtttgagaaactagagcgggcccgggccaccacaaaaaaaatcgaggacctcacagagctggaaggctgggaagagctggaagataatgagaaggaacagataacccagcacattgcagatctgtcttctaaggcagcaggtacaccaaagaagaaagctgttgtccaggctaagttgacaaccactggccaggtgacttctccagtgaaaggcgcctcatttgtcaccagtaccaatccccggaaattttctggcttttcagccaagcccaacaactctggggaagccccctcgagccccacccctaagagaagtctgtcttcaagcaaatgtgaccccaggcataaggactgtctgctacgggagtttcgaaagttatgcgccatggtggccgataatcctagctacaacacgaagacccagatcatccaggacttccttcggaaaggctcagcaggaggtgtggcatgagcatcctgaataggcctttcctccggagagctcaaggccatggctgccttcctgggcatgtgagctgtatagttgcccgggatcccatgcttggtttaatgctgtactgtagtgctatctggaaattcttaataattttgaacaaggggcctcgcatttgcattttgcactgtactccacaaattatgtagccagtttttctcag

SEQ ID NO: 372328 - DNA, 1122 bp, Homo sapiens
ctactactactaggccacgcgtcgactagtacgggggggggaaagcgcgcgagcaagatggccaccaccaagcgcgtcttgtacgtgggtggactggcagaggaagtggacgacaaagttcttcatgctgcgttcattccttttggagacatcacagatattcagattcctctggattatgaaacagaaaagcaccgaggatttgcttttgttgaatttgagttggcagaggatgctgcagcagctatcgacaacatgaatgaatctgagctttttggacgtacaattcgtgtcaatttggccaaaccaatgagaattaaggaaggctcttccaggccagtttggtcagatgatgactggttgaagaagttttctgggaagacgcttgaagagaataaagaggaagaagggtcagagcctcccaaagcagagacccaggagggagagcccattgctaaaaaggcccgctcaaatcctcaggtgtacatggacatcaagattgggaacaagccggctggccgcatccagatgctcctgcgttctgatgtcgtgcccatgacagcagagaatttccgctgcctgtgcactcatgaaaagggctttggctttaagggaagcagcttccaccgcatcatcccccagttcatgtgccagggcggtgatttcacaaaccacaatggcactgggggcaagtccatctatgggaagaagttcgatgatgaaaactttatcctcaagcatacgggaccaggtctactatccatggccaactctggcccaaacaccaatggctctcagttcttcctgacatgtgacaagacagactggctggatggcaagcatgtggtgtttggagaggtcaccgaaggcctagatgtcttgcggcaaattgagaaacaagaagagtcagcaattaccagccagccgaggtcctggaagctgacgtagagctcgtgccgacggcagacctgccggccgtgggagccgtggacgtcatctgcagggacagaaggggcaaggtcttttctggggttcctactgtgtgcagctactatggggtaccagggtgggggatgccctgatgagcacatttgtcaaataaatgaatgacaggaaaccaat

SEQ ID NO: 372329 - DNA, 991 bp, Homo sapiens
  misc_feature (905)..(905): n is a, c, g, or t
  misc_feature (908)..(908): n is a, c, g, or t
  misc_feature (913)..(914): n is a, c, g, or t
  misc_feature (922)..(922): n is a, c, g, or t
  misc_feature (938)..(938): n is a, c, g, or t
aaacttacggctaggtacgaggctgggtggtggcagatggccaccaccaagcgcgtcttgtacgtgggtggactggcagaggaagtggacgacaaagttcttcatgctgcgttcattccttttggagacatcacagatattcagattcctctggattatgaaacagaaaagcaccgaggatttgcttttgttgaatttgagttggcagaggatgctgcagcagctatcgacaacatgaatgaatctgagctttttggacgtacaattcgtgtcaatttggccaaaccaatgagaattaaggaaggctcttccaggccagtttggtcagatgatgactggttgaagaagttttctgggaagacgcttgaagagaataaagaggaagaagggtcagagcctcccaaagcagagacccaggagggagagcccattgctaaaaaggcccgctcaaatcctcaggtgtacatggacatcaagattgggaacaagccggctggccgcatccagatgctcctgcgttctgatgtcgtgcccatgacagcagagaatttccgctgcctgtgcactcatgaaaagggctttggctttaagggaagcagcttccaccgcatcatcccccagttcatgtgccagggcggtgatttcacaaaccacaatggcactgggggcaagtccatctatgggaagaagttcgatgatgaaaactttatcctcaagcatacgggaccaggtctactatccatggccaactctggcccaaacaccaatggctctcagttcttcctgacatgtgacaagacagactggctggatggcaagcatgtggtgtttggagaggtcaccgaaggcctagatgtcttgcggcaaattgagtggggaaatgaggccggcccagacggaaccanaangggcnngccggggngacgtgagggaccttncccccgttacgttcgaggggcccaggggccggtctgaaatgttgccccggggg

SEQ ID NO: 372330 - DNA, 985 bp, Homo sapiens
tcctatcggtcccggggatgcccctgtctaaaaggcccctgatattctccggtgaacgcgacatccagatggggaacaatccggtcggcccggcttccagatgcgcgcaggcgttttcgaacgtcctgcccctgctacacgcaagggaagttcgtgccgcgtgcccgggaccacttccattgaaataggggcttttcggcctttaaggggaatgcccaagccttcccatccggcagtacattccgccccgagcttacaatgtatgccaagcccgggtgaactttccgccctaagccctcctattgggcacttggggggccagagggtccattttaatgcggaaagaaaagtttcgaatggatggaaaatcttgtatcccttcaaaggtcatttaccggggaaccaagggtcttactattcccagtgggcccaaacttcttgggcccccaaaaccaccccaaatgggctcttcaagtttcttcctgacatgtgacaagacagactggctggatggcaagcatgtggtgtttggagaggtcaccgaaggcctagatgtcttgcggcaaattgaggcccagggcagcaaggacgggaagccaaagcagaaggtgatcatcgccgactgtggggagtacgtgtgaggcggcactctctctgcttccccctccgctcttgaccctgcatatccaggaaggaactgccagcctcagaggaggcagcaccgagggtgcctgtttgaagcaagcagcatttgggatatgtgcccttcctcagggtctgcttggagcagctcctctgcaggcacagcctggactattcccaggcacagctgtgggcccaggagccagctcaggtgctcccctccaccatgggcaggctgtgcaaaaagccactggcttttctcagcatttgctgctgggcctctcctgggactaccagtgtggctcttacgtgttttctttgctaaaataaaccctagttctta

SEQ ID NO: 372331 - DNA, 1306 bp, Homo sapiens
ggtcgcgtcgacacggctgcgagaagacgacaaaagggggaaagcgcgcgagcaagatggccaccaccaagcgcgtcttgtacgtgggtggactggcagaggaagtggacgacaaagttcttcatgctgcgttcattccttttggagacatcacagatattcagattcctctggattatgaaacagaaaagcaccgaggatttgcttttgttgaatttgagttggcagaggatgctgcagcagctatcgacaacatgaatgaatctgagctttttggacgtacaattcgtgtcaatttggccaaaccaatgagaattaaggaaggctcttccaggccagtttggtcagatgatgactggttgaagaagttttctgggaagacgcttgaagagaataaagaggaagaagggtcagagcctcccaaagcagagacccaggagggagagcccattgctaaaaaggcccgctcaaatcctcaggtgtacatggacatcaagattgggaacaagccggctggccgcatccagatgctcctgcgttctgatgtcgtgcccatgacagcagagaatttccgctgcctgtgcactcatgaaaagggctttggctttaagggaagcagcttccaccgcatcatcccccagttcatgtgccagggcggtgatttcacaaaccacaatggcactgggggcaagtccatctatgggaagaagttcgatgatgaaaactttatcctcaagcatacgggaccaggtctactatccatggccaactctggcccaaacaccaatggctctcagttcttcctgacatgtgacaagacagactggctggatggcaagcatgtggtgtttggagaggtcaccgaaggcctagatgtcttgcggcaaattgaggcccagggcagcaaggacgggaagccaaagcagaaggtgatcatcgccgactgtggggagtacgtgtgaggcggcactctctctgcttccccctccgctcttgaccctgcatatccaggaaggaactgccagcctcagaggaggcagcaccgagggtgcctgtttgaagcaagcagcatttgggatatgtgcccttcctcagggtctgcttggagcagctcctctgcaggcacagcctggactattcccaggcacagctgtgggcccaggagccagctcaggtgctcccctccaccatgggcaggctgtgcaaaaagccactggcttttctcagcatttgctgctgggcctctcctgggactaccagtgtggctcttacgtgttttctttgctaaaataaaccctagttctta

SEQ ID NO: 372332 - DNA, 1907 bp, Homo sapiens
cggctagtacaggccggggtaatcggccgaggcaccaagcgcgtcttgtacgtgggtggactggcagaggaagtggacgacaaagttcttcatgctgcgttcattccttttggagacatcacagatattcagattcctctggattatgaaacagaaaagcaccgaggatttgcttttgttgaatttgagttggcagaggatgctgcagcagctatcgacaacatgaatgaatctgagctttttggacgtacaattcgtgtcaatttggccaaaccaatgagaattaaggaaggctcttccaggccagtttggtcagatgatgactggttgaagaagttttctgggaagacgcttgaagagaataaagaggaagaagggtcagagcctcccaaagcagagacccaggagggagagcccattgctaaaaaggcccgctcaaatcctcaggtgtacatggacatcaagattgggaacaagccggctggccgcatccagatgctcctgcgttctgatgtcgtgcccatgacagcagagaatttccgctgcctgtgcactcatgaaaagggctttggctttaagggaagcagcttccaccgcatcatcccccagttcatgtgccagggcggtgatttcacaaaccacaatggcactgggggcaagtccatctatgggaagaagttcgatgatgaaaactttatcctcaagcatacgggaccaggtctactatccatggccaactctggcccaaacaccaatggctctcagttcttcctgacatgtgacaagacagactggctggatggcaagcatgtggtgtttggagaggtcaccgaaggcctagatgtcttgcggcaaattgaggcccagggcagcaaggacgggaagccaaagcagaaggtgatcatcgccgactgtggggagtacgtgtgaggcggcactctctctgcttccccctccgctcttgaccctgcatatccaggaaggaactgccagcctcagaggaggcagcaccgagggtgcctgtttgaagcaagcagcatttgggatatgtgcccttcctcagggtctgcttggagcagctcctctgcaggcacagcctggactattcccaggcacagctgtgggcccaggagccagctcaggtgctcccctccaccatgggcaggctgtgcaaaaagccactggcttttctcagcatttgctgctgggcctctcctgggactaccagtgtggctcttacgtgttttctttgctaaaataaaccctagttcttatattgctcttcctgctagttcttgggagttgtcagagattgtgtctgtggctaagctggacctctgaggcaggctggtgagtggggagagcagagcatctttttcacagctttcatttcctcccttgggccgatccccttagatgtcaggtgatgtatcttcacaccaggcatcgatgtcagggcaacggaaattaaagactggaaagctccggtcttctgctgcctctgctcctaaacccagctgccggccttacagccagcaagtgtactctcagtggttcatttgtttatttgttcactttcaccctacagattttaaaaaatgaaatttttataactcaaagtgccttctctgtgccaagtactatgcctatttgtcaggagacaggaagccaacaaactacatgtgccagggcggtgatttcacaaaccacaatggcactgggggcaagtccatctatgggaagaagttcgatgatgaaaactttatcctcaagcatacgggaccaggtctactatccatggccaactctggcccaaacaccaatggctctcagttcttcctgacatgtgacaagacagactggctggatggcaagcatgtggtgtttggagaggcaccgaagcctag

SEQ ID NO: 372333 - DNA, 1286 bp, Homo sapiens
aaacttacggctaggtacgaggctgggtggtggcagatggccaccaccaagcgcgtcttgtacgtgggtggactggcagaggaagtggacgacaaagttcttcatgctgcgttcattccttttggagacatcacagatattcagattcctctggattatgaaacagaaaagcaccgaggatttgcttttgttgaatttgagttggcagaggatgctgcagcagctatcgacaacatgaatgaatctgagctttttggacgtacaattcgtgtcaatttggccaaaccaatgagaattaaggaaggctcttccaggccagtttggtcagatgatgactggttgaagaagttttctgggaagacgcttgaagagaataaagaggaagaagggtcagagcctcccaaagcagagacccaggagggagagcccattgctaaaaaggcccgctcaaatcctcaggtgtacatggacatcaagattgggaacaagccggctggccgcatccagatgctcctgcgttctgatgtcgtgcccatgacagcagagaatttccgctgcctgtgcactcatgaaaagggctttggctttaagggaagcagcttccaccgcatcatcccccagttcatgtgccagggcggtgatttcacaaaccacaatggcactgggggcaagtccatctatgggaagaagttcgatgatgaaaactttatcctcaagcatacgggaccaggtctactatccatggccaactctggcccaaacaccaatggctctcagttcttcctgacatgtgacaagacagactggctggatggcaagcatgtggtgtttggagaggtcaccgaaggcctagatgtcttgcggcaaattgaggcccagggcagcaaggacgggaagccaaagcagaaggtgatcatcgccgactgtggggagtacgtgtgaggcggcactctctctgcttccccctccgctcttgaccctgcatatccaggaaggaactgccagcctcagaggaggcagcaccgagggtgcctgtttgaagcaagcagcatttgggatatgtgcccttcctcagggtctgcttggagcagctcctctgcaggcacagcctggactattcccaggcacagctgtgggcccaggagccagctcaggtgctcccctccaccatgggcaggctgtgcaaaaagccactggcttttctcagcatttgctgctgggcctctcctgggactaccagtgtggctcttacgtgttttctttgctaaaataaaccctagttctta

SEQ ID NO: 372334 - DNA, 1383 bp, Homo sapiens
gcgacccccaagggtcggggcgtggggtgggacgcatctctgaaccaggaggacggcgagctgctgtcaaggccgggtctctggcggtagtgctggcgatagctctggctgtgcttaaactccttccaaggtttcccactgtcctcaggaaaaagtgcagacttgtggactggcagaggaagtggacgacaaagttcttcatgctgcgttcattccttttggagacatcacagatattcagattcctctggattatgaaacagaaaagcaccgaggatttgcttttgttgaatttgagttggcagaggatgctgcagcagctatcgacaacatgaatgaatctgagctttttggacgtacaattcgtgtcaatttggccaaaccaatgagaattaaggaaggctcttccaggccagtttggtcagatgatgactggttgaagaagttttctgggaagacgcttgaagagaataaagaggaagaagggtcagagcctcccaaagcagagacccaggagggagagcccattgctaaaaaggcccgctcaaatcctcaggtgtacatggacatcaagattgggaacaagccggctggccgcatccagatgctcctgcgttctgatgtcgtgcccatgacagcagagaatttccgctgcctgtgcactcatgaaaagggctttggctttaagggaagcagcttccaccgcatcatcccccagttcatgtgccagggcggtgatttcacaaaccacaatggcactgggggcaagtccatctatgggaagaagttcgatgatgaaaactttatcctcaagcatacgggaccaggtctactatccatggccaactctggcccaaacaccaatggctctcagttcttcctgacatgtgacaagacagactggctggatggcaagcatgtggtgtttggagaggtcaccgaaggcctagatgtcttgcggcaaattgaggcccagggcagcaaggacgggaagccaaagcagaaggtgatcatcgccgactgtggggagtacgtgtgaggcggcactctctctgcttccccctccgctcttgaccctgcatatccaggaaggaactgccagcctcagaggaggcagcaccgagggtgcctgtttgaagcaagcagcatttgggatatgtgcccttcctcagggtctgcttggagcagctcctctgcaggcacagcctggactattcccaggcacagctgtgggcccaggagccagctcaggtgctcccctccaccatgggcaggctgtgcaaaaagccactggcttttctcagcatttgctgctgggcctctcctgggactaccagtgtggctcttacgtgttttctttgctaaaataaaccctagttctta

SEQ ID NO: 372335 - DNA, 1224 bp, Homo sapiens
cggctagtacaggccggggtaatcggccgaggcaccaagcgcgtcttgtacgtgggtggactggcagaggaagtggacgacaaagttcttcatgctgcgttcattccttttggagacatcacagatattcagattcctctggattatgaaacagaaaagcaccgaggatttgcttttgttgaatttgagttggcagaggatgctgcagcagctatcgacaacatgaatgaatctgagctttttggacgtacaattcgtgtcaatttggccaaaccaatgagaattaaggaaggctcttccaggccagtttggtcagatgatgactggttgaagaagttttctgggaagacgcttgaagagaataaagaggaagaagggtcagagcctcccaaagcagagacccaggagggagagcccattgctaaaaaggcccgctcaaatcctcaggtgtacatggacatcaagattgggaacaagccggctggccgcatccagatgctcctgcgttctgatgtcgtgcccatgacagcagagaatttccgctgcctgtgcactcatgaaaagggctttggctttaagggaagcagcttccaccgcatcatcccccagttcatgtgccagggcggtgatttcacaaaccacaatggcactgggggcaagtccatctatgggaagaagttcgatgatgaaaactttatcctcaagcatacgggaccaggtctactatccatggccaactctggcccaaacaccaatggctctcagttcttcctgacatgtgacaagacagactggctggatggcaagcatgtggtgtttggagaggtcaccgaaggcctagatgtcttgcggcaaattgaggttgccccagataccaaggcatcaaaagccaggggatccagaaaaaacaaagatggccaagagagaaactgggggaaaagccaaaaggttgagagccacaccatctagaagcttcctgcctgcggtgcggcacagaaacaagaagagtcagcaattaccagccagccgaggtcctggaagctgacgtagagctcgtgccgacggcagacctgccggccgtgggagccgtggacgtcatctgcagggacagaaggggcaaggtcttttctggggttcctactgtgtgcagctactatggggtaccagggtgggggatgccctgatgagcacatttgtcaaataaatgaatgacaggaaaccaat

SEQ ID NO: 372336 - DNA, 979 bp, Homo sapiens
  misc_feature (893)..(893): n is a, c, g, or t
  misc_feature (896)..(896): n is a, c, g, or t
  misc_feature (901)..(902): n is a, c, g, or t
  misc_feature (910)..(910): n is a, c, g, or t
  misc_feature (926)..(926): n is a, c, g, or t
cggctagtacaggccggggtaatcggccgaggcaccaagcgcgtcttgtacgtgggtggactggcagaggaagtggacgacaaagttcttcatgctgcgttcattccttttggagacatcacagatattcagattcctctggattatgaaacagaaaagcaccgaggatttgcttttgttgaatttgagttggcagaggatgctgcagcagctatcgacaacatgaatgaatctgagctttttggacgtacaattcgtgtcaatttggccaaaccaatgagaattaaggaaggctcttccaggccagtttggtcagatgatgactggttgaagaagttttctgggaagacgcttgaagagaataaagaggaagaagggtcagagcctcccaaagcagagacccaggagggagagcccattgctaaaaaggcccgctcaaatcctcaggtgtacatggacatcaagattgggaacaagccggctggccgcatccagatgctcctgcgttctgatgtcgtgcccatgacagcagagaatttccgctgcctgtgcactcatgaaaagggctttggctttaagggaagcagcttccaccgcatcatcccccagttcatgtgccagggcggtgatttcacaaaccacaatggcactgggggcaagtccatctatgggaagaagttcgatgatgaaaactttatcctcaagcatacgggaccaggtctactatccatggccaactctggcccaaacaccaatggctctcagttcttcctgacatgtgacaagacagactggctggatggcaagcatgtggtgtttggagaggtcaccgaaggcctagatgtcttgcggcaaattgagtggggaaatgaggccggcccagacggaaccanaangggcnngccggggngacgtgagggaccttncccccgttacgttcgaggggcccaggggccggtctgaaatgttgccccggggg

SEQ ID NO: 372337 - DNA, 1416 bp, Homo sapiens
ggtcgcgtcgacacggctgcgagaagacgacaaaagggggaaagcgcgcgagcaagatggccaccaccaagcgcgtcttgtacgtgggtggactggcagaggaagtggacgacaaagttcttcatgctgcgttcattccttttggagacatcacagatattcagattcctctggattatgaaacagaaaagcaccgaggatttgcttttgttgaatttgagttggcagaggatgctgcagcagctatcgacaacatggtatggctgggaatcttaattctaactaaagttgctttttggtggtacagaggctccttattcatatatcagtgttctggacttccaaagttacaaggttgcatggggagaatgaatctgagctttttggacgtacaattcgtgtcaatttggccaaaccaatgagaattaaggaaggctcttccaggccagtttggtcagatgatgactggttgaagaagttttctgggaagacgcttgaagagaataaagaggaagaagggtcagagcctcccaaagcagagacccaggagggagagcccattgctaaaaaggcccgctcaaatcctcaggtgtacatggacatcaagattgggaacaagccggctggccgcatccagatgctcctgcgttctgatgtcgtgcccatgacagcagagaatttccgctgcctgtgcactcatgaaaagggctttggctttaagggaagcagcttccaccgcatcatcccccagttcatgtgccagggcggtgatttcacaaaccacaatggcactgggggcaagtccatctatgggaagaagttcgatgatgaaaactttatcctcaagcatacgggaccaggtctactatccatggccaactctggcccaaacaccaatggctctcagttcttcctgacatgtgacaagacagactggctggatggcaagcatgtggtgtttggagaggtcaccgaaggcctagatgtcttgcggcaaattgaggcccagggcagcaaggacgggaagccaaagcagaaggtgatcatcgccgactgtggggagtacgtgtgaggcggcactctctctgcttccccctccgctcttgaccctgcatatccaggaaggaactgccagcctcagaggaggcagcaccgagggtgcctgtttgaagcaagcagcatttgggatatgtgcccttcctcagggtctgcttggagcagctcctctgcaggcacagcctggactattcccaggcacagctgtgggcccaggagccagctcaggtgctcccctccaccatgggcaggctgtgcaaaaagccactggcttttctcagcatttgctgctgggcctctcctgggactaccagtgtggctcttacgtgttttctttgctaaaataaaccctagttctta

SEQ ID NO: 372338 - DNA, 1267 bp, Homo sapiens
ggtcgcgtcgacacggctgcgagaagacgacaaaagggggaaagcgcgcgagcaagatggccaccaccaagcgcgtcttgtacgtgggtggactggcagaggaagtggacgacaaagttcttcatgctgcgttcattccttttggagacatcacagatattcagattcctctggattatgaaacagaaaagcaccgaggatttgcttttgttgaatttgagttggcagaggatgctgcagcagctatcgacaacatgaatgaatctgagctttttggacgtacaattcgtgtcaatttggccaaaccaatgagaattaaggaaggctcttccaggccagtttggtcagatgatgactggttgaagaagttttctgggaagacgcttgaagagaataaagaggaagaagggtcagagcctcccaaagcagagacccaggaggtgtacatggacatcaagattgggaacaagccggctggccgcatccagatgctcctgcgttctgatgtcgtgcccatgacagcagagaatttccgctgcctgtgcactcatgaaaagggctttggctttaagggaagcagcttccaccgcatcatcccccagttcatgtgccagggcggtgatttcacaaaccacaatggcactgggggcaagtccatctatgggaagaagttcgatgatgaaaactttatcctcaagcatacgggaccaggtctactatccatggccaactctggcccaaacaccaatggctctcagttcttcctgacatgtgacaagacagactggctggatggcaagcatgtggtgtttggagaggtcaccgaaggcctagatgtcttgcggcaaattgaggcccagggcagcaaggacgggaagccaaagcagaaggtgatcatcgccgactgtggggagtacgtgtgaggcggcactctctctgcttccccctccgctcttgaccctgcatatccaggaaggaactgccagcctcagaggaggcagcaccgagggtgcctgtttgaagcaagcagcatttgggatatgtgcccttcctcagggtctgcttggagcagctcctctgcaggcacagcctggactattcccaggcacagctgtgggcccaggagccagctcaggtgctcccctccaccatgggcaggctgtgcaaaaagccactggcttttctcagcatttgctgctgggcctctcctgggactaccagtgtggctcttacgtgttttctttgctaaaataaaccctagttctta

SEQ ID NO: 372339 - DNA, 1153 bp, Homo sapiens
ggtcgcgtcgacacggctgcgagaagacgacaaaagggggaaagcgcgcgagcaagatggccaccaccaagcgcgtcttgtacgtgggtggactggcagaggaagtggacgacaaagttcttcatgctgcgttcattccttttggagacatcacagatattcagattcctctggattatgaaacagtttggtcagatgatgactggttgaagaagttttctgggaagacgcttgaagagaataaagaggaagaagggtcagagcctcccaaagcagagacccaggagggagagcccattgctaaaaaggcccgctcaaatcctcaggtgtacatggacatcaagattgggaacaagccggctggccgcatccagatgctcctgcgttctgatgtcgtgcccatgacagcagagaatttccgctgcctgtgcactcatgaaaagggctttggctttaagggaagcagcttccaccgcatcatcccccagttcatgtgccagggcggtgatttcacaaaccacaatggcactgggggcaagtccatctatgggaagaagttcgatgatgaaaactttatcctcaagcatacgggaccaggtctactatccatggccaactctggcccaaacaccaatggctctcagttcttcctgacatgtgacaagacagactggctggatggcaagcatgtggtgtttggagaggtcaccgaaggcctagatgtcttgcggcaaattgaggcccagggcagcaaggacgggaagccaaagcagaaggtgatcatcgccgactgtggggagtacgtgtgaggcggcactctctctgcttccccctccgctcttgaccctgcatatccaggaaggaactgccagcctcagaggaggcagcaccgagggtgcctgtttgaagcaagcagcatttgggatatgtgcccttcctcagggtctgcttggagcagctcctctgcaggcacagcctggactattcccaggcacagctgtgggcccaggagccagctcaggtgctcccctccaccatgggcaggctgtgcaaaaagccactggcttttctcagcatttgctgctgggcctctcctgggactaccagtgtggctcttacgtgttttctttgctaaaataaaccctagttctta

SEQ ID NO: 372340 - DNA, 900 bp, Homo sapiens
cggctagtacaggccggggtaatcggccgaggcaccaagcgcgtcttgtacgtgggtggactggcagaggaagtggacgacaaagttcttcatgctgcgttcattccttttggagacatcacagatattcagattcctctggattatgaaacagaaaagcaccgaggatttgcttttgttgaatttgagttggcagaggatgctgcagcagctatcgacaacatgaatgaatctgagctttttggacgtacaattcgtgtcaatttggccaaaccaatgagaattaaggaaggctcttccaggccagtttggtcagatgatgactggttgaagaagttttctgggaagacgcttgaagagaataaagaggaagaagggtcagagcctcccaaagcagagacccaggagggagagcccattgctaaaaaggcccgctcaaatcctcaggtgtacatggacatcaagattgggaacaagccggctggccgcatccagatgctcctgcgttctgatgtcgtgcccatgacagcagagaatttccgctgcctgtgcactcatgaaaagggctttggctttaagggaagcagcttccaccgcatcatcccccagttcatgtgccagggcggtgatttcacaaaccacaatggcactgggggcaagtccatctatgggaagaagttcgatgatgaaaactttatcctcaagcatacgggaccaggtctactatccatggccaactctggcccaaacaccaatggctctcagttcttcctgacatgtgacaagacagagctgtgcaaaaagccactggcttttctcagcatttgctgctgggcctctcctgggactaccagtgtggctcttacgtgttttctttgctaaaataaaccctagttctta

SEQ ID NO: 372341 - DNA, 1463 bp, Homo sapiens
aaacttacggctaggtacgaggctgggtggtggcagatggccaccaccaagcgcgtcttgtacgtgggtggactggcagaggaagtggacgacaaagttcttcatgctgcgttcattccttttggagacatcacagatattcagattcctctggattatgaaacagaaaagcaccgaggatttgcttttgttgaatttgagttggcagaggatgctgcagcagctatcgacaacatgaatgaatctgagctttttggacgtacaattcgtgtcaatttggccaaaccaatgagaattaaggaaggctcttccaggccagtttggtcagatgatgactggttgaagaagttttctgggaagacgcttgaagagaataaagaggaagaagggtcagagcctcccaaagcagagacccaggagggagagcccattgctaaaaaggcccgctcaaatcctcaggtgtacatggacatcaagattgggaacaagccggctggccgcatccagatgctcctgcgttctgatgtcgtgcccatgacagcagccaggtgtatggtacatgcctgtagtcccagctactcaagaggctgaggcaggggaatgacttgaacccaagaggtggaagttgcagtgaactgagattgtgccattgcactgcagcatgggcaacaagagtgaaactccgtctcaaggaaaaagaatcccttatagtccttacaagagaatttccgctgcctgtgcactcatgaaaagggctttggctttaagggaagcagcttccaccgcatcatcccccagttcatgtgccagggcggtgatttcacaaaccacaatggcactgggggcaagtccatctatgggaagaagttcgatgatgaaaactttatcctcaagcatacgggaccaggtctactatccatggccaactctggcccaaacaccaatggctctcagttcttcctgacatgtgacaagacagactggctggatggcaagcatgtggtgtttggagaggtcaccgaaggcctagatgtcttgcggcaaattgaggcccagggcagcaaggacgggaagccaaagcagaaggtgatcatcgccgactgtggggagtacgtgtgaggcggcactctctctgcttccccctccgctcttgaccctgcatatccaggaaggaactgccagcctcagaggaggcagcaccgagggtgcctgtttgaagcaagcagcatttgggatatgtgcccttcctcagggtctgcttggagcagctcctctgcaggcacagcctggactattcccaggcacagctgtgggcccaggagccagctcaggtgctcccctccaccatgggcaggctgtgcaaaaagccactggcttttctcagcatttgctgctgggcctctcctgggactaccagtgtggctcttacgtgttttctttgctaaaataaaccctagttctta

SEQ ID NO: 372342 - DNA, 1323 bp, Homo sapiens
gaataatattccgttgtatttggataaatatcttgttcattcatttgttgatgggcacttgcacattgttttcaccttttgactattgtaaatgcctgtgtgaatatccacatgtaagtatatgtttaaattcctgttttcaattcttttggatatatatgcctaggaatggaaatgcttagtcatatggtaactctgtatttaactttttgaggaaatgccaaactattttccacagtggctggaccattttacatttctaccagcaatgtatgagtgtttcagtttttccacatcttctctttttttttttttttttttttttttgagacagagtctcgcactgttgcccgggctggagtacagtggcgtgatattggctcactgcaacctccgcctcccaggttcaagtgattcttgtgcctcagctcccagctactcaagaggctgaggcaggggaatgacttgaacccaagaggtggaagttgcagtgaactgagattgtgccattgcactgcagcatgggcaacaagagtgaaactccgtctcaaggaaaaagaatcccttatagtccttacaagagaatttccgctgcctgtgcactcatgaaaagggctttggctttaagggaagcagcttccaccgcatcatcccccagttcatgtgccagggcggtgatttcacaaaccacaatggcactgggggcaagtccatctatgggaagaagttcgatgatgaaaactttatcctcaagcatacgggaccaggtctactatccatggccaactctggcccaaacaccaatggctctcagttcttcctgacatgtgacaagacagactggctggatggcaagcatgtggtgtttggagaggtcaccgaaggcctagatgtcttgcggcaaattgaggcccagggcagcaaggacgggaagccaaagcagaaggtgatcatcgccgactgtggggagtacgtgtgaggcggcactctctctgcttccccctccgctcttgaccctgcatatccaggaaggaactgccagcctcagaggaggcagcaccgagggtgcctgtttgaagcaagcagcatttgggatatgtgcccttcctcagggtctgcttggagcagctcctctgcaggcacagcctggactattcccaggcacagctgtgggcccaggagccagctcaggtgctcccctccaccatgggcaggctgtgcaaaaagccactggcttttctcagcatttgctgctgggcctctcctgggactaccagtgtggctcttacgtgttttctttgctaaaataaaccctagttctta

SEQ ID NO: 372343 - DNA, 911 bp, Homo sapiens
ggtcgcgtcgacacggctgcgagaagacgacaaaagggggaaagcgcgcgagcaagatggccaccaccaagcgcgtcttgtacgtgggtggactggcagaggaagtggacgacaaagttcttcatgctgcgttcattccttttggagacatcacagatattcagattcctctggattatgaaacagaaaagcaccgaggatttgcttttgttgaatttgagttggcagaggatgctgcagcagctatcgacaacatgaatgaatctgagctttttggacgtacaattcgtgtcaatttggccaaaccaatgagaattaaggaaggctcttccaggccagtttggtcagatgatgactggttgaagaagttttctgggaagacgcttgaagagaataaagaggaagaagggtcagagcctcccaaagcagagacccaggagggagagcccattgctaaaaaggcccgctcaaatcctcaggtgtacatggacatcaagattgggaacaagccggctggccgcatccagatgctcctgcgttctgatgtcgtgcccatgacagcagagaatttccgctgcctgtgcactcatgaaaagggctttggctttaagggaagcagcttccaccgcatcatcccccagttcatgtgccagggcggtgatttcacaaaccacaatggcactgggggcaagtccatctatgggaagaagttcgatgatgaaaactttatcctcaagcatacgggaccagtctatatcatggcaatcttggccaaacatgtattcatttccgggcattgaccccagctgggtgctgcactttgtgtcgaagaccgcgcaaatctggcgacaagcccgtccacgcggaacaaccacacaacacagggacagtacgctctgcactcacaacaa

SEQ ID NO: 372344 - DNA, 483 bp, Homo sapiens
ggtcgcgtcgacacggctgcgagaagacgacaaaagggggaaagcgcgcgagcaagatggccaccaccaagcgcgtcttgtacgtgggtggactggcagaggaagtggacgacaaagttcttcatgctgcgttcattccttttggagacatcacagatattcagattcctctggattatgaaacagaaaagcaccgaggatttgcttttgttgaatttgagttggcagaggatgctgcagcagctatcgacaacatgaatgaatctgagctttttggacgtacaattcgtgtcaatttggccaaaccaatgagaattaaggaaggctcttccaggccaggagccagctcaggtgctcccctccaccatgggcaggctgtgcaaaaagccactggcttttctcagcatttgctgctgggcctctcctgggactaccagtgtggctcttacgtgttttctttgctaaaataaaccctagttctta

SEQ ID NO: 372345 - DNA, 319 bp, Homo sapiens
caggaactgggattctaggtaaaaagttctagaaggaagcctcggtgccagaatccacaaacacacagagcactcaacagtgagcagcaccagtgatcccatcagaaacctgcttttgtcctttaaggttgccccagataccaaggcatcaaaagccaggggatccagaaaaaacaaagatggccaagagagaaactgggggaaaagccaaaaggttgagagccacaccatctagaagcttcctgcctgcggtgcggcacaggtgggtgagtgcacacgcacaccccacacactgtgcacacatatcacgggcggtcag

SEQ ID NO: 372346 - DNA, 332 bp, Homo sapiens
aggctgtgcaataccaggaactgggattctaggtaaaaagttctagaaggaagcctcggtgccagaatccacaaacacacagagcactcaacagtgagcagcaccagtgatcccatcagaaacctgcttttgtcctttaaggttgccccagataccaaggcatcaaaagccaggggatccagaaaaaacaaagatggccaagagagaaactgggggaaaagccaaaaggttgagagccacaccatctagaagcttcctgcctgcggtgcggcacaggtgggtgagtgcacacgcacaccccacacactgtgcacacatatcacgggcggtca

SEQ ID NO: 372347 - DNA, 1307 bp, Homo sapiens
ctactactactaggccacgcgtcgactagtacgggggggggaaagcgcgcgagcaagatggccaccaccaagcgcgtcttgtacgtgggtggactggcagaggaagtggacgacaaagttcttcatgctgcgttcattccttttggagacatcacagatattcagattcctctggattatgaaacagaaaagcaccgaggatttgcttttgttgaatttgagttggcagaggatgctgcagcagctatcgacaacatgaatgaatctgagctttttggacgtacaattcgtgtcaatttggccaaaccaatgagaattaaggaaggctcttccaggccagtttggtcagatgatgactggttgaagaagttttctgggaagacgcttgaagagaataaagaggaagaagggtcagagcctcccaaagcagagacccaggagggagagcccattgctaaaaaggcccgctcaaatcctcaggtgtacatggacatcaagattgggaacaagccggctggccgcatccagatgctcctgcgttctgatgtcgtgcccatgacagcagagaatttccgctgcctgtgcactcatgaaaagggctttggctttaagggaagcagcttccaccgcatcatcccccagttcatgtgccagggcggtgatttcacaaaccacaatggcactgggggcaagtccatctatgggaagaagttcgatgatgaaaactttatcctcaagcatacgggaccaggtctactatccatggccaactctggcccaaacaccaatggctctcagttcttcctgacatgtgacaagacagactggctggatggcaagcatgtggtgtttggagaggtcaccgaaggcctagatgtcttgcggcaaattgaggcccagggcagcaaggacgggaagccaaagcagaaggtgatcatcgccgactgtggggagtacgtgtgaggcggcactctctctgcttccccctccgctcttgaccctgcatatccaggaaggaactgccagcctcagaggaggcagcaccgagggtgcctgtttgaagcaagcagcatttgggatatgtgcccttcctcagggtctgcttggagcagctcctctgcaggcacagcctggactattcccaggcacagctgtgggcccaggagccagctcaggtgctcccctccaccatgggcaggctgtgcaaaaagccactggcttttctcagcatttgctgctgggcctctcctgggactaccagtgtggctcttacgtgttttctttgctaaaataaaccctagttctta

SEQ ID NO: 372348 - DNA, 877 bp, Homo sapiens
taggctaggtacgaggctgggtgttactcggccgaggcgcgtcttgtacgtgggtggactggcagaggaagtggacgacaaagttcttcatgctgcgttcattccttttggagacatcacagatattcagattcctctggattatgaaacagaaaagcaccgaggatttgcttttgttgaatttgagttggcagaggatgctgcagcagctatcgacaacatgaatgaatctgagctttttggacgtacaattcgtgtcaatttggccaaaccaatgagaattaaggaaggctcttccaggccagtttggtcagatgatgactggttgaagaagttttctgggaagacgcttgaagagaataaagaggaagaagggtcagagcctcccaaagcagagacccaggagggagagcccattgctaaaaaggcccgctcaaatcctcaggtgtacatggacatcaagattgggaacaagccggctggccgcatccagatgctcctgcgttctgatgtcgtgcccatgacagcagagaatttccgctgcctgtgcactcatgaaaagggctttggctttaagggaagcagcttccaccgcatcatcccccagttcatgtgccagggcggtgatttcacaaaccacaatggcactgggggcaagtccatctatgggaagaagttcgatgatgaaaactttatcctcaagcatacgggaccagtctatatcatggcaatcttggccaaacatgtattcatttccgggcattgaccccagctgggtgctgcactttgtgtcgaagaccgcgcaaatctggcgacaagcccgtccacgcggaacaaccacacaacacagggacagtacgctctgcactcacaacaa

SEQ ID NO: 372349 - DNA, 1274 bp, Homo sapiens
cggctagtacaggccggggtaatcggccgaggcaccaagcgcgtcttgtacgtgggtggactggcagaggaagtggacgacaaagttcttcatgctgcgttcattccttttggagacatcacagatattcagattcctctggattatgaaacagaaaagcaccgaggatttgcttttgttgaatttgagttggcagaggatgctgcagcagctatcgacaacatgaatgaatctgagctttttggacgtacaattcgtgtcaatttggccaaaccaatgagaattaaggaaggctcttccaggccagtttggtcagatgatgactggttgaagaagttttctgggaagacgcttgaagagaataaagaggaagaagggtcagagcctcccaaagcagagacccaggagggagagcccattgctaaaaaggcccgctcaaatcctcaggtgtacatggacatcaagattgggaacaagccggctggccgcatccagatgctcctgcgttctgatgtcgtgcccatgacagcagagaatttccgctgcctgtgcactcatgaaaagggctttggctttaagggaagcagcttccaccgcatcatcccccagttcatgtgccagggcggtgatttcacaaaccacaatggcactgggggcaagtccatctatgggaagaagttcgatgatgaaaactttatcctcaagcatacgggaccaggtctactatccatggccaactctggcccaaacaccaatggctctcagttcttcctgacatgtgacaagacagactggctggatggcaagcatgtggtgtttggagaggtcaccgaaggcctagatgtcttgcggcaaattgaggcccagggcagcaaggacgggaagccaaagcagaaggtgatcatcgccgactgtggggagtacgtgtgaggcggcactctctctgcttccccctccgctcttgaccctgcatatccaggaaggaactgccagcctcagaggaggcagcaccgagggtgcctgtttgaagcaagcagcatttgggatatgtgcccttcctcagggtctgcttggagcagctcctctgcaggcacagcctggactattcccaggcacagctgtgggcccaggagccagctcaggtgctcccctccaccatgggcaggctgtgcaaaaagccactggcttttctcagcatttgctgctgggcctctcctgggactaccagtgtggctcttacgtgttttctttgctaaaataaaccctagttctta

SEQ ID NO: 372350 - DNA, 1448 bp, Homo sapiens
cggctagtacaggccggggtaatcggccgaggcaccaagcgcgtcttgtacgtgggtggactggcagaggaagtggacgacaaagttcttcatgctgcgttcattccttttggagacatcacagatattcagattcctctggattatgaaacagaaaagcaccgaggatttgcttttgttgaatttgagttggcagaggatgctgcagcagctatcgacaacatgaatgaatctgagctttttggacgtacaattcgtgtcaatttggccaaaccaatgagaattaaggaaggctcttccaggccagtttggtcagatgatgactggttgaagaagttttctgggaagacgcttgaagagaataaagaggaagaagggtcagagcctcccaaagcagagacccaggagggagagcccattgctaaaaaggcccgctcaaatcctcaggtgtacatggacatcaagattgggaacaagccggctggccgcatccagatgctcctgcgttctgatgtcgtgcccatgacagcagagaatttccgctgcctgtgcactcatgaaaagggctttggctttaagggaagcagcttccaccgcatcatcccccagttcatgtgccagggcggtgatttcacaaaccacaatggcactgggggcaagtccatctatgggaagaagttcgatgatgaaaactttatcctcaagcatacgggaccaggtctactatccatggccaactctggcccaaacaccaatggctctcagttcttcctgacatgtgacaagacagactggctggatggcaagcatgtggtgtttggagaggtcaccgaaggcctagatgtcttgcggcaaattgaggcccagggcagcaaggacgggaagccaaagcagaaggtgatcatcgccgactgtggggagtacgtgtgaggcggcactctctctgcttccccctccgctcttgaccctgcatatccaggaaggaactgccagcctcagaggaggcagcaccgagggtgcctgtttgaagcaagcagcatttgggatatgtgcccttcctcagggtctgcttggagcagctcctctgcaggcacagcctggactattcccaggcacagctgtgggcccaggagccagctcaggtgctcccctccaccatgggcaggctgtgcaaaaagccactggcttttctcagcatttgctgctgggcctctcctgggactaccagtgtggctcttacgtgttttctttgctaaaataaaccctagttcttaaaaaaaaaaaactcgggctcattccggggcggaaaggtaatgatggctggcagctgtcccggccctttcggacaggggatgccggccctagggggtaaatcaagcgtcgtttatacgagggtaaaaaagggaaaagggaaaaagagtcaacaagaaaaagagaaatagacgcat

SEQ ID NO: 372351 - DNA, 1272 bp, Homo sapiens
taggctaggtacgaggctgggtgttactcggccgaggcgcgtcttgtacgtgggtggactggcagaggaagtggacgacaaagttcttcatgctgcgttcattccttttggagacatcacagatattcagattcctctggattatgaaacagaaaagcaccgaggatttgcttttgttgaatttgagttggcagaggatgctgcagcagctatcgacaacatgaatgaatctgagctttttggacgtacaattcgtgtcaatttggccaaaccaatgagaattaaggaaggctcttccaggccagtttggtcagatgatgactggttgaagaagttttctgggaagacgcttgaagagaataaagaggaagaagggtcagagcctcccaaagcagagacccaggagggagagcccattgctaaaaaggcccgctcaaatcctcaggtgtacatggacatcaagattgggaacaagccggctggccgcatccagatgctcctgcgttctgatgtcgtgcccatgacagcagagaatttccgctgcctgtgcactcatgaaaagggctttggctttaagggaagcagcttccaccgcatcatcccccagttcatgtgccagggcggtgatttcacaaaccacaatggcactgggggcaagtccatctatgggaagaagttcgatgatgaaaactttatcctcaagcatacgggaccaggtctactatccatggccaactctggcccaaacaccaatggctctcagttcttcctgacatgtgacaagacagactggctggatggcaagcatgtggtgtttggagaggtcaccgaaggcctagatgtcttgcggcaaattgaggcccagggcagcaaggacgggaagccaaagcagaaggtgatcatcgccgactgtggggagtacgtgtgaggcggcactctctctgcttccccctccgctcttgaccctgcatatccaggaaggaactgccagcctcagaggaggcagcaccgagggtgcctgtttgaagcaagcagcatttgggatatgtgcccttcctcagggtctgcttggagcagctcctctgcaggcacagcctggactattcccaggcacagctgtgggcccaggagccagctcaggtgctcccctccaccatgggcaggctgtgcaaaaagccactggcttttctcagcatttgctgctgggcctctcctgggactaccagtgtggctcttacgtgttttctttgctaaaataaaccctagttctta

SEQ ID NO: 372352 - DNA, 1102 bp, Homo sapiens
ggtcgcgtcgacacggctgcgagaagacgacaaaagggggaaagcgcgcgagcaagatggccaccaccaagcgcgtcttgtacgtgggtggactggcagaggaagtggacgacaaagttcttcatgctgcgttcattccttttggagacatcacagatattcagattcctctggattatgaaacagaaaagcaccgaggatttgcttttgttgaatttgagttggcagaggatgctgcagcagctatcgacaacatgaatgaatctgagctttttggacgtacaattcgtgtcaatttggccaaaccaatgagaattaaggaaggctcttccaggccagtttggtcagatgatgactggttgaagaagttttctgggaagacgcttgaagagaataaagaggaagaagggtcagagcctcccaaagcagagacccaggagggagagcccattgctaaaaaggcccgctcaaatcctcaggtgtacatggacatcaagattgggaacaagccggctggccgcatccagatgctcctgcgttctgatgtcgtgcccatgacagcagagaatttccgctgcctgtgcactcatgaaaagggctttggctttaagggaagcagcttccaccgcatcatcccccagttcatgtgccagggcggtgatttcacaaaccacaatggcactgggggcaagtccatctatgggaagaagttcgatgatgaaaactttatcctcaagcatacgggaccaggtctactatccatggccaactctggcccaaacaccaatggctctcagttcttcctgacatgtgacaagacagactggctggatggcaagcatgtggtgtttggagaggtcaccgaaggcctagatgtcttgcggcaaattgagaaacaagaagagtcagcaattaccagccagccgaggtcctggaagctgacgtagagctcgtgccgtgggagccgtggacgtcatctgcagggacagaaggggcaaggtcttttctggggttcctactgtgtgcagctactatggggtaccagggtgggggatgccctgatgagcacatttgtcaaataaatgaatgacaggaaaccaat

SEQ ID NO: 372353 - DNA, 1653 bp, Homo sapiens
gcgacccccaagggtcggggcgtggggtgggacgcatctctgaaccaggaggacggcgagctgctgtcaaggccgggtctctggcggtagtgctggcgatagctctggctgtgcttaaactccttccaaggtttcccactgtcctcaggaaaaagtgcagacttcttagcagtacgcacttctccagcttctttgctttgcttcccgattcgctgggtctcccgaaaaatgacccacttgcccccaaggttcaggttatttcacacctttgggcctctgcttttgcgactcccttgcagtgaacagccttgccacacacctcaggtggactggcagaggaagtggacgacaaagttcttcatgctgcgttcattccttttggagacatcacagatattcagattcctctggattatgaaacagaaaagcaccgaggatttgcttttgttgaatttgagttggcagaggatgctgcagcagctatcgacaacatggtatggctgggaatcttaattctaactaaagttgctttttggtggtacagaggctccttattcatatatcagtgttctggacttccaaagttacaaggttgcatggggagaatgaatctgagctttttggacgtacaattcgtgtcaatttggccaaaccaatgagaattaaggaaggctcttccaggccagtttggtcagatgatgactggttgaagaagttttctgggaagacgcttgaagagaataaagaggaagaagggtcagagcctcccaaagcagagacccaggagggagagcccattgctaaaaaggcccgctcaaatcctcaggtgtacatggacatcaagattgggaacaagccggctggccgcatccagatgctcctgcgttctgatgtcgtgcccatgacagcagagaatttccgctgcctgtgcactcatgaaaagggctttggctttaagggaagcagcttccaccgcatcatcccccagttcatgtgccagggcggtgatttcacaaaccacaatggcactgggggcaagtccatctatgggaagaagttcgatgatgaaaactttatcctcaagcatacgggaccaggtctactatccatggccaactctggcccaaacaccaatggctctcagttcttcctgacatgtgacaagacagactggctggatggcaagcatgtggtgtttggagaggtcaccgaaggcctagatgtcttgcggcaaattgaggcccagggcagcaaggacgggaagccaaagcagaaggtgatcatcgccgactgtggggagtacgtgtgaggcggcactctctctgcttccccctccgctcttgaccctgcatatccaggaaggaactgccagcctcagaggaggcagcaccgagggtgcctgtttgaagcaagcagcatttgggatatgtgcccttcctcagggtctgcttggagcagctcctctgcaggcacagcctggactattcccaggcacagctgtgggcccaggagccagctcaggtgctcccctccaccatgggcaggctgtgcaaaaagccactggcttttctcagcatttgctgctgggcctctcctgggactaccagtgtggctcttacgtgttttctttgctaaaataaaccctagttctta

SEQ ID NO: 372354 - DNA, 1252 bp, Homo sapiens
ggtcgcgtcgacacggctgcgagaagacgacaaaagggggaaagcgcgcgagcaagatggccaccaccaagcgcgtcttgtacgtgggtggactggcagaggaagtggacgacaaagttcttcatgctgcgttcattccttttggagacatcacagatattcagattcctctggattatgaaacagaaaagcaccgaggatttgcttttgttgaatttgagttggcagaggatgctgcagcagctatcgacaacatgaatgaatctgagctttttggacgtacaattcgtgtcaatttggccaaaccaatgagaattaaggaaggctcttccaggccagtttggtcagatgatgactggttgaagaagttttctgggaagacgcttgaagagaataaagaggaagaagggtcagagcctcccaaagcagagacccaggagggagagcccattgctaaaaaggcccgctcaaatcctcaggtgtacatggacatcaagattgggaacaagccggctggccgcatccagatgctcctgcgttctgatgtcgtgcccatgacagcagagaatttccgctgcctgtgcactcatgaaaagggctttggctttaagggaagcagcttccaccgcatcatcccccagttcatgtgccagggcggtgatttcacaaaccacaatggcactgggggcaagtccatctatgggaagaagttcgatgatggcccaaacaccaatggctctcagttcttcctgacatgtgacaagacagactggctggatggcaagcatgtggtgtttggagaggtcaccgaaggcctagatgtcttgcggcaaattgaggcccagggcagcaaggacgggaagccaaagcagaaggtgatcatcgccgactgtggggagtacgtgtgaggcggcactctctctgcttccccctccgctcttgaccctgcatatccaggaaggaactgccagcctcagaggaggcagcaccgagggtgcctgtttgaagcaagcagcatttgggatatgtgcccttcctcagggtctgcttggagcagctcctctgcaggcacagcctggactattcccaggcacagctgtgggcccaggagccagctcaggtgctcccctccaccatgggcaggctgtgcaaaaagccactggcttttctcagcatttgctgctgggcctctcctgggactaccagtgtggctcttacgtgttttctttgctaaaataaaccctagttctta

SEQ ID NO: 372355 - DNA, 1483 bp, Homo sapiens
ggtcgcgtcgacacggctgcgagaagacgacaaaagggggaaagcgcgcgagcaagatggccaccaccaagcgcgtcttgtacgtgggtggactggcagaggaagtggacgacaaagttcttcatgctgcgttcattccttttggagacatcacagatattcagattcctctggattatgaaacagaaaagcaccgaggatttgcttttgttgaatttgagttggcagaggatgctgcagcagctatcgacaacatgaatgaatctgagctttttggacgtacaattcgtgtcaatttggccaaaccaatgagaattaaggaaggctcttccaggccagtttggtcagatgatgactggttgaagaagttttctgggaagacgcttgaagagaataaagaggaagaagggtcagagcctcccaaagcagagacccaggagggagagcccattgctaaaaaggcccgctcaaatcctcaggtgtacatggacatcaagattgggaacaagccggctggccgcatccagatgctcctgcgttctgatgtcgtgcccatgacagcagccaggtgtatggtacatgcctgtagtcccagctactcaagaggctgaggcaggggaatgacttgaacccaagaggtggaagttgcagtgaactgagattgtgccattgcactgcagcatgggcaacaagagtgaaactccgtctcaaggaaaaagaatcccttatagtccttacaagagaatttccgctgcctgtgcactcatgaaaagggctttggctttaagggaagcagcttccaccgcatcatcccccagttcatgtgccagggcggtgatttcacaaaccacaatggcactgggggcaagtccatctatgggaagaagttcgatgatgaaaactttatcctcaagcatacgggaccaggtctactatccatggccaactctggcccaaacaccaatggctctcagttcttcctgacatgtgacaagacagactggctggatggcaagcatgtggtgtttggagaggtcaccgaaggcctagatgtcttgcggcaaattgaggcccagggcagcaaggacgggaagccaaagcagaaggtgatcatcgccgactgtggggagtacgtgtgaggcggcactctctctgcttccccctccgctcttgaccctgcatatccaggaaggaactgccagcctcagaggaggcagcaccgagggtgcctgtttgaagcaagcagcatttgggatatgtgcccttcctcagggtctgcttggagcagctcctctgcaggcacagcctggactattcccaggcacagctgtgggcccaggagccagctcaggtgctcccctccaccatgggcaggctgtgcaaaaagccactggcttttctcagcatttgctgctgggcctctcctgggactaccagtgtggctcttacgtgttttctttgctaaaataaaccctagttctta

SEQ ID NO: 372356 - DNA, 851 bp, Homo sapiens
gttttaaaataagagatactcattataaacctttgtgatactaaccttgtaaggactataagggattctttttccttgagacggagtttcactcttgttgcccatgctgagaatttccgctgcctgtgcactcatgaaaagggctttggctttaagggaagcagcttccaccgcatcatcccccagttcatgtgccagggcggtgatttcacaaaccacaatggcactgggggcaagtccatctatgggaagaagttcgatgatgaaaactttatcctcaagcatacgggaccaggtctactatccatggccaactctggcccaaacaccaatggctctcagttcttcctgacatgtgacaagacagactggctggatggcaagcatgtggtgtttggagaggtcaccgaaggcctagatgtcttgcggcaaattgaggcccagggcagcaaggacgggaagccaaagcagaaggtgatcatcgccgactgtggggagtacgtgtgaggcggcactctctctgcttccccctccgctcttgaccctgcatatccaggaaggaactgccagcctcagaggaggcagcaccgagggtgcctgtttgaagcaagcagcatttgggatatgtgcccttcctcagggtctgcttggagcagctcctctgcaggcacagcctggactattcccaggcacagctgtgggcccaggagccagctcaggtgctcccctccaccatgggcaggctgtgcaaaaagccactggcttttctcagcatttgctgctgggcctctcctgggactaccagtgtggctcttacgtgttttctttgctaaaataaaccctagttctta

SEQ ID NO: 372357 - DNA, 985 bp, Homo sapiens
ggtcgcgtcgacacggctgcgagaagacgacaaaagggggaaagcgcgcgagcaagatggccaccaccaagcgcgtcttgtacgtgggtggactggcagaggaagtggacgacaaagttcttcatgctgcgttcattccttttggagacatcacagatattcagattcctctggattatgaaacagaaaagcaccgaggatttgcttttgttgaatttgagttggcagaggatgctgcagcagctatcgacaacatgaatgaatctgagctttttggacgtacaattcgtgtcaatttggccaaaccaatgagaattaaggaaggctcttccaggccagtttggtcagatgatgactggttgaagaagttttctgggaagacgcttgaagagaataaagaggaagaagggtcagagcctcccaaagcagagacccaggagagaatttccgctgcctgtgcactcatgaaaagggctttggctttaagggaagcagcttccaccgcatcatcccccagttcatgtgccagggcggtgatttcacaaaccacaatggcactgggggcaagtccatctatgggaagaagttcgatgatgaaaactttatcctcaagcatacgggaccaggtctactatccatggccaactctggcccaaacaccaatggctctcagttcttcctgacatgtgacaagacagactggctggatggcaagcatgtggtgtttggagaggtcaccgaaggcctagatgtcttgcggcaaattgagaggtatgtggccaggaatgggcctcctccttacccaggccctaggagcacagccctgtgtgagggctggagagtctctgtggcctgagagagatggccaggggctgtgtccagcgggaggggctgctgctgcccaggttccggggtggaagtgggcaaatgggcaggcaggggttggtatccctaaaccactgttagtctccggccttactccctc

SEQ ID NO: 372358 - DNA, 1489 bp, Homo sapiens
gggccgaggagcgcggcggccagagcggggccgcggaggcgacgccggggacgcccgcgcgacgagcaggtggcggcggctgcaggcttgtccagccggaagccctgagggcagctgttcccactggctctgctgaccttgtgccttggacggctgtcctcagcgaggggccgtgcacccgctcctgagcagcgccatgggcctgctggccttcctgaagacccagttcgtgctgcacctgctggtcggctttgtcttcgtggtgagtggtctggtcatcaacttcgtccagctgtgcacgctggcgctctggccggtcagcaagcagctctaccgccgcctcaactgccgcctcgcctactcactctggagccaactggtcatgctgctggagtggtggtcctgcacggagtgtacactgttcacggaccaggccacggtagagcgctttgggaaggagcacgcagtcatcatcctcaaccacaacttcgagatcgacttcctctgtgggtggaccatgtgtgagcgcttcggagtgctggggagctccaaggtcctcgctaagaaggagctgctctacgtgcccctcatcggctggacgtggtactttctggagattgtgttctgcaagcggaagtgggaggaggaccgggacaccgtggtcgaagggctgaggcgcctgtcggactaccccgagtacatgtggtttctcctgtactgcgaggggacgcgcttcacggagaccaagcaccgcgttagcatggaggtggcggctgctaaggggcttcctgtcctcaagtaccacctgctgccgcggaccaagggcttcaccaccgcagtcaagtgcctccgggggacagtcgcagctgtctatgatgtaaccctgaacttcagaggaaacaagaacccgtccctgctggggatcctctacgggaagaagtacgaggcggacatgtgcgtgaggagatttcctctggaagacatcccgctggatgaaaaggaagcagctcagtggcttcataaactgtaccaggagaaggacgcgctccaggagatatataatcagaagggcatgtttccaggggagcagtttaagcctgcccggaggccgtggaccctcctgaacttcctgtcctgggccaccattctcctgtctcccctcttcagttttgtcttgggcgtctttgccagcggatcacctctcctgatcctgactttcttggggtttgtgggagcagcttcctttggagttcgcagactgataggagtaactgagatagaaaaaggctccagctacggaaaccaagagtttaagaaaaaggaataattaatggctgtgactgaacacacgcggccctgacggtggtatccagttaactcaaaaccaacacacagagtgcaggaaaagacaattagaaactatttttcttattaactggtgactaatattaacaaaacttgagccaagagtaaagaattcagaaggcct

SEQ ID NO: 372359 - DNA, 775 bp, Homo sapiens
gtgctgtcagcggcatgcctgccttctgcaagcccctcttccctgttccccagcccgcacttccaatgagctgtgggccaggaaaccagcccgtcacacttgtccacgctgcgtttaaagcgggaggaaggaggacccaatgcagggcccgaaaggtccactgacctccaggacgtagaggttgatgatccgggcaggtggccttcagcgagggagcacgtcaaaaggctgtgggccgtgcagacagctgggggacaccgtcccgggtgtgaccttgggccacacggcagggtggtggacttgctcctagaattgggctccagggctgaagccagcccctctgatctggcactggccggctccattcaccctttttggggcttactgccgcagagacttcctttgaggagagctggacccaagacgccagagttccgggggcactgagtgctgtgtggcacccgggccaggagaaacatgtgccagagggcaggcgtgggctctccggggagtctctgcgtagactttctagcccagaggttcaggtgatggaccagagactggccgctttgtgacaccgaggacggttgataaagtggattctcgaggggaagctgcatccacacagaggctgggacgtgaatgtgcatcacggctctatctgtggcccccaaaggctgggtgccagctgcctgtcggcagggagcgtatcaccgtggcacgtccatgccgtgggggtcactcagcagccacggatgcgccctgggtgctgtcc

SEQ ID NO: 372360 - DNA, 3594 bp, Homo sapiens
tctatgaaaccaacatacatggcgtttgcatcacagttggagtcagatgtgagcccggagggcaggtgtctggcttgtccagccggaagccctgagggcagctgttcccactggctctgctgaccttgtgccttggacggctgtcctcagcgaggggccgtgcacccgctcctgagcagcgccatgggcctgctggccttcctgaagacccagttcgtgctgcacctgctggtcggctttgtcttcgtggtgagtggtctggtcatcaacttcgtccagctgtgcacgctggcgctctggccggtcagcaagcagctctaccgccgcctcaactgccgcctcgcctactcactctggagccaactggtcatgctgctggagtggtggtcctgcacggagtgtacactgttcacggaccaggccacggtagagcgctttgggaaggagcacgcagtcatcatcctcaaccacaacttcgagatcgacttcctctgtgggtggaccatgtgtgagcgcttcggagtgctggggagctccaaggtcctcgctaagaaggagctgctctacgtgcccctcatcggctggacgtggtactttctggagattgtgttctgcaagcggaagtgggaggaggaccgggacaccgtggtcgaagggctgaggcgcctgtcggactaccccgagtacatgtggtttctcctgtactgcgaggggacgcgcttcacggagaccaagcaccgcgttagcatggaggtggcggctgctaaggggcttcctgtcctcaagtaccacctgctgccgcggaccaagggcttcaccaccgcagtcaagtgcctccgggggacagtcgcagctgtctatgatgtaaccctgaacttcagaggaaacaagaacccgtccctgctggggatcctctacgggaagaagtacgaggcggacatgtgcgtgaggagatttcctctggaagacatcccgctggatgaaaaggaagcagctcagtggcttcataaactgtaccaggagaaggacgcgctccaggagatatataatcagaagggcatgtttccaggggagcagtttaagcctgcccggaggccgtggaccctcctgaacttcctgtcctgggccaccattctcctgtctcccctcttcagttttgtcttgggcgtctttgccagcggatcacctctcctgatcctgactttcttggggtttgtgggagcagcttcctttggagttcgcagactgataggagtaactgagatagaaaaaggctccagctacggaaaccaagagtttaagaaaaaggaataattaatggctgtgactgaacacacgcggccctgacggtggtatccagttaactcaaaaccaacacacagagtgcaggaaaagacaattagaaactatttttcttattaactggtgactaatattaacaaaacttgagccaagagtaaagaattcagaaggcctgtcaggtgaagtcttcagcctcccacagcgcagggtcccagcatctccacgcgcgcccgtgggaggtgggtccggccggagaggcctcccgcggacgccgtctctccagaactccgcttccaagagggagcctttggctgctttctctccttaaacttagatcaaattttttggtttttaatcagttatcttgggaacttaacctggcccctcacctcttctgcaccccccgcccccgaaactgtctcgtaatgaatttctgctgtcctcctgggagtggacggccgggtcccgtcccccgggagcatcgctcggctcagcaccttggctcccagtgggggccccgtggagggcgcccgtagtgataagcacaccggcacgaacgtcaggtccattcctcgaagtcggagccctcactctgccctgtcctggggctggctgagggcgaacgccccacctcactttctagagccctgtctgtcctagctcctatctgaccttgtgtgtaaatacgtacatctgtttttaaagtggatgggcccctgagaactcagtgaaatgcagagttctccatgcacctaaagctcctttgtcgctctcatggctgtcagatcctggtccctccacactgggtgctggggagggaggaccctcggggctaccgcgcgcccccccatcccacagatcaggagccaaggagggagaacagggcagcctgtgggactctaggatgcttcagaagaagcgacggcaccgtcaaccctctgttttttaaaggtggttggagactgttaacactgagctcattgacttctagagattttatttttactggttgatctcttggtggttttcaacttcctgctggaaactagaggtggggcaccccccaccccccagcctcgcactgtgtccttggggagggcccgcccccatcctggccggtgtcactgtggcccggccacccctgagcgcccagctccctacctcctggacgtctctgagagtccaggcagagcagagggcagcgctcggccggtcatgctggctcccttggccttgcagcgagcccctggcccacgccgagcgagggatgcttctccctacagcatgtccactcccccggcatggccaggtggggcccctggggcaatggcagtggtagaacgctcaacttggttgcggtaccatcagcccacctgcatttggctttcgacttgcttgttctaagtcacagcgccctcatctttttagcaaggtaaaaaaaccaaaatgggtgttatctctgatatcttgaaaccagcgttctgaatagaggtaggttgagttttctaggggaaaacaaatggagaaaagaggcatgaagaaaagtaaaccgagaacataattaggcatcgggcctaagtgtcctggggagattggaggggacggcagcgttctgcatgatggaggcgctgccgggccccgggtctgtgggggccgtgctctcagggcgtgtgcgggacgccacctgtgcacacctgctcagagcacggctcctcgcaggggtgaaggggcagaccaacgaaaccagatgagaccaacgacaccatgcgagacacgcttgcagacactgttgttttggaaatgtgcttccctccatctgaaatctcatccctccacccgcccactcgggcagctgtgccgtgggcagggcatgcgctcccctggctgagcaccccagagattctcctgcaccttcctcatgccgcacgctgctcatccgtctccatgtgtgtttagatccatgccattcactgactcactaacacctgcaaaatctttaaggaaaaaagctgaagggtacgaccatgcacatatgtgacctggaaaatgcaaatttagatcttttatgatttaattattattgtttcccatagaagttccctccctttgaaattaatatataatgtataaattctgcactgagccatggcggagctgggcagcccctaggttagagtggagacggaggcccaggcgcaggggtcacacctcatctggtttccttcccatctcacagcttagcttgtgcttctcaacaccaagtctttaagagcaataaaaactacaccatga

SEQ ID NO: 372361 - DNA, 4051 bp, Homo sapiens
cgccgacacatggtcgttcgacttctggcttggcctcttttgtgagtgtggggcctggtcatatcctcttggtcagtgtctctgtgatgatgagaacgggaagacggccacggtgcccaccctggcaggactctctcccctcgctggcgctggctcagctgccgtgagcggccgtaggcactgtcccgggccctcctgtggttgctcccagccatgctgctggctgcttctgccgtcctggcttgcagagactctgggtcatgcggggaagagggcagagtcctcctccctgctcaggcaagagaggatccagcaagatttcttcctccccaccctcctgcccctcccagtctgggcagcagataaaagccagggccccacacttctgccacctcctgctgctcacacactccagccagggacctgcccccggggtccaacaaggacggctgtcctcagcgaggggccgtgcacccgctcctgagcagcgccatgggcctgctggccttcctgaagacccagttcgtgctgcacctgctggtcggctttgtcttcgtggtgagtggtctggtcatcaacttcgtccagctgtgcacgctggcgctctggccggtcagcaagcagctctaccgccgcctcaactgccgcctcgcctactcactctggagcctagcacaaaactagaagcaacccaagcacctgtcactggagactaattatgcggcacccatacagggaccctctgcggccatcatggagagccttcatcttgcccgtacagttttaagcgaaaaaggaagtatacaacaaagtccataaactggtcatgctgctggagtggtggtcctgcacggagtgtacactgttcacggaccaggccacggtagagcgctttgggaaggagcacgcagtcatcatcctcaaccacaacttcgagatcgacttcctctgtgggtggaccatgtgtgagcgcttcggagtgctggggagctccaaggtcctcgctaagaaggagctgctctacgtgcccctcatcggctggacgtggtactttctggagattgtgttctgcaagcggaagtgggaggaggaccgggacaccgtggtcgaagggctgaggcgcctgtcggactaccccgagtacatgtggtttctcctgtactgcgaggggacgcgcttcacggagaccaagcaccgcgttagcatggaggtggcggctgctaaggggcttcctgtcctcaagtaccacctgctgccgcggaccaagggcttcaccaccgcagtcaagtgcctccgggggacagtcgcagctgtctatgatgtaaccctgaacttcagaggaaacaagaacccgtccctgctggggatcctctacgggaagaagtacgaggcggacatgtgcgtgaggagatttcctctggaagacatcccgctggatgaaaaggaagcagctcagtggcttcataaactgtaccaggagaaggacgcgctccaggagatatataatcagaagggcatgtttccaggggagcagtttaagcctgcccggaggccgtggaccctcctgaacttcctgtcctgggccaccattctcctgtctcccctcttcagttttgtcttgggcgtctttgccagcggatcacctctcctgatcctgactttcttggggtttgtgggagcagcttcctttggagttcgcagactgataggagtaactgagatagaaaaaggctccagctacggaaaccaagagtttaagaaaaaggaataattaatggctgtgactgaacacacgcggccctgacggtggtatccagttaactcaaaaccaacacacagagtgcaggaaaagacaattagaaactatttttcttattaactggtgactaatattaacaaaacttgagccaagagtaaagaattcagaaggcctgtcaggtgaagtcttcagcctcccacagcgcagggtcccagcatctccacgcgcgcccgtgggaggtgggtccggccggagaggcctcccgcggacgccgtctctccagaactccgcttccaagagggagcctttggctgctttctctccttaaacttagatcaaattttttggtttttaatcagttatcttgggaacttaacctggcccctcacctcttctgcaccccccgcccccgaaactgtctcgtaatgaatttctgctgtcctcctgggagtggacggccgggtcccgtcccccgggagcatcgctcggctcagcaccttggctcccagtgggggccccgtggagggcgcccgtagtgataagcacaccggcacgaacgtcaggtccattcctcgaagtcggagccctcactctgccctgtcctggggctggctgagggcgaacgccccacctcactttctagagccctgtctgtcctagctcctatctgaccttgtgtgtaaatacgtacatctgtttttaaagtggatgggcccctgagaactcagtgaaatgcagagttctccatgcacctaaagctcctttgtcgctctcatggctgtcagatcctggtccctccacactgggtgctggggagggaggaccctcggggctaccgcgcgcccccccatcccacagatcaggagccaaggagggagaacagggcagcctgtgggactctaggatgcttcagaagaagcgacggcaccgtcaaccctctgttttttaaaggtggttggagactgttaacactgagctcattgacttctagagattttatttttactggttgatctcttggtggttttcaacttcctgctggaaactagaggtggggcaccccccaccccccagcctcgcactgtgtccttggggagggcccgcccccatcctggccggtgtcactgtggcccggccacccctgagcgcccagctccctacctcctggacgtctctgagagtccaggcagagcagagggcagcgctcggccggtcatgctggctcccttggccttgcagcgagcccctggcccacgccgagcgagggatgcttctccctacagcatgtccactcccccggcatggccaggtggggcccctggggcaatggcagtggtagaacgctcaacttggttgcggtaccatcagcccacctgcatttggctttcgacttgcttgttctaagtcacagcgccctcatctttttagcaaggtaaaaaaaccaaaatgggtgttatctctgatatcttgaaaccagcgttctgaatagaggtaggttgagttttctaggggaaaacaaatggagaaaagaggcatgaagaaaagtaaaccgagaacataattaggcatcgggcctaagtgtcctggggagattggaggggacggcagcgttctgcatgatggaggcgctgccgggccccgggtctgtgggggccgtgctctcagggcgtgtgcgggacgccacctgtgcacacctgctcagagcacggctcctcgcaggggtgaaggggcagaccaacgaaaccagatgagaccaacgacaccatgcgagacacgcttgcagacactgttgttttggaaatgtgcttccctccatctgaaatctcatccctccacccgcccactcgggcagctgtgccgtgggcagggcatgcgctcccctggctgagcaccccagagattctcctgcaccttcctcatgccgcacgctgctcatccgtctccatgtgtgtttagatccatgccattcactgactcactaacacctgcaaaatctttaaggaaaaaagctgaagggtacgaccatgcacatatgtgacctggaaaatgcaaatttagatcttttatgatttaattattattgtttcccatagaagttccctccctttgaaattaatatataatgtataaattctgcactgagccatggcggagctgggcagcccctaggttagagtggagacggaggcccaggcgcaggggtcacacctcatctggtttccttcccatctcacagcttagcttgtgcttctcaacaccaagtctttaagagcaataaaaactacaccatga

SEQ ID NO: 372362 - DNA, 3726 bp, Homo sapiens
atgtggattggaaggacactctgtcagccgctccctgccatcaccacacactcctggagcctctgccaccacggcccgtgctgaccccagagcgagtcaaagccaggagccttcccacggacggctgtcctcagcgaggggccgtgcacccgctcctgagcagcgccatgggcctgctggccttcctgaagacccagttcgtgctgcacctgctggtcggctttgtcttcgtggtgagtggtctggtcatcaacttcgtccagctgtgcacgctggcgctctggccggtcagcaagcagctctaccgccgcctcaactgccgcctcgcctactcactctggagcctagcacaaaactagaagcaacccaagcacctgtcactggagactaattatgcggcacccatacagggaccctctgcggccatcatggagagccttcatcttgcccgtacagttttaagcgaaaaaggaagtatacaacaaagtccataaactggtcatgctgctggagtggtggtcctgcacggagtgtacactgttcacggaccaggccacggtagagcgctttgggaaggagcacgcagtcatcatcctcaaccacaacttcgagatcgacttcctctgtgggtggaccatgtgtgagcgcttcggagtgctggggagctccaaggtcctcgctaagaaggagctgctctacgtgcccctcatcggctggacgtggtactttctggagattgtgttctgcaagcggaagtgggaggaggaccgggacaccgtggtcgaagggctgaggcgcctgtcggactaccccgagtacatgtggtttctcctgtactgcgaggggacgcgcttcacggagaccaagcaccgcgttagcatggaggtggcggctgctaaggggcttcctgtcctcaagtaccacctgctgccgcggaccaagggcttcaccaccgcagtcaagtgcctccgggggacagtcgcagctgtctatgatgtaaccctgaacttcagaggaaacaagaacccgtccctgctggggatcctctacgggaagaagtacgaggcggacatgtgcgtgaggagatttcctctggaagacatcccgctggatgaaaaggaagcagctcagtggcttcataaactgtaccaggagaaggacgcgctccaggagatatataatcagaagggcatgtttccaggggagcagtttaagcctgcccggaggccgtggaccctcctgaacttcctgtcctgggccaccattctcctgtctcccctcttcagttttgtcttgggcgtctttgccagcggatcacctctcctgatcctgactttcttggggtttgtgggagcagcttcctttggagttcgcagactgataggagtaactgagatagaaaaaggctccagctacggaaaccaagagtttaagaaaaaggaataattaatggctgtgactgaacacacgcggccctgacggtggtatccagttaactcaaaaccaacacacagagtgcaggaaaagacaattagaaactatttttcttattaactggtgactaatattaacaaaacttgagccaagagtaaagaattcagaaggcctgtcaggtgaagtcttcagcctcccacagcgcagggtcccagcatctccacgcgcgcccgtgggaggtgggtccggccggagaggcctcccgcggacgccgtctctccagaactccgcttccaagagggagcctttggctgctttctctccttaaacttagatcaaattttttggtttttaatcagttatcttgggaacttaacctggcccctcacctcttctgcaccccccgcccccgaaactgtctcgtaatgaatttctgctgtcctcctgggagtggacggccgggtcccgtcccccgggagcatcgctcggctcagcaccttggctcccagtgggggccccgtggagggcgcccgtagtgataagcacaccggcacgaacgtcaggtccattcctcgaagtcggagccctcactctgccctgtcctggggctggctgagggcgaacgccccacctcactttctagagccctgtctgtcctagctcctatctgaccttgtgtgtaaatacgtacatctgtttttaaagtggatgggcccctgagaactcagtgaaatgcagagttctccatgcacctaaagctcctttgtcgctctcatggctgtcagatcctggtccctccacactgggtgctggggagggaggaccctcggggctaccgcgcgcccccccatcccacagatcaggagccaaggagggagaacagggcagcctgtgggactctaggatgcttcagaagaagcgacggcaccgtcaaccctctgttttttaaaggtggttggagactgttaacactgagctcattgacttctagagattttatttttactggttgatctcttggtggttttcaacttcctgctggaaactagaggtggggcaccccccaccccccagcctcgcactgtgtccttggggagggcccgcccccatcctggccggtgtcactgtggcccggccacccctgagcgcccagctccctacctcctggacgtctctgagagtccaggcagagcagagggcagcgctcggccggtcatgctggctcccttggccttgcagcgagcccctggcccacgccgagcgagggatgcttctccctacagcatgtccactcccccggcatggccaggtggggcccctggggcaatggcagtggtagaacgctcaacttggttgcggtaccatcagcccacctgcatttggctttcgacttgcttgttctaagtcacagcgccctcatctttttagcaaggtaaaaaaaccaaaatgggtgttatctctgatatcttgaaaccagcgttctgaatagaggtaggttgagttttctaggggaaaacaaatggagaaaagaggcatgaagaaaagtaaaccgagaacataattaggcatcgggcctaagtgtcctggggagattggaggggacggcagcgttctgcatgatggaggcgctgccgggccccgggtctgtgggggccgtgctctcagggcgtgtgcgggacgccacctgtgcacacctgctcagagcacggctcctcgcaggggtgaaggggcagaccaacgaaaccagatgagaccaacgacaccatgcgagacacgcttgcagacactgttgttttggaaatgtgcttccctccatctgaaatctcatccctccacccgcccactcgggcagctgtgccgtgggcagggcatgcgctcccctggctgagcaccccagagattctcctgcaccttcctcatgccgcacgctgctcatccgtctccatgtgtgtttagatccatgccattcactgactcactaacacctgcaaaatctttaaggaaaaaagctgaagggtacgaccatgcacatatgtgacctggaaaatgcaaatttagatcttttatgatttaattattattgtttcccatagaagttccctccctttgaaattaatatataatgtataaattctgcactgagccatggcggagctgggcagcccctaggttagagtggagacggaggcccaggcgcaggggtcacacctcatctggtttccttcccatctcacagcttagcttgtgcttctcaacaccaagtctttaagagcaataaaaactacaccatga

SEQ ID NO: 372363 - DNA, 3903 bp, Homo sapiens
cgccgacacatggtcgttcgacttctggcttggcctcttttgtgagtgtggggcctggtcatatcctcttggtcagtgtctctgtgatgatgagaacgggaagacggccacggtgcccaccctggcaggactctctcccctcgctggcgctggctcagctgccgtgagcggccgtaggcactgtcccgggccctcctgtggttgctcccagccatgctgctggctgcttctgccgtcctggcttgcagagactctgggtcatgcggggaagagggcagagtcctcctccctgctcaggcaagagaggatccagcaagatttcttcctccccaccctcctgcccctcccagtctgggcagcagataaaagccagggccccacacttctgccacctcctgctgctcacacactccagccagggacctgcccccggggtccaacaaggacggctgtcctcagcgaggggccgtgcacccgctcctgagcagcgccatgggcctgctggccttcctgaagacccagttcgtgctgcacctgctggtcggctttgtcttcgtggtgagtggtctggtcatcaacttcgtccagctgtgcacgctggcgctctggccggtcagcaagcagctctaccgccgcctcaactgccgcctcgcctactcactctggagccaactggtcatgctgctggagtggtggtcctgcacggagtgtacactgttcacggaccaggccacggtagagcgctttgggaaggagcacgcagtcatcatcctcaaccacaacttcgagatcgacttcctctgtgggtggaccatgtgtgagcgcttcggagtgctggggagctccaaggtcctcgctaagaaggagctgctctacgtgcccctcatcggctggacgtggtactttctggagattgtgttctgcaagcggaagtgggaggaggaccgggacaccgtggtcgaagggctgaggcgcctgtcggactaccccgagtacatgtggtttctcctgtactgcgaggggacgcgcttcacggagaccaagcaccgcgttagcatggaggtggcggctgctaaggggcttcctgtcctcaagtaccacctgctgccgcggaccaagggcttcaccaccgcagtcaagtgcctccgggggacagtcgcagctgtctatgatgtaaccctgaacttcagaggaaacaagaacccgtccctgctggggatcctctacgggaagaagtacgaggcggacatgtgcgtgaggagatttcctctggaagacatcccgctggatgaaaaggaagcagctcagtggcttcataaactgtaccaggagaaggacgcgctccaggagatatataatcagaagggcatgtttccaggggagcagtttaagcctgcccggaggccgtggaccctcctgaacttcctgtcctgggccaccattctcctgtctcccctcttcagttttgtcttgggcgtctttgccagcggatcacctctcctgatcctgactttcttggggtttgtgggagcagcttcctttggagttcgcagactgataggagtaactgagatagaaaaaggctccagctacggaaaccaagagtttaagaaaaaggaataattaatggctgtgactgaacacacgcggccctgacggtggtatccagttaactcaaaaccaacacacagagtgcaggaaaagacaattagaaactatttttcttattaactggtgactaatattaacaaaacttgagccaagagtaaagaattcagaaggcctgtcaggtgaagtcttcagcctcccacagcgcagggtcccagcatctccacgcgcgcccgtgggaggtgggtccggccggagaggcctcccgcggacgccgtctctccagaactccgcttccaagagggagcctttggctgctttctctccttaaacttagatcaaattttttggtttttaatcagttatcttgggaacttaacctggcccctcacctcttctgcaccccccgcccccgaaactgtctcgtaatgaatttctgctgtcctcctgggagtggacggccgggtcccgtcccccgggagcatcgctcggctcagcaccttggctcccagtgggggccccgtggagggcgcccgtagtgataagcacaccggcacgaacgtcaggtccattcctcgaagtcggagccctcactctgccctgtcctggggctggctgagggcgaacgccccacctcactttctagagccctgtctgtcctagctcctatctgaccttgtgtgtaaatacgtacatctgtttttaaagtggatgggcccctgagaactcagtgaaatgcagagttctccatgcacctaaagctcctttgtcgctctcatggctgtcagatcctggtccctccacactgggtgctggggagggaggaccctcggggctaccgcgcgcccccccatcccacagatcaggagccaaggagggagaacagggcagcctgtgggactctaggatgcttcagaagaagcgacggcaccgtcaaccctctgttttttaaaggtggttggagactgttaacactgagctcattgacttctagagattttatttttactggttgatctcttggtggttttcaacttcctgctggaaactagaggtggggcaccccccaccccccagcctcgcactgtgtccttggggagggcccgcccccatcctggccggtgtcactgtggcccggccacccctgagcgcccagctccctacctcctggacgtctctgagagtccaggcagagcagagggcagcgctcggccggtcatgctggctcccttggccttgcagcgagcccctggcccacgccgagcgagggatgcttctccctacagcatgtccactcccccggcatggccaggtggggcccctggggcaatggcagtggtagaacgctcaacttggttgcggtaccatcagcccacctgcatttggctttcgacttgcttgttctaagtcacagcgccctcatctttttagcaaggtaaaaaaaccaaaatgggtgttatctctgatatcttgaaaccagcgttctgaatagaggtaggttgagttttctaggggaaaacaaatggagaaaagaggcatgaagaaaagtaaaccgagaacataattaggcatcgggcctaagtgtcctggggagattggaggggacggcagcgttctgcatgatggaggcgctgccgggccccgggtctgtgggggccgtgctctcagggcgtgtgcgggacgccacctgtgcacacctgctcagagcacggctcctcgcaggggtgaaggggcagaccaacgaaaccagatgagaccaacgacaccatgcgagacacgcttgcagacactgttgttttggaaatgtgcttccctccatctgaaatctcatccctccacccgcccactcgggcagctgtgccgtgggcagggcatgcgctcccctggctgagcaccccagagattctcctgcaccttcctcatgccgcacgctgctcatccgtctccatgtgtgtttagatccatgccattcactgactcactaacacctgcaaaatctttaaggaaaaaagctgaagggtacgaccatgcacatatgtgacctggaaaatgcaaatttagatcttttatgatttaattattattgtttcccatagaagttccctccctttgaaattaatatataatgtataaattctgcactgagccatggcggagctgggcagcccctaggttagagtggagacggaggcccaggcgcaggggtcacacctcatctggtttccttcccatctcacagcttagcttgtgcttctcaacaccaagtctttaagagcaataaaaactacaccatga

SEQ ID NO: 372364 - DNA, 3594 bp, Homo sapiens
aggtccattgtgcagtcatcaggccctgggagctttccacatccctccacctcccacccaacatcaccactctccggccagtgagaccgtcacagcaccccagaggagacaaattctggagctcagagagctggggacggctgtcctcagcgaggggccgtgcacccgctcctgagcagcgccatgggcctgctggccttcctgaagacccagttcgtgctgcacctgctggtcggctttgtcttcgtggtgagtggtctggtcatcaacttcgtccagctgtgcacgctggcgctctggccggtcagcaagcagctctaccgccgcctcaactgccgcctcgcctactcactctggagccaactggtcatgctgctggagtggtggtcctgcacggagtgtacactgttcacggaccaggccacggtagagcgctttgggaaggagcacgcagtcatcatcctcaaccacaacttcgagatcgacttcctctgtgggtggaccatgtgtgagcgcttcggagtgctggggagctccaaggtcctcgctaagaaggagctgctctacgtgcccctcatcggctggacgtggtactttctggagattgtgttctgcaagcggaagtgggaggaggaccgggacaccgtggtcgaagggctgaggcgcctgtcggactaccccgagtacatgtggtttctcctgtactgcgaggggacgcgcttcacggagaccaagcaccgcgttagcatggaggtggcggctgctaaggggcttcctgtcctcaagtaccacctgctgccgcggaccaagggcttcaccaccgcagtcaagtgcctccgggggacagtcgcagctgtctatgatgtaaccctgaacttcagaggaaacaagaacccgtccctgctggggatcctctacgggaagaagtacgaggcggacatgtgcgtgaggagatttcctctggaagacatcccgctggatgaaaaggaagcagctcagtggcttcataaactgtaccaggagaaggacgcgctccaggagatatataatcagaagggcatgtttccaggggagcagtttaagcctgcccggaggccgtggaccctcctgaacttcctgtcctgggccaccattctcctgtctcccctcttcagttttgtcttgggcgtctttgccagcggatcacctctcctgatcctgactttcttggggtttgtgggagcagcttcctttggagttcgcagactgataggagtaactgagatagaaaaaggctccagctacggaaaccaagagtttaagaaaaaggaataattaatggctgtgactgaacacacgcggccctgacggtggtatccagttaactcaaaaccaacacacagagtgcaggaaaagacaattagaaactatttttcttattaactggtgactaatattaacaaaacttgagccaagagtaaagaattcagaaggcctgtcaggtgaagtcttcagcctcccacagcgcagggtcccagcatctccacgcgcgcccgtgggaggtgggtccggccggagaggcctcccgcggacgccgtctctccagaactccgcttccaagagggagcctttggctgctttctctccttaaacttagatcaaattttttggtttttaatcagttatcttgggaacttaacctggcccctcacctcttctgcaccccccgcccccgaaactgtctcgtaatgaatttctgctgtcctcctgggagtggacggccgggtcccgtcccccgggagcatcgctcggctcagcaccttggctcccagtgggggccccgtggagggcgcccgtagtgataagcacaccggcacgaacgtcaggtccattcctcgaagtcggagccctcactctgccctgtcctggggctggctgagggcgaacgccccacctcactttctagagccctgtctgtcctagctcctatctgaccttgtgtgtaaatacgtacatctgtttttaaagtggatgggcccctgagaactcagtgaaatgcagagttctccatgcacctaaagctcctttgtcgctctcatggctgtcagatcctggtccctccacactgggtgctggggagggaggaccctcggggctaccgcgcgcccccccatcccacagatcaggagccaaggagggagaacagggcagcctgtgggactctaggatgcttcagaagaagcgacggcaccgtcaaccctctgttttttaaaggtggttggagactgttaacactgagctcattgacttctagagattttatttttactggttgatctcttggtggttttcaacttcctgctggaaactagaggtggggcaccccccaccccccagcctcgcactgtgtccttggggagggcccgcccccatcctggccggtgtcactgtggcccggccacccctgagcgcccagctccctacctcctggacgtctctgagagtccaggcagagcagagggcagcgctcggccggtcatgctggctcccttggccttgcagcgagcccctggcccacgccgagcgagggatgcttctccctacagcatgtccactcccccggcatggccaggtggggcccctggggcaatggcagtggtagaacgctcaacttggttgcggtaccatcagcccacctgcatttggctttcgacttgcttgttctaagtcacagcgccctcatctttttagcaaggtaaaaaaaccaaaatgggtgttatctctgatatcttgaaaccagcgttctgaatagaggtaggttgagttttctaggggaaaacaaatggagaaaagaggcatgaagaaaagtaaaccgagaacataattaggcatcgggcctaagtgtcctggggagattggaggggacggcagcgttctgcatgatggaggcgctgccgggccccgggtctgtgggggccgtgctctcagggcgtgtgcgggacgccacctgtgcacacctgctcagagcacggctcctcgcaggggtgaaggggcagaccaacgaaaccagatgagaccaacgacaccatgcgagacacgcttgcagacactgttgttttggaaatgtgcttccctccatctgaaatctcatccctccacccgcccactcgggcagctgtgccgtgggcagggcatgcgctcccctggctgagcaccccagagattctcctgcaccttcctcatgccgcacgctgctcatccgtctccatgtgtgtttagatccatgccattcactgactcactaacacctgcaaaatctttaaggaaaaaagctgaagggtacgaccatgcacatatgtgacctggaaaatgcaaatttagatcttttatgatttaattattattgtttcccatagaagttccctccctttgaaattaatatataatgtataaattctgcactgagccatggcggagctgggcagcccctaggttagagtggagacggaggcccaggcgcaggggtcacacctcatctggtttccttcccatctcacagcttagcttgtgcttctcaacaccaagtctttaagagcaataaaaactacaccatga

SEQ ID NO: 372365 - DNA, 3627 bp, Homo sapiens
cggaacggcagggccgcctttaggcttacatccctggaactcccacctccacagacccgtccgggtgctgaaagtccacggatgctatccctggtcaaatcagaggcttgtccagccggaagccctgagggcagctgttcccactggctctgctgaccttgtgccttggacggctgtcctcagcgaggggccgtgcacccgctcctgagcagcgccatgggcctgctggccttcctgaagacccagttcgtgctgcacctgctggtcggctttgtcttcgtggtgagtggtctggtcatcaacttcgtccagctgtgcacgctggcgctctggccggtcagcaagcagctctaccgccgcctcaactgccgcctcgcctactcactctggagccaactggtcatgctgctggagtggtggtcctgcacggagtgtacactgttcacggaccaggccacggtagagcgctttgggaaggagcacgcagtcatcatcctcaaccacaacttcgagatcgacttcctctgtgggtggaccatgtgtgagcgcttcggagtgctggggagctccaaggtcctcgctaagaaggagctgctctacgtgcccctcatcggctggacgtggtactttctggagattgtgttctgcaagcggaagtgggaggaggaccgggacaccgtggtcgaagggctgaggcgcctgtcggactaccccgagtacatgtggtttctcctgtactgcgaggggacgcgcttcacggagaccaagcaccgcgttagcatggaggtggcggctgctaaggggcttcctgtcctcaagtaccacctgctgccgcggaccaagggcttcaccaccgcagtcaagtgcctccgggggacagtcgcagctgtctatgatgtaaccctgaacttcagaggaaacaagaacccgtccctgctggggatcctctacgggaagaagtacgaggcggacatgtgcgtgaggagatttcctctggaagacatcccgctggatgaaaaggaagcagctcagtggcttcataaactgtaccaggagaaggacgcgctccaggagatatataatcagaagggcatgtttccaggggagcagtttaagcctgcccggaggccgtggaccctcctgaacttcctgtcctgggccaccattctcctgtctcccctcttcagttttgtcttgggcgtctttgccagcggatcacctctcctgatcctgactttcttggggtttgtgggagcagcttcctttggagttcgcagactgataggagtaactgagatagaaaaaggctccagctacggaaaccaagagtttaagaaaaaggaataattaatggctgtgactgaacacacgcggccctgacggtggtatccagttaactcaaaaccaacacacagagtgcaggaaaagacaattagaaactatttttcttattaactggtgactaatattaacaaaacttgagccaagagtaaagaattcagaaggcctgtcaggtgaagtcttcagcctcccacagcgcagggtcccagcatctccacgcgcgcccgtgggaggtgggtccggccggagaggcctcccgcggacgccgtctctccagaactccgcttccaagagggagcctttggctgctttctctccttaaacttagatcaaattttttggtttttaatcagttatcttgggaacttaacctggcccctcacctcttctgcaccccccgcccccgaaactgtctcgtaatgaatttctgctgtcctcctgggagtggacggccgggtcccgtcccccgggagcatcgctcggctcagcaccttggctcccagtgggggccccgtggagggcgcccgtagtgataagcacaccggcacgaacgtcaggtccattcctcgaagtcggagccctcactctgccctgtcctggggctggctgagggcgaacgccccacctcactttctagagccctgtctgtcctagctcctatctgaccttgtgtgtaaatacgtacatctgtttttaaagtggatgggcccctgagaactcagtgaaatgcagagttctccatgcacctaaagctcctttgtcgctctcatggctgtcagatcctggtccctccacactgggtgctggggagggaggaccctcggggctaccgcgcgcccccccatcccacagatcaggagccaaggagggagaacagggcagcctgtgggactctaggatgcttcagaagaagcgacggcaccgtcaaccctctgttttttaaaggtggttggagactgttaacactgagctcattgacttctagagattttatttttactggttgatctcttggtggttttcaacttcctgctggaaactagaggtggggcaccccccaccccccagcctcgcactgtgtccttggggagggcccgcccccatcctggccggtgtcactgtggcccggccacccctgagcgcccagctccctacctcctggacgtctctgagagtccaggcagagcagagggcagcgctcggccggtcatgctggctcccttggccttgcagcgagcccctggcccacgccgagcgagggatgcttctccctacagcatgtccactcccccggcatggccaggtggggcccctggggcaatggcagtggtagaacgctcaacttggttgcggtaccatcagcccacctgcatttggctttcgacttgcttgttctaagtcacagcgccctcatctttttagcaaggtaaaaaaaccaaaatgggtgttatctctgatatcttgaaaccagcgttctgaatagaggtaggttgagttttctaggggaaaacaaatggagaaaagaggcatgaagaaaagtaaaccgagaacataattaggcatcgggcctaagtgtcctggggagattggaggggacggcagcgttctgcatgatggaggcgctgccgggccccgggtctgtgggggccgtgctctcagggcgtgtgcgggacgccacctgtgcacacctgctcagagcacggctcctcgcaggggtgaaggggcagaccaacgaaaccagatgagaccaacgacaccatgcgagacacgcttgcagacactgttgttttggaaatgtgcttccctccatctgaaatctcatccctccacccgcccactcgggcagctgtgccgtgggcagggcatgcgctcccctggctgagcaccccagagattctcctgcaccttcctcatgccgcacgctgctcatccgtctccatgtgtgtttagatccatgccattcactgactcactaacacctgcaaaatctttaaggaaaaaagctgaagggtacgaccatgcacatatgtgacctggaaaatgcaaatttagatcttttatgatttaattattattgtttcccatagaagttccctccctttgaaattaatatataatgtataaattctgcactgagccatggcggagctgggcagcccctaggttagagtggagacggaggcccaggcgcaggggtcacacctcatctggtttccttcccatctcacagcttagcttgtgcttctcaacaccaagtctttaagagcaataaaaactacaccatga

SEQ ID NO: 372366 - DNA, 3523 bp, Homo sapiens
atttggtcacacggcgtctctccagtcctgcgcaagcacgttgacatgtgtgcctttcactttcaggcttgtccagccggaagccctgagggcagctgttcccactggctctgctgaccttgtgccttggacggctgtcctcagcgaggggccgtgcacccgctcctgagcagcgccatgggcctgctggccttcctgaagacccagttcgtgctgcacctgctggtcggctttgtcttcgtggtgagtggtctggtcatcaacttcgtccagctgtgcacgctggcgctctggccggtcagcaagcagctctaccgccgcctcaactgccgcctcgcctactcactctggagccaactggtcatgctgctggagtggtggtcctgcacggagtgtacactgttcacggaccaggccacggtagagcgctttgggaaggagcacgcagtcatcatcctcaaccacaacttcgagatcgacttcctctgtgggtggaccatgtgtgagcgcttcggagtgctggggagctccaaggtcctcgctaagaaggagctgctctacgtgcccctcatcggctggacgtggtactttctggagattgtgttctgcaagcggaagtgggaggaggaccgggacaccgtggtcgaagggctgaggcgcctgtcggactaccccgagtacatgtggtttctcctgtactgcgaggggacgcgcttcacggagaccaagcaccgcgttagcatggaggtggcggctgctaaggggcttcctgtcctcaagtaccacctgctgccgcggaccaagggcttcaccaccgcagtcaagtgcctccgggggacagtcgcagctgtctatgatgtaaccctgaacttcagaggaaacaagaacccgtccctgctggggatcctctacgggaagaagtacgaggcggacatgtgcgtgaggagatttcctctggaagacatcccgctggatgaaaaggaagcagctcagtggcttcataaactgtaccaggagaaggacgcgctccaggagatatataatcagaagggcatgtttccaggggagcagtttaagcctgcccggaggccgtggaccctcctgaacttcctgtcctgggccaccattctcctgtctcccctcttcagttttgtcttgggcgtctttgccagcggatcacctctcctgatcctgactttcttggggtttgtgggagcagcttcctttggagttcgcagactgataggagtaactgagatagaaaaaggctccagctacggaaaccaagagtttaagaaaaaggaataattaatggctgtgactgaacacacgcggccctgacggtggtatccagttaactcaaaaccaacacacagagtgcaggaaaagacaattagaaactatttttcttattaactggtgactaatattaacaaaacttgagccaagagtaaagaattcagaaggcctgtgggtccggccggagaggcctcccgcggacgccgtctctccagaactccgcttccaagagggagcctttggctgctttctctccttaaacttagatcaaattttttggtttttaatcagttatcttgggaacttaacctggcccctcacctcttctgcaccccccgcccccgaaactgtctcgtaatgaatttctgctgtcctcctgggagtggacggccgggtcccgtcccccgggagcatcgctcggctcagcaccttggctcccagtgggggccccgtggagggcgcccgtagtgataagcacaccggcacgaacgtcaggtccattcctcgaagtcggagccctcactctgccctgtcctggggctggctgagggcgaacgccccacctcactttctagagccctgtctgtcctagctcctatctgaccttgtgtgtaaatacgtacatctgtttttaaagtggatgggcccctgagaactcagtgaaatgcagagttctccatgcacctaaagctcctttgtcgctctcatggctgtcagatcctggtccctccacactgggtgctggggagggaggaccctcggggctaccgcgcgcccccccatcccacagatcaggagccaaggagggagaacagggcagcctgtgggactctaggatgcttcagaagaagcgacggcaccgtcaaccctctgttttttaaaggtggttggagactgttaacactgagctcattgacttctagagattttatttttactggttgatctcttggtggttttcaacttcctgctggaaactagaggtggggcaccccccaccccccagcctcgcactgtgtccttggggagggcccgcccccatcctggccggtgtcactgtggcccggccacccctgagcgcccagctccctacctcctggacgtctctgagagtccaggcagagcagagggcagcgctcggccggtcatgctggctcccttggccttgcagcgagcccctggcccacgccgagcgagggatgcttctccctacagcatgtccactcccccggcatggccaggtggggcccctggggcaatggcagtggtagaacgctcaacttggttgcggtaccatcagcccacctgcatttggctttcgacttgcttgttctaagtcacagcgccctcatctttttagcaaggtaaaaaaaccaaaatgggtgttatctctgatatcttgaaaccagcgttctgaatagaggtaggttgagttttctaggggaaaacaaatggagaaaagaggcatgaagaaaagtaaaccgagaacataattaggcatcgggcctaagtgtcctggggagattggaggggacggcagcgttctgcatgatggaggcgctgccgggccccgggtctgtgggggccgtgctctcagggcgtgtgcgggacgccacctgtgcacacctgctcagagcacggctcctcgcaggggtgaaggggcagaccaacgaaaccagatgagaccaacgacaccatgcgagacacgcttgcagacactgttgttttggaaatgtgcttccctccatctgaaatctcatccctccacccgcccactcgggcagctgtgccgtgggcagggcatgcgctcccctggctgagcaccccagagattctcctgcaccttcctcatgccgcacgctgctcatccgtctccatgtgtgtttagatccatgccattcactgactcactaacacctgcaaaatctttaaggaaaaaagctgaagggtacgaccatgcacatatgtgacctggaaaatgcaaatttagatcttttatgatttaattattattgtttcccatagaagttccctccctttgaaattaatatataatgtataaattctgcactgagccatggcggagctgggcagcccctaggttagagtggagacggaggcccaggcgcaggggtcacacctcatctggtttccttcccatctcacagcttagcttgtgcttctcaacaccaagtctttaagagcaataaaaactacaccatga

SEQ ID NO: 372367 - DNA, 3295 bp, Homo sapiens
gctccctgaccatcccaggaggaggggtcctaccagtgccaacgccctccccctgtccgcagaactggtcatgctgctggagtggtggtcctgcacggagtgtacactgttcacggaccaggccacggtagagcgctttgggaaggagcacgcagtcatcatcctcaaccacaacttcgagatcgacttcctctgtgggtggaccatgtgtgagcgcttcggagtgctggggagctccaaggtcctcgctaagaaggagctgctctacgtgcccctcatcggctggacgtggtactttctggagattgtgttctgcaagcggaagtgggaggaggaccgggacaccgtggtcgaagggctgaggcgcctgtcggactaccccgagtacatgtggtttctcctgtactgcgaggggacgcgcttcacggagaccaagcaccgcgttagcatggaggtggcggctgctaaggggcttcctgtcctcaagtaccacctgctgccgcggaccaagggcttcaccaccgcagtcaagtgcctccgggggacagtcgcagctgtctatgatgtaaccctgaacttcagaggaaacaagaacccgtccctgctggggatcctctacgggaagaagtacgaggcggacatgtgcgtgaggagatttcctctggaagacatcccgctggatgaaaaggaagcagctcagtggcttcataaactgtaccaggagaaggacgcgctccaggagatatataatcagaagggcatgtttccaggggagcagtttaagcctgcccggaggccgtggaccctcctgaacttcctgtcctgggccaccattctcctgtctcccctcttcagttttgtcttgggcgtctttgccagcggatcacctctcctgatcctgactttcttggggtttgtgggagcagcttcctttggagttcgcagactgataggagtaactgagatagaaaaaggctccagctacggaaaccaagagtttaagaaaaaggaataattaatggctgtgactgaacacacgcggccctgacggtggtatccagttaactcaaaaccaacacacagagtgcaggaaaagacaattagaaactatttttcttattaactggtgactaatattaacaaaacttgagccaagagtaaagaattcagaaggcctgtcaggtgaagtcttcagcctcccacagcgcagggtcccagcatctccacgcgcgcccgtgggaggtgggtccggccggagaggcctcccgcggacgccgtctctccagaactccgcttccaagagggagcctttggctgctttctctccttaaacttagatcaaattttttggtttttaatcagttatcttgggaacttaacctggcccctcacctcttctgcaccccccgcccccgaaactgtctcgtaatgaatttctgctgtcctcctgggagtggacggccgggtcccgtcccccgggagcatcgctcggctcagcaccttggctcccagtgggggccccgtggagggcgcccgtagtgataagcacaccggcacgaacgtcaggtccattcctcgaagtcggagccctcactctgccctgtcctggggctggctgagggcgaacgccccacctcactttctagagccctgtctgtcctagctcctatctgaccttgtgtgtaaatacgtacatctgtttttaaagtggatgggcccctgagaactcagtgaaatgcagagttctccatgcacctaaagctcctttgtcgctctcatggctgtcagatcctggtccctccacactgggtgctggggagggaggaccctcggggctaccgcgcgcccccccatcccacagatcaggagccaaggagggagaacagggcagcctgtgggactctaggatgcttcagaagaagcgacggcaccgtcaaccctctgttttttaaaggtggttggagactgttaacactgagctcattgacttctagagattttatttttactggttgatctcttggtggttttcaacttcctgctggaaactagaggtggggcaccccccaccccccagcctcgcactgtgtccttggggagggcccgcccccatcctggccggtgtcactgtggcccggccacccctgagcgcccagctccctacctcctggacgtctctgagagtccaggcagagcagagggcagcgctcggccggtcatgctggctcccttggccttgcagcgagcccctggcccacgccgagcgagggatgcttctccctacagcatgtccactcccccggcatggccaggtggggcccctggggcaatggcagtggtagaacgctcaacttggttgcggtaccatcagcccacctgcatttggctttcgacttgcttgttctaagtcacagcgccctcatctttttagcaaggtaaaaaaaccaaaatgggtgttatctctgatatcttgaaaccagcgttctgaatagaggtaggttgagttttctaggggaaaacaaatggagaaaagaggcatgaagaaaagtaaaccgagaacataattaggcatcgggcctaagtgtcctggggagattggaggggacggcagcgttctgcatgatggaggcgctgccgggccccgggtctgtgggggccgtgctctcagggcgtgtgcgggacgccacctgtgcacacctgctcagagcacggctcctcgcaggggtgaaggggcagaccaacgaaaccagatgagaccaacgacaccatgcgagacacgcttgcagacactgttgttttggaaatgtgcttccctccatctgaaatctcatccctccacccgcccactcgggcagctgtgccgtgggcagggcatgcgctcccctggctgagcaccccagagattctcctgcaccttcctcatgccgcacgctgctcatccgtctccatgtgtgtttagatccatgccattcactgactcactaacacctgcaaaatctttaaggaaaaaagctgaagggtacgaccatgcacatatgtgacctggaaaatgcaaatttagatcttttatgatttaattattattgtttcccatagaagttccctccctttgaaattaatatataatgtataaattctgcactgagccatggcggagctgggcagcccctaggttagagtggagacggaggcccaggcgcaggggtcacacctcatctggtttccttcccatctcacagcttagcttgtgcttctcaacaccaagtctttaagagcaataaaaactacaccatga

SEQ ID NO: 372368 - DNA, 3705 bp, Homo sapiens
tctatgaaaccaacatacatggcgtttgcatcacagttggagtcagatgtgagcccggagggcaggtgtctggcttgtccagccggaagccctgagggcagctgttcccactggctctgctgaccttgtgccttggacggctgtcctcagcgaggggccgtgcacccgctcctgagcagcgccatgggcctgctggccttcctgaagacccagttcgtgctgcacctgctggtcggctttgtcttcgtggtgagtggtctggtcatcaacttcgtccagctgtgcacgctggcgctctggccggtcagcaagcagctctaccgccgcctcaactgccgcctcgcctactcactctggagccaactggtcatgctgctggagtggtggtcctgcacggagtgtacactgttcacggaccaggccacggtagagcgctttgggaaggagcacgcagtcatcatcctcaaccacaacttcgagatcgacttcctctgtgggtggaccatgtgtgagcgcttcggagtgctggggagctccaaggtcctcgctaagaaggagctgctctacgtgcccctcatcggctggacgtggtactttctggagattgtgttctgcaagcggaagtgggaggaggaccgggacaccgtggtcgaagggctgaggcgcctgtcggactaccccgagtacatgtggtttctcctgtactgcgaggggacgcgcttcacggagaccaagcaccgcgttagcatggaggtggcggctgctaaggggcttcctgtcctcaagtaccacctgctgccgcggaccaagggcttcaccaccgcagtcaagtgcctccgggggacagtcgcagctgtctatgatgtaaccctgaacttcagaggaaacaagaacccgtccctgctggggatcctctacgggaagaagtacgaggcggacatgtgcgtgaggagatttcctctggaagacatcccgctggatgaaaaggaagcagctcagtggcttcataaactgtaccaggagaaggacgcgctccaggagatatataatcagaagggcatgtttccaggggagcagtttaagcctgcccggaggccgtggaccctcctgaacttcctgtcctgggccaccattctcctgtctcccctcttcagttttgtcttgggcgtctttgccagcggatcacctctcctgatcctgactttcttggggtttgtgggagcagcttcctttggagttcgcagactgataggagtaactgagatagaaaaaggctccagctacggaaaccaagagtttaagaaaaaggaataattaatggctgtgactgaacacacgcggccctgacggtggtatccagttaactcaaaaccaacacacagagtgcaggaaaagacaattagaaactatttttcttattaactggtgactaatattaacaaaacttgagccaagagtaaagaattcagaaggcctgtcaggtgaagtcttcagcctcccacagcgcagggtcccagcatctccacgcgcgcccgtgggaggtgggtccggccggagaggcctcccgcggacgccgtctctccagaactccgcttccaagagggagcctttggctgctttctctccttaaacttagatcaaattttttggtttttaatcagttatcttgggaacttaacctggcccctcacctcttctgcaccccccgcccccgaaactgtctcgtaatgaatttctgctgtcctcctgggagtggacggccgggtcccgtcccccgggagcatcgctcggctcagcaccttggctcccagtgggggccccgtggagggcgcccgtagtgataagcacaccggcacgaacgtcaggtccattcctcgaagtcggagccctcactctgccctgtcctggggctggctgagggcgaacgccccacctcactttctagagccctgtctgtcctagctcctatctgaccttgtgtgtaaatacgtacatctgtttttaaagtggatgggcccctgagaactcagtgaaatgcagagttctccatgcacctaaagctcctttgtcgctctcatggctgtcagatcctggtccctccacactgggtgctggggagggaggaccctcggggctaccgcgcgcccccccatcccacagatcaggagccaaggagggagaacagggcagcctgtgggactctaggatgcttcagaagaagcgacggcaccgtcaaccctctgttttttaaaggtggttggagactgttaacactgagctcattgacttctagagattttatttttactggttgatctcttggtggttttcaacttcctgctggaaactagaggtggggcaccccccaccccccagcctcgcactgtgtccttggggagggcccgcccccatcctggccggtgtcactgtggcccggccacccctgagcgcccagctccctacctcctggacgtctctgagagtccaggcagagcagagggcagcgctcggccggtcatgctggctcccttggccttgcagcgagcccctggcccacgccgagcgagggatgcttctccctacagcatgtccactcccccggcatggccaggtggggcccctggggcaatggcagtggtagaacgctcaacttggttgcggtaccatcagcccacctgcatttggctttcgacttgcttgttctaagtcacagcgccctcatctttttagcaaggtaaaaaaaccaaaatgggtgttatctctgatatcttgaaaccagcgttctgaatagaggtaggttgagttttctaggggaaaacaaatggagaaaagaggcatgaagaaaagtaaaccgagaacataattaggcatcgggcctaagtgtcctggggagattggaggggacggcagcgttctgcatgatggaggcgctgccgggccccgggtctgtgggggccgtgctctcagggcgtgtgcgggacgccacctgtgcacacctgctcagagcacggctcctcgcaggggtgaaggggcagaccaacgaaaccagatgagaccaacgacaccatgcgagacacgcttgcagacactgttgttttggaaatgtgcttccctccatctgaaatctcatccctccacccgcccactcgggcagctgtgccgtgggcagggcatgcgctcccctggctgagcaccccagagattctcctgcaccttcctcatgccgcacgctgctcatccgtctccatgtgtgtttagatccatgccattcactgactcactaacacctgcaaaatctttaaggaaaaaagctgaagggtacgaccatgcacatatgtgacctggaaaatgcaaatttagatcttttatgatttaattattattgtttcccatagaagttccctccctttgaaattaatatataatgtataaattctgcactgagccatggcggagctgggcagcccctaggttagagtggagacggaggcccaggcgcaggggtcacacctcatctggtttccttcccatctcacagcttagcttgtgcttctcaacaccaagtctttaagagcaataaaaactacaccatgaatgtttgaattttttttttttgggggggggagggtggattttgcttttcatccagaaggaaaaggggaggagagctcctttacattttttaaattaaattcataaatccca

SEQ ID NO: 372369 - DNA, 4161 bp, Homo sapiens
tctatgaaaccaacatacatggcgtttgcatcacagttggagtcagatgtgagcccggagggcaggtgtctggcttgtccagccggaagccctgagggcagctgttcccactggctctgctgaccttgtgccttggacggctgtcctcagcgaggggccgtgcacccgctcctgagcagcgccatgggcctgctggccttcctgaagacccagttcgtgctgcacctgctggtcggctttgtcttcgtggtgagtggtctggtcatcaacttcgtccagctgtgcacgctggcgctctggccggtcagcaagcagctctaccgccgcctcaactgccgcctcgcctactcactctggagccaactggtcatgctgctggagtggtggtcctgcacggagtgtacactgttcacggaccaggccacggtagagcgctttgggaaggagcacgcagtcatcatcctcaaccacaacttcgagatcgacttcctctgtgggtggaccatgtgtgagcgcttcggagtgctggggagctccaaggtcctcgctaagaaggagctgctctacgtgcccctcatcggctggacgtggtactttctggagattgtgttctgcaagcggaagtgggaggaggaccgggacaccgtggtcgaagggctgaggcgcctgtcggactaccccgagtacatgtggtttctcctgtactgcgaggggacgcgcttcacggagaccaagcaccgcgttagcatggaggtggcggctgctaaggggcttcctgtcctcaagtaccacctgctgccgcggaccaagggcttcaccaccgcagtcaagtgcctccgggggacagtcgcagctgtctatgatgtaaccctgaacttcagaggaaacaagaacccgtccctgctggggatcctctacgggaagaagtacgaggcggacatgtgcgtgaggagatttcctctggaagacatcccgctggatgaaaaggaagcagctcagtggcttcataaactgtaccaggagaaggacgcgctccaggagatatataatcagaagggcatgtttccaggggagcagtttaagcctgcccggaggccgtggaccctcctgaacttcctgtcctgggccaccattctcctgtctcccctcttcagttttgtcttgggcgtctttgccagcggatcacctctcctgatcctgactttcttggggtttgtgggagcagcttcctttggagttcgcagactgataggagtaactgagatagaaaaaggctccagctacggaaaccaagagtttaagaaaaaggaataattaatggctgtgactgaacacacgcggccctgacggtggtatccagttaactcaaaaccaacacacagagtgcaggaaaagacaattagaaactatttttcttattaactggtgactaatattaacaaaacttgagccaagagtaaagaattcagaaggcctgtcaggtgaagtcttcagcctcccacagcgcagggtcccagcatctccacgcgcgcccgtgggaggtgggtccggccggagaggcctcccgcggacgccgtctctccagaactccgcttccaagagggagcctttggctgctttctctccttaaacttagatcaaattttttggtttttaatcagttatcttgggaacttaacctggcccctcacctcttctgcaccccccgcccccgaaactgtctcgtaatgaatttctgctgtcctcctgggagtggacggccgggtcccgtcccccgggagcatcgctcggctcagcaccttggctcccagtgggggccccgtggagggcgcccgtagtgataagcacaccggcacgaacgtcaggtccattcctcgaagtcggagccctcactctgccctgtcctggggctggctgagggcgaacgccccacctcactttctagagccctgtctgtcctagctcctatctgaccttgtgtgtaaatacgtacatctgtttttaaagtggatgggcccctgagaactcagtgaaatgcagagttctccatgcacctaaagctcctttgtcgctctcatggctgtcagatcctggtccctccacactgggtgctggggagggaggaccctcggggctaccgcgcgcccccccatcccacagatcaggagccaaggagggagaacagggcagcctgtgggactctaggatgcttcagaagaagcgacggcaccgtcaaccctctgttttttaaaggtggttggagactgttaacactgagctcattgacttctagagattttatttttactggttgatctcttggtggttttcaacttcctgctggaaactagaggtggggcaccccccaccccccagcctcgcactgtgtccttggggagggcccgcccccatcctggccggtgtcactgtggcccggccacccctgagcgcccagctccctacctcctggacgtctctgagagtccaggcagagcagagggcagcgctcggccggtcatgctggctcccttggccttgcagcgagcccctggcccacgccgagcgagggatgcttctccctacagcatgtccactcccccggcatggccaggtggggcccctggggcaatggcagtggtagaacgctcaacttggttgcggtaccatcagcccacctgcatttggctttcgacttgcttgttctaagtcacagcgccctcatctttttagcaaggtaaaaaaaccaaaatgggtgttatctctgatatcttgaaaccagcgttctgaatagaggtaggttgagttttctaggggaaaacaaatggagaaaagaggcatgaagaaaagtaaaccgagaacataattaggcatcgggcctaagtgtcctggggagattggaggggacggcagcgttctgcatgatggaggcgctgccgggccccgggtctgtgggggccgtgctctcagggcgtgtgcgggacgccacctgtgcacacctgctcagagcacggctcctcgcaggggtgaaggggcagaccaacgaaaccagatgagaccaacgacaccatgcgagacacgcttgcagacactgttgttttggaaatgtgcttccctccatctgaaatctcatccctccacccgcccactcgggcagctgtgccgtgggcagggcatgcgctcccctggctgagcaccccagagattctcctgcaccttcctcatgccgcacgctgctcatccgtctccatgtgtgtttagatccatgccattcactgactcactaacacctgcaaaatctttaaggaaaaaagctgaagggtacgaccatgcacatatgtgacctggaaaatgcaaatttagatcttttatgatttaattattattgtttcccatagaagttccctccctttgaaattaatatataatgtataaattctgcactgagccatggcggagctgggcagcccctaggttagagtggagacggaggcccaggcgcaggggtcacacctcatctggtttccttcccatctcacagcttagcttgtgcttctcaacaccaagtctttaagagcaataaaaactacaccatgaatgtttgaattttttttttttgggggggggagggtggattttgcttttcatccagaaggaaaaggggaggagagctcctttacattttttaaattaaattcataaatcccagaacagtcttttttttttctttttcctttacaccctacttctgagcttaattcagttgatgttatgtccaaattcaggctgagtgctcaggctgaagcaactctgtagcccacagtccgtgctggccactgtcggggtgaggcacattctaggcctggcatcgctgatgccctctgcacccagtccttgagccaggccgaggacaggaagggcattgctggcctgtagctcctgttacccacccagagccaggcgccacactggaggctcccaggcgggagggcccaggcccacccacgggcgtctggccggtcaagctcccagcctgggccgggtctcctggggacgccgtctggcctcccagcttaggcccaggtgccaggtgtcatggggtctcctgcccatttcccaaggatgccattgctgtcttcatcgcttcccccgtgtgagacactg

SEQ ID NO: 372370 - DNA, 1725 bp, Homo sapiens
cgccgacacatggtcgttcgacttctggcttggcctcttttgtgagtgtggggcctggtcatatcctcttggtcagtgtctctgtgatgatgagaacgggaagacggccacggtgcccaccctggcaggactctctcccctcgctggcgctggctcagctgccgtgagcggccgtaggcactgtcccgggccctcctgtggttgctcccagccatgctgctggctgcttctgccgtcctggcttgcagagactctgggtcatgcggggaagagggcagagtcctcctccctgctcaggcaagagaggatccagcaagatttcttcctccccaccctcctgcccctcccagtctgggcagcagataaaagccagggccccacacttctgccacctcctgctgctcacacactccagccagggacctgcccccggggtccaacaaggacggctgtcctcagcgaggggccgtgcacccgctcctgagcagcgccatgggcctgctggccttcctgaagacccagttcgtgctgcacctgctggtcggctttgtcttcgtggtgagtggtctggtcatcaacttcgtccagctgtgcacgctggcgctctggccggtcagcaagcagctctaccgccgcctcaactgccgcctcgcctactcactctggagccaactggtcatgctgctggagtggtggtcctgcacggagtgtacactgttcacggaccaggccacggtagagcgctttgggaaggagcacgcagtcatcatcctcaaccacaacttcgagatcgacttcctctgtgggtggaccatgtgtgagcgcttcggagtgctggggagctccaaggtcctcgctaagaaggagctgctctacgtgcccctcatcggctggacgtggtactttctggagattgtgttctgcaagcggaagtgggaggaggaccgggacaccgtggtcgaagggctgaggcgcctgtcggactaccccgagtacatgtggtttctcctgtactgcgaggggacgcgcttcacggagaccaagcaccgcgttagcatggaggtggcggctgctaaggggcttcctgtcctcaagtaccacctgctgccgcggaccaagggcttcaccaccgcagtcaagtgcctccgggggacagtcgcagctgtctatgatgtaaccctgaacttcagaggaaacaagaacccgtccctgctggggatcctctacgggaagaagtacgaggcggacatgtgcgtgaggagatttcctctggaagacatcccgctggatgaaaaggaagcagctcagtggcttcataaactgtaccaggagaaggacgcgctccaggagatatataatcagaagggcatgtttccaggggagcagtttaagcctgcccggaggccgtggaccctcctgaacttcctgtcctgggccaccattctcctgtctcccctcttcagttttgtcttgggcgtctttgccagcggatcacctctcctgatcctgactttcttggggtttgtgggagcaggtaatggacactgtcgctaacagctcacactctgacgggcctcacagtatcagccacagggtccgggacctggtgactcatcacagtggctgtgggaggcaggggcctggctgttatggaccctggagccaggatccccccacggcctgcgggcctcagagcctggattcttgcactgagctgagggtcgc

SEQ ID NO: 372371 - DNA, 1219 bp, Homo sapiens
cgccgacacatggtcgttcgacttctggcttggcctcttttgtgagtgtggggcctggtcatatcctcttggtcagtgtctctgtgatgatgagaacgggaagacggccacggtgcccaccctggcaggactctctcccctcgctggcgctggctcagctgccgtgagcggccgtaggcactgtcccgggccctcctgtggttgctcccagccatgctgctggctgcttctgccgtcctggcttgcagagactctgggtcatgcggggaagagggcagagtcctcctccctgctcaggcaagagaggatccagcaagatttcttcctccccaccctcctgcccctcccagtctgggcagcagataaaagccagggccccacacttctgccacctcctgctgctcacacactccagccagggacctgcccccggggtccaacaaggacggctgtcctcagcgaggggccgtgcacccgctcctgagcagcgccatgggcctgctggccttcctgaagacccagttcgtgctgcacctgctggtcggctttgtcttcgtggtgagtggtctggtcatcaacttcgtccagctgtgcacgctggcgctctggccggtcagcaagcagctctaccgccgcctcaactgccgcctcgcctactcactctggagccaactggtcatgctgctggagtggtggtcctgcacggagtgtacactgttcacggaccaggccacggtagagcgctttgggaaggagcacgcagtcatcatcctcaaccacaacttcgagatcgacttcctctgtgggtggaccatgtgtgagcgcttcggagtgctggggagctccaaggtcctcgctaagaaggagctgctctacgtgcccctcatcggctggacgtggtactttctggagattgtgttctgcaagcggaagtgggaggaggaccgggacaccgtggtcgaagggctgaggcgcctgtcggactaccccgagtacatgtggtttctcctgtactgcgaggggacgcgcttcacggagaccaagcaccgcgttagcatggaggtggcggctgctaaggggcttcctgtcctcaagtaccacctgctgccgcggaccaagggcttcaccaccgcagtcaagtgcctccgggggacaggtaggccccagactgcccgagccggggccaccgctatgctcacggaaaatagtgatttcttta

SEQ ID NO: 372372 - DNA, 930 bp, Homo sapiens
aggtccattgtgcagtcatcaggccctgggagctttccacatccctccacctcccacccaacatcaccactctccggccagtgagaccgtcacagcaccccagaggagacaaattctggagctcagagagctgggagggcagctgctggtgtgacctcagctgctccccagaccctaaggggatctgggaccttccaccttctaccaacggtgttggtcttctgtcctcacgcctatggtttcacgctcccacagtggctcctgcaccttcagacactgcctcctcaccgagggagggaagaacgacaaaggtgatggacctccaggacgtagaggttgatgatccgggcaggtggccttcagcgagggagcacgtcaaaaggctgtgggccgtgcagacagctgggggacaccgtcccgggtgtgaccttgggccacacggcagggtggtggacttgctcctagaattgggctccagggctgaagccagcccctctgatctggcactggccggctccattcaccctttttggggcttactgccgcagagacttcctttgaggagagctggacccaagacgccagagttccgggggcactgagtgctgtgtggcacccgggccaggagaaacatgtgccagagggcaggcgtgggctctccggggagtctctgcgtagactttctagcccagaggttcaggtgatggaccagagactggccgctttgtgacaccgaggacggttgataaagtggattctcgaggggaagctgcatccacacagaggctgggacgtgaatgtgcatcacggctctatctgtggcccccaaaggctgggtgccagctgcctgtcggcagggagcgtatcaccgtggcacgtccatgccgtgggggtcactcagcagccacggatgcgccctgggtgctgtcc

SEQ ID NO: 372373 - DNA, 812 bp, Homo sapiens
aggtccattgtgcagtcatcaggccctgggagctttccacatccctccacctcccacccaacatcaccactctccggccagtgagaccgtcacagcaccccagaggagacaaattctggagctcagagagctgggagtggctcctgcaccttcagacactgcctcctcaccgagggagggaagaacgacaaaggtgatggacctccaggacgtagaggttgatgatccgggcaggtggccttcagcgagggagcacgtcaaaaggctgtgggccgtgcagacagctgggggacaccgtcccgggtgtgaccttgggccacacggcagggtggtggacttgctcctagaattgggctccagggctgaagccagcccctctgatctggcactggccggctccattcaccctttttggggcttactgccgcagagacttcctttgaggagagctggacccaagacgccagagttccgggggcactgagtgctgtgtggcacccgggccaggagaaacatgtgccagagggcaggcgtgggctctccggggagtctctgcgtagactttctagcccagaggttcaggtgatggaccagagactggccgctttgtgacaccgaggacggttgataaagtggattctcgaggggaagctgcatccacacagaggctgggacgtgaatgtgcatcacggctctatctgtggcccccaaaggctgggtgccagctgcctgtcggcagggagcgtatcaccgtggcacgtccatgccgtgggggtcactcagcagccacggatgcgccctgggtgctgtcc

SEQ ID NO: 372374 - DNA, 3755 bp, Homo sapiens
gggccgaggagcgcggcggccagagcggggccgcggaggcgacgccggggacgcccgcgcgacgagcaggtggcggcggctgcaggcttgtccagccggaagccctgagggcagctgttcccactggctctgctgaccttgtgccttggacggctgtcctcagcgaggggccgtgcacccgctcctgagcagcgccatgggcctgctggccttcctgaagacccagttcgtgctgcacctgctggtcggctttgtcttcgtggtgagtggtctggtcatcaacttcgtccagctgtgcacgctggcgctctggccggtcagcaagcagctctaccgccgcctcaactgccgcctcgcctactcactctggagcctagcacaaaactagaagcaacccaagcacctgtcactggagactaattatgcggcacccatacagggaccctctgcggccatcatggagagccttcatcttgcccgtacagttttaagcgaaaaaggaagtatacaacaaagtccataaactggtcatgctgctggagtggtggtcctgcacggagtgtacactgttcacggaccaggccacggtagagcgctttgggaaggagcacgcagtcatcatcctcaaccacaacttcgagatcgacttcctctgtgggtggaccatgtgtgagcgcttcggagtgctggggagctccaaggtcctcgctaagaaggagctgctctacgtgcccctcatcggctggacgtggtactttctggagattgtgttctgcaagcggaagtgggaggaggaccgggacaccgtggtcgaagggctgaggcgcctgtcggactaccccgagtacatgtggtttctcctgtactgcgaggggacgcgcttcacggagaccaagcaccgcgttagcatggaggtggcggctgctaaggggcttcctgtcctcaagtaccacctgctgccgcggaccaagggcttcaccaccgcagtcaagtgcctccgggggacagtcgcagctgtctatgatgtaaccctgaacttcagaggaaacaagaacccgtccctgctggggatcctctacgggaagaagtacgaggcggacatgtgcgtgaggagatttcctctggaagacatcccgctggatgaaaaggaagcagctcagtggcttcataaactgtaccaggagaaggacgcgctccaggagatatataatcagaagggcatgtttccaggggagcagtttaagcctgcccggaggccgtggaccctcctgaacttcctgtcctgggccaccattctcctgtctcccctcttcagttttgtcttgggcgtctttgccagcggatcacctctcctgatcctgactttcttggggtttgtgggagcagcttcctttggagttcgcagactgataggagtaactgagatagaaaaaggctccagctacggaaaccaagagtttaagaaaaaggaataattaatggctgtgactgaacacacgcggccctgacggtggtatccagttaactcaaaaccaacacacagagtgcaggaaaagacaattagaaactatttttcttattaactggtgactaatattaacaaaacttgagccaagagtaaagaattcagaaggcctgtcaggtgaagtcttcagcctcccacagcgcagggtcccagcatctccacgcgcgcccgtgggaggtgggtccggccggagaggcctcccgcggacgccgtctctccagaactccgcttccaagagggagcctttggctgctttctctccttaaacttagatcaaattttttggtttttaatcagttatcttgggaacttaacctggcccctcacctcttctgcaccccccgcccccgaaactgtctcgtaatgaatttctgctgtcctcctgggagtggacggccgggtcccgtcccccgggagcatcgctcggctcagcaccttggctcccagtgggggccccgtggagggcgcccgtagtgataagcacaccggcacgaacgtcaggtccattcctcgaagtcggagccctcactctgccctgtcctggggctggctgagggcgaacgccccacctcactttctagagccctgtctgtcctagctcctatctgaccttgtgtgtaaatacgtacatctgtttttaaagtggatgggcccctgagaactcagtgaaatgcagagttctccatgcacctaaagctcctttgtcgctctcatggctgtcagatcctggtccctccacactgggtgctggggagggaggaccctcggggctaccgcgcgcccccccatcccacagatcaggagccaaggagggagaacagggcagcctgtgggactctaggatgcttcagaagaagcgacggcaccgtcaaccctctgttttttaaaggtggttggagactgttaacactgagctcattgacttctagagattttatttttactggttgatctcttggtggttttcaacttcctgctggaaactagaggtggggcaccccccaccccccagcctcgcactgtgtccttggggagggcccgcccccatcctggccggtgtcactgtggcccggccacccctgagcgcccagctccctacctcctggacgtctctgagagtccaggcagagcagagggcagcgctcggccggtcatgctggctcccttggccttgcagcgagcccctggcccacgccgagcgagggatgcttctccctacagcatgtccactcccccggcatggccaggtggggcccctggggcaatggcagtggtagaacgctcaacttggttgcggtaccatcagcccacctgcatttggctttcgacttgcttgttctaagtcacagcgccctcatctttttagcaaggtaaaaaaaccaaaatgggtgttatctctgatatcttgaaaccagcgttctgaatagaggtaggttgagttttctaggggaaaacaaatggagaaaagaggcatgaagaaaagtaaaccgagaacataattaggcatcgggcctaagtgtcctggggagattggaggggacggcagcgttctgcatgatggaggcgctgccgggccccgggtctgtgggggccgtgctctcagggcgtgtgcgggacgccacctgtgcacacctgctcagagcacggctcctcgcaggggtgaaggggcagaccaacgaaaccagatgagaccaacgacaccatgcgagacacgcttgcagacactgttgttttggaaatgtgcttccctccatctgaaatctcatccctccacccgcccactcgggcagctgtgccgtgggcagggcatgcgctcccctggctgagcaccccagagattctcctgcaccttcctcatgccgcacgctgctcatccgtctccatgtgtgtttagatccatgccattcactgactcactaacacctgcaaaatctttaaggaaaaaagctgaagggtacgaccatgcacatatgtgacctggaaaatgcaaatttagatcttttatgatttaattattattgtttcccatagaagttccctccctttgaaattaatatataatgtataaattctgcactgagccatggcggagctgggcagcccctaggttagagtggagacggaggcccaggcgcaggggtcacacctcatctggtttccttcccatctcacagcttagcttgtgcttctcaacaccaagtctttaagagcaataaaaactacaccatga

SEQ ID NO: 372375 - DNA, 3588 bp, Homo sapiens
atttggtcacacggcgtctctccagtcctgcgcaagcacgttgacatgtgtgcctttcactttcaggcttgtccagccggaagccctgagggcagctgttcccactggctctgctgaccttgtgccttggacggctgtcctcagcgaggggccgtgcacccgctcctgagcagcgccatgggcctgctggccttcctgaagacccagttcgtgctgcacctgctggtcggctttgtcttcgtggtgagtggtctggtcatcaacttcgtccagctgtgcacgctggcgctctggccggtcagcaagcagctctaccgccgcctcaactgccgcctcgcctactcactctggagccaactggtcatgctgctggagtggtggtcctgcacggagtgtacactgttcacggaccaggccacggtagagcgctttgggaaggagcacgcagtcatcatcctcaaccacaacttcgagatcgacttcctctgtgggtggaccatgtgtgagcgcttcggagtgctggggagctccaaggtcctcgctaagaaggagctgctctacgtgcccctcatcggctggacgtggtactttctggagattgtgttctgcaagcggaagtgggaggaggaccgggacaccgtggtcgaagggctgaggcgcctgtcggactaccccgagtacatgtggtttctcctgtactgcgaggggacgcgcttcacggagaccaagcaccgcgttagcatggaggtggcggctgctaaggggcttcctgtcctcaagtaccacctgctgccgcggaccaagggcttcaccaccgcagtcaagtgcctccgggggacagtcgcagctgtctatgatgtaaccctgaacttcagaggaaacaagaacccgtccctgctggggatcctctacgggaagaagtacgaggcggacatgtgcgtgaggagatttcctctggaagacatcccgctggatgaaaaggaagcagctcagtggcttcataaactgtaccaggagaaggacgcgctccaggagatatataatcagaagggcatgtttccaggggagcagtttaagcctgcccggaggccgtggaccctcctgaacttcctgtcctgggccaccattctcctgtctcccctcttcagttttgtcttgggcgtctttgccagcggatcacctctcctgatcctgactttcttggggtttgtgggagcagcttcctttggagttcgcagactgataggagtaactgagatagaaaaaggctccagctacggaaaccaagagtttaagaaaaaggaataattaatggctgtgactgaacacacgcggccctgacggtggtatccagttaactcaaaaccaacacacagagtgcaggaaaagacaattagaaactatttttcttattaactggtgactaatattaacaaaacttgagccaagagtaaagaattcagaaggcctgtcaggtgaagtcttcagcctcccacagcgcagggtcccagcatctccacgcgcgcccgtgggaggtgggtccggccggagaggcctcccgcggacgccgtctctccagaactccgcttccaagagggagcctttggctgctttctctccttaaacttagatcaaattttttggtttttaatcagttatcttgggaacttaacctggcccctcacctcttctgcaccccccgcccccgaaactgtctcgtaatgaatttctgctgtcctcctgggagtggacggccgggtcccgtcccccgggagcatcgctcggctcagcaccttggctcccagtgggggccccgtggagggcgcccgtagtgataagcacaccggcacgaacgtcaggtccattcctcgaagtcggagccctcactctgccctgtcctggggctggctgagggcgaacgccccacctcactttctagagccctgtctgtcctagctcctatctgaccttgtgtgtaaatacgtacatctgtttttaaagtggatgggcccctgagaactcagtgaaatgcagagttctccatgcacctaaagctcctttgtcgctctcatggctgtcagatcctggtccctccacactgggtgctggggagggaggaccctcggggctaccgcgcgcccccccatcccacagatcaggagccaaggagggagaacagggcagcctgtgggactctaggatgcttcagaagaagcgacggcaccgtcaaccctctgttttttaaaggtggttggagactgttaacactgagctcattgacttctagagattttatttttactggttgatctcttggtggttttcaacttcctgctggaaactagaggtggggcaccccccaccccccagcctcgcactgtgtccttggggagggcccgcccccatcctggccggtgtcactgtggcccggccacccctgagcgcccagctccctacctcctggacgtctctgagagtccaggcagagcagagggcagcgctcggccggtcatgctggctcccttggccttgcagcgagcccctggcccacgccgagcgagggatgcttctccctacagcatgtccactcccccggcatggccaggtggggcccctggggcaatggcagtggtagaacgctcaacttggttgcggtaccatcagcccacctgcatttggctttcgacttgcttgttctaagtcacagcgccctcatctttttagcaaggtaaaaaaaccaaaatgggtgttatctctgatatcttgaaaccagcgttctgaatagaggtaggttgagttttctaggggaaaacaaatggagaaaagaggcatgaagaaaagtaaaccgagaacataattaggcatcgggcctaagtgtcctggggagattggaggggacggcagcgttctgcatgatggaggcgctgccgggccccgggtctgtgggggccgtgctctcagggcgtgtgcgggacgccacctgtgcacacctgctcagagcacggctcctcgcaggggtgaaggggcagaccaacgaaaccagatgagaccaacgacaccatgcgagacacgcttgcagacactgttgttttggaaatgtgcttccctccatctgaaatctcatccctccacccgcccactcgggcagctgtgccgtgggcagggcatgcgctcccctggctgagcaccccagagattctcctgcaccttcctcatgccgcacgctgctcatccgtctccatgtgtgtttagatccatgccattcactgactcactaacacctgcaaaatctttaaggaaaaaagctgaagggtacgaccatgcacatatgtgacctggaaaatgcaaatttagatcttttatgatttaattattattgtttcccatagaagttccctccctttgaaattaatatataatgtataaattctgcactgagccatggcggagctgggcagcccctaggttagagtggagacggaggcccaggcgcaggggtcacacctcatctggtttccttcccatctcacagcttagcttgtgcttctcaacaccaagtctttaagagcaataaaaactacaccatga

SEQ ID NO: 372376 - DNA, 3831 bp, Homo sapiens
  misc_feature (3782)..(3782): n is a, c, g, or t
tctatgaaaccaacatacatggcgtttgcatcacagttggagtcagatgtgagcccggagggcaggtgtctggcttgtccagccggaagccctgagggcagctgttcccactggctctgctgaccttgtgccttggacggctgtcctcagcgaggggccgtgcacccgctcctgagcagcgccatgggcctgctggccttcctgaagacccagttcgtgctgcacctgctggtcggctttgtcttcgtggtgagtggtctggtcatcaacttcgtccagctgtgcacgctggcgctctggccggtcagcaagcagctctaccgccgcctcaactgccgcctcgcctactcactctggagccaactggtcatgctgctggagtggtggtcctgcacggagtgtacactgttcacggaccaggccacggtagagcgctttgggaaggagcacgcagtcatcatcctcaaccacaacttcgagatcgacttcctctgtgggtggaccatgtgtgagcgcttcggagtgctggggagctccaaggtcctcgctaagaaggagctgctctacgtgcccctcatcggctggacgtggtactttctggagattgtgttctgcaagcggaagtgggaggaggaccgggacaccgtggtcgaagggctgaggcgcctgtcggactaccccgagtacatgtggtttctcctgtactgcgaggggacgcgcttcacggagaccaagcaccgcgttagcatggaggtggcggctgctaaggggcttcctgtcctcaagtaccacctgctgccgcggaccaagggcttcaccaccgcagtcaagtgcctccgggggacagtcgcagctgtctatgatgtaaccctgaacttcagaggaaacaagaacccgtccctgctggggatcctctacgggaagaagtacgaggcggacatgtgcgtgaggagatttcctctggaagacatcccgctggatgaaaaggaagcagctcagtggcttcataaactgtaccaggagaaggacgcgctccaggagatatataatcagaagggcatgtttccaggggagcagtttaagcctgcccggaggccgtggaccctcctgaacttcctgtcctgggccaccattctcctgtctcccctcttcagttttgtcttgggcgtctttgccagcggatcacctctcctgatcctgactttcttggggtttgtgggagcagcttcctttggagttcgcagactgataggagtaactgagatagaaaaaggctccagctacggaaaccaagagtttaagaaaaaggaataattaatggctgtgactgaacacacgcggccctgacggtggtatccagttaactcaaaaccaacacacagagtgcaggaaaagacaattagaaactatttttcttattaactggtgactaatattaacaaaacttgagccaagagtaaagaattcagaaggcctgtcaggtgaagtcttcagcctcccacagcgcagggtcccagcatctccacgcgcgcccgtgggaggtgggtccggccggagaggcctcccgcggacgccgtctctccagaactccgcttccaagagggagcctttggctgctttctctccttaaacttagatcaaattttttggtttttaatcagttatcttgggaacttaacctggcccctcacctcttctgcaccccccgcccccgaaactgtctcgtaatgaatttctgctgtcctcctgggagtggacggccgggtcccgtcccccgggagcatcgctcggctcagcaccttggctcccagtgggggccccgtggagggcgcccgtagtgataagcacaccggcacgaacgtcaggtccattcctcgaagtcggagccctcactctgccctgtcctggggctggctgagggcgaacgccccacctcactttctagagccctgtctgtcctagctcctatctgaccttgtgtgtaaatacgtacatctgtttttaaagtggatgggcccctgagaactcagtgaaatgcagagttctccatgcacctaaagctcctttgtcgctctcatggctgtcagatcctggtccctccacactgggtgctggggagggaggaccctcggggctaccgcgcgcccccccatcccacagatcaggagccaaggagggagaacagggcagcctgtgggactctaggatgcttcagaagaagcgacggcaccgtcaaccctctgttttttaaaggtggttggagactgttaacactgagctcattgacttctagagattttatttttactggttgatctcttggtggttttcaacttcctgctggaaactagaggtggggcaccccccaccccccagcctcgcactgtgtccttggggagggcccgcccccatcctggccggtgtcactgtggcccggccacccctgagcgcccagctccctacctcctggacgtctctgagagtccaggcagagcagagggcagcgctcggccggtcatgctggctcccttggccttgcagcgagcccctggcccacgccgagcgagggatgcttctccctacagcatgtccactcccccggcatggccaggtggggcccctggggcaatggcagtggtagaacgctcaacttggttgcggtaccatcagcccacctgcatttggctttcgacttgcttgttctaagtcacagcgccctcatctttttagcaaggtaaaaaaaccaaaatgggtgttatctctgatatcttgaaaccagcgttctgaatagaggtaggttgagttttctaggggaaaacaaatggagaaaagaggcatgaagaaaagtaaaccgagaacataattaggcatcgggcctaagtgtcctggggagattggaggggacggcagcgttctgcatgatggaggcgctgccgggccccgggtctgtgggggccgtgctctcagggcgtgtgcgggacgccacctgtgcacacctgctcagagcacggctcctcgcaggggtgaaggggcagaccaacgaaaccagatgagaccaacgacaccatgcgagacacgcttgcagacactgttgttttggaaatgtgcttccctccatctgaaatctcatccctccacccgcccactcgggcagctgtgccgtgggcagggcatgcgctcccctggctgagcaccccagagattctcctgcaccttcctcatgccgcacgctgctcatccgtctccatgtgtgtttagatccatgccattcactgactcactaacacctgcaaaatctttaaggaaaaaagctgaagggtacgaccatgcacatatgtgacctggaaaatgcaaatttagatcttttatgatttaattattattgtttcccatagaagttccctccctttgaaattaatatataatgtataaattctgcactgagccatggcggagctgggcagcccctaggttagagtggagacggaggcccaggcgcaggggtcacacctcatctggtttccttcccatctcacagcttagcttgtgcttctcaacaccaagtctttaagagcaataaaaactacaccatgaatgtttgaattttttttttttgggggggggagggtggattttgcttttcatccagaaggaaaaggggaggagagctcctttacattttttaaattaaattcataaatcccagaacagtcttttttttttctttttcctttacaccctacttctgagcttaattcagttgatgttatgtccaatcggcnaggcaagtgagcatcgtgccagccggtggcagggggagcaatagcggat

SEQ ID NO: 372377 - DNA, 2710 bp, Homo sapiens
tctatgaaaccaacatacatggcgtttgcatcacagttggagtcagatgtgagcccggagggcaggtgtctggcttgtccagccggaagccctgagggcagctgttcccactggctctgctgaccttgtgccttggacggctgtcctcagcgaggggccgtgcacccgctcctgagcagcgccatgggcctgctggccttcctgaagacccagttcgtgctgcacctgctggtcggctttgtcttcgtggtgagtggtctggtcatcaacttcgtccagctgtgcacgctggcgctctggccggtcagcaagcagctctaccgccgcctcaactgccgcctcgcctactcactctggagccaactggtcatgctgctggagtggtggtcctgcacggagtgtacactgttcacggaccaggccacggtagagcgctttgggaaggagcacgcagtcatcatcctcaaccacaacttcgagatcgacttcctctgtgggtggaccatgtgtgagcgcttcggagtgctggggagctccaaggtcctcgctaagaaggagctgctctacgtgcccctcatcggctggacgtggtactttctggagattgtgttctgcaagcggaagtgggaggaggaccgggacaccgtggtcgaagggctgaggcgcctgtcggactaccccgagtacatgtggtttctcctgtactgcgaggggacgcgcttcacggagaccaagcaccgcgttagcatggaggtggcggctgctaaggggcttcctgtcctcaagtaccacctgctgccgcggaccaagggcttcaccaccgcagtcaagtgcctccgggggacagtcgcagctgtctatgatgtaaccctgaacttcagaggaaacaagaacccgtccctgctggggatcctctacgggaagaagtacgaggcggacatgtgcgtgaggagatttcctctggaagacatcccgctggatgaaaaggaagcagctcagtggcttcataaactgtaccaggagaaggacgcgctccaggagatatataatcagaagggcatgtttccaggggagcagtttaagcctgcccggaggccgtggaccctcctgaacttcctgtcctgggccaccattctcctgtctcccctcttcagttttgtcttgggcgtctttgccagcggatcacctctcctgatcctgactttcttggggtttgtgggagcagcttcctttggagttcgcagactgataggagtaactgagatagaaaaaggctccagctacggaaaccaagagtttaagaaaaaggaataattaatggctgtgactgaacacacgcggccctgacggtggtatccagttaactcaaaaccaacacacagagtgcaggaaaagacaattagaaactatttttcttattaactggtgactaatattaacaaaacttgagccaagagtaaagaattcagaaggcctgtcaggtgaagtcttcagcctcccacagcgcagggtcccagcatctccacgcgcgcccgtgggaggtgggtccggccggagaggcctcccgcggacgccgtctctccagaactccgcttccaagagggagcctttggctgctttctctccttaaacttagatcaaattttttggtttttaatcagttatcttgggaacttaacctggcccctcacctcttctgcaccccccgcccccgaaactgtctcgtaatgaatttctgctgtcctcctgggagtggacggccgggtcccgtcccccgggagcatcgctcggctcagcaccttggctcccagtgggggccccgtggagggcgcccgtagtgataagcacaccggcacgaacgtcaggtccattcctcgaagtcggagccctcactctgccctgtcctggggctggctgagggcgaacgccccacctcactttctagagccctgtctgtcctagctcctatctgaccttgtgtgtaaatacgtacatctgtttttaaagtggatgggcccctgagaactcagtgaaatgcagagttctccatgcacctaaagctcctttgtcgctctcatggctgtcagatcctggtccctccacactgggtgctggggagggaggaccctcggggctaccgcgcgcccccccatcccacagatcaggagccaaggagggagaacagggcagcctgtgggactctaggatgcttcagaagaagcgacggcaccgtcaaccctctgttttttaaaggtggttggagactgttaacactgagctcattgacttctagagattttatttttactggttgatctcttggtggttttcaacttcctgctggaaactagaggtggggcaccccccaccccccagcctcgcactgtgtccttggggagggcccgcccccatcctggccggtgtcactgtggcccggccacccctgagcgcccagctccctacctcctggacgtctctgagagtccaggcagagcagagggcagcgctcggccggtcatgctggctcccttggccttgcagcgagcccctggcccacgccgagcgagggatgcttctccctacagcatgtccactcccccggcatggccaggcgcaggggtcacacctcatctggtttccttcccatctcacagcttagcttgtgcttctcaacaccaagtctttaagagcaataaaaactacaccatga

SEQ ID NO: 372378 - DNA, 432 bp, Homo sapiens
gacagctatcttcatcactatctacagtactcaagaggtctcagctactgctcattctccatggctttgcaggtgcaggtggggctgcaggccagggaggaagcccccccaggacagggaagggctggggtgaagaggggcaccctgcacatgggtgagggaaggccaggcccttctgcagcttggcagacgcagacgtgtggctcccacgtgaacctgcggaccagtggctctcaccctccctgcttttgacatacttggcacttgcttgaagtaatttttgccttcgaagtagtgaccacatgtaaatgagctccaaattttcctggcaagcccaatttcacacatcactgtatttatgaaggcaggttaatggatctttaactaaatgtgatttaactttatgtttatataggactttataaacacact

SEQ ID NO: 372379 - DNA, 2039 bp, Homo sapiens
gtgcagggaagagacgcgtcagcgccagggccaggcccgcccgggggcagcccggcagccgaatcttgggctactctgtcccaacagccggagcagatcagaccgaccggccctgcccgctcggtcccgcgccctccagaccctacggtctccgtttctaggggcacatggttagcggcaggcgcccacagccaatccactttgccagcctgccccttcctctgccaagagcagcttcttcagccgcgctccagttccgcagacgcctgccccaccctgctcttcccttccagggaagacggatcacgcggccaagaacgagactcgcaaactgggcatttctccgagccgggctagagcaagtagcgagactccgcgtgagagtgggaaagagccttaacaggcaaccatgttgcccagtgggttttctgtgcctttgggtgcggaccaatgaggcgcgtggggcgggacttccgcttcgcctaggtgttgtcgtccctgctagtactccgggctgtgggggtcggtgcggatattcagtcatgaaatcagggtagggacttctcccgcagcgacgcggctggcaagactgtttgtgttgcgggggccggacttcaaggtgattttacaacgagatgctgctctccatagggatgctcatgctgtcagccacacaagtctacaccatcttgactgtccagctctttgcattcttaaacctactgcctgtagaagcagacattttagcatataactttgaaaatgcatctcagacatttgatgacctccctgcaagatttggttatagacttccagctgaaggtttaaagggttttttgattaactcaaaaccagagaatgcctgtgaacccatagtgcctccaccagtaaaagacaattcatctggcactttcatcgtgttaattagaagacttgattgtaattttgatataaaggttttaaatgcacagagagcaggatacaaggcagccatagttcacaatgttgattctgatgacctcattagcatgggatccaacgacattgaggtactaaagaaaattgacattccatctgtctttattggtgaatcatcagctaattctctgaaagatgaattcacatatgaaaaagggggccaccttatcttagttccagaatttagtcttcctttggaatactacctaattcccttccttatcatagtgggcatctgtctcatcttgatagtcattttcatgatcacaaaatttgtccaggatagacatagagctagaagaaacagacttcgtaaagatcaacttaagaaacttcctgtacataaattcaagaaaggagatgagtatgatgtatgtgccatttgtttggatgagtatgaagatggagacaaactcagaatccttccctgttcccatgcttatcattgcaagtgtgtagacccttggctaactaaaaccaaaaaaacctgtccagtgtgcaagcaaaaagttgttccttctcaaggcgattcagactctgacacagacagtagtcaagaagaaaatgaagtgacagaacatacccctttactgagacctttagcttctgtcagtgcccagtcatttggggctttatcggaatcccgctcacatcagaacatgacagaatcttcagactatgaggaagacgacaatgaagatactgacagtagtgatgcagaaaatgaaattaatgaacatgatgtcgtggtccagttgcagcctaatggtgaacgggattacaacatagcaaatactgtttgactttcagaagatgattggtttatttccctttaaaatgattaggtatatactgtaatttgattttttgctcccttcaaagatttctgtagaaataacttattttttagtattctacagtttaatcaaattactgaaacaggacttttgatctggtatttatctgccaagaatatacttcattcactaataatagactggtgctgtaactcaagcatcaattcagctcttcttttggaatgaaagtatagccaaaacata

SEQ ID NO: 372380 - DNA, 2905 bp, Homo sapiens
gtgcagggaagagacgcgtcagcgccagggccaggcccgcccgggggcagcccggcagccgaatcttgggctactctgtcccaacagccggagcagatcagaccgaccggccctgcccgctcggtcccgcgccctccagaccctacggtctccgtttctaggggcacatggttagcggcaggcgcccacagccaatccactttgccagcctgccccttcctctgccaagagcagcttcttcagccgcgctccagttccgcagacgcctgccccaccctgctcttcccttccagggaagacggatcacgcggccaagaacgagactcgcaaactgggcatttctccgagccgggctagagcaagtagcgagactccgcgtgagagtgggaaagagccttaacaggcaaccatgttgcccagtgggttttctgtgcctttgggtgcggaccaatgaggcgcgtggggcgggacttccgcttcgcctaggtgttgtcgtccctgctagtactccgggctgtgggggtcggtgcggatattcagtcatgaaatcagggtagggacttctcccgcagcgacgcggctggcaagactgtttgtgttgcgggggccggacttcaagagagaaagagagagtgggcagacatcgaagccaaacagcagtatcccggaagcactcatgcaactttggtggcggccactcagttttctctgccagtgtctggtgattttacaacgagatgctgctctccatagggatgctcatgctgtcagccacacaagtctacaccatcttgactgtccagctctttgcattcttaaacctactgcctgtagaagcagacattttagcatataactttgaaaatgcatctcagacatttgatgacctccctgcaagatttggttatagacttccagctgaaggtttaaagggttttttgattaactcaaaaccagagaatgcctgtgaacccatagtgcctccaccagtaaaagacaattcatctggcactttcatcgtgttaattagaagacttgattgtaattttgatataaaggttttaaatgcacagagagcaggatacaaggcagccatagttcacaatgttgattctgatgacctcattagcatgggatccaacgacattgaggtactaaagaaaattgacattccatctgtctttattggtgaatcatcagctaattctctgaaagatgaattcacatatgaaaaagggggccaccttatcttagttccagaatttagtcttcctttggaatactacctaattcccttccttatcatagtgggcatctgtctcatcttgatagtcattttcatgatcacaaaatttgtccaggatagacatagagctagaagaaacagacttcgtaaagatcaacttaagaaacttcctgtacataaattcaagaaaggagatgagtatgatgtatgtgccatttgtttggatgagtatgaagatggagacaaactcagaatccttccctgttcccatgcttatcattgcaagtgtgtagacccttggctaactaaaaccaaaaaaacctgtccagtgtgcaagcaaaaagttgttccttctcaaggcgattcagactctgacacagacagtagtcaagaagaaaatgaagtgacagaacatacccctttactgagacctttagcttctgtcagtgcccagtcatttggggctttatcggaatcccgctcacatcagaacatgacagaatcttcagactatgaggaagacgacaatgaagatactgacagtagtgatgcagaaaatgaaattaatgaacatgatgtcgtggtccagttgcagcctaatggtgaacgggattacaacatagcaaatactgtttgactttcagaagatgattggtttatttccctttaaaatgattaggtatatactgtaatttgattttttgctcccttcaaagatttctgtagaaataacttattttttagtattctacagtttaatcaaattactgaaacaggacttttgatctggtatttatctgccaagaatatacttcattcactaataatagactggtgctgtaactcaagcatcaattcagctcttcttttggaatgaaagtatagccaaaacataaaaaaaaaaaaatcctcagtatagcttgcaattaagacctagatcacagtatttaagtgttttgcgttttatacatgaggtcagtgctacagccacctagcatgaactaacccagcttccacctccataaagttacctagagttgttgagttggaatatgttctggcatttacctgacctgccaatcattagggagaggcaacaaggtaattcagcctttcctcctatcagcacaaagaaactcaaagctgttttttccctttctgttccaaagcagtcttatcctgacaggagcggtctatactagtgcagatttcaacacttttttttaacgttttaattactatagtgttatgtagagatttgattgagcagctaatgtttctgaactttacttactaattttcagtgtccttaagggttctgtagtgttatcaaagcaaaaagaaaatgctgcataaaaataccaaacttcagcaactgttaatactcagatcatatacctcttaataaatagcatcttatgctaattagccctgctaaactatgtacagaggaaactgttcaagtattggatttgaaagtaagtgacttatgtttaacagaactaatgatgtattgaaacactgtattatgaaaagctaaattatacatcattgtaactatgtagaaagtgtagactaatgtataatcaaaatgctaaggatttttatatggccttgtatgaggggagtttgaatgttaataaacatgttttccacttt

SEQ ID NO: 372381 - DNA, 2757 bp, Homo sapiens
gtgcagggaagagacgcgtcagcgccagggccaggcccgcccgggggcagcccggcagccgaatcttgggctactctgtcccaacagccggagcagatcagaccgaccggccctgcccgctcggtcccgcgccctccagaccctacggtctccgtttctaggggcacatggttagcggcaggcgcccacagccaatccactttgccagcctgccccttcctctgccaagagcagcttcttcagccgcgctccagttccgcagacgcctgccccaccctgctcttcccttccagggaagacggatcacgcggccaagaacgagactcgcaaactgggcatttctccgagccgggctagagcaagtagcgagactccgcgtgagagtgggaaagagccttaacaggcaaccatgttgcccagtgggttttctgtgcctttgggtgcggaccaatgaggcgcgtggggcgggacttccgcttcgcctaggtgttgtcgtccctgctagtactccgggctgtgggggtcggtgcggatattcagtcatgaaatcagggtagggacttctcccgcagcgacgcggctggcaagactgtttgtgttgcgggggccggacttcaaggtgattttacaacgagatgctgctctccatagggatgctcatgctgtcagccacacaagtctacaccatcttgactgtccagctctttgcattcttaaacctactgcctgtagaagcagacattttagcatataactttgaaaatgcatctcagacatttgatgacctccctgcaagatttggttatagacttccagctgaaggtttaaagggttttttgattaactcaaaaccagagaatgcctgtgaacccatagtgcctccaccagtaaaagacaattcatctggcactttcatcgtgttaattagaagacttgattgtaattttgatataaaggttttaaatgcacagagagcaggatacaaggcagccatagttcacaatgttgattctgatgacctcattagcatgggatccaacgacattgaggtactaaagaaaattgacattccatctgtctttattggtgaatcatcagctaattctctgaaagatgaattcacatatgaaaaaggtacctaattcccttccttatcatagtgggcatctgtctcatcttgatagtcattttcatgatcacaaaatttgtccaggatagacatagagctagaagaaacagacttcgtaaagatcaacttaagaaacttcctgtacataaattcaagaaaggagatgagtatgatgtatgtgccatttgtttggatgagtatgaagatggagacaaactcagaatccttccctgttcccatgcttatcattgcaagtgtgtagacccttggctaactaaaaccaaaaaaacctgtccagtgtgcaagcaaaaagttgttccttctcaaggcgattcagactctgacacagacagtagtcaagaagaaaatgaagtgacagaacatacccctttactgagacctttagcttctgtcagtgcccagtcatttggggctttatcggaatcccgctcacatcagaacatgacagaatcttcagactatgaggaagacgacaatgaagatactgacagtagtgatgcagaaaatgaaattaatgaacatgatgtcgtggtccagttgcagcctaatggtgaacgggattacaacatagcaaatactgtttgactttcagaagatgattggtttatttccctttaaaatgattaggtatatactgtaatttgattttttgctcccttcaaagatttctgtagaaataacttattttttagtattctacagtttaatcaaattactgaaacaggacttttgatctggtatttatctgccaagaatatacttcattcactaataatagactggtgctgtaactcaagcatcaattcagctcttcttttggaatgaaagtatagccaaaacataaaaaaaaaaaaatcctcagtatagcttgcaattaagacctagatcacagtatttaagtgttttgcgttttatacatgaggtcagtgctacagccacctagcatgaactaacccagcttccacctccataaagttacctagagttgttgagttggaatatgttctggcatttacctgacctgccaatcattagggagaggcaacaaggtaattcagcctttcctcctatcagcacaaagaaactcaaagctgttttttccctttctgttccaaagcagtcttatcctgacaggagcggtctatactagtgcagatttcaacacttttttttaacgttttaattactatagtgttatgtagagatttgattgagcagctaatgtttctgaactttacttactaattttcagtgtccttaagggttctgtagtgttatcaaagcaaaaagaaaatgctgcataaaaataccaaacttcagcaactgttaatactcagatcatatacctcttaataaatagcatcttatgctaattagccctgctaaactatgtacagaggaaactgttcaagtattggatttgaaagtaagtgacttatgtttaacagaactaatgatgtattgaaacactgtattatgaaaagctaaattatacatcattgtaactatgtagaaagtgtagactaatgtataatcaaaatgctaaggatttttatatggccttgtatgaggggagtttgaatgttaataaacatgttttccacttt

SEQ ID NO: 372382 - DNA, 2592 bp, Homo sapiens
gtgcagggaagagacgcgtcagcgccagggccaggcccgcccgggggcagcccggcagccgaatcttgggctactctgtcccaacagccggagcagatcagaccgaccggccctgcccgctcggtcccgcgccctccagaccctacggtctccgtttctaggggcacatggttagcggcaggcgcccacagccaatccactttgccagcctgccccttcctctgccaagagcagcttcttcagccgcgctccagttccgcagacgcctgccccaccctgctcttcccttccagggaagacggatcacgcggccaagaacgagactcgcaaactgggcatttctccgagccgggctagagcaagtagcgagactccgcgtgagagtgggaaagagccttaacaggcaaccatgttgcccagtgggttttctgtgcctttgggtgcggaccaatgaggcgcgtggggcgggacttccgcttcgcctaggtgttgtcgtccctgctagtactccgggctgtgggggtcggtgcggatattcagtcatgaaatcagggtagggacttctcccgcagcgacgcggctggcaagactgtttgtgttgcgggggccggacttcaagggttttttgattaactcaaaaccagagaatgcctgtgaacccatagtgcctccaccagtaaaagacaattcatctggcactttcatcgtgttaattagaagacttgattgtaattttgatataaaggttttaaatgcacagagagcaggatacaaggcagccatagttcacaatgttgattctgatgacctcattagcatgggatccaacgacattgaggtactaaagaaaattgacattccatctgtctttattggtgaatcatcagctaattctctgaaagatgaattcacatatgaaaaagggggccaccttatcttagttccagaatttagtcttcctttggaatactacctaattcccttccttatcatagtgggcatctgtctcatcttgatagtcattttcatgatcacaaaatttgtccaggatagacatagagctagaagaaacagacttcgtaaagatcaacttaagaaacttcctgtacataaattcaagaaaggagatgagtatgatgtatgtgccatttgtttggatgagtatgaagatggagacaaactcagaatccttccctgttcccatgcttatcattgcaagtgtgtagacccttggctaactaaaaccaaaaaaacctgtccagtgtgcaagcaaaaagttgttccttctcaaggcgattcagactctgacacagacagtagtcaagaagaaaatgaagtgacagaacatacccctttactgagacctttagcttctgtcagtgcccagtcatttggggctttatcggaatcccgctcacatcagaacatgacagaatcttcagactatgaggaagacgacaatgaagatactgacagtagtgatgcagaaaatgaaattaatgaacatgatgtcgtggtccagttgcagcctaatggtgaacgggattacaacatagcaaatactgtttgactttcagaagatgattggtttatttccctttaaaatgattaggtatatactgtaatttgattttttgctcccttcaaagatttctgtagaaataacttattttttagtattctacagtttaatcaaattactgaaacaggacttttgatctggtatttatctgccaagaatatacttcattcactaataatagactggtgctgtaactcaagcatcaattcagctcttcttttggaatgaaagtatagccaaaacataaaaaaaaaaaaatcctcagtatagcttgcaattaagacctagatcacagtatttaagtgttttgcgttttatacatgaggtcagtgctacagccacctagcatgaactaacccagcttccacctccataaagttacctagagttgttgagttggaatatgttctggcatttacctgacctgccaatcattagggagaggcaacaaggtaattcagcctttcctcctatcagcacaaagaaactcaaagctgttttttccctttctgttccaaagcagtcttatcctgacaggagcggtctatactagtgcagatttcaacacttttttttaacgttttaattactatagtgttatgtagagatttgattgagcagctaatgtttctgaactttacttactaattttcagtgtccttaagggttctgtagtgttatcaaagcaaaaagaaaatgctgcataaaaataccaaacttcagcaactgttaatactcagatcatatacctcttaataaatagcatcttatgctaattagccctgctaaactatgtacagaggaaactgttcaagtattggatttgaaagtaagtgacttatgtttaacagaactaatgatgtattgaaacactgtattatgaaaagctaaattatacatcattgtaactatgtagaaagtgtagactaatgtataatcaaaatgctaaggatttttatatggccttgtatgaggggagtttgaatgttaataaacatgttttccacttt

SEQ ID NO: 372383 - DNA, 1702 bp, Homo sapiens
gtggtacggcccggaagttaagggatgaaaaagggggccaccttatcttagttccagaatttagtcttcctttggaatactacctaattcccttccttatcatagtgggcatctgtctcatcttgatagtcattttcatgatcacaaaatttgtccaggatagacatagagctagaagaaacagacttcgtaaagatcaacttaagaaacttcctgtacataaattcaagaaaggagatgagtatgatgtatgtgccatttgtttggatgagtatgaagatggagacaaactcagaatccttccctgttcccatgcttatcattgcaagtgtgtagacccttggctaactaaaaccaaaaaaacctgtccagtgtgcaagcaaaaagttgttccttctcaaggcgattcagactctgacacagacagtagtcaagaagaaaatgaagtgacagaacatacccctttactgagacctttagcttctgtcagtgcccagtcatttggggctttatcggaatcccgctcacatcagaacatgacagaatcttcagactatgaggaagacgacaatgaagatactgacagtagtgatgcagaaaatgaaattaatgaacatgatgtcgtggtccagttgcagcctaatggtgaacgggattacaacatagcaaatactgtttgactttcagaagatgattggtttatttccctttaaaatgattaggtatatactgtaatttgattttttgctcccttcaaagatttctgtagaaataacttattttttagtattctacagtttaatcaaattactgaaacaggacttttgatctggtatttatctgccaagaatatacttcattcactaataatagactggtgctgtaactcaagcatcaattcagctcttcttttggaatgaaagtatagccaaaacataaaaaaaaaaaaatcctcagtatagcttgcaattaagacctagatcacagtatttaagtgttttgcgttttatacatgaggtcagtgctacagccacctagcatgaactaacccagcttccacctccataaagttacctagagttgttgagttggaatatgttctggcatttacctgacctgccaatcattagggagaggcaacaaggtaattcagcctttcctcctatcagcacaaagaaactcaaagctgttttttccctttctgttccaaagcagtcttatcctgacaggagcggtctatactagtgcagatttcaacacttttttttaacgttttaattactatagtgttatgtagagatttgattgagcagctaatgtttctgaactttacttactaattttcagtgtccttaagggttctgtagtgttatcaaagcaaaaagaaaatgctgcataaaaataccaaacttcagcaactgttaatactcagatcatatacctcttaataaatagcatcttatgctaattagccctgctaaactatgtacagaggaaactgttcaagtattggatttgaaagtaagtgacttatgtttaacagaactaatgatgtattgaaacactgtattatgaaaagctaaattatacatcattgtaactatgtagaaagtgtagactaatgtataatcaaaatgctaaggatttttatatggccttgtatgaggggagtttgaatgttaataaacatgttttccacttt

SEQ ID NO: 372384 - DNA, 1139 bp, Homo sapiens
aattcatggctttggcgcttcctggtgtgaaaactaaggacaattaatgaacatgatgtcgtggtccagttgcagcctaatggtgaacgggattacaacatagcaaatactgtttgactttcagaagatgattggtttatttccctttaaaatgattaggtatatactgtaatttgattttttgctcccttcaaagatttctgtagaaataacttattttttagtattctacagtttaatcaaattactgaaacaggacttttgatctggtatttatctgccaagaatatacttcattcactaataatagactggtgctgtaactcaagcatcaattcagctcttcttttggaatgaaagtatagccaaaacataaaaaaaaaaaaatcctcagtatagcttgcaattaagacctagatcacagtatttaagtgttttgcgttttatacatgaggtcagtgctacagccacctagcatgaactaacccagcttccacctccataaagttacctagagttgttgagttggaatatgttctggcatttacctgacctgccaatcattagggagaggcaacaaggtaattcagcctttcctcctatcagcacaaagaaactcaaagctgttttttccctttctgttccaaagcagtcttatcctgacaggagcggtctatactagtgcagatttcaacacttttttttaacgttttaattactatagtgttatgtagagatttgattgagcagctaatgtttctgaactttacttactaattttcagtgtccttaagggttctgtagtgttatcaaagcaaaaagaaaatgctgcataaaaataccaaacttcagcaactgttaatactcagatcatatacctcttaataaatagcatcttatgctaattagccctgctaaactatgtacagaggaaactgttcaagtattggatttgaaagtaagtgacttatgtttaacagaactaatgatgtattgaaacactgtattatgaaaagctaaattatacatcattgtaactatgtagaaagtgtagactaatgtataatcaaaatgctaaggatttttatatggccttgtatgaggggagtttgaatgttaataaacatgttttccacttt

SEQ ID NO: 372385 - DNA, 297 bp, Homo sapiens
ctttcttcccgtccctacatgatacatacagaacactgaataaatatggcaagagattaaatataaaagtatcaaccgcagcatactaactaaagatgtatattttgcttcaacagcttatcattgcaagtgtgtagacccttggctaactaaaaccaaaaaaacctgtccagtgtgcaagcaaaaagttgttccttctcaaggcgattcagactctgacacagacagtagtcaagaagaaaatgaagtgacagaacatacccctttactgagacctttagcttctgtcagtgccca

SEQ ID NO: 372386 - DNA, 647 bp, Homo sapiens
cttcgcctaggtgttgtcgtccctgctagtactccgggctgtgggggtcggtgcggatattcagtcatgaaatcagggtagggacttctcccgcagcgacgcggctggcaagactgtttgtgttgcgggggccggacttcaaggtaagaccctgtccggcttcgcggcagccgggcagctcgttatcgagcggcccagagaacataccccgcttgttggccctcgagctcggagtcggccctgctgctgaggtctttgctgctcctctagagctgggtgagaagtcaattaggctttttgcaaaaggaataaaatagccttgccctcgggggaccgagtctcccctgcactctcattccgcgagtttgtgtgtgtccaaagttgagttaccggttttgcttctctcattcccttcttgaggctgcaagagcctgcctggaaaacatgtttggaaggcttttcttggtcaagtacctgccgcaacgtcctcgggcacatcgcttgactttagttgagggggctgttttgtctctgaatagaaggagggcagtcacttcctctcttttacccccaccccctttttctttccctggaagctcagattgcaggtttgggacttaacccctgctagggccagatactacggt

SEQ ID NO: 372387 - DNA, 2803 bp, Homo sapiens
gtgcagggaagagacgcgtcagcgccagggccaggcccgcccgggggcagcccggcagccgaatcttgggctactctgtcccaacagccggagcagatcagaccgaccggccctgcccgctcggtcccgcgccctccagaccctacggtctccgtttctaggggcacatggttagcggcaggcgcccacagccaatccactttgccagcctgccccttcctctgccaagagcagcttcttcagccgcgctccagttccgcagacgcctgccccaccctgctcttcccttccagggaagacggatcacgcggccaagaacgagactcgcaaactgggcatttctccgagccgggctagagcaagtagcgagactccgcgtgagagtgggaaagagccttaacaggcaaccatgttgcccagtgggttttctgtgcctttgggtgcggaccaatgaggcgcgtggggcgggacttccgcttcgcctaggtgttgtcgtccctgctagtactccgggctgtgggggtcggtgcggatattcagtcatgaaatcagggtagggacttctcccgcagcgacgcggctggcaagactgtttgtgttgcgggggccggacttcaaggtgattttacaacgagatgctgctctccatagggatgctcatgctgtcagccacacaagtctacaccatcttgactgtccagctctttgcattcttaaacctactgcctgtagaagcagacattttagcatataactttgaaaatgcatctcagacatttgatgacctccctgcaagatttggttatagacttccagctgaaggtttaaagggttttttgattaactcaaaaccagagaatgcctgtgaacccatagtgcctccaccagtaaaagacaattcatctggcactttcatcgtgttaattagaagacttgattgtaattttgatataaaggttttaaatgcacagagagcaggatacaaggcagccatagttcacaatgttgattctgatgacctcattagcatgggatccaacgacattgaggtactaaagaaaattgacattccatctgtctttattggtgaatcatcagctaattctctgaaagatgaattcacatatgaaaaagggggccaccttatcttagttccagaatttagtcttcctttggaatactacctaattcccttccttatcatagtgggcatctgtctcatcttgatagtcattttcatgatcacaaaatttgtccaggatagacatagagctagaagaaacagacttcgtaaagatcaacttaagaaacttcctgtacataaattcaagaaaggagatgagtatgatgtatgtgccatttgtttggatgagtatgaagatggagacaaactcagaatccttccctgttcccatgcttatcattgcaagtgtgtagacccttggctaactaaaaccaaaaaaacctgtccagtgtgcaagcaaaaagttgttccttctcaaggcgattcagactctgacacagacagtagtcaagaagaaaatgaagtgacagaacatacccctttactgagacctttagcttctgtcagtgcccagtcatttggggctttatcggaatcccgctcacatcagaacatgacagaatcttcagactatgaggaagacgacaatgaagatactgacagtagtgatgcagaaaatgaaattaatgaacatgatgtcgtggtccagttgcagcctaatggtgaacgggattacaacatagcaaatactgtttgactttcagaagatgattggtttatttccctttaaaatgattaggtatatactgtaatttgattttttgctcccttcaaagatttctgtagaaataacttattttttagtattctacagtttaatcaaattactgaaacaggacttttgatctggtatttatctgccaagaatatacttcattcactaataatagactggtgctgtaactcaagcatcaattcagctcttcttttggaatgaaagtatagccaaaacataaaaaaaaaaaaatcctcagtatagcttgcaattaagacctagatcacagtatttaagtgttttgcgttttatacatgaggtcagtgctacagccacctagcatgaactaacccagcttccacctccataaagttacctagagttgttgagttggaatatgttctggcatttacctgacctgccaatcattagggagaggcaacaaggtaattcagcctttcctcctatcagcacaaagaaactcaaagctgttttttccctttctgttccaaagcagtcttatcctgacaggagcggtctatactagtgcagatttcaacacttttttttaacgttttaattactatagtgttatgtagagatttgattgagcagctaatgtttctgaactttacttactaattttcagtgtccttaagggttctgtagtgttatcaaagcaaaaagaaaatgctgcataaaaataccaaacttcagcaactgttaatactcagatcatatacctcttaataaatagcatcttatgctaattagccctgctaaactatgtacagaggaaactgttcaagtattggatttgaaagtaagtgacttatgtttaacagaactaatgatgtattgaaacactgtattatgaaaagctaaattatacatcattgtaactatgtagaaagtgtagactaatgtataatcaaaatgctaaggatttttatatggccttgtatgaggggagtttgaatgttaataaacatgttttccacttt

SEQ ID NO: 372388 - DNA, 2775 bp, Homo sapiens
  misc_feature (2774)..(2775): n is a, c, g, or t
gtgcagggaagagacgcgtcagcgccagggccaggcccgcccgggggcagcccggcagccgaatcttgggctactctgtcccaacagccggagcagatcagaccgaccggccctgcccgctcggtcccgcgccctccagaccctacggtctccgtttctaggggcacatggttagcggcaggcgcccacagccaatccactttgccagcctgccccttcctctgccaagagcagcttcttcagccgcgctccagttccgcagacgcctgccccaccctgctcttcccttccagggaagacggatcacgcggccaagaacgagactcgcaaactgggcatttctccgagccgggctagagcaagtagcgagactccgcgtgagagtgggaaagagccttaacaggcaaccatgttgcccagtgggttttctgtgcctttgggtgcggaccaatgaggcgcgtggggcgggacttccgcttcgcctaggtgttgtcgtccctgctagtactccgggctgtgggggtcggtgcggatattcagtcatgaaatcagggtagggacttctcccgcagcgacgcggctggcaagactgtttgtgttgcgggggccggacttcaaggtgattttacaacgagatgctgctctccatagggatgctcatgctgtcagccacacaagtctacaccatcttgactgtccagctctttgcattcttaaacctactgcctgtagaagcagacattttagcatataactttgaaaatgcatctcagacatttgatgacctccctgcaagatttggttatagacttccagctgaaggtttaaagggttttttgattaactcaaaaccagagaatgcctgtgaacccatagtgcctccaccagtaaaagacaattcatctggcactttcatcgtgttaattagaagacttgattgtaattttgatataaaggttttaaatgcacagagagcaggatacaaggcagccatagttcacaatgttgattctgatgacctcattagcatgggatccaacgacattgaggtactaaagaaaattgacattccatctgtctttattggtgaatcatcagctaattctctgaaagatgaattcacatatgaaaaagggggccaccttatcttagttccagaatttagtcttcctttggaatactacctaattcccttccttatcatagtgggcatctgtctcatcttgatagtcattttcatgatcacaaaatttgtccaggatagacatagagctagaagaaacagacttcgtaaagatcaacttaagaaacttcctgtacataaattcaagaaaggagatgagtatgatgtatgtgccatttgtttggatgagtatgaagatggagacaaactcagaatccttccctgttcccatgcttatcattgcaagtgtgtagacccttggctaactaaaaccaaaaaaacctgtccagtgtgcaagcaaaaagttgttccttctcaaggcgattcagactctgacacagacagtagtcaagaagaaaatgaagtgacagaacatacccctttactgagacctttagcttctgtcagtgcccagtcatttggggctttatcggaatcccgctcacatcagaacatgacagaatcttcagactatgaggaagacgacaatgaagatactgacagtagtgatgcagaaaatgaaattaatgaacatgatgtcgtggtccagttgcagcctaatggtgaacgggattacaacatagcaaatactgtttgactttcagaagatgattggtttatttccctttaaaatgattaggtatatactgtaatttgattttttgctcccttcaaagatttctgtagaaataacttattttttagtattctacagtttaatcaaattactgaaacaggacttttgatctggtatttatctgccaagaatatacttcattcactaataatagactggtgctgtaactcaagcatcaattcagctcttcttttggaatgaaagtatagccaaaacataaaaaaaaaaaaatcctcagtatagcttgcaattaagacctagatcacagtatttaagtgttttgcgttttatacatgaggtcagtgctacagccacctagcatgaactaacccagcttccacctccataaagttacctagagttgttgagttggaatatgttctggcatttacctgacctgccaatcattagggagaggcaacaaggtaattcagcctttcctcctatcagcacaaagaaactcaaagctgttttttccctttctgttccaaagcagtcttatcctgacaggagcggtctatactagtgcagatttcaacacttttttttaacgttttaattactatagtgttatgtagagatttgattgagcagctaatgtttctgaactttacttactaattttcagtgtccttaagggttctgtagtgttatcaaagcaaaaagaaaatgctgcataaaaataccaaacttcagcaactgttaatactcagatcatatacctcttaataaatagcatcttatgctaattagccctgctaaactatgtacagaggaaactgttcaagtattggatttgaaagtaagtgacttatgtttaacagaactaatgatgtattgaaacactgtattatgaaaagctaaattatacatcattgtaactatgtagagtgtagactataatgtataatccaaatgctaacgacacccggaaataagggggatgctcgacann

SEQ ID NO: 372389 - DNA, 2734 bp, Homo sapiens
gtgcagggaagagacgcgtcagcgccagggccaggcccgcccgggggcagcccggcagccgaatcttgggctactctgtcccaacagccggagcagatcagaccgaccggccctgcccgctcggtcccgcgccctccagaccctacggtctccgtttctaggggcacatggttagcggcaggcgcccacagccaatccactttgccagcctgccccttcctctgccaagagcagcttcttcagccgcgctccagttccgcagacgcctgccccaccctgctcttcccttccagggaagacggatcacgcggccaagaacgagactcgcaaactgggcatttctccgagccgggctagagcaagtagcgagactccgcgtgagagtgggaaagagccttaacaggcaaccatgttgcccagtgggttttctgtgcctttgggtgcggaccaatgaggcgcgtggggcgggacttccgcttcgcctaggtgttgtcgtccctgctagtactccgggctgtgggggtcggtgcggatattcagtcatgaaatcagggtagggacttctcccgcagcgacgcggctggcaagactgtttgtgttgcgggggccggacttcaaggtgattttacaacgagatgctgctctccatagggatgctcatgctgtcagccacacaagtctacaccatcttgactgtccagctctttgcattcttaaacctactgcctgtagaagcagacattttagcatataactttgaaaatgcatctcagacatttgatgacctccctgcaagatttggttatagacttccagctgaaggtttaaagggttttttgattaactcaaaaccagagaatgcctgtgaacccatagtgcctccaccagttttaaatgcacagagagcaggatacaaggcagccatagttcacaatgttgattctgatgacctcattagcatgggatccaacgacattgaggtactaaagaaaattgacattccatctgtctttattggtgaatcatcagctaattctctgaaagatgaattcacatatgaaaaagggggccaccttatcttagttccagaatttagtcttcctttggaatactacctaattcccttccttatcatagtgggcatctgtctcatcttgatagtcattttcatgatcacaaaatttgtccaggatagacatagagctagaagaaacagacttcgtaaagatcaacttaagaaacttcctgtacataaattcaagaaaggagatgagtatgatgtatgtgccatttgtttggatgagtatgaagatggagacaaactcagaatccttccctgttcccatgcttatcattgcaagtgtgtagacccttggctaactaaaaccaaaaaaacctgtccagtgtgcaagcaaaaagttgttccttctcaaggcgattcagactctgacacagacagtagtcaagaagaaaatgaagtgacagaacatacccctttactgagacctttagcttctgtcagtgcccagtcatttggggctttatcggaatcccgctcacatcagaacatgacagaatcttcagactatgaggaagacgacaatgaagatactgacagtagtgatgcagaaaatgaaattaatgaacatgatgtcgtggtccagttgcagcctaatggtgaacgggattacaacatagcaaatactgtttgactttcagaagatgattggtttatttccctttaaaatgattaggtatatactgtaatttgattttttgctcccttcaaagatttctgtagaaataacttattttttagtattctacagtttaatcaaattactgaaacaggacttttgatctggtatttatctgccaagaatatacttcattcactaataatagactggtgctgtaactcaagcatcaattcagctcttcttttggaatgaaagtatagccaaaacataaaaaaaaaaaaatcctcagtatagcttgcaattaagacctagatcacagtatttaagtgttttgcgttttatacatgaggtcagtgctacagccacctagcatgaactaacccagcttccacctccataaagttacctagagttgttgagttggaatatgttctggcatttacctgacctgccaatcattagggagaggcaacaaggtaattcagcctttcctcctatcagcacaaagaaactcaaagctgttttttccctttctgttccaaagcagtcttatcctgacaggagcggtctatactagtgcagatttcaacacttttttttaacgttttaattactatagtgttatgtagagatttgattgagcagctaatgtttctgaactttacttactaattttcagtgtccttaagggttctgtagtgttatcaaagcaaaaagaaaatgctgcataaaaataccaaacttcagcaactgttaatactcagatcatatacctcttaataaatagcatcttatgctaattagccctgctaaactatgtacagaggaaactgttcaagtattggatttgaaagtaagtgacttatgtttaacagaactaatgatgtattgaaacactgtattatgaaaagctaaattatacatcattgtaactatgtagaaagtgtagactaatgtataatcaaaatgctaaggatttttatatggccttgtatgaggggagtttgaatgttaataaacatgttttccacttt

SEQ ID NO: 372390 - DNA, 1267 bp, Homo sapiens
gtgcagggaagagacgcgtcagcgccagggccaggcccgcccgggggcagcccggcagccgaatcttgggctactctgtcccaacagccggagcagatcagaccgaccggccctgcccgctcggtcccgcgccctccagaccctacggtctccgtttctaggggcacatggttagcggcaggcgcccacagccaatccactttgccagcctgccccttcctctgccaagagcagcttcttcagccgcgctccagttccgcagacgcctgccccaccctgctcttcccttccagggaagacggatcacgcggccaagaacgagactcgcaaactgggcatttctccgagccgggctagagcaagtagcgagactccgcgtgagagtgggaaagagccttaacaggcaaccatgttgcccagtgggttttctgtgcctttgggtgcggaccaatgaggcgcgtggggcgggacttccgcttcgcctaggtgttgtcgtccctgctagtactccgggctgtgggggtcggtgcggatattcagtcatgaaatcagggtagggacttctcccgcagcgacgcggctggcaagactgtttgtgttgcgggggccggacttcaagagagaaagagagagtgggcagacatcgaagccaaacagcagtatcccggaagcactcatgcaactttggtggcggccactcagttttctctgccagtgtctggtaaattcctctattttgtcctaatctgacaatagtaaatagtaaatttccaaaactgtcgtttcatcatcagtttcagcaccgtgggcagctgctcgggtcctctcttgttgccccaaacctgcccggctattactgttcgtcagtgatgcagcagaaacagtgaaaactgatgcattcctttcaacaatgatgtgtttgttctccaaggagaacatctgcagtttttgatacaatataaataagtaaggtggctgtgcctccaaagagttcttctggagaaacagatcaattcaagatttaaggtagggctttcaagagtttatgctatttaagcacagttttttaatgggtggacattagctccatctcgaagtaacaaaactggacagtgatagcaattaaaaagaactttaaacaggaggtaagaagtgtagtgcagtgctgtagtgcaggaagtgtagtgcagtgctgtagtgcagggcccataaggattcattaatagattttagaatcaatttagtacattgacataagctttataaa

SEQ ID NO: 372391 - DNA, 544 bp, Homo sapiens
gtcatagcctgctgtgaagaaataaactaggtaggggtcagtatatggaggctatcagcctattgatataccagtgctaaagagtcttttacttatatgacttcgggaattttcaagaaagataattttattgcagaaatataactggaattctccaaatggaatgaactgttttgacagtattatagaagtggttaaagagagattgcattaaatgtaatacaaaaccggtttgaggtcactcttgttgccatatttaatttgtatcatagcttagggttttaagccaaccaatctatctgtaatgaacagtaagcataaatatataaacacaatttgaatacttaagtggtattaaaaaaaccttaaaactgtattttgagtcaaaaattcagcagtagcagttcctagttctgtataaatacagaactgcatgtgtatatgtacctgtatacgtgtgtgtgtggtgaatttttataaaagttgaccaaatttattggaacatttgattgtaatatcacctgtttgaataaaatctaaaagc

SEQ ID NO: 372392 - DNA, 2841 bp, Homo sapiens
aggtcacaggcctttccagtgccgctactgtccctacagtgcctctcagaaggggaacctgaagacccatgtcctctgcgtccatcgcatgccttttgacaacagccagtatcccgaccgcaggttcaagcgctccagggtcgactcagaggcttctgggaatttcgaggagcctacagctgtcaaggcggggagctctgcagacctcacggaagagggcggcaagggccaggaggagaccaactgagcagaccaacctgtatattgcaatagtattttacacagttttaacattatgcatctggtaaaagtttgctaactgcattccaaggggaaaaaatcatgtacaaccccccaatagtgtatagaacatttaaaaaattttaaaagatatctatatatatattaaaaaaaaaaaattccccagcccttgaaaatggctgctaaactgttacccggcaacaagtacttccaaaacaatgcaggtgggagaaaagtgatttcaaaaattcttggtgccctctgagctggagagagctgggggcccttccaactcgaaagtcgtctttgtccaaaaataatgctcttaactgaaaaacgataccatctaaacgatttagtgttgcgttgaagatggaggggctgtgttttcgttgttgaaaacacctctataatctgacaccagctgctgtaattcgcctagaaccctaatgagatgtgtcgggaggcagctgcggtgccagttcagactggagcggtcactgcagagaaaatcaattcacgtggtgttgtaactgcactcttggagaaaccttagacggcccgcagccagcgccggggctgaccggcactgcagaggattgagatcttaaatgcgcatttttacaaaatacacagccaaatgaaatcaatgatcaggaagtgtctgcagacaaatgtccattgcaggtttgatgagtaattcctttttttagatcaaattgttctcggtagccttttcttcttttttaaaaaaaaattttggatgaagaaggaagttgctattaaaaaaaagtagggtacattatataaaatgttgttagaaaaactagctaaccccatccatagaagatgctggtgagcaattaaaatttaggtaataatagaaagatttttttactatgatttttaaaattttacttgaatgaaggctgctccggtccttattatcggattttttttcatgtgttggtttttataagtgtcacagacatgaagcaagattttcttctccagcaagctcttatgaaatagcttgtattaaaatatgaatctaaacatcgtgctctctatctctaatgacgaaaactgtttgagttaaaaatgtctgtttttgtaaaacaaatgtgttctatatttttgtagattttagattttctactgattggatactccaaatttatcaagttctgcaccacacagaaggagattttgagtgtcaataatgaaacacttaactcattaaaaaaatgatttaagaagactagttaaaggtttattcttgaatctgctagcatggtgtaaagttgagccttttaacatacttcctttgagtgacatgaaattggtgctgttgcttgtggtggtagagaagtatgaaagtattaacttcttctaaaacaaaatcattcagacttaaaaaaaaaaaaaaggtcaatatttccttgcaggctgggagcacagattaaaccccagggccttaaaaacttcagctctgcctacagcagtttacaaaaatactaaactgcaatcaatgtaaataaaattcttagtgctatcctgagacccagaaagaatctcaggcctaataaggaatccggtttgcatatgctgtcaaaagggtgtcatcctaaccgaggtttcagtgtaaatgaggtcgctgtgcaacttggacccatctggcatagagcaagctgctttccttgtttttcctagtatagttcctcactgccttacttaaatcgagttgataaacttaatgcaactgtttctatgatcctagagaaaggactgaaatgttattgaaaactttccgactgtagtaagctttaggattttgactgcactactgtgtttggtgactgtgccagtcccttgctttctgtgtttgctctgcctttggtatcttagcaaagaaaaataaaaaaagaaaaaaaaacataaaaaaaaaagaaaaaagaaaaaaaagaggaaaaaaaagtgggggaaaaaatgagagccacattccatttctagcactttgggagctctttcagtatttttttgtgtcttttcagcatcctcagatgcgacaggcaataattctgtttgtgacactgggaacatcccctcttctttgtggtgtgtgttgattccattttgtccagtgctgctgtccttcctccccctctgacacaggccttctttccagaacatttgtaacttgtaatacaaacaagtgacagccacagtgatgcagcgtcagtttctgaatgtcatcaggttctcatatctaaacatgtcaagttttttccctgtaacttctgtagtctgtgatgctggtcataatactgtctacattcctacgcaaagaaaaaaaaatctatcttggaggaaatctgagatcaataggagtagaggattttgttgctatgcttgtaacaagtagaaaactttgtatttaaagtttattcttggtcattatttattattataatacatcagttgacagaactttattctggtatagaaagtattaaaagttgttttttcagcaatgactgttttctttctgctgttagaataaaatgtctttgaagcagc

SEQ ID NO: 372393 - DNA, 757 bp, Homo sapiens
attaccattctaatgtttctaatggctttcagagctgtcagcatgaaatacaagtaattcctccaggtagactgactggatgagatagaaaaatggagggcttgaggagattcgggtgtgtttgatgtttcctatcatttcatcacttcccagggaactggggctttagagagtgaatagagtattgtttgccatattggtagcacatggaatttggattccatgatttatttctttggatctcaattgataacatcatcacagcctggcgcagaggctcacgcctgtaatcccagcactttgggaggccgaggcggttggatcatttgaggtcaggtgttcgagaccagcctgaccaacatggtgaaaccccgtctctactaaaaatacagaaaaagtagcccggcgtgctggtgcatgcctgtagtcccagctactcgggaggctgaggcaggagaatcgcttgaacccgggaggcggtggttgcagtgagtttagatcaaaccactgcactccagcctgggtgacagactctcaaaacaaaaaaacaaaaaaacaaaaaaaccaaccataatcacagagaagtgagagtgattaaaaggagcacttattggggtttattctccaattctccattcttatttgggctatctacaagccatctgaatttacttcttcaaagctttcgaaaggtgatccgcctcattatatttttacccttttcctatgttgatgactcaggatttaaatacagtgt

SEQ ID NO: 372394 - DNA, 2228 bp, Homo sapiens
tgtttaatcaaaggaagagtcaaaataagctacacccagattactgagaaaggtgaaatgaaaacaagctcaaaaccaaattccaggaagatgctgtctttgtattgacttaccatttcatgttttcacacatgtcaaagtcttgaagcttcggtcattagtcttccgcttcctaaagcaagaaactaaatgctgacttgtgtcgtttgccccagatgccaccggaaatgtcatcttctccccagacgctggcttgcaagcacagcagcacccagaggctaacctatttcccctatagcccaagctctgagatctcccgtctggtcacaatgatctacaggagaggaagaaagctatctagggacgagatctagaatcaactgagagagatgcttaaaaatcaccagttactttaatgacaagaaactagaatgtgtttaatgctaaaaagaaggatccaggccaaggagggtaaagaaaatgcagaatgcaaattatcccctcactgggggatatccgggagcgaagtccctgagctgctgaggaagctttacgcctaaggagccatccgcagagccatcctgtgcaaaggaaggagctaggctgtgcgccctgggcgtcatgatccttctgcgggcctccgaagtgcggcagctgcttcacaataagttcgtggtcatcctgggggactctgtgcatagggcagtatacaaggacctggtgcttctgctgcagaaggaccgcctgctcactcccgggcagcttagagcaaggggggagctgaacttcgaacaagatgagctggtggacggaggccagcggggccacatgcacaacggccttaactaccgtgaggtccgcgagttccgctccgaccaccatctggtacgtttttacttcctcacccgcgtgtactccgattacctccagaccatcttgaaagagctgcagtcgggcgagcacgcccccgacctggtcatcatgaattcctgcctctgggacatctccaggtatggtccgaactcctggagaagctacctggagaacctggagaacctgttccagtgcctgggccaggtgctgcccgagtcttgcctcctggtgtggaacacggccatgcctgtgggcgaggaagtcaccgggggttttcttccgcccaagctccggcggcagaaggccaccttcctgaaaaacgaagtggtcaaagccaacttccacagcgccaccgaggcacgtaaacataacttcgatgtactggacttgcatttccacttccgccacgcgagggagaacctgcactgggacggggtgcactggaatggacgtgtgcaccgctgcctctcccagctgctgctggcccacgtggccgacgcctggggtgtggagctgccccaccgccaccccgtgggcgagtggatcaagaagaaaaaacctggcccgagagtcgaagggccgccccaggccaacagaaatcacccggccttacctctgtccccacccttaccttcccccacataccgccccctgcttgggttcccaccccagcgcttgccgctgctcccgctcctgtccccacagcctcctcctcccattctccatcaccagggaatgccccggttcccacagggtcccccagatgcctgtttttcctcagaccatactttccagtcggatcaattctattgccattcagatgtcccctcatcagcccatgcaggtttcttcgtcgaagacaattttatggttggtcctcagctgcctatgcccttcttccccacaccccgttatcagcggcctgccccagtggtacataggggttttggcaggtatcgtccccgtggcccctatacgccctggggacagcggcctcgaccttcaaagagaagggccccagccaatcctgagccaaggcctcaatagacggacctaggccttatttcctctttatgaacatggattggacagatctgacacttcctttccattgcttggcctgaacagactgaccttgttaacttaagcctggagtccatgcctcgtcttccttttgttcattgctgttaccaagaaagccaaggaagagcagcctgactcattcttcttggctgcagcctcttccccacttcctgggagtgacccagcgttattcctgcctcctcactcctattctctttgcctttgtgtaaaaataaaatggaaataaacaagttgcacagaaaaaaaaaagg

SEQ ID NO: 372395 - DNA, 1836 bp, Homo sapiens
caaagatgtttcctttctttttcaaagcaagaaactagaatgtgtttaatgctaaaaagaaggatccaggccaaggagggtaaagaaaatgcagaatgcaaattatcccctcactgggggatatccgggagcgaagtccctgagctgctgaggaagctttacgcctaaggagccatccgcagagccatcctgtgcaaaggaaggagctaggctgtgcgccctgggcgtcatgatccttctgcgggcctccgaagtgcggcagctgcttcacaataagttcgtggtcatcctgggggactctgtgcatagggcagtatacaaggacctggtgcttctgctgcagaaggaccgcctgctcactcccgggcagcttagagcaaggggggagctgaacttcgaacaagatgagctggtggacggaggccagcggggccacatgcacaacggccttaactaccgtgaggtccgcgagttccgctccgaccaccatctggtacgtttttacttcctcacccgcgtgtactccgattacctccagaccatcttgaaagagctgcagtcgggcgagcacgcccccgacctggtcatcatgaattcctgcctctgggacatctccaggtatggtccgaactcctggagaagctacctggagaacctggagaacctgttccagtgcctgggccaggtgctgcccgagtcttgcctcctggtgtggaacacggccatgcctgtgggcgaggaagtcaccgggggttttcttccgcccaagctccggcggcagaaggccaccttcctgaaaaacgaagtggtcaaagccaacttccacagcgccaccgaggcacgtaaacataacttcgatgtactggacttgcatttccacttccgccacgcgagggagaacctgcactgggacggggtgcactggaatggacgtgtgcaccgctgcctctcccagctgctgctggcccacgtggccgacgcctggggtgtggagctgccccaccgccaccccgtgggcgagtggatcaagaagaaaaaacctggcccgagagtcgaagggccgccccaggccaacagaaatcacccggccttacctctgtccccacccttaccttcccccacataccgccccctgcttgggttcccaccccagcgcttgccgctgctcccgctcctgtccccacagcctcctcctcccattctccatcaccagggaatgccccggttcccacagggtcccccagatgcctgtttttcctcagaccatactttccagtcggatcaattctattgccattcagatgtcccctcatcagcccatgcaggtttcttcgtcgaagacaattttatggttggtcctcagctgcctatgcccttcttccccacaccccgttatcagcggcctgccccagtggtacataggggttttggcaggtatcgtccccgtggcccctatacgccctggggacagcggcctcgaccttcaaagagaagggccccagccaatcctgagccaaggcctcaatagacggacctaggccttatttcctctttatgaacatggattggacagatctgacacttcctttccattgcttggcctgaacagactgaccttgttaacttaagcctggagtccatgcctcgtcttccttttgttcattgctgttaccaagaaagccaaggaagagcagcctgactcattcttcttggctgcagcctcttccccacttcctgggagtgacccagcgttattcctgcctcctcactcctattctctttgcctttgtgtaaaaataaaatggaaataaacaagttgcacagaaaaaaaaaagg

SEQ ID NO: 372396 - DNA, 718 bp, Homo sapiens
caccaggtggaacctgagcctccaacagcagcctcaggtcattcataggtcaagccccaggcctgaactgccactagacaaggcttttggctcccttcctgccctctcgccaatctcccaggtccgggcttggtggagcctgttatgcgggcactccaggtccactccctcagggcagaggccacagcgccatccccttccccatggtctccctacccccaacctgcactgggcgctccgcccagaggtgagtccctcccagcccttctctccttctgtcctagccatccgcagagccatcctgtgcaaaggaaggagctaggctgtgcgccctgggcgtcatgatccttctgcgggcctccgaagtgcggcagctgcttcacaataagttcgtggtcatcctgggggactctgtgcatagggcagtatacaaggacctggtgcttctgctgcagaaggaccgcctgctcactcccgggcagcttagagcaaggggggagctgaacttcgaacaagatgagctggtggacggaggccagcggggccacatgcacaacggccttaactaccgtgaggtccgcgagttccgctccgaccaccatctggtacgtttttacttcctcacccgcgtgtactccgattacctccagaccatcttgaaagagctgcagtcgggcgagcacgcccccgacctggtcatcatgaattcctgcctctg

SEQ ID NO: 372397 - DNA, 2083 bp, Homo sapiens
tgtttaatcaaaggaagagtcaaaataagctacacccagattactgagaaaggtgaaatgaaaacaagctcaaaaccaaattccaggaagatgctgtctttgtattgacttaccatttcatgttttcacacatgtcaaagtcttgaagcttcggtcattagtcttccgcttcctaaagcaagaaactaaatgctgacttgtgtcgtttgccccagatgccaccggaaatgtcatcttctccccagacgctggcttgcaagcacagcagcacccagaggctaacctatttcccctatagcccaagctctgagatctcccgtctggtcacaatgatctacaggagaggaagaaagctatctagggacgagatctagaatcaactgagagagatgcttaaaaatcaccagttactttaatgaccatccgcagagccatcctgtgcaaaggaaggagctaggctgtgcgccctgggcgtcatgatccttctgcgggcctccgaagtgcggcagctgcttcacaataagttcgtggtcatcctgggggactctgtgcatagggcagtatacaaggacctggtgcttctgctgcagaaggaccgcctgctcactcccgggcagcttagagcaaggggggagctgaacttcgaacaagatgagctggtggacggaggccagcggggccacatgcacaacggccttaactaccgtgaggtccgcgagttccgctccgaccaccatctggtacgtttttacttcctcacccgcgtgtactccgattacctccagaccatcttgaaagagctgcagtcgggcgagcacgcccccgacctggtcatcatgaattcctgcctctgggacatctccaggtatggtccgaactcctggagaagctacctggagaacctggagaacctgttccagtgcctgggccaggtgctgcccgagtcttgcctcctggtgtggaacacggccatgcctgtgggcgaggaagtcaccgggggttttcttccgcccaagctccggcggcagaaggccaccttcctgaaaaacgaagtggtcaaagccaacttccacagcgccaccgaggcacgtaaacataacttcgatgtactggacttgcatttccacttccgccacgcgagggagaacctgcactgggacggggtgcactggaatggacgtgtgcaccgctgcctctcccagctgctgctggcccacgtggccgacgcctggggtgtggagctgccccaccgccaccccgtgggcgagtggatcaagaagaaaaaacctggcccgagagtcgaagggccgccccaggccaacagaaatcacccggccttacctctgtccccacccttaccttcccccacataccgccccctgcttgggttcccaccccagcgcttgccgctgctcccgctcctgtccccacagcctcctcctcccattctccatcaccagggaatgccccggttcccacagggtcccccagatgcctgtttttcctcagaccatactttccagtcggatcaattctattgccattcagatgtcccctcatcagcccatgcaggtttcttcgtcgaagacaattttatggttggtcctcagctgcctatgcccttcttccccacaccccgttatcagcggcctgccccagtggtacataggggttttggcaggtatcgtccccgtggcccctatacgccctggggacagcggcctcgaccttcaaagagaagggccccagccaatcctgagccaaggcctcaatagacggacctaggccttatttcctctttatgaacatggattggacagatctgacacttcctttccattgcttggcctgaacagactgaccttgttaacttaagcctggagtccatgcctcgtcttccttttgttcattgctgttaccaagaaagccaaggaagagcagcctgactcattcttcttggctgcagcctcttccccacttcctgggagtgacccagcgttattcctgcctcctcactcctattctctttgcctttgtgtaaaaataaaatggaaataaacaagttgcacagaaaaaaaaaagg

SEQ ID NO: 372398 - DNA, 1717 bp, Homo sapiens
tgtttaatcaaaggaagagtcaaaataagctacacccagattactgagaaaggtgaaatgaaaacaagctcaaaaccaaattccaggaagatgctgtctttgtattgacttaccatttcatgttttcacacatgtcaaagtcttgaagcttcggtcattagtcttccgcttcctaaagcaagaaactaaatgctgacttgtgtcgtttgccccagatgccaccggaaatgtcatcttctccccagacgctggcttgcaagcacagcagcacccagaggctaacctatttcccctatagcccaagctctgagatctcccgtctggtcacaatgatctacaggagaggaagaaagctatctagggacgagatctagaatcaactgagagagatgcttaaaaatcaccagttactttaatgaaccatcttgaaagagctgcagtcgggcgagcacgcccccgacctggtcatcatgaattcctgcctctgggacatctccaggtatggtccgaactcctggagaagctacctggagaacctggagaacctgttccagtgcctgggccaggtgctgcccgagtcttgcctcctggtgtggaacacggccatgcctgtgggcgaggaagtcaccgggggttttcttccgcccaagctccggcggcagaaggccaccttcctgaaaaacgaagtggtcaaagccaacttccacagcgccaccgaggcacgtaaacataacttcgatgtactggacttgcatttccacttccgccacgcgagggagaacctgcactgggacggggtgcactggaatggacgtgtgcaccgctgcctctcccagctgctgctggcccacgtggccgacgcctggggtgtggagctgccccaccgccaccccgtgggcgagtggatcaagaagaaaaaacctggcccgagagtcgaagggccgccccaggccaacagaaatcacccggccttacctctgtccccacccttaccttcccccacataccgccccctgcttgggttcccaccccagcgcttgccgctgctcccgctcctgtccccacagcctcctcctcccattctccatcaccagggaatgccccggttcccacagggtcccccagatgcctgtttttcctcagaccatactttccagtcggatcaattctattgccattcagatgtcccctcatcagcccatgcaggtttcttcgtcgaagacaattttatggttggtcctcagctgcctatgcccttcttccccacaccccgttatcagcggcctgccccagtggtacataggggttttggcaggtatcgtccccgtggcccctatacgccctggggacagcggcctcgaccttcaaagagaagggccccagccaatcctgagccaaggcctcaatagacggacctaggccttatttcctctttatgaacatggattggacagatctgacacttcctttccattgcttggcctgaacagactgaccttgttaacttaagcctggagtccatgcctcgtcttccttttgttcattgctgttaccaagaaagccaaggaagagcagcctgactcattcttcttggctgcagcctcttccccacttcctgggagtgacccagcgttattcctgcctcctcactcctattctctttgcctttgtgtaaaaataaaatggaaataaacaagttgcacagaaaaaaaaaagg

SEQ ID NO: 372399 - DNA, 432 bp, Homo sapiens
ataggctgaagaacttaatggagaaattaataagattaaaaatgaattatcatcccttaaagaaactcatattaagttacaagaacattataacaaattatgcaatcaaaaaacatttgaggaagacaaaaagtttcaggtgaaaacaaagcctctgatatcaactccactacaaagccatttgcaggcaatcaagacgactaaaaatacttctggtgatgatgactggcagagcctcattacgaatcaactaaataaaagtgaaaatttactaagtttagaaaatgacaaccagccaaagaaaagaaaagcagaagagacgttggaaaaaaacaacagattaaaataatgtagataagtgctttcagtagtgaaattatgtaactgaaattctggtatagtttttactagaataaaatgactgttgtattt

SEQ ID NO: 372400 - DNA, 262 bp, Homo sapiens
ttgaaaacatgccaacttccaaatatctcactgcccttcctgtttcttcaacaatggtgttctgaagcatgggaggaaacatgaagtagtaaaaggcagtttttgtacactttacttcagttatatattagagattttgaagatctactacataagcctacacattcacattgtatacttttctggtgccagaactactaaggtagtggaaatcagccaagagatggtggttttaccacatactcataactgcagaggcttt

SEQ ID NO: 372401 - DNA, 672 bp, Homo sapiens
ataggctgaagaacttaatggagaaattaataagattaaaaatgaattatcatcccttaaagaaactcatattaagttacaagaacattataacaaattatgcaatcaaaaaacatttgaggaagacaaaaagtttcaggtgaaaacaaagcctctgatatcaactccactacaaagccatttgcaggcaatcaagacgactaaaaatacttctggtgatgatgactggcagagcctcattacgaatcaactaaataaaagtgaaaatttactaagtttagaaaatgacaaccagccaaagaaaagaaaagcagaagagacgttggaaaaaaacaacagattaaaataatgtagataagtgctttcagtagtgaaattatgtaactgaaattctggtatagtttttactagaataaaatgactgttgtatttaaagctctacagtttgtctttgcttttccaagtttttctaatgtgaagaaattgtattactctacttctgtcttctctctgtatattatcctttctttaaagtgctcattgcttcttcaatatccttttttaaagaacagaacttatgtattgtatgacagacattgtgaccccttgtaatttattacttcatatcctctggagtttgtgattttagtataaatttgagacaataactgt

SEQ ID NO: 372402 - DNA, 531 bp, Homo sapiens
taaaattacccaatacagtgtcttgaaaacatgccaacttccaaatatctcactgcccttcctgtttcttcaacaatggtgttctgaagcatgggaggaaacatgaagtagtaaaaggcagtttttgtacactttacttcagttatatattagagattttgaagatctactacataagcctacacattcacattgtatacttttctggtgccagaactactaaggtagtggaaatcagccaagagatggtggttttaccacatactcataactgcagaggctttacagactctttaaaatcttttgtataataatttcgaaggtaaaattagtttatctttcccaggtgaaaacaaagcctctgatatcaactccactacaaagccatttgcaggcaatcaagacgactaaaaatacttctggtgatgatgactggcagagcctcattacgaatcaactaaataaaagtgaaaatttactaagtttagaaaatgacaaccagccaaagaaaagaaaagcagaagagacgtt

SEQ ID NO: 372403 - DNA, 371 bp, Homo sapiens
ccataaagtaagtaaaattttatagggattggcctggtcatgaaaggaaaagaattgcctggaaaggagacccctgtcacatggtcttgataaaagatgaaaaaggcttgatgtgtcaaaaaaaaaaaaaaaaaactccagctctcctggtacccacaagttcccctgcatttccacctggccacagcaagcagtgatgctgagctgatagccctgggtggggcagggacacagccttgcaggcctgggcatcaagtgagagagcagctggcctgattgtggctcctgcctgctgcccgcgggggatttgacctagatgctctgtttatcttagtccccggcctgcagcatcagcagcggaggagaaatga

SEQ ID NO: 372404 - DNA, 414 bp, Homo sapiens
tagggctgacagaaagctagaaactattatatactcgtaactttgttaagacaccttggcagagaaataatactaaaccagtacctccagatttcaccccaacatatattcatattaggaacaactactctcttaacagcaaatggatgctttatatttacaaaatatatttaaatgtggtcaaataagaataattcttaataaaaaaagaccctagtaaaaaaaaatcctacgaaacaggtctcagcagtgcttattaattggctttccaaggtcttttctttaaaaaaaaaaaatgtaaaattaggcagcagcacctgaaccagttcaaaaaacattaatgcccaaaccaatttgcagattaatcttacaatattcattttgtaatctcttgtgcctgcacagtgcctggcc

SEQ ID NO: 372405 - DNA, 472 bp, Homo sapiens
taaaaaggagagaggtagatgataattgcattattgagagcagataattcttctgagtgaaatacatagttcatatcaaaagcatctactgagtgtgtggtgttatatatatatgtaggtttttcatccagggttctttggctcataactcccacagcccttacacagtcttgttataatgttggatgtgttaggcctcaggtaggcctctggtgttctgccctccttccactctaatattctcccacctttctgattgtgggtcttaagactcaaaattccaagaggacagggttcagagagcttcccaatagctgaacatgtggaggttccgggagagtggtgtgcccaggtagggcatggaagcttcaagcctcttcccccataccttgccctagcgtttcttcgtctgtattttttccagtatagagcaataaactggtgaactaagtgtttccctgagttgtatgaa

SEQ ID NO: 372406 - DNA, 362 bp, Homo sapiens
gactgcatgtccatttataggttgtctgcaaggggaagcacatcacacgctgttgggtcattctggcagtccaacctggcattgtctttacacaatcctgcgtgtaattttgtatttacaataatcaggagcatttcatcttttattctgtagcaatagtttcaggtggtctccctacaatcatccagataattgtttcatcttctgctttggtttcaagttatcactaaattaccaaacccttctttgctaagttcacgggaacagtgtcctgaagtgaaaaaggctgcaggccaggcgaggtggcttacccttgtaatcccagtgctttaggaggccgaggtgggcagatcacttgaggc

SEQ ID NO: 372407 - DNA, 1500 bp, Homo sapiens
ccggcagcccccacgcccacggttggtttgttcagggagagaaaacggctttcccagctctactcacctcacttcaccctcagagagtcggggcggagtgagggtgaggagcctggtccagggtccccacctcggaagcatttagagatgtaaactttgatcctttgatcatttaacctgctcagcacagcaggaagtgggaacttggtccctaccccagtccccagggcctttggagggaagggttggacagtttggaggccagcagaccccttggggacagcttaatgtatctgaagattcctgagtgggaatgttgctggagggcaagctgcttctcttttttaaaaattcattttctctagcagctgttttggcccctttggtgtccctgagctccccatggcactgtttcctgccgtgactttctcctcctggacactggagcccaggtggtgcccgcgcacctctcacacactgggggatagggtcaaggcctcatccaagtctgttaacagcttcccactcaaccagtctccccaaaatacactgtgagttcaatgattctgcttataaaggagtgctatgaaactgacctattttcctaattggttaactgacttcatctcacataaccttgagtaaccaaagccttcatcagagcggacgatccaacccaacatgctgtttcccatcctcaaaaggcacggggaccaatggccacccaactccttcccaaccctcccctccagggacgagagatggccccctctttccctttccccactctgcaagcactcccccaccaacgggtgcatcacagcccctcactgggaccagggggcctccctctccggtggaaccagtgtcacatgcctgtgcatctctgtgattctcagagggtctgaggtccgagcaccctgctgtggcctgtgggaagacgctacaaagtcccactggatctaaaccagaggcctgttctggcgagcagggaaactgtgtcctggcagagatcgtggtcctgggcacacaggacccctcagcacactgaggtggagctggggcgaggggagggggtgcgctctgggtaactgaaggtgtgaagggcccagggcctgtttctgggcagtgcaggaagtcccagccccatgcctgtggtgagatcccctgtagggccccccccaccatggacacttcggggcctctacggtcttccaaagctgtgtcctcatttccactgcagcagaggggcgtccccagctccgtcaaacagccctttctgtttctggagtcctacaagtggaggcccaaatccgttcccatgttgaggcaaggccctggctgttccttcctctctggaaaccgccttgaactcttcctttgggacatgcctcctcgaccagccttgaaggggtgctcctctctcactacctggaaccaaacacccccttcctttgtgtacaagggcaataaagagtagaccttcatcttctttatttt

SEQ ID NO: 372408 - DNA, 1111 bp, Homo sapiens
gcggtcacgtgacgtgcgtggcgacgtgtcggccatcttgtgttgttgaggctgaggactgactggggttctgagactccctgtcccggaccgcagattatagtgggaccagtctcattaggttgaatctacagcctatgttggtgttaacccaggtctcttagagcgttaaaaggatctgaacaaagtctgctcaaatctcctgctgtgaaccagcagaatttttgaacaggtttcttcacatataaaaatctattgtaaaaatacggaaaagaatggcagcggaaacgcagacactgaactttgggcctgaatgatgtgtttggaccccgaatatggaattctcatggaattttgagatccatcacattgtagtgtggcttccccccctcccctccttcctttttccccaaagttggtgattgaagatcctctcttcagtggcatcaataataataattactttttctattcaaacctcgggcaacccctttggtaatatcagaagtagtatctaaaatagataaattggatttgtgtcttaaactcttggttgttcaggtgggagtggttcaataaatgatgcagacttcctgtagtaactctatttgaggagtcttattaacttatcctattagaaatatttctttttattaatatatgtaatctcgaagttttcttaacctttatagccagcatttggagactgaggagaaatcactatttgaagttctaagaaccgatggaactcctgtattttgagagtttatttagaacatgttaacctaagtaatgctgtacttgttttagttattcctttatatttttaaaatgattttcttagtatcaaattaatatgtttctaaaaaaattagaaataactagtaagccagaaataatttcaacatccatggtacacactgtaaataccttggtgtatctttccaggtggttttatgtatgcttatttgtgtatatatacacttattttttacaaaaatgggatcatactgtaccttcagttttgtagcctgcttaaagaaataaccaaatcagaaacatctttttttaatcaataaatattttctgttgtattaaatggttgcattgt

SEQ ID NO: 372409 - DNA, 1041 bp, Homo sapiens
gcggtcacgtgacgtgcgtggcgacgtgtcggccatcttgtgttgttgaggctgaggactgactggggttctgagactccctgtcccggaccgcagcgttaaaaggatctgaacaaagtctgctcaaatctcctgctgtgaaccagcagaatttttgaacaggtttcttcacatataaaaatctattgtaaaaatacggaaaagaatggcagcggaaacgcagacactgaactttgggcctgaatgatgtgtttggaccccgaatatggaattctcatggaattttgagatccatcacattgtagtgtggcttccccccctcccctccttcctttttccccaaagttggtgattgaagatcctctcttcagtggcatcaataataataattactttttctattcaaacctcgggcaacccctttggtaatatcagaagtagtatctaaaatagataaattggatttgtgtcttaaactcttggttgttcaggtgggagtggttcaataaatgatgcagacttcctgtagtaactctatttgaggagtcttattaacttatcctattagaaatatttctttttattaatatatgtaatctcgaagttttcttaacctttatagccagcatttggagactgaggagaaatcactatttgaagttctaagaaccgatggaactcctgtattttgagagtttatttagaacatgttaacctaagtaatgctgtacttgttttagttattcctttatatttttaaaatgattttcttagtatcaaattaatatgtttctaaaaaaattagaaataactagtaagccagaaataatttcaacatccatggtacacactgtaaataccttggtgtatctttccaggtggttttatgtatgcttatttgtgtatatatacacttattttttacaaaaatgggatcatactgtaccttcagttttgtagcctgcttaaagaaataaccaaatcagaaacatctttttttaatcaataaatattttctgttgtattaaatggttgcattgt

SEQ ID NO: 372410 - DNA, 1150 bp, Homo sapiens
gcggtcacgtgacgtgcgtggcgacgtgtcggccatcttgtgttgttgaggctgaggactgactggggttctgagactccctgtcccggaccgcagtcaaagcacttaaacacacgtagtctctctgtaagaaagcgttaaaaggatctgaacaaagtctgctcaaatctcctgctgtgaaccagcagaatttttgaacagagaccacgtctccacctcctgggctccaacgattctcccatcttggcctcccaaagcgctggatttacaggtttcttcacatataaaaatctattgtaaaaatacggaaaagaatggcagcggaaacgcagacactgaactttgggcctgaatgatgtgtttggaccccgaatatggaattctcatggaattttgagatccatcacattgtagtgtggcttccccccctcccctccttcctttttccccaaagttggtgattgaagatcctctcttcagtggcatcaataataataattactttttctattcaaacctcgggcaacccctttggtaatatcagaagtagtatctaaaatagataaattggatttgtgtcttaaactcttggttgttcaggtgggagtggttcaataaatgatgcagacttcctgtagtaactctatttgaggagtcttattaacttatcctattagaaatatttctttttattaatatatgtaatctcgaagttttcttaacctttatagccagcatttggagactgaggagaaatcactatttgaagttctaagaaccgatggaactcctgtattttgagagtttatttagaacatgttaacctaagtaatgctgtacttgttttagttattcctttatatttttaaaatgattttcttagtatcaaattaatatgtttctaaaaaaattagaaataactagtaagccagaaataatttcaacatccatggtacacactgtaaataccttggtgtatctttccaggtggttttatgtatgcttatttgtgtatatatacacttattttttacaaaaatgggatcatactgtaccttcagttttgtagcctgcttaaagaaataaccaaatcagaaacatctttttttaatcaataaatattttctgttgtattaaatggttgcattgt

SEQ ID NO: 372411 - DNA, 1111 bp, Homo sapiens
gcggtcacgtgacgtgcgtggcgacgtgtcggccatcttgtgttgttgaggctgaggactgactggggttctgagactccctgtcccggaccgcagcgttaaaaggatctgaacaaagtctgctcaaatctcctgctgtgaaccagcagaatttttgaacagagaccacgtctccacctcctgggctccaacgattctcccatcttggcctcccaaagcgctggatttacaggtttcttcacatataaaaatctattgtaaaaatacggaaaagaatggcagcggaaacgcagacactgaactttgggcctgaatgatgtgtttggaccccgaatatggaattctcatggaattttgagatccatcacattgtagtgtggcttccccccctcccctccttcctttttccccaaagttggtgattgaagatcctctcttcagtggcatcaataataataattactttttctattcaaacctcgggcaacccctttggtaatatcagaagtagtatctaaaatagataaattggatttgtgtcttaaactcttggttgttcaggtgggagtggttcaataaatgatgcagacttcctgtagtaactctatttgaggagtcttattaacttatcctattagaaatatttctttttattaatatatgtaatctcgaagttttcttaacctttatagccagcatttggagactgaggagaaatcactatttgaagttctaagaaccgatggaactcctgtattttgagagtttatttagaacatgttaacctaagtaatgctgtacttgttttagttattcctttatatttttaaaatgattttcttagtatcaaattaatatgtttctaaaaaaattagaaataactagtaagccagaaataatttcaacatccatggtacacactgtaaataccttggtgtatctttccaggtggttttatgtatgcttatttgtgtatatatacacttattttttacaaaaatgggatcatactgtaccttcagttttgtagcctgcttaaagaaataaccaaatcagaaacatctttttttaatcaataaatattttctgttgtattaaatggttgcattgt

SEQ ID NO: 372412 - DNA, 930 bp, Homo sapiens
gcggtcacgtgacgtgcgtggcgacgtgtcggccatcttgtgttgttgaggctgaggactgactggggttctgagactccctgtcccggaccgcagattatagtgggaccagtctcattaggttgaatctacagcctatgttggtgttaacccaggtctcttagagcgttaaaaggatctgaacaaagtctgctcaaatctcctgctgtgaaccagcagaatttttgaacagagaccacgtctccacctcctgggctccaacgattctcccatcttggcctcccaaagcgctggatttacaggtttcttcacatataaaaatctattgtaaaaatacggaaaagaatggcagcggaaacgcagacactgaactttgggcctgaatgatgtgtttggaccccgaatatggaattctcatggaattttgagatccatcacattgtagtgtggcttccccccctcccctccttcctttttccccaaagttggtgattgaagatcctctcttcagtggcatcaataataataattactttttctattcaaacctcgggcaacccctttggtaatatcagaagtagtatctaaaatagataaattggatttgtgtcttaaactcttggttgttcaggtgggagtggttcaataaatgatgcagacttcctgtagtaactctatttgaggagtcttattaacttatcctattagaaatatttctttttattaatatatgtaatctcgaagttttcttaacctttatagccagcatttggagactgaggagaaatcactatttgaactagacgtgacccgtttggcgtcttgcatgtccggatgcgctggtgtccaattaaggtgccgtaccatgttaaagacatccaatcccgggcacggtcagggggtttacaaggcgggaaatattgtgggcaa

SEQ ID NO: 372413 - DNA, 723 bp, Homo sapiens
  misc_feature (355)..(355): n is a, c, g, or t
  misc_feature (381)..(381): n is a, c, g, or t
aaattgtatatagttattacaattttgtagcagtctctgtatagttattacacatgtttagaagggagggaggcaagaagggatagggagaatggtgatccaaaattgtatatagtttttggatcaaatagcatgaggggagaggaaaccattaaaaattggggctcctactctcctttgctttgtaaattcaaaagttgggggtgggtaagagggatagttaaaatgtttacaaaactttaggctccctcggaacttttgccagtgtggaggaaaataaaaaagaacttaaataaaatctgattgtattctaaaaaaaaaaaaaaaaaaaaaaaaaaaaaaaaaaaaaaaaaanaaaaaaaaaaaaaaaaaaaaaaaaanaaaaaaaaaaaaaaagaggaggggcggccggccgccgcacagaccacccgcgccggggaacgcgccgccgctctttgcccctcgacccccccacctgtcgtgatcttagtagtgcggtcgcgcgcccccccaggtgagtggtgcgcggtcgtattatttcctcaccacgcgcgcgcgcgcctcgcttcgccttctcacttctccgcgtctttcgtggtgcgggtaaacagctaccgctgcctcgtggtggctcgtcttgtcgtgctgcagcacgcccctccctttctgcggcgtgggctgctatcttacttgccggccccccccccgcgcctggaggttgtc

SEQ ID NO: 372414 - DNA, 860 bp, Homo sapiens
gcggtcacgtgacgtgcgtggcgacgtgtcggccatcttgtgttgttgaggctgaggactgactggggttctgagactccctgtcccggaccgcagattatagtgggaccagtctcattaggttgaatctacagcctatgttggtgttaacccaggtctcttagagcgttaaaaggatctgaacaaagtctgctcaaatctcctgctgtgaaccagcagaatttttgaacagagactgtctcgctctgtcacccaggctagagtgcagtggtgctatcgtaactcactggagccctgatctaggctcaaaccatcctcccacctcagcctcccaagtagctgggactaagatgctgcttgaatctggggcttcgtttatatttcaagactgctgcctgtaggagctccatctgtatcatttgtgttaatagtgaccctggagttttgtacttccagaacctatgtgagcatatgtgatggccttgtagtaagttaaaggggaaaaaattaaatcactaacaatgaatttagtattttcacaaatagcaaatactttgaattttagttgagatttacctgctttataaattcagtctgatttaaatcctgacttgctttataaatgcagagccattattcaatgctctaaaatcctctacgggtttgagtttaaaacatttggctagatggggcttaaaatggtggtaaaaccgctccttcaggatgtttagtattaaagaaaaaccttacaattgatgtggtctctacagctctagttgatgtagtctcttcatctctgtttgtcatccaagtaggtccacatacttttagaaaacacactgaattgatttatgttacaa

SEQ ID NO: 372415 - DNA, 678 bp, Homo sapiens
gcggtcacgtgacgtgcgtggcgacgtgtcggccatcttgtgttgttgaggctgaggactgactggggttctgagactccctgtcccggaccgcagcgttaaaaggatctgaacaaagtctgctcaaatctcctgctgtgaaccagcagaatttttgaacagagttgcactcttgctgccgaggctggagcacaatggcgtgatctcggctcaccacatcctctgcctcctgggctcaagcagttctgcctcagcctcccgagtagctgggattacaggcatgcgccaccacaccccgctaattttgtatttgtagtagagacagggtttctccatgttggtcaggcaggtctcaaattcccgacctcaggttatccgcccgccttggcctcccaaagtactgggattacaggcgtgagccaccgtgtgtggcctttatttttattttttgagatggagtttcactcttgttgcccaggctggagtgcaatggcacgatcttggctcactgcaacctccgtttcctgggttcaagcgattctcctgcctcagactcccgagtagctgggattgcaggtgtgtgctaccacacccggctaattttttgtatttttagtagagacagggtttcaccatgttggccaggctggtctggaactcccgacctcaggtgatcca

SEQ ID NO: 372416 - DNA, 297 bp, Homo sapiens
agatgtaagatgtcttgtaagatgtaagaagcttgcataacccctgtgaacaaccataggagaatgtgaagtttccaaaggaacgtttaaagttagttccgaagtagtcttcctgatcatgtgtgcaagacttcatgaccaagctcccagatgatccaggtcagtcctgtttgggcttttagaaaccagaggagttggaaattcagggacagtcttgtcaaaattctccatcttgatttgatattcacctttggaacctcgggtcaacagagatgcaaaacagtgatgtaacatgat

SEQ ID NO: 372417 - DNA, 151 bp, Homo sapiens
ggatttgctggtgcagtacaactaggcttaatagggacatgcctcctcgaccagccttgaaggggtgctcctctctcactacctggaaccaaacacccccttcctttgtgtacaagggcaataaagagtagaccttcatcttctttatttt

SEQ ID NO: 372418 - DNA, 5939 bp, Homo sapiens
gcggtcacgtgacgtgcgtggcgacgtgtcggccatcttgtgttgttgaggctgaggactgactggggttctgagactccctgtcccggaccgcagcgttaaaaggatctgaacaaagtctgctcaaatctcctgctgtgaaccagcagaatttttgaacagagaccacgtctccacctcctgggctccaacgattctcccatcttggcctcccaaagcgctggatttacaggtttcttcacatataaaaatctattgtaaaaatacggaaaagaatggcagcggaaacgcagacactgaactttgggcctgaatggctccgagctctgtccagtggtgggagtattacatcccctcctctttctccagcattgccgaagtataaattagcagattatcgttacggcagagaagaaatgttagcacttttccttaaagacaacaagataccttcagaccttctggataaagaatttctgcctatcctccaggaggaaccccttccaccattggctctggtaccctttacagaagaagaacagagaaacttttccatgtctgtaaatagtgctgctgtcctgcgattgacaggacgaggaggaggaggaacagtggtgggggctcctagaggtcgaagttcttcaagagggcgaggcagaggcagaggtgaatgtggtttctaccaaagaagttttgatgaagtagagggtgtttttggtcgaggaggtggcagagaaatgcatagatcgcagagctgggaggaaaggggtgacagacgttttgaaaaaccaggacgaaaagatgtagggagaccaaattttgaggaaggtggaccaacatcagtagggagaaagcatgaatttatacgctcagaaagtgaaaattggcgcatctttagagaggaacaaaatggagaagatgaagatggaggttggcgactagctggatcaaggagggatggagagaggtggcgacctcacagtcctgatggccctcgttctgcaggctggcgggaacacatggaacgacgtcggaggtttgagtttgattttcgagatagagatgatgaacggggttaccgaagggttcgctctggcagtgggagcatagatgatgacagggatagcttgcccgaatggtgcttagaggatgctgaagaagaaatgggtacatttgactcatctggagcattcctttctctaaaaaaagtacagaaagagcctattccagaagagcaggagatggacttccggcctgtggacgaaggggaggagtgctctgactctgagggtagccataatgaagaggccaaagaacccgataagacaaataagaaagaaggagagaaaacagatagagtaggagttgaagctagtgaggaaactccccagacctcatcatcatctgctagaccaggtactccttcagaccatcagtctcaggaagcatcacagtttgagaggaaagatgaaccaaaaactgagcaaacggaaaaagctgaagaggagactcggatggaaaatagtctaccagccaaagtgcccagcagaggggatgaaatggttgctgatgtccagcagcccctgtcgcagattccttcagatacagcctctcctcttctcatacttccacctcctgttcccaatcctagtcctactctccggccagttgaaacaccagttgtaggtgctcctggtatgggcagtgtttccacagaacctgatgatgaagaaggtctcaaacatttggagcagcaagctgagaaaatggtggcttatctccaagacagtgcactagatgatgaaagattggcatcaaaactgcaagagcacagagctaaaggagtgtcgattccattgatgcatgaagcaatgcagaagtggtattacaaagatcctcagggagaaattcaaggtcccttcaataatcaggagatggcagaatggtttcaggcgggctattttactatgtctttattggtgaagagagcgtgtgatgaaagcttccaacctcttggcgatatcatgaaaatgtggggaagggttcccttttctccaggtccagctccccctcctcatatgggagagctggaccaggaacgactgaccaggcagcaagaactcacagccttataccagatgcagcacctgcagtaccagcagtttttaatacaacaacaatatgcacaggttttggcccaacagcagaaagcagcactgtcttcccagcagcagcagcagttggcacttcttcttcaacagtttcagaccttgaagatgagaatatctgatcagaacatcattccctcagtaactaggtctgtgtccgtgccagatactggctctatctgggagcttcagccaacagcttcacagcctacagtttgggaaggtggtagtgtatgggatcttcctctggacaccacgacaccaggccctgccctggaacagcttcagcagctagagaaggccaaagctgcaaagctagagcaagagagaagagaggcagaaatgagggcaaaacgggaagaggaagagcgaaagaggcaggaagaactccgaagacaacaggaggaaattcttcggcgacagcaggaagaagaaaggaaaaggcgagaggaagaagaacttgcccgaaggaaacaggaagaggctctgcgtcgccagcgggagcaagaaattgcattaaggcgacagcgagaagaggaagaaagacagcagcaagaagaagctcttagaagactggaagagaggagaagagaagaggaagaaaggcggaagcaggaagaattgttacgcaaacaggaagaggaggctgcaaaatgggcccgggaagaagaagaagcccagcgtcgattagaggagaaccggctgcggatggaagaggaggcagccagactccggcatgaggaagaagaacggaagagaaaggagctggaggtccagcggcagaaggagttaatgcgccagaggcagcagcagcaagaggctctccggaggttgcagcagcagcagcagcaacaacagctggcgcagatgaagcttccttcttcttcaacgtggggccagcagtccaatacaacagcatgtcagtcccaggccacgctgtcgttggctgaaatccaaaaactagaggaagaacgagaacggcagcttcgagaagagcaaaggcgccagcagagggagttgatgaaagctcttcagcagcagcagcagcagcaacagcagaaactctcaggttgggggaatgtcagcaaaccttcaggtaccacgaaatctcttctggagatccagcaggaagaggccaggcaaatgcaaaagcagcagcagcagcagcagcaacaccagcaaccaaacagagctcgtaacaatacgcattccaacctgcacaccagcattgggaattctgtttggggctctataaatactggtcctcctaaccagtgggcatctgacctagtcagtagtatttggagtaatgctgacactaaaaactccaacatgggattctgggatgatgcagtgaaagaggtgggacctaggaattcaacaaataaaaataaaaacaacgccagtctcagtaaatctgtaggtgtgtctaaccggcagaataagaaagtagaagaagaagaaaagttgctgaagctctttcagggagtaaataaagcccaagatggatttacgcagtggtgtgaacagatgcttcatgcccttaatacggcaaataacttggatgttcccacatttgtttctttcctgaaagaagtagaatctccttatgaggtccatgattatatcagggcctatttaggagatacttctgaggccaaggagtttgccaagcagttccttgagcgccgtgccaaacagaaagccaaccagcagcgtcagcagcagcagctgccgcagcagcagcagcagccaccacagcagccgccacagcagccacaacagcaggactctgtgtgggggatgaaccacagtacactccattcagtatttcagaccaatcaaagcaacaaccaacaatccaattttgaggctgtgcagagtggcaagaagaagaaaaagcagaagatggtccgagcagatcccagtttattaggattttcagtcaatgcatcatcggagcgactcaacatgggtgaaatcgagacgttggatgactactgagcacctgccagtggactggccatccctctcctgtctgccgactatggagtctccacctttggacacaacacttactcaccatttactctttatcactctgcaacaaatcacagaaccgatcatctcaggctttttcttctggccctttgtgtccaagattctttaatccatttttgttggtgaacatctcagactatagataagtggactggaccctgtgtcttgggggtggcagttgggattactccccaacaaggctgattttaggcagcatgtgttcactgtgctgtgatttcatctactgtctcccagaaagtgtgttgggatcggccattagcagcttgctttctcttgtcactttttttcttctattttgttttttcttcttctttttccccccatcagggcaaatggtctaactggtgcaatcatgaagagagttaatggttaacagacattggccaataacaaaacaccccatggactgtgactcgagtatccaacaggcagtcagagctctcccggtctgaaagttgcattgccactgctaactttgggattgcatcagagaggccctgagtggggttgagatgaggttggtttggtttgatgttacacactcctcacctgttctttctgagtgtcctttctctgaaaggatttatgtttttcttcgttagatagtgacttctgagcaagctgatctcccctggcatgctccaacctgattggacaaaggaagctctatggcctgggagagagactattcttaatttttctttcttacaaaaactgatttttcccataaatatttttacttcagaggactaggaccattttgttttgggcccttctgctgaaaatttgtctcgtttaagaggcagctagaatctttaccatatgtatgaatttgtataatttcatttttggatagggataaacttttgcttctgataaaagcctggaatttcatctggtcctcagagcattgcgtgtgtgtcttgctgtagcccggaaaaggttttgtgtaaagattctgggatggcaagttgtttgccttttctgaaaagagaacatacagaacctgtccatctttaagaccttcatccatggaatctactatacaggaggatgcagtgggctggaggggatgggcgaaaatgggagcaggaagcctggcctggcttctggtcatggcctcctaaaaccttaaacttcaagtagaaatgtactcaagccctatttataaacaaatacttttcctgcctccaccaaacccctacagaacatcacctggaattgccactcacactgggttggagtcattgggcagctgtgcctgtgcgagaggtgctgtggtctgggcagcccctggaaaagcacctttgctgcctgtcattgttgcctgaagaaggctggagttgctctgagagcagtttgggtttggagtattatatttggcttctatttttattattttggatcaccattctccctatcccttcttgcctccctcccttctaaacatgtgtaataactatacagagactgctacaaaattgtatatagtttttggatcaaatagcatgaggggagaggaaaccattaaaaattggggctcctactctcctttgctttgtaaattcaaaagttgggggtgggtaagagggatagttaaaatgtttacaaaactttaggctccctcggaacttttgccagtgtggaggaaaataaaaaagaacttaaataaaatctgattgtattcta

SEQ ID NO: 372419 - DNA, 5870 bp, Homo sapiens
ctttctgttttattctatttcttatagattatagtgggaccagtctcattaggttgaatctacagcctatgttggtgttaacccaggtctcttagagcgttaaaaggatctgaacaaagtctgctcaaatctcctgctgtgaaccagcagaatttttgaacaggtttcttcacatataaaaatctattgtaaaaatacggaaaagaatggcagcggaaacgcagacactgaactttgggcctgaatggctccgagctctgtccagtggtgggagtattacatcccctcctctttctccagcattgccgaagtataaattagcagattatcgttacggcagagaagaaatgttagcacttttccttaaagacaacaagataccttcagaccttctggataaagaatttctgcctatcctccaggaggaaccccttccaccattggctctggtaccctttacagaagaagaacagagaaacttttccatgtctgtaaatagtgctgctgtcctgcgattgacaggacgaggaggaggaggaacagtggtgggggctcctagaggtcgaagttcttcaagagggcgaggcagaggcagaggtgaatgtggtttctaccaaagaagttttgatgaagtagagggtgtttttggtcgaggaggtggcagagaaatgcatagatcgcagagctgggaggaaaggggtgacagacgttttgaaaaaccaggacgaaaagatgtagggagaccaaattttgaggaaggtggaccaacatcagtagggagaaagcatgaatttatacgctcagaaagtgaaaattggcgcatctttagagaggaacaaaatggagaagatgaagatggaggttggcgactagctggatcaaggagggatggagagaggtggcgacctcacagtcctgatggccctcgttctgcaggctggcgggaacacatggaacgacgtcggaggtttgagtttgattttcgagatagagatgatgaacggggttaccgaagggttcgctctggcagtgggagcatagatgatgacagggatagcttgcccgaatggtgcttagaggatgctgaagaagaaatgggtacatttgactcatctggagcattcctttctctaaaaaaagtacagaaagagcctattccagaagagcaggagatggacttccggcctgtggacgaaggggaggagtgctctgactctgagggtagccataatgaagaggccaaagaacccgataagacaaataagaaagaaggagagaaaacagatagagtaggagttgaagctagtgaggaaactccccagacctcatcatcatctgctagaccaggtactccttcagaccatcagtctcaggaagcatcacagtttgagaggaaagatgaaccaaaaactgagcaaacggaaaaagctgaagaggagactcggatggaaaatagtctaccagccaaagtgcccagcagaggggatgaaatggttgctgatgtccagcagcccctgtcgcagattccttcagatacagcctctcctcttctcatacttccacctcctgttcccaatcctagtcctactctccggccagttgaaacaccagttgtaggtgctcctggtatgggcagtgtttccacagaacctgatgatgaagaaggtctcaaacatttggagcagcaagctgagaaaatggtggcttatctccaagacagtgcactagatgatgaaagattggcatcaaaactgcaagagcacagagctaaaggagtgtcgattccattgatgcatgaagcaatgcagaagtggtattacaaagatcctcagggagaaattcaaggtcccttcaataatcaggagatggcagaatggtttcaggcgggctattttactatgtctttattggtgaagagagcgtgtgatgaaagcttccaacctcttggcgatatcatgaaaatgtggggaagggttcccttttctccaggtccagctccccctcctcatatgggagagctggaccaggaacgactgaccaggcagcaagaactcacagccttataccagatgcagcacctgcagtaccagcagtttttaatacaacaacaatatgcacaggttttggcccaacagcagaaagcagcactgtcttcccagcagcagcagcagttggcacttcttcttcaacagtttcagaccttgaagatgagaatatctgatcagaacatcattccctcagtaactaggtctgtgtccgtgccagatactggctctatctgggagcttcagccaacagcttcacagcctacagtttgggaaggtggtagtgtatgggatcttcctctggacaccacgacaccaggccctgccctggaacagcttcagcagctagagaaggccaaagctgcaaagctagagcaagagagaagagaggcagaaatgagggcaaaacgggaagaggaagagcgaaagaggcaggaagaactccgaagacaacaggaggaaattcttcggcgacagcaggaagaagaaaggaaaaggcgagaggaagaagaacttgcccgaaggaaacaggaagaggctctgcgtcgccagcgggagcaagaaattgcattaaggcgacagcgagaagaggaagaaagacagcagcaagaagaagctcttagaagactggaagagaggagaagagaagaggaagaaaggcggaagcaggaagaattgttacgcaaacaggaagaggaggctgcaaaatgggcccgggaagaagaagaagcccagcgtcgattagaggagaaccggctgcggatggaagaggaggcagccagactccggcatgaggaagaagaacggaagagaaaggagctggaggtccagcggcagaaggagttaatgcgccagaggcagcagcagcaagaggctctccggaggttgcagcagcagcagcagcaacaacagctggcgcagatgaagcttccttcttcttcaacgtggggccagcagtccaatacaacagcatgtcagtcccaggccacgctgtcgttggctgaaatccaaaaactagaggaagaacgagaacggcagcttcgagaagagcaaaggcgccagcagagggagttgatgaaagctcttcagcagcagcagcagcagcaacagcagaaactctcaggttgggggaatgtcagcaaaccttcaggtaccacgaaatctcttctggagatccagcaggaagaggccaggcaaatgcaaaagcagcagcagcagcagcagcaacaccagcaaccaaacagagctcgtaacaatacgcattccaacctgcacaccagcattgggaattctgtttggggctctataaatactggtcctcctaaccagtgggcatctgacctagtcagtagtatttggagtaatgctgacactaaaaactccaacatgggattctgggatgatgcagtgaaagaggtgggacctaggaattcaacaaataaaaataaaaacaacgccagtctcagtaaatctgtaggtgtgtctaaccggcagaataagaaagtagaagaagaagaaaagttgctgaagctctttcagggagtaaataaagcccaagatggatttacgcagtggtgtgaacagatgcttcatgcccttaatacggcaaataacttggatgttcccacatttgtttctttcctgaaagaagtagaatctccttatgaggtccatgattatatcagggcctatttaggagatacttctgaggccaaggagtttgccaagcagttccttgagcgccgtgccaaacagaaagccaaccagcagcgtcagcagcagcagctgccgcagcagcagcagcagccaccacagcagccgccacagcagccacaacagcaggactctgtgtgggggatgaaccacagtacactccattcagtatttcagaccaatcaaagcaacaaccaacaatccaattttgaggctgtgcagagtggcaagaagaagaaaaagcagaagatggtccgagcagatcccagtttattaggattttcagtcaatgcatcatcggagcgactcaacatgggtgaaatcgagacgttggatgactactgagcacctgccagtggactggccatccctctcctgtctgccgactatggagtctccacctttggacacaacacttactcaccatttactctttatcactctgcaacaaatcacagaaccgatcatctcaggctttttcttctggccctttgtgtccaagattctttaatccatttttgttggtgaacatctcagactatagataagtggactggaccctgtgtcttgggggtggcagttgggattactccccaacaaggctgattttaggcagcatgtgttcactgtgctgtgatttcatctactgtctcccagaaagtgtgttgggatcggccattagcagcttgctttctcttgtcactttttttcttctattttgttttttcttcttctttttccccccatcagggcaaatggtctaactggtgcaatcatgaagagagttaatggttaacagacattggccaataacaaaacaccccatggactgtgactcgagtatccaacaggcagtcagagctctcccggtctgaaagttgcattgccactgctaactttgggattgcatcagagaggccctgagtggggttgagatgaggttggtttggtttgatgttacacactcctcacctgttctttctgagtgtcctttctctgaaaggatttatgtttttcttcgttagatagtgacttctgagcaagctgatctcccctggcatgctccaacctgattggacaaaggaagctctatggcctgggagagagactattcttaatttttctttcttacaaaaactgatttttcccataaatatttttacttcagaggactaggaccattttgttttgggcccttctgctgaaaatttgtctcgtttaagaggcagctagaatctttaccatatgtatgaatttgtataatttcatttttggatagggataaacttttgcttctgataaaagcctggaatttcatctggtcctcagagcattgcgtgtgtgtcttgctgtagcccggaaaaggttttgtgtaaagattctgggatggcaagttgtttgccttttctgaaaagagaacatacagaacctgtccatctttaagaccttcatccatggaatctactatacaggaggatgcagtgggctggaggggatgggcgaaaatgggagcaggaagcctggcctggcttctggtcatggcctcctaaaaccttaaacttcaagtagaaatgtactcaagccctatttataaacaaatacttttcctgcctccaccaaacccctacagaacatcacctggaattgccactcacactgggttggagtcattgggcagctgtgcctgtgcgagaggtgctgtggtctgggcagcccctggaaaagcacctttgctgcctgtcattgttgcctgaagaaggctggagttgctctgagagcagtttgggtttggagtattatatttggcttctatttttattattttggatcaccattctccctatcccttcttgcctccctcccttctaaacatgtgtaataactatacagagactgctacaaaattgtatatagtttttggatcaaatagcatgaggggagaggaaaccattaaaaattggggctcctactctcctttgctttgtaaattcaaaagttgggggtgggtaagagggatagttaaaatgtttacaaaactttaggctccctcggaacttttgccagtgtggaggaaaataaaaaagaacttaaataaaatctgattgtattcta

SEQ ID NO: 372420 - DNA, 5621 bp, Homo sapiens
tatttaatctacggtagtgttttattgaacttcttagaatttcactattcaactgttcgttaaagaacttaaagttgatactttcttgttcaggactgggtctattgcattatattatgttagtttttttaacttgtttctttcagcctcttgtggtccagctacttcaatgccattgttggtctcataagtcaagatcatcaggcctcgttcagtatttaaatgtagatgtcctgccttgtatagagatagaactttagatattaatttatggtggtgaatgtgtgccacatgttgacatctgactatcatttttttctgttttcttattttcaggcagaggcagaggtgaatgtggtttctaccaaagaagttttgatgaagtagagggtgtttttggtcgaggaggtggcagagaaatgcatagatcgcagagctgggaggaaaggggtgacagacgttttgaaaaaccaggacgaaaagatgtagggagaccaaattttgaggaaggtggaccaacatcagtagggagaaagcatgaatttatacgctcagaaagtgaaaattggcgcatctttagagaggaacaaaatggagaagatgaagatggaggttggcgactagctggatcaaggagggatggagagaggtggcgacctcacagtcctgatggccctcgttctgcaggctggcgggaacacatggaacgacgtcggaggtttgagtttgattttcgagatagagatgatgaacggggttaccgaagggttcgctctggcagtgggagcatagatgatgacagggatagcttgcccgaatggtgcttagaggatgctgaagaagaaatgggtacatttgactcatctggagcattcctttctctaaaaaaagtacagaaagagcctattccagaagagcaggagatggacttccggcctgtggacgaaggggaggagtgctctgactctgagggtagccataatgaagaggccaaagaacccgataagacaaataagaaagaaggagagaaaacagatagagtaggagttgaagctagtgaggaaactccccagacctcatcatcatctgctagaccaggtactccttcagaccatcagtctcaggaagcatcacagtttgagaggaaagatgaaccaaaaactgagcaaacggaaaaagctgaagaggagactcggatggaaaatagtctaccagccaaagtgcccagcagaggggatgaaatggttgctgatgtccagcagcccctgtcgcagattccttcagatacagcctctcctcttctcatacttccacctcctgttcccaatcctagtcctactctccggccagttgaaacaccagttgtaggtgctcctggtatgggcagtgtttccacagaacctgatgatgaagaaggtctcaaacatttggagcagcaagctgagaaaatggtggcttatctccaagacagtgcactagatgatgaaagattggcatcaaaactgcaagagcacagagctaaaggagtgtcgattccattgatgcatgaagcaatgcagaagtggtattacaaagatcctcagggagaaattcaaggtcccttcaataatcaggagatggcagaatggtttcaggcgggctattttactatgtctttattggtgaagagagcgtgtgatgaaagcttccaacctcttggcgatatcatgaaaatgtggggaagggttcccttttctccaggtccagctccccctcctcatatgggagagctggaccaggaacgactgaccaggcagcaagaactcacagccttataccagatgcagcacctgcagtaccagcagtttttaatacaacaacaatatgcacaggttttggcccaacagcagaaagcagcactgtcttcccagcagcagcagcagttggcacttcttcttcaacagtttcagaccttgaagatgagaatatctgatcagaacatcattccctcagtaactaggtctgtgtccgtgccagatactggctctatctgggagcttcagccaacagcttcacagcctacagtttgggaaggtggtagtgtatgggatcttcctctggacaccacgacaccaggccctgccctggaacagcttcagcagctagagaaggccaaagctgcaaagctagagcaagagagaagagaggcagaaatgagggcaaaacgggaagaggaagagcgaaagaggcaggaagaactccgaagacaacaggaggaaattcttcggcgacagcaggaagaagaaaggaaaaggcgagaggaagaagaacttgcccgaaggaaacaggaagaggctctgcgtcgccagcgggagcaagaaattgcattaaggcgacagcgagaagaggaagaaagacagcagcaagaagaagctcttagaagactggaagagaggagaagagaagaggaagaaaggcggaagcaggaagaattgttacgcaaacaggaagaggaggctgcaaaatgggcccgggaagaagaagaagcccagcgtcgattagaggagaaccggctgcggatggaagaggaggcagccagactccggcatgaggaagaagaacggaagagaaaggagctggaggtccagcggcagaaggagttaatgcgccagaggcagcagcagcaagaggctctccggaggttgcagcagcagcagcagcaacaacagctggcgcagatgaagcttccttcttcttcaacgtggggccagcagtccaatacaacagcatgtcagtcccaggccacgctgtcgttggctgaaatccaaaaactagaggaagaacgagaacggcagcttcgagaagagcaaaggcgccagcagagggagttgatgaaagctcttcagcagcagcagcagcagcaacagcagaaactctcaggttgggggaatgtcagcaaaccttcaggtaccacgaaatctcttctggagatccagcaggaagaggccaggcaaatgcaaaagcagcagcagcagcagcagcaacaccagcaaccaaacagagctcgtaacaatacgcattccaacctgcacaccagcattgggaattctgtttggggctctataaatactggtcctcctaaccagtgggcatctgacctagtcagtagtatttggagtaatgctgacactaaaaactccaacatgggattctgggatgatgcagtgaaagaggtgggacctaggaattcaacaaataaaaataaaaacaacgccagtctcagtaaatctgtaggtgtgtctaaccggcagaataagaaagtagaagaagaagaaaagttgctgaagctctttcagggagtaaataaagcccaagatggatttacgcagtggtgtgaacagatgcttcatgcccttaatacggcaaataacttggatgttcccacatttgtttctttcctgaaagaagtagaatctccttatgaggtccatgattatatcagggcctatttaggagatacttctgaggccaaggagtttgccaagcagttccttgagcgccgtgccaaacagaaagccaaccagcagcgtcagcagcagcagctgccgcagcagcagcagcagccaccacagcagccgccacagcagccacaacagcaggactctgtgtgggggatgaaccacagtacactccattcagtatttcagaccaatcaaagcaacaaccaacaatccaattttgaggctgtgcagagtggcaagaagaagaaaaagcagaagatggtccgagcagatcccagtttattaggattttcagtcaatgcatcatcggagcgactcaacatgggtgaaatcgagacgttggatgactactgagcacctgccagtggactggccatccctctcctgtctgccgactatggagtctccacctttggacacaacacttactcaccatttactctttatcactctgcaacaaatcacagaaccgatcatctcaggctttttcttctggccctttgtgtccaagattctttaatccatttttgttggtgaacatctcagactatagataagtggactggaccctgtgtcttgggggtggcagttgggattactccccaacaaggctgattttaggcagcatgtgttcactgtgctgtgatttcatctactgtctcccagaaagtgtgttgggatcggccattagcagcttgctttctcttgtcactttttttcttctattttgttttttcttcttctttttccccccatcagggcaaatggtctaactggtgcaatcatgaagagagttaatggttaacagacattggccaataacaaaacaccccatggactgtgactcgagtatccaacaggcagtcagagctctcccggtctgaaagttgcattgccactgctaactttgggattgcatcagagaggccctgagtggggttgagatgaggttggtttggtttgatgttacacactcctcacctgttctttctgagtgtcctttctctgaaaggatttatgtttttcttcgttagatagtgacttctgagcaagctgatctcccctggcatgctccaacctgattggacaaaggaagctctatggcctgggagagagactattcttaatttttctttcttacaaaaactgatttttcccataaatatttttacttcagaggactaggaccattttgttttgggcccttctgctgaaaatttgtctcgtttaagaggcagctagaatctttaccatatgtatgaatttgtataatttcatttttggatagggataaacttttgcttctgataaaagcctggaatttcatctggtcctcagagcattgcgtgtgtgtcttgctgtagcccggaaaaggttttgtgtaaagattctgggatggcaagttgtttgccttttctgaaaagagaacatacagaacctgtccatctttaagaccttcatccatggaatctactatacaggaggatgcagtgggctggaggggatgggcgaaaatgggagcaggaagcctggcctggcttctggtcatggcctcctaaaaccttaaacttcaagtagaaatgtactcaagccctatttataaacaaatacttttcctgcctccaccaaacccctacagaacatcacctggaattgccactcacactgggttggagtcattgggcagctgtgcctgtgcgagaggtgctgtggtctgggcagcccctggaaaagcacctttgctgcctgtcattgttgcctgaagaaggctggagttgctctgagagcagtttgggtttggagtattatatttggcttctatttttattattttggatcaccattctccctatcccttcttgcctccctcccttctaaacatgtgtaataactatacagagactgctacaaaattgtatatagtttttggatcaaatagcatgaggggagaggaaaccattaaaaattggggctcctactctcctttgctttgtaaattcaaaagttgggggtgggtaagagggatagttaaaatgtttacaaaactttaggctccctcggaacttttgccagtgtggaggaaaataaaaaagaacttaaataaaatctgattgtattcta

SEQ ID NO: 372421 - DNA, 5226 bp, Homo sapiens
gcggtcacgtgacgtgcgtggcgacgtgtcggccatcttgtgttgttgaggctgaggactgactggggttctgagactccctgtcccggaccgcagattatagtgggaccagtctcattaggttgaatctacagcctatgttggtgttaacccaggtctcttagagcgttaaaaggatctgaacaaagtctgctcaaatctcctgctgtgaaccagcagaatttttgaacagagaccacgtctccacctcctgggctccaacgattctcccatcttggcctcccaaagcgctggatttacaggtttcttcacatataaaaatctattgtaaaaatacggaaaagaatggcagcggaaacgcagacactgaactttgggcctgaatggctccgagctctgtccagtggtgggagtattacatcccctcctctttctccagcattgccgaagtataaattagcagattatcgttacggcagagaagaaatgttagcacttttccttaaagacaacaagataccttcagaccttctggataaagaatttctgcctatcctccaggaggaaccccttccaccattggctctggtaccctttacagaagaagaacagagaaacttttccatgtctgtaaatagtgctgctgtcctgcgattgacaggacgaggaggaggaggaacagtggtgggggctcctagaggtcgaagttcttcaagagggcgaggcagaggcagaggtgaatgtggtttctaccaaagaagttttgatgaagtagagggtgtttttggtcgaggaggtggcagagaaatgcatagatcgcagagctgggaggaaaggggtgacagacgttttgaaaaaccaggacgaaaagatgtagggagaccaaattttgaggaaggtggaccaacatcagtagggagaaagcatgaatttatacgctcagaaagtgaaaattggcgcatctttagagaggaacaaaatggagaagatgaagatggaggttggcgactagctggatcaaggagggatggagagaggtggcgacctcacagtcctgatggccctcgttctgcaggctggcgggaacacatggaacgacgtcggaggtttgagtttgattttcgagatagagatgatgaacggggttaccgaagggttcgctctggcagtgggagcatagatgatgacagggatagcttgcccgaatggtgcttagaggatgctgaagaagaaatgggtacatttgactcatctggagcattcctttctctaaaaaaagtacagaaagagcctattccagaagagcaggagatggacttccggcctgtggacgaaggggaggagtgctctgactctgagggtagccataatgaagaggccaaagaacccgataagacaaataagaaagaaggagagaaaacagatagagtaggagttgaagctagtgaggaaactccccagacctcatcatcatctgctagaccaggtactccttcagaccatcagtctcaggaagcatcacagtttgagaggaaagatgaaccaaaaactgagcaaacggaaaaagctgaagaggagactcggatggaaaatagtctaccagccaaagtgcccagcagaggggatgaaatggttgctgatgtccagcagcccctgtcgcagattccttcagatacagcctctcctcttctcatacttccacctcctgttcccaatcctagtcctactctccggccagttgaaacaccagttgtaggtgctcctggtatgggcagtgtttccacagaacctgatgatgaagaaggtctcaaacatttggagcagcaagctgagaaaatggtggcttatctccaagacagtgcactagatgatgaaagattggcatcaaaactgcaagagcacagagctaaaggagtgtcgattccattgatgcatgaagcaatgcagaagtggtattacaaagatcctcagggagaaattcaaggtcccttcaataatcaggagatggcagaatggtttcaggcgggctattttactatgtctttattggtgaagagagcgtgtgatgaaagcttccaacctcttggcgatatcatgaaaatgtggggaagggttcccttttctccaggtccagctccccctcctcatatgggagagctggaccaggaacgactgaccaggcagcaagaactcacagccttataccagatgcagcacctgcagtaccagcagtttttaatacaacaacaatatgcacaggttttggcccaacagcagaaagcagcactgtcttcccagcagcagcagcagttggcacttcttcttcaacagtttcagaccttgaagatgagaatatctgatcagaacatcattccctcagtaactaggtctgtgtccgtgccagatactggctctatctgggagcttcagccaacagcttcacagcctacagtttgggaaggtggtagtgtatgggatcttcctctggacaccacgacaccaggccctgccctggaacagcttcagcagctagagaaggccaaagctgcaaagctagagcaagagagaagagaggcagaaatgagggcaaaacgggaagaggaagagcgaaagaggcaggaagaactccgaagacaacaggaggaaattcttcggcgacagcaggaagaagaaaggaaaaggcgagaggaagaagaacttgcccgaaggaaacaggaagaggctctgcgtcgccagcgggagcaagaaattgcattaaggcgacagcgagaagaggaagaaagacagcagcaagaagaagctcttagaagactggaagagaggagaagagaagaggaagaaaggcggaagcaggaagaattgttacgcaaacaggaagaggaggctgcaaaatgggcccgggaagaagaagaagcccagcgtcgattagaggagaaccggctgcggatggaagaggaggcagccagactccggcatgaggaagaagaacggaagagaaaggagctggaggtccagcggcagaaggagttaatgcgccagaggcagcagcagcaagaggctctccggaggttgcagcagcagcagcagcaacaacagctggcgcagatgaagcttccttcttcttcaacgtggggccagcagtccaatacaacagcatgtcagtcccaggccacgctgtcgttggctgaaatccaaaaactagaggaagaacgagaacggcagcttcgagaagagcaaaggcgccagcagagggagttgatgaaagctcttcagcagcagcagcagcagcaacagcagaaactctcaggttgggggaatgtcagcaaaccttcaggtaccacgaaatctcttctggagatccagcaggaagaggccaggcaaatgcaaaagcagcagcagcagcagcagcaacaccagcaaccaaacagagctcgtaacaatacgcattccaacctgcacaccagcattgggaattctgtttggggctctataaatactggtcctcctaaccagtgggcatctgacctagtcagtagtatttggagtaatgctgacactaaaaactccaacatgggattctgggatgatgcagtgaaagaggtgggacctaggaattcaacaaataaaaataaaaacaacgccagtctcagtaaatctgtaggtgtgtctaaccggcagaataagaaagtagaagaagaagaaaagttgctgaagctctttcagggagtaaataaagcccaagatggatttacgcagtggtgtgaacagatgcttcatgcccttaatacggcaaataacttggatgttcccacatttgtttctttcctgaaagaagtagaatctccttatgaggtccatgattatatcagggcctatttaggagatacttctgaggccaaggagtttgccaagcagttccttgagcgccgtgccaaacagaaagccaaccagcagcgtcagcagcagcagctgccgcagcagcagcagcagccaccacagcagccgccacagcagccacaacagcaggactctgtgtgggggatgaaccacagtacactccattcagtatttcagaccaatcaaagcaacaaccaacaatccaattttgaggctgtgcagagtggcaagaagaagaaaaagcagaagatggtccgagcagatcccagtttattaggattttcagtcaatgcatcatcggagcgactcaacatgggtgaaatcgagacgttggatgactactgagcacctgccagtggactggccatccctctcctgtctgccgactatggagtctccacctttggacacaacacttactcaccatttactctttatcactctgcaacaaatcacagaaccgatcatctcaggctttttcttctggccctttgtgtccaagattctttaatccatttttgttggtgaacatctcagactatagataagtggactggaccctgtgtcttgggggtggcagttgggattactccccaacaaggctgattttaggcagcatgtgttcactgtgctgtgatttcatctactgtctcccagaaagtgtgttgggatcggccattagcagcttgctttctcttgtcactttttttcttctattttgttttttcttcttctttttccccccatcagggcaaatggtctaactggtgcaatcatgaagagagttaatggttaacagacattggccaataacaaaacaccccatggactgtgactcgagtatccaacaggcagtcagagctctcccggtctgaaagttgcattgccactgctaactttgggattgcatcagagaggccctgagtggggttgagatgaggttggtttggtttgatgttacacactcctcacctgttctttctgagtgtcctttctctgaaaggatttatgtttttcttcgttagatagtgacttctgagcaagctgatctcccctggcatgctccaacctgattggacaaaggaagctctatggcctgggagagagactattcttaatttttctttcttacaaaaactgatttttcccataaatatttttacttcagaggactaggaccattttgttttgggcccttctgctgaaaatttgtctcgtttaagaggcagctagaatctttaccatatgtatgaatttgtataatttcatttttggatagggataaacttttgcttctgataaaagcctggaatttcatctggtcctcag

SEQ ID NO: 372422 - DNA, 4915 bp, Homo sapiens
acggatagcggatctgctagcggatctgttttctctccttctttcttatttgtcttatcgggttcgctctggcagtgggagcatagatgatgacagggatagcttgcccgaatggtgcttagaggatgctgaagaagaaatgggtacatttgactcatctggagcattcctttctctaaaaaaagtacagaaagagcctattccagaagagcaggagatggacttccggcctgtggacgaaggggaggagtgctctgactctgagggtagccataatgaagaggccaaagaacccgataagacaaataagaaagaaggagagaaaacagatagagtaggagttgaagctagtgaggaaactccccagacctcatcatcatctgctagaccaggtactccttcagaccatcagtctcaggaagcatcacagtttgagaggaaagatgaaccaaaaactgagcaaacggaaaaagctgaagaggagactcggatggaaaatagtctaccagccaaagtgcccagcagaggggatgaaatggttgctgatgtccagcagcccctgtcgcagattccttcagatacagcctctcctcttctcatacttccacctcctgttcccaatcctagtcctactctccggccagttgaaacaccagttgtaggtgctcctggtatgggcagtgtttccacagaacctgatgatgaagaaggtctcaaacatttggagcagcaagctgagaaaatggtggcttatctccaagacagtgcactagatgatgaaagattggcatcaaaactgcaagagcacagagctaaaggagtgtcgattccattgatgcatgaagcaatgcagaagtggtattacaaagatcctcagggagaaattcaaggtcccttcaataatcaggagatggcagaatggtttcaggcgggctattttactatgtctttattggtgaagagagcgtgtgatgaaagcttccaacctcttggcgatatcatgaaaatgtggggaagggttcccttttctccaggtccagctccccctcctcatatgggagagctggaccaggaacgactgaccaggcagcaagaactcacagccttataccagatgcagcacctgcagtaccagcagtttttaatacaacaacaatatgcacaggttttggcccaacagcagaaagcagcactgtcttcccagcagcagcagcagttggcacttcttcttcaacagtttcagaccttgaagatgagaatatctgatcagaacatcattccctcagtaactaggtctgtgtccgtgccagatactggctctatctgggagcttcagccaacagcttcacagcctacagtttgggaaggtggtagtgtatgggatcttcctctggacaccacgacaccaggccctgccctggaacagcttcagcagctagagaaggccaaagctgcaaagctagagcaagagagaagagaggcagaaatgagggcaaaacgggaagaggaagagcgaaagaggcaggaagaactccgaagacaacaggaggaaattcttcggcgacagcaggaagaagaaaggaaaaggcgagaggaagaagaacttgcccgaaggaaacaggaagaggctctgcgtcgccagcgggagcaagaaattgcattaaggcgacagcgagaagaggaagaaagacagcagcaagaagaagctcttagaagactggaagagaggagaagagaagaggaagaaaggcggaagcaggaagaattgttacgcaaacaggaagaggaggctgcaaaatgggcccgggaagaagaagaagcccagcgtcgattagaggagaaccggctgcggatggaagaggaggcagccagactccggcatgaggaagaagaacggaagagaaaggagctggaggtccagcggcagaaggagttaatgcgccagaggcagcagcagcaagaggctctccggaggttgcagcagcagcagcagcaacaacagctggcgcagatgaagcttccttcttcttcaacgtggggccagcagtccaatacaacagcatgtcagtcccaggccacgctgtcgttggctgaaatccaaaaactagaggaagaacgagaacggcagcttcgagaagagcaaaggcgccagcagagggagttgatgaaagctcttcagcagcagcagcagcagcaacagcagaaactctcaggttgggggaatgtcagcaaaccttcaggtaccacgaaatctcttctggagatccagcaggaagaggccaggcaaatgcaaaagcagcagcagcagcagcagcaacaccagcaaccaaacagagctcgtaacaatacgcattccaacctgcacaccagcattgggaattctgtttggggctctataaatactggtcctcctaaccagtgggcatctgacctagtcagtagtatttggagtaatgctgacactaaaaactccaacatgggattctgggatgatgcagtgaaagaggtgggacctaggaattcaacaaataaaaataaaaacaacgccagtctcagtaaatctgtaggtgtgtctaaccggcagaataagaaagtagaagaagaagaaaagttgctgaagctctttcagggagtaaataaagcccaagatggatttacgcagtggtgtgaacagatgcttcatgcccttaatacggcaaataacttggatgttcccacatttgtttctttcctgaaagaagtagaatctccttatgaggtccatgattatatcagggcctatttaggagatacttctgaggccaaggagtttgccaagcagttccttgagcgccgtgccaaacagaaagccaaccagcagcgtcagcagcagcagctgccgcagcagcagcagcagccaccacagcagccgccacagcagccacaacagcaggactctgtgtgggggatgaaccacagtacactccattcagtatttcagaccaatcaaagcaacaaccaacaatccaattttgaggctgtgcagagtggcaagaagaagaaaaagcagaagatggtccgagcagatcccagtttattaggattttcagtcaatgcatcatcggagcgactcaacatgggtgaaatcgagacgttggatgactactgagcacctgccagtggactggccatccctctcctgtctgccgactatggagtctccacctttggacacaacacttactcaccatttactctttatcactctgcaacaaatcacagaaccgatcatctcaggctttttcttctggccctttgtgtccaagattctttaatccatttttgttggtgaacatctcagactatagataagtggactggaccctgtgtcttgggggtggcagttgggattactccccaacaaggctgattttaggcagcatgtgttcactgtgctgtgatttcatctactgtctcccagaaagtgtgttgggatcggccattagcagcttgctttctcttgtcactttttttcttctattttgttttttcttcttctttttccccccatcagggcaaatggtctaactggtgcaatcatgaagagagttaatggttaacagacattggccaataacaaaacaccccatggactgtgactcgagtatccaacaggcagtcagagctctcccggtctgaaagttgcattgccactgctaactttgggattgcatcagagaggccctgagtggggttgagatgaggttggtttggtttgatgttacacactcctcacctgttctttctgagtgtcctttctctgaaaggatttatgtttttcttcgttagatagtgacttctgagcaagctgatctcccctggcatgctccaacctgattggacaaaggaagctctatggcctgggagagagactattcttaatttttctttcttacaaaaactgatttttcccataaatatttttacttcagaggactaggaccattttgttttgggcccttctgctgaaaatttgtctcgtttaagaggcagctagaatctttaccatatgtatgaatttgtataatttcatttttggatagggataaacttttgcttctgataaaagcctggaatttcatctggtcctcagagcattgcgtgtgtgtcttgctgtagcccggaaaaggttttgtgtaaagattctgggatggcaagttgtttgccttttctgaaaagagaacatacagaacctgtccatctttaagaccttcatccatggaatctactatacaggaggatgcagtgggctggaggggatgggcgaaaatgggagcaggaagcctggcctggcttctggtcatggcctcctaaaaccttaaacttcaagtagaaatgtactcaagccctatttataaacaaatacttttcctgcctccaccaaacccctacagaacatcacctggaattgccactcacactgggttggagtcattgggcagctgtgcctgtgcgagaggtgctgtggtctgggcagcccctggaaaagcacctttgctgcctgtcattgttgcctgaagaaggctggagttgctctgagagcagtttgggtttggagtattatatttggcttctatttttattattttggatcaccattctccctatcccttcttgcctccctcccttctaaacatgtgtaataactatacagagactgctacaaaattgtatatagtttttggatcaaatagcatgaggggagaggaaaccattaaaaattggggctcctactctcctttgctttgtaaattcaaaagttgggggtgggtaagagggatagttaaaatgtttacaaaactttaggctccctcggaacttttgccagtgtggaggaaaataaaaaagaacttaaataaaatctgattgtattcta

SEQ ID NO: 372423 - DNA, 6006 bp, Homo sapiens
gcggtcacgtgacgtgcgtggcgacgtgtcggccatcttgtgttgttgaggctgaggactgactggggttctgagactccctgtcccggaccgcagattatagtgggaccagtctcattaggttgaatctacagcctatgttggtgttaacccaggtctcttagagcgttaaaaggatctgaacaaagtctgctcaaatctcctgctgtgaaccagcagaatttttgaacagagaccacgtctccacctcctgggctccaacgattctcccatcttggcctcccaaagcgctggatttacaggtttcttcacatataaaaatctattgtaaaaatacggaaaagaatggcagcggaaacgcagacactgaactttgggcctgaatggctccgagctctgtccagtggtgggagtattacatcccctcctctttctccagcattgccgaagtataaattagcagattatcgttacggcagagaagaaatgttagcacttttccttaaagacaacaagataccttcagaccttctggataaagaatttctgcctatcctccaggaggaaccccttccaccattggctctggtaccctttacagaagaagaacagagaaacttttccatgtctgtaaatagtgctgctgtcctgcgattgacaggacgaggaggaggaggaacagtggtgggggctcctagaggtcgaagttcttcaagagggcgaggcagaggcagaggtgaatgtggtttctaccaaagaagttttgatgaagtagagggtgtttttggtcgaggaggtggcagagaaatgcatagatcgcagagctgggaggaaaggggtgacagacgttttgaaaaaccaggacgaaaagatgtagggagaccaaattttgaggaaggtggaccaacatcagtagggagaaagcatgaatttatacgctcagaaagtgaaaattggcgcatctttagagaggaacaaaatggagaagatgaagatggaggttggcgactagctggatcaaggagggatggagagaggtggcgacctcacagtcctgatggccctcgttctgcaggctggcgggaacacatggaacgacgtcggaggtttgagtttgattttcgagatagagatgatgaacggggttaccgaagggttcgctctggcagtgggagcatagatgatgacagggatagcttgcccgaatggtgcttagaggatgctgaagaagaaatgggtacatttgactcatctggagcattcctttctctaaaaaaagtacagaaagagcctattccagaagagcaggagatggacttccggcctgtggacgaaggggaggagtgctctgactctgagggtagccataatgaagaggccaaagaacccgataagacaaataagaaagaaggagagaaaacagatagagtaggagttgaagctagtgaggaaactccccagacctcatcatcatctgctagaccaggtactccttcagaccatcagtctcaggaagcatcacagtttgagaggaaagatgaaccaaaaactgagcaaacggaaaaagctgaagaggagactcggatggaaaatagtctaccagccaaagtgcccagcagaggggatgaaatggttgctgatgtccagcagcccctgtcgcagattccttcagatacagcctctcctcttctcatacttccacctcctgttcccaatcctagtcctactctccggccagttgaaacaccagttgtaggtgctcctggtatgggcagtgtttccacagaacctgatgatgaagaaggtctcaaacatttggagcagcaagctgagaaaatggtggcttatctccaagacagtgcactagatgatgaaagattggcatcaaaactgcaagagcacagagctaaaggagtgtcgattccattgatgcatgaagcaatgcagaagtggtattacaaagatcctcagggagaaattcaaggtcccttcaataatcaggagatggcagaatggtttcaggcgggctattttactatgtctttattggtgaagagagcgtgtgatgaaagcttccaacctcttggcgatatcatgaaaatgtggggaagggttcccttttctccaggtccagctccccctcctcatatgggagagctggaccaggaacgactgaccaggcagcaagaactcacagccttataccagatgcagcacctgcagtaccagcagtttttaatacaacaacaatatgcacaggttttggcccaacagcagaaagcagcactgtcttcccagcagcagcagcagttggcacttcttcttcaacagtttcagaccttgaagatgagaatatctgatcagaacatcattccctcagtaactaggtctgtgtccgtgccagatactggctctatctgggagcttcagccaacagcttcacagcctacagtttgggaaggtggtagtgtatgggatcttcctctggacaccacgacaccaggccctgccctggaacagcttcagcagctagagaaggccaaagctgcaaagctagagcaagagagaagagaggcagaaatgagggcaaaacgggaagaggaagagcgaaagaggcaggaagaactccgaagacaacaggaggaaattcttcggcgacagcaggaagaagaaaggaaaaggcgagaggaagaagaacttgcccgaaggaaacaggaagaggctctgcgtcgccagcgggagcaagaaattgcattaaggcgacagcgagaagaggaagaaagacagcagcaagaagaagctcttagaagactggaagagaggagaagagaagaggaagaaaggcggaagcaggaagaattgttacgcaaacaggaagaggaggctgcaaaatgggcccgggaagaagaagaagcccagcgtcgattagaggagaaccggctgcggatggaagaggaggcagccagactccggcatgaggaagaagaacggaagagaaaggagctggaggtccagcggcagaaggagttaatgcgccagaggcagcagcagcaagaggctctccggaggttgcagcagcagcagcagcaacaacagctggcgcagatgaagcttccttcttcttcaacgtggggccagcagtccaatacaacagcatgtcagtcccaggccacgctgtcgttggctgaaatccaaaaactagaggaagaacgagaacggcagcttcgagaagagcaaaggcgccagcagagggagttgatgaaagctcttcagcagcagcagcagcagcaacagcagaaactctcaggttgggggaatgtcagcaaaccttcaggtaccacgaaatctcttctggagatccagcaggaagaggccaggcaaatgcaaaagcagcagcagcagcagcagcaacaccagcaaccaaacagagctcgtaacaatacgcattccaacctgcacaccagcattgggaattctgtttggggctctataaatactggtcctcctaaccagtgggcatctgacctagtcagtagtatttggagtaatgctgacactaaaaactccaacatgggattctgggatgatgcagtgaaagaggtgggacctaggaattcaacaaataaaaataaaaacaacgccagtctcagtaaatctgtaggtgtgtctaaccggcagaataagaaagtagaagaagaagaaaagttgctgaagctctttcagggagtaaataaagcccaagatggatttacgcagtggtgtgaacagatgcttcatgcccttaatacggcaaataacttggatgttcccacatttgtttctttcctgaaagaagtagaatctccttatgaggtccatgattatatcagggcctatttaggagatacttctgaggccaaggagtttgccaagcagttccttgagcgccgtgccaaacagaaagccaaccagcagcgtcagcagcagcagctgccgcagcagcagcagcagccaccacagcagccgccacagcagccacaacagcaggactctgtgtgggggatgaaccacagtacactccattcagtatttcagaccaatcaaagcaacaaccaacaatccaattttgaggctgtgcagagtggcaagaagaagaaaaagcagaagatggtccgagcagatcccagtttattaggattttcagtcaatgcatcatcggagcgactcaacatgggtgaaatcgagacgttggatgactactgagcacctgccagtggactggccatccctctcctgtctgccgactatggagtctccacctttggacacaacacttactcaccatttactctttatcactctgcaacaaatcacagaaccgatcatctcaggctttttcttctggccctttgtgtccaagattctttaatccatttttgttggtgaacatctcagactatagataagtggactggaccctgtgtcttgggggtggcagttgggattactccccaacaaggctgattttaggcagcatgtgttcactgtgctgtgatttcatctactgtctcccagaaagtgtgttgggatcggccattagcagcttgctttctcttgtcactttttttcttctattttgttttttcttcttctttttccccccatcagggcaaatggtctaactggtgcaatcatgaagagagttaatggttaacagacattggccaataacaaaacaccccatggactgtgactcgagtatccaacaggcagtcagagctctcccggtctgaaagttgcattgccactgctaactttgggattgcatcagagaggccctgagtggggttgagatgaggttggtttggtttgatgttacacactcctcacctgttctttctgagtgtcctttctctgaaaggatttatgtttttcttcgttagatagtgacttctgagcaagctgatctcccctggcatgctccaacctgattggacaaaggaagctctatggcctgggagagagactattcttaatttttctttcttacaaaaactgatttttcccataaatatttttacttcagaggactaggaccattttgttttgggcccttctgctgaaaatttgtctcgtttaagaggcagctagaatctttaccatatgtatgaatttgtataatttcatttttggatagggataaacttttgcttctgataaaagcctggaatttcatctggtcctcagagcattgcgtgtgtgtcttgctgtagcccggaaaaggttttgtgtaaagattctgggatggcaagttgtttgccttttctgaaaagagaacatacagaacctgtccatctttaagaccttcatccatggaatctactatacaggaggatgcagtgggctggaggggatgggcgaaaatgggagcaggaagcctggcctggcttctggtcatggcctcctaaaaccttaaacttcaagtagaaatgtactcaagccctatttataaacaaatacttttcctgcctccaccaaacccctacagaacatcacctggaattgccactcacactgggttggagtcattgggcagctgtgcctgtgcgagaggtgctgtggtctgggcagcccctggaaaagcacctttgctgcctgtcattgttgcctgaagaaggctggagttgctctgagagcagtttgggtttggagtattatatttggcttctatttttattattttggatcaccattctccctatcccttcttgcctccctcccttctaaacatgtgtaataactatacagagactgctacaaaattgtatatagtttttggatcaaatagcatgaggggagaggaaaccattaaaaattggggctcctaaaaaaaaataaaataaaaagggggggggcaaaaaatttcctggaaggggcagtaagcgatcccgttttggaaaggggccctaaaggggcataaataaacagagggggggttaaacgcttgggtggacaggtatgggcttg

SEQ ID NO: 372424 - DNA, 4954 bp, Homo sapiens
gcggtcacgtgacgtgcgtggcgacgtgtcggccatcttgtgttgttgaggctgaggactgactggggttctgagactccctgtcccggaccgcagattatagtgggaccagtctcattaggttgaatctacagcctatgttggtgttaacccaggtctcttagagcgttaaaaggatctgaacaaagtctgctcaaatctcctgctgtgaaccagcagaatttttgaacagagaccacgtctccacctcctgggctccaacgattctcccatcttggcctcccaaagcgctggatttacaggtttcttcacatataaaaatctattgtaaaaatacggaaaagaatggcagcggaaacgcagacactgaactttgggcctgaatggctccgagctctgtccagtggtgggagtattacatcccctcctctttctccagcattgccgaagtataaattagcagattatcgttacggcagagaagaaatgttagcacttttccttaaagacaacaagataccttcagaccttctggataaagaatttctgcctatcctccaggaggaaccccttccaccattggctctggtaccctttacagaagaagaacagagaaacttttccatgtctgtaaatagtgctgctgtcctgcgattgacaggacgaggaggaggaggaacagtggtgggggctcctagaggtcgaagttcttcaagagggcgaggcagaggcagaggtgaatgtggtttctaccaaagaagttttgatgaagtagagggtgtttttggtcgaggaggtggcagagaaatgcatagatcgcagagctgggaggaaaggggtgacagacgttttgaaaaaccaggacgaaaagatgtagggagaccaaattttgaggaaggtggaccaacatcagtagggagaaagcatgaatttatacgctcagaaagtgaaaattggcgcatctttagagaggaacaaaatggagaagatgaagatggaggttggcgactagctggatcaaggagggatggagagaggtggcgacctcacagtcctgatggccctcgttctgcaggctggcgggaacacatggaacgacgtcggaggtttgagtttgattttcgagatagagatgatgaacggggttaccgaagggttcgctctggcagtgggagcatagatgatgacagggatagcttgcccgaatggtgcttagaggatgctgaagaagaaatgggtacatttgactcatctggagcattcctttctctaaaaaaagtacagaaagagcctattccagaagagcaggagatggacttccggcctgtggacgaaggggaggagtgctctgactctgagggtagccataatgaagaggccaaagaacccgataagacaaataagaaagaaggagagaaaacagatagagtaggagttgaagctagtgaggaaactccccagacctcatcatcatctgctagaccaggtactccttcagaccatcagtctcaggaagcatcacagtttgagaggaaagatgaaccaaaaactgagcaaacggaaaaagctgaagaggagactcggatggaaaatagtctaccagccaaagtgcccagcagaggggatgaaatggttgctgatgtccagcagcccctgtcgcagattccttcagatacagcctctcctcttctcatacttccacctcctgttcccaatcctagtcctactctccggccagttgaaacaccagttgtaggtgctcctggtatgggcagtgtttccacagaacctgatgatgaagaaggtctcaaacatttggagcagcaagctgagaaaatggtggcttatctccaagacagtgcactagatgatgaaagattggcatcaaaactgcaagagcacagagctaaaggagtgtcgattccattgatgcatgaagcaatgcagaagtggtattacaaagatcctcagggagaaattcaaggtcccttcaataatcaggagatggcagaatggtttcaggcgggctattttactatgtctttattggtgaagagagcgtgtgatgaaagcttccaacctcttggcgatatcatgaaaatgtggggaagggttcccttttctccaggtccagctccccctcctcatatgggagagctggaccaggaacgactgaccaggcagcaagaactcacagccttataccagatgcagcacctgcagtaccagcagtttttaatacaacaacaatatgcacaggttttggcccaacagcagaaagcagcactgtcttcccagcagcagcagcagttggcacttcttcttcaacagtttcagaccttgaagatgagaatatctgatcagaacatcattccctcagtaactaggtctgtgtccgtgccagatactggctctatctgggagcttcagccaacagcttcacagcctacagtttgggaaggtggtagtgtatgggatcttcctctggacaccacgacaccaggccctgccctggaacagcttcagcagctagagaaggccaaagctgcaaagctagagcaagagagaagagaggcagaaatgagggcaaaacgggaagaggaagagcgaaagaggcaggaagaactccgaagacaacaggaggaaattcttcggcgacagcaggaagaagaaaggaaaaggcgagaggaagaagaacttgcccgaaggaaacaggaagaggctctgcgtcgccagcgggagcaagaaattgcattaaggcgacagcgagaagaggaagaaagacagcagcaagaagaagctcttagaagactggaagagaggagaagagaagaggaagaaaggcggaagcaggaagaattgttacgcaaacaggaagaggaggctgcaaaatgggcccgggaagaagaagaagcccagcgtcgattagaggagaaccggctgcggatggaagaggaggcagccagactccggcatgaggaagaagaacggaagagaaaggagctggaggtccagcggcagaaggagttaatgcgccagaggcagcagcagcaagaggctctccggaggttgcagcagcagcagcagcaacaacagctggcgcagatgaagcttccttcttcttcaacgtggggccagcagtccaatacaacagcatgtcagtcccaggccacgctgtcgttggctgaaatccaaaaactagaggaagaacgagaacggcagcttcgagaagagcaaaggcgccagcagagggagttgatgaaagctcttcagcagcagcagcagcagcaacagcagaaactctcaggttgggggaatgtcagcaaaccttcaggtaccacgaaatctcttctggagatccagcaggaagaggccaggcaaatgcaaaagcagcagcagcagcagcagcaacaccagcaaccaaacagagctcgtaacaatacgcattccaacctgcacaccagcattgggaattctgtttggggctctataaatactggtcctcctaaccagtgggcatctgacctagtcagtagtatttggagtaatgctgacactaaaaactccaacatgggattctgggatgatgcagtgaaagaggtgggacctaggaattcaacaaataaaaataaaaacaacgccagtctcagtaaatctgtaggtgtgtctaaccggcagaataagaaagtagaagaagaagaaaagttgctgaagctctttcagggagtaaataaagcccaagatggatttacgcagtggtgtgaacagatgcttcatgcccttaatacggcaaataacttggatgttcccacatttgtttctttcctgaaagaagtagaatctccttatgaggtccatgattatatcagggcctatttaggagatacttctgaggccaaggagtttgccaagcagttccttgagcgccgtgccaaacagaaagccaaccagcagcgtcagcagcagcagctgccgcagcagcagcagcagccaccacagcagccgccacagcagccacaacagcaggactctgtgtgggggatgaaccacagtacactccattcagtatttcagaccaatcaaagcaacaaccaacaatccaattttgaggctgtgcagagtggcaagaagaagaaaaagcagaagatggtccgagcagatcccagtttattaggattttcagtcaatgcatcatcggagcgactcaacatgggtgaaatcgagacgttggatgactactgagcacctgccagtggactggccatccctctcctgtctgccgactatggagtctccacctttggacacaacacttactcaccatttactctttatcactctgcaacaaatcacagaaccgatcatctcaggctttttcttctggccctttgtgtccaagattctttaatccatttttgttggtgaacatctcagactatagataagtggactggaccctgtgtcttgggggtggcagttgggattactccccaacaaggctgattttaggcagcatgtgttcactgtgctgtgatttcatctactgtctcccagaaagtgtgttgggatcggccattagcagcttgctttctcttgtcactttttttcttctattttgttttttcttcttctttttccccccatcagggcaaatggtctaactggtgcaatcatgaagagagttaatggttaacagacattggccaataacaaaacaccccatggactgtgactcgagtatccaacaggcagtcagagctctcccggtctgaaagttgcattgccactgctaactttgggattgcatcagagaggccctgagtggggttgagatgaggttggtttggtttgatgttacacactcctcacctgttctttctgagtgtcctttctctgaaaggatttatgtttttcttcgttagataatgtatagccaagatcctcgagagcaact

SEQ ID NO: 372425 - DNA, 4680 bp, Homo sapiens
  misc_feature (4300)..(4300): n is a, c, g, or t
  misc_feature (4364)..(4364): n is a, c, g, or t
gcggtcacgtgacgtgcgtggcgacgtgtcggccatcttgtgttgttgaggctgaggactgactggggttctgagactccctgtcccggaccgcagattatagtgggaccagtctcattaggttgaatctacagcctatgttggtgttaacccaggtctcttagagcgttaaaaggatctgaacaaagtctgctcaaatctcctgctgtgaaccagcagaatttttgaacagagaccacgtctccacctcctgggctccaacgattctcccatcttggcctcccaaagcgctggatttacaggtttcttcacatataaaaatctattgtaaaaatacggaaaagaatggcagcggaaacgcagacactgaactttgggcctgaatggctccgagctctgtccagtggtgggagtattacatcccctcctctttctccagcattgccgaagtataaattagcagattatcgttacggcagagaagaaatgttagcacttttccttaaagacaacaagataccttcagaccttctggataaagaatttctgcctatcctccaggaggaaccccttccaccattggctctggtaccctttacagaagaagaacagagaaacttttccatgtctgtaaatagtgctgctgtcctgcgattgacaggacgaggaggaggaggaacagtggtgggggctcctagaggtcgaagttcttcaagagggcgaggcagaggcagaggtgaatgtggtttctaccaaagaagttttgatgaagtagagggtgtttttggtcgaggaggtggcagagaaatgcatagatcgcagagctgggaggaaaggggtgacagacgttttgaaaaaccaggacgaaaagatgtagggagaccaaattttgaggaaggtggaccaacatcagtagggagaaagcatgaatttatacgctcagaaagtgaaaattggcgcatctttagagaggaacaaaatggagaagatgaagatggaggttggcgactagctggatcaaggagggatggagagaggtggcgacctcacagtcctgatggccctcgttctgcaggctggcgggaacacatggaacgacgtcggaggtttgagtttgattttcgagatagagatgatgaacggggttaccgaagggttcgctctggcagtgggagcatagatgatgacagggatagcttgcccgaatggtgcttagaggatgctgaagaagaaatgggtacatttgactcatctggagcattcctttctctaaaaaaagtacagaaagagcctattccagaagagcaggagatggacttccggcctgtggacgaaggggaggagtgctctgactctgagggtagccataatgaagaggccaaagaacccgataagacaaataagaaagaaggagagaaaacagatagagtaggagttgaagctagtgaggaaactccccagacctcatcatcatctgctagaccaggtactccttcagaccatcagtctcaggaagcatcacagtttgagaggaaagatgaaccaaaaactgagcaaacggaaaaagctgaagaggagactcggatggaaaatagtctaccagccaaagtgcccagcagaggggatgaaatggttgctgatgtccagcagcccctgtcgcagattccttcagatacagcctctcctcttctcatacttccacctcctgttcccaatcctagtcctactctccggccagttgaaacaccagttgtaggtgctcctggtatgggcagtgtttccacagaacctgatgatgaagaaggtctcaaacatttggagcagcaagctgagaaaatggtggcttatctccaagacagtgcactagatgatgaaagattggcatcaaaactgcaagagcacagagctaaaggagtgtcgattccattgatgcatgaagcaatgcagaagtggtattacaaagatcctcagggagaaattcaaggtcccttcaataatcaggagatggcagaatggtttcaggcgggctattttactatgtctttattggtgaagagagcgtgtgatgaaagcttccaacctcttggcgatatcatgaaaatgtggggaagggttcccttttctccaggtccagctccccctcctcatatgggagagctggaccaggaacgactgaccaggcagcaagaactcacagccttataccagatgcagcacctgcagtaccagcagtttttaatacaacaacaatatgcacaggttttggcccaacagcagaaagcagcactgtcttcccagcagcagcagcagttggcacttcttcttcaacagtttcagaccttgaagatgagaatatctgatcagaacatcattccctcagtaactaggtctgtgtccgtgccagatactggctctatctgggagcttcagccaacagcttcacagcctacagtttgggaaggtggtagtgtatgggatcttcctctggacaccacgacaccaggccctgccctggaacagcttcagcagctagagaaggccaaagctgcaaagctagagcaagagagaagagaggcagaaatgagggcaaaacgggaagaggaagagcgaaagaggcaggaagaactccgaagacaacaggaggaaattcttcggcgacagcaggaagaagaaaggaaaaggcgagaggaagaagaacttgcccgaaggaaacaggaagaggctctgcgtcgccagcgggagcaagaaattgcattaaggcgacagcgagaagaggaagaaagacagcagcaagaagaagctcttagaagactggaagagaggagaagagaagaggaagaaaggcggaagcaggaagaattgttacgcaaacaggaagaggaggctgcaaaatgggcccgggaagaagaagaagcccagcgtcgattagaggagaaccggctgcggatggaagaggaggcagccagactccggcatgaggaagaagaacggaagagaaaggagctggaggtccagcggcagaaggagttaatgcgccagaggcagcagcagcaagaggctctccggaggttgcagcagcagcagcagcaacaacagctggcgcagatgaagcttccttcttcttcaacgtggggccagcagtccaatacaacagcatgtcagtcccaggccacgctgtcgttggctgaaatccaaaaactagaggaagaacgagaacggcagcttcgagaagagcaaaggcgccagcagagggagttgatgaaagctcttcagcagcagcagcagcagcaacagcagaaactctcaggttgggggaatgtcagcaaaccttcaggtaccacgaaatctcttctggagatccagcaggaagaggccaggcaaatgcaaaagcagcagcagcagcagcagcaacaccagcaaccaaacagagctcgtaacaatacgcattccaacctgcacaccagcattgggaattctgtttggggctctataaatactggtcctcctaaccagtgggcatctgacctagtcagtagtatttggagtaatgctgacactaaaaactccaacatgggattctgggatgatgcagtgaaagaggtgggacctaggaattcaacaaataaaaataaaaacaacgccagtctcagtaaatctgtaggtgtgtctaaccggcagaataagaaagtagaagaagaagaaaagttgctgaagctctttcagggagtaaataaagcccaagatggatttacgcagtggtgtgaacagatgcttcatgcccttaatacggcaaataacttggatgttcccacatttgtttctttcctgaaagaagtagaatctccttatgaggtccatgattatatcagggcctatttaggagatacttctgaggccaaggagtttgccaagcagttccttgagcgccgtgccaaacagaaagccaaccagcagcgtcagcagcagcagctgccgcagcagcagcagcagccaccacagcagccgccacagcagccacaacagcaggactctgtgtgggggatgaaccacagtacactccattcagtatttcagcagctagagaaggccaaagctgcaaagctagagcaagagagaagagaggcagaaatgagggcaaaacgggaagaggaagagcgaaagaggcaggaagatctccgaagacaacaggaggaaattcttcggcgacagcaggaagaagaaaggaaatggcgagaggaagaagaacttgcccgaaggaaacaggaagaggctcttcgtcgccagcgggagcaagaaattncattaaggcgacagcgagaagaggaagaaagacagcagcaagaagaagctcttagaagactggnagagaggagaagagaagaggaagaaaggcggaagcaggaagaattgttacgcaaacaggaagaggggcgtccccagctccgtcaaacagccctttctgtttctggagtcctacaagtggaggcccaaatccgttcccatgttgaggcaaggccctggctgttccttcctctctggaaaccgccttgaactcttcctttgggacatgcctcctcgaccagccttgaaggggtgctcctctctcactacctggaaccaaacacccccttcctttgtgtacaagggcaataaagagtagaccttcatcttctttatttt

SEQ ID NO: 372426 - DNA, 2438 bp, Homo sapiens
  misc_feature (43)..(44): n is a, c, g, or t
ccgctgagatgacagtcggcattagctctagactggatcagcnntgttgccacaaaataagctaatacaggctcagtactaaatctgtaggtgtgtctaaccggcagaataagaaagtagaagaagaagaaaagttgctgaagctctttcagggagtaaataaagcccaagatggatttacgcagtggtgtgaacagatgcttcatgcccttaatacggcaaataacttggatgttcccacatttgtttctttcctgaaagaagtagaatctccttatgaggtccatgattatatcagggcctatttaggagatacttctgaggccaaggagtttgccaagcagttccttgagcgccgtgccaaacagaaagccaaccagcagcgtcagcagcagcagctgccgcagcagcagcagcagccaccacagcagccgccacagcagccacaacagcaggactctgtgtgggggatgaaccacagtacactccattcagtatttcagaccaatcaaagcaacaaccaacaatccaattttgaggctgtgcagagtggcaagaagaagaaaaagcagaagatggtccgagcagatcccagtttattaggattttcagtcaatgcatcatcggagcgactcaacatgggtgaaatcgagacgttggatgactactgagcacctgccagtggactggccatccctctcctgtctgccgactatggagtctccacctttggacacaacacttactcaccatttactctttatcactctgcaacaaatcacagaaccgatcatctcaggctttttcttctggccctttgtgtccaagattctttaatccatttttgttggtgaacatctcagactatagataagtggactggaccctgtgtcttgggggtggcagttgggattactccccaacaaggctgattttaggcagcatgtgttcactgtgctgtgatttcatctactgtctcccagaaagtgtgttgggatcggccattagcagcttgctttctcttgtcactttttttcttctattttgttttttcttcttctttttccccccatcagggcaaatggtctaactggtgcaatcatgaagagagttaatggttaacagacattggccaataacaaaacaccccatggactgtgactcgagtatccaacaggcagtcagagctctcccggtctgaaagttgcattgccactgctaactttgggattgcatcagagaggccctgagtggggttgagatgaggttggtttggtttgatgttacacactcctcacctgttctttctgagtgtcctttctctgaaaggatttatgtttttcttcgttagatagtgacttctgagcaagctgatctcccctggcatgctccaacctgattggacaaaggaagctctatggcctgggagagagactattcttaatttttctttcttacaaaaactgatttttcccataaatatttttacttcagaggactaggaccattttgttttgggcccttctgctgaaaatttgtctcgtttaagaggcagctagaatctttaccatatgtatgaatttgtataatttcatttttggatagggataaacttttgcttctgataaaagcctggaatttcatctggtcctcagagcattgcgtgtgtgtcttgctgtagcccggaaaaggttttgtgtaaagattctgggatggcaagttgtttgccttttctgaaaagagaacatacagaacctgtccatctttaagaccttcatccatggaatctactatacaggaggatgcagtgggctggaggggatgggcgaaaatgggagcaggaagcctggcctggcttctggtcatggcctcctaaaaccttaaacttcaagtagaaatgtactcaagccctatttataaacaaatacttttcctgcctccaccaaacccctacagaacatcacctggaattgccactcacactgggttggagtcattgggcagctgtgcctgtgcgagaggtgctgtggtctgggcagcccctggaaaagcacctttgctgcctgtcattgttgcctgaagaaggctggagttgctctgagagcagtttgggtttggagtattatatttggcttctatttttattattttggatcaccattctccctatcccttcttgcctccctcccttctaaacatgtgtaataactatacagagactgctacaaaattgtatatagtttttggatcaaatagcatgaggggagaggaaaccattaaaaattggggctcctactctcctttgctttgtaaattcaaaagttgggggtgggtaagagggatagttaaaatgtttacaaaactttaggctccctcggaacttttgccagtgtggaggaaaataaaaaagaacttaaataaaatctgattgtattcta

SEQ ID NO: 372427 - DNA, 1842 bp, Homo sapiens
caacgtctcgatttcacccatgttgagtcgctccgatgatgcatgggtgaaatcgagacgttggatgactactgagcacctgccagtggactggccatccctctcctgtctgccgactatggagtctccacctttggacacaacacttactcaccatttactctttatcactctgcaacaaatcacagaaccgatcatctcaggctttttcttctggccctttgtgtccaagattctttaatccatttttgttggtgaacatctcagactatagataagtggactggaccctgtgtcttgggggtggcagttgggattactccccaacaaggctgattttaggcagcatgtgttcactgtgctgtgatttcatctactgtctcccagaaagtgtgttgggatcggccattagcagcttgctttctcttgtcactttttttcttctattttgttttttcttcttctttttccccccatcagggcaaatggtctaactggtgcaatcatgaagagagttaatggttaacagacattggccaataacaaaacaccccatggactgtgactcgagtatccaacaggcagtcagagctctcccggtctgaaagttgcattgccactgctaactttgggattgcatcagagaggccctgagtggggttgagatgaggttggtttggtttgatgttacacactcctcacctgttctttctgagtgtcctttctctgaaaggatttatgtttttcttcgttagatagtgacttctgagcaagctgatctcccctggcatgctccaacctgattggacaaaggaagctctatggcctgggagagagactattcttaatttttctttcttacaaaaactgatttttcccataaatatttttacttcagaggactaggaccattttgttttgggcccttctgctgaaaatttgtctcgtttaagaggcagctagaatctttaccatatgtatgaatttgtataatttcatttttggatagggataaacttttgcttctgataaaagcctggaatttcatctggtcctcagagcattgcgtgtgtgtcttgctgtagcccggaaaaggttttgtgtaaagattctgggatggcaagttgtttgccttttctgaaaagagaacatacagaacctgtccatctttaagaccttcatccatggaatctactatacaggaggatgcagtgggctggaggggatgggcgaaaatgggagcaggaagcctggcctggcttctggtcatggcctcctaaaaccttaaacttcaagtagaaatgtactcaagccctatttataaacaaatacttttcctgcctccaccaaacccctacagaacatcacctggaattgccactcacactgggttggagtcattgggcagctgtgcctgtgcgagaggtgctgtggtctgggcagcccctggaaaagcacctttgctgcctgtcattgttgcctgaagaaggctggagttgctctgagagcagtttgggtttggagtattatatttggcttctatttttattattttggatcaccattctccctatcccttcttgcctccctcccttctaaacatgtgtaataactatacagagactgctacaaaattgtatatagtttttggatcaaatagcatgaggggagaggaaaccattaaaaattggggctcctactctcctttgctttgtaaattcaaaagttgggggtgggtaagagggatagttaaaatgtttacaaaactttaggctccctcggaacttttgccagtgtggaggaaaataaaaaagaacttaaataaaatctgattgtattcta

SEQ ID NO: 372428 - DNA, 1155 bp, Homo sapiens
tcgcgacgtgtatctctccggcttgcctctgtcctttctctgaaaggatttatgtttttcttcgttagatagtgacttctgagcaagctgatctcccctggcatgctccaacctgattggacaaaggaagctctatggcctgggagagagactattcttaatttttctttcttacaaaaactgatttttcccataaatatttttacttcagaggactaggaccattttgttttgggcccttctgctgaaaatttgtctcgtttaagaggcagctagaatctttaccatatgtatgaatttgtataatttcatttttggatagggataaacttttgcttctgataaaagcctggaatttcatctggtcctcagagcattgcgtgtgtgtcttgctgtagcccggaaaaggttttgtgtaaagattctgggatggcaagttgtttgccttttctgaaaagagaacatacagaacctgtccatctttaagaccttcatccatggaatctactatacaggaggatgcagtgggctggaggggatgggcgaaaatgggagcaggaagcctggcctggcttctggtcatggcctcctaaaaccttaaacttcaagtagaaatgtactcaagccctatttataaacaaatacttttcctgcctccaccaaacccctacagaacatcacctggaattgccactcacactgggttggagtcattgggcagctgtgcctgtgcgagaggtgctgtggtctgggcagcccctggaaaagcacctttgctgcctgtcattgttgcctgaagaaggctggagttgctctgagagcagtttgggtttggagtattatatttggcttctatttttattattttggatcaccattctccctatcccttcttgcctccctcccttctaaacatgtgtaataactatacagagactgctacaaaattgtatatagtttttggatcaaatagcatgaggggagaggaaaccattaaaaattggggctcctactctcctttgctttgtaaattcaaaagttgggggtgggtaagagggatagttaaaatgtttacaaaactttaggctccctcggaacttttgccagtgtggaggaaaataaaaaagaacttaaataaaatctgattgtattcta

SEQ ID NO: 372429 - DNA, 1132 bp, Homo sapiens
gcggtcacgtgacgtgcgtggcgacgtgtcggccatcttgtgttgttgaggctgaggactgactggggttctgagactccctgtcccggaccgcagcgttaaaaggatctgaacaaagtctgctcaaatctcctgctgtgaaccagcagaatttttgaacaggctggagcacagtggcgtgatctcggctcactgcaaactctgccttcgagcaattcttctgcctcagcctcccgagtagatgggattacaggtttcttcacatataaaaatctattgtaaaaatacggaaaagaatggcagcggaaacgcagacactgaactttgggcctgaatgatgtgtttggaccccgaatatggaattctcatggaattttgagatccatcacattgtagtgtggcttccccccctcccctccttcctttttccccaaagttggtgattgaagatcctctcttcagtggcatcaataataataattactttttctattcaaacctcgggcaacccctttggtaatatcagaagtagtatctaaaatagataaattggatttgtgtcttaaactcttggttgttcaggtgggagtggttcaataaatgatgcagacttcctgtagtaactctatttgaggagtcttattaacttatcctattagaaatatttctttttattaatatatgtaatctcgaagttttcttaacctttatagccagcatttggagactgaggagaaatcactatttgaagttctaagaaccgatggaactcctgtattttgagagtttatttagaacatgttaacctaagtaatgctgtacttgttttagttattcctttatatttttaaaatgattttcttagtatcaaattaatatgtttctaaaaaaattagaaataactagtaagccagaaataatttcaacatccatggtacacactgtaaataccttggtgtatctttccaggtggttttatgtatgcttatttgtgtatatatacacttattttttacaaaaatgggatcatactgtaccttcagttttgtagcctgcttaaagaaataaccaaatcagaaacatctttttttaatcaataaatattttctgttgtattaaatggttgcattgt

SEQ ID NO: 372430 - DNA, 1739 bp, Homo sapiens
gcggtcacgtgacgtgcgtggcgacgtgtcggccatcttgtgttgttgaggctgaggactgactggggttctgagactccctgtcccggaccgcagattatagtgggaccagtctcattaggttgaatctacagcctatgttggtgttaacccaggtctcttagagcgttaaaaggatctgaacaaagtctgctcaaatctcctgctgtgaaccagcagaatttttgaacagagaccacgtctccacctcctgggctccaacgattctcccatcttggcctcccaaagcgctggatttacaggtttcttcacatataaaaatctattgtaaaaatacggaaaagaatggcagcggaaacgcagacactgaactttgggcctgaatggctccgagctctgtccagtggtgggagtattacatcccctcctctttctccagcattgccgaagtataaattagcagattatcgttacggcagagaagaaatgttagcacttttccttaaagacaacaagataccttcagaccttctggataaagaatttctgcctatcctccaggaggaaccccttccaccattggctctggtaccctttacagaagaagaacagagaaacttttccatgtctgtaaatagtgctgctgtcctgcgattgacaggacgaggaggaggaggaacagtggtgggggctcctagaggtcgaagttcttcaagagggcgaggcagaggcagaggtgaatgtggtttctaccaaagaagttttgatgaagtagagggtgtttttggtcgaggaggtggcagagaaatgcatagatcgcagagctgggaggaaaggggtgacagacgttttgaaaaaccaggacgaaaagatgtagggagaccaaattttgaggaaggtggaccaacatcagtagggagaaagcatgaatttatacgctcagaaagtgaaaattggcgcatctttagagaggaacaaaatggagaagatgaagatggaggttggcgactagctggatcaaggagggatggagagaggtggcgacctcacagtcctgatggccctcgttctgcaggctggcgggaacacatggaacgacgtcggaggtttgagtttgattttcgagatagagatgatgaacggggttaccgaagggttcgctctggcagtgggagcatagatgatgacagggatagcttgcccgaatggtgcttagaggatgctgaagaagaaatgggtacatttgactcatctggagcattcctttctctaaaaaaagtacagaaagagcctattccagaagagcaggagatggacttccggcctgtggacgaaggggaggagtgctctgactctgagggtagccataatgaagaggccaaagatgcagataaactcgcaaacatgggaaaataacagagcagaaaaagtgaaaactaaaaatcagagtgcctctcctcctccaaaggaacgcagctcctcaccagcaacagaacaaagctggacggagaatgactttgattagttgagagaggaaggcttcagacaatcaaactactctgagctacaggaggaaatacgaaacaatagcaaagaagtaaaaagctttgaaaaaaattagacgaatggataactagaataactaatgcagacaagtccttaaaggacctgatggagctgaaaaccaaggcatgagagagaaacgtgacaaatgcagaagactcaggagccaatgtgat

SEQ ID NO: 372431 - DNA, 654 bp, Homo sapiens
gcggtcacgtgacgtgcgtggcgacgtgtcggccatcttgtgttgttgaggctgaggactgactggggttctgagactccctgtcccggaccgcagtcaaagcacttaaacacacgtagtctctctgtaagaaagcgttaaaaggatctgaacaaagtctgctcaaatctcctgctgtgaaccagcagaatttttgaacagagactgtctcgctctgtcacccaggctagagtgcagtggtgctatcgtaactcactggagccctgatctaggctcaaaccatcctcccacctcagcctcccaagtagctgggactaaggtttcttcacatataaaaatctattgtaaaaatacggaaaagaatggcagcggaaacgcagacactgaactttgggcctgaatggtgagttttcaaaatctcatcttctttgatattggatgactaatacagtagtaaagtatttgacaggtgctaggtggtttataaatgtgcatgtttttgaaacttttgctttatgtgcctcgctgaaaacaatgtgttagttcaggaataaattatatttggtaaatgagtgtattctatacttaattaaaattttttttctttgtctggttatatatgtaatgatggcgggagtcccacccgccctagaa

SEQ ID NO: 372432 - DNA, 218 bp, Homo sapiens
gccgcttggttgcctgggtgtggtcactcatagccagttttttttctgcaggattttcagtcaatgcatcatcggagcgactcaacatgggtgaaatcgagacgttggatgactactgagcacctgccagtggactggccatccctctcctgtctgccgactatggagtctccacctttggacacaacacttactcaccatttactctttatcactct

SEQ ID NO: 372433 - DNA, 151 bp, Homo sapiens
tagccataatgaagaggccaaagaacccgataagacaaataagaaagaaggagagaaaacagatagagtaggagttggtaaggcctcttcttgccctttgccttttttttcctccatcaaaccaaaactttcgtaagttcaactaagatta

SEQ ID NO: 372434 - DNA, 463 bp, Homo sapiens
gtcaacctgtaactgggtagatgctctggtgacacaggtaagccctggagaagcaccttttagataccttttaactcttaccttttgtcattctgtgtaggtaattttgtcactctaggaaggaatattacgtttctccatagaagtagcttcactgttcatgacagggctcacgttttctgtttggcccatttagcaggctgtgcgacttgataatgtagttagccttcacagaagtctctgtatttcaaaggattttcatctgattttttccccctagaaatggttgctgatgtccagcagcccctgtcgcagattccttcagatacagcctctcctcttctcatacttccacctcctgttcccaatcctagtcctactctccggccagttgaaacaccagttgtaggtgctcctggtatgggcagtgtttccacagaacctgatgatgaagaaggtctca

SEQ ID NO: 372435 - DNA, 439 bp, Homo sapiens
aaagagatggagtctcactatgttgcccaatccagtcttgaactcctgggcccaagccgtctgcctggcttggcctcccaaattataaatttatttttatttgtttattttgtagagacagggtctcactccatcgtctaggatggagtgcagtggcaggaccacaactcactgcagccccaaactcctgggctcaagtgatccctccacctcaccctcccaggcagctaagactacaggcatgtaccaccatgcccagttgatctttaacatttcttttttttagagaccacgtctccacctcctgggctccaacgattctcccatcttggcctcccaaagcgctggatttacaggtatgagccaccttgcctggtggttcctggcctgatccaagataatttttaaaagaagcagtaggctcgagaggctgagacag

SEQ ID NO: 372436 - DNA, 518 bp, Homo sapiens
tctacggtagtgttttattgaacttcttagaatttcactattcaactgttcgttaaagaacttaaagttgatactttcttgttcaggactgggtctattgcattatattatgttagtttttttaacttgtttctttcagcctcttgtggtccagctacttcaatgccattgttggtctcataagtcaagatcatcaggcctcgttcagtatttaaatgtagatgtcctgccttgtatagagatagaactttagatattaatttatggtggtgaatgtgtgccacatgttgacatctgactatcatttttttctgttttcttattttcaggcagaggcagaggtgaatgtggtttctaccaaagaagttttgatgaagtagagggtgtttttggtcgaggaggtggcagagaaatgcatagatcgcagagctgggaggaaaggtaactggatccacatattggcataaaaatttcttggcatataaaacttatattttttgctttctgcggggagaaat

SEQ ID NO: 372437 - DNA, 6009 bp, Homo sapiens
gcggtcacgtgacgtgcgtggcgacgtgtcggccatcttgtgttgttgaggctgaggactgactggggttctgagactccctgtcccggaccgcagattatagtgggaccagtctcattaggttgaatctacagcctatgttggtgttaacccaggtctcttagagcgttaaaaggatctgaacaaagtctgctcaaatctcctgctgtgaaccagcagaatttttgaacagagaccacgtctccacctcctgggctccaacgattctcccatcttggcctcccaaagcgctggatttacaggtttcttcacatataaaaatctattgtaaaaatacggaaaagaatggcagcggaaacgcagacactgaactttgggcctgaatggctccgagctctgtccagtggtgggagtattacatcccctcctctttctccagcattgccgaagtataaattagcagattatcgttacggcagagaagaaatgttagcacttttccttaaagacaacaagataccttcagaccttctggataaagaatttctgcctatcctccaggaggaaccccttccaccattggctctggtaccctttacagaagaagaacagagaaacttttccatgtctgtaaatagtgctgctgtcctgcgattgacaggacgaggaggaggaggaacagtggtgggggctcctagaggtcgaagttcttcaagagggcgaggcagaggcagaggtgaatgtggtttctaccaaagaagttttgatgaagtagagggtgtttttggtcgaggaggtggcagagaaatgcatagatcgcagagctgggaggaaaggggtgacagacgttttgaaaaaccaggacgaaaagatgtagggagaccaaattttgaggaaggtggaccaacatcagtagggagaaagcatgaatttatacgctcagaaagtgaaaattggcgcatctttagagaggaacaaaatggagaagatgaagatggaggttggcgactagctggatcaaggagggatggagagaggtggcgacctcacagtcctgatggccctcgttctgcaggctggcgggaacacatggaacgacgtcggaggtttgagtttgattttcgagatagagatgatgaacggggttaccgaagggttcgctctggcagtgggagcatagatgatgacagggatagcttgcccgaatggtgcttagaggatgctgaagaagaaatgggtacatttgactcatctggagcattcctttctctaaaaaaagtacagaaagagcctattccagaagagcaggagatggacttccggcctgtggacgaaggggaggagtgctctgactctgagggtagccataatgaagaggccaaagaacccgataagacaaataagaaagaaggagagaaaacagatagagtaggagttgaagctagtgaggaaactccccagacctcatcatcatctgctagaccaggtactccttcagaccatcagtctcaggaagcatcacagtttgagaggaaagatgaaccaaaaactgagcaaacggaaaaagctgaagaggagactcggatggaaaatagtctaccagccaaagtgcccagcagaggggatgaaatggttgctgatgtccagcagcccctgtcgcagattccttcagatacagcctctcctcttctcatacttccacctcctgttcccaatcctagtcctactctccggccagttgaaacaccagttgtaggtgctcctggtatgggcagtgtttccacagaacctgatgatgaagaaggtctcaaacatttggagcagcaagctgagaaaatggtggcttatctccaagacagtgcactagatgatgaaagattggcatcaaaactgcaagagcacagagctaaaggagtgtcgattccattgatgcatgaagcaatgcagaagtggtattacaaagatcctcagggagaaattcaaggtcccttcaataatcaggagatggcagaatggtttcaggcgggctattttactatgtctttattggtgaagagagcgtgtgatgaaagcttccaacctcttggcgatatcatgaaaatgtggggaagggttcccttttctccaggtccagctccccctcctcatatgggagagctggaccaggaacgactgaccaggcagcaagaactcacagccttataccagatgcagcacctgcagtaccagcagtttttaatacaacaacaatatgcacaggttttggcccaacagcagaaagcagcactgtcttcccagcagcagcagcagttggcacttcttcttcaacagtttcagaccttgaagatgagaatatctgatcagaacatcattccctcagtaactaggtctgtgtccgtgccagatactggctctatctgggagcttcagccaacagcttcacagcctacagtttgggaaggtggtagtgtatgggatcttcctctggacaccacgacaccaggccctgccctggaacagcttcagcagctagagaaggccaaagctgcaaagctagagcaagagagaagagaggcagaaatgagggcaaaacgggaagaggaagagcgaaagaggcaggaagaactccgaagacaacaggaggaaattcttcggcgacagcaggaagaagaaaggaaaaggcgagaggaagaagaacttgcccgaaggaaacaggaagaggctctgcgtcgccagcgggagcaagaaattgcattaaggcgacagcgagaagaggaagaaagacagcagcaagaagaagctcttagaagactggaagagaggagaagagaagaggaagaaaggcggaagcaggaagaattgttacgcaaacaggaagaggaggctgcaaaatgggcccgggaagaagaagaagcccagcgtcgattagaggagaaccggctgcggatggaagaggaggcagccagactccggcatgaggaagaagaacggaagagaaaggagctggaggtccagcggcagaaggagttaatgcgccagaggcagcagcagcaagaggctctccggaggttgcagcagcagcagcagcaacaacagctggcgcagatgaagcttccttcttcttcaacgtggggccagcagtccaatacaacagcatgtcagtcccaggccacgctgtcgttggctgaaatccaaaaactagaggaagaacgagaacggcagcttcgagaagagcaaaggcgccagcagagggagttgatgaaagctcttcagcagcagcagcagcagcaacagcagaaactctcaggttgggggaatgtcagcaaaccttcaggtaccacgaaatctcttctggagatccagcaggaagaggccaggcaaatgcaaaagcagcagcagcagcagcagcaacaccagcaaccaaacagagctcgtaacaatacgcattccaacctgcacaccagcattgggaattctgtttggggctctataaatactggtcctcctaaccagtgggcatctgacctagtcagtagtatttggagtaatgctgacactaaaaactccaacatgggattctgggatgatgcagtgaaagaggtgggacctaggaattcaacaaataaaaataaaaacaacgccagtctcagtaaatctgtaggtgtgtctaaccggcagaataagaaagtagaagaagaagaaaagttgctgaagctctttcagggagtaaataaagcccaagatggatttacgcagtggtgtgaacagatgcttcatgcccttaatacggcaaataacttggatgttcccacatttgtttctttcctgaaagaagtagaatctccttatgaggtccatgattatatcagggcctatttaggagatacttctgaggccaaggagtttgccaagcagttccttgagcgccgtgccaaacagaaagccaaccagcagcgtcagcagcagcagctgccgcagcagcagcagcagccaccacagcagccgccacagcagccacaacagcaggactctgtgtgggggatgaaccacagtacactccattcagtatttcagaccaatcaaagcaacaaccaacaatccaattttgaggctgtgcagagtggcaagaagaagaaaaagcagaagatggtccgagcagatcccagtttattaggattttcagtcaatgcatcatcggagcgactcaacatgggtgaaatcgagacgttggatgactactgagcacctgccagtggactggccatccctctcctgtctgccgactatggagtctccacctttggacacaacacttactcaccatttactctttatcactctgcaacaaatcacagaaccgatcatctcaggctttttcttctggccctttgtgtccaagattctttaatccatttttgttggtgaacatctcagactatagataagtggactggaccctgtgtcttgggggtggcagttgggattactccccaacaaggctgattttaggcagcatgtgttcactgtgctgtgatttcatctactgtctcccagaaagtgtgttgggatcggccattagcagcttgctttctcttgtcactttttttcttctattttgttttttcttcttctttttccccccatcagggcaaatggtctaactggtgcaatcatgaagagagttaatggttaacagacattggccaataacaaaacaccccatggactgtgactcgagtatccaacaggcagtcagagctctcccggtctgaaagttgcattgccactgctaactttgggattgcatcagagaggccctgagtggggttgagatgaggttggtttggtttgatgttacacactcctcacctgttctttctgagtgtcctttctctgaaaggatttatgtttttcttcgttagatagtgacttctgagcaagctgatctcccctggcatgctccaacctgattggacaaaggaagctctatggcctgggagagagactattcttaatttttctttcttacaaaaactgatttttcccataaatatttttacttcagaggactaggaccattttgttttgggcccttctgctgaaaatttgtctcgtttaagaggcagctagaatctttaccatatgtatgaatttgtataatttcatttttggatagggataaacttttgcttctgataaaagcctggaatttcatctggtcctcagagcattgcgtgtgtgtcttgctgtagcccggaaaaggttttgtgtaaagattctgggatggcaagttgtttgccttttctgaaaagagaacatacagaacctgtccatctttaagaccttcatccatggaatctactatacaggaggatgcagtgggctggaggggatgggcgaaaatgggagcaggaagcctggcctggcttctggtcatggcctcctaaaaccttaaacttcaagtagaaatgtactcaagccctatttataaacaaatacttttcctgcctccaccaaacccctacagaacatcacctggaattgccactcacactgggttggagtcattgggcagctgtgcctgtgcgagaggtgctgtggtctgggcagcccctggaaaagcacctttgctgcctgtcattgttgcctgaagaaggctggagttgctctgagagcagtttgggtttggagtattatatttggcttctatttttattattttggatcaccattctccctatcccttcttgcctccctcccttctaaacatgtgtaataactatacagagactgctacaaaattgtatatagtttttggatcaaatagcatgaggggagaggaaaccattaaaaattggggctcctactctcctttgctttgtaaattcaaaagttgggggtgggtaagagggatagttaaaatgtttacaaaactttaggctccctcggaacttttgccagtgtggaggaaaataaaaaagaacttaaataaaatctgattgtattcta

SEQ ID NO: 372438 - DNA, 5869 bp, Homo sapiens
gcggtcacgtgacgtgcgtggcgacgtgtcggccatcttgtgttgttgaggctgaggactgactggggttctgagactccctgtcccggaccgcagcgttaaaaggatctgaacaaagtctgctcaaatctcctgctgtgaaccagcagaatttttgaacaggtttcttcacatataaaaatctattgtaaaaatacggaaaagaatggcagcggaaacgcagacactgaactttgggcctgaatggctccgagctctgtccagtggtgggagtattacatcccctcctctttctccagcattgccgaagtataaattagcagattatcgttacggcagagaagaaatgttagcacttttccttaaagacaacaagataccttcagaccttctggataaagaatttctgcctatcctccaggaggaaccccttccaccattggctctggtaccctttacagaagaagaacagagaaacttttccatgtctgtaaatagtgctgctgtcctgcgattgacaggacgaggaggaggaggaacagtggtgggggctcctagaggtcgaagttcttcaagagggcgaggcagaggcagaggtgaatgtggtttctaccaaagaagttttgatgaagtagagggtgtttttggtcgaggaggtggcagagaaatgcatagatcgcagagctgggaggaaaggggtgacagacgttttgaaaaaccaggacgaaaagatgtagggagaccaaattttgaggaaggtggaccaacatcagtagggagaaagcatgaatttatacgctcagaaagtgaaaattggcgcatctttagagaggaacaaaatggagaagatgaagatggaggttggcgactagctggatcaaggagggatggagagaggtggcgacctcacagtcctgatggccctcgttctgcaggctggcgggaacacatggaacgacgtcggaggtttgagtttgattttcgagatagagatgatgaacggggttaccgaagggttcgctctggcagtgggagcatagatgatgacagggatagcttgcccgaatggtgcttagaggatgctgaagaagaaatgggtacatttgactcatctggagcattcctttctctaaaaaaagtacagaaagagcctattccagaagagcaggagatggacttccggcctgtggacgaaggggaggagtgctctgactctgagggtagccataatgaagaggccaaagaacccgataagacaaataagaaagaaggagagaaaacagatagagtaggagttgaagctagtgaggaaactccccagacctcatcatcatctgctagaccaggtactccttcagaccatcagtctcaggaagcatcacagtttgagaggaaagatgaaccaaaaactgagcaaacggaaaaagctgaagaggagactcggatggaaaatagtctaccagccaaagtgcccagcagaggggatgaaatggttgctgatgtccagcagcccctgtcgcagattccttcagatacagcctctcctcttctcatacttccacctcctgttcccaatcctagtcctactctccggccagttgaaacaccagttgtaggtgctcctggtatgggcagtgtttccacagaacctgatgatgaagaaggtctcaaacatttggagcagcaagctgagaaaatggtggcttatctccaagacagtgcactagatgatgaaagattggcatcaaaactgcaagagcacagagctaaaggagtgtcgattccattgatgcatgaagcaatgcagaagtggtattacaaagatcctcagggagaaattcaaggtcccttcaataatcaggagatggcagaatggtttcaggcgggctattttactatgtctttattggtgaagagagcgtgtgatgaaagcttccaacctcttggcgatatcatgaaaatgtggggaagggttcccttttctccaggtccagctccccctcctcatatgggagagctggaccaggaacgactgaccaggcagcaagaactcacagccttataccagatgcagcacctgcagtaccagcagtttttaatacaacaacaatatgcacaggttttggcccaacagcagaaagcagcactgtcttcccagcagcagcagcagttggcacttcttcttcaacagtttcagaccttgaagatgagaatatctgatcagaacatcattccctcagtaactaggtctgtgtccgtgccagatactggctctatctgggagcttcagccaacagcttcacagcctacagtttgggaaggtggtagtgtatgggatcttcctctggacaccacgacaccaggccctgccctggaacagcttcagcagctagagaaggccaaagctgcaaagctagagcaagagagaagagaggcagaaatgagggcaaaacgggaagaggaagagcgaaagaggcaggaagaactccgaagacaacaggaggaaattcttcggcgacagcaggaagaagaaaggaaaaggcgagaggaagaagaacttgcccgaaggaaacaggaagaggctctgcgtcgccagcgggagcaagaaattgcattaaggcgacagcgagaagaggaagaaagacagcagcaagaagaagctcttagaagactggaagagaggagaagagaagaggaagaaaggcggaagcaggaagaattgttacgcaaacaggaagaggaggctgcaaaatgggcccgggaagaagaagaagcccagcgtcgattagaggagaaccggctgcggatggaagaggaggcagccagactccggcatgaggaagaagaacggaagagaaaggagctggaggtccagcggcagaaggagttaatgcgccagaggcagcagcagcaagaggctctccggaggttgcagcagcagcagcagcaacaacagctggcgcagatgaagcttccttcttcttcaacgtggggccagcagtccaatacaacagcatgtcagtcccaggccacgctgtcgttggctgaaatccaaaaactagaggaagaacgagaacggcagcttcgagaagagcaaaggcgccagcagagggagttgatgaaagctcttcagcagcagcagcagcagcaacagcagaaactctcaggttgggggaatgtcagcaaaccttcaggtaccacgaaatctcttctggagatccagcaggaagaggccaggcaaatgcaaaagcagcagcagcagcagcagcaacaccagcaaccaaacagagctcgtaacaatacgcattccaacctgcacaccagcattgggaattctgtttggggctctataaatactggtcctcctaaccagtgggcatctgacctagtcagtagtatttggagtaatgctgacactaaaaactccaacatgggattctgggatgatgcagtgaaagaggtgggacctaggaattcaacaaataaaaataaaaacaacgccagtctcagtaaatctgtaggtgtgtctaaccggcagaataagaaagtagaagaagaagaaaagttgctgaagctctttcagggagtaaataaagcccaagatggatttacgcagtggtgtgaacagatgcttcatgcccttaatacggcaaataacttggatgttcccacatttgtttctttcctgaaagaagtagaatctccttatgaggtccatgattatatcagggcctatttaggagatacttctgaggccaaggagtttgccaagcagttccttgagcgccgtgccaaacagaaagccaaccagcagcgtcagcagcagcagctgccgcagcagcagcagcagccaccacagcagccgccacagcagccacaacagcaggactctgtgtgggggatgaaccacagtacactccattcagtatttcagaccaatcaaagcaacaaccaacaatccaattttgaggctgtgcagagtggcaagaagaagaaaaagcagaagatggtccgagcagatcccagtttattaggattttcagtcaatgcatcatcggagcgactcaacatgggtgaaatcgagacgttggatgactactgagcacctgccagtggactggccatccctctcctgtctgccgactatggagtctccacctttggacacaacacttactcaccatttactctttatcactctgcaacaaatcacagaaccgatcatctcaggctttttcttctggccctttgtgtccaagattctttaatccatttttgttggtgaacatctcagactatagataagtggactggaccctgtgtcttgggggtggcagttgggattactccccaacaaggctgattttaggcagcatgtgttcactgtgctgtgatttcatctactgtctcccagaaagtgtgttgggatcggccattagcagcttgctttctcttgtcactttttttcttctattttgttttttcttcttctttttccccccatcagggcaaatggtctaactggtgcaatcatgaagagagttaatggttaacagacattggccaataacaaaacaccccatggactgtgactcgagtatccaacaggcagtcagagctctcccggtctgaaagttgcattgccactgctaactttgggattgcatcagagaggccctgagtggggttgagatgaggttggtttggtttgatgttacacactcctcacctgttctttctgagtgtcctttctctgaaaggatttatgtttttcttcgttagatagtgacttctgagcaagctgatctcccctggcatgctccaacctgattggacaaaggaagctctatggcctgggagagagactattcttaatttttctttcttacaaaaactgatttttcccataaatatttttacttcagaggactaggaccattttgttttgggcccttctgctgaaaatttgtctcgtttaagaggcagctagaatctttaccatatgtatgaatttgtataatttcatttttggatagggataaacttttgcttctgataaaagcctggaatttcatctggtcctcagagcattgcgtgtgtgtcttgctgtagcccggaaaaggttttgtgtaaagattctgggatggcaagttgtttgccttttctgaaaagagaacatacagaacctgtccatctttaagaccttcatccatggaatctactatacaggaggatgcagtgggctggaggggatgggcgaaaatgggagcaggaagcctggcctggcttctggtcatggcctcctaaaaccttaaacttcaagtagaaatgtactcaagccctatttataaacaaatacttttcctgcctccaccaaacccctacagaacatcacctggaattgccactcacactgggttggagtcattgggcagctgtgcctgtgcgagaggtgctgtggtctgggcagcccctggaaaagcacctttgctgcctgtcattgttgcctgaagaaggctggagttgctctgagagcagtttgggtttggagtattatatttggcttctatttttattattttggatcaccattctccctatcccttcttgcctccctcccttctaaacatgtgtaataactatacagagactgctacaaaattgtatatagtttttggatcaaatagcatgaggggagaggaaaccattaaaaattggggctcctactctcctttgctttgtaaattcaaaagttgggggtgggtaagagggatagttaaaatgtttacaaaactttaggctccctcggaacttttgccagtgtggaggaaaataaaaaagaacttaaataaaatctgattgtattcta

SEQ ID NO: 372439 - DNA, 6055 bp, Homo sapiens
ggagtctcactatgttgcccaatccagtcttgaactcctgggcccaagccgtctgcctggcttggcctcccaaattataaatttatttttatttgtttattttgtagagacagggtctcactccatcgtctaggatggagtgcagtggcaggaccacaactcactgcagccccaaactcctgggctcaagtgatccctccacctcaccctcccaggcagctaagactacaggcatgtaccaccatgcccagttgatctttaacatttcttttttttagagaccacgtctccacctcctgggctccaacgattctcccatcttggcctcccaaagcgctggatttacaggtttcttcacatataaaaatctattgtaaaaatacggaaaagaatggcagcggaaacgcagacactgaactttgggcctgaatggctccgagctctgtccagtggtgggagtattacatcccctcctctttctccagcattgccgaagtataaattagcagattatcgttacggcagagaagaaatgttagcacttttccttaaagacaacaagataccttcagaccttctggataaagaatttctgcctatcctccaggaggaaccccttccaccattggctctggtaccctttacagaagaagaacagagaaacttttccatgtctgtaaatagtgctgctgtcctgcgattgacaggacgaggaggaggaggaacagtggtgggggctcctagaggtcgaagttcttcaagagggcgaggcagaggcagaggtgaatgtggtttctaccaaagaagttttgatgaagtagagggtgtttttggtcgaggaggtggcagagaaatgcatagatcgcagagctgggaggaaaggggtgacagacgttttgaaaaaccaggacgaaaagatgtagggagaccaaattttgaggaaggtggaccaacatcagtagggagaaagcatgaatttatacgctcagaaagtgaaaattggcgcatctttagagaggaacaaaatggagaagatgaagatggaggttggcgactagctggatcaaggagggatggagagaggtggcgacctcacagtcctgatggccctcgttctgcaggctggcgggaacacatggaacgacgtcggaggtttgagtttgattttcgagatagagatgatgaacggggttaccgaagggttcgctctggcagtgggagcatagatgatgacagggatagcttgcccgaatggtgcttagaggatgctgaagaagaaatgggtacatttgactcatctggagcattcctttctctaaaaaaagtacagaaagagcctattccagaagagcaggagatggacttccggcctgtggacgaaggggaggagtgctctgactctgagggtagccataatgaagaggccaaagaacccgataagacaaataagaaagaaggagagaaaacagatagagtaggagttgaagctagtgaggaaactccccagacctcatcatcatctgctagaccaggtactccttcagaccatcagtctcaggaagcatcacagtttgagaggaaagatgaaccaaaaactgagcaaacggaaaaagctgaagaggagactcggatggaaaatagtctaccagccaaagtgcccagcagaggggatgaaatggttgctgatgtccagcagcccctgtcgcagattccttcagatacagcctctcctcttctcatacttccacctcctgttcccaatcctagtcctactctccggccagttgaaacaccagttgtaggtgctcctggtatgggcagtgtttccacagaacctgatgatgaagaaggtctcaaacatttggagcagcaagctgagaaaatggtggcttatctccaagacagtgcactagatgatgaaagattggcatcaaaactgcaagagcacagagctaaaggagtgtcgattccattgatgcatgaagcaatgcagaagtggtattacaaagatcctcagggagaaattcaaggtcccttcaataatcaggagatggcagaatggtttcaggcgggctattttactatgtctttattggtgaagagagcgtgtgatgaaagcttccaacctcttggcgatatcatgaaaatgtggggaagggttcccttttctccaggtccagctccccctcctcatatgggagagctggaccaggaacgactgaccaggcagcaagaactcacagccttataccagatgcagcacctgcagtaccagcagtttttaatacaacaacaatatgcacaggttttggcccaacagcagaaagcagcactgtcttcccagcagcagcagcagttggcacttcttcttcaacagtttcagaccttgaagatgagaatatctgatcagaacatcattccctcagtaactaggtctgtgtccgtgccagatactggctctatctgggagcttcagccaacagcttcacagcctacagtttgggaaggtggtagtgtatgggatcttcctctggacaccacgacaccaggccctgccctggaacagcttcagcagctagagaaggccaaagctgcaaagctagagcaagagagaagagaggcagaaatgagggcaaaacgggaagaggaagagcgaaagaggcaggaagaactccgaagacaacaggaggaaattcttcggcgacagcaggaagaagaaaggaaaaggcgagaggaagaagaacttgcccgaaggaaacaggaagaggctctgcgtcgccagcgggagcaagaaattgcattaaggcgacagcgagaagaggaagaaagacagcagcaagaagaagctcttagaagactggaagagaggagaagagaagaggaagaaaggcggaagcaggaagaattgttacgcaaacaggaagaggaggctgcaaaatgggcccgggaagaagaagaagcccagcgtcgattagaggagaaccggctgcggatggaagaggaggcagccagactccggcatgaggaagaagaacggaagagaaaggagctggaggtccagcggcagaaggagttaatgcgccagaggcagcagcagcaagaggctctccggaggttgcagcagcagcagcagcaacaacagctggcgcagatgaagcttccttcttcttcaacgtggggccagcagtccaatacaacagcatgtcagtcccaggccacgctgtcgttggctgaaatccaaaaactagaggaagaacgagaacggcagcttcgagaagagcaaaggcgccagcagagggagttgatgaaagctcttcagcagcagcagcagcagcaacagcagaaactctcaggttgggggaatgtcagcaaaccttcaggtaccacgaaatctcttctggagatccagcaggaagaggccaggcaaatgcaaaagcagcagcagcagcagcagcaacaccagcaaccaaacagagctcgtaacaatacgcattccaacctgcacaccagcattgggaattctgtttggggctctataaatactggtcctcctaaccagtgggcatctgacctagtcagtagtatttggagtaatgctgacactaaaaactccaacatgggattctgggatgatgcagtgaaagaggtgggacctaggaattcaacaaataaaaataaaaacaacgccagtctcagtaaatctgtaggtgtgtctaaccggcagaataagaaagtagaagaagaagaaaagttgctgaagctctttcagggagtaaataaagcccaagatggatttacgcagtggtgtgaacagatgcttcatgcccttaatacggcaaataacttggatgttcccacatttgtttctttcctgaaagaagtagaatctccttatgaggtccatgattatatcagggcctatttaggagatacttctgaggccaaggagtttgccaagcagttccttgagcgccgtgccaaacagaaagccaaccagcagcgtcagcagcagcagctgccgcagcagcagcagcagccaccacagcagccgccacagcagccacaacagcaggactctgtgtgggggatgaaccacagtacactccattcagtatttcagaccaatcaaagcaacaaccaacaatccaattttgaggctgtgcagagtggcaagaagaagaaaaagcagaagatggtccgagcagatcccagtttattaggattttcagtcaatgcatcatcggagcgactcaacatgggtgaaatcgagacgttggatgactactgagcacctgccagtggactggccatccctctcctgtctgccgactatggagtctccacctttggacacaacacttactcaccatttactctttatcactctgcaacaaatcacagaaccgatcatctcaggctttttcttctggccctttgtgtccaagattctttaatccatttttgttggtgaacatctcagactatagataagtggactggaccctgtgtcttgggggtggcagttgggattactccccaacaaggctgattttaggcagcatgtgttcactgtgctgtgatttcatctactgtctcccagaaagtgtgttgggatcggccattagcagcttgctttctcttgtcactttttttcttctattttgttttttcttcttctttttccccccatcagggcaaatggtctaactggtgcaatcatgaagagagttaatggttaacagacattggccaataacaaaacaccccatggactgtgactcgagtatccaacaggcagtcagagctctcccggtctgaaagttgcattgccactgctaactttgggattgcatcagagaggccctgagtggggttgagatgaggttggtttggtttgatgttacacactcctcacctgttctttctgagtgtcctttctctgaaaggatttatgtttttcttcgttagatagtgacttctgagcaagctgatctcccctggcatgctccaacctgattggacaaaggaagctctatggcctgggagagagactattcttaatttttctttcttacaaaaactgatttttcccataaatatttttacttcagaggactaggaccattttgttttgggcccttctgctgaaaatttgtctcgtttaagaggcagctagaatctttaccatatgtatgaatttgtataatttcatttttggatagggataaacttttgcttctgataaaagcctggaatttcatctggtcctcagagcattgcgtgtgtgtcttgctgtagcccggaaaaggttttgtgtaaagattctgggatggcaagttgtttgccttttctgaaaagagaacatacagaacctgtccatctttaagaccttcatccatggaatctactatacaggaggatgcagtgggctggaggggatgggcgaaaatgggagcaggaagcctggcctggcttctggtcatggcctcctaaaaccttaaacttcaagtagaaatgtactcaagccctatttataaacaaatacttttcctgcctccaccaaacccctacagaacatcacctggaattgccactcacactgggttggagtcattgggcagctgtgcctgtgcgagaggtgctgtggtctgggcagcccctggaaaagcacctttgctgcctgtcattgttgcctgaagaaggctggagttgctctgagagcagtttgggtttggagtattatatttggcttctatttttattattttggatcaccattctccctatcccttcttgcctccctcccttctaaacatgtgtaataactatacagagactgctacaaaattgtatatagtttttggatcaaatagcatgaggggagaggaaaccattaaaaattggggctcctactctcctttgctttgtaaattcaaaagttgggggtgggtaagagggatagttaaaatgtttacaaaactttaggctccctcggaacttttgccagtgtggaggaaaataaaaaagaacttaaataaaatctgattgtattcta

SEQ ID NO: 372440 - DNA, 5399 bp, Homo sapiens
gaaagggtccacacatttgagtaggagggctggggcatttgaagccttgcgatgggaactgtgtgaaggaaatggagctgtttagataggagacaagattgtggacagggcagagtggggaggagggcttatagggtcactctctatcaatacctgcctactaatcatgatcatgtgagtttccaaaggaacgtttaaagttagttccgaagtagtcttcctgatcatgtgtgcaagacttcatgaccaagctcccagatgatccagggagaccaaattttgaggaaggtggaccaacatcagtagggagaaagcatgaatttatacgctcagaaagtgaaaattggcgcatctttagagaggaacaaaatggagaagatgaagatggaggttggcgactagctggatcaaggagggatggagagaggtggcgacctcacagtcctgatggccctcgttctgcaggctggcgggaacacatggaacgacgtcggaggtttgagtttgattttcgagatagagatgatgaacggggttaccgaagggttcgctctggcagtgggagcatagatgatgacagggatagcttgcccgaatggtgcttagaggatgctgaagaagaaatgggtacatttgactcatctggagcattcctttctctaaaaaaagtacagaaagagcctattccagaagagcaggagatggacttccggcctgtggacgaaggggaggagtgctctgactctgagggtagccataatgaagaggccaaagaacccgataagacaaataagaaagaaggagagaaaacagatagagtaggagttgaagctagtgaggaaactccccagacctcatcatcatctgctagaccaggtactccttcagaccatcagtctcaggaagcatcacagtttgagaggaaagatgaaccaaaaactgagcaaacggaaaaagctgaagaggagactcggatggaaaatagtctaccagccaaagtgcccagcagaggggatgaaatggttgctgatgtccagcagcccctgtcgcagattccttcagatacagcctctcctcttctcatacttccacctcctgttcccaatcctagtcctactctccggccagttgaaacaccagttgtaggtgctcctggtatgggcagtgtttccacagaacctgatgatgaagaaggtctcaaacatttggagcagcaagctgagaaaatggtggcttatctccaagacagtgcactagatgatgaaagattggcatcaaaactgcaagagcacagagctaaaggagtgtcgattccattgatgcatgaagcaatgcagaagtggtattacaaagatcctcagggagaaattcaaggtcccttcaataatcaggagatggcagaatggtttcaggcgggctattttactatgtctttattggtgaagagagcgtgtgatgaaagcttccaacctcttggcgatatcatgaaaatgtggggaagggttcccttttctccaggtccagctccccctcctcatatgggagagctggaccaggaacgactgaccaggcagcaagaactcacagccttataccagatgcagcacctgcagtaccagcagtttttaatacaacaacaatatgcacaggttttggcccaacagcagaaagcagcactgtcttcccagcagcagcagcagttggcacttcttcttcaacagtttcagaccttgaagatgagaatatctgatcagaacatcattccctcagtaactaggtctgtgtccgtgccagatactggctctatctgggagcttcagccaacagcttcacagcctacagtttgggaaggtggtagtgtatgggatcttcctctggacaccacgacaccaggccctgccctggaacagcttcagcagctagagaaggccaaagctgcaaagctagagcaagagagaagagaggcagaaatgagggcaaaacgggaagaggaagagcgaaagaggcaggaagaactccgaagacaacaggaggaaattcttcggcgacagcaggaagaagaaaggaaaaggcgagaggaagaagaacttgcccgaaggaaacaggaagaggctctgcgtcgccagcgggagcaagaaattgcattaaggcgacagcgagaagaggaagaaagacagcagcaagaagaagctcttagaagactggaagagaggagaagagaagaggaagaaaggcggaagcaggaagaattgttacgcaaacaggaagaggaggctgcaaaatgggcccgggaagaagaagaagcccagcgtcgattagaggagaaccggctgcggatggaagaggaggcagccagactccggcatgaggaagaagaacggaagagaaaggagctggaggtccagcggcagaaggagttaatgcgccagaggcagcagcagcaagaggctctccggaggttgcagcagcagcagcagcaacaacagctggcgcagatgaagcttccttcttcttcaacgtggggccagcagtccaatacaacagcatgtcagtcccaggccacgctgtcgttggctgaaatccaaaaactagaggaagaacgagaacggcagcttcgagaagagcaaaggcgccagcagagggagttgatgaaagctcttcagcagcagcagcagcagcaacagcagaaactctcaggttgggggaatgtcagcaaaccttcaggtaccacgaaatctcttctggagatccagcaggaagaggccaggcaaatgcaaaagcagcagcagcagcagcagcaacaccagcaaccaaacagagctcgtaacaatacgcattccaacctgcacaccagcattgggaattctgtttggggctctataaatactggtcctcctaaccagtgggcatctgacctagtcagtagtatttggagtaatgctgacactaaaaactccaacatgggattctgggatgatgcagtgaaagaggtgggacctaggaattcaacaaataaaaataaaaacaacgccagtctcagtaaatctgtaggtgtgtctaaccggcagaataagaaagtagaagaagaagaaaagttgctgaagctctttcagggagtaaataaagcccaagatggatttacgcagtggtgtgaacagatgcttcatgcccttaatacggcaaataacttggatgttcccacatttgtttctttcctgaaagaagtagaatctccttatgaggtccatgattatatcagggcctatttaggagatacttctgaggccaaggagtttgccaagcagttccttgagcgccgtgccaaacagaaagccaaccagcagcgtcagcagcagcagctgccgcagcagcagcagcagccaccacagcagccgccacagcagccacaacagcaggactctgtgtgggggatgaaccacagtacactccattcagtatttcagaccaatcaaagcaacaaccaacaatccaattttgaggctgtgcagagtggcaagaagaagaaaaagcagaagatggtccgagcagatcccagtttattaggattttcagtcaatgcatcatcggagcgactcaacatgggtgaaatcgagacgttggatgactactgagcacctgccagtggactggccatccctctcctgtctgccgactatggagtctccacctttggacacaacacttactcaccatttactctttatcactctgcaacaaatcacagaaccgatcatctcaggctttttcttctggccctttgtgtccaagattctttaatccatttttgttggtgaacatctcagactatagataagtggactggaccctgtgtcttgggggtggcagttgggattactccccaacaaggctgattttaggcagcatgtgttcactgtgctgtgatttcatctactgtctcccagaaagtgtgttgggatcggccattagcagcttgctttctcttgtcactttttttcttctattttgttttttcttcttctttttccccccatcagggcaaatggtctaactggtgcaatcatgaagagagttaatggttaacagacattggccaataacaaaacaccccatggactgtgactcgagtatccaacaggcagtcagagctctcccggtctgaaagttgcattgccactgctaactttgggattgcatcagagaggccctgagtggggttgagatgaggttggtttggtttgatgttacacactcctcacctgttctttctgagtgtcctttctctgaaaggatttatgtttttcttcgttagatagtgacttctgagcaagctgatctcccctggcatgctccaacctgattggacaaaggaagctctatggcctgggagagagactattcttaatttttctttcttacaaaaactgatttttcccataaatatttttacttcagaggactaggaccattttgttttgggcccttctgctgaaaatttgtctcgtttaagaggcagctagaatctttaccatatgtatgaatttgtataatttcatttttggatagggataaacttttgcttctgataaaagcctggaatttcatctggtcctcagagcattgcgtgtgtgtcttgctgtagcccggaaaaggttttgtgtaaagattctgggatggcaagttgtttgccttttctgaaaagagaacatacagaacctgtccatctttaagaccttcatccatggaatctactatacaggaggatgcagtgggctggaggggatgggcgaaaatgggagcaggaagcctggcctggcttctggtcatggcctcctaaaaccttaaacttcaagtagaaatgtactcaagccctatttataaacaaatacttttcctgcctccaccaaacccctacagaacatcacctggaattgccactcacactgggttggagtcattgggcagctgtgcctgtgcgagaggtgctgtggtctgggcagcccctggaaaagcacctttgctgcctgtcattgttgcctgaagaaggctggagttgctctgagagcagtttgggtttggagtattatatttggcttctatttttattattttggatcaccattctccctatcccttcttgcctccctcccttctaaacatgtgtaataactatacagagactgctacaaaattgtatatagtttttggatcaaatagcatgaggggagaggaaaccattaaaaattggggctcctactctcctttgctttgtaaattcaaaagttgggggtgggtaagagggatagttaaaatgtttacaaaactttaggctccctcggaacttttgccagtgtggaggaaaataaaaaagaacttaaataaaatctgattgtattcta

SEQ ID NO: 372441 - DNA, 5955 bp, Homo sapiens
gcggtcacgtgacgtgcgtggcgacgtgtcggccatcttgtgttgttgaggctgaggactgactggggttctgagactccctgtcccggaccgcagattatagtgggaccagtctcattaggttgaatctacagcctatgttggtgttaacccaggtctcttagagcgttaaaaggatctgaacaaagtctgctcaaatctcctgctgtgaaccagcagaatttttgaacagagaccacgtctccacctcctgggctccaacgattctcccatcttggcctcccaaagcgctggatttacaggtttcttcacatataaaaatctattgtaaaaatacggaaaagaatggcagcggaaacgcagacactgaactttgggcctgaatggctccgagctctgtccagtggtgggagtattacatcccctcctctttctccagcattgccgaagtataaattagcagattatcgttacggcagagaagaaatgttagcacttttccttaaagacaacaagataccttcagaccttctggataaagaatttctgcctatcctccaggaggaaccccttccaccattggctctggtaccctttacagaagaagaacagagaaacttttccatgtctgtaaatagtgctgctgtcctgcgattgacaggacgaggaggaggaggaacagtggtgggggctcctagaggtcgaagttcttcaagagggcgaggcagaggcagaggtgaatgtggtttctaccaaagaagttttgatgaagtagagggtgtttttggtcgaggaggtggcagagaaatgcatagatcgcagagctgggaggaaaggggtgacagacgttttgaaaaaccaggacgaaaagatgtagggagaccaaattttgaggaaggtggaccaacatcagtagggagaaagcatgaatttatacgctcagaaagtgaaaattggcgcatctttagagaggaacaaaatggagaagatgaagatggaggttggcgactagctggatcaaggagggatggagagaggtggcgacctcacagtcctgatggccctcgttctgcaggctggcgggaacacatggaacgacgtcggaggtttgagtttgattttcgagatagagatgatgaacggggttaccgaagggttcgctctggcagtgggagcatagatgatgacagggatagcttgcccgaatggtgcttagaggatgctgaagaagaaatgggtacatttgactcatctggagcattcctttctctaaaaaaagtacagaaagagcctattccagaagagcaggagatggacttccggcctgtggacgaaggggaggagtgctctgactctgagggtagccataatgaagaggccaaagaacccgataagacaaataagaaagaaggagagaaaacagatagagtaggagttgaagctagtgaggaaactccccagacctcatcatcatctgctagaccaggtactccttcagaccatcagtctcaggaagcatcacagtttgagaggaaagatgaaccaaaaactgagcaaacggaaaaagctgaagaggagactcggatggaaaatagtctaccagccaaagtgcccagcagaggggatgaaatggttgctgatgtccagcagcccctgtcgcagattccttcagatacagcctctcctcttctcatacttccacctcctgttcccaatcctagtcctactctccggccagttgaaacaccagttgtaggtgctcctggtatgggcagtgtttccacagaacctgatgatgaagaaggtctcaaacatttggagcagcaagctgagaaaatggtggcttatctccaagacagtgcactagatgatgaaagattggcatcaaaactgcaagagcacagagctaaaggagtgtcgattccattgatgcatgaagcaatgcagaagtggtattacaaagatcctcagggagaaattcaaggtcccttcaataatcaggagatggcagaatggtttcaggcgggctattttactatgtctttattggtgaagagagcgtgtgatgaaagcttccaacctcttggcgatatcatgaaaatgtggggaagggttcccttttctccaggtccagctccccctcctcatatgggagagctggaccaggaacgactgaccaggcagcaagaactcacagccttataccagatgcagcacctgcagtaccagcagtttttaatacaacaacaatatgcacaggttttggcccaacagcagaaagcagcactgtcttcccagcagcagcagcagttggcacttcttcttcaacagtttcagaccttgaagatgagaatatctgatcagaacatcattccctcagtaactaggtctgtgtccgtgccagatactggctctatctgggagcttcagccaacagcttcacagcctacagtttgggaaggtggtagtgtatgggatcttcctctggacaccacgacaccaggccctgccctggaacagcttcagcagctagagaaggccaaagctgcaaagctagagcaagagagaagagaggcagaaatgagggcaaaacgggaagaggaagagcgaaagaggcaggaagaactccgaagacaacaggaggaaattcttcggcgacagcaggaagaagaaaggaaaaggcgagaggaagaagaacttgcccgaaggaaacaggaagaggctctgcgtcgccagcgggagcaagaaattgcattaaggcgacagcgagaagaggaagaaagacagcagcaagaagaagctcttagaagactggaagagaggagaagagaagaggaagaaaggcggaagcaggaagaattgttacgcaaacaggaagaggaggctgcaaaatgggcccgggaagaagaagaagcccagcgtcgattagaggagaaccggctgcggatggaagaggaggcagccagactccggcatgaggaagaagaacggaagagaaaggagctggaggtccagcggcagaaggagttaatgcgccagaggcagcagcagcaagaggctctccggaggttgcagcagcagcagcagcaacaacagctggcgcagatgaagcttccttcttcttcaacgtggggccagcagtccaatacaacagcatgtcagtcccaggccacgctgtcgttggctgaaatccaaaaactagaggaagaacgagaacggcagcttcgagaagagcaaaggcgccagcagagggagttgatgaaagctcttcagcagcagcagcagcagcaacagcagaaactctcaggttgggggaatgtcagcaaaccttcaggtaccacgaaatctcttctggagatccagcaggaagaggccaggcaaatgcaaaagcagcagcagcagcagcagcaacaccagcaaccaaacagagctcgtaacaatacgcattccaacctgcacaccagcattgggaattctgtttggggctctataaatactggtcctcctaaccagtgggcatctgacctagtcagtagtatttggagtaatgctgacactaaaaactccaacatgggattctgggatgatgcagtgaaagaggtgggacctaggaattcaacaaataaaaataaaaacaacgccagtctcagtaaatctgtaggtgtgtctaaccggcagaataagaaagtagaagaagaagagtggtgtgaacagatgcttcatgcccttaatacggcaaataacttggatgttcccacatttgtttctttcctgaaagaagtagaatctccttatgaggtccatgattatatcagggcctatttaggagatacttctgaggccaaggagtttgccaagcagttccttgagcgccgtgccaaacagaaagccaaccagcagcgtcagcagcagcagctgccgcagcagcagcagcagccaccacagcagccgccacagcagccacaacagcaggactctgtgtgggggatgaaccacagtacactccattcagtatttcagaccaatcaaagcaacaaccaacaatccaattttgaggctgtgcagagtggcaagaagaagaaaaagcagaagatggtccgagcagatcccagtttattaggattttcagtcaatgcatcatcggagcgactcaacatgggtgaaatcgagacgttggatgactactgagcacctgccagtggactggccatccctctcctgtctgccgactatggagtctccacctttggacacaacacttactcaccatttactctttatcactctgcaacaaatcacagaaccgatcatctcaggctttttcttctggccctttgtgtccaagattctttaatccatttttgttggtgaacatctcagactatagataagtggactggaccctgtgtcttgggggtggcagttgggattactccccaacaaggctgattttaggcagcatgtgttcactgtgctgtgatttcatctactgtctcccagaaagtgtgttgggatcggccattagcagcttgctttctcttgtcactttttttcttctattttgttttttcttcttctttttccccccatcagggcaaatggtctaactggtgcaatcatgaagagagttaatggttaacagacattggccaataacaaaacaccccatggactgtgactcgagtatccaacaggcagtcagagctctcccggtctgaaagttgcattgccactgctaactttgggattgcatcagagaggccctgagtggggttgagatgaggttggtttggtttgatgttacacactcctcacctgttctttctgagtgtcctttctctgaaaggatttatgtttttcttcgttagatagtgacttctgagcaagctgatctcccctggcatgctccaacctgattggacaaaggaagctctatggcctgggagagagactattcttaatttttctttcttacaaaaactgatttttcccataaatatttttacttcagaggactaggaccattttgttttgggcccttctgctgaaaatttgtctcgtttaagaggcagctagaatctttaccatatgtatgaatttgtataatttcatttttggatagggataaacttttgcttctgataaaagcctggaatttcatctggtcctcagagcattgcgtgtgtgtcttgctgtagcccggaaaaggttttgtgtaaagattctgggatggcaagttgtttgccttttctgaaaagagaacatacagaacctgtccatctttaagaccttcatccatggaatctactatacaggaggatgcagtgggctggaggggatgggcgaaaatgggagcaggaagcctggcctggcttctggtcatggcctcctaaaaccttaaacttcaagtagaaatgtactcaagccctatttataaacaaatacttttcctgcctccaccaaacccctacagaacatcacctggaattgccactcacactgggttggagtcattgggcagctgtgcctgtgcgagaggtgctgtggtctgggcagcccctggaaaagcacctttgctgcctgtcattgttgcctgaagaaggctggagttgctctgagagcagtttgggtttggagtattatatttggcttctatttttattattttggatcaccattctccctatcccttcttgcctccctcccttctaaacatgtgtaataactatacagagactgctacaaaattgtatatagtttttggatcaaatagcatgaggggagaggaaaccattaaaaattggggctcctactctcctttgctttgtaaattcaaaagttgggggtgggtaagagggatagttaaaatgtttacaaaactttaggctccctcggaacttttgccagtgtggaggaaaataaaaaagaacttaaataaaatctgattgtattcta

SEQ ID NO: 372442 - DNA, 3197 bp, Homo sapiens
caacagtttcctgaagcaactattccgctcagaaacacaaacgtccgatccagacccccaacgaagaggaggctgcaaaatgggcccgggaagaagaagaagcccagcgtcgattagaggagaaccggctgcggatggaagaggaggcagccagactccggcatgaggaagaagaacggaagagaaaggagctggaggtccagcggcagaaggagttaatgcgccagaggcagcagcagcaagaggctctccggaggttgcagcagcagcagcagcaacaacagctggcgcagatgaagcttccttcttcttcaacgtggggccagcagtccaatacaacagcatgtcagtcccaggccacgctgtcgttggctgaaatccaaaaactagaggaagaacgagaacggcagcttcgagaagagcaaaggcgccagcagagggagttgatgaaagctcttcagcagcagcagcagcagcaacagcagaaactctcaggttgggggaatgtcagcaaaccttcaggtaccacgaaatctcttctggagatccagcaggaagaggccaggcaaatgcaaaagcagcagcagcagcagcagcaacaccagcaaccaaacagagctcgtaacaatacgcattccaacctgcacaccagcattgggaattctgtttggggctctataaatactggtcctcctaaccagtgggcatctgacctagtcagtagtatttggagtaatgctgacactaaaaactccaacatgggattctgggatgatgcagtgaaagaggtgggacctaggaattcaacaaataaaaataaaaacaacgccagtctcagtaaatctgtaggtgtgtctaaccggcagaataagaaagtagaagaagaagaaaagttgctgaagctctttcagggagtaaataaagcccaagatggatttacgcagtggtgtgaacagatgcttcatgcccttaatacggcaaataacttggatgttcccacatttgtttctttcctgaaagaagtagaatctccttatgaggtccatgattatatcagggcctatttaggagatacttctgaggccaaggagtttgccaagcagttccttgagcgccgtgccaaacagaaagccaaccagcagcgtcagcagcagcagctgccgcagcagcagcagcagccaccacagcagccgccacagcagccacaacagcaggactctgtgtgggggatgaaccacagtacactccattcagtatttcagaccaatcaaagcaacaaccaacaatccaattttgaggctgtgcagagtggcaagaagaagaaaaagcagaagatggtccgagcagatcccagtttattaggattttcagtcaatgcatcatcggagcgactcaacatgggtgaaatcgagacgttggatgactactgagcacctgccagtggactggccatccctctcctgtctgccgactatggagtctccacctttggacacaacacttactcaccatttactctttatcactctgcaacaaatcacagaaccgatcatctcaggctttttcttctggccctttgtgtccaagattctttaatccatttttgttggtgaacatctcagactatagataagtggactggaccctgtgtcttgggggtggcagttgggattactccccaacaaggctgattttaggcagcatgtgttcactgtgctgtgatttcatctactgtctcccagaaagtgtgttgggatcggccattagcagcttgctttctcttgtcactttttttcttctattttgttttttcttcttctttttccccccatcagggcaaatggtctaactggtgcaatcatgaagagagttaatggttaacagacattggccaataacaaaacaccccatggactgtgactcgagtatccaacaggcagtcagagctctcccggtctgaaagttgcattgccactgctaactttgggattgcatcagagaggccctgagtggggttgagatgaggttggtttggtttgatgttacacactcctcacctgttctttctgagtgtcctttctctgaaaggatttatgtttttcttcgttagatagtgacttctgagcaagctgatctcccctggcatgctccaacctgattggacaaaggaagctctatggcctgggagagagactattcttaatttttctttcttacaaaaactgatttttcccataaatatttttacttcagaggactaggaccattttgttttgggcccttctgctgaaaatttgtctcgtttaagaggcagctagaatctttaccatatgtatgaatttgtataatttcatttttggatagggataaacttttgcttctgataaaagcctggaatttcatctggtcctcagagcattgcgtgtgtgtcttgctgtagcccggaaaaggttttgtgtaaagattctgggatggcaagttgtttgccttttctgaaaagagaacatacagaacctgtccatctttaagaccttcatccatggaatctactatacaggaggatgcagtgggctggaggggatgggcgaaaatgggagcaggaagcctggcctggcttctggtcatggcctcctaaaaccttaaacttcaagtagaaatgtactcaagccctatttataaacaaatacttttcctgcctccaccaaacccctacagaacatcacctggaattgccactcacactgggttggagtcattgggcagctgtgcctgtgcgagaggtgctgtggtctgggcagcccctggaaaagcacctttgctgcctgtcattgttgcctgaagaaggctggagttgctctgagagcagtttgggtttggagtattatatttggcttctatttttattattttggatcaccattctccctatcccttcttgcctccctcccttctaaacatgtgtaataactatacagagactgctacaaaattgtatatagtttttggatcaaatagcatgaggggagaggaaaccattaaaaattggggctcctactctcctttgctttgtaaattcaaaagttgggggtgggtaagagggatagttaaaatgtttacaaaactttaggctccctcggaacttttgccagtgtggaggaaaataaaaaagaacttaaataaaatctgattgtattcta

SEQ ID NO: 372443 - DNA, 4595 bp, Homo sapiens
gcggtcacgtgacgtgcgtggcgacgtgtcggccatcttgtgttgttgaggctgaggactgactggggttctgagactccctgtcccggaccgcagattatagtgggaccagtctcattaggttgaatctacagcctatgttggtgttaacccaggtctcttagagcgttaaaaggatctgaacaaagtctgctcaaatctcctgctgtgaaccagcagaatttttgaacagagaccacgtctccacctcctgggctccaacgattctcccatcttggcctcccaaagcgctggatttacaggtttcttcacatataaaaatctattgtaaaaatacggaaaagaatggcagcggaaacgcagacactgaactttgggcctgaatggctccgagctctgtccagtggtgggagtattacatcccctcctctttctccagcattgccgaagtataaattagcagattatcgttacggcagagaagaaatgttagcacttttccttaaagacaacaagataccttcagaccttctggataaagaatttctgcctatcctccaggaggaaccccttccaccattggctctggtaccctttacagaagaagaacagagaaacttttccatgtctgtaaatagtgctgctgtcctgcgattgacaggacgaggaggaggaggaacagtggtgggggctcctagaggtcgaagttcttcaagagggcgaggcagaggcagaggtgaatgtggtttctaccaaagaagttttgatgaagtagagggtgtttttggtcgaggaggtggcagagaaatgcatagatcgcagagctgggaggaaaggggtgacagacgttttgaaaaaccaggacgaaaagatgtagggagaccaaattttgaggaaggtggaccaacatcagtagggagaaagcatgaatttatacgctcagaaagtgaaaattggcgcatctttagagaggaacaaaatggagaagatgaagatggaggttggcgactagctggatcaaggagggatggagagaggtggcgacctcacagtcctgatggccctcgttctgcaggctggcgggaacacatggaacgacgtcggaggtttgagtttgattttcgagatagagatgatgaacggggttaccgaagggttcgctctggcagtgggagcatagatgatgacagggatagcttgcccgaatggtgcttagaggatgctgaagaagaaatgggtacatttgactcatctggagcattcctttctctaaaaaaagtacagaaagagcctattccagaagagcaggagatggacttccggcctgtggacgaaggggaggagtgctctgactctgagggtagccataatgaagaggccaaagaacccgataagacaaataagaaagaaggagagaaaacagatagagtaggagttgaagctagtgaggaaactccccagacctcatcatcatctgctagaccaggtactccttcagaccatcagtctcaggaagcatcacagtttgagaggaaagatgaaccaaaaactgagcaaacggaaaaagctgaagaggagactcggatggaaaatagtctaccagccaaagtgcccagcagaggggatgaaatggttgctgatgtccagcagcccctgtcgcagattccttcagatacagcctctcctcttctcatacttccacctcctgttcccaatcctagtcctactctccggccagttgaaacaccagttgtaggtgctcctggtatgggcagtgtttccacagaacctgatgatgaagaaggtctcaaacatttggagcagcaagctgagaaaatggtggcttatctccaagacagtgcactagatgatgaaagattggcatcaaaactgcaagagcacagagctaaaggagtgtcgattccattgatgcatgaagcaatgcagaagtggtattacaaagatcctcagggagaaattcaaggtcccttcaataatcaggagatggcagaatggtttcaggcgggctattttactatgtctttattggtgaagagagcgtgtgatgaaagcttccaacctcttggcgatatcatgaaaatgtggggaagggttcccttttctccaggtccagctccccctcctcatatgggagagctggaccaggaacgactgaccaggcagcaagaactcacagccttataccagatgcagcacctgcagtaccagcagtttttaatacaacaacaatatgcacaggttttggcccaacagcagaaagcagcactgtcttcccagcagcagcagcagttggcacttcttcttcaacagtttcagaccttgaagatgagaatatctgatcagaacatcattccctcagtaactaggtctgtgtccgtgccagatactggctctatctgggagcttcagccaacagcttcacagcctacagtttgggaaggtggtagtgtatgggatcttcctctggacaccacgacaccaggccctgccctggaacagcttcagcagctagagaaggccaaagctgcaaagctagagcaagagagaagagaggcagaaatgagggcaaaacgggaagaggaagagcgaaagaggcaggaagaactccgaagacaacaggaggaaattcttcggcgacagcaggaagaagaaaggaaaaggcgagaggaagaagaacttgcccgaaggaaacaggaagaggctctgcgtcgccagcgggagcaagaaattgcattaaggcgacagcgagaagaggaagaaagacagcagcaagaagaagctcttagaagactggaagagaggagaagagaagaggaagaaaggcggaagcaggaagaattgttacgcaaacaggaagaggaggctgcaaaatgggcccgggaagaagaagaagcccagcgtcgattagaggagaaccggctgcggatggaagaggaggcagccagactccggcatgaggaagaagaacggaagagaaaggagctggaggtccagcggcagaaggagttaatgcgccagaggcagcagcagcaagaggctctccggaggttgcagcagcagcagcagcaacaacagctggcgcagatgaagcttccttcttcttcaacgtggggccagcagtccaatacaacagcatgtcagtcccaggccacgctgtcgttggctgaaatccaaaaactagaggaagaacgagaacggcagcttcgagaagagcaaaggcgccagcagagggagttgatgaaagctcttcagcagcagcagcagcagcaacagcagaaactctcaggttgggggaatgtcagcaaaccttcaggtaccacgaaatctcttctggagatccagcaggaagaggccaggcaaatgcaaaagcagcagcagcagcagcagcaacaccagcaaccaaacagagctcgtaacaatacgcattccaacctgcacaccagcattgggaattctgtttggggctctataaatactggtcctcctaaccagtgggcatctgacctagtcagtagtatttggagtaatgctgacactaaaaactccaacatgggattctgggatgatgcagtgaaagaggtgggacctaggaattcaacaaataaaaataaaaacaacgccagtctcagtaaatctgtaggtgtgtctaaccggcagaataagaaagtagaagaagaagaaaagttgctgaagctctttcagggagtaaataaagcccaagatggatttacgcagtggtgtgaacagatgcttcatgcccttaatacggcaaataacttggatgttcccacatttgtttctttcctgaaagaagtagaatctccttatgaggtccatgattatatcagggcctatttaggagatacttctgaggccaaggagtttgccaagcagttccttgagcgccgtgccaaacagaaagccaaccagcagcgtcagcagcagcagctgccgcagcagcagcagcagccaccacagcagccgccacagcagccacaacagcaggactctgtgtgggggatgaaccacagtacactccattcagtatttcagaccaatcaaagcaacaaccaacaatccaattttgaggctgtgcagagtggcaagaagaagaaaaagcagaagatggtccgagcagatcccagtttattaggattttcagtcaatgcatcatcggagcgactcaacatgggtgaaatcgagacgttggatgactactgagcacctgccagtggactggccatccctctcctgtctgccgactatggagtctccacctttggacacaacacttactcaccatttactctttatcactctgcaacaaatcacagaaccgatcatctcaggctttttcttctggccctttgtgtccaagattctttaatccatttttgttggtgaacatctcagactatagataagtggactggaccctgtgtcttgggggtggcagttgggattactccccaacaaggctgattttaggcagcatgtgttcactgtgctgtgatttcatctactgtctcccagaaagtgtgttgggcgataagggatcctcagatcatcacgac

SEQ ID NO: 372444 - DNA, 2535 bp, Homo sapiens
ctaggtagaggccgcgggtaatcggccgaggcctaccagtgggcatctgacctagtcagtagtatttggagtaatgctgacactaaaaactccaacatgggattctgggatgatgcagtgaaagaggtgggacctaggaattcaacaaataaaaataaaaacaacgccagtctcagtaaatctgtaggtgtgtctaaccggcagaataagaaagtagaagaagaagaaaagttgctgaagctctttcagggagtaaataaagcccaagatggatttacgcagtggtgtgaacagatgcttcatgcccttaatacggcaaataacttggatgttcccacatttgtttctttcctgaaagaagtagaatctccttatgaggtccatgattatatcagggcctatttaggagatacttctgaggccaaggagtttgccaagcagttccttgagcgccgtgccaaacagaaagccaaccagcagcgtcagcagcagcagctgccgcagcagcagcagcagccaccacagcagccgccacagcagccacaacagcaggactctgtgtgggggatgaaccacagtacactccattcagtatttcagaccaatcaaagcaacaaccaacaatccaattttgaggctgtgcagagtggcaagaagaagaaaaagcagaagatggtccgagcagatcccagtttattaggattttcagtcaatgcatcatcggagcgactcaacatgggtgaaatcgagacgttggatgactactgagcacctgccagtggactggccatccctctcctgtctgccgactatggagtctccacctttggacacaacacttactcaccatttactctttatcactctgcaacaaatcacagaaccgatcatctcaggctttttcttctggccctttgtgtccaagattctttaatccatttttgttggtgaacatctcagactatagataagtggactggaccctgtgtcttgggggtggcagttgggattactccccaacaaggctgattttaggcagcatgtgttcactgtgctgtgatttcatctactgtctcccagaaagtgtgttgggatcggccattagcagcttgctttctcttgtcactttttttcttctattttgttttttcttcttctttttccccccatcagggcaaatggtctaactggtgcaatcatgaagagagttaatggttaacagacattggccaataacaaaacaccccatggactgtgactcgagtatccaacaggcagtcagagctctcccggtctgaaagttgcattgccactgctaactttgggattgcatcagagaggccctgagtggggttgagatgaggttggtttggtttgatgttacacactcctcacctgttctttctgagtgtcctttctctgaaaggatttatgtttttcttcgttagatagtgacttctgagcaagctgatctcccctggcatgctccaacctgattggacaaaggaagctctatggcctgggagagagactattcttaatttttctttcttacaaaaactgatttttcccataaatatttttacttcagaggactaggaccattttgttttgggcccttctgctgaaaatttgtctcgtttaagaggcagctagaatctttaccatatgtatgaatttgtataatttcatttttggatagggataaacttttgcttctgataaaagcctggaatttcatctggtcctcagagcattgcgtgtgtgtcttgctgtagcccggaaaaggttttgtgtaaagattctgggatggcaagttgtttgccttttctgaaaagagaacatacagaacctgtccatctttaagaccttcatccatggaatctactatacaggaggatgcagtgggctggaggggatgggcgaaaatgggagcaggaagcctggcctggcttctggtcatggcctcctaaaaccttaaacttcaagtagaaatgtactcaagccctatttataaacaaatacttttcctgcctccaccaaacccctacagaacatcacctggaattgccactcacactgggttggagtcattgggcagctgtgcctgtgcgagaggtgctgtggtctgggcagcccctggaaaagcacctttgctgcctgtcattgttgcctgaagaaggctggagttgctctgagagcagtttgggtttggagtattatatttggcttctatttttattattttggatcaccattctccctatcccttcttgcctccctcccttctaaacatgtgtaataactatacagagactgctacaaaattgtatatagtttttggatcaaatagcatgaggggagaggaaaccattaaaaattggggctcctactctcctttgctttgtaaattcaaaagttgggggtgggtaagagggatagttaaaatgtttacaaaactttaggctccctcggaacttttgccagtgtggaggaaaataaaaaagaacttaaataaaatctgattgtattcta

SEQ ID NO: 372445 - DNA, 2725 bp, Homo sapiens
gcggtcacgtgacgtgcgtggcgacgtgtcggccatcttgtgttgttgaggctgaggactgactggggttctgagactccctgtcccggaccgcagattatagtgggaccagtctcattaggttgaatctacagcctatgttggtgttaacccaggtctcttagagcgttaaaaggatctgaacaaagtctgctcaaatctcctgctgtgaaccagcagaatttttgaacagagaccacgtctccacctcctgggctccaacgattctcccatcttggcctcccaaagcgctggatttacaggtttcttcacatataaaaatctattgtaaaaatacggaaaagaatggcagcggaaacgcagacactgaactttgggcctgaatggctccgagctctgtccagtggtgggagtattacatcccctcctctttctccagcattgccgaagtataaattagcagattatcgttacggcagagaagaaatgttagcacttttccttaaagacaacaagataccttcagaccttctggataaagaatttctgcctatcctccaggaggaaccccttccaccattggctctggtaccctttacagaagaagaacagagaaacttttccatgtctgtaaatagtgctgctgtcctgcgattgacaggacgaggaggaggaggaacagtggtgggggctcctagaggtcgaagttcttcaagagggcgaggcagaggcagaggtgaatgtggtttctaccaaagaagttttgatgaagtagagggtgtttttggtcgaggaggtggcagagaaatgcatagatcgcagagctgggaggaaaggggtgacagacgttttgaaaaaccaggacgaaaagatgtagggagaccaaattttgaggaaggtggaccaacatcagtagggagaaagcatgaatttatacgctcagaaagtgaaaattggcgcatctttagagaggaacaaaatggagaagatgaagatggaggttggcgactagctggatcaaggagggatggagagaggtggcgacctcacagtcctgatggccctcgttctgcaggctggcgggaacacatggaacgacgtcggaggtttgagtttgattttcgagatagagatgatgaacggggttaccgaagggttcgctctggcagtgggagcatagatgatgacagggatagcttgcccgaatggtgcttagaggatgctgaagaagaaatgggtacatttgactcatctggagcattcctttctctaaaaaaagtacagaaagagcctattccagaagagcaggagatggacttccggcctgtggacgaaggggaggagtgctctgactctgagggtagccataatgaagaggccaaagaacccgataagacaaataagaaagaaggagagaaaacagatagagtaggagttgaagctagtgaggaaactccccagacctcatcatcatctgctagaccaggtactccttcagaccatcagtctcaggaagcatcacagtttgagaggaaagatgaaccaaaaactgagcaaacggaaaaagctgaagaggagactcggatggaaaatagtctaccagccaaagtgcccagcagaggggatgaaatggttgctgatgtccagcagcccctgtcgcagattccttcagatacagcctctcctcttctcatacttccacctcctgttcccaatcctagtcctactctccggccagttgaaacaccagttgtaggtgctcctggtatgggcagtgtttccacagaacctgatgatgaagaaggtctcaaacatttggagcagcaagctgagaaaatggtggcttatctccaagacagtgcactagatgatgaaagattggcatcaaaactgcaagagcacagagctaaaggagtgtcgattccattgatgcatgaagcaatgcagaagtggtattacaaagatcctcagggagaaattcaaggtcccttcaataatcaggagatggcagaatggtttcaggcgggctattttactatgtctttattggtgaagagagcgtgtgatgaaagcttccaacctcttggcgatatcatgaaaatgtggggaagggttcccttttctccaggtccagctccccctcctcatatgggagagctggaccaggaacgactgaccaggcagcaagaactcacagccttataccagatgcagcacctgcagtaccagcagtttttaatacaacaacaatatgcacaggttttggcccaacagcagaaagcagcactgtcttcccagcagcagcagcagttggcacttcttcttcaacagtttcagaccttgaagatgagaatatctgatcagaacatcattccctcagtaactaggtctgtgtccgtgccagatactggctctatctgggagcttcagccaacagcttcacagcctacagtttgggaaggtggtagtgtatgggatcttcctctggacaccacgacaccaggccctgccctggaacagcttcagcagctagagaaggccaaagctgcaaaggtctgaaactcattcttctgcaacagtgcattgtcatctggctgcaggacataaacattgctgtttattcatctctctagctagctatgctttttactttcagtttactgctgcttagctggtataagtacattcatattgtatctttactgtgctctcttctcccaaaaaa

SEQ ID NO: 372446 - DNA, 842 bp, Homo sapiens
gcggtcacgtgacgtgcgtggcgacgtgtcggccatcttgtgttgttgaggctgaggactgactggggttctgagactccctgtcccggaccgcagattatagtgggaccagtctcattaggttgaatctacagcctatgttggtgttaacccaggtctcttagagcgttaaaaggatctgaacaaagtctgctcaaatctcctgctgtgaaccagcagaatttttgaacagagaccacgtctccacctcctgggctccaacgattctcccatcttggcctcccaaagcgctggatttacaggtttcttcacatataaaaatctattgtaaaaatacggaaaagaatggcagcggaaacgcagacactgaactttgggcctgaatggctccgagctctgtccagtggtgggagtattacatcccctcctctttctccagcattgccgaagtataaattagcagattatcgttacggcagagaagaaatgttagcacttttccttaaagacaacaagataccttcagaccttctggataaagaatttctgcctatcctccaggaggaaccccttccaccattggctctggtaccctttacagaagaagaacagagaaacttttccatgtctgtaaatagtgctgctgtcctgcgattgacaggacgaggaggaggaggaacagtggtgggggctcctagaggtcgaagttcttcaagagggcgaggctaatgaaaagggttctttctcttgggggaaatgtgtgtgtcagttctgtcagctgcaagttcttgtataatgaagtcaatgccatcaggccaaggaaataaaataattgcttacct

SEQ ID NO: 372447 - DNA, 201 bp, Homo sapiens
ggtcctgccattttaaagacaattaaaaggagttttgggtctctgagatgtgtgggctgtggggaatcagattggccatttggctttttttcctgcagtcttaaccacaaaattgagctctaaggattcctacactaaatggggaagcaggaagagcaagtcttaaaagattcaagtccattggctcacccttctcactgg

SEQ ID NO: 372448 - DNA, 456 bp, Homo sapiens
ggtgatgccagacatggtctacaaggcgtggaagagtgccctgggaaaaagcaaatacacatgaatatccagcagagggcgatctaatcaaataaaatgtattaatagttttgacatagtacccagtactcacagcatgccaagatacttacttccaaagaacatgaagagcacgaagagcacgggatagaaaaagctcaagcaaacagccaaggcatattcgtgtactacagcagatacagcaaagacagctaacatggcagcagatttgaatctcttggagaaaaactaaagaaaaaggaaaacactacaaagtaatttttaaaaatttaaagcaagcatggattatataggatgtaaaattatatgccaaaggcacctattgtatttgtacttaattttctaagtctactccttggattaatccaagtctattaaaataactacaaatcatat

SEQ ID NO: 372449 - DNA, 393 bp, Homo sapiens
gtagtattgctacttattttgatagagatacaagaaaagagagaagacgtacatagtacccagtactcacagcatgccaagatacttacttccaaagaacatgaagagcacgaagagcacgggatagaaaaagctcaagcaaacagccaaggcatattcgtgtactacagcagatacagcaaagacagctaacatggcagcagatttgaatctcttggagaaaaactaaagaaaaaggaaaacactacaaagtaatttttaaaaatttaaagcaagcatggattatataggatgtaaaattatatgccaaaggcacctattgtatttgtacttaattttctaagtctactccttggattaatccaagtctattaaaataactacaaatcatat

SEQ ID NO: 372450 - DNA, 1306 bp, Homo sapiens
tgtctctcattgttttttggtgaaagtttgtatatgacgacataggaagaattagtgtacaaaaactggttagaacctgtggcccctctttgtctccaaagtgtttaattctcccctgttggggcccacctgccaagggttccaagctctttaaattgggaaaccctggatttgaggaggaacacccgattgaatctaaagaaacccaatagggtctcgaattaaatgccatgttaatacatcaaaggcattagttgatattttttaaaatatcattggagaatttaatctttctttataaaaatagagcatttttctgctttctggcaaaagttggggataaaaggaaaaaaagttgtcaaaatgtaattttcagtccaattcaccaggaaaacatgcttgtgaattgtgcagtaaaaggtggtaatgactactggaagctaagtcaaaggtgatttcctacctgattttacttacttaaataaaagttacttacaatgggagtgaaaaactgaggtttctgttatttagtagagaaatcaactccacgtttacttaaagagatggtaaggtcaaggttcaaatgctactgtgttttaatttggatatttgaaatttctcttgaggccaaaaaaaaaaaaaattgatgcctctccttaaatctaggatgaagtgtcaacatggagacaggtaaccactgttatagagtcttgtcacctaaagggatgtcttggttaacacgtaacagtgcaagtttggccataggttatttatttgtacttttttagtttgaaggactgaggaaacaatagctacagaaaatacttcttgtgccttattcctaacaaagctgaggtccctgcctggggttagttacaagtataaatacttaacgaggtgcgttcattataaaagcctcagtatagaaaccttaaagtttatctaggaaagtttagtatattttcaggtgttgctaaaaaattactcatcatctgtttgcaaaagtatgacttgacctatagaaatctgtttctttatgctttgtactcatacaagcatctaggtaggatattaataaataatacaggataatagcatcaccagtgtccaataacgggccatcaggaacaggattcacgtttggtggatatgagagaaaataaacacttcaggaaacttgctcaccacagctggagatcaggaatagaacctttccaagatatcataatattttctttataggaacactgagtaatggcaagaatattttgagcttttccatggttaagagcgatagtctcagagg

SEQ ID NO: 372451 - DNA, 672 bp, Homo sapiens
tcgtgccgaattcggcacgagcttaaatctaggatgaagtgtcaacatggagacaggtaaccactgttatagagtcttgtcacctaaagggatgtcttggttaacacgtaacagtgcaagtttggccataggttatttatttgtacttttttagtttgaaggactgaggaaacaatagctacagaaaatacttcttgtgccttattcctaacaaagctgaggtccctgcctggggttagttacaagtataaatacttaacgaggtgcgttcattataaaagcctcagtatagaaaccttaaagtttatctaggaaagtttagtatattttcaggtgttgctaaaaaattactcatcatctgtttgcaaaagtatgacttgacctatagaaatctgtttctttatgctttgtactcatacaagcatctaggtaggatattaataaataatacaggataatagcatcaccagtgtccaataacgggccatcaggaacaggattcacgtttggtggatatgagagaaaataaacacttcaggaaacttgctcaccacagctggagatcaggaatagaacctttccaagatatcataatattttctttataggaacactgagtaatggcaagaatattttgagcttttccatggttaagagcgatagtctcagagg

SEQ ID NO: 372452 - DNA, 2673 bp, Homo sapiens
cggacgcgtgggtcgacccacgcgtcctcgaatgtgtacataactcccgcaggatctcagggcctgccgccccattatgatgatgtcgaggttttcatcctgcagctggagggagagaaacactggcgcctctaccaccccactgtgcccctggcacgagagtacagcgtggaggccgaggaaaggatcggcaggccggtgcatgagtttatgctgaagccgggtgatttgttgtactttcccagaggaaccattcatcaagcggacactcctgcggggctggcccactcgactcacgtgaccatcagcacctaccagaacaattcatggggagatttccttttggataccatctcggggcttgtatttgatactgcaaaggaagacgtggagttacggaccggcataccccggcagctgctcctgcaggtggaatccacaactgttgctacaagacgattaagtggcttcctgaggacacttgcagaccggctggagggcaccaaagaactgctttcctcagacatgaagaaggattttattatgcacagactccccccttactctgcgggagatggggcagagctgtcaacaccaggtggaaagttaccgaggctggacagtgtagtgagactgcagtttaaagaccacattgtcctcacagtactgccggatcaagatcaatctgatgaaactcaagaaaagatggtgtacatctatcattccttaaagaatagtagagagacacacatgatgggaaatgaggaggaaacagagtttcatggacttcgcttccctttgtcacatttggatgcactgaagcaaatttggaatagtccagctatttctgtcaaggacctgaaacttactacagatgaggaaaaggaaagcctggtattatccctctggacagaatgtttaattcaagtagtctagtgcctttgcagaatcaaatgcctactattttatatgcatatattaaaagaaaagcaaagacctgagccgaggagaggatgaattcaagtttccttacctgcgtatctactaacaaacatgagacctccctgttacaggtggtcagttggccaaatgtactaacgggcacatgaaagaaagaacagcaaattaccaagtgtctcagaaaatgacaaaaccatattttgacaagtttatttaatccagtgtggtagaaaaggcacaattccaatgtatcatttagaattgaatgtcattaacctggctttgttctttggaagaaacaacttctttaaagagcttctttggctctagaaaaatttcaaacaattaaaataagaaaaaattttaaactggttttttataatgaaaatatacatacctttgtgtatagacaagcccatgcccattaaaataaagttatcctgtaacataaattttattaaataatacttccccacagatgagaggcacgcaacacctatggacaaaagggagttacagaggctgcttaaaagatggagaaaagcctgagattgaaggaggaaaaaaacccagtatttaaagtctataaaaaatactcaaaatagtgggtcttcgagtttaaaatagtcattgttattttacattctaaagtgcatgtaggttgatattttttaaaatatcattggagaatttaatctttctttataaaaatagagcatttttctgctttctggcaaaagttggggataaaaggaaaaaaagttgtcaaaatgtaattttcagtccaattcaccaggaaaacatgcttgtgaattgtgcagtaaaaggtggtaatgactactggaagctaagtcaaaggtgatttcctacctgattttacttacttaaataaaagttacttacaatgggagtgaaaaactgaggtttctgttatttagtagagaaatcaactccacgtttacttaaagagatggtaaggtcaaggttcaaatgctactgtgttttaatttggatatttgaaatttctcttgaggccaaaaaaaaaaaaaattgatgcctctccttaaatctaggatgaagtgtcaacatggagacaggtaaccactgttatagagtcttgtcacctaaagggatgtcttggttaacacgtaacagtgcaagtttggccataggttatttatttgtacttttttagtttgaaggactgaggaaacaatagctacagaaaatacttcttgtgccttattcctaacaaagctgaggtccctgcctggggttagttacaagtataaatacttaacgaggtgcgttcattataaaagcctcagtatagaaaccttaaagtttatctaggaaagtttagtatattttcaggtgttgctaaaaaattactcatcatctgtttgcaaaagtatgacttgacctatagaaatctgtttctttatgctttgtactcatacaagcatctaggtaggatattaataaataatacaggataatagcatcaccagtgtccaataacgggccatcaggaacaggattcacgtttggtggatatgagagaaaataaacacttcaggaaacttgctcaccacagctggagatcaggaatagaacctttccaagatatcataatattttctttataggaacactgagtaatggcaagaatattttgagcttttccatggttaagagcgatagtctcagagg

SEQ ID NO: 372453 - DNA, 1299 bp, Homo sapiens
atcagccggtccctcgcgacgttatcctgtaacataaattttattaaataatacttccccacagatgagaggcacgcaacacctatggacaaaagggagttacagaggctgcttaaaagatggagaaaagcctgagattgaaggaggaaaaaaacccagtatttaaagtctataaaaaatactcaaaatagtgggtcttcgagtttaaaatagtcattgttattttacattctaaagtgcatgtaggttgatattttttaaaatatcattggagaatttaatctttctttataaaaatagagcatttttctgctttctggcaaaagttggggataaaaggaaaaaaagttgtcaaaatgtaattttcagtccaattcaccaggaaaacatgcttgtgaattgtgcagtaaaaggtggtaatgactactggaagctaagtcaaaggtgatttcctacctgattttacttacttaaataaaagttacttacaatgggagtgaaaaactgaggtttctgttatttagtagagaaatcaactccacgtttacttaaagagatggtaaggtcaaggttcaaatgctactgtgttttaatttggatatttgaaatttctcttgaggccaaaaaaaaaaaaaattgatgcctctccttaaatctaggatgaagtgtcaacatggagacaggtaaccactgttatagagtcttgtcacctaaagggatgtcttggttaacacgtaacagtgcaagtttggccataggttatttatttgtacttttttagtttgaaggactgaggaaacaatagctacagaaaatacttcttgtgccttattcctaacaaagctgaggtccctgcctggggttagttacaagtataaatacttaacgaggtgcgttcattataaaagcctcagtatagaaaccttaaagtttatctaggaaagtttagtatattttcaggtgttgctaaaaaattactcatcatctgtttgcaaaagtatgacttgacctatagaaatctgtttctttatgctttgtactcatacaagcatctaggtaggatattaataaataatacaggataatagcatcaccagtgtccaataacgggccatcaggaacaggattcacgtttggtggatatgagagaaaataaacacttcaggaaacttgctcaccacagctggagatcaggaatagaacctttccaagatatcataatattttctttataggaacactgagtaatggcaagaatattttgagcttttccatggttaagagcgatagtctcagagg

SEQ ID NO: 372454 - DNA, 312 bp, Homo sapiens
gccatgtttggattcacctgtaaattgttagtaaatgtgtttcctatgtgtatgtataagcaagtttgaatctgcctgtttccttttttgaaggtcggctttctctctttggggttttctaggtggaaagttaccgaggctggacagtgtagtgagactgcagtttaaagaccacattgtcctcacagtactgccggatcaagatcaatctgtgagtatccaagaggagatttcctgtcttctcagggtgtttttcatcagaggcctcaggttattagattaaccactggtctctgcccttctttaggaatc

SEQ ID NO: 372455 - DNA, 3229 bp, Homo sapiens
agccgctgcgccgcaacgcagtgggctcgcggccgcgagcaacaggccgtgccgggtttgcatttccttactgctttgtcttgaagacagaacgatgccaaagaaagcaaagcctacagggagtgggaaggaagaggggccggctccctgtaagcagatgaagttagaagcagctggggggccttcagctttaaactttgacagtcccagtagtctctttgaaagtttaatctcgcccatcaagacagagacttttttcaaggaattctgggagcagaagccccttctcattcagagagatgaccctgcactggccacatactatgggtccctgttcaagctaacagatctgaagagtctgtgcagccgggggatgtactatggaagagatgtgaatgtctgccggtgtgtcaatgggaagaagaaggttttaaataaagatggcaaagcacactttcttcagctgagaaaagattttgatcagaaaagggcaacgattcagtttcaccaacctcagagatttaaggatgagctttggaggatccaggagaagctggaatgttactttggctccttggttggctcgaatgtgtacataactcccgcaggatctcagggcctgccgccccattatgatgatgtcgaggttttcatcctgcagctggagggagagaaacactggcgcctctaccaccccactgtgcccctggcacgagagtacagcgtggaggccgaggaaaggatcggcaggccggtgcatgagtttatgctgaagccgggtgatttgttgtactttcccagaggaaccattcatcaagcggacactcctgcggggctggcccactcgactcacgtgaccatcagcacctaccagaacaattcatggggagatttccttttggataccatctcggggcttgtatttgatactgcaaaggaagacgtggagttacggaccggcataccccggcagctgctcctgcaggtggaatccacaactgttgctacaagacgattaagtggcttcctgaggacacttgcagaccggctggagggcaccaaagaactgctttcctcagacatgaagaaggattttattatgcacagactccccccttactctgcgggagatggggcagagctgtcaacaccaggtggaaagttaccgaggctggacagtgtagtgagactgcagtttaaagaccacattgtcctcacagtactgccggatcaagatcaatctgatgaaactcaagaaaagatggtgtacatctatcattccttaaagaatagtagagagacacacatgatgggaaatgaggaggaaacagagtttcatggacttcgcttccctttgtcacatttggatgcactgaagcaaatttggaatagtccagctatttctgtcaaggacctgaaacttactacagatgaggaaaaggaaagcctggtattatccctctggacagaatgtttaattcaagtagtctagtgcctttgcagaatcaaatgcctactattttatatgcatatattaaaagaaaagcaaagacctgagccgaggagaggatgaattcaagtttccttacctgcgtatctactaacaaacatgagacctccctgttacaggtggtcagttggccaaatgtactaacgggcacatgaaagaaagaacagcaaattaccaagtgtctcagaaaatgacaaaaccatattttgacaagtttatttaatccagtgtggtagaaaaggcacaattccaatgtatcatttagaattgaatgtcattaacctggctttgttctttggaagaaacaacttctttaaagagcttctttggctctagaaaaatttcaaacaattaaaataagaaaaaattttaaactggttttttataatgaaaatatacatacctttgtgtatagacaagcccatgcccattaaaataaagttatcctgtaacataaattttattaaataatacttccccacagatgagaggcacgcaacacctatggacaaaagggagttacagaggctgcttaaaagatggagaaaagcctgagattgaaggaggaaaaaaacccagtatttaaagtctataaaaaatactcaaaatagtgggtcttcgagtttaaaatagtcattgttattttacattctaaagtgcatgtaggttgatattttttaaaatatcattggagaatttaatctttctttataaaaatagagcatttttctgctttctggcaaaagttggggataaaaggaaaaaaagttgtcaaaatgtaattttcagtccaattcaccaggaaaacatgcttgtgaattgtgcagtaaaaggtggtaatgactactggaagctaagtcaaaggtgatttcctacctgattttacttacttaaataaaagttacttacaatgggagtgaaaaactgaggtttctgttatttagtagagaaatcaactccacgtttacttaaagagatggtaaggtcaaggttcaaatgctactgtgttttaatttggatatttgaaatttctcttgaggccaaaaaaaaaaaaaattgatgcctctccttaaatctaggatgaagtgtcaacatggagacaggtaaccactgttatagagtcttgtcacctaaagggatgtcttggttaacacgtaacagtgcaagtttggccataggttatttatttgtacttttttagtttgaaggactgaggaaacaatagctacagaaaatacttcttgtgccttattcctaacaaagctgaggtccctgcctggggttagttacaagtataaatacttaacgaggtgcgttcattataaaagcctcagtatagaaaccttaaagtttatctaggaaagtttagtatattttcaggtgttgctaaaaaattactcatcatctgtttgcaaaagtatgacttgacctatagaaatctgtttctttatgctttgtactcatacaagcatctaggtaggatattaataaataatacaggataatagcatcaccagtgtccaataacgggccatcaggaacaggattcacgtttggtggatatgagagaaaataaacacttcaggaaacttgctcaccacagctggagatcaggaatagaacctttccaagatatcataatattttctttataggaacactgagtaatggcaagaatattttgagcttttccatggttaagagcgatagtctcagagg

SEQ ID NO: 372456 - DNA, 3696 bp, Homo sapiens
agccgctgcgccgcaacgcagtgggctcgcggccgcgagcaacaggccgtgccgggtgagtggggcgctctcgtgggcatcccagcgccggggcaggccgggtagtgcccgatcccgcggggcgcgcgctgctgctttaggcacccgggctcgggtgcgggtctgggagacctgtcggtcggcgagaagcctcggtggccggcgctgtggttgcgggacctgggacgcgctcccaggcgtcccacctccccggagactggggcagggtgggtggggcccggatctaggggtagggtcgcggaagccttggttacagagagtcgcacacgtggcctgctaatggtcgcgacaccggtgacgagcgcacggaaagtttggaggcttagcaaggagggtggtgccggcctccgcccggtggtggcagaactgcctgtgcgagcacggcttccacgtgggctgcgccgccgggcgtcatgtcgggcctaagagacacgctctacagctgtgaaatctgaagttcaggtttgcatttccttactgctttgtcttgaagacagaacgatgccaaagaaagcaaagcctacagggagtgggaaggaagaggggccggctccctgtaagcagatgaagttagaagcagctggggggccttcagctttaaactttgacagtcccagtagtctctttgaaagtttaatctcgcccatcaagacagagacttttttcaaggaattctgggagcagaagccccttctcattcagagagatgaccctgcactggccacatactatgggtccctgttcaagctaacagatctgaagagtctgtgcagccgggggatgtactatggaagagatgtgaatgtctgccggtgtgtcaatgggaagaagaaggttttaaataaagatggcaaagcacactttcttcagctgagaaaagattttgatcagaaaagggcaacgattcagtttcaccaacctcagagatttaaggatgagctttggaggatccaggagaagctggaatgttactttggctccttggttggctcgaatgtgtacataactcccgcaggatctcagggcctgccgccccattatgatgatgtcgaggttttcatcctgcagctggagggagagaaacactggcgcctctaccaccccactgtgcccctggcacgagagtacagcgtggaggccgaggaaaggatcggcaggccggtgcatgagtttatgctgaagccgggtgatttgttgtactttcccagaggaaccattcatcaagcggacactcctgcggggctggcccactcgactcacgtgaccatcagcacctaccagaacaattcatggggagatttccttttggataccatctcggggcttgtatttgatactgcaaaggaagacgtggagttacggaccggcataccccggcagctgctcctgcaggtggaatccacaactgttgctacaagacgattaagtggcttcctgaggacacttgcagaccggctggagggcaccaaagaactgctttcctcagacatgaagaaggattttattatgcacagactccccccttactctgcgggagatggggcagagctgtcaacaccaggtggaaagttaccgaggctggacagtgtagtgagactgcagtttaaagaccacattgtcctcacagtactgccggatcaagatcaatctgatgaaactcaagaaaagatggtgtacatctatcattccttaaagaatagtagagagacacacatgatgggaaatgaggaggaaacagagtttcatggacttcgcttccctttgtcacatttggatgcactgaagcaaatttggaatagtccagctatttctgtcaaggacctgaaacttactacagatgaggaaaaggaaagcctggtattatccctctggacagaatgtttaattcaagtagtctagtgcctttgcagaatcaaatgcctactattttatatgcatatattaaaagaaaagcaaagacctgagccgaggagaggatgaattcaagtttccttacctgcgtatctactaacaaacatgagacctccctgttacaggtggtcagttggccaaatgtactaacgggcacatgaaagaaagaacagcaaattaccaagtgtctcagaaaatgacaaaaccatattttgacaagtttatttaatccagtgtggtagaaaaggcacaattccaatgtatcatttagaattgaatgtcattaacctggctttgttctttggaagaaacaacttctttaaagagcttctttggctctagaaaaatttcaaacaattaaaataagaaaaaattttaaactggttttttataatgaaaatatacatacctttgtgtatagacaagcccatgcccattaaaataaagttatcctgtaacataaattttattaaataatacttccccacagatgagaggcacgcaacacctatggacaaaagggagttacagaggctgcttaaaagatggagaaaagcctgagattgaaggaggaaaaaaacccagtatttaaagtctataaaaaatactcaaaatagtgggtcttcgagtttaaaatagtcattgttattttacattctaaagtgcatgtaggttgatattttttaaaatatcattggagaatttaatctttctttataaaaatagagcatttttctgctttctggcaaaagttggggataaaaggaaaaaaagttgtcaaaatgtaattttcagtccaattcaccaggaaaacatgcttgtgaattgtgcagtaaaaggtggtaatgactactggaagctaagtcaaaggtgatttcctacctgattttacttacttaaataaaagttacttacaatgggagtgaaaaactgaggtttctgttatttagtagagaaatcaactccacgtttacttaaagagatggtaaggtcaaggttcaaatgctactgtgttttaatttggatatttgaaatttctcttgaggccaaaaaaaaaaaaaattgatgcctctccttaaatctaggatgaagtgtcaacatggagacaggtaaccactgttatagagtcttgtcacctaaagggatgtcttggttaacacgtaacagtgcaagtttggccataggttatttatttgtacttttttagtttgaaggactgaggaaacaatagctacagaaaatacttcttgtgccttattcctaacaaagctgaggtccctgcctggggttagttacaagtataaatacttaacgaggtgcgttcattataaaagcctcagtatagaaaccttaaagtttatctaggaaagtttagtatattttcaggtgttgctaaaaaattactcatcatctgtttgcaaaagtatgacttgacctatagaaatctgtttctttatgctttgtactcatacaagcatctaggtaggatattaataaataatacaggataatagcatcaccagtgtccaataacgggccatcaggaacaggattcacgtttggtggatatgagagaaaataaacacttcaggaaacttgctcaccacagctggagatcaggaatagaacctttccaagatatcataatattttctttataggaacactgagtaatggcaagaatattttgagcttttccatggttaagagcgatagtctcagagg

SEQ ID NO: 372457 - DNA, 3684 bp, Homo sapiens
agccgctgcgccgcaacgcagtgggctcgcggccgcgagcaacaggccgtgccgggtttgcatttccttactgctttgtcttgaagacagaacgatgccaaagaaagcaaagcctacagggagtgggaaggaagaggggccggctccctgtaagcagatgaagttagaagcagctggggggccttcagctttaaactttgacagtcccagtagtctctttgaaagtttaatctcgcccatcaagacagagacttttttcaaggaattctgggagcagaagccccttctcattcagagagatgaccctgcactggccacatactatgggtccctgttcaagctaacagatctgaagagtctgtgcagccgggggatgtactatggaagagatgtgaatgtctgccggtgtgtcaatgggaagaagaaggttttaaataaagatggcaaagcacactttcttcagctgagaaaagattttgatcagaaaagggcaacgattcagtttcaccaacctcagagatttaaggatgagctttggaggatccaggagaagctggaatgttactttggctccttggttggctcgaatgtgtacataactcccgcaggatctcagggcctgccgccccattatgatgatgtcgaggttttcatcctgcagctggagggagagaaacactggcgcctctaccaccccactgtgcccctggcacgagagtacagcgtggaggccgaggaaaggatcggcaggccggtgcatgagtttatgctgaagccgggtgatttgttgtactttcccagaggaaccattcatcaagcggacactcctgcggggctggcccactcgactcacgtgaccatcagcacctaccagaacaattcatggggagatttccttttggataccatctcggggcttgtatttgatactgcaaaggaagacgtggagttacggaccggcataccccggcagctgctcctgcaggtggaatccacaactgttgctacaagacgattaagtggcttcctgaggacacttgcagaccggctggagggcaccaaagaactgctttcctcagacatgaagaaggattttattatgcacagactccccccttactctgcgggagatggggcagagctgtcaacaccaggtggaaagttaccgaggctggacagtgtagtgagactgcagtttaaagaccacattgtcctcacagtactgccggatcaagatcaatctgatgaaactcaagaaaagatggtgtacatctatcattccttaaagaatagtagagagacacacatgatgggaaatgaggaggaaacagaggtttgtttcaactgaaaacaaatgcctatcctgtgacttgggtggtggttgggaagaattgattatttttgatttacaggtaatatgctttttatggctgcactgtggacttaaccattttgcactactcacagagctcctgcatggggatgattaagtcagacatttctgtgatacatgcacaccagttttaagacatactagctgggacctgtagccttataggaatggtataatgtaaaacatttcaaattactaatatcacttactacataaattaggatgccttttatatagaagttggcatcttttatgttatctaattgtagtgtgtctaaaatactcatgaggggtatcaaaaataatgatgtatggagaataaatttacaggaaaatgctacttcaatgacataagtagtatacatatattttgacaaataaatttatcctttcagtttcatggacttcgcttccctttgtcacatttggatgcactgaagcaaatttggaatagtccagctatttctgtcaaggacctgaaacttactacagatgaggaaaaggaaagcctggtattatccctctggacagaatgtttaattcaagtagtctagtgcctttgcagaatcaaatgcctactattttatatgcatatattaaaagaaaagcaaagacctgagccgaggagaggatgaattcaagtttccttacctgcgtatctactaacaaacatgagacctccctgttacaggtggtcagttggccaaatgtactaacgggcacatgaaagaaagaacagcaaattaccaagtgtctcagaaaatgacaaaaccatattttgacaagtttatttaatccagtgtggtagaaaaggcacaattccaatgtatcatttagaattgaatgtcattaacctggctttgttctttggaagaaacaacttctttaaagagcttctttggctctagaaaaatttcaaacaattaaaataagaaaaaattttaaactggttttttataatgaaaatatacatacctttgtgtatagacaagcccatgcccattaaaataaagttatcctgtaacataaattttattaaataatacttccccacagatgagaggcacgcaacacctatggacaaaagggagttacagaggctgcttaaaagatggagaaaagcctgagattgaaggaggaaaaaaacccagtatttaaagtctataaaaaatactcaaaatagtgggtcttcgagtttaaaatagtcattgttattttacattctaaagtgcatgtaggttgatattttttaaaatatcattggagaatttaatctttctttataaaaatagagcatttttctgctttctggcaaaagttggggataaaaggaaaaaaagttgtcaaaatgtaattttcagtccaattcaccaggaaaacatgcttgtgaattgtgcagtaaaaggtggtaatgactactggaagctaagtcaaaggtgatttcctacctgattttacttacttaaataaaagttacttacaatgggagtgaaaaactgaggtttctgttatttagtagagaaatcaactccacgtttacttaaagagatggtaaggtcaaggttcaaatgctactgtgttttaatttggatatttgaaatttctcttgaggccaaaaaaaaaaaaaattgatgcctctccttaaatctaggatgaagtgtcaacatggagacaggtaaccactgttatagagtcttgtcacctaaagggatgtcttggttaacacgtaacagtgcaagtttggccataggttatttatttgtacttttttagtttgaaggactgaggaaacaatagctacagaaaatacttcttgtgccttattcctaacaaagctgaggtccctgcctggggttagttacaagtataaatacttaacgaggtgcgttcattataaaagcctcagtatagaaaccttaaagtttatctaggaaagtttagtatattttcaggtgttgctaaaaaattactcatcatctgtttgcaaaagtatgacttgacctatagaaatctgtttctttatgctttgtactcatacaagcatctaggtaggatattaataaataatacaggataatagcatcaccagtgtccaataacgggccatcaggaacaggattcacgtttggtggatatgagagaaaataaacacttcaggaaacttgctcaccacagctggagatcaggaatagaacctttccaagatatcataatattttctttataggaacactgagtaatggcaagaatattttgagcttttccatggttaagagcgatagtctcagagg

SEQ ID NO: 372458 - DNA, 2427 bp, Homo sapiens
tccaggctggattttgacctgtgtcttggacagtgatgctggagctagaatgagaagatgtgacttgagggccattgctccccagaaatgatcctgtgttttgagcctaatgctccttcaggtaccatgtaaagttcatggggagatttccttttggataccatctcggggcttgtatttgatactgcaaaggaagacgtggagttacggaccggcataccccggcagctgctcctgcaggtggaatccacaactgttgctacaagacgattaagtggcttcctgaggacacttgcagaccggctggagggcaccaaagaactgctttcctcagacatgaagaaggattttattatgcacagactccccccttactctgcgggagatggggcagagctgtcaacaccaggtggaaagttaccgaggctggacagtgtagtgagactgcagtttaaagaccacattgtcctcacagtactgccggatcaagatcaatctacacacatgatgggaaatgaggaggaaacagagtttcatggacttcgcttccctttgtcacatttggatgcactgaagcaaatttggaatagtccagctatttctgtcaaggacctgaaacttactacagatgaggaaaaggaaagcctggtattatccctctggacagaatgtttaattcaagtagtctagtgcctttgcagaatcaaatgcctactattttatatgcatatattaaaagaaaagcaaagacctgagccgaggagaggatgaattcaagtttccttacctgcgtatctactaacaaacatgagacctccctgttacaggtggtcagttggccaaatgtactaacgggcacatgaaagaaagaacagcaaattaccaagtgtctcagaaaatgacaaaaccatattttgacaagtttatttaatccagtgtggtagaaaaggcacaattccaatgtatcatttagaattgaatgtcattaacctggctttgttctttggaagaaacaacttctttaaagagcttctttggctctagaaaaatttcaaacaattaaaataagaaaaaattttaaactggttttttataatgaaaatatacatacctttgtgtatagacaagcccatgcccattaaaataaagttatcctgtaacataaattttattaaataatacttccccacagatgagaggcacgcaacacctatggacaaaagggagttacagaggctgcttaaaagatggagaaaagcctgagattgaaggaggaaaaaaacccagtatttaaagtctataaaaaatactcaaaatagtgggtcttcgagtttaaaatagtcattgttattttacattctaaagtgcatgtaggttgatattttttaaaatatcattggagaatttaatctttctttataaaaatagagcatttttctgctttctggcaaaagttggggataaaaggaaaaaaagttgtcaaaatgtaattttcagtccaattcaccaggaaaacatgcttgtgaattgtgcagtaaaaggtggtaatgactactggaagctaagtcaaaggtgatttcctacctgattttacttacttaaataaaagttacttacaatgggagtgaaaaactgaggtttctgttatttagtagagaaatcaactccacgtttacttaaagagatggtaaggtcaaggttcaaatgctactgtgttttaatttggatatttgaaatttctcttgaggccaaaaaaaaaaaaaattgatgcctctccttaaatctaggatgaagtgtcaacatggagacaggtaaccactgttatagagtcttgtcacctaaagggatgtcttggttaacacgtaacagtgcaagtttggccataggttatttatttgtacttttttagtttgaaggactgaggaaacaatagctacagaaaatacttcttgtgccttattcctaacaaagctgaggtccctgcctggggttagttacaagtataaatacttaacgaggtgcgttcattataaaagcctcagtatagaaaccttaaagtttatctaggaaagtttagtatattttcaggtgttgctaaaaaattactcatcatctgtttgcaaaagtatgacttgacctatagaaatctgtttctttatgctttgtactcatacaagcatctaggtaggatattaataaataatacaggataatagcatcaccagtgtccaataacgggccatcaggaacaggattcacgtttggtggatatgagagaaaataaacacttcaggaaacttgctcaccacagctggagatcaggaatagaacctttccaagatatcataatattttctttataggaacactgagtaatggcaagaatattttgagcttttccatggttaagagcgatagtctcagagg

SEQ ID NO: 372459 - DNA, 444 bp, Homo sapiens
tcatcacacccaactgtcagtaagtacgaattatctcccattttacattttagaaaactgaggctcagcagtattttataacttactccgaactcccgctgcctgcttgtcagtgacagagtcgatttggtcccacgtggggagagctgtggaattcccaagcccagaccctgcattataacggctatttccagcacttctggagaggatgccaaatgcattcatcagcttttctgagattccttagggaagggagagtggagtgtgtagccctgctttgtgctttttttctctaacagagggttgtgagagagagagccctgttgggcataaggaaatatgtttttagtacaggttctgccacttgctcataggtcatttcactttagcttggtttttcaattatagaaaaaaattattaagcttcattcctagaaaaaaaaa

SEQ ID NO: 372460 - DNA, 508 bp, Homo sapiens
tgcagccataaaaaatgatgagttcatgtcctttgtaaggacgtggatgaagctggaaaccgtcattctcagcaaactatcgcaaggacaaaaaaccaaacactgcatgttctcactcataggtgggaattgaacaatgagaacacatggacacaggaaggggaacatcacatactggggactgttgtggggtgcggggagtggggagggatagcattaggagatatacctaatgctaaatgactagttaatgggtgcagcacaccaacatgacacatgtatacatatgtaacaaacctgcacggtgtgcacatgtaccctaaagcttaaagtataacaataaaaaaaaaaaaaaaaaaaactctcagaataaaacttagatgtattttgtcatgactttggattagcccattttttctgtattatgataccaaaagcccaagcagctaaagagaaaattagataaattgaacttcaatttaattaaaattaaaaactttaaaaaaaa

SEQ ID NO: 372461 - DNA, 399 bp, Homo sapiens
aaaaaaaaaaagaaattattttccacaaagaggtggcagcaccaccacccctacctcatgtacaagtctgttggcctccagatggcacaccccgacttgctcacaatagctcacacctctccctgcctgcccaagtgctgctgtctgccccacaaggcacccacattatgtgggcctgtatttcagctctgtccacatgaggacccctgggagggcaggactcaggcaccactgggctgtttccctgctgttctgtggactccacacaggggtgtgacctcaaactggagtttacacctttctcttaaagcttgccttggcaccttcctgtctggaaacattatcttctgatatctagttgtttgacacagttatggtggttctgttcttctgtagctc

SEQ ID NO: 372462 - DNA, 779 bp, Homo sapiens
tcacaaagtgagagcaatcagattttgtgcctcctaatggaagtacatataccacctatgaagcagttctgccaaaagtcacatctcatcatgatgaagcctcctgatctaactaccccttcattagaaatacaggggacagagggacaaataatatacaagggactcaatcagcaaaatccagactctggaaaactacaagacatatggtcctgcttcaacaacagaaatgcaaagagaaaagacaacgatgggttaaaggagacttaagagctacatctatcaagacaatttatggacttatttggatactgatttgaacaaactgttgagaccattggaaaaatgtgaaaagtggatatttgatattaaggtttttaattatttttaggtgtgataatggtattgttacattttttaaaggaccccttttagagatgcaaattgaaacacttaaaaaatgaaatgatacgatgtataagtttttgcttaaaaataaggattgaagttggctggtgtgtgtggatatagttgaaacaagattggctgtgagttgataattattgaagctgggtgatgggcacttggggatttattatactattttctctacctgtgtttatatttgaaatttttcatagaagttttaaaatgtggccagttgtgatggctcatacctgtaatcccaacactttgggaggccaaggtgggaggatcacttgagctcaggagttagagaccagcctgggcaaaatagtgagactccatctcaaagaaaa

SEQ ID NO: 372463 - DNA, 511 bp, Homo sapiens
  misc_feature (5)..(5): n is a, c, g, or t
  misc_feature (510)..(511): n is a, c, g, or t
gggangctgaggccggccggaggcagcacgcggaggagcgcggccgccgcaaccccaagacggggttgaccctggagcgtgtgggccctgaaagcagcccttacctctcgcggcgccaccgcggccagggccaggagggcgagcactaccacagctgcgtgcagctggccccgacgcgaggcctggaggagctgggccacggccccctgagcttggccggtggccctcgggtgggcggggtggcggccgcggccactgaagcaccgcgcatggagtggaaagtgaaggtgcgcagcgacggaacccgctacgtggccaagcggcccgtgcgagatcggctgctgaaagcccgtgccctgaagatccgggaggagcgcagcggtatgacgaccgacgacgacgcggtgagcgagatgaagatgggccgctactggagcaaggaggagcggaagcagcaccctgcatctcaagaataaagcaagctgcctttgtacttggttgaaaaaaaann

SEQ ID NO: 372464 - DNA, 1911 bp, Homo sapiens
  misc_feature (5)..(5): n is a, c, g, or t
  misc_feature (1910)..(1911): n is a, c, g, or t
gggangctgaggccggccggaggcagcacgcggaggagcgcggccgccgcaaccccaagacggggttgaccctggagcgtgtgggccctgaaagcagcccttacctctcgcggcgccaccgcggccagggccaggagggcgagcactaccacagctgcgtgcagctggccccgacgcgaggcctggaggagctgggccacggccccctgagcttggccggtggccctcgggtgggcggggtggcggccgcggccactgaagcaccgcgcatggagtggaaagtgaaggtgcgcagcgacggaacccgctacgtggccaagcggcccgtgcgagatcggctgctgaaagcccgtgccctgaagatccgggaggagcgcagcggtatgacgaccgacgacgacgcggtgagcgagatgaagatgggccgctactggagcaaggaggagcggaagcagcacctgatccgggcccgtgagcagcggaagcggcgcgagttcatgatgcagagccggctggagtgcctgcgggagcagcagaatggcgacagcaagcccgagctcaacatcattgccctgagccaccgcaaaaccatgaagaagcggaacaagaagatcctggacaactggatcaccatccaggagatgctggcccacggcgcgcgctccgccgatggcaagcgggtctacaaccctcttctctcagtcaccaccgtgtgagctgcccgggcgggtacacggcccaggcccagggaaccccctggggccccggccctcactctcctatagagattgtgtgtgtgtgtgtgtgcgcgcgcgcgtgctcgctgtgcgcacgcacacatctcctcgtctgggtgtgcgcacagggctttgttagcagagagaagcccctgaggagaagggacgcttttcttccttctgcccaagtaaagtgaccatgccagtggccagcactgggggcacacctgtgatgggcaccccttcagctgtgcgtgtgcattccccatcccccatgctcttgcgtgtgcttgcacgtgcacgcacacacacacccagtgctctctccacccgacccgtgtacttgcagacagggaagctgagctgaaaggagcacaagagagtgtccggcttcgctgctgagcgcggcctctccccgccgctgcgcactgcagttatttgtagacaaaggcacccctgatttttgtggtttttctccctttctgtgcttgccaatagttgttttgttttgtggacctgccctgggggctggcagctccttcaggcagcctggcagaagtggaactcccctctccactgatggctgggaagggagttggggaggaagagtgggagggagggctggggatggatgggagggaaggggagggaaaggtgggaggaatgggaagcagctgttctggtggcttccactctgaggtgtgggaacggggagcctctggggggcacctgtttccccagtgactcagagagagcaagactgcaggaacggaggggtcctgcagggtgtccaccaagaagtcacagagcccgttctgcgccccacaccatctggagcaggggcttctcttctgagtgaactgaggaaggtgcttagatggtgagggctctagaaaccaagccccatgagcagcagtggaagacctcgggccatgcggcctggggaggacttggtggcgatccgcaacctggaccccagtgagaggcggtgggctgactgggaaggagaggcccccaacctcctcaggatttgcacgtgtgaactaggctgcctgtggggtgccccttaggcttggagagccccagattggaggcagacagactgcaccaccccttccccccctgcatctcaagaataaagcaagctgcctttgtacttggttgaaaaaaaann

SEQ ID NO: 372465 - DNA, 5589 bp, Homo sapiens
  misc_feature (3)..(3): n is a, c, g, or t
  misc_feature (5)..(5): n is a, c, g, or t
  misc_feature (8)..(10): n is a, c, g, or t
  misc_feature (12)..(14): n is a, c, g, or t
ggncncgnnncnnngcctgggcgcggggcgggaggcggtgaccagcagcaggaggagaaagaacatggcgggcgcatcagagctcgggaccggcccaggagcagcgggtggagatggagatgattcgctatacccgatcgcggttttaatcgacgagctccgcaatgaagacgtgcagctccgactcaacagtattaagaagttatcaacaattgccctagcacttggagtagaaaggacccgaagtgaattgttgccatttcttacagatacaatttatgatgaagatgaggtactattagctcttgctgagcagctgggaaatttcactggcctagtgggaggtcctgactttgcccactgtctgctgcctcctttggaaaatctggcaactgtggaagagactgttgttcgtgacaaggctgtggagtccctgagacagatctcccaggagcatactcctgttgctctggaagcttattttgtacctctggtgaaacgcttagcaagtggggattggttcacctctcgcacatctgcatgtggtttgttcagcgtttgctatcccagggcatcaaatgctgttaaagcagaaatcagacagcaattccgttccttgtgctcagatgacacaccaatggtacgacgtgctgctgcttccaaattgggtgaatttgcaaaagttttggaattagacagtgtgaaaagtgaaattgttccactgttcactagtctagcttcagatgaacaggattcagtgcgcctccttgctgtggaagcttgtgtcagtattgcccagttattgtctcaggatgaccttgagactttggtgatgcctacacttcgacaagcagcagaagataaatcttggcgcgttcgctatatggtggctgacagattttcagagctccagaaagccatgggtcctaaaatcaccctaaatgacctcatccccgcctttcagaacctacttaaagactgtgaagctgaagtccgggcagctgctgcccacaaagtaaaagaacttggtgagaacttgcccattgaagatagagagaccataattatgaatcaaattctgccttatataaaggaattagtatccgataccaatcaacatgtcaaatcggctctagcttctgtaattatgggattgtctactattttgggcaaagaaaataccattgaacatcttctacctcttttcttagctcagttaaaggatgagtgtcctgacgttcgtttgaatatcatctccaatttggattgtgtaaatgaagtgattggaatccgtcagctctctcagtctctccttcctgccatagtggagctggcagaagatgccaaatggagggtccgcctggccatcattgagtatatgccgctgctggcaggccagctgggtgtggaattctttgatgaaaagctgaattctttatgtatggcttggctcgtggaccatgtatacgccatccgagaagctgccaccaacaacctcatgaaactagttcagaagtttggtacagagtgggcccaaaatactattgttcccaaagtgttagtaatggcaaatgatcctaattacttgcatagaatgaccactttattctgcattaatgcactgtctgaggcctgtggtcaggaaataactactaagcaaatgctgcccatcgtattaaaaatggcaggagaccaagtagcaaatgttcgcttcaatgtggccaaatctctacaaaagattggaccaattctagataccaatgctttacagggagaagtgaagccagtactacagaagttaggtcaagatgaagacatggatgtcaaatactttgcacaggaagctataagtgttcttgcattggcataatgaggagcaggagggaaaaggcctttactagattcttgtcacaaatttctagtcaatgtgttcttaactgggtggagaaagaatggaaaaccttcaagatctcatccaagcaaatggcaacaacttagaagaaatcatttagtgacttaattctttctaaagatgaaatgggattgttttttactcgtcttccttgttaaatcattatttaagccgttcttattgaccaattcctgacacttgattgtctcctaatgctttatccatcaccacctgggctcctgcatcctcactgtggaatcaggcaccagccacataatgttccagacaaagcctggaagggtgtggacccagacgtggagtggagtgattctcttgacgtttacatatatctctgtgtctctccatcattccaaagctaaatgtacatgtttagaataacttattttataaactcttcgggagacatgttgagatttgaccgtaatgaaagccacattttcctgaattatgatggtctgcattagtctcatgtgaaaggggaatgtggaagctcagggttaatgtagtggttgttttggtttttatttgctcaattttgtctgtactcatgtcattcagaaacctgaagtgtggctgcatcttgctgctaatgtgtgatgttgacgcctaactgaatttgaacagctcaccactgtgcctacatttaaaaatacttctctctcttttctaaaaagctttaactgtagtgcctcctaataagcagtatgtttgtttcattgtgagattgcagttctgtatttcgaatgagtctaagaaccacagggataatactgtgcagatttcctgttctttacctggctctgcttccagcagtattgacacctagtccttgctgcattgtacagtagcttttcaaactgcagttttattgctaagtttttagtatgggtgatactggagtcttatcatttgaagtgtttgcttttctacttttacagtaaaacctcattaattctgaaatttaagataatgagttaagctgaagagtttactgaagcaaattaatagtgaggaagcctatttgaactacttaaacagtattaaagccctttttaaaaagcacctatttgggatcatttgaggtcaagaattcgagatcagcctgaccaacatggtgaaaccccatctctactaaaaatacaaaaaagttagctgggcgtggtggcacacacctgtagtcccagctactcaggaggctgaggcaggagaattgcttgaacctgggaggtagaggttgcactgagccgagatcgcgccactgcactctagcctgggccatagagcgagagtccatctcaaaaaaaaacaactatttttcacataatcaaactcaccttgtctcatgacttttggttaagggggttttcccatagtttatttttctctcagtgcatcttgctatgaggtttgcttgttacccttttggtttttgaattgttgattttgttcacaacctcttttaaatctaacaagtcctgttctgtttagtgaaggcccaaagactcctctaagactttgtatatttgttacataaaaccaagttttactaaatactttaaaatttgtcctacattcgaaaaatagaaattgtaaatcagaggttatctgtctgcattttaaactgccaaattaccttatagtaagtttctattttatgactttgggccaagaattaagtattttcctaagcacaaatctttttctatattctcattttaatatcttatgctattattctgtaaacattttaattttagtttcatgagtctttattttttgttacctgcaagttatgttcttcttcattgaatttcatatttgagagacatttgtcttcatgaagcagatttgcactggaaccattgctttactctggttggaaatgccattgttttggggacagacttttaaaatgcccttgtgtctcccagtgaggagccctaagcattgacttctctaccctaaaactgtttgagagagggagagtgggccctggctttctcaagcatgggtcgggggttcagcggggcctctgtcttttgtggtgacccctcaggggtttcattgtttccttctgacttaagcaatagagagagaatttgttttggtactcttcagaggaattgtgctttggctcataacttggccatgttctccatgaattagttctcctatttttttttttaactaccttaaacttaagggaaaagttctcctatcttgatttcactggaatataggctttaggagctctgtaaggctggtatttttgtctgttttatcttctactgtatcgccagtgcctggaacagtgtctggtgcacataataggtgctcaataaaaatgtgttcaatggatgaatttctaaaatatcctccaatgtgtgcatggaacaaataatcaaaagaaccagactgtgtcttattctcccactgacagaaagattttcctgctttcaggaaacaagctttatgtggcccttttctggtcccctggcttagactacagttctgtgtggatttgtctgattgcttcagacatgtaatgttgtttttcatccttggcagcttacatcagttgtttgtttgattagaaaaatgaagcagacacacacacacacacacacacacacacacacacacacacacacacaaacatataacctatgccaataaaaatgtctcagcaacagtggaattcaccttggtgtttctctctgtaatttgtgtggggtttacccctcacaggtttaagagaccaggtcttgtttctctctctgtgctaccaagaagatgtgaacctgaggatgcatcttgtttcataagaaggaaggcaggtgaatatgtggtttctaacgaggtcttgttgaaataacgggctgccctcagctcacagaaataccacagctcagccactgtgatgcagagccccaggggtctttgccagacaacttgtcctgactcaacagagacggcagcctgacctttgagctggcttgtccaggcattcaggttgcttgcgtagacttccagggaagcaagcctgtccttcctgacccggcggttaacctggtgcacttttgttcctttgttaactgttgtgttgtcactaaactgaaaggctggggcttgcccttagacgtcacattggctctgtccctgtggcgatggcagggcagggtggccaaacaggtcaggtgcttgttctgtcctcttgccttttacttaaattcctctgacttttaaaaatggtgacactcttatcgtaaagcttcttatttttctccactgcttggatatgaaactgtagagggagaggccctgttgcccagtgttctcctggtttagcagctgaggtgactgcagtctgatgtgatgtaactgtttccctttgattctccagtattcctgtttccatccagttccttactctcctctttcctcttccctcgcatgtctccctccagtcctctgtacctagaatagtctcactgtcccccgtttgcctccacgagcctgctgtttccaggaaattacataacgttcagttgggatggaaatcttccggaggacgaatagagtttaattactcattgcgtcggaaagccaagccatttctgtctccagagttgttctcttaaactgatatgagttct

SEQ ID NO: 372466 - DNA, 395 bp, Homo sapiens
accagccctggcaatgtagtaagaacctgtctctgcaaaaaatgaaaaaaattagccaggcctggtggtgcatgtctgtagacccagctactctggaggctgaagtgcttgagcctgggagggtgaggctgcagtgagccaaggtcatgccactgcactccagcctgggcaacagagcaagactctgtttcccagaataatggtatggaagtttctgttgtcttgtaataaaggcttttaatttcgattttattttaggaattagtatccgataccaatcaacatgtcaaatcggctctagcttctgtaatcccagcactttgggaggctgaggtgagtggattgcttgagaccaggagtttgagaccagcctggtcaacatggtgaagccctgt

SEQ ID NO: 372467 - DNA, 5967 bp, Homo sapiens
  misc_feature (3)..(3): n is a, c, g, or t
  misc_feature (5)..(5): n is a, c, g, or t
  misc_feature (8)..(10): n is a, c, g, or t
  misc_feature (12)..(14): n is a, c, g, or t
ggncncgnnncnnngcctgggcgcggggcgggaggcggtgaccagcagcaggaggagaaagaacatggcgggcgcatcagagctcgggaccggcccaggagcagcgggtggagatggagatgattcgctatacccgatcgcggttttaatcgacgagctccgcaatgaagacgtgcagctccgactcaacagtattaagaagttatcaacaattgccctagcacttggagtagaaaggacccgaagtgaattgttgccatttcttacagatacaatttatgatgaagatgaggtactattagctcttgctgagcagctgggaaatttcactggcctagtgggaggtcctgactttgcccactgtctgctgcctcctttggaaaatctggcaactgtggaagagactgttgttcgtgacaaggctgtggagtccctgagacagatctcccaggagcatactcctgttgctctggaagcttattttgtacctctggtgaaacgcttagcaagtggggattggttcacctctcgcacatctgcatgtggtttgttcagcgtttgctatcccagggcatcaaatgctgttaaagcagaaatcagacagcaattccgttccttgtgctcagatgacacaccaatggtacgacgtgctgctgcttccaaattgggtgaatttgcaaaagttttggaattagacagtgtgaaaagtgaaattgttccactgttcactagtctagcttcagatgaacaggattcagtgcgcctccttgctgtggaagcttgtgtcagtattgcccagttattgtctcaggatgaccttgagactttggtgatgcctacacttcgacaagcagcagaagataaatcttggcgcgttcgctatatggtggctgacagattttcagagctccagaaagccatgggtcctaaaatcaccctaaatgacctcatccccgcctttcagaacctacttaaagactgtgaagctgaagtccgggcagctgctgcccacaaagtaaaagaacttggtgagaacttgcccattgaagatagagagaccataattatgaatcaaattctgccttatataaaggaattagtatccgataccaatcaacatgtcaaatcggctctagcttctgtaattatgggattgtctactattttgggcaaagaaaataccattgaacatcttctacctcttttcttagctcagttaaaggatgagtgtcctgacgttcgtttgaatatcatctccaatttggattgtgtaaatgaagtgattggaatccgtcagctctctcagtctctccttcctgccatagtggagctggcagaagatgccaaatggagggtccgcctggccatcattgagtatatgccgctgctggcaggccagctgggtgtggaattctttgatgaaaagctgaattctttatgtatggcttggctcgtggaccatgtatacgccatccgagaagctgccaccaacaacctcatgaaactagttcagaagtttggtacagagtgggcccaaaatactattgttcccaaagtgttagtaatggcaaatgatcctaattacttgcatagaatgaccactttattctgcattaatgcactgtctgaggcctgtggtcaggaaataactactaagcaaatgctgcccatcgtattaaaaatggcaggagaccaagtagcaaatgttcgcttcaatgtggccaaatctctacaaaagattggaccaattctagataccaagtaagattttagtgtttagtcttgttttaaaagtgtactttaaattttaccttatagtggggagtaattagctaaaattaagttcagggattttcactttacttaagatctgggtttgcttaaagaaaataatttagcaactatttttgaggatgtccactatgacttttatatttaagctctgtaaatgtgtagatccttgtctgaagctgattttgctgagaatttctttagacattattttgtgtatttgtcaagtttataaatgtctttatttttttactttaaattttaacaattaccattaaccatatacaccaaaaaggatttctatggcccattagactgtctttcacagataatacttttgaatgtcagtgctttacagggagaagtgaagccagtactacagaagttaggtcaagatgaagacatggatgtcaaatactttgcacaggaagctataagtgttcttgcattggcataatgaggagcaggagggaaaaggcctttactagattcttgtcacaaatttctagtcaatgtgttcttaactgggtggagaaagaatggaaaaccttcaagatctcatccaagcaaatggcaacaacttagaagaaatcatttagtgacttaattctttctaaagatgaaatgggattgttttttactcgtcttccttgttaaatcattatttaagccgttcttattgaccaattcctgacacttgattgtctcctaatgctttatccatcaccacctgggctcctgcatcctcactgtggaatcaggcaccagccacataatgttccagacaaagcctggaagggtgtggacccagacgtggagtggagtgattctcttgacgtttacatatatctctgtgtctctccatcattccaaagctaaatgtacatgtttagaataacttattttataaactcttcgggagacatgttgagatttgaccgtaatgaaagccacattttcctgaattatgatggtctgcattagtctcatgtgaaaggggaatgtggaagctcagggttaatgtagtggttgttttggtttttatttgctcaattttgtctgtactcatgtcattcagaaacctgaagtgtggctgcatcttgctgctaatgtgtgatgttgacgcctaactgaatttgaacagctcaccactgtgcctacatttaaaaatacttctctctcttttctaaaaagctttaactgtagtgcctcctaataagcagtatgtttgtttcattgtgagattgcagttctgtatttcgaatgagtctaagaaccacagggataatactgtgcagatttcctgttctttacctggctctgcttccagcagtattgacacctagtccttgctgcattgtacagtagcttttcaaactgcagttttattgctaagtttttagtatgggtgatactggagtcttatcatttgaagtgtttgcttttctacttttacagtaaaacctcattaattctgaaatttaagataatgagttaagctgaagagtttactgaagcaaattaatagtgaggaagcctatttgaactacttaaacagtattaaagccctttttaaaaagcacctatttgggatcatttgaggtcaagaattcgagatcagcctgaccaacatggtgaaaccccatctctactaaaaatacaaaaaagttagctgggcgtggtggcacacacctgtagtcccagctactcaggaggctgaggcaggagaattgcttgaacctgggaggtagaggttgcactgagccgagatcgcgccactgcactctagcctgggccatagagcgagagtccatctcaaaaaaaaacaactatttttcacataatcaaactcaccttgtctcatgacttttggttaagggggttttcccatagtttatttttctctcagtgcatcttgctatgaggtttgcttgttacccttttggtttttgaattgttgattttgttcacaacctcttttaaatctaacaagtcctgttctgtttagtgaaggcccaaagactcctctaagactttgtatatttgttacataaaaccaagttttactaaatactttaaaatttgtcctacattcgaaaaatagaaattgtaaatcagaggttatctgtctgcattttaaactgccaaattaccttatagtaagtttctattttatgactttgggccaagaattaagtattttcctaagcacaaatctttttctatattctcattttaatatcttatgctattattctgtaaacattttaattttagtttcatgagtctttattttttgttacctgcaagttatgttcttcttcattgaatttcatatttgagagacatttgtcttcatgaagcagatttgcactggaaccattgctttactctggttggaaatgccattgttttggggacagacttttaaaatgcccttgtgtctcccagtgaggagccctaagcattgacttctctaccctaaaactgtttgagagagggagagtgggccctggctttctcaagcatgggtcgggggttcagcggggcctctgtcttttgtggtgacccctcaggggtttcattgtttccttctgacttaagcaatagagagagaatttgttttggtactcttcagaggaattgtgctttggctcataacttggccatgttctccatgaattagttctcctatttttttttttaactaccttaaacttaagggaaaagttctcctatcttgatttcactggaatataggctttaggagctctgtaaggctggtatttttgtctgttttatcttctactgtatcgccagtgcctggaacagtgtctggtgcacataataggtgctcaataaaaatgtgttcaatggatgaatttctaaaatatcctccaatgtgtgcatggaacaaataatcaaaagaaccagactgtgtcttattctcccactgacagaaagattttcctgctttcaggaaacaagctttatgtggcccttttctggtcccctggcttagactacagttctgtgtggatttgtctgattgcttcagacatgtaatgttgtttttcatccttggcagcttacatcagttgtttgtttgattagaaaaatgaagcagacacacacacacacacacacacacacacacacacacacacacacacaaacatataacctatgccaataaaaatgtctcagcaacagtggaattcaccttggtgtttctctctgtaatttgtgtggggtttacccctcacaggtttaagagaccaggtcttgtttctctctctgtgctaccaagaagatgtgaacctgaggatgcatcttgtttcataagaaggaaggcaggtgaatatgtggtttctaacgaggtcttgttgaaataacgggctgccctcagctcacagaaataccacagctcagccactgtgatgcagagccccaggggtctttgccagacaacttgtcctgactcaacagagacggcagcctgacctttgagctggcttgtccaggcattcaggttgcttgcgtagacttccagggaagcaagcctgtccttcctgacccggcggttaacctggtgcacttttgttcctttgttaactgttgtgttgtcactaaactgaaaggctggggcttgcccttagacgtcacattggctctgtccctgtggcgatggcagggcagggtggccaaacaggtcaggtgcttgttctgtcctcttgccttttacttaaattcctctgacttttaaaaatggtgacactcttatcgtaaagcttcttatttttctccactgcttggatatgaaactgtagagggagaggccctgttgcccagtgttctcctggtttagcagctgaggtgactgcagtctgatgtgatgtaactgtttccctttgattctccagtattcctgtttccatccagttccttactctcctctttcctcttccctcgcatgtctccctccagtcctctgtacctagaatagtctcactgtcccccgtttgcctccacgagcctgctgtttccaggaaattacataacgttcagttgggatggaaatcttccggaggacgaatagagtttaattactcattgcgtcggaaagccaagccatttctgtctccagagttgttctcttaaactgatatgagttct

SEQ ID NO: 372468 - DNA, 2377 bp, Homo sapiens
  misc_feature (3)..(3): n is a, c, g, or t
  misc_feature (5)..(5): n is a, c, g, or t
  misc_feature (8)..(10): n is a, c, g, or t
  misc_feature (12)..(14): n is a, c, g, or t
ggncncgnnncnnngcctgggcgcggggcgggaggcggtgaccagcagcaggaggagaaagaacatggcgggcgcatcagagctcgggaccggcccaggagcagcgggtggagatggagatgattcgctatacccgatcgcggttttaatcgacgagctccgcaatgaagacgtgcagctccgactcaacagtattaagaagttatcaacaattgccctagcacttggagtagaaaggacccgaagtgaattgttgccatttcttacagatacaatttatgatgaagatgaggtactattagctcttgctgagcagctgggaaatttcactggcctagtgggaggtcctgactttgcccactgtctgctgcctcctttggaaaatctggcaactgtggaagagactgttgttcgtgacaaggctgtggagtccctgagacagatctcccaggagcatactcctgttgctctggaagcttattttgtacctctggtgaaacgcttagcaagtggggattggttcacctctcgcacatctgcatgtggtttgttcagcgtttgctatcccagggcatcaaatgctgttaaagcagaaatcagacagcaattccgttccttgtgctcagatgacacaccaatggtacgacgtgctgctgcttccaaattgggtgaatttgcaaaagttttggaattagacagtgtgaaaagtgaaattgttccactgttcactagtctagcttcagatgaacaggattcagtgcgcctccttgctgtggaagcttgtgtcagtattgcccagttattgtctcaggatgaccttgagactttggtgatgcctacacttcgacaagcagcagaagataaatcttggcgcgttcgctatatggtggctgacagattttcagagctccagaaagccatgggtcctaaaatcaccctaaatgacctcatccccgcctttcagaacctacttaaagactgtgaagctgaagtccgggcagctgctgcccacaaagtaaaagaacttggtgagaacttgcccattgaagatagagagaccataattatgaatcaaattctgccttatataaaggaattagtatccgataccaatcaacatgtcaaatcggctctagcttctgtaattatgggattgtctactattttgggcaaagaaaataccattgaacatcttctacctcttttcttagctcagttaaaggatgagtgtcctgacgttcgtttgaatatcatctccaatttggattgtgtaaatgaagtgattggaatccgtcagctctctcagtctctccttcctgccatagtggagctggcagaagatgccaaatggagggtccgcctggccatcattgagtatatgccgctgctggcaggccagctgggtgtggaattctttgatgaaaagctgaattctttatgtatggcttggctcgtggaccatgtatacgccatccgagaagctgccaccaacaacctcatgaaactagttcagaagtttggtacagagtgggcccaaaatactattgttcccaaagtgttagtaatggcaaatgatcctaattacttgcatagaatgaccactttattctgcattaatgcactgtctgaggcctgtggtcaggaaataactactaagcaaatgctgcccatcgtattaaaaatggcaggagaccaagtagcaaatgttcgcttcaatgtggccaaatctctacaaaagattggaccaattctagataccaatgctttacagggagaagtgaagccagtactacagaagttaggtcaagatgaagacatggatgtcaaatactttgcacaggaagctataagtgttcttgcattggcataatgaggagcaggagggaaaaggcctttactagattcttgtcacaaatttctagtcaatgtgttcttaactgggtggagaaagaatggaaaaccttcaagatctcatccaagcaaatggcaacaacttagaagaaatcatttagtgacttaattctttctaaagatgaaatgggattgttttttactcgtcttccttgttaaatcattatttaagccgttcttattgaccaattcctgacacttgattgtctcctaatgctttatccatcaccacctgggctcctgcatcctcactgtggaatcaggcaccagccacataatgttccagacaaagcctggaagggtgtggacccagacgtggagtggagtgattctcttgacgtttacatatatctctgtgtctctccatcattccaaagctaaatgtacatgtttagaataacttattttataaactcttcgggagacatgttgagatttgaccgtaatgaaagccacattttcctga

SEQ ID NO: 372469 - DNA, 1502 bp, Homo sapiens
  misc_feature (3)..(3): n is a, c, g, or t
  misc_feature (5)..(5): n is a, c, g, or t
  misc_feature (8)..(10): n is a, c, g, or t
  misc_feature (12)..(14): n is a, c, g, or t
ggncncgnnncnnngcctgggcgcggggcgggaggcggtgaccagcagcaggaggagaaagaacatggcgggcgcatcagagctcgggaccggcccaggagcagcgggtggagatggagatgattcgctatacccgatcgcggttttaatcgacgagctccgcaatgaagacgtgcagctccgactcaacagtattaagaagttatcaacaattgccctagcacttggagtagaaaggacccgaagtgaattgttgccatttcttacagatacaatttatgatgaagatgaggtactattagctcttgctgagcagctgggaaatttcactggcctagtgggaggtcctgactttgcccactgtctgctgcctcctttggaaaatctggcaactgtggaagagactgttgttcgtgacaaggctgtggagtccctgagacagatctcccaggagcatactcctgttgctctggaagcttattttgtacctctggtgaaacgcttagcaagtggggattggttcacctctcgcacatctgcatgtggtttgttcagcgtttgctatcccagggcatcaaatgctgttaaagcagaaatcagacagcaattccgttccttgtgctcagatgacacaccaatggtacgacgtgctgctgcttccaaattgggtgaatttgcaaaagttttggaattagacagtgtgaaaagtgaaattgttccactgttcactagtctagcttcagatgaacaggattcagtgcgcctccttgctgtggaagcttgtgtcagtattgcccagttattgtctcaggatgaccttgagactttggtgatgcctacacttcgacaagcagcagaagataaatcttggcgcgttcgctatatggtggctgacagattttcagagctccagaaagccatgggtcctaaaatcaccctaaatgacctcatccccgcctttcagaacctacttaaagactgtgaagctgaagtccgggcagctgctgcccacaaagtaaaagaacttggtgagaacttgcccattgaagatagagagaccataattatgaatcaaattctgccttatataaaggaattagtatccgataccaatcaacatgtcaaatcggctctagcttctgtaattatgggattgtctactattttgggcaaagaaaataccattgaacatcttctacctcttttcttagctcagttaaaggatgagtgtcctgacgttcgtttgaatatcatctccaatttggattgtgtaaatgaagtgattggaatccgtcagctctctcagtctctccttcctgccatagtggagctggcagaagatgccaaatggagggtccgcctggccatcattgagtatatgccgctgctggcaggccagctgctgggaattgcagagctagtgcatttctcccaaagcacagactaataccccagatttaaaaaaagaacataaaaaataaagtaccacacatattgcactt

SEQ ID NO: 372470 - DNA, 1684 bp, Homo sapiens
  misc_feature (3)..(3): n is a, c, g, or t
  misc_feature (5)..(5): n is a, c, g, or t
  misc_feature (8)..(10): n is a, c, g, or t
  misc_feature (12)..(14): n is a, c, g, or t
ggncncgnnncnnngcctgggcgcggggcgggaggcggtgaccagcagcaggaggagaaagaacatggcgggcgcatcagagctcgggaccggcccaggagcagcgggtggagatggagatgattcgctatacccgatcgcggttttaatcgacgagctccgcaatgaagacgtgcagctccgactcaacagtattaagaagttatcaacaattgccctagcacttggagtagaaaggacccgaagtgaattgttgccatttcttacagatacaatttatgatgaagatgaggtactattagctcttgctgagcagctgggaaatttcactggcctagtgggaggtcctgactttgcccactgtctgctgcctcctttggaaaatctggcaactgtggaagagactgttgttcgtgacaaggctgtggagtccctgagacagatctcccaggagcatactcctgttgctctggaagcttattttgtacctctggtgaaacgcttagcaagtggggattggttcacctctcgcacatctgcatgtggtttgttcagcgtttgctatcccagggcatcaaatgctgttaaagcagaaatcagacagcaattccgttccttgtgctcagatgacacaccaatggtacgacgtgctgctgcttccaaattgggtgaatttgcaaaagttttggaattagacagtgtgaaaagtgaaattgttccactgttcactagtctagcttcagatgaacaggattcagtgcgcctccttgctgtggaagcttgtgtcagtattgcccagttattgtctcaggatgaccttgagactttggtgatgcctacacttcgacaagcagcagaagataaatcttggcgcgttcgctatatggtggctgacagattttcagagctccagaaagccatgggtcctaaaatcaccctaaatgacctcatccccgcctttcagaacctacttaaagactgtgaagctgaagtccgggcagctgctgcccacaaagtaaaaggttaaggagttcaatttatgttggaacatgtgtcattcattttggtgcatttttttgttagtcaattttgcatgttttttgttctagaatatgtttttaaaatacatagggatgtttttagtgtgtggaaatgttacattgtcacttaaagatagtctctttatatttaaaaccaagaaatcattttgtcttgtttttgtaaaaaaaaaaatgcctttcaggttggattggtgtgatatgcaatggcatagagagttcacgaaaaagtttatttagaacaagagctgttttccttatttgcttaaacatataatttaattgaaattattgataaacctggttaaatgtcctcatttggctctttgtaaatggccctgtgaaagcattctttttttctatttatcttttagaacttggtgagaacttgcccattgaagatagagagaccataattatgaatcaaattctgccttatataaaggtaaacctgactttattttgtttcactctcttttatatgaaggtaaaccttaatctcattatttttgtttgtttgtttaccttaaagctctttgagtttaaaggttgacagggaatgaatggggaagatgtgttaatgtgcaacattgttattcatcacttattagcccattgtaattgta

SEQ ID NO: 372471 - DNA, 329 bp, Homo sapiens
tggtgttaatttttttaaacacctgcaccaccccacagcagttccccatgggtctcagtaaatgtctgaattacagaaattttgttcctttaggattcagtgcgcctccttgctgtggaagcttgtgtcagtattgcccagttattgtctcaggatgaccttgagactttggtgatgcctacacttcgacaagcagcagaagataaatcttggcgcgttcgctatatggtggctgacagattttcagaggtaaagtgatcatttttaagtactaaggaaataaacctgaaaacacatagatttgctgttgtacccaaagtttctgaatt

SEQ ID NO: 372472 - DNA, 5373 bp, Homo sapiens
  misc_feature (3)..(3): n is a, c, g, or t
  misc_feature (5)..(5): n is a, c, g, or t
  misc_feature (8)..(10): n is a, c, g, or t
  misc_feature (12)..(14): n is a, c, g, or t
ggncncgnnncnnngcctgggcgcggggcgggaggcggtgaccagcagcaggaggagaaagaacatggcgggcgcatcagagctcgggaccggcccaggagcagcgggtggagatggagatgattcgctatacccgatcgcggttttaatcgacgagctccgcaatgaagacgtgcagctccgactcaacagtattaagaagttatcaacaattgccctagcacttggagtagaaaggacccgaagtgaattgttgccatttcttacagatacaatttatgatgaagatgaggtactattagctcttgctgagcagctgggaaatttcactggcctagtgggaggtcctgactttgcccactgtctgctgcctcctttggaaaatctggcaactgtggaagagactgttgttcgtgacaaggctgtggagtccctgagacagatctcccaggagcatactcctgttgctctggaagcttattttgtacctctggtgaaacgcttagcaagtggggattggttcacctctcgcacatctgcatgtggtttgttcagcgtttgctatcccagggcatcaaatgctgttaaagcagaaatcagacagcaattccgttccttgtgctcagatgacacaccaatggtacgacgtgctgctgcttccaaattgggtgaatttgcaaaagttttggaattagacagtgtgaaaagtgaaattgttccactgttcactagtctagcttcagatgaacaggattcagtgcgcctccttgctgtggaagcttgtgtcagtattgcccagttattgtctcaggatgaccttgagactttggtgatgcctacacttcgacaagcagcagaagataaatcttggcgcgttcgctatatggtggctgacagattttcagagctccagaaagccatgggtcctaaaatcaccctaaatgacctcatccccgcctttcagaacctacttaaagactgtgaagctgaagtccgggcagctgctgcccacaaagtaaaagaacttggtgagaacttgcccattgaagatagagagaccataattatgaatcaaattctgccttatataaaggaattagtatccgataccaatcaacatgtcaaatcggctctagcttctgtaattatgggattgtctactattttgggcaaagaaaataccattgaacatcttctacctcttttcttagctcagttaaaggatgagtgtcctgacgttcgtttgaatatcatctccaatttggattgtgtaaatgaagtgattggaatccgtcagctctctcagtctctccttcctgccatagtggagctggcagaagatgccaaatggagggtccgcctggccatcattgagtatatgccgctgctggcaggccagctggcactgtctgaggcctgtggtcaggaaataactactaagcaaatgctgcccatcgtattaaaaatggcaggagaccaagtagcaaatgttcgcttcaatgtggccaaatctctacaaaagattggaccaattctagataccaatgctttacagggagaagtgaagccagtactacagaagttaggtcaagatgaagacatggatgtcaaatactttgcacaggaagctataagtgttcttgcattggcataatgaggagcaggagggaaaaggcctttactagattcttgtcacaaatttctagtcaatgtgttcttaactgggtggagaaagaatggaaaaccttcaagatctcatccaagcaaatggcaacaacttagaagaaatcatttagtgacttaattctttctaaagatgaaatgggattgttttttactcgtcttccttgttaaatcattatttaagccgttcttattgaccaattcctgacacttgattgtctcctaatgctttatccatcaccacctgggctcctgcatcctcactgtggaatcaggcaccagccacataatgttccagacaaagcctggaagggtgtggacccagacgtggagtggagtgattctcttgacgtttacatatatctctgtgtctctccatcattccaaagctaaatgtacatgtttagaataacttattttataaactcttcgggagacatgttgagatttgaccgtaatgaaagccacattttcctgaattatgatggtctgcattagtctcatgtgaaaggggaatgtggaagctcagggttaatgtagtggttgttttggtttttatttgctcaattttgtctgtactcatgtcattcagaaacctgaagtgtggctgcatcttgctgctaatgtgtgatgttgacgcctaactgaatttgaacagctcaccactgtgcctacatttaaaaatacttctctctcttttctaaaaagctttaactgtagtgcctcctaataagcagtatgtttgtttcattgtgagattgcagttctgtatttcgaatgagtctaagaaccacagggataatactgtgcagatttcctgttctttacctggctctgcttccagcagtattgacacctagtccttgctgcattgtacagtagcttttcaaactgcagttttattgctaagtttttagtatgggtgatactggagtcttatcatttgaagtgtttgcttttctacttttacagtaaaacctcattaattctgaaatttaagataatgagttaagctgaagagtttactgaagcaaattaatagtgaggaagcctatttgaactacttaaacagtattaaagccctttttaaaaagcacctatttgggatcatttgaggtcaagaattcgagatcagcctgaccaacatggtgaaaccccatctctactaaaaatacaaaaaagttagctgggcgtggtggcacacacctgtagtcccagctactcaggaggctgaggcaggagaattgcttgaacctgggaggtagaggttgcactgagccgagatcgcgccactgcactctagcctgggccatagagcgagagtccatctcaaaaaaaaacaactatttttcacataatcaaactcaccttgtctcatgacttttggttaagggggttttcccatagtttatttttctctcagtgcatcttgctatgaggtttgcttgttacccttttggtttttgaattgttgattttgttcacaacctcttttaaatctaacaagtcctgttctgtttagtgaaggcccaaagactcctctaagactttgtatatttgttacataaaaccaagttttactaaatactttaaaatttgtcctacattcgaaaaatagaaattgtaaatcagaggttatctgtctgcattttaaactgccaaattaccttatagtaagtttctattttatgactttgggccaagaattaagtattttcctaagcacaaatctttttctatattctcattttaatatcttatgctattattctgtaaacattttaattttagtttcatgagtctttattttttgttacctgcaagttatgttcttcttcattgaatttcatatttgagagacatttgtcttcatgaagcagatttgcactggaaccattgctttactctggttggaaatgccattgttttggggacagacttttaaaatgcccttgtgtctcccagtgaggagccctaagcattgacttctctaccctaaaactgtttgagagagggagagtgggccctggctttctcaagcatgggtcgggggttcagcggggcctctgtcttttgtggtgacccctcaggggtttcattgtttccttctgacttaagcaatagagagagaatttgttttggtactcttcagaggaattgtgctttggctcataacttggccatgttctccatgaattagttctcctatttttttttttaactaccttaaacttaagggaaaagttctcctatcttgatttcactggaatataggctttaggagctctgtaaggctggtatttttgtctgttttatcttctactgtatcgccagtgcctggaacagtgtctggtgcacataataggtgctcaataaaaatgtgttcaatggatgaatttctaaaatatcctccaatgtgtgcatggaacaaataatcaaaagaaccagactgtgtcttattctcccactgacagaaagattttcctgctttcaggaaacaagctttatgtggcccttttctggtcccctggcttagactacagttctgtgtggatttgtctgattgcttcagacatgtaatgttgtttttcatccttggcagcttacatcagttgtttgtttgattagaaaaatgaagcagacacacacacacacacacacacacacacacacacacacacacacacaaacatataacctatgccaataaaaatgtctcagcaacagtggaattcaccttggtgtttctctctgtaatttgtgtggggtttacccctcacaggtttaagagaccaggtcttgtttctctctctgtgctaccaagaagatgtgaacctgaggatgcatcttgtttcataagaaggaaggcaggtgaatatgtggtttctaacgaggtcttgttgaaataacgggctgccctcagctcacagaaataccacagctcagccactgtgatgcagagccccaggggtctttgccagacaacttgtcctgactcaacagagacggcagcctgacctttgagctggcttgtccaggcattcaggttgcttgcgtagacttccagggaagcaagcctgtccttcctgacccggcggttaacctggtgcacttttgttcctttgttaactgttgtgttgtcactaaactgaaaggctggggcttgcccttagacgtcacattggctctgtccctgtggcgatggcagggcagggtggccaaacaggtcaggtgcttgttctgtcctcttgccttttacttaaattcctctgacttttaaaaatggtgacactcttatcgtaaagcttcttatttttctccactgcttggatatgaaactgtagagggagaggccctgttgcccagtgttctcctggtttagcagctgaggtgactgcagtctgatgtgatgtaactgtttccctttgattctccagtattcctgtttccatccagttccttactctcctctttcctcttccctcgcatgtctccctccagtcctctgtacctagaatagtctcactgtcccccgtttgcctccacgagcctgctgtttccaggaaattacataacgttcagttgggatggaaatcttccggaggacgaatagagtttaattactcattgcgtcggaaagccaagccatttctgtctccagagttgttctcttaaactgatatgagttct

SEQ ID NO: 372473 - DNA, 5232 bp, Homo sapiens
gtacccaaagtttctgaattaattcttttcaatgggaagtgctgtggcaaaaatatgtatttacagattgcacaattttgttttgttcttgttaattcttttgttagtatacattaaaacccgttcaaattcttttatagctccagaaagccatgggtcctaaaatcaccctaaatgacctcatccccgcctttcagaacctacttaaagactgtgaagctgaagtccgggcagctgctgcccacaaagtaaaaggttaaggagttcaatttatgttggaacatgtgtcattcattttggtgcatttttttgttagtcaattttgcatgttttttgttctagaatatgtttttaaaatacatagggatgtttttagtgtgtggaaatgttacattgtcacttaaagatagtctctttatatttaaaaccaagaaatcattttgtcttgtttttgtaaaaaaaaaaatgcctttcaggttggattggtgtgatatgcaatggcatagagagttcacgaaaaagtttatttagaacaagagctgttttccttatttgcttaaacatataatttaattgaaattattgataaacctggttaaatgtcctcatttggctctttgtaaatggccctgtgaaagcattctttttttctatttatcttttagaacttggtgagaacttgcccattgaagatagagagaccataattatgaatcaaattctgccttatataaaggaattagtatccgataccaatcaacatgtcaaatcggctctagcttctgtaattatgggattgtctactattttgggcaaagaaaataccattgaacatcttctacctcttttcttagctcagttaaaggatgagtgtcctgacgttcgtttgaatatcatctccaatttggattgtgtaaatgaagtgattggaatccgtcagctctctcagtctctccttcctgccatagtggagctggcagaagatgccaaatggagggtccgcctggccatcattgagtatatgccgctgctggcaggccagctgggtgtggaattctttgatgaaaagctgaattctttatgtatggcttggctcgtggaccatgtatacgccatccgagaagctgccaccaacaacctcatgaaactagttcagaagtttggtacagagtgggcccaaaatactattgttcccaaagtgttagtaatggcaaatgatcctaattacttgcatagaatgaccactttattctgcattaatgcactgtctgaggcctgtggtcaggaaataactactaagcaaatgctgcccatcgtattaaaaatggcaggagaccaagtagcaaatgttcgcttcaatgtggccaaatctctacaaaagattggaccaattctagataccaatgctttacagggagaagtgaagccagtactacagaagttaggtcaagatgaagacatggatgtcaaatactttgcacaggaagctataagtgttcttgcattggcataatgaggagcaggagggaaaaggcctttactagattcttgtcacaaatttctagtcaatgtgttcttaactgggtggagaaagaatggaaaaccttcaagatctcatccaagcaaatggcaacaacttagaagaaatcatttagtgacttaattctttctaaagatgaaatgggattgttttttactcgtcttccttgttaaatcattatttaagccgttcttattgaccaattcctgacacttgattgtctcctaatgctttatccatcaccacctgggctcctgcatcctcactgtggaatcaggcaccagccacataatgttccagacaaagcctggaagggtgtggacccagacgtggagtggagtgattctcttgacgtttacatatatctctgtgtctctccatcattccaaagctaaatgtacatgtttagaataacttattttataaactcttcgggagacatgttgagatttgaccgtaatgaaagccacattttcctgaattatgatggtctgcattagtctcatgtgaaaggggaatgtggaagctcagggttaatgtagtggttgttttggtttttatttgctcaattttgtctgtactcatgtcattcagaaacctgaagtgtggctgcatcttgctgctaatgtgtgatgttgacgcctaactgaatttgaacagctcaccactgtgcctacatttaaaaatacttctctctcttttctaaaaagctttaactgtagtgcctcctaataagcagtatgtttgtttcattgtgagattgcagttctgtatttcgaatgagtctaagaaccacagggataatactgtgcagatttcctgttctttacctggctctgcttccagcagtattgacacctagtccttgctgcattgtacagtagcttttcaaactgcagttttattgctaagtttttagtatgggtgatactggagtcttatcatttgaagtgtttgcttttctacttttacagtaaaacctcattaattctgaaatttaagataatgagttaagctgaagagtttactgaagcaaattaatagtgaggaagcctatttgaactacttaaacagtattaaagccctttttaaaaagcacctatttgggatcatttgaggtcaagaattcgagatcagcctgaccaacatggtgaaaccccatctctactaaaaatacaaaaaagttagctgggcgtggtggcacacacctgtagtcccagctactcaggaggctgaggcaggagaattgcttgaacctgggaggtagaggttgcactgagccgagatcgcgccactgcactctagcctgggccatagagcgagagtccatctcaaaaaaaaacaactatttttcacataatcaaactcaccttgtctcatgacttttggttaagggggttttcccatagtttatttttctctcagtgcatcttgctatgaggtttgcttgttacccttttggtttttgaattgttgattttgttcacaacctcttttaaatctaacaagtcctgttctgtttagtgaaggcccaaagactcctctaagactttgtatatttgttacataaaaccaagttttactaaatactttaaaatttgtcctacattcgaaaaatagaaattgtaaatcagaggttatctgtctgcattttaaactgccaaattaccttatagtaagtttctattttatgactttgggccaagaattaagtattttcctaagcacaaatctttttctatattctcattttaatatcttatgctattattctgtaaacattttaattttagtttcatgagtctttattttttgttacctgcaagttatgttcttcttcattgaatttcatatttgagagacatttgtcttcatgaagcagatttgcactggaaccattgctttactctggttggaaatgccattgttttggggacagacttttaaaatgcccttgtgtctcccagtgaggagccctaagcattgacttctctaccctaaaactgtttgagagagggagagtgggccctggctttctcaagcatgggtcgggggttcagcggggcctctgtcttttgtggtgacccctcaggggtttcattgtttccttctgacttaagcaatagagagagaatttgttttggtactcttcagaggaattgtgctttggctcataacttggccatgttctccatgaattagttctcctatttttttttttaactaccttaaacttaagggaaaagttctcctatcttgatttcactggaatataggctttaggagctctgtaaggctggtatttttgtctgttttatcttctactgtatcgccagtgcctggaacagtgtctggtgcacataataggtgctcaataaaaatgtgttcaatggatgaatttctaaaatatcctccaatgtgtgcatggaacaaataatcaaaagaaccagactgtgtcttattctcccactgacagaaagattttcctgctttcaggaaacaagctttatgtggcccttttctggtcccctggcttagactacagttctgtgtggatttgtctgattgcttcagacatgtaatgttgtttttcatccttggcagcttacatcagttgtttgtttgattagaaaaatgaagcagacacacacacacacacacacacacacacacacacacacacacacacaaacatataacctatgccaataaaaatgtctcagcaacagtggaattcaccttggtgtttctctctgtaatttgtgtggggtttacccctcacaggtttaagagaccaggtcttgtttctctctctgtgctaccaagaagatgtgaacctgaggatgcatcttgtttcataagaaggaaggcaggtgaatatgtggtttctaacgaggtcttgttgaaataacgggctgccctcagctcacagaaataccacagctcagccactgtgatgcagagccccaggggtctttgccagacaacttgtcctgactcaacagagacggcagcctgacctttgagctggcttgtccaggcattcaggttgcttgcgtagacttccagggaagcaagcctgtccttcctgacccggcggttaacctggtgcacttttgttcctttgttaactgttgtgttgtcactaaactgaaaggctggggcttgcccttagacgtcacattggctctgtccctgtggcgatggcagggcagggtggccaaacaggtcaggtgcttgttctgtcctcttgccttttacttaaattcctctgacttttaaaaatggtgacactcttatcgtaaagcttcttatttttctccactgcttggatatgaaactgtagagggagaggccctgttgcccagtgttctcctggtttagcagctgaggtgactgcagtctgatgtgatgtaactgtttccctttgattctccagtattcctgtttccatccagttccttactctcctctttcctcttccctcgcatgtctccctccagtcctctgtacctagaatagtctcactgtcccccgtttgcctccacgagcctgctgtttccaggaaattacataacgttcagttgggatggaaatcttccggaggacgaatagagtttaattactcattgcgtcggaaagccaagccatttctgtctccagagttgttctcttaaactgatatgagttct

SEQ ID NO: 372474 - DNA, 2123 bp, Homo sapiens
  misc_feature (3)..(3): n is a, c, g, or t
  misc_feature (5)..(5): n is a, c, g, or t
  misc_feature (8)..(10): n is a, c, g, or t
  misc_feature (12)..(14): n is a, c, g, or t
ggncncgnnncnnngcctgggcgcggggcgggaggcggtgaccagcagcaggaggagaaagaacatggcgggcgcatcagagctcgggaccggcccaggagcagcgggtggagatggagatgattcgctatacccgatcgcggttttaatcgacgagctccgcaatgaagacgtgcagctccgactcaacagtattaagaagttatcaacaattgccctagcacttggagtagaaaggacccgaagtgaattgttgccatttcttacagatacaatttatgatgaagatgaggtactattagctcttgctgagcagctgggaaatttcactggcctagtgggaggtcctgactttgcccactgtctgctgcctcctttggaaaatctggcaactgtggaagagactgttgttcgtgacaaggctgtggagtccctgagacagatctcccaggagcatactcctgttgctctggaagcttattttgtacctctggtgaaacgcttagcaagtggggattggttcacctctcgcacatctgcatgtggtttgttcagcgtttgctatcccagggcatcaaatgctgttaaagcagaaatcagacagcaattccgttccttgtgctcagatgacacaccaatggtacgacgtgctgctgcttccaaattgggtgaatttgcaaaagttttggaattagacagtgtgaaaagtgaaattgttccactgttcactagtctagcttcagatgaacaggattcagtgcgcctccttgctgtggaagcttgtgtcagtattgcccagttattgtctcaggatgaccttgagactttggtgatgcctacacttcgacaagcagcagaagataaatcttggcgcgttcgctatatggtggctgacagattttcagagctccagaaagccatgggtcctaaaatcaccctaaatgacctcatccccgcctttcagaacctacttaaagactgtgaagctgaagtccgggcagctgctgcccacaaagtaaaagaacttggtgagaacttgcccattgaagatagagagaccataattatgaatcaaattctgccttatataaaggaattagtatccgataccaatcaacatgtcaaatcggctctagcttctgtaattatgggattgtctactattttgggcaaagaaaataccattgaacatcttctacctcttttcttagctcagttaaaggatgagtgtcctgacgttcgtttgaatatcatctccaatttggattgtgtaaatgaagtgattggaatccgtcagctctctcagtctctccttcctgccatagtggagctggcagaagatgccaaatggagggtccgcctggccatcattgagtatatgccgctgctggcaggccagctgggtgtggaattctttgatgaaaagctgaattctttatgtatggcttggctcgtggaccatgtatacgccatccgagaagctgccaccaacaacctcatgaaactagttcagaagtttggtacagagtgggcccaaaatactattgttcccaaagtgttagtaatggcaaatgatcctaattacttgcatagaatgaccactttattctgcattaatgcactgtctgaggcctgtggtcaggaaataactactaagcaaatgctgcccatcgtattaaaaatggcaggagaccaagtagcaaatgttcgcttcaatgtggccaaatctctacaaaagattggaccaattctagataccaatgctttacagggagaagtgaagccagtactacagaagttaggtcaagatgaagacatggatgtcaaatactttgcacaggaagctataagtgtggtggcacaaaggctgaggaagctagaatttcctgtgaaggacagtggagaacccagtgtccctcgggctgacaagaaccacttcccaagacccacagtgcctggagaggacatggggaagggaccagtgtatcagttgcgtggagatactagagacacacttgcccagctgggaattgcagagctagtgcatttctcccaaagcacagactaataccccagatttaaaaaaagaacataaaaaataaagtaccacacatattgcactt

SEQ ID NO: 372475 - DNA, 435 bp, Homo sapiens
cacatagtaagcactttaaaaagttatctattactgttactattagagttcatcattaattatttaaccttttatttccttaacttcatctgagaaatgaaactctgacttaaattctctataagatcctttcttgtgctcaaattctttggtttcagttacatcgctccttgatgatttacatagtttcattcatgtctgcatgttcatgcatgtatgcattcatgtttctagaatgtaactggggcacttcttctgacaaagcatgcagtgtggcatccttttttggttttttgtgtttgaaaggcccatccaaattggagtggagtaggaaaaaagtgggagttctagaccaaaaatagccctgatctttggtctgtgacattttataggaatcccagtgatttttatgaaattcgaagtctgtaagactga

SEQ ID NO: 372476 - DNA, 1170 bp, Homo sapiens
gtgggaaccgtggagggcactttcccagtccccgaggcggatccggtgttgcatccttggagagagctgagagctggagtacagaacctgctaaggccatcaaacctattgatcggaagtcagtccatcagatttgctctgggccggtagtactgagtctaagcactgcggtgaagaagatggtagaaaacagtctggatgctggtgccactaatattgatctaaagcttaaggactatggaatggatctcattgaagtttcaggcaatggatgtggggtagaagaagaaaacttcgaaggcttaactctgaaacatcacacatctaagattcaagagtttgccgacctacctcaggttgaaacttttggctttcggggggaagctctgagctcactttgtgcactgagtgatgtcaccatttctacctgccacgtatcggcgaaggttgggactcgactggtgtttgatcacgatgggaaaatcatccagaaaaccccctacccccaccccagagggaccacagtcagcgtgaagcagttattttctacgctacctgtgcgccataaggaatttcaaaggaatattaagaagaaacgtgcctgcttccccttcgccttctgccgtgattgtcagttccttgagggctccccagccatgcttcctgtacagcctgcaaaactgactcctagaagtaccccaccccacccctgctccttggaggacaacgtgatcactgtattcagctctgtcaagaatggtccaggttcttctagatgatctgcacaaatggttcctctcctccttcctgatgtctgccattagcattggaataaagttcctgctgaaaatccacatctcccctgggtccggtgttctggaagtgagagagacaatgtcacacttcaaggaggcagctctctagacaggaaggttattcacgtcccatgtcaagtctagctagagttcagagcaattgagaagtgcaattttatctcctgcctttcattctataccctgcttctgaaccatcgtgttcaactgtgaaactcacactttggtgaccctgactccaaaacttaatacacccaaggtcagccccagtgatctgcttcatagcaaggactttgggtgggtcttcccagggagtagggcacccttcagagaattg

SEQ ID NO: 372477 - DNA, 690 bp, Homo sapiens
agacggggatttcgctatgttgcccaagctggtctggaactccggagctcaagcagtccgcccgccttggccccccaaagcgctggaattacaggcgtaatgcactgtgcctggccttttaaaaaaaaattgaggttattttggggacagtagagcatccagacatatcctaatttgcgtagctgctcagttttaaaaaatgcaatgcatttttacctgttagggtatgtgatttctggctggtaagctacaccgaatcttggctagcacagttgaattccatgtcagatttgtaaacgcaaatttgctctctgcatttaaatatattagatatatttaggtaactacatttaaatgtattgagacatttaaataaatttgccgtctgtatctaaatatctgaagtggaccaggtgcggtggctcacgcctgtgatcccatcgctttgggaggccaaggcaagtggatcatgaggtcaggagttcacgaccagcctggccaacatggtgaaatcccatttctactaaaaatgcaaaaattagctgggcgtggtggcgggcgcctgtggtcctagctacttgggaggctgaggcgggagaatcgctggaacccaggagacggaggttgcagtgagctgagattgcaccactgcagtctagcctgggtgacacagcaagactccatctcaaa

SEQ ID NO: 372478 - DNA, 734 bp, Homo sapiens
agggagagacctggtgggagatgattggctcatggcggctgacgtcccccttgctggtctcgtgatagtgagtgagcgctcatgggatctggttgtttagaagcatgcagcacctcctgcttcactctctctgtctctcctgctccaccatggccagaaacgtgcctgcttccccttcgccttctgccgtgattgtcagttccttgagggctccccagccatgcttcctgtacagcctgcaaaactgactcctagaagtaccccaccccacccctgctccttggaggacaacgtgatcactgtattcagctctgtcaagaatggtccaggttcttctagatgatctgcacaaatggttcctctcctccttcctgatgtctgccattagcattggaataaagttcctgctgaaaatccacatctcccctgggtccggtgttctggaagtgagagagacaatgtcacacttcaaggaggcagctctctagacaggaaggttattcacgtcccatgtcaagtctagctagagttcagagcaattgagaagtgcaattttatctcctgcctttcattctataccctgcttctgaaccatcgtgttcaactgtgaaactcacactttggtgaccctgactccaaaacttaatacacccaaggtcagccccagtgatctgcttcatagcaaggactttgggtgggtcttcccagggagtagggcacccttcagagaattg

SEQ ID NO: 372479 - DNA, 1248 bp, Homo sapiens
gtgggaaccgtggagggcactttcccagtccccgaggcggatccggtgttgcatccttggagagagctgagagctggaggtgagctgggctcgcggtcgcccctctcgcgcgccctctttgagaaccacggcttccaacctccctggaaatggggggaacatggccgaggcgcgtggcgaggtcacctcgtggaggccccggagcggcatcctcagcgccccagcgatccggtgcccattaggtgcgccttgaagcctagtacagaacctgctaaggccatcaaacctattgatcggaagtcagtccatcagatttgctctgggccggtagtactgagtctaagcactgcggtgaagaagatggtagaaaacagtctggatgctggtgccactaatattgatctaaagcttaaggactatggaatggatctcattgaagtttcaggcaatggatgtggggtagaagaagaaaacttcgaaggcttaatgatgtcaccatttctacctgccacgtatcggcgaaggttgggactcgactggtgtttgatcacgatgggaaaatcatccagaaaaccccctacccccaccccagagggaccacagtcagcgtgaagcagttattttctacgctacctgtgcgccataaggaatttcaaaggaatattaagaagaaacgtgcctgcttccccttcgccttctgccgtgattgtcagttccttgagggctccccagccatgcttcctgtacagcctgcaaaactgactcctagaagtaccccaccccacccctgctccttggaggacaacgtgatcactgtattcagctctgtcaagaatggtccaggttcttctagatgatctgcacaaatggttcctctcctccttcctgatgtctgccattagcattggaataaagttcctgctgaaaatccacatctcccctgggtccggtgttctggaagtgagagagacaatgtcacacttcaaggaggcagctctctagacaggaaggttattcacgtcccatgtcaagtctagctagagttcagagcaattgagaagtgcaattttatctcctgcctttcattctataccctgcttctgaaccatcgtgttcaactgtgaaactcacactttggtgaccctgactccaaaacttaatacacccaaggtcagccccagtgatctgcttcatagcaaggactttgggtgggtcttcccagggagtagggcacccttcagagaattg

SEQ ID NO: 372480 - DNA, 791 bp, Homo sapiens
gtgggaaccgtggagggcactttcccagtccccgaggcggatccggtgttgcatccttggagagagctgagagctggaggtgagctgggctcgcggtcgcccctctcgcgcgccctctttgagaaccacggcttccaacctccctggaaatggggggaacatggccgaggcgcgtggcgaggtcacctcgtggaggccccggagcggcatcctcagcgccccagcgatccggtgcccattaggtgcgccttgaagcctagtacagaacctgctaaggccatcaaacctattgatcggaagtcagtccatcagatttgctctgggccggtagtactgagtctaagcactgcggtgaagaagatggtagaaaacagtctggatgctggtgccactaatattgatctaaagcttaaggactatggaatggatctcattgaagtttcaggcaatggatgtggggtagaagaagaaaacttcgaaggcttaatgatgtcaccatttctacctgccacgtatcggcgaaggttgggactcgactggtgtttgatcacgatgggaaaatcatccagaaaaccccctacccccaccccagagggaccacagtcagcgtgaagcagttattttctacgctacctgtgcgccataaggaatttcaaaggaatattaagaagaaacgtgcctgcttccccttcgccttctgccgtgattgtcagttccttgagggctccccagccatgcttcctgtacagcctgcaaaactgtgagtcaattaaacttcttttcttcataaa

SEQ ID NO: 372481 - DNA, 1230 bp, Homo sapiens
gtgggaaccgtggagggcactttcccagtccccgaggcggatccggtgttgcatccttggagagagctgagagctggaggtgagctgggctcgcggtcgcccctctcgcgcgccctctttgagaaccacggcttccaacctccctggaaatggggggaacatggccgaggcgcgtggcgaggtcacctcgtggaggccccggagcggcatcctcagcgccccagcgatccggtgcccattagtacagaacctgctaaggccatcaaacctattgatcggaagtcagtccatcagatttgctctgggccggtagtactgagtctaagcactgcggtgaagaagatggtagaaaacagtctggatgctggtgccactaatattgatctaaagcttaaggactatggaatggatctcattgaagtttcaggcaatggatgtggggtagaagaagaaaacttcgaaggcttaatgatgtcaccatttctacctgccacgtatcggcgaaggttgggactcgactggtgtttgatcacgatgggaaaatcatccagaaaaccccctacccccaccccagagggaccacagtcagcgtgaagcagttattttctacgctacctgtgcgccataaggaatttcaaaggaatattaagaagaaacgtgcctgcttccccttcgccttctgccgtgattgtcagttccttgagggctccccagccatgcttcctgtacagcctgcaaaactgactcctagaagtaccccaccccacccctgctccttggaggacaacgtgatcactgtattcagctctgtcaagaatggtccaggttcttctagatgatctgcacaaatggttcctctcctccttcctgatgtctgccattagcattggaataaagttcctgctgaaaatccacatctcccctgggtccggtgttctggaagtgagagagacaatgtcacacttcaaggaggcagctctctagacaggaaggttattcacgtcccatgtcaagtctagctagagttcagagcaattgagaagtgcaattttatctcctgcctttcattctataccctgcttctgaaccatcgtgttcaactgtgaaactcacactttggtgaccctgactccaaaacttaatacacccaaggtcagccccagtgatctgcttcatagcaaggactttgggtgggtcttcccagggagtagggcacccttcagagaattg

SEQ ID NO: 372482 - DNA, 1067 bp, Homo sapiens
gtgggaaccgtggagggcactttcccagtccccgaggcggatccggtgttgcatccttggagagagctgagagctggagtacagaacctgctaaggccatcaaacctattgatcggaagtcagtccatcagatttgctctgggccggtagtactgagtctaagcactgcggtgaagaagatggtagaaaacagtctggatgctggtgccactaatattgatctaaagcttaaggactatggaatggatctcattgaagtttcaggcaatggatgtggggtagaagaagaaaacttcgaaggcttaatgatgtcaccatttctacctgccacgtatcggcgaaggttgggactcgactggtgtttgatcacgatgggaaaatcatccagaaaaccccctacccccaccccagagggaccacagtcagcgtgaagcagttattttctacgctacctgtgcgccataaggaatttcaaaggaatattaagaagaaacgtgcctgcttccccttcgccttctgccgtgattgtcagttccttgagggctccccagccatgcttcctgtacagcctgcaaaactgactcctagaagtaccccaccccacccctgctccttggaggacaacgtgatcactgtattcagctctgtcaagaatggtccaggttcttctagatgatctgcacaaatggttcctctcctccttcctgatgtctgccattagcattggaataaagttcctgctgaaaatccacatctcccctgggtccggtgttctggaagtgagagagacaatgtcacacttcaaggaggcagctctctagacaggaaggttattcacgtcccatgtcaagtctagctagagttcagagcaattgagaagtgcaattttatctcctgcctttcattctataccctgcttctgaaccatcgtgttcaactgtgaaactcacactttggtgaccctgactccaaaacttaatacacccaaggtcagccccagtgatctgcttcatagcaaggactttgggtgggtcttcccagggagtagggcacccttcagagaattg

SEQ ID NO: 372483 - DNA, 1212 bp, Homo sapiens
agacggggatttcgctatgttgcccaagctggtctggaactccggagctcaagcagtccgcccgccttggccccccaaagcgctggaattacaggcgtaatgcactgtgcctggccttttaaaaaaaaattgaggttattttggggacagtagagcatccagacatatcctaatttgcgtagctgctcagttttaaaaaatgcaatgcatttttacctgttaggtacagaacctgctaaggccatcaaacctattgatcggaagtcagtccatcagatttgctctgggccggtagtactgagtctaagcactgcggtgaagaagatggtagaaaacagtctggatgctggtgccactaatattgatctaaagcttaaggactatggaatggatctcattgaagtttcaggcaatggatgtggggtagaagaagaaaacttcgaaggcttaatgatgtcaccatttctacctgccacgtatcggcgaaggttgggactcgactggtgtttgatcacgatgggaaaatcatccagaaaaccccctacccccaccccagagggaccacagtcagcgtgaagcagttattttctacgctacctgtgcgccataaggaatttcaaaggaatattaagaagaaacgtgcctgcttccccttcgccttctgccgtgattgtcagttccttgagggctccccagccatgcttcctgtacagcctgcaaaactgactcctagaagtaccccaccccacccctgctccttggaggacaacgtgatcactgtattcagctctgtcaagaatggtccaggttcttctagatgatctgcacaaatggttcctctcctccttcctgatgtctgccattagcattggaataaagttcctgctgaaaatccacatctcccctgggtccggtgttctggaagtgagagagacaatgtcacacttcaaggaggcagctctctagacaggaaggttattcacgtcccatgtcaagtctagctagagttcagagcaattgagaagtgcaattttatctcctgcctttcattctataccctgcttctgaaccatcgtgttcaactgtgaaactcacactttggtgaccctgactccaaaacttaatacacccaaggtcagccccagtgatctgcttcatagcaaggactttgggtgggtcttcccagggagtagggcacccttcagagaattg

SEQ ID NO: 372484 - DNA, 1141 bp, Homo sapiens
gtgggaaccgtggagggcactttcccagtccccgaggcggatccggtgttgcatccttggagagagctgagagctggaggtgagctgggctcgcggtcgcccctctcgcgcgccctctttgagaaccacggcttccaacctccctggaaatggggggaacatggccgaggcgcgtggcgaggtcacctcgtggaggccccggagcggcatcctcagcgccccagcgatccggtgcccattagtacagaacctgctaaggccatcaaacctattgatcggaagtcagtccatcagatttgctctgggccggtagtactgagtctaagcactgcggtgaagaagatggtagaaaacagtctggatgctggtgccactaatattgatctaaagcttaaggactatggaatggatctcattgaagtttcaggcaatggatgtggggtagaagaagaaaacttcgaaggcttaatgatgtcaccatttctacctgccacgtatcggcgaaggttgggactcgactggtgtttgatcacgatgggaaaatcatccagaaaaccccctacccccaccccagagggaccacagtcagcgtgaagcagttattttctacgctacctgtgcgccataaggaatttcaaaggaatattaagaaggactcctagaagtaccccaccccacccctgctccttggaggacaacgtgatcactgtattcagctctgtcaagaatggtccaggttcttctagatgatctgcacaaatggttcctctcctccttcctgatgtctgccattagcattggaataaagttcctgctgaaaatccacatctcccctgggtccggtgttctggaagtgagagagacaatgtcacacttcaaggaggcagctctctagacaggaaggttattcacgtcccatgtcaagtctagctagagttcagagcaattgagaagtgcaattttatctcctgcctttcattctataccctgcttctgaaccatcgtgttcaactgtgaaactcacactttggtgaccctgactccaaaacttaatacacccaaggtcagccccagtgatctgcttcatagcaaggactttgggtgggtcttcccagggagtagggcacccttcagagaattg

SEQ ID NO: 372485 - DNA, 302 bp, Homo sapiens
aatgttaaaaagaatctataatttaagactccacattttctcttaatgctatacaacctaattgaaattaacaatacattgaaattgttgactgacttgcttttcaaaagaataacatttggttggcaggccaaggcgggaggatcacaaggtcaggaaatcgagaacaccctggctaacatggtgaaaccccgtctctaataaaaatacaaaaaattagccgggcgtggtggtaggtgcctgtagtcccagctactcgggaggctgagacaggagaatggcgtgaacctgggaagcggagc

SEQ ID NO: 372486 - DNA, 1877 bp, Homo sapiens
cgcagggggcgggcccgcggcgcggcgccggaggaggaagtggtgaggttgttgctccttcagcgcctatcgctggctcttggggcgcagagaggggccgcagtctccgcggctgcgtcgagctcccttgcagtcccctccatgttccccggcgccactactccccttcctaaggccgccgcttaccccggggtctatggaagtaatggaaggacccctcaacctggctcatcaacagagcagacgagcagaccgtttattagctgcaggcaaatacgaagaggctatttcttgtcacaaaaaggctgcagcatatctttctgaagccatgaagctgacacagtcagagcaggctcatctttcactggaattgcaaagggatagccatatgaaacagctcctcctcatccaagagagatggaaaagggcccagcgtgaagaaagattgaaagcccagcagaacacagacaaggatgcagctgcccatcttcagacatctcacaaaccctctgcagaggatgcagagggccagagtcccctttctcagaagtacagcccttccacagagaaatgcctgcctgagattcaggggatctttgacagggatccagacacactactttatttacttcagcaaaagagtgagccagcagagccatgtattggaagcaaagccccaaaagatgataaaacaattatagaggagcaggcaaccaaaattgcagatttgaagaggcatgtggaattccttgtggctgagaatgaaagattaaggaaagaaaataaacaactaaaggctgaaaaggccagacttctaaaaggtccaatagaaaaggagctggatgtagatgctgattttgtagaaacgtcagagttatggagcttgccaccacatgcagaaactgctacagcctcctcaacctggcagaagttcgcagcaaatactgggaaagccaaggacattccaatccccaatcttcctcccttggattttccatctccagaacttcctcttatggagctctctgaggatattctgaaaggatttatgaataattaaaatggaaggccacagaaaaggggaaaagaggaaataatacagtaatcgttaatccagcaaaaagaaatgaaaagggaaaaccacatagaagggtaatcccggaaatgcttcatctggtggactgtgggagcagaggcattgccaggacttgggaaacagtcactgtgaaatgcgctgcgtatctcattcactcacttcagctaatgattccgacttggcagacgctaaactcatggaggttcggtttctcctgatacaaaccaaatggctacctggaagaatttctttcaagcaacagttatttttcttatcttcagggttaaaatgtataaaagttatgtgtaattaatctataatgccataaatgataatgcaaaacctaaataatatggtggccggaggggctgccttatatttgaaacatgctttctatcatgcattgactgtatgcattttgttaatgcacattctgtttgtttaaggtgtgtaagatacacacccttctagatgaaactatatgtgccacactttgcactactcataatgataacctcaagactatcagaagaaatatttaaatttccattttatgaagaaaggaaccaaattattatgctttttaaaacaaattaccagtttacataattaatcagggtgcattttaagttctaacttcgtttattgtataatgcatcatttgaaaataccaaggaggaaataccctttgtttttaatgatgcaagagtggacgtaatgctagttggcagtattttattgtaagaaatcaataaagtaattgtgttttataaaaaaaaaa

SEQ ID NO: 372487 - DNA, 1283 bp, Homo sapiens
cgcagggggcgggcccgcggcgcggcgccggaggaggaagtggtgaggttgttgctccttcagcgcctatcgctggctcttggggcgcagagaggggccgcagtctccgcggctgcgtcgagctcccttgcagtcccctccatgttccccggcgccactactccccttcctaaggccgccgcttaccccggggtctatggaagtaatggaaggacccctcaacctggctcatcaacagagcagacgagcagaccgtttattagctgcaggcaaatacgaagaggctatttcttgtcacaaaaaggctgcagcatatctttctgaagccatgaagctgacacagtcagagcaggctcatctttcactggaattgcaaagggatagccatatgaaacagctcctcctcatccaagagagatggaaaagggcccagcgtgaagaaagattgaaagcccagcagaacacagacaaggatgcagctgcccatcttcagacatctcacaaaccctctgcagaggatgcagagggccagagtcccctttctcagaagtacagcccttccacagagaaatgcctgcctgagattcaggggatctttgacagggatccagacacactactttatttacttcagcaaaagagtgagccagcagagccatgtattggaagcaaagccccaaaagatgataaaacaattatagaggagcaggcaaccaaaattgcagatttgaagaggcatgtggaattccttgtggctgagaatgaaagattaaggaaagaaaataaacaactaaaggctgaaaaggccagacttctaaaaggtccaatagaaaaggagctggatgtagatgctgattttgtagaaacgtcagagttatggagcttgccaccacatgcagaaactgctacagcctcctcaacctggcatgggcctgtagtcccagctacttaggaggctgagcaggagaatcacttgaacccaggaggcagaggttgcagtgagctgagattgtgccactgcactccagcctgggcaacagagctggactctgtctaaaaaaaaaatatatatatattaatttgtttatctcagtgttgttgttttttttattattttttctgtttggttgactagaatttctgttctgctaaatatctcagtgttttaatatcctagactcgacattttacttgcctaaccttgctcataaaacttgacatttaaaagcttgtgccaaaaatagtcatgtgttgcttaacaaggatgtgttctgaggaatgtg

SEQ ID NO: 372488 - DNA, 1827 bp, Homo sapiens
cgcagggggcgggcccgcggcgcggcgccggaggaggaagtggtgaggttgttgctccttcagcgcctatcgctggctcttggggcgcagagaggggccgcagtctccgcggctgcgtcgagctcccttgcagtcccctccatgttccccggcgccactactccccttcctaaggccgccgcttaccccggggtctatggaagtaatggaaggacccctcaacctggctcatcaacagagcagacgagcagaccgtttattagctgcaggcaaatacgaagaggctatttcttgtcacaaaaaggctgcagcatatctttctgaagccatgaagctgacacagtcagagcaggctcatctttcactggaattgcaaagggatagccatatgaaacagctcctcctcatccaagagagatggaaaagggcccagcgtgaagaaagattgaaagcccagcagaacacagacaaggatgcagctgcccatcttcagacatctcacaaaccctctgcagaggatgcagagggccagagtcccctttctcagaagtacagcccttccacagagaaatgcctgcctgagattcaggggatctttgacagggatccagacacactactttatttacttcagcaaaagagtgagccagcagagccatgtattggaagcaaagccccaaaagatgataaaacaattatagaggagcaggcaaccaaaattgcagatttgaagaggcatgtggaattccttgtggctgagaatgaaagattaaggaaagaaaataaacaactaaaggctgaaaaggccagacttctaaaaggtccaatagagcttgccaccacatgcagaaactgctacagcctcctcaacctggcagaagttcgcagcaaatactgggaaagccaaggacattccaatccccaatcttcctcccttggattttccatctccagaacttcctcttatggagctctctgaggatattctgaaaggatttatgaataattaaaatggaaggccacagaaaaggggaaaagaggaaataatacagtaatcgttaatccagcaaaaagaaatgaaaagggaaaaccacatagaagggtaatcccggaaatgcttcatctggtggactgtgggagcagaggcattgccaggacttgggaaacagtcactgtgaaatgcgctgcgtatctcattcactcacttcagctaatgattccgacttggcagacgctaaactcatggaggttcggtttctcctgatacaaaccaaatggctacctggaagaatttctttcaagcaacagttatttttcttatcttcagggttaaaatgtataaaagttatgtgtaattaatctataatgccataaatgataatgcaaaacctaaataatatggtggccggaggggctgccttatatttgaaacatgctttctatcatgcattgactgtatgcattttgttaatgcacattctgtttgtttaaggtgtgtaagatacacacccttctagatgaaactatatgtgccacactttgcactactcataatgataacctcaagactatcagaagaaatatttaaatttccattttatgaagaaaggaaccaaattattatgctttttaaaacaaattaccagtttacataattaatcagggtgcattttaagttctaacttcgtttattgtataatgcatcatttgaaaataccaaggaggaaataccctttgtttttaatgatgcaagagtggacgtaatgctagttggcagtattttattgtaagaaatcaataaagtaattgtgttttataaaaaaaaaa

SEQ ID NO: 372489 - DNA, 1287 bp, Homo sapiens
cgcagggggcgggcccgcggcgcggcgccggaggaggaagtggtgaggttgttgctccttcagcgcctatcgctggctcttggggcgcagagaggggccgcagtctccgcggctgcgtcgagctcccttgcagtcccctccatgttccccggcgccactactccccttcctaaggccgccgcttaccccggggtctatggaagtaatggaaggacccctcaacctggctcatcaacagagcagacgagcagaccgtttattagctgcaggcaaatacgaagaggctatttcttgtcacaaaaaggctgcagcatatctttctgaagccatgaagctgacacagtcagagcaggctcatctttcactggaattgcaaagggatagccatatgaaacagctcctccccatctccagaacttcctcttatggagctctctgaggatattctgaaaggatttatgaataattaaaatggaaggccacagaaaaggggaaaagaggaaataatacagtaatcgttaatccagcaaaaagaaatgaaaagggaaaaccacatagaagggtaatcccggaaatgcttcatctggtggactgtgggagcagaggcattgccaggacttgggaaacagtcactgtgaaatgcgctgcgtatctcattcactcacttcagctaatgattccgacttggcagacgctaaactcatggaggttcggtttctcctgatacaaaccaaatggctacctggaagaatttctttcaagcaacagttatttttcttatcttcagggttaaaatgtataaaagttatgtgtaattaatctataatgccataaatgataatgcaaaacctaaataatatggtggccggaggggctgccttatatttgaaacatgctttctatcatgcattgactgtatgcattttgttaatgcacattctgtttgtttaaggtgtgtaagatacacacccttctagatgaaactatatgtgccacactttgcactactcataatgataacctcaagactatcagaagaaatatttaaatttccattttatgaagaaaggaaccaaattattatgctttttaaaacaaattaccagtttacataattaatcagggtgcattttaagttctaacttcgtttattgtataatgcatcatttgaaaataccaaggaggaaataccctttgtttttaatgatgcaagagtggacgtaatgctagttggcagtattttattgtaagaaatcaataaagtaattgtgttttataaaaaaaaaa

SEQ ID NO: 372490 - DNA, 497 bp, Homo sapiens
cgcagggggcgggcccgcggcgcggcgccggaggaggaagtggtgaggttgttgctccttcagcgcctatcgctggctcttggggcgcagagaggggccgcagtctccgcggctgcgtcgagctcccttgcagtcccctccatgttccccggcgccactactccccttcctaaggccgccgcttaccccggggtctatggaagtaatggaaggacccctcaacctggctcatcaacagagcagacgagcagaccgtttattagctgcaggcaaatacgaagaggctatttcttgtcacaaaaaggctgcagtagagacggggtttcaccatgctggccaggctggtctcgaactcccgacctcaggcgatccaccagcctcagcctcccaaagtgctaggattacaggtgtgagccaccacacccggccgtcttcacagatttaaacatgaacaaaaggaaaagaaatagtatgcagctgtacagacatactacagg

SEQ ID NO: 372491 - DNA, 605 bp, Homo sapiens
gaccacaactcccagggtgctccgcgtcctcgccgctgtcgccgccgcggagacaaagatggctgcgagagtcggcgccttcctcaagaatgcctgggacaaggagccagtgctggtcgtgtccttcgtcgtcgggggcctcgctgtaattctgcccccattgagcccctacttcaagtactccgtcatgatcaacaaggccacgccctacaactacccagtgcccgtccgtgatgatgggaacatgcccgacgtgcccagccacccccaggaccctcagggccccagcctggagtggctgaagaaactgtgagcacctccactgacagaggcggcccctcccacggctcccaataaaaatgtgaaaaccaaaaaaaaaaaaaaacaaaaaaaaaaaaactgggggggggcgcacttgggcccccgcgaagaaagcttctgtaagaacccattcgcgatggggcacggcggcgggccccccatagaggtctacgggagaccgggggcccatagagcgagtggttcaccaaaggagaaaactcgggggtccacgcacatgacggccggggaactccaccaccaaaataagaaaaaagcgcccgggt

SEQ ID NO: 372492 - DNA, 330 bp, Homo sapiens
cagcggaacaagcaaacattcatatcccctgcctccagagttccttaaggttcaattgatggaatgcctcctctgcaccagcacctgggcagagacggagtttcaccgtgttagccaggatggtcccgatctcctgacctcgtgatccgcctgcctcggcctcccaaagtgctgggattacaggcatgatgagccactgcgcccggcctatttcaacttaagtgaaaatctcacctgtggccagcggctaccgtgctggacagcacagtgctcatctgaggaggcaggacgcagcctctccgcctctttgcttattctgctgactgaccg

SEQ ID NO: 372493 - DNA, 800 bp, Homo sapiens
aattcgcggccgcgtcgacgagaagacgacagaagggggccgctgtcgccgccgcggagacaaagatggctgcgagagtcggcgccttcctcaagaatgcctgggacaaggagccagtgctggtcgtgtccttcgtcgtcgggggcctcgctgtaattctgcccccattgagcccctacttcaagtactccgtcatgatcaacaaggccacgccctacaactacccagtgcccgtccgtgatgatgggaacatgcccgacgtgcccagccacccccaggaccctcagggccccagcctggagtggctgaagaaactgtgagcacctccactgacagaggcggcccctcccacggctcccaataaaaatgtgaaaaccaacgaacgtgagcatgtgtgtgatcagaggtgggaacaagtagacggtggccggggtgagtgtggggtcagtttattgggcatgcgtcagtcagaggctgggctggccagggtcgggtagggcagcagtttgtctggaccccgagaaacccaactggaatccagggcctcatctgcttcaaagccaaagtcttcctcaaccttaatctgcaggagataaggaacaaggtgttaacaggcctgggaatctagaaaatcccatcagcttcaccatttttgttttcattttgttttgctttttaaagagacagggtctcactctgttgcccaggctggagtgcagtggtgccatcatagttcactgcagcctctgcctcccaggctcaagtgatcctcccacctcagcttcccaagtagctgggac

SEQ ID NO: 372494 - DNA, 396 bp, Homo sapiens
  misc_feature (25)..(25): n is a, c, g, or t
  misc_feature (29)..(29): n is a, c, g, or t
actactactactaaattcgcggccngtcngagccgccgcggagacaaagatggctgcgagagtcggcgccttcctcaagaatgcctgggacaaggagccagtgctggtcgtgtccttcgtcgtcgggggcctcgctgtaattctgcccccattgagcccctacttcaagtactccgtcatgatcaacaaggccacgccctacaactacccagtgcccgtccgtgatgatgggaacatgcccgacgtgcccagccacccccaggaccctcagggccccagcctggagtggctgaagaaactgtgagcacctccactgacagaggcggcccctcccacggctcccaataaaaatgtgaaaaccaaaaaaaagcggccgctcgttgtcgcgcggccgcg

SEQ ID NO: 372495 - DNA, 802 bp, Homo sapiens
aattcgcggccgcgtcgacgagaagacgacagaagggggccgctgtcgccgccgcggagacaaagatggctgcgagagtcggcgccttcctcaagaatgcctgggacaaggagccagtgctggtcgtgtccttcgtcgtcgggggcctcgctgtaattctgcccccattgagcccctacttcaagtactccgtcatgatcaacaaggccacgccctacaactacccagtgcccgtccgtgatgatgggaacatgcccgacgtgcccagccacccccaggaccctcagggccccagcctggagtggctgaagaaactgtgagcacctccactgacagaggcggcccctcccacggctcccaataaaaatgtgaaaaccaacggctggggaaaagggccacaggatagagctcagctcccactccactcaacgccaaagctgtcctggagccagacggtcctgagctctggcactggaggcctgggagccatgcccttgaccagccttgagacctcgagcaagacaaggcaaccattctgaggctgagtttcctgctctgcaaacgacatgacaccctcggctggatgttgcagcggtgacactgaagtagtgacaccagacgatttctgtacttaatgtgatgtcagcacttagtaaacattcatatcccctgcctccagagttccttaaggttcaattgatggaatgcctcctctgcaccagcacctgggcaggtttgttgttgttgttttgcgacggaatctcacttccagcctggacaacaagagtgaaactccatctca
